United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 37

SEQ ID NO: 1545042 - DNA, 23 bp, Homo sapiens
gagaggcagcaaggtggccacag

SEQ ID NO: 1545043 - DNA, 11 bp, Homo sapiens
gagaggcaggc

SEQ ID NO: 1545044 - DNA, 15 bp, Homo sapiens
gagaggcatggctgg

SEQ ID NO: 1545045 - DNA, 18 bp, Homo sapiens
gagaggccaaaggctggt

SEQ ID NO: 1545046 - DNA, 18 bp, Homo sapiens
gagaggccttttggaatg

SEQ ID NO: 1545047 - DNA, 20 bp, Homo sapiens
gagaggcgttagtgggcagg

SEQ ID NO: 1545048 - DNA, 22 bp, Homo sapiens
gagaggcgttagtgggcaggtg

SEQ ID NO: 1545049 - DNA, 15 bp, Homo sapiens
gagaggctgcctcag

SEQ ID NO: 1545050 - DNA, 15 bp, Homo sapiens
gagagggaagctggc

SEQ ID NO: 1545051 - DNA, 16 bp, Homo sapiens
gagagggaagctggct

SEQ ID NO: 1545052 - DNA, 14 bp, Homo sapiens
gagagggaatgtga

SEQ ID NO: 1545053 - DNA, 15 bp, Homo sapiens
gagagggaatgtgaa

SEQ ID NO: 1545054 - DNA, 18 bp, Homo sapiens
gagagggacaggcactcc

SEQ ID NO: 1545055 - DNA, 10 bp, Homo sapiens
gagagggaga

SEQ ID NO: 1545056 - DNA, 18 bp, Homo sapiens
gagagggcagtgtttcct

SEQ ID NO: 1545057 - DNA, 14 bp, Homo sapiens
gagagggcccagct

SEQ ID NO: 1545058 - DNA, 19 bp, Homo sapiens
gagagggcccagctgtagc

SEQ ID NO: 1545059 - DNA, 21 bp, Homo sapiens
gagagggcccagctgtagcca

SEQ ID NO: 1545060 - DNA, 20 bp, Homo sapiens
gagagggctcgaggggtggg

SEQ ID NO: 1545061 - DNA, 21 bp, Homo sapiens
gagagggctcgaggggtgggc

SEQ ID NO: 1545062 - DNA, 21 bp, Homo sapiens
gagagggctgttggacagctg

SEQ ID NO: 1545063 - DNA, 16 bp, Homo sapiens
gagaggggaagggcca

SEQ ID NO: 1545064 - DNA, 14 bp, Homo sapiens
gagaggggagagag

SEQ ID NO: 1545065 - DNA, 16 bp, Homo sapiens
gagaggtggagaactg

SEQ ID NO: 1545066 - DNA, 22 bp, Homo sapiens
gagaggtgggccagtctgtgga

SEQ ID NO: 1545067 - DNA, 23 bp, Homo sapiens
gagaggtgggccagtctgtggat

SEQ ID NO: 1545068 - DNA, 22 bp, Homo sapiens
gagagtatttttatacaaacct

SEQ ID NO: 1545069 - DNA, 15 bp, Homo sapiens
gagagtcccagagca

SEQ ID NO: 1545070 - DNA, 15 bp, Homo sapiens
gagagtgagtgcctt

SEQ ID NO: 1545071 - DNA, 24 bp, Homo sapiens
gagagtggcaggtgggctgcctgc

SEQ ID NO: 1545072 - DNA, 13 bp, Homo sapiens
gagagtggctcct

SEQ ID NO: 1545073 - DNA, 21 bp, Homo sapiens
gagagtggctcctcccggtgc

SEQ ID NO: 1545074 - DNA, 16 bp, Homo sapiens
gagagttaaaagcagc

SEQ ID NO: 1545075 - DNA, 14 bp, Homo sapiens
gagagttagcatgt

SEQ ID NO: 1545076 - DNA, 18 bp, Homo sapiens
gagagttggctcaggcag

SEQ ID NO: 1545077 - DNA, 14 bp, Homo sapiens
gagagtttcctgaa

SEQ ID NO: 1545078 - DNA, 19 bp, Homo sapiens
gagataaaccaataaatcc

SEQ ID NO: 1545079 - DNA, 20 bp, Homo sapiens
gagataaacgaccaaactca

SEQ ID NO: 1545080 - DNA, 22 bp, Homo sapiens
gagataatatgagatttctact

SEQ ID NO: 1545081 - DNA, 23 bp, Homo sapiens
gagataccacaaaccctgctgaa

SEQ ID NO: 1545082 - DNA, 18 bp, Homo sapiens
gagatacttatgcaagat

SEQ ID NO: 1545083 - DNA, 22 bp, Homo sapiens
gagatagacgggttgaaagaca

SEQ ID NO: 1545084 - DNA, 15 bp, Homo sapiens
gagatatgtgtgtgt

SEQ ID NO: 1545085 - DNA, 14 bp, Homo sapiens
gagatattataagg

SEQ ID NO: 1545086 - DNA, 14 bp, Homo sapiens
gagatattcttatt

SEQ ID NO: 1545087 - DNA, 19 bp, Homo sapiens
gagatattcttatttcact

SEQ ID NO: 1545088 - DNA, 15 bp, Homo sapiens
gagatcagcattcaa

SEQ ID NO: 1545089 - DNA, 21 bp, Homo sapiens
gagatccaaaagaagccccca

SEQ ID NO: 1545090 - DNA, 22 bp, Homo sapiens
gagatccagtgcagttgtgatt

SEQ ID NO: 1545091 - DNA, 11 bp, Homo sapiens
gagatccccag

SEQ ID NO: 1545092 - DNA, 16 bp, Homo sapiens
gaggctttgggtggct

SEQ ID NO: 1545093 - DNA, 14 bp, Homo sapiens
gaggcttttcactg

SEQ ID NO: 1545094 - DNA, 16 bp, Homo sapiens
gaggcttttcccacca

SEQ ID NO: 1545095 - DNA, 21 bp, Homo sapiens
gagggaaatctgtaaagccag

SEQ ID NO: 1545096 - DNA, 18 bp, Homo sapiens
gagggaacagacaggaga

SEQ ID NO: 1545097 - DNA, 19 bp, Homo sapiens
gagggaagaccagaattcc

SEQ ID NO: 1545098 - DNA, 19 bp, Homo sapiens
gagggaagggtttctctat

SEQ ID NO: 1545099 - DNA, 14 bp, Homo sapiens
gagggacagagccc

SEQ ID NO: 1545100 - DNA, 14 bp, Homo sapiens
gagggacaggctga

SEQ ID NO: 1545101 - DNA, 17 bp, Homo sapiens
gagggacaggctgaaga

SEQ ID NO: 1545102 - DNA, 18 bp, Homo sapiens
gagggacaggctgaagag

SEQ ID NO: 1545103 - DNA, 14 bp, Homo sapiens
gagggaccttggag

SEQ ID NO: 1545104 - DNA, 19 bp, Homo sapiens
gagggaccttggagagctc

SEQ ID NO: 1545105 - DNA, 22 bp, Homo sapiens
gagggacgtcagacttggctca

SEQ ID NO: 1545106 - DNA, 13 bp, Homo sapiens
gagggagaaggga

SEQ ID NO: 1545107 - DNA, 22 bp, Homo sapiens
gagggagaatcctcccttccca

SEQ ID NO: 1545108 - DNA, 15 bp, Homo sapiens
gagggagagagagag

SEQ ID NO: 1545109 - DNA, 21 bp, Homo sapiens
gagggagatctttcccaggcc

SEQ ID NO: 1545110 - DNA, 12 bp, Homo sapiens
gagggagctgct

SEQ ID NO: 1545111 - DNA, 15 bp, Homo sapiens
gagggagcttagcca

SEQ ID NO: 1545112 - DNA, 14 bp, Homo sapiens
gagggaggccaggc

SEQ ID NO: 1545113 - DNA, 12 bp, Homo sapiens
gagggaggcccc

SEQ ID NO: 1545114 - DNA, 16 bp, Homo sapiens
gagggagttagggaga

SEQ ID NO: 1545115 - DNA, 22 bp, Homo sapiens
gagggagttagggagagagaag

SEQ ID NO: 1545116 - DNA, 22 bp, Homo sapiens
gagggagtttaatacaggaaat

SEQ ID NO: 1545117 - DNA, 15 bp, Homo sapiens
gagggatcacagggc

SEQ ID NO: 1545118 - DNA, 23 bp, Homo sapiens
gagggatcacagggccccagaag

SEQ ID NO: 1545119 - DNA, 17 bp, Homo sapiens
gagggatgctgcctgag

SEQ ID NO: 1545120 - DNA, 20 bp, Homo sapiens
gagggatgctgcctgagtca

SEQ ID NO: 1545121 - DNA, 15 bp, Homo sapiens
gagggatgctgctcc

SEQ ID NO: 1545122 - DNA, 18 bp, Homo sapiens
gagggatgctgctccgcc

SEQ ID NO: 1545123 - DNA, 18 bp, Homo sapiens
gagggattctggttccag

SEQ ID NO: 1545124 - DNA, 17 bp, Homo sapiens
gagggcaacagggagca

SEQ ID NO: 1545125 - DNA, 15 bp, Homo sapiens
gagggcacagccctc

SEQ ID NO: 1545126 - DNA, 21 bp, Homo sapiens
gagggcagactggggcatcct

SEQ ID NO: 1545127 - DNA, 11 bp, Homo sapiens
gagggcagagc

SEQ ID NO: 1545128 - DNA, 13 bp, Homo sapiens
gagggcagagcca

SEQ ID NO: 1545129 - DNA, 21 bp, Homo sapiens
gagggcagagccatgggcctg

SEQ ID NO: 1545130 - DNA, 22 bp, Homo sapiens
gagggcagcagaagggggtggt

SEQ ID NO: 1545131 - DNA, 14 bp, Homo sapiens
gagggcagctgcta

SEQ ID NO: 1545132 - DNA, 14 bp, Homo sapiens
gagggcaggcttgg

SEQ ID NO: 1545133 - DNA, 16 bp, Homo sapiens
gagggcaggcttgggg

SEQ ID NO: 1545134 - DNA, 14 bp, Homo sapiens
gagggcaggggtgc

SEQ ID NO: 1545135 - DNA, 13 bp, Homo sapiens
gagggcagtgccc

SEQ ID NO: 1545136 - DNA, 23 bp, Homo sapiens
gagggcagtgccctttgagatct

SEQ ID NO: 1545137 - DNA, 12 bp, Homo sapiens
gagggccagcag

SEQ ID NO: 1545138 - DNA, 15 bp, Homo sapiens
gagggccagggaccc

SEQ ID NO: 1545139 - DNA, 14 bp, Homo sapiens
gagggcccagccag

SEQ ID NO: 1545140 - DNA, 18 bp, Homo sapiens
gagggcccagctgtagcc

SEQ ID NO: 1545141 - DNA, 23 bp, Homo sapiens
gagggcccagctgtagccatggc

SEQ ID NO: 1545142 - DNA, 13 bp, Homo sapiens
gagggcccaggca

SEQ ID NO: 1545143 - DNA, 17 bp, Homo sapiens
gagggcccatcaggcag

SEQ ID NO: 1545144 - DNA, 22 bp, Homo sapiens
gagggcccctctgcccagcttg

SEQ ID NO: 1545145 - DNA, 23 bp, Homo sapiens
gagggccctgtggagtccagctc

SEQ ID NO: 1545146 - DNA, 20 bp, Homo sapiens
gagggccgtaccccaccctc

SEQ ID NO: 1545147 - DNA, 21 bp, Homo sapiens
gagggccgtaccccaccctca

SEQ ID NO: 1545148 - DNA, 22 bp, Homo sapiens
gagggcctcaaaggcccgctct

SEQ ID NO: 1545149 - DNA, 15 bp, Homo sapiens
gagggcctctgcctg

SEQ ID NO: 1545150 - DNA, 17 bp, Homo sapiens
gagggcctctgcctggg

SEQ ID NO: 1545151 - DNA, 14 bp, Homo sapiens
gagggcctgctgga

SEQ ID NO: 1545152 - DNA, 20 bp, Homo sapiens
gagggcgtgactcacccaag

SEQ ID NO: 1545153 - DNA, 20 bp, Homo sapiens
gagggctctgatctaacaaa

SEQ ID NO: 1545154 - DNA, 18 bp, Homo sapiens
gagggctgatggaggaaa

SEQ ID NO: 1545155 - DNA, 22 bp, Homo sapiens
gagggctgatggaggaaaaagg

SEQ ID NO: 1545156 - DNA, 16 bp, Homo sapiens
gagggctgcagtcaca

SEQ ID NO: 1545157 - DNA, 18 bp, Homo sapiens
gagggctggctggcctca

SEQ ID NO: 1545158 - DNA, 23 bp, Homo sapiens
gagggctgttggacagctgcttg

SEQ ID NO: 1545159 - DNA, 17 bp, Homo sapiens
gagggcttggcccagcg

SEQ ID NO: 1545160 - DNA, 22 bp, Homo sapiens
gagggctttctgggtgtgtcca

SEQ ID NO: 1545161 - DNA, 12 bp, Homo sapiens
gaggggaagagg

SEQ ID NO: 1545162 - DNA, 15 bp, Homo sapiens
gaggggaagaggcct

SEQ ID NO: 1545163 - DNA, 12 bp, Homo sapiens
gaggggaaggcc

SEQ ID NO: 1545164 - DNA, 19 bp, Homo sapiens
gaggggaggggcctaggga

SEQ ID NO: 1545165 - DNA, 16 bp, Homo sapiens
gaggggatccagccac

SEQ ID NO: 1545166 - DNA, 17 bp, Homo sapiens
gaggggatccagccact

SEQ ID NO: 1545167 - DNA, 18 bp, Homo sapiens
gaggggcagaacagccgc

SEQ ID NO: 1545168 - DNA, 14 bp, Homo sapiens
gaggggcagccctt

SEQ ID NO: 1545169 - DNA, 19 bp, Homo sapiens
gaggggcagcctgtgcctg

SEQ ID NO: 1545170 - DNA, 22 bp, Homo sapiens
gaggggcatctgcccctccccc

SEQ ID NO: 1545171 - DNA, 11 bp, Homo sapiens
gaggggcccac

SEQ ID NO: 1545172 - DNA, 14 bp, Homo sapiens
gaggggcccaccca

SEQ ID NO: 1545173 - DNA, 12 bp, Homo sapiens
gaggggcctagg

SEQ ID NO: 1545174 - DNA, 15 bp, Homo sapiens
gaggggcgctggccc

SEQ ID NO: 1545175 - DNA, 17 bp, Homo sapiens
gaggggcgctggcccag

SEQ ID NO: 1545176 - DNA, 12 bp, Homo sapiens
gaggggctcctg

SEQ ID NO: 1545177 - DNA, 13 bp, Homo sapiens
gaggggctcctgg

SEQ ID NO: 1545178 - DNA, 15 bp, Homo sapiens
gaggggctcctggaa

SEQ ID NO: 1545179 - DNA, 14 bp, Homo sapiens
gaggggctggggca

SEQ ID NO: 1545180 - DNA, 17 bp, Homo sapiens
gaggggctttctggaga

SEQ ID NO: 1545181 - DNA, 14 bp, Homo sapiens
gagggggagggggt

SEQ ID NO: 1545182 - DNA, 14 bp, Homo sapiens
gagggggagtagcc

SEQ ID NO: 1545183 - DNA, 17 bp, Homo sapiens
gagggggagtagccaag

SEQ ID NO: 1545184 - DNA, 19 bp, Homo sapiens
gagggggctatttctctcc

SEQ ID NO: 1545185 - DNA, 17 bp, Homo sapiens
gagggggcttgaagcca

SEQ ID NO: 1545186 - DNA, 22 bp, Homo sapiens
gaggggggccaaggtcctgctc

SEQ ID NO: 1545187 - DNA, 13 bp, Homo sapiens
gaggggggtggga

SEQ ID NO: 1545188 - DNA, 23 bp, Homo sapiens
gagggggtcatttcagagccctc

SEQ ID NO: 1545189 - DNA, 20 bp, Homo sapiens
gagggggttacaaactgcaa

SEQ ID NO: 1545190 - DNA, 14 bp, Homo sapiens
gaggggtctcggat

SEQ ID NO: 1545191 - DNA, 20 bp, Homo sapiens
gaggggtgagtcccctactc

SEQ ID NO: 1545192 - DNA, 21 bp, Homo sapiens
gaggggtgagtcccctactcc

SEQ ID NO: 1545193 - DNA, 13 bp, Homo sapiens
gaggggtggggag

SEQ ID NO: 1545194 - DNA, 23 bp, Homo sapiens
gaggggtggtggggggcagggcc

SEQ ID NO: 1545195 - DNA, 14 bp, Homo sapiens
gaggggtgtggcag

SEQ ID NO: 1545196 - DNA, 17 bp, Homo sapiens
gagggtcctggctcctg

SEQ ID NO: 1545197 - DNA, 24 bp, Homo sapiens
gagggtctggagaagcagtgagcc

SEQ ID NO: 1545198 - DNA, 18 bp, Homo sapiens
gagggtgacagcttcctt

SEQ ID NO: 1545199 - DNA, 17 bp, Homo sapiens
gagggtgacgcccagct

SEQ ID NO: 1545200 - DNA, 20 bp, Homo sapiens
gagggtgacgcccagctccg

SEQ ID NO: 1545201 - DNA, 21 bp, Homo sapiens
gagggtgcagccctcttgccc

SEQ ID NO: 1545202 - DNA, 20 bp, Homo sapiens
gagggtggagactaagccct

SEQ ID NO: 1545203 - DNA, 14 bp, Homo sapiens
gagggtggccagca

SEQ ID NO: 1545204 - DNA, 17 bp, Homo sapiens
gagggtggctggagtga

SEQ ID NO: 1545205 - DNA, 17 bp, Homo sapiens
gagggtgggggagggag

SEQ ID NO: 1545206 - DNA, 20 bp, Homo sapiens
gagggtggttcaacaaagaa

SEQ ID NO: 1545207 - DNA, 15 bp, Homo sapiens
gagggttagggaggg

SEQ ID NO: 1545208 - DNA, 18 bp, Homo sapiens
gagggttcacacagccca

SEQ ID NO: 1545209 - DNA, 18 bp, Homo sapiens
agttgtggaaagcctctg

SEQ ID NO: 1545210 - DNA, 19 bp, Homo sapiens
agttgtggaaagcctctgc

SEQ ID NO: 1545211 - DNA, 21 bp, Homo sapiens
agttgtggaaagcctctgctg

SEQ ID NO: 1545212 - DNA, 18 bp, Homo sapiens
agttgtggatatcagggt

SEQ ID NO: 1545213 - DNA, 14 bp, Homo sapiens
agttgtggtactgt

SEQ ID NO: 1545214 - DNA, 23 bp, Homo sapiens
agttgtgttgttttttgttcaat

SEQ ID NO: 1545215 - DNA, 17 bp, Homo sapiens
agttgtgttttttaaga

SEQ ID NO: 1545216 - DNA, 15 bp, Homo sapiens
agttgttgactgtga

SEQ ID NO: 1545217 - DNA, 18 bp, Homo sapiens
agttgttgactgtgatta

SEQ ID NO: 1545218 - DNA, 15 bp, Homo sapiens
agttgttggcctccg

SEQ ID NO: 1545219 - DNA, 16 bp, Homo sapiens
agttgtttcattgact

SEQ ID NO: 1545220 - DNA, 23 bp, Homo sapiens
agttgtttctaagagcagagtct

SEQ ID NO: 1545221 - DNA, 20 bp, Homo sapiens
agttgtttctgacccactga

SEQ ID NO: 1545222 - DNA, 21 bp, Homo sapiens
agttgttttttgtgtttccat

SEQ ID NO: 1545223 - DNA, 23 bp, Homo sapiens
agtttaaaatgtgtatttttcaa

SEQ ID NO: 1545224 - DNA, 15 bp, Homo sapiens
agtttaatacaggaa

SEQ ID NO: 1545225 - DNA, 14 bp, Homo sapiens
agtttaatgtctcc

SEQ ID NO: 1545226 - DNA, 23 bp, Homo sapiens
agtttaatgtctcctttgctctt

SEQ ID NO: 1545227 - DNA, 13 bp, Homo sapiens
agtttaattgtct

SEQ ID NO: 1545228 - DNA, 16 bp, Homo sapiens
agtttacaagcgagaa

SEQ ID NO: 1545229 - DNA, 13 bp, Homo sapiens
agtttacagaaaa

SEQ ID NO: 1545230 - DNA, 17 bp, Homo sapiens
agtttacattgtaaata

SEQ ID NO: 1545231 - DNA, 14 bp, Homo sapiens
agtttacattgtcc

SEQ ID NO: 1545232 - DNA, 17 bp, Homo sapiens
agtttacattgtcctgt

SEQ ID NO: 1545233 - DNA, 20 bp, Homo sapiens
agtttacattgtcctgtagc

SEQ ID NO: 1545234 - DNA, 16 bp, Homo sapiens
agtttaccaatcaaca

SEQ ID NO: 1545235 - DNA, 13 bp, Homo sapiens
agtttaccatttg

SEQ ID NO: 1545236 - DNA, 14 bp, Homo sapiens
agtttaccatttgt

SEQ ID NO: 1545237 - DNA, 16 bp, Homo sapiens
agtttaccatttgtaa

SEQ ID NO: 1545238 - DNA, 17 bp, Homo sapiens
agtttaccatttgtaat

SEQ ID NO: 1545239 - DNA, 21 bp, Homo sapiens
agtttacccatgaagattggt

SEQ ID NO: 1545240 - DNA, 20 bp, Homo sapiens
agtttacctctttaaaaaca

SEQ ID NO: 1545241 - DNA, 20 bp, Homo sapiens
agtttagtgtgataaaggca

SEQ ID NO: 1545242 - DNA, 22 bp, Homo sapiens
agtttatattactctcattctt

SEQ ID NO: 1545243 - DNA, 22 bp, Homo sapiens
agtttatcttaagcatgtcaat

SEQ ID NO: 1545244 - DNA, 24 bp, Homo sapiens
agtttatgatgcaaatctgccaag

SEQ ID NO: 1545245 - DNA, 22 bp, Homo sapiens
agtttatggatatgctgcttta

SEQ ID NO: 1545246 - DNA, 16 bp, Homo sapiens
agtttattacaatgta

SEQ ID NO: 1545247 - DNA, 21 bp, Homo sapiens
agtttattacaatgtatcttt

SEQ ID NO: 1545248 - DNA, 22 bp, Homo sapiens
agtttattacaatgtatcttta

SEQ ID NO: 1545249 - DNA, 15 bp, Homo sapiens
agtttattggaagtg

SEQ ID NO: 1545250 - DNA, 18 bp, Homo sapiens
agtttattggaagtgttc

SEQ ID NO: 1545251 - DNA, 17 bp, Homo sapiens
agtttattttttctaca

SEQ ID NO: 1545252 - DNA, 19 bp, Homo sapiens
agtttattttttctacaca

SEQ ID NO: 1545253 - DNA, 13 bp, Homo sapiens
agtttcaaatgag

SEQ ID NO: 1545254 - DNA, 20 bp, Homo sapiens
agtttcaagttttaaagttc

SEQ ID NO: 1545255 - DNA, 22 bp, Homo sapiens
agtttcacagaaaataaggcac

SEQ ID NO: 1545256 - DNA, 23 bp, Homo sapiens
agtttcacaggtcaataaactta

SEQ ID NO: 1545257 - DNA, 19 bp, Homo sapiens
agtttcacatatttgtagc

SEQ ID NO: 1545258 - DNA, 20 bp, Homo sapiens
agtttcacatatttgtagct

SEQ ID NO: 1545259 - DNA, 19 bp, Homo sapiens
agtttcagtaaataatgaa

SEQ ID NO: 1545260 - DNA, 22 bp, Homo sapiens
agtttcagttgtccttaaattt

SEQ ID NO: 1545261 - DNA, 18 bp, Homo sapiens
agtttcagtttgttggaa

SEQ ID NO: 1545262 - DNA, 15 bp, Homo sapiens
agtttccaaaaccag

SEQ ID NO: 1545263 - DNA, 17 bp, Homo sapiens
agtttccaattccactg

SEQ ID NO: 1545264 - DNA, 23 bp, Homo sapiens
agtttctaaggtccggtgttcta

SEQ ID NO: 1545265 - DNA, 22 bp, Homo sapiens
agtttctacattcagattatat

SEQ ID NO: 1545266 - DNA, 15 bp, Homo sapiens
agtttctagaggcct

SEQ ID NO: 1545267 - DNA, 13 bp, Homo sapiens
agtttctattctg

SEQ ID NO: 1545268 - DNA, 11 bp, Homo sapiens
agtttctattt

SEQ ID NO: 1545269 - DNA, 22 bp, Homo sapiens
agtttctcaaactgagcttcag

SEQ ID NO: 1545270 - DNA, 18 bp, Homo sapiens
agtttctcagatccttgt

SEQ ID NO: 1545271 - DNA, 22 bp, Homo sapiens
agtttctcagatccttgtttca

SEQ ID NO: 1545272 - DNA, 12 bp, Homo sapiens
agtttctccttg

SEQ ID NO: 1545273 - DNA, 14 bp, Homo sapiens
agtttctttcccca

SEQ ID NO: 1545274 - DNA, 13 bp, Homo sapiens
agtttctttggga

SEQ ID NO: 1545275 - DNA, 15 bp, Homo sapiens
agtttgaaggaaaca

SEQ ID NO: 1545276 - DNA, 16 bp, Homo sapiens
agtttgaaggaaacag

SEQ ID NO: 1545277 - DNA, 17 bp, Homo sapiens
agtttgagacaagccct

SEQ ID NO: 1545278 - DNA, 23 bp, Homo sapiens
agtttgagctgccttccctagct

SEQ ID NO: 1545279 - DNA, 18 bp, Homo sapiens
agtttgaggaaatttgca

SEQ ID NO: 1545280 - DNA, 19 bp, Homo sapiens
agtttgaggaaatttgcag

SEQ ID NO: 1545281 - DNA, 17 bp, Homo sapiens
agtttgaggctgcagcg

SEQ ID NO: 1545282 - DNA, 16 bp, Homo sapiens
agtttgattattatgt

SEQ ID NO: 1545283 - DNA, 22 bp, Homo sapiens
agtttgattgaggagctgcact

SEQ ID NO: 1545284 - DNA, 20 bp, Homo sapiens
agtttgcactcaaatcttaa

SEQ ID NO: 1545285 - DNA, 13 bp, Homo sapiens
agtttgcagaaaa

SEQ ID NO: 1545286 - DNA, 14 bp, Homo sapiens
agtttgcagaaaag

SEQ ID NO: 1545287 - DNA, 20 bp, Homo sapiens
agtttgcattcctgatatga

SEQ ID NO: 1545288 - DNA, 15 bp, Homo sapiens
agtttgcatttcaga

SEQ ID NO: 1545289 - DNA, 13 bp, Homo sapiens
agtttgccagaag

SEQ ID NO: 1545290 - DNA, 20 bp, Homo sapiens
agtttggagcactagtttga

SEQ ID NO: 1545291 - DNA, 22 bp, Homo sapiens
agtttggagcactagtttgatt

SEQ ID NO: 1545292 - DNA, 12 bp, Homo sapiens
agtttggaggaa

SEQ ID NO: 1545293 - DNA, 14 bp, Homo sapiens
agtttggccctgga

SEQ ID NO: 1545294 - DNA, 15 bp, Homo sapiens
agtttggccctggag

SEQ ID NO: 1545295 - DNA, 16 bp, Homo sapiens
agtttggccctggagc

SEQ ID NO: 1545296 - DNA, 23 bp, Homo sapiens
agtttggctgctgtcataacatc

SEQ ID NO: 1545297 - DNA, 13 bp, Homo sapiens
agtttgggtaaaa

SEQ ID NO: 1545298 - DNA, 13 bp, Homo sapiens
agtttgtaaagtc

SEQ ID NO: 1545299 - DNA, 17 bp, Homo sapiens
agtttgtaaatattcta

SEQ ID NO: 1545300 - DNA, 18 bp, Homo sapiens
agtttgtagtaaaagtgg

SEQ ID NO: 1545301 - DNA, 22 bp, Homo sapiens
agtttgtatgccaagtgagaag

SEQ ID NO: 1545302 - DNA, 13 bp, Homo sapiens
agtttgtattttg

SEQ ID NO: 1545303 - DNA, 15 bp, Homo sapiens
agtttgtattttgca

SEQ ID NO: 1545304 - DNA, 14 bp, Homo sapiens
agtttgtcagactt

SEQ ID NO: 1545305 - DNA, 17 bp, Homo sapiens
agtttgtcgctcatgtg

SEQ ID NO: 1545306 - DNA, 15 bp, Homo sapiens
agtttgtctatttta

SEQ ID NO: 1545307 - DNA, 20 bp, Homo sapiens
agtttgtggcatcttgccaa

SEQ ID NO: 1545308 - DNA, 20 bp, Homo sapiens
agtttgtgtgtatttgtatt

SEQ ID NO: 1545309 - DNA, 22 bp, Homo sapiens
agtttgtgtgtcttaattatta

SEQ ID NO: 1545310 - DNA, 14 bp, Homo sapiens
agtttgtgtgttgt

SEQ ID NO: 1545311 - DNA, 21 bp, Homo sapiens
agtttgtgtgttgtctcttga

SEQ ID NO: 1545312 - DNA, 18 bp, Homo sapiens
agtttgtgtgttgtcttg

SEQ ID NO: 1545313 - DNA, 22 bp, Homo sapiens
agttttaaaaagccagtttggg

SEQ ID NO: 1545314 - DNA, 15 bp, Homo sapiens
agttttaaaaggctc

SEQ ID NO: 1545315 - DNA, 11 bp, Homo sapiens
agttttaaagt

SEQ ID NO: 1545316 - DNA, 20 bp, Homo sapiens
agttttaactttaatacagc

SEQ ID NO: 1545317 - DNA, 23 bp, Homo sapiens
agttttacagagaggatacattt

SEQ ID NO: 1545318 - DNA, 17 bp, Homo sapiens
agttttagaataaggag

SEQ ID NO: 1545319 - DNA, 18 bp, Homo sapiens
agttttagaataaggagg

SEQ ID NO: 1545320 - DNA, 18 bp, Homo sapiens
agttttagggtacatgtg

SEQ ID NO: 1545321 - DNA, 21 bp, Homo sapiens
agttttagtctttagaactct

SEQ ID NO: 1545322 - DNA, 15 bp, Homo sapiens
agttttataaaactc

SEQ ID NO: 1545323 - DNA, 16 bp, Homo sapiens
agttttatatgcttta

SEQ ID NO: 1545324 - DNA, 14 bp, Homo sapiens
agttttatttgtat

SEQ ID NO: 1545325 - DNA, 11 bp, Homo sapiens
gagggttgcca

SEQ ID NO: 1545326 - DNA, 20 bp, Homo sapiens
gagggtttgcactccacaca

SEQ ID NO: 1545327 - DNA, 17 bp, Homo sapiens
gaggtactggtcccttc

SEQ ID NO: 1545328 - DNA, 12 bp, Homo sapiens
gaggtactgtaa

SEQ ID NO: 1545329 - DNA, 23 bp, Homo sapiens
gaggtagaaggggaggacactgg

SEQ ID NO: 1545330 - DNA, 14 bp, Homo sapiens
gaggtataaagaca

SEQ ID NO: 1545331 - DNA, 14 bp, Homo sapiens
gaggtattaaaact

SEQ ID NO: 1545332 - DNA, 16 bp, Homo sapiens
gaggtcaacagagaag

SEQ ID NO: 1545333 - DNA, 17 bp, Homo sapiens
gaggtcaccagctgctg

SEQ ID NO: 1545334 - DNA, 15 bp, Homo sapiens
gaggtcaccagggga

SEQ ID NO: 1545335 - DNA, 21 bp, Homo sapiens
gaggtcaccaggggaggagcc

SEQ ID NO: 1545336 - DNA, 16 bp, Homo sapiens
gaggtcactggaaagg

SEQ ID NO: 1545337 - DNA, 23 bp, Homo sapiens
gaggtcagcatgtctattcagct

SEQ ID NO: 1545338 - DNA, 14 bp, Homo sapiens
gaggtcaggcccca

SEQ ID NO: 1545339 - DNA, 16 bp, Homo sapiens
gaggtccagctgggcc

SEQ ID NO: 1545340 - DNA, 12 bp, Homo sapiens
gaggtcccaggc

SEQ ID NO: 1545341 - DNA, 14 bp, Homo sapiens
gaggtcccaggcag

SEQ ID NO: 1545342 - DNA, 22 bp, Homo sapiens
gaggtcgcagctaccctcagcc

SEQ ID NO: 1545343 - DNA, 21 bp, Homo sapiens
gaggtctcaggttctttccat

SEQ ID NO: 1545344 - DNA, 16 bp, Homo sapiens
gaggtctccaaactga

SEQ ID NO: 1545345 - DNA, 21 bp, Homo sapiens
gaggtctccaggggcctgcag

SEQ ID NO: 1545346 - DNA, 19 bp, Homo sapiens
gaggtctctgggagcccag

SEQ ID NO: 1545347 - DNA, 14 bp, Homo sapiens
gaggtctcttgagg

SEQ ID NO: 1545348 - DNA, 13 bp, Homo sapiens
gaggtctgagccc

SEQ ID NO: 1545349 - DNA, 19 bp, Homo sapiens
gaggtctgagccctggtgt

SEQ ID NO: 1545350 - DNA, 20 bp, Homo sapiens
gaggtctgagccctggtgtg

SEQ ID NO: 1545351 - DNA, 18 bp, Homo sapiens
gaggtctgattggctgct

SEQ ID NO: 1545352 - DNA, 20 bp, Homo sapiens
gaggtctggctgagcccctg

SEQ ID NO: 1545353 - DNA, 23 bp, Homo sapiens
gaggtctggctgagcccctgggg

SEQ ID NO: 1545354 - DNA, 16 bp, Homo sapiens
gaggtgaacaaggtaa

SEQ ID NO: 1545355 - DNA, 13 bp, Homo sapiens
gaggtgattccag

SEQ ID NO: 1545356 - DNA, 21 bp, Homo sapiens
gaggtgattccagtgaagata

SEQ ID NO: 1545357 - DNA, 18 bp, Homo sapiens
gaggtgcagagtgcccag

SEQ ID NO: 1545358 - DNA, 15 bp, Homo sapiens
gaggtgcctgtccca

SEQ ID NO: 1545359 - DNA, 12 bp, Homo sapiens
gaggtgcttcac

SEQ ID NO: 1545360 - DNA, 14 bp, Homo sapiens
gaggtgcttgaggc

SEQ ID NO: 1545361 - DNA, 19 bp, Homo sapiens
gaggtggaagaagggagaa

SEQ ID NO: 1545362 - DNA, 19 bp, Homo sapiens
gaggtggaggttgcagtga

SEQ ID NO: 1545363 - DNA, 15 bp, Homo sapiens
gaggtggcagccctg

SEQ ID NO: 1545364 - DNA, 18 bp, Homo sapiens
gaggtggcagccctgtag

SEQ ID NO: 1545365 - DNA, 13 bp, Homo sapiens
gaggtgggagggc

SEQ ID NO: 1545366 - DNA, 14 bp, Homo sapiens
gaggtgggcagctg

SEQ ID NO: 1545367 - DNA, 16 bp, Homo sapiens
gaggtgggcagctggg

SEQ ID NO: 1545368 - DNA, 21 bp, Homo sapiens
gaggtgggcaggtggtggcac

SEQ ID NO: 1545369 - DNA, 14 bp, Homo sapiens
gaggtgggctgggg

SEQ ID NO: 1545370 - DNA, 22 bp, Homo sapiens
gaggtggtaggatcacctgagg

SEQ ID NO: 1545371 - DNA, 13 bp, Homo sapiens
gaggtgtctgggg

SEQ ID NO: 1545372 - DNA, 20 bp, Homo sapiens
gaggtgtctggggtgaggga

SEQ ID NO: 1545373 - DNA, 16 bp, Homo sapiens
gaggtgtggagccgag

SEQ ID NO: 1545374 - DNA, 17 bp, Homo sapiens
gaggtgtgggggctgca

SEQ ID NO: 1545375 - DNA, 20 bp, Homo sapiens
gaggtgtgggtgtctgtttg

SEQ ID NO: 1545376 - DNA, 16 bp, Homo sapiens
gaggtgttacagagga

SEQ ID NO: 1545377 - DNA, 14 bp, Homo sapiens
gaggttactttagt

SEQ ID NO: 1545378 - DNA, 22 bp, Homo sapiens
gaggttaggagttcgagaccag

SEQ ID NO: 1545379 - DNA, 22 bp, Homo sapiens
gaggttagttctgtgtgtctgg

SEQ ID NO: 1545380 - DNA, 16 bp, Homo sapiens
gaggttatctgcctgg

SEQ ID NO: 1545381 - DNA, 17 bp, Homo sapiens
gaggttatctgcctggc

SEQ ID NO: 1545382 - DNA, 17 bp, Homo sapiens
gaggttcctctgcctgc

SEQ ID NO: 1545383 - DNA, 15 bp, Homo sapiens
gaggttctgggcctc

SEQ ID NO: 1545384 - DNA, 15 bp, Homo sapiens
gaggttgcagcatga

SEQ ID NO: 1545385 - DNA, 12 bp, Homo sapiens
gaggttggattt

SEQ ID NO: 1545386 - DNA, 19 bp, Homo sapiens
gaggttgtagtgagccaag

SEQ ID NO: 1545387 - DNA, 22 bp, Homo sapiens
gaggtttatagaaagatagata

SEQ ID NO: 1545388 - DNA, 15 bp, Homo sapiens
gaggtttgcctgtga

SEQ ID NO: 1545389 - DNA, 17 bp, Homo sapiens
gaggtttggaagagtga

SEQ ID NO: 1545390 - DNA, 16 bp, Homo sapiens
gaggttttatttcatt

SEQ ID NO: 1545391 - DNA, 21 bp, Homo sapiens
gaggttttatttcatttttca

SEQ ID NO: 1545392 - DNA, 22 bp, Homo sapiens
gaggtttttaaatatatatttt

SEQ ID NO: 1545393 - DNA, 16 bp, Homo sapiens
gagtaaaaagaaaaca

SEQ ID NO: 1545394 - DNA, 21 bp, Homo sapiens
gagtaacaatacaaatggatt

SEQ ID NO: 1545395 - DNA, 15 bp, Homo sapiens
gagtaacatttgctg

SEQ ID NO: 1545396 - DNA, 12 bp, Homo sapiens
gagtaagagctg

SEQ ID NO: 1545397 - DNA, 20 bp, Homo sapiens
gagtaatgacgtgtgtggct

SEQ ID NO: 1545398 - DNA, 23 bp, Homo sapiens
gagtaatgacgtgtgtggctggg

SEQ ID NO: 1545399 - DNA, 22 bp, Homo sapiens
gagtaatggtgtagaacactaa

SEQ ID NO: 1545400 - DNA, 14 bp, Homo sapiens
gagtaatttattgt

SEQ ID NO: 1545401 - DNA, 13 bp, Homo sapiens
gagtaatttcatt

SEQ ID NO: 1545402 - DNA, 14 bp, Homo sapiens
gagtacaaaacaat

SEQ ID NO: 1545403 - DNA, 14 bp, Homo sapiens
gagtacagatactg

SEQ ID NO: 1545404 - DNA, 23 bp, Homo sapiens
gagtacctgcaaaaatgagttgt

SEQ ID NO: 1545405 - DNA, 16 bp, Homo sapiens
gagtacctgctgcccc

SEQ ID NO: 1545406 - DNA, 15 bp, Homo sapiens
gagtactatatttac

SEQ ID NO: 1545407 - DNA, 16 bp, Homo sapiens
gagtactatatttaca

SEQ ID NO: 1545408 - DNA, 15 bp, Homo sapiens
gagtagaatgtagtt

SEQ ID NO: 1545409 - DNA, 12 bp, Homo sapiens
gagtagagaagt

SEQ ID NO: 1545410 - DNA, 13 bp, Homo sapiens
gagtagagaggcc

SEQ ID NO: 1545411 - DNA, 21 bp, Homo sapiens
gagtagagaggcccgcccgcc

SEQ ID NO: 1545412 - DNA, 21 bp, Homo sapiens
gagtagatactctcagcacca

SEQ ID NO: 1545413 - DNA, 21 bp, Homo sapiens
gagtagccagggtgtggccct

SEQ ID NO: 1545414 - DNA, 18 bp, Homo sapiens
gagtagccgagagcctgc

SEQ ID NO: 1545415 - DNA, 14 bp, Homo sapiens
gagtagtgtggaat

SEQ ID NO: 1545416 - DNA, 14 bp, Homo sapiens
gagtatatgcactt

SEQ ID NO: 1545417 - DNA, 14 bp, Homo sapiens
gagtatccttcctt

SEQ ID NO: 1545418 - DNA, 16 bp, Homo sapiens
gagtatccttccttca

SEQ ID NO: 1545419 - DNA, 21 bp, Homo sapiens
gagtatgcaatgctatcactg

SEQ ID NO: 1545420 - DNA, 20 bp, Homo sapiens
gagtatgcttgggccctgca

SEQ ID NO: 1545421 - DNA, 17 bp, Homo sapiens
gagtattaagaatgcag

SEQ ID NO: 1545422 - DNA, 20 bp, Homo sapiens
gagtattgtttaaaatgtaa

SEQ ID NO: 1545423 - DNA, 20 bp, Homo sapiens
gagtatttcccttccaaaga

SEQ ID NO: 1545424 - DNA, 21 bp, Homo sapiens
gagtatttttaaaaaatatgt

SEQ ID NO: 1545425 - DNA, 18 bp, Homo sapiens
gagtatttttgacagaat

SEQ ID NO: 1545426 - DNA, 12 bp, Homo sapiens
gagtatttttgg

SEQ ID NO: 1545427 - DNA, 15 bp, Homo sapiens
gagtcaaaacaaagc

SEQ ID NO: 1545428 - DNA, 16 bp, Homo sapiens
gagtcaaatccagtgg

SEQ ID NO: 1545429 - DNA, 21 bp, Homo sapiens
gagtcaaatccagtggtgggt

SEQ ID NO: 1545430 - DNA, 21 bp, Homo sapiens
gagtcaaggcctgctccctgt

SEQ ID NO: 1545431 - DNA, 23 bp, Homo sapiens
gagtcacatcagtgaggagggat

SEQ ID NO: 1545432 - DNA, 20 bp, Homo sapiens
gagtcacccatgaagacagg

SEQ ID NO: 1545433 - DNA, 15 bp, Homo sapiens
gagtcacctgcaagc

SEQ ID NO: 1545434 - DNA, 17 bp, Homo sapiens
gagtcacctgcaagccc

SEQ ID NO: 1545435 - DNA, 15 bp, Homo sapiens
gagtcacctgctcca

SEQ ID NO: 1545436 - DNA, 21 bp, Homo sapiens
gagtcactgcctctccctggc

SEQ ID NO: 1545437 - DNA, 13 bp, Homo sapiens
gagtcagcacctt

SEQ ID NO: 1545438 - DNA, 17 bp, Homo sapiens
gagtcagcaccttggcc

SEQ ID NO: 1545439 - DNA, 20 bp, Homo sapiens
gagtcagcaccttggcccag

SEQ ID NO: 1545440 - DNA, 14 bp, Homo sapiens
gagtcagccaggag

SEQ ID NO: 1545441 - DNA, 18 bp, Homo sapiens
gagtcagggagagctgaa

SEQ ID NO: 1545442 - DNA, 16 bp, Homo sapiens
agttttcagaacctct

SEQ ID NO: 1545443 - DNA, 17 bp, Homo sapiens
agttttcagaacctctt

SEQ ID NO: 1545444 - DNA, 21 bp, Homo sapiens
agttttcagaacctcttcccc

SEQ ID NO: 1545445 - DNA, 13 bp, Homo sapiens
agttttcagcctt

SEQ ID NO: 1545446 - DNA, 15 bp, Homo sapiens
agttttcccctggcc

SEQ ID NO: 1545447 - DNA, 17 bp, Homo sapiens
agttttcccctggcctc

SEQ ID NO: 1545448 - DNA, 18 bp, Homo sapiens
agttttcccctggcctca

SEQ ID NO: 1545449 - DNA, 16 bp, Homo sapiens
agttttccctgaagtt

SEQ ID NO: 1545450 - DNA, 12 bp, Homo sapiens
agttttccctgg

SEQ ID NO: 1545451 - DNA, 18 bp, Homo sapiens
agttttccttctcatctg

SEQ ID NO: 1545452 - DNA, 22 bp, Homo sapiens
agttttccttctcatctgtgat

SEQ ID NO: 1545453 - DNA, 18 bp, Homo sapiens
agttttctagcaattttc

SEQ ID NO: 1545454 - DNA, 22 bp, Homo sapiens
agttttctagcaattttctttg

SEQ ID NO: 1545455 - DNA, 13 bp, Homo sapiens
agttttctccttt

SEQ ID NO: 1545456 - DNA, 14 bp, Homo sapiens
agttttctgagaaa

SEQ ID NO: 1545457 - DNA, 18 bp, Homo sapiens
agttttctggtaggaaga

SEQ ID NO: 1545458 - DNA, 15 bp, Homo sapiens
agttttcttccatga

SEQ ID NO: 1545459 - DNA, 13 bp, Homo sapiens
agttttgatgaaa

SEQ ID NO: 1545460 - DNA, 19 bp, Homo sapiens
agttttgattaatgtttct

SEQ ID NO: 1545461 - DNA, 20 bp, Homo sapiens
agttttgattaatgtttctt

SEQ ID NO: 1545462 - DNA, 24 bp, Homo sapiens
agttttgattaatgtttcttaaat

SEQ ID NO: 1545463 - DNA, 23 bp, Homo sapiens
agttttgcctttctaagggaggg

SEQ ID NO: 1545464 - DNA, 19 bp, Homo sapiens
agttttgggaagttaaagg

SEQ ID NO: 1545465 - DNA, 20 bp, Homo sapiens
agttttgggaagttaaaggg

SEQ ID NO: 1545466 - DNA, 13 bp, Homo sapiens
agttttgtaaatg

SEQ ID NO: 1545467 - DNA, 13 bp, Homo sapiens
agttttgtataaa

SEQ ID NO: 1545468 - DNA, 17 bp, Homo sapiens
agttttgtataaataat

SEQ ID NO: 1545469 - DNA, 16 bp, Homo sapiens
agttttgtcagaaaag

SEQ ID NO: 1545470 - DNA, 13 bp, Homo sapiens
agttttgtcttga

SEQ ID NO: 1545471 - DNA, 14 bp, Homo sapiens
agttttgtcttgaa

SEQ ID NO: 1545472 - DNA, 16 bp, Homo sapiens
agttttgtgtttgttg

SEQ ID NO: 1545473 - DNA, 23 bp, Homo sapiens
agttttgttgtacttaaatggta

SEQ ID NO: 1545474 - DNA, 22 bp, Homo sapiens
agtttttaaaaacctgtatctg

SEQ ID NO: 1545475 - DNA, 23 bp, Homo sapiens
agtttttaaaatatattgctgca

SEQ ID NO: 1545476 - DNA, 18 bp, Homo sapiens
agtttttacagctgtgtt

SEQ ID NO: 1545477 - DNA, 16 bp, Homo sapiens
agtttttactttctgt

SEQ ID NO: 1545478 - DNA, 13 bp, Homo sapiens
agtttttatacca

SEQ ID NO: 1545479 - DNA, 18 bp, Homo sapiens
agtttttatgagaaactt

SEQ ID NO: 1545480 - DNA, 22 bp, Homo sapiens
agtttttcattaaataaatttg

SEQ ID NO: 1545481 - DNA, 12 bp, Homo sapiens
agtttttcattt

SEQ ID NO: 1545482 - DNA, 16 bp, Homo sapiens
agtttttcatttgttt

SEQ ID NO: 1545483 - DNA, 13 bp, Homo sapiens
agtttttcctgga

SEQ ID NO: 1545484 - DNA, 23 bp, Homo sapiens
agtttttctgttttgtttggcaa

SEQ ID NO: 1545485 - DNA, 13 bp, Homo sapiens
agtttttgaaaat

SEQ ID NO: 1545486 - DNA, 16 bp, Homo sapiens
agtttttgtaatttat

SEQ ID NO: 1545487 - DNA, 16 bp, Homo sapiens
agttttttgttttaca

SEQ ID NO: 1545488 - DNA, 15 bp, Homo sapiens
agtttttttctttgt

SEQ ID NO: 1545489 - DNA, 14 bp, Homo sapiens
agttttttttgtaa

SEQ ID NO: 1545490 - DNA, 16 bp, Homo sapiens
agttttttttgtaaac

SEQ ID NO: 1545491 - DNA, 15 bp, Homo sapiens
agttttttttgtttg

SEQ ID NO: 1545492 - DNA, 18 bp, Homo sapiens
agttttttttgtttgcct

SEQ ID NO: 1545493 - DNA, 17 bp, Homo sapiens
ataaaaaaaagaaatga

SEQ ID NO: 1545494 - DNA, 14 bp, Homo sapiens
ataaaaaagaaatc

SEQ ID NO: 1545495 - DNA, 15 bp, Homo sapiens
ataaaaaagatccca

SEQ ID NO: 1545496 - DNA, 21 bp, Homo sapiens
ataaaaaataatctatttcta

SEQ ID NO: 1545497 - DNA, 12 bp, Homo sapiens
ataaaaaatgga

SEQ ID NO: 1545498 - DNA, 15 bp, Homo sapiens
ataaaaaatgtaaca

SEQ ID NO: 1545499 - DNA, 18 bp, Homo sapiens
ataaaaacaactttcact

SEQ ID NO: 1545500 - DNA, 16 bp, Homo sapiens
ataaaaacaatccttt

SEQ ID NO: 1545501 - DNA, 13 bp, Homo sapiens
ataaaaaccctgt

SEQ ID NO: 1545502 - DNA, 16 bp, Homo sapiens
ataaaaactgatttgc

SEQ ID NO: 1545503 - DNA, 11 bp, Homo sapiens
ataaaaagaaa

SEQ ID NO: 1545504 - DNA, 13 bp, Homo sapiens
ataaaaagaaaaa

SEQ ID NO: 1545505 - DNA, 14 bp, Homo sapiens
ataaaaagatcact

SEQ ID NO: 1545506 - DNA, 18 bp, Homo sapiens
ataaaaagcagaatttta

SEQ ID NO: 1545507 - DNA, 14 bp, Homo sapiens
ataaaaagcctctt

SEQ ID NO: 1545508 - DNA, 11 bp, Homo sapiens
ataaaaaggaa

SEQ ID NO: 1545509 - DNA, 21 bp, Homo sapiens
ataaaaagtttcacaggtcaa

SEQ ID NO: 1545510 - DNA, 14 bp, Homo sapiens
ataaaaataaaaaa

SEQ ID NO: 1545511 - DNA, 13 bp, Homo sapiens
ataaaaataaatt

SEQ ID NO: 1545512 - DNA, 22 bp, Homo sapiens
ataaaaataaatttggttctaa

SEQ ID NO: 1545513 - DNA, 14 bp, Homo sapiens
ataaaaatacacat

SEQ ID NO: 1545514 - DNA, 16 bp, Homo sapiens
ataaaaatacacatga

SEQ ID NO: 1545515 - DNA, 17 bp, Homo sapiens
ataaaaatacacatgaa

SEQ ID NO: 1545516 - DNA, 15 bp, Homo sapiens
ataaaaatatgtaat

SEQ ID NO: 1545517 - DNA, 12 bp, Homo sapiens
ataaaaatgaaa

SEQ ID NO: 1545518 - DNA, 22 bp, Homo sapiens
ataaaaatgtctcagcaacagt

SEQ ID NO: 1545519 - DNA, 14 bp, Homo sapiens
ataaaaatgtcttg

SEQ ID NO: 1545520 - DNA, 12 bp, Homo sapiens
ataaaaatgttt

SEQ ID NO: 1545521 - DNA, 15 bp, Homo sapiens
ataaaacaataaatg

SEQ ID NO: 1545522 - DNA, 15 bp, Homo sapiens
ataaaactgtgacta

SEQ ID NO: 1545523 - DNA, 21 bp, Homo sapiens
ataaaactgtgactaggcata

SEQ ID NO: 1545524 - DNA, 17 bp, Homo sapiens
ataaaagataaattatt

SEQ ID NO: 1545525 - DNA, 16 bp, Homo sapiens
ataaaagcagcatctg

SEQ ID NO: 1545526 - DNA, 20 bp, Homo sapiens
ataaaaggcttgaagctgtg

SEQ ID NO: 1545527 - DNA, 18 bp, Homo sapiens
ataaaatacatagtgaaa

SEQ ID NO: 1545528 - DNA, 22 bp, Homo sapiens
ataaaatagatataaattttta

SEQ ID NO: 1545529 - DNA, 20 bp, Homo sapiens
ataaaatatcataaagcatt

SEQ ID NO: 1545530 - DNA, 14 bp, Homo sapiens
ataaaatatcctca

SEQ ID NO: 1545531 - DNA, 15 bp, Homo sapiens
ataaaatatcctcag

SEQ ID NO: 1545532 - DNA, 18 bp, Homo sapiens
ataaaatattcactctcc

SEQ ID NO: 1545533 - DNA, 22 bp, Homo sapiens
ataaaatcataagtatttggaa

SEQ ID NO: 1545534 - DNA, 12 bp, Homo sapiens
ataaaatctgaa

SEQ ID NO: 1545535 - DNA, 11 bp, Homo sapiens
ataaaatctgt

SEQ ID NO: 1545536 - DNA, 14 bp, Homo sapiens
ataaaatgaacatc

SEQ ID NO: 1545537 - DNA, 18 bp, Homo sapiens
ataaaatgaacatctctt

SEQ ID NO: 1545538 - DNA, 11 bp, Homo sapiens
ataaaatgtac

SEQ ID NO: 1545539 - DNA, 18 bp, Homo sapiens
ataaaatgtttcattatg

SEQ ID NO: 1545540 - DNA, 15 bp, Homo sapiens
ataaaattaaatgcc

SEQ ID NO: 1545541 - DNA, 16 bp, Homo sapiens
ataaaattaaatgcct

SEQ ID NO: 1545542 - DNA, 23 bp, Homo sapiens
ataaaattaaatgccttgtataa

SEQ ID NO: 1545543 - DNA, 16 bp, Homo sapiens
ataaaattcatttcta

SEQ ID NO: 1545544 - DNA, 13 bp, Homo sapiens
ataaaattcgctt

SEQ ID NO: 1545545 - DNA, 17 bp, Homo sapiens
ataaaattcgctttcta

SEQ ID NO: 1545546 - DNA, 13 bp, Homo sapiens
ataaaatttaatt

SEQ ID NO: 1545547 - DNA, 15 bp, Homo sapiens
ataaaatttacattt

SEQ ID NO: 1545548 - DNA, 18 bp, Homo sapiens
ataaaatttgataaacat

SEQ ID NO: 1545549 - DNA, 14 bp, Homo sapiens
ataaaattttgctt

SEQ ID NO: 1545550 - DNA, 16 bp, Homo sapiens
ataaacaacttaatgt

SEQ ID NO: 1545551 - DNA, 19 bp, Homo sapiens
ataaacaataaaaacaact

SEQ ID NO: 1545552 - DNA, 17 bp, Homo sapiens
ataaacacaggcaggta

SEQ ID NO: 1545553 - DNA, 19 bp, Homo sapiens
ataaacacaggcaggtact

SEQ ID NO: 1545554 - DNA, 21 bp, Homo sapiens
ataaacactgttttatagaaa

SEQ ID NO: 1545555 - DNA, 13 bp, Homo sapiens
ataaacagaaatg

SEQ ID NO: 1545556 - DNA, 19 bp, Homo sapiens
ataaacagacaatatgtga

SEQ ID NO: 1545557 - DNA, 15 bp, Homo sapiens
ataaacaggaatttt

SEQ ID NO: 1545558 - DNA, 17 bp, Homo sapiens
ataaacaggaattttat

SEQ ID NO: 1545559 - DNA, 22 bp, Homo sapiens
ataaacagtggaatataaggaa

SEQ ID NO: 1545560 - DNA, 20 bp, Homo sapiens
gagtcataaaccttaagtaa

SEQ ID NO: 1545561 - DNA, 22 bp, Homo sapiens
gagtcatctgttagggccttgg

SEQ ID NO: 1545562 - DNA, 15 bp, Homo sapiens
gagtccattctccca

SEQ ID NO: 1545563 - DNA, 14 bp, Homo sapiens
gagtcccaaggaaa

SEQ ID NO: 1545564 - DNA, 12 bp, Homo sapiens
gagtcccagagc

SEQ ID NO: 1545565 - DNA, 18 bp, Homo sapiens
gagtcccagagcaggagg

SEQ ID NO: 1545566 - DNA, 19 bp, Homo sapiens
gagtcccagagcaggaggc

SEQ ID NO: 1545567 - DNA, 19 bp, Homo sapiens
gagtcccaggagctgccca

SEQ ID NO: 1545568 - DNA, 19 bp, Homo sapiens
gagtcccctcacctcctct

SEQ ID NO: 1545569 - DNA, 18 bp, Homo sapiens
gagtcccctccccggccc

SEQ ID NO: 1545570 - DNA, 23 bp, Homo sapiens
gagtcccctcctccagccgctgg

SEQ ID NO: 1545571 - DNA, 13 bp, Homo sapiens
gagtccctccaaa

SEQ ID NO: 1545572 - DNA, 24 bp, Homo sapiens
gagtccctgtgatggccaggccag

SEQ ID NO: 1545573 - DNA, 14 bp, Homo sapiens
gagtccggatttct

SEQ ID NO: 1545574 - DNA, 20 bp, Homo sapiens
gagtccgtggttgccctaga

SEQ ID NO: 1545575 - DNA, 16 bp, Homo sapiens
gagtcctcactcccag

SEQ ID NO: 1545576 - DNA, 20 bp, Homo sapiens
gagtcctcattgaatcctca

SEQ ID NO: 1545577 - DNA, 19 bp, Homo sapiens
gagtcctctagcaggccta

SEQ ID NO: 1545578 - DNA, 19 bp, Homo sapiens
gagtcctggtttcctggca

SEQ ID NO: 1545579 - DNA, 13 bp, Homo sapiens
gagtcctgtctct

SEQ ID NO: 1545580 - DNA, 14 bp, Homo sapiens
gagtcctgtctctg

SEQ ID NO: 1545581 - DNA, 17 bp, Homo sapiens
gagtcctgtctctgcct

SEQ ID NO: 1545582 - DNA, 16 bp, Homo sapiens
gagtcctgttcttcct

SEQ ID NO: 1545583 - DNA, 18 bp, Homo sapiens
gagtcggccccacatggg

SEQ ID NO: 1545584 - DNA, 20 bp, Homo sapiens
gagtcgtcactctctattgt

SEQ ID NO: 1545585 - DNA, 18 bp, Homo sapiens
gagtcgtggggtgtgctg

SEQ ID NO: 1545586 - DNA, 20 bp, Homo sapiens
gagtcgtggggtgtgctggg

SEQ ID NO: 1545587 - DNA, 22 bp, Homo sapiens
gagtctaaagatggagtttcta

SEQ ID NO: 1545588 - DNA, 16 bp, Homo sapiens
gagtctagatgtttat

SEQ ID NO: 1545589 - DNA, 21 bp, Homo sapiens
gagtctagattcaaaggttct

SEQ ID NO: 1545590 - DNA, 23 bp, Homo sapiens
gagtctagattcaaaggttctag

SEQ ID NO: 1545591 - DNA, 22 bp, Homo sapiens
gagtctatcctagtcttcacaa

SEQ ID NO: 1545592 - DNA, 17 bp, Homo sapiens
gagtctatgttcaaaga

SEQ ID NO: 1545593 - DNA, 19 bp, Homo sapiens
gagtctatgttcaaagact

SEQ ID NO: 1545594 - DNA, 12 bp, Homo sapiens
gagtctcagagc

SEQ ID NO: 1545595 - DNA, 15 bp, Homo sapiens
gagtctcctctctga

SEQ ID NO: 1545596 - DNA, 17 bp, Homo sapiens
gagtctcctctctgaga

SEQ ID NO: 1545597 - DNA, 20 bp, Homo sapiens
gagtctctcactgtcgccca

SEQ ID NO: 1545598 - DNA, 13 bp, Homo sapiens
gagtctgagcccc

SEQ ID NO: 1545599 - DNA, 13 bp, Homo sapiens
gagtctgagtcct

SEQ ID NO: 1545600 - DNA, 12 bp, Homo sapiens
gagtctgccact

SEQ ID NO: 1545601 - DNA, 23 bp, Homo sapiens
gagtctggtgaagctcacttctg

SEQ ID NO: 1545602 - DNA, 12 bp, Homo sapiens
gagtctgtctca

SEQ ID NO: 1545603 - DNA, 14 bp, Homo sapiens
gagtcttcagaccc

SEQ ID NO: 1545604 - DNA, 21 bp, Homo sapiens
gagtcttcagacccagagaag

SEQ ID NO: 1545605 - DNA, 13 bp, Homo sapiens
gagtcttggttct

SEQ ID NO: 1545606 - DNA, 18 bp, Homo sapiens
gagtctttggttctaagg

SEQ ID NO: 1545607 - DNA, 22 bp, Homo sapiens
gagtctttggttctaaggacct

SEQ ID NO: 1545608 - DNA, 20 bp, Homo sapiens
gagtgaaacctttagggcag

SEQ ID NO: 1545609 - DNA, 23 bp, Homo sapiens
gagtgaaacctttagggcagctt

SEQ ID NO: 1545610 - DNA, 18 bp, Homo sapiens
gagtgaaagggctatggc

SEQ ID NO: 1545611 - DNA, 16 bp, Homo sapiens
gagtgaagaggggcag

SEQ ID NO: 1545612 - DNA, 18 bp, Homo sapiens
gagtgaagaggggcagcc

SEQ ID NO: 1545613 - DNA, 16 bp, Homo sapiens
gagtgacagctttctg

SEQ ID NO: 1545614 - DNA, 16 bp, Homo sapiens
gagtgactacacacag

SEQ ID NO: 1545615 - DNA, 18 bp, Homo sapiens
gagtgagaccctgtctca

SEQ ID NO: 1545616 - DNA, 18 bp, Homo sapiens
gagtgagcaagggggccc

SEQ ID NO: 1545617 - DNA, 19 bp, Homo sapiens
gagtgagcacacccgtgtg

SEQ ID NO: 1545618 - DNA, 13 bp, Homo sapiens
gagtgagccacag

SEQ ID NO: 1545619 - DNA, 13 bp, Homo sapiens
gagtgagccagtg

SEQ ID NO: 1545620 - DNA, 20 bp, Homo sapiens
gagtgagctctggtggagac

SEQ ID NO: 1545621 - DNA, 23 bp, Homo sapiens
gagtgagctctggtggagacaaa

SEQ ID NO: 1545622 - DNA, 18 bp, Homo sapiens
gagtgaggcttccaggct

SEQ ID NO: 1545623 - DNA, 21 bp, Homo sapiens
gagtgagtcacctgctccaga

SEQ ID NO: 1545624 - DNA, 21 bp, Homo sapiens
gagtgataatctggtgacaaa

SEQ ID NO: 1545625 - DNA, 19 bp, Homo sapiens
gagtgatagtcttttgctt

SEQ ID NO: 1545626 - DNA, 15 bp, Homo sapiens
gagtgattagagctg

SEQ ID NO: 1545627 - DNA, 15 bp, Homo sapiens
gagtgattgcagctt

SEQ ID NO: 1545628 - DNA, 14 bp, Homo sapiens
gagtgcacagctgt

SEQ ID NO: 1545629 - DNA, 12 bp, Homo sapiens
gagtgcaggggc

SEQ ID NO: 1545630 - DNA, 13 bp, Homo sapiens
gagtgccaggacc

SEQ ID NO: 1545631 - DNA, 14 bp, Homo sapiens
gagtgccaggacca

SEQ ID NO: 1545632 - DNA, 18 bp, Homo sapiens
gagtgccaggaccagcct

SEQ ID NO: 1545633 - DNA, 20 bp, Homo sapiens
gagtgcccccagcccagagc

SEQ ID NO: 1545634 - DNA, 13 bp, Homo sapiens
gagtgcctggagt

SEQ ID NO: 1545635 - DNA, 14 bp, Homo sapiens
gagtgccttttgca

SEQ ID NO: 1545636 - DNA, 23 bp, Homo sapiens
gagtgcgctcttggtccctggtc

SEQ ID NO: 1545637 - DNA, 14 bp, Homo sapiens
gagtggactgcatt

SEQ ID NO: 1545638 - DNA, 15 bp, Homo sapiens
gagtggactgcattt

SEQ ID NO: 1545639 - DNA, 13 bp, Homo sapiens
gagtggaggcatt

SEQ ID NO: 1545640 - DNA, 15 bp, Homo sapiens
gagtggagtctgagt

SEQ ID NO: 1545641 - DNA, 16 bp, Homo sapiens
gagtggataatcagga

SEQ ID NO: 1545642 - DNA, 13 bp, Homo sapiens
gagtggcagcagc

SEQ ID NO: 1545643 - DNA, 14 bp, Homo sapiens
gagtggcagcagcc

SEQ ID NO: 1545644 - DNA, 15 bp, Homo sapiens
gagtggcagcagccc

SEQ ID NO: 1545645 - DNA, 12 bp, Homo sapiens
gagtggcagcca

SEQ ID NO: 1545646 - DNA, 13 bp, Homo sapiens
gagtggcagccat

SEQ ID NO: 1545647 - DNA, 15 bp, Homo sapiens
gagtggcagccatgc

SEQ ID NO: 1545648 - DNA, 24 bp, Homo sapiens
gagtggcagccatgcctcatgcca

SEQ ID NO: 1545649 - DNA, 19 bp, Homo sapiens
gagtggcaggggacaggag

SEQ ID NO: 1545650 - DNA, 14 bp, Homo sapiens
gagtggcaggtggg

SEQ ID NO: 1545651 - DNA, 18 bp, Homo sapiens
gagtggcaggtgggctgc

SEQ ID NO: 1545652 - DNA, 11 bp, Homo sapiens
gagtggcctcc

SEQ ID NO: 1545653 - DNA, 15 bp, Homo sapiens
gagtggcctccctgc

SEQ ID NO: 1545654 - DNA, 13 bp, Homo sapiens
gagtggcctggcc

SEQ ID NO: 1545655 - DNA, 13 bp, Homo sapiens
gagtggctcctcc

SEQ ID NO: 1545656 - DNA, 14 bp, Homo sapiens
gagtggctgccgga

SEQ ID NO: 1545657 - DNA, 11 bp, Homo sapiens
gagtgggaagc

SEQ ID NO: 1545658 - DNA, 13 bp, Homo sapiens
gagtgggaagccc

SEQ ID NO: 1545659 - DNA, 14 bp, Homo sapiens
gagtgggtgggatg

SEQ ID NO: 1545660 - DNA, 14 bp, Homo sapiens
gagtggtctttctg

SEQ ID NO: 1545661 - DNA, 14 bp, Homo sapiens
gagtggtgccctgg

SEQ ID NO: 1545662 - DNA, 15 bp, Homo sapiens
gagtggttcctgtgg

SEQ ID NO: 1545663 - DNA, 16 bp, Homo sapiens
gagtggttctcatttg

SEQ ID NO: 1545664 - DNA, 13 bp, Homo sapiens
gagtgtaactttc

SEQ ID NO: 1545665 - DNA, 17 bp, Homo sapiens
gagtgtaagtgtgagta

SEQ ID NO: 1545666 - DNA, 20 bp, Homo sapiens
gagtgtaagtgtgagtaaga

SEQ ID NO: 1545667 - DNA, 18 bp, Homo sapiens
gagtgtagcctaaagggc

SEQ ID NO: 1545668 - DNA, 13 bp, Homo sapiens
gagtgtatgagta

SEQ ID NO: 1545669 - DNA, 20 bp, Homo sapiens
gagtgtcatgaagtgcacag

SEQ ID NO: 1545670 - DNA, 19 bp, Homo sapiens
gagtgtcctcttccctctc

SEQ ID NO: 1545671 - DNA, 18 bp, Homo sapiens
gagtgtcggatcctgtga

SEQ ID NO: 1545672 - DNA, 19 bp, Homo sapiens
gagtgtcggatcctgtgag

SEQ ID NO: 1545673 - DNA, 16 bp, Homo sapiens
gagtgtgcagacagcc

SEQ ID NO: 1545674 - DNA, 14 bp, Homo sapiens
gagtgtgtctgctg

SEQ ID NO: 1545675 - DNA, 14 bp, Homo sapiens
gagtgtgtgggcag

SEQ ID NO: 1545676 - DNA, 16 bp, Homo sapiens
gagtgtgtggtctctg

SEQ ID NO: 1545677 - DNA, 19 bp, Homo sapiens
gagtgtgtggtctctgccc

SEQ ID NO: 1545678 - DNA, 16 bp, Homo sapiens
ataaacatcagtttct

SEQ ID NO: 1545679 - DNA, 18 bp, Homo sapiens
ataaaccacttgagccta

SEQ ID NO: 1545680 - DNA, 13 bp, Homo sapiens
ataaaccattcca

SEQ ID NO: 1545681 - DNA, 15 bp, Homo sapiens
ataaacctaatattc

SEQ ID NO: 1545682 - DNA, 17 bp, Homo sapiens
ataaacctaatattcaa

SEQ ID NO: 1545683 - DNA, 12 bp, Homo sapiens
ataaacgaccaa

SEQ ID NO: 1545684 - DNA, 15 bp, Homo sapiens
ataaacgaccaaact

SEQ ID NO: 1545685 - DNA, 14 bp, Homo sapiens
ataaactaagagaa

SEQ ID NO: 1545686 - DNA, 21 bp, Homo sapiens
ataaactaccaaattagtgaa

SEQ ID NO: 1545687 - DNA, 14 bp, Homo sapiens
ataaactaggtaaa

SEQ ID NO: 1545688 - DNA, 15 bp, Homo sapiens
ataaactagtttcca

SEQ ID NO: 1545689 - DNA, 17 bp, Homo sapiens
ataaactagtttccagt

SEQ ID NO: 1545690 - DNA, 15 bp, Homo sapiens
ataaactataaactt

SEQ ID NO: 1545691 - DNA, 23 bp, Homo sapiens
ataaactatttatatcacacaat

SEQ ID NO: 1545692 - DNA, 13 bp, Homo sapiens
ataaactgagcct

SEQ ID NO: 1545693 - DNA, 16 bp, Homo sapiens
ataaacttagaggaaa

SEQ ID NO: 1545694 - DNA, 17 bp, Homo sapiens
ataaacttggattctct

SEQ ID NO: 1545695 - DNA, 16 bp, Homo sapiens
ataaactttaatataa

SEQ ID NO: 1545696 - DNA, 22 bp, Homo sapiens
ataaactttaatataaagtagt

SEQ ID NO: 1545697 - DNA, 21 bp, Homo sapiens
ataaagaaaagacattttaag

SEQ ID NO: 1545698 - DNA, 12 bp, Homo sapiens
ataaagaagaaa

SEQ ID NO: 1545699 - DNA, 17 bp, Homo sapiens
ataaagaagaaaataac

SEQ ID NO: 1545700 - DNA, 18 bp, Homo sapiens
ataaagaagaaaataacc

SEQ ID NO: 1545701 - DNA, 17 bp, Homo sapiens
ataaagacaacaaaaga

SEQ ID NO: 1545702 - DNA, 18 bp, Homo sapiens
ataaagacaacaaaagaa

SEQ ID NO: 1545703 - DNA, 20 bp, Homo sapiens
ataaagacaatcactgccaa

SEQ ID NO: 1545704 - DNA, 16 bp, Homo sapiens
ataaagacctataaat

SEQ ID NO: 1545705 - DNA, 16 bp, Homo sapiens
ataaagaggcatcttt

SEQ ID NO: 1545706 - DNA, 15 bp, Homo sapiens
ataaagataaaatat

SEQ ID NO: 1545707 - DNA, 21 bp, Homo sapiens
ataaagataacccttattcca

SEQ ID NO: 1545708 - DNA, 11 bp, Homo sapiens
ataaagatgat

SEQ ID NO: 1545709 - DNA, 23 bp, Homo sapiens
ataaagatgatctactcagaaat

SEQ ID NO: 1545710 - DNA, 13 bp, Homo sapiens
ataaagatgtgaa

SEQ ID NO: 1545711 - DNA, 15 bp, Homo sapiens
ataaagatgttaaaa

SEQ ID NO: 1545712 - DNA, 14 bp, Homo sapiens
ataaagattgtact

SEQ ID NO: 1545713 - DNA, 16 bp, Homo sapiens
ataaagattgtactta

SEQ ID NO: 1545714 - DNA, 12 bp, Homo sapiens
ataaagcaaata

SEQ ID NO: 1545715 - DNA, 16 bp, Homo sapiens
ataaagcaatgtgttt

SEQ ID NO: 1545716 - DNA, 17 bp, Homo sapiens
ataaagcattactcttt

SEQ ID NO: 1545717 - DNA, 16 bp, Homo sapiens
ataaagcattctttaa

SEQ ID NO: 1545718 - DNA, 17 bp, Homo sapiens
ataaagcctttgtatct

SEQ ID NO: 1545719 - DNA, 12 bp, Homo sapiens
ataaagctgtta

SEQ ID NO: 1545720 - DNA, 20 bp, Homo sapiens
ataaagctgttattcttgtt

SEQ ID NO: 1545721 - DNA, 23 bp, Homo sapiens
ataaagctgttattcttgttata

SEQ ID NO: 1545722 - DNA, 16 bp, Homo sapiens
ataaagcttttggaag

SEQ ID NO: 1545723 - DNA, 11 bp, Homo sapiens
ataaaggcagc

SEQ ID NO: 1545724 - DNA, 13 bp, Homo sapiens
ataaaggcagctg

SEQ ID NO: 1545725 - DNA, 16 bp, Homo sapiens
ataaaggcagctgcct

SEQ ID NO: 1545726 - DNA, 19 bp, Homo sapiens
ataaaggccccaaatacca

SEQ ID NO: 1545727 - DNA, 18 bp, Homo sapiens
ataaagggcccacacctg

SEQ ID NO: 1545728 - DNA, 19 bp, Homo sapiens
ataaagggcccacacctgg

SEQ ID NO: 1545729 - DNA, 21 bp, Homo sapiens
ataaaggttgacaataaatgt

SEQ ID NO: 1545730 - DNA, 12 bp, Homo sapiens
ataaagtacaaa

SEQ ID NO: 1545731 - DNA, 23 bp, Homo sapiens
ataaagtacaaatgaagaaagtc

SEQ ID NO: 1545732 - DNA, 17 bp, Homo sapiens
ataaagtagtcctgtga

SEQ ID NO: 1545733 - DNA, 14 bp, Homo sapiens
ataaagtatatatt

SEQ ID NO: 1545734 - DNA, 19 bp, Homo sapiens
ataaagtcacttccagtgt

SEQ ID NO: 1545735 - DNA, 14 bp, Homo sapiens
ataaagtctaagca

SEQ ID NO: 1545736 - DNA, 21 bp, Homo sapiens
ataaagtctaagcaagatgtt

SEQ ID NO: 1545737 - DNA, 22 bp, Homo sapiens
ataaagtctaagcaagatgttt

SEQ ID NO: 1545738 - DNA, 16 bp, Homo sapiens
ataaagttgtattgca

SEQ ID NO: 1545739 - DNA, 16 bp, Homo sapiens
ataaagtttacaagcg

SEQ ID NO: 1545740 - DNA, 15 bp, Homo sapiens
ataaataaaaatgca

SEQ ID NO: 1545741 - DNA, 17 bp, Homo sapiens
ataaataaaaatgcatt

SEQ ID NO: 1545742 - DNA, 18 bp, Homo sapiens
ataaataaagaagaaaat

SEQ ID NO: 1545743 - DNA, 20 bp, Homo sapiens
ataaataaagaagaaaataa

SEQ ID NO: 1545744 - DNA, 21 bp, Homo sapiens
ataaataaagaagaaaataac

SEQ ID NO: 1545745 - DNA, 22 bp, Homo sapiens
ataaataaagaagaaaataacc

SEQ ID NO: 1545746 - DNA, 20 bp, Homo sapiens
ataaataacccataattgaa

SEQ ID NO: 1545747 - DNA, 15 bp, Homo sapiens
ataaataatcacaca

SEQ ID NO: 1545748 - DNA, 15 bp, Homo sapiens
ataaataatctgtac

SEQ ID NO: 1545749 - DNA, 19 bp, Homo sapiens
ataaatacaaaaatgaata

SEQ ID NO: 1545750 - DNA, 20 bp, Homo sapiens
ataaatacaaaaatgaatac

SEQ ID NO: 1545751 - DNA, 13 bp, Homo sapiens
ataaatacatata

SEQ ID NO: 1545752 - DNA, 22 bp, Homo sapiens
ataaatagggaagatggagaca

SEQ ID NO: 1545753 - DNA, 23 bp, Homo sapiens
ataaatatataaaaagaaaagat

SEQ ID NO: 1545754 - DNA, 13 bp, Homo sapiens
ataaatatatcta

SEQ ID NO: 1545755 - DNA, 14 bp, Homo sapiens
ataaatatcagtat

SEQ ID NO: 1545756 - DNA, 15 bp, Homo sapiens
ataaatcaatgtcac

SEQ ID NO: 1545757 - DNA, 15 bp, Homo sapiens
ataaatcagtatttt

SEQ ID NO: 1545758 - DNA, 23 bp, Homo sapiens
ataaatccagtgacctctctctc

SEQ ID NO: 1545759 - DNA, 21 bp, Homo sapiens
ataaatctaataattattcat

SEQ ID NO: 1545760 - DNA, 15 bp, Homo sapiens
ataaatctaggatgt

SEQ ID NO: 1545761 - DNA, 14 bp, Homo sapiens
ataaatctcttctt

SEQ ID NO: 1545762 - DNA, 16 bp, Homo sapiens
ataaatctgacccagt

SEQ ID NO: 1545763 - DNA, 19 bp, Homo sapiens
ataaatctgtctgattcta

SEQ ID NO: 1545764 - DNA, 17 bp, Homo sapiens
ataaatgaagcagcttt

SEQ ID NO: 1545765 - DNA, 20 bp, Homo sapiens
ataaatgaagcagctttaaa

SEQ ID NO: 1545766 - DNA, 17 bp, Homo sapiens
ataaatgaatgaataac

SEQ ID NO: 1545767 - DNA, 20 bp, Homo sapiens
ataaatgagctatgtattaa

SEQ ID NO: 1545768 - DNA, 19 bp, Homo sapiens
ataaatgattatattcaca

SEQ ID NO: 1545769 - DNA, 13 bp, Homo sapiens
ataaatggctggt

SEQ ID NO: 1545770 - DNA, 20 bp, Homo sapiens
ataaatgtataaatatacag

SEQ ID NO: 1545771 - DNA, 19 bp, Homo sapiens
ataaatgtgccttcatttt

SEQ ID NO: 1545772 - DNA, 19 bp, Homo sapiens
ataaatgttacctaattat

SEQ ID NO: 1545773 - DNA, 14 bp, Homo sapiens
ataaattactatct

SEQ ID NO: 1545774 - DNA, 13 bp, Homo sapiens
ataaattactgtt

SEQ ID NO: 1545775 - DNA, 23 bp, Homo sapiens
ataaattagatttggcatctcct

SEQ ID NO: 1545776 - DNA, 13 bp, Homo sapiens
ataaattataagt

SEQ ID NO: 1545777 - DNA, 17 bp, Homo sapiens
ataaattatggcatttc

SEQ ID NO: 1545778 - DNA, 18 bp, Homo sapiens
ataaattatggcatttct

SEQ ID NO: 1545779 - DNA, 13 bp, Homo sapiens
ataaattcaaaac

SEQ ID NO: 1545780 - DNA, 20 bp, Homo sapiens
ataaattcaactttgtaaaa

SEQ ID NO: 1545781 - DNA, 22 bp, Homo sapiens
ataaattcagatatatttttca

SEQ ID NO: 1545782 - DNA, 15 bp, Homo sapiens
ataaattccactgga

SEQ ID NO: 1545783 - DNA, 18 bp, Homo sapiens
ataaattcctaaactccc

SEQ ID NO: 1545784 - DNA, 16 bp, Homo sapiens
ataaattctataggaa

SEQ ID NO: 1545785 - DNA, 15 bp, Homo sapiens
ataaattggattatt

SEQ ID NO: 1545786 - DNA, 19 bp, Homo sapiens
ataaatttaataaatattg

SEQ ID NO: 1545787 - DNA, 20 bp, Homo sapiens
ataaatttaataaatattga

SEQ ID NO: 1545788 - DNA, 13 bp, Homo sapiens
ataaatttcccag

SEQ ID NO: 1545789 - DNA, 12 bp, Homo sapiens
ataaatttgact

SEQ ID NO: 1545790 - DNA, 21 bp, Homo sapiens
ataaatttgacttttctgtaa

SEQ ID NO: 1545791 - DNA, 20 bp, Homo sapiens
ataaatttggttctaataga

SEQ ID NO: 1545792 - DNA, 15 bp, Homo sapiens
ataaattttttataa

SEQ ID NO: 1545793 - DNA, 15 bp, Homo sapiens
ataacaaaaaataaa

SEQ ID NO: 1545794 - DNA, 23 bp, Homo sapiens
ataacaaagaacctaacatttat

SEQ ID NO: 1545795 - DNA, 17 bp, Homo sapiens
gagtgtgtttgtcaccg

SEQ ID NO: 1545796 - DNA, 18 bp, Homo sapiens
gagtgtttctaataaact

SEQ ID NO: 1545797 - DNA, 21 bp, Homo sapiens
gagttaaaatgtttactgtaa

SEQ ID NO: 1545798 - DNA, 23 bp, Homo sapiens
gagttaaaatgtttactgtaaat

SEQ ID NO: 1545799 - DNA, 22 bp, Homo sapiens
gagttaaatagagtatatgcac

SEQ ID NO: 1545800 - DNA, 20 bp, Homo sapiens
gagttaactgtgaaatacca

SEQ ID NO: 1545801 - DNA, 13 bp, Homo sapiens
gagttaagacctg

SEQ ID NO: 1545802 - DNA, 17 bp, Homo sapiens
gagttacaataaagttt

SEQ ID NO: 1545803 - DNA, 15 bp, Homo sapiens
gagttacagttctgt

SEQ ID NO: 1545804 - DNA, 17 bp, Homo sapiens
gagttacagttctgtgg

SEQ ID NO: 1545805 - DNA, 18 bp, Homo sapiens
gagttacttgtctgaggc

SEQ ID NO: 1545806 - DNA, 14 bp, Homo sapiens
gagttagaggccag

SEQ ID NO: 1545807 - DNA, 16 bp, Homo sapiens
gagttagaggccagcc

SEQ ID NO: 1545808 - DNA, 18 bp, Homo sapiens
gagttagaggccagcctg

SEQ ID NO: 1545809 - DNA, 18 bp, Homo sapiens
gagttagtttctttggga

SEQ ID NO: 1545810 - DNA, 20 bp, Homo sapiens
gagttatcatgaattttaaa

SEQ ID NO: 1545811 - DNA, 20 bp, Homo sapiens
gagttatgataacaccagtg

SEQ ID NO: 1545812 - DNA, 17 bp, Homo sapiens
gagttcaagaccagcct

SEQ ID NO: 1545813 - DNA, 18 bp, Homo sapiens
gagttcaagaccagcctg

SEQ ID NO: 1545814 - DNA, 18 bp, Homo sapiens
gagttcaagcctgtggga

SEQ ID NO: 1545815 - DNA, 22 bp, Homo sapiens
gagttcaataaatgtctgttga

SEQ ID NO: 1545816 - DNA, 19 bp, Homo sapiens
gagttcaccttggaagggc

SEQ ID NO: 1545817 - DNA, 20 bp, Homo sapiens
gagttccaagttgaagggaa

SEQ ID NO: 1545818 - DNA, 15 bp, Homo sapiens
gagttccagaaagta

SEQ ID NO: 1545819 - DNA, 14 bp, Homo sapiens
gagttcctctgggt

SEQ ID NO: 1545820 - DNA, 19 bp, Homo sapiens
gagttccttatccctctct

SEQ ID NO: 1545821 - DNA, 21 bp, Homo sapiens
gagttccttgatctgtatata

SEQ ID NO: 1545822 - DNA, 19 bp, Homo sapiens
gagttcgaggctgcagtca

SEQ ID NO: 1545823 - DNA, 22 bp, Homo sapiens
gagttcttagctatccttggct

SEQ ID NO: 1545824 - DNA, 19 bp, Homo sapiens
gagttcttgtgtcctggta

SEQ ID NO: 1545825 - DNA, 17 bp, Homo sapiens
gagttgagtctcctctc

SEQ ID NO: 1545826 - DNA, 22 bp, Homo sapiens
gagttgagtctcctctctgaga

SEQ ID NO: 1545827 - DNA, 17 bp, Homo sapiens
gagttgatctggaaccc

SEQ ID NO: 1545828 - DNA, 21 bp, Homo sapiens
gagttgatctggaacccagac

SEQ ID NO: 1545829 - DNA, 16 bp, Homo sapiens
gagttgattgtctagt

SEQ ID NO: 1545830 - DNA, 23 bp, Homo sapiens
gagttgattgtctagtgaggaag

SEQ ID NO: 1545831 - DNA, 18 bp, Homo sapiens
gagttgctgcaaacctga

SEQ ID NO: 1545832 - DNA, 20 bp, Homo sapiens
gagttggagtagaatgtagt

SEQ ID NO: 1545833 - DNA, 14 bp, Homo sapiens
gagttggctcaggc

SEQ ID NO: 1545834 - DNA, 23 bp, Homo sapiens
gagttgggggagggaagaccaga

SEQ ID NO: 1545835 - DNA, 18 bp, Homo sapiens
gagtttaatacaggaaat

SEQ ID NO: 1545836 - DNA, 20 bp, Homo sapiens
gagtttaccatttgtaataa

SEQ ID NO: 1545837 - DNA, 18 bp, Homo sapiens
gagtttatacagtgtaca

SEQ ID NO: 1545838 - DNA, 20 bp, Homo sapiens
gagtttatacagtgtacatg

SEQ ID NO: 1545839 - DNA, 23 bp, Homo sapiens
gagtttattacaatgtatcttta

SEQ ID NO: 1545840 - DNA, 18 bp, Homo sapiens
gagtttccactatcccaa

SEQ ID NO: 1545841 - DNA, 16 bp, Homo sapiens
gagtttctaaggtccg

SEQ ID NO: 1545842 - DNA, 20 bp, Homo sapiens
gagtttgagacaagccctgg

SEQ ID NO: 1545843 - DNA, 21 bp, Homo sapiens
gagtttgagacaagccctggc

SEQ ID NO: 1545844 - DNA, 20 bp, Homo sapiens
gagtttgagaccagcctggc

SEQ ID NO: 1545845 - DNA, 18 bp, Homo sapiens
gagtttgctattagagca

SEQ ID NO: 1545846 - DNA, 14 bp, Homo sapiens
gagtttgtattttg

SEQ ID NO: 1545847 - DNA, 22 bp, Homo sapiens
gagtttgtcgctcatgtgtgca

SEQ ID NO: 1545848 - DNA, 13 bp, Homo sapiens
gagtttgtgtctg

SEQ ID NO: 1545849 - DNA, 20 bp, Homo sapiens
gagtttgtgttgttgttgct

SEQ ID NO: 1545850 - DNA, 21 bp, Homo sapiens
gagttttgggaagttaaaggg

SEQ ID NO: 1545851 - DNA, 16 bp, Homo sapiens
gagttttgtcattcag

SEQ ID NO: 1545852 - DNA, 15 bp, Homo sapiens
gagttttgtctgtct

SEQ ID NO: 1545853 - DNA, 15 bp, Homo sapiens
gagttttgtgtttgt

SEQ ID NO: 1545854 - DNA, 16 bp, Homo sapiens
gagtttttaaagcctt

SEQ ID NO: 1545855 - DNA, 22 bp, Homo sapiens
gataaaagcaattctgactgtc

SEQ ID NO: 1545856 - DNA, 14 bp, Homo sapiens
gataaaataaatga

SEQ ID NO: 1545857 - DNA, 18 bp, Homo sapiens
gataaacacaggcaggta

SEQ ID NO: 1545858 - DNA, 19 bp, Homo sapiens
gataaacattaaacactgt

SEQ ID NO: 1545859 - DNA, 18 bp, Homo sapiens
gataaactgatgtttgaa

SEQ ID NO: 1545860 - DNA, 17 bp, Homo sapiens
gataaagaaaaaaatac

SEQ ID NO: 1545861 - DNA, 13 bp, Homo sapiens
gataaagaaaaga

SEQ ID NO: 1545862 - DNA, 18 bp, Homo sapiens
gatatatgctctgcatgt

SEQ ID NO: 1545863 - DNA, 17 bp, Homo sapiens
gatatatttttaagata

SEQ ID NO: 1545864 - DNA, 14 bp, Homo sapiens
gatatcaacagctt

SEQ ID NO: 1545865 - DNA, 12 bp, Homo sapiens
gatatcacctct

SEQ ID NO: 1545866 - DNA, 18 bp, Homo sapiens
gatatcacctctcttcag

SEQ ID NO: 1545867 - DNA, 18 bp, Homo sapiens
gatatcagagctcttaat

SEQ ID NO: 1545868 - DNA, 14 bp, Homo sapiens
gatatccatctttt

SEQ ID NO: 1545869 - DNA, 23 bp, Homo sapiens
gatatcgacttgtttttgcacat

SEQ ID NO: 1545870 - DNA, 16 bp, Homo sapiens
gatatctgaaaatatt

SEQ ID NO: 1545871 - DNA, 15 bp, Homo sapiens
gatatctgcatgtgt

SEQ ID NO: 1545872 - DNA, 18 bp, Homo sapiens
gatatgacccacactgcc

SEQ ID NO: 1545873 - DNA, 19 bp, Homo sapiens
gatatgacccacactgcca

SEQ ID NO: 1545874 - DNA, 21 bp, Homo sapiens
gatatgagttgttttcagact

SEQ ID NO: 1545875 - DNA, 14 bp, Homo sapiens
gatatgcaaaagct

SEQ ID NO: 1545876 - DNA, 20 bp, Homo sapiens
gatatgctgaacgcagaaga

SEQ ID NO: 1545877 - DNA, 22 bp, Homo sapiens
gatatggagtgagtcacctgct

SEQ ID NO: 1545878 - DNA, 23 bp, Homo sapiens
gatatggagtgagtcacctgctc

SEQ ID NO: 1545879 - DNA, 12 bp, Homo sapiens
gatatggctgcc

SEQ ID NO: 1545880 - DNA, 15 bp, Homo sapiens
gatatggctgcccag

SEQ ID NO: 1545881 - DNA, 16 bp, Homo sapiens
gatatggctgcccagg

SEQ ID NO: 1545882 - DNA, 23 bp, Homo sapiens
gatatgtatcataaaaataaaat

SEQ ID NO: 1545883 - DNA, 15 bp, Homo sapiens
gatatgtctgctgag

SEQ ID NO: 1545884 - DNA, 13 bp, Homo sapiens
gatattaaatttc

SEQ ID NO: 1545885 - DNA, 16 bp, Homo sapiens
gatattaaatttcaaa

SEQ ID NO: 1545886 - DNA, 14 bp, Homo sapiens
gatattaatcaaaa

SEQ ID NO: 1545887 - DNA, 12 bp, Homo sapiens
gatattatagaa

SEQ ID NO: 1545888 - DNA, 14 bp, Homo sapiens
gatattatagaaaa

SEQ ID NO: 1545889 - DNA, 18 bp, Homo sapiens
gatattattaatttttat

SEQ ID NO: 1545890 - DNA, 13 bp, Homo sapiens
gatattatttctt

SEQ ID NO: 1545891 - DNA, 19 bp, Homo sapiens
gatattatttcttctctta

SEQ ID NO: 1545892 - DNA, 18 bp, Homo sapiens
gatattccatgaatgtat

SEQ ID NO: 1545893 - DNA, 19 bp, Homo sapiens
gatattccatgaatgtatc

SEQ ID NO: 1545894 - DNA, 12 bp, Homo sapiens
gatattctaaga

SEQ ID NO: 1545895 - DNA, 13 bp, Homo sapiens
gatattctaagac

SEQ ID NO: 1545896 - DNA, 20 bp, Homo sapiens
gatattcttatttcactaaa

SEQ ID NO: 1545897 - DNA, 20 bp, Homo sapiens
gatattgaaggagaaaatag

SEQ ID NO: 1545898 - DNA, 12 bp, Homo sapiens
gatattgcctta

SEQ ID NO: 1545899 - DNA, 18 bp, Homo sapiens
gatattgctaattgtgta

SEQ ID NO: 1545900 - DNA, 18 bp, Homo sapiens
gatattggttcttcccct

SEQ ID NO: 1545901 - DNA, 17 bp, Homo sapiens
gatattgtacataaaag

SEQ ID NO: 1545902 - DNA, 22 bp, Homo sapiens
gatattgtcagagttctgctct

SEQ ID NO: 1545903 - DNA, 17 bp, Homo sapiens
gatattgttttctgtaa

SEQ ID NO: 1545904 - DNA, 22 bp, Homo sapiens
gatattgttttctgtaaataac

SEQ ID NO: 1545905 - DNA, 13 bp, Homo sapiens
gatatttaagaaa

SEQ ID NO: 1545906 - DNA, 16 bp, Homo sapiens
gatatttatatatatt

SEQ ID NO: 1545907 - DNA, 19 bp, Homo sapiens
gatatttccatttcttcct

SEQ ID NO: 1545908 - DNA, 22 bp, Homo sapiens
gatatttccatttcttcctcac

SEQ ID NO: 1545909 - DNA, 12 bp, Homo sapiens
gatatttcctaa

SEQ ID NO: 1545910 - DNA, 17 bp, Homo sapiens
gatatttcctaaggcat

SEQ ID NO: 1545911 - DNA, 23 bp, Homo sapiens
gatattttcaacgcagccctgct

SEQ ID NO: 1545912 - DNA, 21 bp, Homo sapiens
gatattttctgtgcctgaata

SEQ ID NO: 1545913 - DNA, 13 bp, Homo sapiens
gatatttttaaaa

SEQ ID NO: 1545914 - DNA, 15 bp, Homo sapiens
ataagttcatacatt

SEQ ID NO: 1545915 - DNA, 20 bp, Homo sapiens
ataagtttacacctttatct

SEQ ID NO: 1545916 - DNA, 16 bp, Homo sapiens
ataagtttctattctg

SEQ ID NO: 1545917 - DNA, 21 bp, Homo sapiens
ataagtttctattctgtcagt

SEQ ID NO: 1545918 - DNA, 13 bp, Homo sapiens
ataagtttgaagg

SEQ ID NO: 1545919 - DNA, 21 bp, Homo sapiens
ataagtttgaaggaaacagtt

SEQ ID NO: 1545920 - DNA, 19 bp, Homo sapiens
ataataaaaaattatgaca

SEQ ID NO: 1545921 - DNA, 17 bp, Homo sapiens
ataataaaaaatttcag

SEQ ID NO: 1545922 - DNA, 13 bp, Homo sapiens
ataataaaatagt

SEQ ID NO: 1545923 - DNA, 13 bp, Homo sapiens
ataataaaattat

SEQ ID NO: 1545924 - DNA, 20 bp, Homo sapiens
ataataaagatgtgaaaact

SEQ ID NO: 1545925 - DNA, 12 bp, Homo sapiens
ataataaatact

SEQ ID NO: 1545926 - DNA, 13 bp, Homo sapiens
ataataagctaaa

SEQ ID NO: 1545927 - DNA, 14 bp, Homo sapiens
ataataataataat

SEQ ID NO: 1545928 - DNA, 12 bp, Homo sapiens
ataatagaagaa

SEQ ID NO: 1545929 - DNA, 12 bp, Homo sapiens
ataatagattct

SEQ ID NO: 1545930 - DNA, 21 bp, Homo sapiens
ataataggtgggggaaaatga

SEQ ID NO: 1545931 - DNA, 23 bp, Homo sapiens
ataataggtgggggaaaatgaat

SEQ ID NO: 1545932 - DNA, 16 bp, Homo sapiens
ataatagtcaatttct

SEQ ID NO: 1545933 - DNA, 23 bp, Homo sapiens
ataatagtcaatttctacttctg

SEQ ID NO: 1545934 - DNA, 11 bp, Homo sapiens
ataatataaaa

SEQ ID NO: 1545935 - DNA, 14 bp, Homo sapiens
ataatatatatcta

SEQ ID NO: 1545936 - DNA, 22 bp, Homo sapiens
ataatatatgtttaccttttaa

SEQ ID NO: 1545937 - DNA, 14 bp, Homo sapiens
ataatatatttctt

SEQ ID NO: 1545938 - DNA, 13 bp, Homo sapiens
ataatatcaaata

SEQ ID NO: 1545939 - DNA, 17 bp, Homo sapiens
ataatatcaaataaaat

SEQ ID NO: 1545940 - DNA, 12 bp, Homo sapiens
ataatatgcaca

SEQ ID NO: 1545941 - DNA, 20 bp, Homo sapiens
ataatatgcacacagtgctt

SEQ ID NO: 1545942 - DNA, 23 bp, Homo sapiens
ataatatgtgccttaagttttag

SEQ ID NO: 1545943 - DNA, 18 bp, Homo sapiens
ataatattagtgattctg

SEQ ID NO: 1545944 - DNA, 20 bp, Homo sapiens
ataatattagtgattctgat

SEQ ID NO: 1545945 - DNA, 12 bp, Homo sapiens
ataatattcagc

SEQ ID NO: 1545946 - DNA, 16 bp, Homo sapiens
ataatattgaaaattg

SEQ ID NO: 1545947 - DNA, 21 bp, Homo sapiens
ataatattgaaaattgaaaag

SEQ ID NO: 1545948 - DNA, 21 bp, Homo sapiens
ataatattgtttggtaaatgt

SEQ ID NO: 1545949 - DNA, 16 bp, Homo sapiens
ataatatttcaagtgc

SEQ ID NO: 1545950 - DNA, 20 bp, Homo sapiens
ataatatttcaagtgcctag

SEQ ID NO: 1545951 - DNA, 19 bp, Homo sapiens
ataatatttttgtatttct

SEQ ID NO: 1545952 - DNA, 21 bp, Homo sapiens
ataatatttttgtatttctct

SEQ ID NO: 1545953 - DNA, 18 bp, Homo sapiens
ataatcaaagctacctgt

SEQ ID NO: 1545954 - DNA, 13 bp, Homo sapiens
ataatcaagattt

SEQ ID NO: 1545955 - DNA, 16 bp, Homo sapiens
ataatcaagattttag

SEQ ID NO: 1545956 - DNA, 17 bp, Homo sapiens
ataatcacacacacact

SEQ ID NO: 1545957 - DNA, 22 bp, Homo sapiens
ataatcactctaattaattgta

SEQ ID NO: 1545958 - DNA, 21 bp, Homo sapiens
ataatcagcaagaatttgatc

SEQ ID NO: 1545959 - DNA, 18 bp, Homo sapiens
ataatcaggaaaaatgag

SEQ ID NO: 1545960 - DNA, 23 bp, Homo sapiens
ataatcagtgactgaaaccattt

SEQ ID NO: 1545961 - DNA, 18 bp, Homo sapiens
ataatcatctctgtcaca

SEQ ID NO: 1545962 - DNA, 15 bp, Homo sapiens
ataatcccagcactt

SEQ ID NO: 1545963 - DNA, 23 bp, Homo sapiens
ataatctagtttacagaaaaatc

SEQ ID NO: 1545964 - DNA, 14 bp, Homo sapiens
ataatctcaaagga

SEQ ID NO: 1545965 - DNA, 21 bp, Homo sapiens
ataatctcaaaggagaaaaaa

SEQ ID NO: 1545966 - DNA, 20 bp, Homo sapiens
ataatctgtttttacgtatg

SEQ ID NO: 1545967 - DNA, 15 bp, Homo sapiens
ataatcttctgcctt

SEQ ID NO: 1545968 - DNA, 17 bp, Homo sapiens
ataatcttctgccttct

SEQ ID NO: 1545969 - DNA, 12 bp, Homo sapiens
ataatgaaaata

SEQ ID NO: 1545970 - DNA, 15 bp, Homo sapiens
ataatgaaataatca

SEQ ID NO: 1545971 - DNA, 17 bp, Homo sapiens
ataatgaattataacag

SEQ ID NO: 1545972 - DNA, 19 bp, Homo sapiens
ataatgaattataacagtt

SEQ ID NO: 1545973 - DNA, 23 bp, Homo sapiens
ataatgactgccctgtttctgtt

SEQ ID NO: 1545974 - DNA, 18 bp, Homo sapiens
ataatgccggtgagaata

SEQ ID NO: 1545975 - DNA, 17 bp, Homo sapiens
ataatgctaatttaaag

SEQ ID NO: 1545976 - DNA, 15 bp, Homo sapiens
ataatgctactgtct

SEQ ID NO: 1545977 - DNA, 19 bp, Homo sapiens
atacagtacggatttgtcc

SEQ ID NO: 1545978 - DNA, 23 bp, Homo sapiens
atacagtattatagacaaaagaa

SEQ ID NO: 1545979 - DNA, 17 bp, Homo sapiens
atacagtgcagagcctt

SEQ ID NO: 1545980 - DNA, 21 bp, Homo sapiens
atacagtgcagagccttctca

SEQ ID NO: 1545981 - DNA, 17 bp, Homo sapiens
atacagtgtacatgtac

SEQ ID NO: 1545982 - DNA, 22 bp, Homo sapiens
atacagttaacacaatgtgaat

SEQ ID NO: 1545983 - DNA, 13 bp, Homo sapiens
atacagttttcta

SEQ ID NO: 1545984 - DNA, 15 bp, Homo sapiens
atacagtttttgtaa

SEQ ID NO: 1545985 - DNA, 15 bp, Homo sapiens
atacataaaaaagtg

SEQ ID NO: 1545986 - DNA, 17 bp, Homo sapiens
atacataacttgatata

SEQ ID NO: 1545987 - DNA, 13 bp, Homo sapiens
atacataatacaa

SEQ ID NO: 1545988 - DNA, 22 bp, Homo sapiens
atacataggtctgtatggctgt

SEQ ID NO: 1545989 - DNA, 16 bp, Homo sapiens
atacatagtgaaaatt

SEQ ID NO: 1545990 - DNA, 13 bp, Homo sapiens
atacatatatata

SEQ ID NO: 1545991 - DNA, 21 bp, Homo sapiens
atacatatgagaatatacctt

SEQ ID NO: 1545992 - DNA, 20 bp, Homo sapiens
atacatggttgtgacctgag

SEQ ID NO: 1545993 - DNA, 15 bp, Homo sapiens
atacatgtgtacata

SEQ ID NO: 1545994 - DNA, 23 bp, Homo sapiens
atacatgtgtacatatatgtata

SEQ ID NO: 1545995 - DNA, 21 bp, Homo sapiens
atacatgtttatgtaaacaaa

SEQ ID NO: 1545996 - DNA, 17 bp, Homo sapiens
atacattaacggtgcta

SEQ ID NO: 1545997 - DNA, 13 bp, Homo sapiens
atacattatttct

SEQ ID NO: 1545998 - DNA, 15 bp, Homo sapiens
atacattccattgtt

SEQ ID NO: 1545999 - DNA, 21 bp, Homo sapiens
atacattgtacgaagagtatt

SEQ ID NO: 1546000 - DNA, 22 bp, Homo sapiens
atacattgtcttgatgtttttt

SEQ ID NO: 1546001 - DNA, 23 bp, Homo sapiens
atacattgtcttgatgttttttc

SEQ ID NO: 1546002 - DNA, 17 bp, Homo sapiens
atacattgtgtgaaaaa

SEQ ID NO: 1546003 - DNA, 11 bp, Homo sapiens
atacatttaat

SEQ ID NO: 1546004 - DNA, 16 bp, Homo sapiens
atacatttaataaaac

SEQ ID NO: 1546005 - DNA, 23 bp, Homo sapiens
atacatttgtaagtgtaaaaaat

SEQ ID NO: 1546006 - DNA, 12 bp, Homo sapiens
atacatttgtat

SEQ ID NO: 1546007 - DNA, 15 bp, Homo sapiens
atacatttgtattta

SEQ ID NO: 1546008 - DNA, 15 bp, Homo sapiens
atacatttgtatttt

SEQ ID NO: 1546009 - DNA, 18 bp, Homo sapiens
atacattttctaaataaa

SEQ ID NO: 1546010 - DNA, 20 bp, Homo sapiens
atacattttttaagcttcag

SEQ ID NO: 1546011 - DNA, 18 bp, Homo sapiens
ataccaaggtacaactgt

SEQ ID NO: 1546012 - DNA, 14 bp, Homo sapiens
ataccaataaagtg

SEQ ID NO: 1546013 - DNA, 15 bp, Homo sapiens
ataccaataaagtga

SEQ ID NO: 1546014 - DNA, 20 bp, Homo sapiens
ataccaattacccataaaca

SEQ ID NO: 1546015 - DNA, 13 bp, Homo sapiens
ataccacaagcct

SEQ ID NO: 1546016 - DNA, 15 bp, Homo sapiens
ataccagaaagctct

SEQ ID NO: 1546017 - DNA, 17 bp, Homo sapiens
ataccagaaagctctac

SEQ ID NO: 1546018 - DNA, 12 bp, Homo sapiens
ataccagagcct

SEQ ID NO: 1546019 - DNA, 18 bp, Homo sapiens
ataccagcttagatttta

SEQ ID NO: 1546020 - DNA, 17 bp, Homo sapiens
ataccaggcaacctccc

SEQ ID NO: 1546021 - DNA, 11 bp, Homo sapiens
ataccagtgtt

SEQ ID NO: 1546022 - DNA, 22 bp, Homo sapiens
ataccattcagatcactgaatt

SEQ ID NO: 1546023 - DNA, 14 bp, Homo sapiens
atacccacccagaa

SEQ ID NO: 1546024 - DNA, 14 bp, Homo sapiens
ataccctccctccc

SEQ ID NO: 1546025 - DNA, 16 bp, Homo sapiens
ataccctccctcccta

SEQ ID NO: 1546026 - DNA, 22 bp, Homo sapiens
ataccctccctccctaccctaa

SEQ ID NO: 1546027 - DNA, 19 bp, Homo sapiens
ataccctggccgccccctg

SEQ ID NO: 1546028 - DNA, 16 bp, Homo sapiens
ataccgcctcgtgcca

SEQ ID NO: 1546029 - DNA, 17 bp, Homo sapiens
ataccgcctcgtgccag

SEQ ID NO: 1546030 - DNA, 19 bp, Homo sapiens
ataccgcctcgtgccagca

SEQ ID NO: 1546031 - DNA, 21 bp, Homo sapiens
ataccgcctcgtgccagcagc

SEQ ID NO: 1546032 - DNA, 16 bp, Homo sapiens
ataccgctcagtattt

SEQ ID NO: 1546033 - DNA, 13 bp, Homo sapiens
gatatttttccat

SEQ ID NO: 1546034 - DNA, 16 bp, Homo sapiens
gatcaaaaactatttg

SEQ ID NO: 1546035 - DNA, 17 bp, Homo sapiens
gatcaaaaataaactag

SEQ ID NO: 1546036 - DNA, 21 bp, Homo sapiens
gatcaaaacatgcttgaataa

SEQ ID NO: 1546037 - DNA, 23 bp, Homo sapiens
gatcaaaacctgtgccaggctga

SEQ ID NO: 1546038 - DNA, 14 bp, Homo sapiens
gatcaaaaggccca

SEQ ID NO: 1546039 - DNA, 23 bp, Homo sapiens
gatcaaattcatttttttcactg

SEQ ID NO: 1546040 - DNA, 12 bp, Homo sapiens
gatcaacattta

SEQ ID NO: 1546041 - DNA, 17 bp, Homo sapiens
gatcaacatttatgacc

SEQ ID NO: 1546042 - DNA, 16 bp, Homo sapiens
gatcaacgcctcactg

SEQ ID NO: 1546043 - DNA, 16 bp, Homo sapiens
gatcaagttgttgact

SEQ ID NO: 1546044 - DNA, 19 bp, Homo sapiens
gatcaagttgttgactgtg

SEQ ID NO: 1546045 - DNA, 21 bp, Homo sapiens
gatcaataaaatgtgattttt

SEQ ID NO: 1546046 - DNA, 16 bp, Homo sapiens
gatcaattatagtttc

SEQ ID NO: 1546047 - DNA, 20 bp, Homo sapiens
gatcaattatagtttctgag

SEQ ID NO: 1546048 - DNA, 21 bp, Homo sapiens
gatcaattatagtttctgagg

SEQ ID NO: 1546049 - DNA, 19 bp, Homo sapiens
gatcaattttcattaaact

SEQ ID NO: 1546050 - DNA, 12 bp, Homo sapiens
gatcacaagatg

SEQ ID NO: 1546051 - DNA, 14 bp, Homo sapiens
gatcacaagatgga

SEQ ID NO: 1546052 - DNA, 18 bp, Homo sapiens
gatcacacctcagtggga

SEQ ID NO: 1546053 - DNA, 19 bp, Homo sapiens
gatcacacctcagtgggaa

SEQ ID NO: 1546054 - DNA, 13 bp, Homo sapiens
gatcacagaggct

SEQ ID NO: 1546055 - DNA, 13 bp, Homo sapiens
gatcacagggccc

SEQ ID NO: 1546056 - DNA, 16 bp, Homo sapiens
gatcacatattctagt

SEQ ID NO: 1546057 - DNA, 15 bp, Homo sapiens
gatcaccagcccggc

SEQ ID NO: 1546058 - DNA, 23 bp, Homo sapiens
gatcacgccactgcactccagcc

SEQ ID NO: 1546059 - DNA, 21 bp, Homo sapiens
gatcacgccattgtactccag

SEQ ID NO: 1546060 - DNA, 15 bp, Homo sapiens
gatcactctctgctg

SEQ ID NO: 1546061 - DNA, 16 bp, Homo sapiens
gatcactctctgctgg

SEQ ID NO: 1546062 - DNA, 20 bp, Homo sapiens
gatcactctctgctggcagg

SEQ ID NO: 1546063 - DNA, 20 bp, Homo sapiens
gatcactgactctgactcat

SEQ ID NO: 1546064 - DNA, 15 bp, Homo sapiens
gatcactgccacact

SEQ ID NO: 1546065 - DNA, 13 bp, Homo sapiens
gatcactggagcc

SEQ ID NO: 1546066 - DNA, 18 bp, Homo sapiens
gatcactggagcccagga

SEQ ID NO: 1546067 - DNA, 19 bp, Homo sapiens
gatcactggctggcctgag

SEQ ID NO: 1546068 - DNA, 21 bp, Homo sapiens
gatcactggctggcctgagca

SEQ ID NO: 1546069 - DNA, 21 bp, Homo sapiens
gatcactgtagtttagttctg

SEQ ID NO: 1546070 - DNA, 22 bp, Homo sapiens
gatcactgtagtttagttctgt

SEQ ID NO: 1546071 - DNA, 15 bp, Homo sapiens
gatcagaaagtgaca

SEQ ID NO: 1546072 - DNA, 20 bp, Homo sapiens
gatcagaacattcagctctg

SEQ ID NO: 1546073 - DNA, 22 bp, Homo sapiens
gatcagaacattcagctctgga

SEQ ID NO: 1546074 - DNA, 15 bp, Homo sapiens
gatcagcattcaaaa

SEQ ID NO: 1546075 - DNA, 21 bp, Homo sapiens
gatcagccccaccctggccta

SEQ ID NO: 1546076 - DNA, 22 bp, Homo sapiens
gatcagccccaccctggcctag

SEQ ID NO: 1546077 - DNA, 21 bp, Homo sapiens
gatcagccttatgtggaagaa

SEQ ID NO: 1546078 - DNA, 16 bp, Homo sapiens
gatcaggcttcctggt

SEQ ID NO: 1546079 - DNA, 19 bp, Homo sapiens
gatcaggcttcctggtgag

SEQ ID NO: 1546080 - DNA, 11 bp, Homo sapiens
gatcagtgttg

SEQ ID NO: 1546081 - DNA, 19 bp, Homo sapiens
gatcatacagttatgtggg

SEQ ID NO: 1546082 - DNA, 21 bp, Homo sapiens
gatcatcaacaagatttcctt

SEQ ID NO: 1546083 - DNA, 14 bp, Homo sapiens
gatcatcgccagag

SEQ ID NO: 1546084 - DNA, 16 bp, Homo sapiens
gatcatcgccagaggt

SEQ ID NO: 1546085 - DNA, 21 bp, Homo sapiens
gatcatcgccagaggtgcttc

SEQ ID NO: 1546086 - DNA, 19 bp, Homo sapiens
gatcatgtactttttagta

SEQ ID NO: 1546087 - DNA, 20 bp, Homo sapiens
gatcatgtactttttagtaa

SEQ ID NO: 1546088 - DNA, 15 bp, Homo sapiens
gatcatgtgtggaag

SEQ ID NO: 1546089 - DNA, 14 bp, Homo sapiens
gatcattatcagcc

SEQ ID NO: 1546090 - DNA, 18 bp, Homo sapiens
gatcatttggagctcttg

SEQ ID NO: 1546091 - DNA, 20 bp, Homo sapiens
atactgaaggaaaaacacaa

SEQ ID NO: 1546092 - DNA, 16 bp, Homo sapiens
atactgacctacctca

SEQ ID NO: 1546093 - DNA, 18 bp, Homo sapiens
atactgattgggaggtgc

SEQ ID NO: 1546094 - DNA, 21 bp, Homo sapiens
atactgcatatcctggtgtct

SEQ ID NO: 1546095 - DNA, 20 bp, Homo sapiens
atactgcgactttctgcctg

SEQ ID NO: 1546096 - DNA, 22 bp, Homo sapiens
atactgcgactttctgcctgga

SEQ ID NO: 1546097 - DNA, 15 bp, Homo sapiens
atactgctacagcaa

SEQ ID NO: 1546098 - DNA, 13 bp, Homo sapiens
atactggaagttt

SEQ ID NO: 1546099 - DNA, 14 bp, Homo sapiens
atactggaagtttt

SEQ ID NO: 1546100 - DNA, 17 bp, Homo sapiens
atactggaagttttgca

SEQ ID NO: 1546101 - DNA, 18 bp, Homo sapiens
atactggaagttttgcat

SEQ ID NO: 1546102 - DNA, 19 bp, Homo sapiens
atactggaagttttgcatt

SEQ ID NO: 1546103 - DNA, 13 bp, Homo sapiens
atactggcacaga

SEQ ID NO: 1546104 - DNA, 23 bp, Homo sapiens
atactggcttcaccatcaatcct

SEQ ID NO: 1546105 - DNA, 22 bp, Homo sapiens
atactgtattaagagtgaaaat

SEQ ID NO: 1546106 - DNA, 18 bp, Homo sapiens
atactgtgtgggatactt

SEQ ID NO: 1546107 - DNA, 20 bp, Homo sapiens
atactgtgtgggatacttag

SEQ ID NO: 1546108 - DNA, 19 bp, Homo sapiens
atactgtttgtaatataca

SEQ ID NO: 1546109 - DNA, 15 bp, Homo sapiens
atacttaaaaattaa

SEQ ID NO: 1546110 - DNA, 16 bp, Homo sapiens
atacttaaaatatctc

SEQ ID NO: 1546111 - DNA, 17 bp, Homo sapiens
atacttaaaatatctct

SEQ ID NO: 1546112 - DNA, 20 bp, Homo sapiens
atacttaacacgtgaatatt

SEQ ID NO: 1546113 - DNA, 23 bp, Homo sapiens
atacttagaaacaaaaagagctt

SEQ ID NO: 1546114 - DNA, 17 bp, Homo sapiens
atacttatgttgtattg

SEQ ID NO: 1546115 - DNA, 16 bp, Homo sapiens
atacttcaggtgcttt

SEQ ID NO: 1546116 - DNA, 13 bp, Homo sapiens
atacttcccaaag

SEQ ID NO: 1546117 - DNA, 18 bp, Homo sapiens
atacttcttacttgtctg

SEQ ID NO: 1546118 - DNA, 17 bp, Homo sapiens
atacttgaagggccaga

SEQ ID NO: 1546119 - DNA, 18 bp, Homo sapiens
atacttgcattccagagt

SEQ ID NO: 1546120 - DNA, 19 bp, Homo sapiens
atacttggctgcttcctgt

SEQ ID NO: 1546121 - DNA, 20 bp, Homo sapiens
atacttggctgcttcctgtg

SEQ ID NO: 1546122 - DNA, 14 bp, Homo sapiens
atacttgtgatttt

SEQ ID NO: 1546123 - DNA, 18 bp, Homo sapiens
atactttaattcatgaag

SEQ ID NO: 1546124 - DNA, 20 bp, Homo sapiens
atactttagtagacatttat

SEQ ID NO: 1546125 - DNA, 18 bp, Homo sapiens
atactttgacaaggaaaa

SEQ ID NO: 1546126 - DNA, 13 bp, Homo sapiens
atactttgtctga

SEQ ID NO: 1546127 - DNA, 19 bp, Homo sapiens
atactttgttctgttgtct

SEQ ID NO: 1546128 - DNA, 21 bp, Homo sapiens
atactttgttctgttgtctgc

SEQ ID NO: 1546129 - DNA, 15 bp, Homo sapiens
atacttttactctgc

SEQ ID NO: 1546130 - DNA, 16 bp, Homo sapiens
atacttttactctgcc

SEQ ID NO: 1546131 - DNA, 17 bp, Homo sapiens
atacttttactctgcct

SEQ ID NO: 1546132 - DNA, 20 bp, Homo sapiens
atacttttactctgcctaca

SEQ ID NO: 1546133 - DNA, 19 bp, Homo sapiens
atacttttgtgtattctgt

SEQ ID NO: 1546134 - DNA, 13 bp, Homo sapiens
atacttttttcta

SEQ ID NO: 1546135 - DNA, 13 bp, Homo sapiens
atagaaaattatt

SEQ ID NO: 1546136 - DNA, 19 bp, Homo sapiens
atagaaaattatttgtatg

SEQ ID NO: 1546137 - DNA, 16 bp, Homo sapiens
atagaaacatgacact

SEQ ID NO: 1546138 - DNA, 17 bp, Homo sapiens
atagaaacgtaaactat

SEQ ID NO: 1546139 - DNA, 21 bp, Homo sapiens
atagaaactcaccatgtaaaa

SEQ ID NO: 1546140 - DNA, 12 bp, Homo sapiens
atagaaagcatt

SEQ ID NO: 1546141 - DNA, 16 bp, Homo sapiens
atagaaagctggactg

SEQ ID NO: 1546142 - DNA, 18 bp, Homo sapiens
atagaaagctggactgac

SEQ ID NO: 1546143 - DNA, 16 bp, Homo sapiens
atagaaagtgccagaa

SEQ ID NO: 1546144 - DNA, 20 bp, Homo sapiens
atagaaatatagccaaaaat

SEQ ID NO: 1546145 - DNA, 20 bp, Homo sapiens
atagaaatggtttcctctgg

SEQ ID NO: 1546146 - DNA, 15 bp, Homo sapiens
atagaaatgtaggtc

SEQ ID NO: 1546147 - DNA, 20 bp, Homo sapiens
atagaaattgtgtttgctaa

SEQ ID NO: 1546148 - DNA, 14 bp, Homo sapiens
atagaaattttgta

SEQ ID NO: 1546149 - DNA, 16 bp, Homo sapiens
atagaaattttgtaag

SEQ ID NO: 1546150 - DNA, 16 bp, Homo sapiens
gatccttcacaggcag

SEQ ID NO: 1546151 - DNA, 22 bp, Homo sapiens
gatccttcacaggcagtgcatg

SEQ ID NO: 1546152 - DNA, 15 bp, Homo sapiens
gatccttcagcacag

SEQ ID NO: 1546153 - DNA, 16 bp, Homo sapiens
gatccttcagcacagg

SEQ ID NO: 1546154 - DNA, 19 bp, Homo sapiens
gatccttcccctcttttgg

SEQ ID NO: 1546155 - DNA, 20 bp, Homo sapiens
gatccttctgagctccacct

SEQ ID NO: 1546156 - DNA, 13 bp, Homo sapiens
gatcgaagaggcc

SEQ ID NO: 1546157 - DNA, 16 bp, Homo sapiens
gatcgagaccatcctg

SEQ ID NO: 1546158 - DNA, 19 bp, Homo sapiens
gatcgagaccatcctggct

SEQ ID NO: 1546159 - DNA, 16 bp, Homo sapiens
gatcgaggcatggggc

SEQ ID NO: 1546160 - DNA, 20 bp, Homo sapiens
gatcgagtgtagctgtgaaa

SEQ ID NO: 1546161 - DNA, 14 bp, Homo sapiens
gatcgatgtgctca

SEQ ID NO: 1546162 - DNA, 15 bp, Homo sapiens
gatcgcatggcagaa

SEQ ID NO: 1546163 - DNA, 23 bp, Homo sapiens
gatcgcgccactacactccagcc

SEQ ID NO: 1546164 - DNA, 14 bp, Homo sapiens
gatcgcgttagcca

SEQ ID NO: 1546165 - DNA, 14 bp, Homo sapiens
gatcggaacagctc

SEQ ID NO: 1546166 - DNA, 20 bp, Homo sapiens
gatcggagcctcctctctca

SEQ ID NO: 1546167 - DNA, 23 bp, Homo sapiens
gatcgtgccgttactctccaacc

SEQ ID NO: 1546168 - DNA, 21 bp, Homo sapiens
gatcgtggccaacgtggacct

SEQ ID NO: 1546169 - DNA, 13 bp, Homo sapiens
gatctaaacagtt

SEQ ID NO: 1546170 - DNA, 18 bp, Homo sapiens
gatctaaacagttatttc

SEQ ID NO: 1546171 - DNA, 13 bp, Homo sapiens
gatctaacaaaat

SEQ ID NO: 1546172 - DNA, 17 bp, Homo sapiens
gatctaagcctttccat

SEQ ID NO: 1546173 - DNA, 22 bp, Homo sapiens
gatctaagggaagatcactgta

SEQ ID NO: 1546174 - DNA, 11 bp, Homo sapiens
gatctacacat

SEQ ID NO: 1546175 - DNA, 12 bp, Homo sapiens
gatctacacatg

SEQ ID NO: 1546176 - DNA, 21 bp, Homo sapiens
gatctacttgcctcatttccc

SEQ ID NO: 1546177 - DNA, 16 bp, Homo sapiens
gatctatcacctgtca

SEQ ID NO: 1546178 - DNA, 16 bp, Homo sapiens
gatctatgcctttcaa

SEQ ID NO: 1546179 - DNA, 14 bp, Homo sapiens
gatctatgggaaga

SEQ ID NO: 1546180 - DNA, 20 bp, Homo sapiens
gatctatgtttgtgtgattt

SEQ ID NO: 1546181 - DNA, 21 bp, Homo sapiens
gatctatgtttgtgtgatttc

SEQ ID NO: 1546182 - DNA, 14 bp, Homo sapiens
gatctcaagccagc

SEQ ID NO: 1546183 - DNA, 22 bp, Homo sapiens
gatctcaagccagccccctcca

SEQ ID NO: 1546184 - DNA, 16 bp, Homo sapiens
gatctcaagtatatgt

SEQ ID NO: 1546185 - DNA, 19 bp, Homo sapiens
gatctcaagtatatgtcat

SEQ ID NO: 1546186 - DNA, 20 bp, Homo sapiens
gatctcaagtatatgtcatt

SEQ ID NO: 1546187 - DNA, 14 bp, Homo sapiens
gatctcagctttga

SEQ ID NO: 1546188 - DNA, 16 bp, Homo sapiens
gatctcagctttgaga

SEQ ID NO: 1546189 - DNA, 18 bp, Homo sapiens
gatctcagggaagcccag

SEQ ID NO: 1546190 - DNA, 19 bp, Homo sapiens
gatctcagggaagcccagc

SEQ ID NO: 1546191 - DNA, 20 bp, Homo sapiens
gatctcagggaagcccagct

SEQ ID NO: 1546192 - DNA, 21 bp, Homo sapiens
gatctcagggaagcccagctc

SEQ ID NO: 1546193 - DNA, 14 bp, Homo sapiens
gatctcagggcaga

SEQ ID NO: 1546194 - DNA, 18 bp, Homo sapiens
gatctcaggggctgtttg

SEQ ID NO: 1546195 - DNA, 16 bp, Homo sapiens
gatctcataatgcttt

SEQ ID NO: 1546196 - DNA, 20 bp, Homo sapiens
gatctcatggaaactggcca

SEQ ID NO: 1546197 - DNA, 15 bp, Homo sapiens
gatctcatgtcctct

SEQ ID NO: 1546198 - DNA, 21 bp, Homo sapiens
gatctcattgttcaattccca

SEQ ID NO: 1546199 - DNA, 18 bp, Homo sapiens
gatctccctgccgcctca

SEQ ID NO: 1546200 - DNA, 20 bp, Homo sapiens
gatctcccttggtcttccat

SEQ ID NO: 1546201 - DNA, 18 bp, Homo sapiens
gatctccttcccttctct

SEQ ID NO: 1546202 - DNA, 20 bp, Homo sapiens
gatctcggtttgccaaaatt

SEQ ID NO: 1546203 - DNA, 20 bp, Homo sapiens
gatctctacattaatgtcct

SEQ ID NO: 1546204 - DNA, 13 bp, Homo sapiens
gatctctcaggag

SEQ ID NO: 1546205 - DNA, 21 bp, Homo sapiens
atagatctgatggtgagctgg

SEQ ID NO: 1546206 - DNA, 13 bp, Homo sapiens
atagatcttctga

SEQ ID NO: 1546207 - DNA, 14 bp, Homo sapiens
atagatcttctgaa

SEQ ID NO: 1546208 - DNA, 16 bp, Homo sapiens
atagatgctggcccag

SEQ ID NO: 1546209 - DNA, 17 bp, Homo sapiens
atagatgctggcccagg

SEQ ID NO: 1546210 - DNA, 20 bp, Homo sapiens
atagatgctggcccagggcc

SEQ ID NO: 1546211 - DNA, 19 bp, Homo sapiens
atagatgtccctttcttgg

SEQ ID NO: 1546212 - DNA, 22 bp, Homo sapiens
atagatgtccctttcttggcca

SEQ ID NO: 1546213 - DNA, 14 bp, Homo sapiens
atagatgtctcaaa

SEQ ID NO: 1546214 - DNA, 13 bp, Homo sapiens
atagatgtgtgga

SEQ ID NO: 1546215 - DNA, 17 bp, Homo sapiens
atagattaatggcactg

SEQ ID NO: 1546216 - DNA, 15 bp, Homo sapiens
atagattaggtttgc

SEQ ID NO: 1546217 - DNA, 15 bp, Homo sapiens
atagattctaaagat

SEQ ID NO: 1546218 - DNA, 20 bp, Homo sapiens
atagcaaaattcctgtgttc

SEQ ID NO: 1546219 - DNA, 16 bp, Homo sapiens
atagcaacactctata

SEQ ID NO: 1546220 - DNA, 17 bp, Homo sapiens
atagcaactaatgtttg

SEQ ID NO: 1546221 - DNA, 23 bp, Homo sapiens
atagcaactaatgtttgaacaaa

SEQ ID NO: 1546222 - DNA, 18 bp, Homo sapiens
atagcaagacctcatctc

SEQ ID NO: 1546223 - DNA, 13 bp, Homo sapiens
atagcaagtgaat

SEQ ID NO: 1546224 - DNA, 22 bp, Homo sapiens
atagcaatccatgttagttttt

SEQ ID NO: 1546225 - DNA, 19 bp, Homo sapiens
atagcactaaccaatgcct

SEQ ID NO: 1546226 - DNA, 12 bp, Homo sapiens
atagcagaaaga

SEQ ID NO: 1546227 - DNA, 15 bp, Homo sapiens
atagcagagagccaa

SEQ ID NO: 1546228 - DNA, 16 bp, Homo sapiens
atagcagagagccaaa

SEQ ID NO: 1546229 - DNA, 17 bp, Homo sapiens
atagcagccagttcaaa

SEQ ID NO: 1546230 - DNA, 13 bp, Homo sapiens
atagcagcctttc

SEQ ID NO: 1546231 - DNA, 19 bp, Homo sapiens
atagcagctttgtctctgt

SEQ ID NO: 1546232 - DNA, 17 bp, Homo sapiens
atagcatatgacaaatg

SEQ ID NO: 1546233 - DNA, 20 bp, Homo sapiens
atagcatatgacaaatgttt

SEQ ID NO: 1546234 - DNA, 23 bp, Homo sapiens
atagcatatgacaaatgtttcta

SEQ ID NO: 1546235 - DNA, 15 bp, Homo sapiens
atagcatgcttcctt

SEQ ID NO: 1546236 - DNA, 18 bp, Homo sapiens
atagcatgcttcctttct

SEQ ID NO: 1546237 - DNA, 21 bp, Homo sapiens
atagcattgtttttgtcatgt

SEQ ID NO: 1546238 - DNA, 16 bp, Homo sapiens
atagccaactctccca

SEQ ID NO: 1546239 - DNA, 15 bp, Homo sapiens
atagccagagaggag

SEQ ID NO: 1546240 - DNA, 23 bp, Homo sapiens
atagccagcattcagcacacaca

SEQ ID NO: 1546241 - DNA, 24 bp, Homo sapiens
atagccccagactgggcccaggca

SEQ ID NO: 1546242 - DNA, 15 bp, Homo sapiens
atagcctaaatgatg

SEQ ID NO: 1546243 - DNA, 13 bp, Homo sapiens
atagcctacattt

SEQ ID NO: 1546244 - DNA, 13 bp, Homo sapiens
atagcctcatgtt

SEQ ID NO: 1546245 - DNA, 16 bp, Homo sapiens
atagcctgcctgatcc

SEQ ID NO: 1546246 - DNA, 17 bp, Homo sapiens
atagcgatgtgcaggaa

SEQ ID NO: 1546247 - DNA, 14 bp, Homo sapiens
atagcgtcctgccc

SEQ ID NO: 1546248 - DNA, 16 bp, Homo sapiens
atagcgtcctgccctg

SEQ ID NO: 1546249 - DNA, 16 bp, Homo sapiens
atagctaactgtaaat

SEQ ID NO: 1546250 - DNA, 17 bp, Homo sapiens
atagctctattttaaag

SEQ ID NO: 1546251 - DNA, 19 bp, Homo sapiens
atagctctggggtgggcag

SEQ ID NO: 1546252 - DNA, 22 bp, Homo sapiens
atagctctggggtgggcagttt

SEQ ID NO: 1546253 - DNA, 19 bp, Homo sapiens
atagcttaactaatttgaa

SEQ ID NO: 1546254 - DNA, 20 bp, Homo sapiens
atagcttaactaatttgaat

SEQ ID NO: 1546255 - DNA, 23 bp, Homo sapiens
atagcttaactaatttgaatgtg

SEQ ID NO: 1546256 - DNA, 22 bp, Homo sapiens
atagcttacaagccagctggag

SEQ ID NO: 1546257 - DNA, 17 bp, Homo sapiens
atagcttacactgagga

SEQ ID NO: 1546258 - DNA, 18 bp, Homo sapiens
atagcttacactgaggac

SEQ ID NO: 1546259 - DNA, 14 bp, Homo sapiens
atagcttacctgaa

SEQ ID NO: 1546260 - DNA, 16 bp, Homo sapiens
atagcttctgtgtgtg

SEQ ID NO: 1546261 - DNA, 19 bp, Homo sapiens
atagcttctgtgtgtgagc

SEQ ID NO: 1546262 - DNA, 18 bp, Homo sapiens
ataggaaaagtacattta

SEQ ID NO: 1546263 - DNA, 15 bp, Homo sapiens
ataggaaactgaagc

SEQ ID NO: 1546264 - DNA, 18 bp, Homo sapiens
ataggaacaatctttgct

SEQ ID NO: 1546265 - DNA, 16 bp, Homo sapiens
ataggaacatatgaaa

SEQ ID NO: 1546266 - DNA, 16 bp, Homo sapiens
ataggaagcgtctggc

SEQ ID NO: 1546267 - DNA, 17 bp, Homo sapiens
ataggaagggatctgag

SEQ ID NO: 1546268 - DNA, 18 bp, Homo sapiens
ataggaatcattcagaaa

SEQ ID NO: 1546269 - DNA, 17 bp, Homo sapiens
gatgaacttattctgta

SEQ ID NO: 1546270 - DNA, 17 bp, Homo sapiens
gatgaagaacacagcat

SEQ ID NO: 1546271 - DNA, 19 bp, Homo sapiens
gatgaagaacacagcatgt

SEQ ID NO: 1546272 - DNA, 18 bp, Homo sapiens
gatgaagagaaggcacac

SEQ ID NO: 1546273 - DNA, 14 bp, Homo sapiens
gatgaagagtgaga

SEQ ID NO: 1546274 - DNA, 18 bp, Homo sapiens
gatgaagggcgagtgaat

SEQ ID NO: 1546275 - DNA, 17 bp, Homo sapiens
gatgaatctacatttgt

SEQ ID NO: 1546276 - DNA, 15 bp, Homo sapiens
gatgaatgataaact

SEQ ID NO: 1546277 - DNA, 16 bp, Homo sapiens
gatgaattttctgcag

SEQ ID NO: 1546278 - DNA, 22 bp, Homo sapiens
gatgaattttctgcagctgttt

SEQ ID NO: 1546279 - DNA, 20 bp, Homo sapiens
gatgacacctccatttctct

SEQ ID NO: 1546280 - DNA, 21 bp, Homo sapiens
gatgacacgcgctctccacca

SEQ ID NO: 1546281 - DNA, 19 bp, Homo sapiens
gatgacaggcgcctgccat

SEQ ID NO: 1546282 - DNA, 20 bp, Homo sapiens
gatgacaggcgcctgccatc

SEQ ID NO: 1546283 - DNA, 12 bp, Homo sapiens
gatgacagtgct

SEQ ID NO: 1546284 - DNA, 18 bp, Homo sapiens
gatgaccaaaccagcctt

SEQ ID NO: 1546285 - DNA, 18 bp, Homo sapiens
gatgaccaatgggatgag

SEQ ID NO: 1546286 - DNA, 14 bp, Homo sapiens
gatgaccagggatg

SEQ ID NO: 1546287 - DNA, 22 bp, Homo sapiens
gatgaccagggatgctgggctg

SEQ ID NO: 1546288 - DNA, 23 bp, Homo sapiens
gatgaccagggatgctgggctgg

SEQ ID NO: 1546289 - DNA, 16 bp, Homo sapiens
gatgaccatactcaga

SEQ ID NO: 1546290 - DNA, 13 bp, Homo sapiens
gatgacccaggct

SEQ ID NO: 1546291 - DNA, 16 bp, Homo sapiens
gatgaccccggcctgt

SEQ ID NO: 1546292 - DNA, 23 bp, Homo sapiens
gatgaccctgcgaaggggccctg

SEQ ID NO: 1546293 - DNA, 15 bp, Homo sapiens
gatgacccttttcat

SEQ ID NO: 1546294 - DNA, 17 bp, Homo sapiens
gatgacccttttcatga

SEQ ID NO: 1546295 - DNA, 15 bp, Homo sapiens
gatgactaaaatatt

SEQ ID NO: 1546296 - DNA, 17 bp, Homo sapiens
gatgactgagtcctcgt

SEQ ID NO: 1546297 - DNA, 22 bp, Homo sapiens
gatgacttagcgtcaagacatt

SEQ ID NO: 1546298 - DNA, 17 bp, Homo sapiens
gatgacttgctgtccag

SEQ ID NO: 1546299 - DNA, 12 bp, Homo sapiens
gatgagaagtgt

SEQ ID NO: 1546300 - DNA, 19 bp, Homo sapiens
gatgagataatatgagatt

SEQ ID NO: 1546301 - DNA, 20 bp, Homo sapiens
gatgagatttgccagcacag

SEQ ID NO: 1546302 - DNA, 19 bp, Homo sapiens
gatgagcagagggaggaag

SEQ ID NO: 1546303 - DNA, 20 bp, Homo sapiens
gatgagccccacgtggagct

SEQ ID NO: 1546304 - DNA, 20 bp, Homo sapiens
gatgagccttgcagatatct

SEQ ID NO: 1546305 - DNA, 20 bp, Homo sapiens
gatgagctggaaggagtgag

SEQ ID NO: 1546306 - DNA, 16 bp, Homo sapiens
gatgaggacagagggc

SEQ ID NO: 1546307 - DNA, 20 bp, Homo sapiens
gatgaggacagagggcacat

SEQ ID NO: 1546308 - DNA, 22 bp, Homo sapiens
gatgaggagtaaaattcagttt

SEQ ID NO: 1546309 - DNA, 19 bp, Homo sapiens
gatgaggccgctagaggcc

SEQ ID NO: 1546310 - DNA, 14 bp, Homo sapiens
gatgagggtgactg

SEQ ID NO: 1546311 - DNA, 20 bp, Homo sapiens
gatgaggtcaccaggggagg

SEQ ID NO: 1546312 - DNA, 22 bp, Homo sapiens
gatgagtgggaggcgtgccccc

SEQ ID NO: 1546313 - DNA, 18 bp, Homo sapiens
gatgagttaactgtgaaa

SEQ ID NO: 1546314 - DNA, 12 bp, Homo sapiens
gatgataataat

SEQ ID NO: 1546315 - DNA, 19 bp, Homo sapiens
gatgataatgatgatgacg

SEQ ID NO: 1546316 - DNA, 13 bp, Homo sapiens
gatgatccagaac

SEQ ID NO: 1546317 - DNA, 15 bp, Homo sapiens
gatgatcccagtcac

SEQ ID NO: 1546318 - DNA, 21 bp, Homo sapiens
gatgatcccagtcactcctct

SEQ ID NO: 1546319 - DNA, 17 bp, Homo sapiens
atagtgcttaaaaatca

SEQ ID NO: 1546320 - DNA, 14 bp, Homo sapiens
atagtgcttgctgg

SEQ ID NO: 1546321 - DNA, 12 bp, Homo sapiens
atagtgcttttt

SEQ ID NO: 1546322 - DNA, 12 bp, Homo sapiens
atagtggggcct

SEQ ID NO: 1546323 - DNA, 17 bp, Homo sapiens
atagtggggcctgggag

SEQ ID NO: 1546324 - DNA, 21 bp, Homo sapiens
atagtggggttccatgagtta

SEQ ID NO: 1546325 - DNA, 15 bp, Homo sapiens
atagtgtaaactgaa

SEQ ID NO: 1546326 - DNA, 23 bp, Homo sapiens
atagtgtaacttgcttaaatttc

SEQ ID NO: 1546327 - DNA, 12 bp, Homo sapiens
atagtgtaagaa

SEQ ID NO: 1546328 - DNA, 23 bp, Homo sapiens
atagtgtaagaactgtacattgt

SEQ ID NO: 1546329 - DNA, 20 bp, Homo sapiens
atagtgtctattatcacatt

SEQ ID NO: 1546330 - DNA, 17 bp, Homo sapiens
atagtgttaactgtcag

SEQ ID NO: 1546331 - DNA, 18 bp, Homo sapiens
atagtgttctgctcctgc

SEQ ID NO: 1546332 - DNA, 19 bp, Homo sapiens
atagttaaaagactgcagc

SEQ ID NO: 1546333 - DNA, 15 bp, Homo sapiens
atagttactgtaaaa

SEQ ID NO: 1546334 - DNA, 17 bp, Homo sapiens
atagttactgtaaaatg

SEQ ID NO: 1546335 - DNA, 17 bp, Homo sapiens
atagttactgtgtaatt

SEQ ID NO: 1546336 - DNA, 20 bp, Homo sapiens
atagttactgtgtaattagt

SEQ ID NO: 1546337 - DNA, 14 bp, Homo sapiens
atagttagccctca

SEQ ID NO: 1546338 - DNA, 18 bp, Homo sapiens
atagttattattgctgtt

SEQ ID NO: 1546339 - DNA, 18 bp, Homo sapiens
atagttcagtagaattac

SEQ ID NO: 1546340 - DNA, 21 bp, Homo sapiens
atagttcagtagaattaccat

SEQ ID NO: 1546341 - DNA, 16 bp, Homo sapiens
atagttccttgcctta

SEQ ID NO: 1546342 - DNA, 23 bp, Homo sapiens
atagttccttgccttaataaata

SEQ ID NO: 1546343 - DNA, 18 bp, Homo sapiens
atagttctagtgcagctg

SEQ ID NO: 1546344 - DNA, 21 bp, Homo sapiens
atagttctatcaggaaaacaa

SEQ ID NO: 1546345 - DNA, 15 bp, Homo sapiens
atagttctatttcta

SEQ ID NO: 1546346 - DNA, 21 bp, Homo sapiens
atagttcttagctttgaaact

SEQ ID NO: 1546347 - DNA, 20 bp, Homo sapiens
atagttgatatgtaacagtt

SEQ ID NO: 1546348 - DNA, 16 bp, Homo sapiens
atagtttcaaatctgt

SEQ ID NO: 1546349 - DNA, 12 bp, Homo sapiens
atagtttcctga

SEQ ID NO: 1546350 - DNA, 17 bp, Homo sapiens
atagtttgtctatttta

SEQ ID NO: 1546351 - DNA, 17 bp, Homo sapiens
atagttttaattctgct

SEQ ID NO: 1546352 - DNA, 23 bp, Homo sapiens
atagttttacttttaaactgtgt

SEQ ID NO: 1546353 - DNA, 23 bp, Homo sapiens
atagttttttctttcccatgtat

SEQ ID NO: 1546354 - DNA, 20 bp, Homo sapiens
atagtttttttttttttcct

SEQ ID NO: 1546355 - DNA, 22 bp, Homo sapiens
atataaaaagaaaagataaaga

SEQ ID NO: 1546356 - DNA, 16 bp, Homo sapiens
atataaaacagtcatg

SEQ ID NO: 1546357 - DNA, 13 bp, Homo sapiens
atataaaacttaa

SEQ ID NO: 1546358 - DNA, 13 bp, Homo sapiens
atataaaatacat

SEQ ID NO: 1546359 - DNA, 13 bp, Homo sapiens
atataaaatgaaa

SEQ ID NO: 1546360 - DNA, 17 bp, Homo sapiens
atataaaatgaaagatt

SEQ ID NO: 1546361 - DNA, 23 bp, Homo sapiens
atataaacatatttttatacttt

SEQ ID NO: 1546362 - DNA, 17 bp, Homo sapiens
atataaagacaacaaaa

SEQ ID NO: 1546363 - DNA, 20 bp, Homo sapiens
atataaagacaacaaaagaa

SEQ ID NO: 1546364 - DNA, 23 bp, Homo sapiens
atataaagacaacaaaagaaatc

SEQ ID NO: 1546365 - DNA, 16 bp, Homo sapiens
atataaatagctaatg

SEQ ID NO: 1546366 - DNA, 23 bp, Homo sapiens
atataaatggctggtttttagaa

SEQ ID NO: 1546367 - DNA, 22 bp, Homo sapiens
atataacacttaggactagaag

SEQ ID NO: 1546368 - DNA, 13 bp, Homo sapiens
atataacatatat

SEQ ID NO: 1546369 - DNA, 20 bp, Homo sapiens
atataacatgcaaacaggtt

SEQ ID NO: 1546370 - DNA, 15 bp, Homo sapiens
atataacatgtaaaa

SEQ ID NO: 1546371 - DNA, 23 bp, Homo sapiens
atataaccacaaagcacagtttg

SEQ ID NO: 1546372 - DNA, 19 bp, Homo sapiens
atataaccctaggaattta

SEQ ID NO: 1546373 - DNA, 21 bp, Homo sapiens
atataactatgtggctgaaaa

SEQ ID NO: 1546374 - DNA, 19 bp, Homo sapiens
atataactattttaaatat

SEQ ID NO: 1546375 - DNA, 23 bp, Homo sapiens
atataactattttaaatatccat

SEQ ID NO: 1546376 - DNA, 17 bp, Homo sapiens
atataactgagttatat

SEQ ID NO: 1546377 - DNA, 15 bp, Homo sapiens
atataactgtcttgt

SEQ ID NO: 1546378 - DNA, 17 bp, Homo sapiens
atataactgtcttgttt

SEQ ID NO: 1546379 - DNA, 19 bp, Homo sapiens
atataactgtcttgtttca

SEQ ID NO: 1546380 - DNA, 16 bp, Homo sapiens
atataactttttttag

SEQ ID NO: 1546381 - DNA, 22 bp, Homo sapiens
atataagaagcaatctttgaaa

SEQ ID NO: 1546382 - DNA, 23 bp, Homo sapiens
atataagaagcaatctttgaaat

SEQ ID NO: 1546383 - DNA, 18 bp, Homo sapiens
atataagagaagtctcat

SEQ ID NO: 1546384 - DNA, 14 bp, Homo sapiens
atataagcataaaa

SEQ ID NO: 1546385 - DNA, 16 bp, Homo sapiens
atataagcataaaaga

SEQ ID NO: 1546386 - DNA, 19 bp, Homo sapiens
atataagcataaaagatca

SEQ ID NO: 1546387 - DNA, 23 bp, Homo sapiens
gatgctgccagggcgccatcgcc

SEQ ID NO: 1546388 - DNA, 23 bp, Homo sapiens
gatgctgccccgttccctgtcag

SEQ ID NO: 1546389 - DNA, 12 bp, Homo sapiens
gatgctgcccct

SEQ ID NO: 1546390 - DNA, 16 bp, Homo sapiens
gatgctgcctgagtca

SEQ ID NO: 1546391 - DNA, 11 bp, Homo sapiens
gatgctgctcc

SEQ ID NO: 1546392 - DNA, 19 bp, Homo sapiens
gatgctgctccgcccgctc

SEQ ID NO: 1546393 - DNA, 22 bp, Homo sapiens
gatgctggatgtctgccaattt

SEQ ID NO: 1546394 - DNA, 13 bp, Homo sapiens
gatgctggcccag

SEQ ID NO: 1546395 - DNA, 14 bp, Homo sapiens
gatgctggcccagg

SEQ ID NO: 1546396 - DNA, 21 bp, Homo sapiens
gatgctgggcaatgaggcaga

SEQ ID NO: 1546397 - DNA, 14 bp, Homo sapiens
gatgctgggctggg

SEQ ID NO: 1546398 - DNA, 23 bp, Homo sapiens
gatgctgggttggtgcacagtga

SEQ ID NO: 1546399 - DNA, 18 bp, Homo sapiens
gatggaaaagaactagga

SEQ ID NO: 1546400 - DNA, 18 bp, Homo sapiens
gatggaaaagtgtccttc

SEQ ID NO: 1546401 - DNA, 15 bp, Homo sapiens
gatggaaaataaaca

SEQ ID NO: 1546402 - DNA, 20 bp, Homo sapiens
gatggaaatacagttatttc

SEQ ID NO: 1546403 - DNA, 23 bp, Homo sapiens
gatggaagatggtccgtgcccag

SEQ ID NO: 1546404 - DNA, 21 bp, Homo sapiens
gatggaagttgcagtgagctg

SEQ ID NO: 1546405 - DNA, 23 bp, Homo sapiens
gatggacacgagccacaagctgc

SEQ ID NO: 1546406 - DNA, 18 bp, Homo sapiens
gatggaccgggtgggcct

SEQ ID NO: 1546407 - DNA, 17 bp, Homo sapiens
gatggactcctgaccat

SEQ ID NO: 1546408 - DNA, 19 bp, Homo sapiens
gatggacttgtgattggct

SEQ ID NO: 1546409 - DNA, 20 bp, Homo sapiens
gatggacttgtgattggctg

SEQ ID NO: 1546410 - DNA, 21 bp, Homo sapiens
gatggacttgtgattggctgc

SEQ ID NO: 1546411 - DNA, 22 bp, Homo sapiens
gatggacttgtgattggctgca

SEQ ID NO: 1546412 - DNA, 23 bp, Homo sapiens
gatggacttgtgattggctgcag

SEQ ID NO: 1546413 - DNA, 18 bp, Homo sapiens
gatggagacaccctctgg

SEQ ID NO: 1546414 - DNA, 19 bp, Homo sapiens
gatggagacaccctctggg

SEQ ID NO: 1546415 - DNA, 15 bp, Homo sapiens
gatggagagagggga

SEQ ID NO: 1546416 - DNA, 16 bp, Homo sapiens
gatggagagaggggaa

SEQ ID NO: 1546417 - DNA, 20 bp, Homo sapiens
gatggagccagctctgcatt

SEQ ID NO: 1546418 - DNA, 15 bp, Homo sapiens
gatggagccccacct

SEQ ID NO: 1546419 - DNA, 16 bp, Homo sapiens
gatggagccccacctt

SEQ ID NO: 1546420 - DNA, 12 bp, Homo sapiens
gatggaggaaaa

SEQ ID NO: 1546421 - DNA, 23 bp, Homo sapiens
gatggaggaaaaccaagccgtgg

SEQ ID NO: 1546422 - DNA, 14 bp, Homo sapiens
gatggaggagaaga

SEQ ID NO: 1546423 - DNA, 14 bp, Homo sapiens
gatggaggctgcag

SEQ ID NO: 1546424 - DNA, 15 bp, Homo sapiens
gatggagggcttggc

SEQ ID NO: 1546425 - DNA, 21 bp, Homo sapiens
gatggaggggtggtcctgact

SEQ ID NO: 1546426 - DNA, 20 bp, Homo sapiens
gatggagtgtgcagacagcc

SEQ ID NO: 1546427 - DNA, 13 bp, Homo sapiens
gatggatggcacc

SEQ ID NO: 1546428 - DNA, 14 bp, Homo sapiens
gatggatggcaccc

SEQ ID NO: 1546429 - DNA, 17 bp, Homo sapiens
gatggatggcaccctgg

SEQ ID NO: 1546430 - DNA, 19 bp, Homo sapiens
gatggatggcaccctggaa

SEQ ID NO: 1546431 - DNA, 21 bp, Homo sapiens
gatggcaacagatctggaacc

SEQ ID NO: 1546432 - DNA, 12 bp, Homo sapiens
gatggcagctgg

SEQ ID NO: 1546433 - DNA, 18 bp, Homo sapiens
atatagttttttctttcc

SEQ ID NO: 1546434 - DNA, 20 bp, Homo sapiens
atatataaagacaacaaaag

SEQ ID NO: 1546435 - DNA, 13 bp, Homo sapiens
atatataaatgta

SEQ ID NO: 1546436 - DNA, 14 bp, Homo sapiens
atatataaatgtat

SEQ ID NO: 1546437 - DNA, 21 bp, Homo sapiens
atatataagtttacaccttta

SEQ ID NO: 1546438 - DNA, 23 bp, Homo sapiens
atatatacagtaactttatgtgt

SEQ ID NO: 1546439 - DNA, 15 bp, Homo sapiens
atatatacatgtttt

SEQ ID NO: 1546440 - DNA, 13 bp, Homo sapiens
atatatagaatct

SEQ ID NO: 1546441 - DNA, 14 bp, Homo sapiens
atatatagtcaaat

SEQ ID NO: 1546442 - DNA, 15 bp, Homo sapiens
atatatataaatgta

SEQ ID NO: 1546443 - DNA, 13 bp, Homo sapiens
atatatatatagt

SEQ ID NO: 1546444 - DNA, 14 bp, Homo sapiens
atatatatatgtat

SEQ ID NO: 1546445 - DNA, 15 bp, Homo sapiens
atatatatgaataaa

SEQ ID NO: 1546446 - DNA, 18 bp, Homo sapiens
atatatatgcacacatat

SEQ ID NO: 1546447 - DNA, 22 bp, Homo sapiens
atatatatgcatatatatatgt

SEQ ID NO: 1546448 - DNA, 13 bp, Homo sapiens
atatatatgtcaa

SEQ ID NO: 1546449 - DNA, 20 bp, Homo sapiens
atatatatgtgtgtgtatat

SEQ ID NO: 1546450 - DNA, 19 bp, Homo sapiens
atatatattatatatatct

SEQ ID NO: 1546451 - DNA, 22 bp, Homo sapiens
atatatccctgataaatattca

SEQ ID NO: 1546452 - DNA, 24 bp, Homo sapiens
atatatctaccccagactagatgt

SEQ ID NO: 1546453 - DNA, 13 bp, Homo sapiens
atatatctattat

SEQ ID NO: 1546454 - DNA, 16 bp, Homo sapiens
atatatctctatttga

SEQ ID NO: 1546455 - DNA, 16 bp, Homo sapiens
atatatcttaagcagg

SEQ ID NO: 1546456 - DNA, 20 bp, Homo sapiens
atatatgaagacaataattc

SEQ ID NO: 1546457 - DNA, 16 bp, Homo sapiens
atatatgcacacatat

SEQ ID NO: 1546458 - DNA, 19 bp, Homo sapiens
atatatgcactatgtatat

SEQ ID NO: 1546459 - DNA, 19 bp, Homo sapiens
atatatggtcatatacata

SEQ ID NO: 1546460 - DNA, 17 bp, Homo sapiens
atatatgtataatatat

SEQ ID NO: 1546461 - DNA, 16 bp, Homo sapiens
atatatgtatatgtat

SEQ ID NO: 1546462 - DNA, 19 bp, Homo sapiens
atatatgtattatttataa

SEQ ID NO: 1546463 - DNA, 20 bp, Homo sapiens
atatatgtattatttataat

SEQ ID NO: 1546464 - DNA, 17 bp, Homo sapiens
atatatgtcaatattta

SEQ ID NO: 1546465 - DNA, 12 bp, Homo sapiens
atatatgtgaac

SEQ ID NO: 1546466 - DNA, 13 bp, Homo sapiens
atatatgtgtgcc

SEQ ID NO: 1546467 - DNA, 22 bp, Homo sapiens
atatatgtgtgtgtatataaat

SEQ ID NO: 1546468 - DNA, 15 bp, Homo sapiens
atatatgtgtgtgtg

SEQ ID NO: 1546469 - DNA, 21 bp, Homo sapiens
atatatgtgtttttcacattt

SEQ ID NO: 1546470 - DNA, 15 bp, Homo sapiens
atatattaaaacaat

SEQ ID NO: 1546471 - DNA, 24 bp, Homo sapiens
atatattaaaacaataatgcaatt

SEQ ID NO: 1546472 - DNA, 15 bp, Homo sapiens
atatattatatatat

SEQ ID NO: 1546473 - DNA, 16 bp, Homo sapiens
atatattatatatatc

SEQ ID NO: 1546474 - DNA, 17 bp, Homo sapiens
atatattatatatatct

SEQ ID NO: 1546475 - DNA, 18 bp, Homo sapiens
atatattattataatctt

SEQ ID NO: 1546476 - DNA, 16 bp, Homo sapiens
atatattcatatacaa

SEQ ID NO: 1546477 - DNA, 18 bp, Homo sapiens
atatattctttcaaagga

SEQ ID NO: 1546478 - DNA, 15 bp, Homo sapiens
atatattgaactttt

SEQ ID NO: 1546479 - DNA, 18 bp, Homo sapiens
atatattgaacttttgta

SEQ ID NO: 1546480 - DNA, 22 bp, Homo sapiens
atatattgaacttttgtactga

SEQ ID NO: 1546481 - DNA, 16 bp, Homo sapiens
atatattgctgcattt

SEQ ID NO: 1546482 - DNA, 14 bp, Homo sapiens
atatattgtacaaa

SEQ ID NO: 1546483 - DNA, 20 bp, Homo sapiens
atatatttaaagggaaattg

SEQ ID NO: 1546484 - DNA, 13 bp, Homo sapiens
atatatttaatga

SEQ ID NO: 1546485 - DNA, 15 bp, Homo sapiens
atatatttaatgata

SEQ ID NO: 1546486 - DNA, 16 bp, Homo sapiens
atatatttaatgataa

SEQ ID NO: 1546487 - DNA, 12 bp, Homo sapiens
atatatttataa

SEQ ID NO: 1546488 - DNA, 22 bp, Homo sapiens
atatatttattttattctatgt

SEQ ID NO: 1546489 - DNA, 22 bp, Homo sapiens
atatatttcacgtgttccctct

SEQ ID NO: 1546490 - DNA, 23 bp, Homo sapiens
atatatttctattattaattgca

SEQ ID NO: 1546491 - DNA, 15 bp, Homo sapiens
atatatttgaaatag

SEQ ID NO: 1546492 - DNA, 23 bp, Homo sapiens
atatattttaaggttgcacacag

SEQ ID NO: 1546493 - DNA, 18 bp, Homo sapiens
atatattttacaattttt

SEQ ID NO: 1546494 - DNA, 22 bp, Homo sapiens
atatattttgtactttgtggag

SEQ ID NO: 1546495 - DNA, 19 bp, Homo sapiens
atatattttgttgttcctc

SEQ ID NO: 1546496 - DNA, 20 bp, Homo sapiens
atatattttgttgttcctct

SEQ ID NO: 1546497 - DNA, 21 bp, Homo sapiens
atatatttttcacagtttttc

SEQ ID NO: 1546498 - DNA, 20 bp, Homo sapiens
atatattttttaatttgatg

SEQ ID NO: 1546499 - DNA, 21 bp, Homo sapiens
atatattttttgttattatta

SEQ ID NO: 1546500 - DNA, 17 bp, Homo sapiens
atatatttttttttgga

SEQ ID NO: 1546501 - DNA, 17 bp, Homo sapiens
atatcaaaaaaccttta

SEQ ID NO: 1546502 - DNA, 19 bp, Homo sapiens
atatcaaaaaacctttaca

SEQ ID NO: 1546503 - DNA, 15 bp, Homo sapiens
atatcaaacattaaa

SEQ ID NO: 1546504 - DNA, 17 bp, Homo sapiens
gatgtctcttgtagaag

SEQ ID NO: 1546505 - DNA, 13 bp, Homo sapiens
gatgtgaaaactc

SEQ ID NO: 1546506 - DNA, 18 bp, Homo sapiens
gatgtgacccaccagtgc

SEQ ID NO: 1546507 - DNA, 21 bp, Homo sapiens
gatgtgacccaccagtgcctt

SEQ ID NO: 1546508 - DNA, 14 bp, Homo sapiens
gatgtgactgtata

SEQ ID NO: 1546509 - DNA, 17 bp, Homo sapiens
gatgtgcaatacatttt

SEQ ID NO: 1546510 - DNA, 15 bp, Homo sapiens
gatgtgctcagccaa

SEQ ID NO: 1546511 - DNA, 24 bp, Homo sapiens
gatgtggagctactgatgaaatct

SEQ ID NO: 1546512 - DNA, 17 bp, Homo sapiens
gatgtggaggaagagcc

SEQ ID NO: 1546513 - DNA, 18 bp, Homo sapiens
gatgtggaggaagagcca

SEQ ID NO: 1546514 - DNA, 21 bp, Homo sapiens
gatgtggaggaagagccacct

SEQ ID NO: 1546515 - DNA, 23 bp, Homo sapiens
gatgtggaggaagagccacctgc

SEQ ID NO: 1546516 - DNA, 13 bp, Homo sapiens
gatgtggccctgg

SEQ ID NO: 1546517 - DNA, 14 bp, Homo sapiens
gatgtggccctggc

SEQ ID NO: 1546518 - DNA, 15 bp, Homo sapiens
gatgtgggtgtcctg

SEQ ID NO: 1546519 - DNA, 16 bp, Homo sapiens
gatgtggtgcttttct

SEQ ID NO: 1546520 - DNA, 13 bp, Homo sapiens
gatgtgtcctcag

SEQ ID NO: 1546521 - DNA, 15 bp, Homo sapiens
gatgtgtggggcatg

SEQ ID NO: 1546522 - DNA, 19 bp, Homo sapiens
gatgtgttcattcaagcta

SEQ ID NO: 1546523 - DNA, 16 bp, Homo sapiens
gatgtgttttgcacgt

SEQ ID NO: 1546524 - DNA, 23 bp, Homo sapiens
gatgtgttttgcacgtcttgcta

SEQ ID NO: 1546525 - DNA, 21 bp, Homo sapiens
gatgttacaagtttatatata

SEQ ID NO: 1546526 - DNA, 14 bp, Homo sapiens
gatgttatgaacag

SEQ ID NO: 1546527 - DNA, 15 bp, Homo sapiens
gatgttatgaacagc

SEQ ID NO: 1546528 - DNA, 19 bp, Homo sapiens
gatgttcagcactgtccct

SEQ ID NO: 1546529 - DNA, 22 bp, Homo sapiens
gatgttcagcactgtcccttgc

SEQ ID NO: 1546530 - DNA, 20 bp, Homo sapiens
gatgttccttccagattgtg

SEQ ID NO: 1546531 - DNA, 12 bp, Homo sapiens
gatgttctaagg

SEQ ID NO: 1546532 - DNA, 13 bp, Homo sapiens
gatgttctaaggc

SEQ ID NO: 1546533 - DNA, 14 bp, Homo sapiens
gatgttctaaggct

SEQ ID NO: 1546534 - DNA, 17 bp, Homo sapiens
gatgttggtccaaagtg

SEQ ID NO: 1546535 - DNA, 14 bp, Homo sapiens
gatgttgttcctgg

SEQ ID NO: 1546536 - DNA, 14 bp, Homo sapiens
gatgtttaacaaat

SEQ ID NO: 1546537 - DNA, 23 bp, Homo sapiens
gatgtttacaggtggacacacaa

SEQ ID NO: 1546538 - DNA, 18 bp, Homo sapiens
gatgtttattcttctaga

SEQ ID NO: 1546539 - DNA, 13 bp, Homo sapiens
gatgtttccagct

SEQ ID NO: 1546540 - DNA, 16 bp, Homo sapiens
gatgtttcctggaagc

SEQ ID NO: 1546541 - DNA, 18 bp, Homo sapiens
gatgtttgcccaaaattt

SEQ ID NO: 1546542 - DNA, 14 bp, Homo sapiens
gatgtttggaaaaa

SEQ ID NO: 1546543 - DNA, 23 bp, Homo sapiens
gatgtttggaaaaaactctgaag

SEQ ID NO: 1546544 - DNA, 12 bp, Homo sapiens
gatgtttggcct

SEQ ID NO: 1546545 - DNA, 14 bp, Homo sapiens
gatgtttgtggcct

SEQ ID NO: 1546546 - DNA, 14 bp, Homo sapiens
gatgttttaaaaaa

SEQ ID NO: 1546547 - DNA, 19 bp, Homo sapiens
gatgttttaaaaaaatttg

SEQ ID NO: 1546548 - DNA, 23 bp, Homo sapiens
atatctctgccaacatgaggaca

SEQ ID NO: 1546549 - DNA, 16 bp, Homo sapiens
atatctgaaaatgtat

SEQ ID NO: 1546550 - DNA, 14 bp, Homo sapiens
atatctgcatgtgt

SEQ ID NO: 1546551 - DNA, 17 bp, Homo sapiens
atatctgcttctagctt

SEQ ID NO: 1546552 - DNA, 16 bp, Homo sapiens
atatctgtaatggtac

SEQ ID NO: 1546553 - DNA, 13 bp, Homo sapiens
atatctgtacaga

SEQ ID NO: 1546554 - DNA, 20 bp, Homo sapiens
atatcttcagctctttttgt

SEQ ID NO: 1546555 - DNA, 19 bp, Homo sapiens
atatctttctcttacctgt

SEQ ID NO: 1546556 - DNA, 20 bp, Homo sapiens
atatgaaaaaaatgcatttt

SEQ ID NO: 1546557 - DNA, 23 bp, Homo sapiens
atatgaaaatacaacttaaataa

SEQ ID NO: 1546558 - DNA, 20 bp, Homo sapiens
atatgaacatattgttgaaa

SEQ ID NO: 1546559 - DNA, 20 bp, Homo sapiens
atatgaacctattttcattt

SEQ ID NO: 1546560 - DNA, 13 bp, Homo sapiens
atatgaaggagag

SEQ ID NO: 1546561 - DNA, 13 bp, Homo sapiens
atatgaatctgct

SEQ ID NO: 1546562 - DNA, 11 bp, Homo sapiens
atatgaatgaa

SEQ ID NO: 1546563 - DNA, 14 bp, Homo sapiens
atatgacaaatgtt

SEQ ID NO: 1546564 - DNA, 15 bp, Homo sapiens
atatgacagctgtcc

SEQ ID NO: 1546565 - DNA, 21 bp, Homo sapiens
atatgacagctgtccctgtca

SEQ ID NO: 1546566 - DNA, 21 bp, Homo sapiens
atatgacttcctagggatctg

SEQ ID NO: 1546567 - DNA, 17 bp, Homo sapiens
atatgagcttcaatata

SEQ ID NO: 1546568 - DNA, 19 bp, Homo sapiens
atatgagtagatactctca

SEQ ID NO: 1546569 - DNA, 14 bp, Homo sapiens
atatgatatgtaaa

SEQ ID NO: 1546570 - DNA, 16 bp, Homo sapiens
atatgatatgtaaaca

SEQ ID NO: 1546571 - DNA, 12 bp, Homo sapiens
atatgattctct

SEQ ID NO: 1546572 - DNA, 16 bp, Homo sapiens
atatgattctctgtgg

SEQ ID NO: 1546573 - DNA, 15 bp, Homo sapiens
atatgatttaaaaca

SEQ ID NO: 1546574 - DNA, 19 bp, Homo sapiens
atatgattttatttgacaa

SEQ ID NO: 1546575 - DNA, 23 bp, Homo sapiens
atatgcaaagcactgacttctaa

SEQ ID NO: 1546576 - DNA, 17 bp, Homo sapiens
atatgcaccttgtgtct

SEQ ID NO: 1546577 - DNA, 19 bp, Homo sapiens
atatgcaccttgtgtctgt

SEQ ID NO: 1546578 - DNA, 22 bp, Homo sapiens
atatgccatttatagagataag

SEQ ID NO: 1546579 - DNA, 16 bp, Homo sapiens
atatgcctgattcata

SEQ ID NO: 1546580 - DNA, 20 bp, Homo sapiens
atatgctctgcatgttacat

SEQ ID NO: 1546581 - DNA, 17 bp, Homo sapiens
atatgctgatcttttaa

SEQ ID NO: 1546582 - DNA, 16 bp, Homo sapiens
atatggaagcaaccag

SEQ ID NO: 1546583 - DNA, 15 bp, Homo sapiens
atatggaattttgca

SEQ ID NO: 1546584 - DNA, 19 bp, Homo sapiens
atatggaattttgcaaaga

SEQ ID NO: 1546585 - DNA, 22 bp, Homo sapiens
atatggagtgagtcacctgctc

SEQ ID NO: 1546586 - DNA, 23 bp, Homo sapiens
atatggagtgagtcacctgctcc

SEQ ID NO: 1546587 - DNA, 18 bp, Homo sapiens
atatggatgattcagaaa

SEQ ID NO: 1546588 - DNA, 19 bp, Homo sapiens
atatggcaaatagccacaa

SEQ ID NO: 1546589 - DNA, 15 bp, Homo sapiens
atatggctgcccagg

SEQ ID NO: 1546590 - DNA, 17 bp, Homo sapiens
atatggctgcccaggag

SEQ ID NO: 1546591 - DNA, 21 bp, Homo sapiens
atatgggaacaaattagagga

SEQ ID NO: 1546592 - DNA, 20 bp, Homo sapiens
atatgggggcctggattcat

SEQ ID NO: 1546593 - DNA, 17 bp, Homo sapiens
atatggtgaagggaagt

SEQ ID NO: 1546594 - DNA, 17 bp, Homo sapiens
atatggttctccaagaa

SEQ ID NO: 1546595 - DNA, 20 bp, Homo sapiens
atatgtaaaataaaattatg

SEQ ID NO: 1546596 - DNA, 22 bp, Homo sapiens
atatgtaacagttggtgatttt

SEQ ID NO: 1546597 - DNA, 14 bp, Homo sapiens
atatgtaagtactt

SEQ ID NO: 1546598 - DNA, 14 bp, Homo sapiens
atatgtaattcttt

SEQ ID NO: 1546599 - DNA, 21 bp, Homo sapiens
atatgtaatttcaaaatacat

SEQ ID NO: 1546600 - DNA, 12 bp, Homo sapiens
atatgtacattt

SEQ ID NO: 1546601 - DNA, 14 bp, Homo sapiens
atatgtaccatgta

SEQ ID NO: 1546602 - DNA, 18 bp, Homo sapiens
atatgtactaagaatgtc

SEQ ID NO: 1546603 - DNA, 16 bp, Homo sapiens
atatgtagaaggcaca

SEQ ID NO: 1546604 - DNA, 18 bp, Homo sapiens
atatgtagtataaagaaa

SEQ ID NO: 1546605 - DNA, 19 bp, Homo sapiens
atatgtagtataaagaaaa

SEQ ID NO: 1546606 - DNA, 19 bp, Homo sapiens
atatgtataatatatatct

SEQ ID NO: 1546607 - DNA, 14 bp, Homo sapiens
atatgtatatatat

SEQ ID NO: 1546608 - DNA, 14 bp, Homo sapiens
atatgtatatgtat

SEQ ID NO: 1546609 - DNA, 18 bp, Homo sapiens
atatgtatatgtatatat

SEQ ID NO: 1546610 - DNA, 12 bp, Homo sapiens
atatgtatcata

SEQ ID NO: 1546611 - DNA, 17 bp, Homo sapiens
atatgtattcccttgta

SEQ ID NO: 1546612 - DNA, 19 bp, Homo sapiens
atatgtattcccttgtatt

SEQ ID NO: 1546613 - DNA, 18 bp, Homo sapiens
atatgtattcttttctca

SEQ ID NO: 1546614 - DNA, 20 bp, Homo sapiens
atatgtattcttttctcagt

SEQ ID NO: 1546615 - DNA, 21 bp, Homo sapiens
atatgtcgtagaattccttcg

SEQ ID NO: 1546616 - DNA, 14 bp, Homo sapiens
atatgtgcagtctt

SEQ ID NO: 1546617 - DNA, 13 bp, Homo sapiens
atatgtgccttaa

SEQ ID NO: 1546618 - DNA, 14 bp, Homo sapiens
atatgtgccttaag

SEQ ID NO: 1546619 - DNA, 14 bp, Homo sapiens
atatgtgtatgtac

SEQ ID NO: 1546620 - DNA, 17 bp, Homo sapiens
atatgtgtgtgtatata

SEQ ID NO: 1546621 - DNA, 23 bp, Homo sapiens
atatgtgtgtgtgtgtgttgctt

SEQ ID NO: 1546622 - DNA, 14 bp, Homo sapiens
gattcagaatgaga

SEQ ID NO: 1546623 - DNA, 15 bp, Homo sapiens
gattcaggcagcagt

SEQ ID NO: 1546624 - DNA, 20 bp, Homo sapiens
gattcaggcagcagtgtctg

SEQ ID NO: 1546625 - DNA, 15 bp, Homo sapiens
gattcaggccagccc

SEQ ID NO: 1546626 - DNA, 16 bp, Homo sapiens
gattcaggccagccca

SEQ ID NO: 1546627 - DNA, 20 bp, Homo sapiens
gattcaggccagcccagcca

SEQ ID NO: 1546628 - DNA, 22 bp, Homo sapiens
gattcaggccagcccagccagg

SEQ ID NO: 1546629 - DNA, 12 bp, Homo sapiens
gattcaggctgc

SEQ ID NO: 1546630 - DNA, 16 bp, Homo sapiens
gattcaggctgcttgg

SEQ ID NO: 1546631 - DNA, 13 bp, Homo sapiens
gattcagtcacat

SEQ ID NO: 1546632 - DNA, 12 bp, Homo sapiens
gattcatgattt

SEQ ID NO: 1546633 - DNA, 17 bp, Homo sapiens
gattcatgatttataaa

SEQ ID NO: 1546634 - DNA, 13 bp, Homo sapiens
gattcatttcctg

SEQ ID NO: 1546635 - DNA, 13 bp, Homo sapiens
gattcattttcct

SEQ ID NO: 1546636 - DNA, 19 bp, Homo sapiens
gattcatttttaatcatga

SEQ ID NO: 1546637 - DNA, 14 bp, Homo sapiens
gattccaaaaacat

SEQ ID NO: 1546638 - DNA, 18 bp, Homo sapiens
gattccattggtccaaga

SEQ ID NO: 1546639 - DNA, 14 bp, Homo sapiens
gattcccaactcct

SEQ ID NO: 1546640 - DNA, 23 bp, Homo sapiens
gattcccactgccgctgcccgct

SEQ ID NO: 1546641 - DNA, 11 bp, Homo sapiens
gattcccccag

SEQ ID NO: 1546642 - DNA, 13 bp, Homo sapiens
gattcccccagcc

SEQ ID NO: 1546643 - DNA, 15 bp, Homo sapiens
gattcccctgtgtca

SEQ ID NO: 1546644 - DNA, 18 bp, Homo sapiens
gattcctgacccaggccg

SEQ ID NO: 1546645 - DNA, 16 bp, Homo sapiens
gattcctggtttgact

SEQ ID NO: 1546646 - DNA, 22 bp, Homo sapiens
gattccttttgatggggagaaa

SEQ ID NO: 1546647 - DNA, 13 bp, Homo sapiens
gattcgctgtccc

SEQ ID NO: 1546648 - DNA, 16 bp, Homo sapiens
gattcggtatcccccc

SEQ ID NO: 1546649 - DNA, 12 bp, Homo sapiens
gattctaaaatg

SEQ ID NO: 1546650 - DNA, 13 bp, Homo sapiens
gattctaaataca

SEQ ID NO: 1546651 - DNA, 15 bp, Homo sapiens
gattctaatgatgat

SEQ ID NO: 1546652 - DNA, 22 bp, Homo sapiens
gattctacaaaaaaccaggatg

SEQ ID NO: 1546653 - DNA, 17 bp, Homo sapiens
gattctatagttctaga

SEQ ID NO: 1546654 - DNA, 20 bp, Homo sapiens
gattctcccgcctcagcctc

SEQ ID NO: 1546655 - DNA, 14 bp, Homo sapiens
gattctcctgtgct

SEQ ID NO: 1546656 - DNA, 16 bp, Homo sapiens
gattctcctgtgctag

SEQ ID NO: 1546657 - DNA, 11 bp, Homo sapiens
gattctccttc

SEQ ID NO: 1546658 - DNA, 12 bp, Homo sapiens
gattctccttca

SEQ ID NO: 1546659 - DNA, 16 bp, Homo sapiens
gattctctctttaacc

SEQ ID NO: 1546660 - DNA, 23 bp, Homo sapiens
gattctctgtgtctaagattcta

SEQ ID NO: 1546661 - DNA, 21 bp, Homo sapiens
gattctcttgagataaggttt

SEQ ID NO: 1546662 - DNA, 22 bp, Homo sapiens
gattctcttgagataaggtttt

SEQ ID NO: 1546663 - DNA, 19 bp, Homo sapiens
atattacctctcttggaaa

SEQ ID NO: 1546664 - DNA, 23 bp, Homo sapiens
atattactctcaaaatctttgta

SEQ ID NO: 1546665 - DNA, 14 bp, Homo sapiens
atattactgacatt

SEQ ID NO: 1546666 - DNA, 15 bp, Homo sapiens
atattactgacattt

SEQ ID NO: 1546667 - DNA, 17 bp, Homo sapiens
atattactgacatttct

SEQ ID NO: 1546668 - DNA, 20 bp, Homo sapiens
atattactgttgcatttact

SEQ ID NO: 1546669 - DNA, 13 bp, Homo sapiens
atattactttgtc

SEQ ID NO: 1546670 - DNA, 15 bp, Homo sapiens
atattagaaaggctc

SEQ ID NO: 1546671 - DNA, 15 bp, Homo sapiens
atattaggaaaatat

SEQ ID NO: 1546672 - DNA, 21 bp, Homo sapiens
atattaggatctgcaaacaat

SEQ ID NO: 1546673 - DNA, 19 bp, Homo sapiens
atattagtattatcttgtt

SEQ ID NO: 1546674 - DNA, 14 bp, Homo sapiens
atattagtgattct

SEQ ID NO: 1546675 - DNA, 14 bp, Homo sapiens
atattagttaatga

SEQ ID NO: 1546676 - DNA, 17 bp, Homo sapiens
atattataacttaaaaa

SEQ ID NO: 1546677 - DNA, 17 bp, Homo sapiens
atattataagggagagc

SEQ ID NO: 1546678 - DNA, 12 bp, Homo sapiens
atattatagaaa

SEQ ID NO: 1546679 - DNA, 15 bp, Homo sapiens
atattatataggata

SEQ ID NO: 1546680 - DNA, 14 bp, Homo sapiens
atattatatatatc

SEQ ID NO: 1546681 - DNA, 16 bp, Homo sapiens
atattatatatatcta

SEQ ID NO: 1546682 - DNA, 18 bp, Homo sapiens
atattatgtcttcttttg

SEQ ID NO: 1546683 - DNA, 23 bp, Homo sapiens
atattatgttcctcaaggtccat

SEQ ID NO: 1546684 - DNA, 19 bp, Homo sapiens
atattattagaaattagaa

SEQ ID NO: 1546685 - DNA, 21 bp, Homo sapiens
atattattataatcttataat

SEQ ID NO: 1546686 - DNA, 21 bp, Homo sapiens
atattcaatgcatttaaaata

SEQ ID NO: 1546687 - DNA, 13 bp, Homo sapiens
atattcacatctt

SEQ ID NO: 1546688 - DNA, 18 bp, Homo sapiens
atattcagccagcttaaa

SEQ ID NO: 1546689 - DNA, 18 bp, Homo sapiens
atattcattggcagctca

SEQ ID NO: 1546690 - DNA, 17 bp, Homo sapiens
atattccaccattcaca

SEQ ID NO: 1546691 - DNA, 20 bp, Homo sapiens
atattccaccattcacattt

SEQ ID NO: 1546692 - DNA, 16 bp, Homo sapiens
atattccatgaatgta

SEQ ID NO: 1546693 - DNA, 17 bp, Homo sapiens
atattccatttacataa

SEQ ID NO: 1546694 - DNA, 21 bp, Homo sapiens
atattcctaacttacccagat

SEQ ID NO: 1546695 - DNA, 18 bp, Homo sapiens
atattcctgaatgaaata

SEQ ID NO: 1546696 - DNA, 23 bp, Homo sapiens
atattcctgaatgaaatatcaga

SEQ ID NO: 1546697 - DNA, 14 bp, Homo sapiens
atattcctggactt

SEQ ID NO: 1546698 - DNA, 23 bp, Homo sapiens
atattctactggcctgtaatcta

SEQ ID NO: 1546699 - DNA, 15 bp, Homo sapiens
atattctatttttat

SEQ ID NO: 1546700 - DNA, 13 bp, Homo sapiens
atattctctctgt

SEQ ID NO: 1546701 - DNA, 15 bp, Homo sapiens
atattctttcaaagg

SEQ ID NO: 1546702 - DNA, 24 bp, Homo sapiens
atattctttctcataaaactgtga

SEQ ID NO: 1546703 - DNA, 23 bp, Homo sapiens
atattgaaaattgaaaagtacaa

SEQ ID NO: 1546704 - DNA, 12 bp, Homo sapiens
atattgaacttt

SEQ ID NO: 1546705 - DNA, 18 bp, Homo sapiens
atattgaacttttgtact

SEQ ID NO: 1546706 - DNA, 20 bp, Homo sapiens
atattgaacttttgtactga

SEQ ID NO: 1546707 - DNA, 21 bp, Homo sapiens
atattgaagacaatttgatac

SEQ ID NO: 1546708 - DNA, 13 bp, Homo sapiens
atattgaagttgt

SEQ ID NO: 1546709 - DNA, 22 bp, Homo sapiens
atattgaagttgtttatcaact

SEQ ID NO: 1546710 - DNA, 12 bp, Homo sapiens
atattgacattt

SEQ ID NO: 1546711 - DNA, 16 bp, Homo sapiens
atattgacatttgtag

SEQ ID NO: 1546712 - DNA, 20 bp, Homo sapiens
atattgacatttgtagttga

SEQ ID NO: 1546713 - DNA, 21 bp, Homo sapiens
atattgagatcagcattcaaa

SEQ ID NO: 1546714 - DNA, 14 bp, Homo sapiens
atattgccttattt

SEQ ID NO: 1546715 - DNA, 15 bp, Homo sapiens
atattgctgtgtctt

SEQ ID NO: 1546716 - DNA, 18 bp, Homo sapiens
atattggaattataaata

SEQ ID NO: 1546717 - DNA, 19 bp, Homo sapiens
atattggtgcgtttttaca

SEQ ID NO: 1546718 - DNA, 16 bp, Homo sapiens
atattggttcttcccc

SEQ ID NO: 1546719 - DNA, 17 bp, Homo sapiens
atattggtttatgtagt

SEQ ID NO: 1546720 - DNA, 17 bp, Homo sapiens
atattgtaaaacaggta

SEQ ID NO: 1546721 - DNA, 14 bp, Homo sapiens
atattgtaaatact

SEQ ID NO: 1546722 - DNA, 22 bp, Homo sapiens
atattgtaaatactggactcag

SEQ ID NO: 1546723 - DNA, 15 bp, Homo sapiens
atattgtagcagtta

SEQ ID NO: 1546724 - DNA, 12 bp, Homo sapiens
atattgtatgta

SEQ ID NO: 1546725 - DNA, 18 bp, Homo sapiens
atattgtattactagaag

SEQ ID NO: 1546726 - DNA, 17 bp, Homo sapiens
atattgtgttgtgaatg

SEQ ID NO: 1546727 - DNA, 21 bp, Homo sapiens
atattgttagtggacttgttt

SEQ ID NO: 1546728 - DNA, 21 bp, Homo sapiens
atattgttgacaactgtgact

SEQ ID NO: 1546729 - DNA, 21 bp, Homo sapiens
atattgtttggtaaatgtttc

SEQ ID NO: 1546730 - DNA, 20 bp, Homo sapiens
atattgttttcagtgtacat

SEQ ID NO: 1546731 - DNA, 14 bp, Homo sapiens
atatttaaaaataa

SEQ ID NO: 1546732 - DNA, 14 bp, Homo sapiens
atatttaaaaattg

SEQ ID NO: 1546733 - DNA, 18 bp, Homo sapiens
atatttaaaaattgtttc

SEQ ID NO: 1546734 - DNA, 12 bp, Homo sapiens
atatttaaaggg

SEQ ID NO: 1546735 - DNA, 17 bp, Homo sapiens
atatttaacaatgacaa

SEQ ID NO: 1546736 - DNA, 22 bp, Homo sapiens
atatttaacattatttatatgg

SEQ ID NO: 1546737 - DNA, 16 bp, Homo sapiens
atatttaagaaaatac

SEQ ID NO: 1546738 - DNA, 18 bp, Homo sapiens
atatttaagaaaatacaa

SEQ ID NO: 1546739 - DNA, 13 bp, Homo sapiens
atatttaagtata

SEQ ID NO: 1546740 - DNA, 14 bp, Homo sapiens
atatttaatatcaa

SEQ ID NO: 1546741 - DNA, 19 bp, Homo sapiens
gatttatgtgcactgcctg

SEQ ID NO: 1546742 - DNA, 20 bp, Homo sapiens
gatttatttggagtggaggc

SEQ ID NO: 1546743 - DNA, 20 bp, Homo sapiens
gatttcactaggactcagaa

SEQ ID NO: 1546744 - DNA, 15 bp, Homo sapiens
gatttcagtttttca

SEQ ID NO: 1546745 - DNA, 23 bp, Homo sapiens
gatttcatacctcagaatgtaaa

SEQ ID NO: 1546746 - DNA, 15 bp, Homo sapiens
gatttcatctgctct

SEQ ID NO: 1546747 - DNA, 19 bp, Homo sapiens
gatttcatcttctggaata

SEQ ID NO: 1546748 - DNA, 18 bp, Homo sapiens
gatttcatgctatctctg

SEQ ID NO: 1546749 - DNA, 20 bp, Homo sapiens
gatttcatgctatctctgtg

SEQ ID NO: 1546750 - DNA, 22 bp, Homo sapiens
gatttccagaaccacacttgaa

SEQ ID NO: 1546751 - DNA, 13 bp, Homo sapiens
gatttccaggccc

SEQ ID NO: 1546752 - DNA, 14 bp, Homo sapiens
gatttccaggcccc

SEQ ID NO: 1546753 - DNA, 17 bp, Homo sapiens
gatttccatcttaatgt

SEQ ID NO: 1546754 - DNA, 22 bp, Homo sapiens
gatttccatgggccccaccatt

SEQ ID NO: 1546755 - DNA, 19 bp, Homo sapiens
gatttcccactgcactcca

SEQ ID NO: 1546756 - DNA, 13 bp, Homo sapiens
gatttcctaatac

SEQ ID NO: 1546757 - DNA, 18 bp, Homo sapiens
gatttcctacagaaatac

SEQ ID NO: 1546758 - DNA, 23 bp, Homo sapiens
gatttcctcctcccagtgccttc

SEQ ID NO: 1546759 - DNA, 22 bp, Homo sapiens
gatttctaacagtccttgcttt

SEQ ID NO: 1546760 - DNA, 15 bp, Homo sapiens
gatttctaattgtaa

SEQ ID NO: 1546761 - DNA, 23 bp, Homo sapiens
gatttctcactatatatatttct

SEQ ID NO: 1546762 - DNA, 11 bp, Homo sapiens
gatttctctga

SEQ ID NO: 1546763 - DNA, 17 bp, Homo sapiens
gatttctggcatatgtt

SEQ ID NO: 1546764 - DNA, 12 bp, Homo sapiens
gatttctgggat

SEQ ID NO: 1546765 - DNA, 15 bp, Homo sapiens
gatttgaaaaatata

SEQ ID NO: 1546766 - DNA, 16 bp, Homo sapiens
gatttgaaaaatataa

SEQ ID NO: 1546767 - DNA, 13 bp, Homo sapiens
gatttgaatccag

SEQ ID NO: 1546768 - DNA, 14 bp, Homo sapiens
gatttgaattctgt

SEQ ID NO: 1546769 - DNA, 21 bp, Homo sapiens
gatttgatgagttaactgtga

SEQ ID NO: 1546770 - DNA, 19 bp, Homo sapiens
gatttgattcattttcctg

SEQ ID NO: 1546771 - DNA, 20 bp, Homo sapiens
gatttgattcattttcctgt

SEQ ID NO: 1546772 - DNA, 17 bp, Homo sapiens
gatttgcaaatgcacat

SEQ ID NO: 1546773 - DNA, 20 bp, Homo sapiens
gatttgcatttcagaatatt

SEQ ID NO: 1546774 - DNA, 15 bp, Homo sapiens
gatttgccaaaaact

SEQ ID NO: 1546775 - DNA, 12 bp, Homo sapiens
gatttgccagca

SEQ ID NO: 1546776 - DNA, 15 bp, Homo sapiens
gatttgccagcacag

SEQ ID NO: 1546777 - DNA, 14 bp, Homo sapiens
gatttgccattcaa

SEQ ID NO: 1546778 - DNA, 20 bp, Homo sapiens
atatttctaagcttatttct

SEQ ID NO: 1546779 - DNA, 16 bp, Homo sapiens
atatttctattgaatt

SEQ ID NO: 1546780 - DNA, 11 bp, Homo sapiens
atatttctcaa

SEQ ID NO: 1546781 - DNA, 23 bp, Homo sapiens
atatttctgtggagggttgccat

SEQ ID NO: 1546782 - DNA, 22 bp, Homo sapiens
atatttcttcttctaagaagac

SEQ ID NO: 1546783 - DNA, 19 bp, Homo sapiens
atatttcttgctgcttcta

SEQ ID NO: 1546784 - DNA, 13 bp, Homo sapiens
atatttgaaactg

SEQ ID NO: 1546785 - DNA, 14 bp, Homo sapiens
atatttgaagggtc

SEQ ID NO: 1546786 - DNA, 12 bp, Homo sapiens
atatttgacatg

SEQ ID NO: 1546787 - DNA, 14 bp, Homo sapiens
atatttgagaataa

SEQ ID NO: 1546788 - DNA, 18 bp, Homo sapiens
atatttgattatgtatgg

SEQ ID NO: 1546789 - DNA, 14 bp, Homo sapiens
atatttgatttcta

SEQ ID NO: 1546790 - DNA, 15 bp, Homo sapiens
atatttgatttctaa

SEQ ID NO: 1546791 - DNA, 16 bp, Homo sapiens
atatttgccaataaag

SEQ ID NO: 1546792 - DNA, 18 bp, Homo sapiens
atatttgccaataaagct

SEQ ID NO: 1546793 - DNA, 16 bp, Homo sapiens
atatttggaaagagac

SEQ ID NO: 1546794 - DNA, 23 bp, Homo sapiens
atatttggggtccttttttatac

SEQ ID NO: 1546795 - DNA, 19 bp, Homo sapiens
atatttgtagctagaatat

SEQ ID NO: 1546796 - DNA, 22 bp, Homo sapiens
atatttgtatcacaaatcttaa

SEQ ID NO: 1546797 - DNA, 18 bp, Homo sapiens
atatttgtatttattctt

SEQ ID NO: 1546798 - DNA, 19 bp, Homo sapiens
atatttgtatttattcttt

SEQ ID NO: 1546799 - DNA, 21 bp, Homo sapiens
atatttgtatttatttccaga

SEQ ID NO: 1546800 - DNA, 16 bp, Homo sapiens
atatttgtttatggta

SEQ ID NO: 1546801 - DNA, 15 bp, Homo sapiens
atattttaaaatttg

SEQ ID NO: 1546802 - DNA, 14 bp, Homo sapiens
atattttaaatctg

SEQ ID NO: 1546803 - DNA, 15 bp, Homo sapiens
atattttaatgaata

SEQ ID NO: 1546804 - DNA, 23 bp, Homo sapiens
atattttacattcttggaaagtc

SEQ ID NO: 1546805 - DNA, 18 bp, Homo sapiens
atattttatgaacattgt

SEQ ID NO: 1546806 - DNA, 13 bp, Homo sapiens
atattttcaaaat

SEQ ID NO: 1546807 - DNA, 19 bp, Homo sapiens
atattttcaacgcagccct

SEQ ID NO: 1546808 - DNA, 13 bp, Homo sapiens
atattttcagagc

SEQ ID NO: 1546809 - DNA, 18 bp, Homo sapiens
atattttcattaaaagct

SEQ ID NO: 1546810 - DNA, 21 bp, Homo sapiens
atattttcctagtagatctat

SEQ ID NO: 1546811 - DNA, 17 bp, Homo sapiens
atattttgctaactggt

SEQ ID NO: 1546812 - DNA, 20 bp, Homo sapiens
atattttgctaactggttaa

SEQ ID NO: 1546813 - DNA, 21 bp, Homo sapiens
atattttggctcaaataaaat

SEQ ID NO: 1546814 - DNA, 14 bp, Homo sapiens
atatttttaagata

SEQ ID NO: 1546815 - DNA, 20 bp, Homo sapiens
atatttttaagataataata

SEQ ID NO: 1546816 - DNA, 19 bp, Homo sapiens
atatttttagactatttct

SEQ ID NO: 1546817 - DNA, 16 bp, Homo sapiens
atatttttagactcat

SEQ ID NO: 1546818 - DNA, 13 bp, Homo sapiens
atatttttatact

SEQ ID NO: 1546819 - DNA, 16 bp, Homo sapiens
atatttttatacttta

SEQ ID NO: 1546820 - DNA, 13 bp, Homo sapiens
atatttttataga

SEQ ID NO: 1546821 - DNA, 14 bp, Homo sapiens
atatttttatagac

SEQ ID NO: 1546822 - DNA, 20 bp, Homo sapiens
atatttttatatttccttta

SEQ ID NO: 1546823 - DNA, 21 bp, Homo sapiens
atatttttatatttcctttat

SEQ ID NO: 1546824 - DNA, 19 bp, Homo sapiens
atatttttcaattttgaaa

SEQ ID NO: 1546825 - DNA, 17 bp, Homo sapiens
atatttttcacatatct

SEQ ID NO: 1546826 - DNA, 14 bp, Homo sapiens
atatttttccattt

SEQ ID NO: 1546827 - DNA, 22 bp, Homo sapiens
atatttttggggcatcctggat

SEQ ID NO: 1546828 - DNA, 15 bp, Homo sapiens
atatttttgtacata

SEQ ID NO: 1546829 - DNA, 22 bp, Homo sapiens
atatttttgtacatattgttag

SEQ ID NO: 1546830 - DNA, 13 bp, Homo sapiens
atatttttgtatt

SEQ ID NO: 1546831 - DNA, 19 bp, Homo sapiens
atatttttgtatttctcta

SEQ ID NO: 1546832 - DNA, 22 bp, Homo sapiens
atatttttgtgttttcttgtaa

SEQ ID NO: 1546833 - DNA, 13 bp, Homo sapiens
atattttttatga

SEQ ID NO: 1546834 - DNA, 13 bp, Homo sapiens
atattttttgctc

SEQ ID NO: 1546835 - DNA, 16 bp, Homo sapiens
atatttttttaattta

SEQ ID NO: 1546836 - DNA, 16 bp, Homo sapiens
atatttttttctaaga

SEQ ID NO: 1546837 - DNA, 17 bp, Homo sapiens
atatttttttctagcta

SEQ ID NO: 1546838 - DNA, 18 bp, Homo sapiens
atatttttttctagctat

SEQ ID NO: 1546839 - DNA, 20 bp, Homo sapiens
atatttttttctttctttgt

SEQ ID NO: 1546840 - DNA, 16 bp, Homo sapiens
atatttttttttggat

SEQ ID NO: 1546841 - DNA, 17 bp, Homo sapiens
atcaaaactttcgttgt

SEQ ID NO: 1546842 - DNA, 19 bp, Homo sapiens
atcaaaagaaaattgatat

SEQ ID NO: 1546843 - DNA, 24 bp, Homo sapiens
atcaaaaggttaataaagtaatta

SEQ ID NO: 1546844 - DNA, 14 bp, Homo sapiens
atcaaaataaaaag

SEQ ID NO: 1546845 - DNA, 22 bp, Homo sapiens
atcaaaatcactatctttctga

SEQ ID NO: 1546846 - DNA, 15 bp, Homo sapiens
atcaaacatgcacac

SEQ ID NO: 1546847 - DNA, 15 bp, Homo sapiens
atcaaacattaaaaa

SEQ ID NO: 1546848 - DNA, 18 bp, Homo sapiens
atcaaaccctagccttgc

SEQ ID NO: 1546849 - DNA, 20 bp, Homo sapiens
atcaaaccctagccttgctt

SEQ ID NO: 1546850 - DNA, 20 bp, Homo sapiens
atcaaacctcacatttgtga

SEQ ID NO: 1546851 - DNA, 18 bp, Homo sapiens
atcaaagaaattcagaac

SEQ ID NO: 1546852 - DNA, 14 bp, Homo sapiens
atcaaagaacagat

SEQ ID NO: 1546853 - DNA, 16 bp, Homo sapiens
atcaaagaacagatgg

SEQ ID NO: 1546854 - DNA, 15 bp, Homo sapiens
atcaaagaattacag

SEQ ID NO: 1546855 - DNA, 17 bp, Homo sapiens
atcaaagaattacagta

SEQ ID NO: 1546856 - DNA, 12 bp, Homo sapiens
atcaaagatgaa

SEQ ID NO: 1546857 - DNA, 15 bp, Homo sapiens
atcaaagcaagggct

SEQ ID NO: 1546858 - DNA, 16 bp, Homo sapiens
atcaaagcagaagtct

SEQ ID NO: 1546859 - DNA, 19 bp, Homo sapiens
gcaaagcgggttataatga

SEQ ID NO: 1546860 - DNA, 20 bp, Homo sapiens
gcaaagctttggctgagacc

SEQ ID NO: 1546861 - DNA, 20 bp, Homo sapiens
gcaaaggaaggtggatggcc

SEQ ID NO: 1546862 - DNA, 12 bp, Homo sapiens
gcaaaggagaag

SEQ ID NO: 1546863 - DNA, 18 bp, Homo sapiens
gcaaaggctccctcgccc

SEQ ID NO: 1546864 - DNA, 18 bp, Homo sapiens
gcaaagggagcactgggt

SEQ ID NO: 1546865 - DNA, 17 bp, Homo sapiens
gcaaagggagcagaact

SEQ ID NO: 1546866 - DNA, 18 bp, Homo sapiens
gcaaagggagcagaactg

SEQ ID NO: 1546867 - DNA, 20 bp, Homo sapiens
gcaaaggggctgaaagaaca

SEQ ID NO: 1546868 - DNA, 14 bp, Homo sapiens
gcaaaggtgcctca

SEQ ID NO: 1546869 - DNA, 16 bp, Homo sapiens
gcaaagtcacttctcc

SEQ ID NO: 1546870 - DNA, 16 bp, Homo sapiens
gcaaagtgctgtaccc

SEQ ID NO: 1546871 - DNA, 19 bp, Homo sapiens
gcaaagtttacagatgttt

SEQ ID NO: 1546872 - DNA, 18 bp, Homo sapiens
gcaaataaggacagcagc

SEQ ID NO: 1546873 - DNA, 20 bp, Homo sapiens
gcaaataaggacagcagctg

SEQ ID NO: 1546874 - DNA, 21 bp, Homo sapiens
gcaaataatggaaaaatagta

SEQ ID NO: 1546875 - DNA, 23 bp, Homo sapiens
gcaaatagccacaattatataaa

SEQ ID NO: 1546876 - DNA, 19 bp, Homo sapiens
gcaaatagtagacatttgt

SEQ ID NO: 1546877 - DNA, 17 bp, Homo sapiens
gcaaatataagctggga

SEQ ID NO: 1546878 - DNA, 13 bp, Homo sapiens
gcaaatatatgat

SEQ ID NO: 1546879 - DNA, 18 bp, Homo sapiens
gcaaatattgaagttgtt

SEQ ID NO: 1546880 - DNA, 20 bp, Homo sapiens
gcaaatattgaagttgttta

SEQ ID NO: 1546881 - DNA, 13 bp, Homo sapiens
gcaaatcagaaac

SEQ ID NO: 1546882 - DNA, 20 bp, Homo sapiens
gcaaatcagaaacttgtgaa

SEQ ID NO: 1546883 - DNA, 17 bp, Homo sapiens
gcaaatcaggcttttgt

SEQ ID NO: 1546884 - DNA, 18 bp, Homo sapiens
gcaaatcagttactaaga

SEQ ID NO: 1546885 - DNA, 18 bp, Homo sapiens
gcaaatcatttgtttaaa

SEQ ID NO: 1546886 - DNA, 19 bp, Homo sapiens
gcaaatgacatgcactgac

SEQ ID NO: 1546887 - DNA, 15 bp, Homo sapiens
gcaaatgcaaaaata

SEQ ID NO: 1546888 - DNA, 18 bp, Homo sapiens
gcaaatgcacatttgtca

SEQ ID NO: 1546889 - DNA, 19 bp, Homo sapiens
gcaaatggaggcttttcac

SEQ ID NO: 1546890 - DNA, 15 bp, Homo sapiens
gcaaatggctgagat

SEQ ID NO: 1546891 - DNA, 19 bp, Homo sapiens
gcaaatggctgagatggag

SEQ ID NO: 1546892 - DNA, 23 bp, Homo sapiens
gcaaatgggtgcccgtatccaga

SEQ ID NO: 1546893 - DNA, 19 bp, Homo sapiens
atcaagcacttcccaggat

SEQ ID NO: 1546894 - DNA, 13 bp, Homo sapiens
atcaagcccttta

SEQ ID NO: 1546895 - DNA, 14 bp, Homo sapiens
atcaagcctttatg

SEQ ID NO: 1546896 - DNA, 22 bp, Homo sapiens
atcaagggagacaccagtggtg

SEQ ID NO: 1546897 - DNA, 21 bp, Homo sapiens
atcaagggcctatcttggaga

SEQ ID NO: 1546898 - DNA, 23 bp, Homo sapiens
atcaaggttataattttttttaa

SEQ ID NO: 1546899 - DNA, 12 bp, Homo sapiens
atcaagtcaccg

SEQ ID NO: 1546900 - DNA, 17 bp, Homo sapiens
atcaagtccatctgaca

SEQ ID NO: 1546901 - DNA, 17 bp, Homo sapiens
atcaagtggcatgtgct

SEQ ID NO: 1546902 - DNA, 23 bp, Homo sapiens
atcaagttgtaacttatattgaa

SEQ ID NO: 1546903 - DNA, 15 bp, Homo sapiens
atcaataaaatgtga

SEQ ID NO: 1546904 - DNA, 16 bp, Homo sapiens
atcaataaaatgtgat

SEQ ID NO: 1546905 - DNA, 17 bp, Homo sapiens
atcaatacactagttgt

SEQ ID NO: 1546906 - DNA, 11 bp, Homo sapiens
atcaatacaga

SEQ ID NO: 1546907 - DNA, 15 bp, Homo sapiens
atcaatatctaatat

SEQ ID NO: 1546908 - DNA, 15 bp, Homo sapiens
atcaatcaaataagt

SEQ ID NO: 1546909 - DNA, 19 bp, Homo sapiens
atcaatcaaataagtattt

SEQ ID NO: 1546910 - DNA, 19 bp, Homo sapiens
atcaatcctgattcctctc

SEQ ID NO: 1546911 - DNA, 20 bp, Homo sapiens
atcaatcctgattcctctct

SEQ ID NO: 1546912 - DNA, 18 bp, Homo sapiens
atcaatcttgttactgct

SEQ ID NO: 1546913 - DNA, 14 bp, Homo sapiens
atcaatgggaaata

SEQ ID NO: 1546914 - DNA, 13 bp, Homo sapiens
atcaattaaatgt

SEQ ID NO: 1546915 - DNA, 14 bp, Homo sapiens
atcaattaaatgta

SEQ ID NO: 1546916 - DNA, 17 bp, Homo sapiens
atcaattagatctaaac

SEQ ID NO: 1546917 - DNA, 16 bp, Homo sapiens
atcaattcatatctat

SEQ ID NO: 1546918 - DNA, 17 bp, Homo sapiens
atcaattttaccctgag

SEQ ID NO: 1546919 - DNA, 20 bp, Homo sapiens
atcaattttcattaaacttg

SEQ ID NO: 1546920 - DNA, 13 bp, Homo sapiens
atcaatttttccc

SEQ ID NO: 1546921 - DNA, 14 bp, Homo sapiens
atcaatttttccca

SEQ ID NO: 1546922 - DNA, 17 bp, Homo sapiens
atcaatttttcccagta

SEQ ID NO: 1546923 - DNA, 21 bp, Homo sapiens
atcaatttttcccagtatttt

SEQ ID NO: 1546924 - DNA, 14 bp, Homo sapiens
atcaatttttctta

SEQ ID NO: 1546925 - DNA, 15 bp, Homo sapiens
atcacacagtgttag

SEQ ID NO: 1546926 - DNA, 16 bp, Homo sapiens
atcacacccatttaaa

SEQ ID NO: 1546927 - DNA, 18 bp, Homo sapiens
atcacacttatattttat

SEQ ID NO: 1546928 - DNA, 21 bp, Homo sapiens
atcacacttcattgtaaatca

SEQ ID NO: 1546929 - DNA, 14 bp, Homo sapiens
atcacacttctgtg

SEQ ID NO: 1546930 - DNA, 14 bp, Homo sapiens
atcacagaggcttc

SEQ ID NO: 1546931 - DNA, 22 bp, Homo sapiens
atcacagatgggtattaaactt

SEQ ID NO: 1546932 - DNA, 20 bp, Homo sapiens
atcacagcccaaaatttgat

SEQ ID NO: 1546933 - DNA, 16 bp, Homo sapiens
atcacagcccagcccg

SEQ ID NO: 1546934 - DNA, 18 bp, Homo sapiens
atcacagcttcagccagg

SEQ ID NO: 1546935 - DNA, 12 bp, Homo sapiens
atcacagggccc

SEQ ID NO: 1546936 - DNA, 12 bp, Homo sapiens
atcacaggggcg

SEQ ID NO: 1546937 - DNA, 18 bp, Homo sapiens
atcacaggggcggggcag

SEQ ID NO: 1546938 - DNA, 17 bp, Homo sapiens
atcacagggtgggcctc

SEQ ID NO: 1546939 - DNA, 23 bp, Homo sapiens
atcacagggttgggcccagatct

SEQ ID NO: 1546940 - DNA, 20 bp, Homo sapiens
atcacagtgtttttattgct

SEQ ID NO: 1546941 - DNA, 21 bp, Homo sapiens
atcacagtgtttttattgctc

SEQ ID NO: 1546942 - DNA, 16 bp, Homo sapiens
atcacatgatgaaaaa

SEQ ID NO: 1546943 - DNA, 14 bp, Homo sapiens
atcacatttctatg

SEQ ID NO: 1546944 - DNA, 12 bp, Homo sapiens
atcacattttat

SEQ ID NO: 1546945 - DNA, 17 bp, Homo sapiens
atcacattttattaaac

SEQ ID NO: 1546946 - DNA, 23 bp, Homo sapiens
atcacattttgtatggagttaaa

SEQ ID NO: 1546947 - DNA, 17 bp, Homo sapiens
atcaccaccgcctctgg

SEQ ID NO: 1546948 - DNA, 15 bp, Homo sapiens
atcaccagcccggcc

SEQ ID NO: 1546949 - DNA, 15 bp, Homo sapiens
atcaccatgtaagca

SEQ ID NO: 1546950 - DNA, 18 bp, Homo sapiens
atcaccattatattttga

SEQ ID NO: 1546951 - DNA, 11 bp, Homo sapiens
atcacccaagc

SEQ ID NO: 1546952 - DNA, 15 bp, Homo sapiens
atcaccctcttcctg

SEQ ID NO: 1546953 - DNA, 19 bp, Homo sapiens
atcaccgatgcaaacattg

SEQ ID NO: 1546954 - DNA, 12 bp, Homo sapiens
atcacctcaggc

SEQ ID NO: 1546955 - DNA, 15 bp, Homo sapiens
atcacctcaggccag

SEQ ID NO: 1546956 - DNA, 16 bp, Homo sapiens
atcacctcattctgaa

SEQ ID NO: 1546957 - DNA, 15 bp, Homo sapiens
atcacctctcttcag

SEQ ID NO: 1546958 - DNA, 18 bp, Homo sapiens
atcacctgaaccccagag

SEQ ID NO: 1546959 - DNA, 19 bp, Homo sapiens
atcacctgaaccccagagg

SEQ ID NO: 1546960 - DNA, 21 bp, Homo sapiens
atcacctgaaccccagaggca

SEQ ID NO: 1546961 - DNA, 16 bp, Homo sapiens
atcacctgaggtcagg

SEQ ID NO: 1546962 - DNA, 12 bp, Homo sapiens
atcacctgcctg

SEQ ID NO: 1546963 - DNA, 13 bp, Homo sapiens
atcacctggtatt

SEQ ID NO: 1546964 - DNA, 11 bp, Homo sapiens
atcacctgtca

SEQ ID NO: 1546965 - DNA, 14 bp, Homo sapiens
atcacgctttcctg

SEQ ID NO: 1546966 - DNA, 16 bp, Homo sapiens
atcacggtggtaaaga

SEQ ID NO: 1546967 - DNA, 17 bp, Homo sapiens
atcactaagctgtggct

SEQ ID NO: 1546968 - DNA, 24 bp, Homo sapiens
atcactaatttggctttcacattt

SEQ ID NO: 1546969 - DNA, 16 bp, Homo sapiens
atcactatctttctga

SEQ ID NO: 1546970 - DNA, 17 bp, Homo sapiens
atcactatgatttctga

SEQ ID NO: 1546971 - DNA, 12 bp, Homo sapiens
atcactccctgg

SEQ ID NO: 1546972 - DNA, 20 bp, Homo sapiens
atcactctaattaattgtaa

SEQ ID NO: 1546973 - DNA, 14 bp, Homo sapiens
atcactctctgctg

SEQ ID NO: 1546974 - DNA, 15 bp, Homo sapiens
atcactctctgctgg

SEQ ID NO: 1546975 - DNA, 20 bp, Homo sapiens
atcactgaatttataaagta

SEQ ID NO: 1546976 - DNA, 16 bp, Homo sapiens
atcactgactctgact

SEQ ID NO: 1546977 - DNA, 19 bp, Homo sapiens
gcaagctctcagcaagtgc

SEQ ID NO: 1546978 - DNA, 14 bp, Homo sapiens
gcaagctgaaattt

SEQ ID NO: 1546979 - DNA, 17 bp, Homo sapiens
gcaagctgaaattttag

SEQ ID NO: 1546980 - DNA, 15 bp, Homo sapiens
gcaagcttcttgctg

SEQ ID NO: 1546981 - DNA, 15 bp, Homo sapiens
gcaagcttgaggcca

SEQ ID NO: 1546982 - DNA, 15 bp, Homo sapiens
gcaaggaaggaaaga

SEQ ID NO: 1546983 - DNA, 14 bp, Homo sapiens
gcaaggaccaggac

SEQ ID NO: 1546984 - DNA, 15 bp, Homo sapiens
gcaaggaccaggact

SEQ ID NO: 1546985 - DNA, 14 bp, Homo sapiens
gcaaggactttgta

SEQ ID NO: 1546986 - DNA, 16 bp, Homo sapiens
gcaaggagcacaagcc

SEQ ID NO: 1546987 - DNA, 23 bp, Homo sapiens
gcaaggagtttattacaatgtat

SEQ ID NO: 1546988 - DNA, 18 bp, Homo sapiens
gcaaggcaggtgcctcca

SEQ ID NO: 1546989 - DNA, 19 bp, Homo sapiens
gcaaggcaggtgcctccag

SEQ ID NO: 1546990 - DNA, 22 bp, Homo sapiens
gcaaggcaggtgcctccaggtg

SEQ ID NO: 1546991 - DNA, 24 bp, Homo sapiens
gcaaggccttggtggagcagccag

SEQ ID NO: 1546992 - DNA, 19 bp, Homo sapiens
gcaaggcgcctgccttggg

SEQ ID NO: 1546993 - DNA, 20 bp, Homo sapiens
gcaagggagaaaagagaaac

SEQ ID NO: 1546994 - DNA, 22 bp, Homo sapiens
gcaagggcacaagtcctggatg

SEQ ID NO: 1546995 - DNA, 13 bp, Homo sapiens
gcaagggcccaga

SEQ ID NO: 1546996 - DNA, 13 bp, Homo sapiens
gcaagggctccag

SEQ ID NO: 1546997 - DNA, 16 bp, Homo sapiens
gcaagggctccagcat

SEQ ID NO: 1546998 - DNA, 17 bp, Homo sapiens
gcaagggctccagcatc

SEQ ID NO: 1546999 - DNA, 19 bp, Homo sapiens
gcaagggctccagcatcca

SEQ ID NO: 1547000 - DNA, 20 bp, Homo sapiens
gcaagggctccagcatccag

SEQ ID NO: 1547001 - DNA, 22 bp, Homo sapiens
gcaagggctccagcatccagcc

SEQ ID NO: 1547002 - DNA, 22 bp, Homo sapiens
gcaagggggtgtcatctgagga

SEQ ID NO: 1547003 - DNA, 17 bp, Homo sapiens
gcaaggtactctggtga

SEQ ID NO: 1547004 - DNA, 18 bp, Homo sapiens
gcaaggtccggcccatcc

SEQ ID NO: 1547005 - DNA, 23 bp, Homo sapiens
gcaaggtctccttactctgagcc

SEQ ID NO: 1547006 - DNA, 17 bp, Homo sapiens
gcaaggtgtccctgcct

SEQ ID NO: 1547007 - DNA, 18 bp, Homo sapiens
gcaagtaagaatggccaa

SEQ ID NO: 1547008 - DNA, 17 bp, Homo sapiens
atcagaagataacttga

SEQ ID NO: 1547009 - DNA, 22 bp, Homo sapiens
atcagaagtatatctgtacaga

SEQ ID NO: 1547010 - DNA, 18 bp, Homo sapiens
atcagaagtcatcttgct

SEQ ID NO: 1547011 - DNA, 19 bp, Homo sapiens
atcagaagtcatcttgcta

SEQ ID NO: 1547012 - DNA, 14 bp, Homo sapiens
atcagaagttgtat

SEQ ID NO: 1547013 - DNA, 12 bp, Homo sapiens
atcagacaagca

SEQ ID NO: 1547014 - DNA, 15 bp, Homo sapiens
atcagacatacagct

SEQ ID NO: 1547015 - DNA, 20 bp, Homo sapiens
atcagaccataatgttacat

SEQ ID NO: 1547016 - DNA, 16 bp, Homo sapiens
atcagaccctacccca

SEQ ID NO: 1547017 - DNA, 13 bp, Homo sapiens
atcagacctgtct

SEQ ID NO: 1547018 - DNA, 22 bp, Homo sapiens
atcagatcatttcaaaactcat

SEQ ID NO: 1547019 - DNA, 14 bp, Homo sapiens
atcagatgaattga

SEQ ID NO: 1547020 - DNA, 22 bp, Homo sapiens
atcagatgcaattgctcccatc

SEQ ID NO: 1547021 - DNA, 12 bp, Homo sapiens
atcagatgcctg

SEQ ID NO: 1547022 - DNA, 18 bp, Homo sapiens
atcagatgtgtgttctca

SEQ ID NO: 1547023 - DNA, 21 bp, Homo sapiens
atcagcaaaccggggcctact

SEQ ID NO: 1547024 - DNA, 19 bp, Homo sapiens
atcagcaacccttcctgct

SEQ ID NO: 1547025 - DNA, 12 bp, Homo sapiens
atcagcactgaa

SEQ ID NO: 1547026 - DNA, 13 bp, Homo sapiens
atcagcactgaaa

SEQ ID NO: 1547027 - DNA, 16 bp, Homo sapiens
atcagcattcaaaata

SEQ ID NO: 1547028 - DNA, 19 bp, Homo sapiens
atcagccccaccctggcct

SEQ ID NO: 1547029 - DNA, 18 bp, Homo sapiens
atcagcccctcaaaggga

SEQ ID NO: 1547030 - DNA, 20 bp, Homo sapiens
atcagcccctcaaagggaga

SEQ ID NO: 1547031 - DNA, 12 bp, Homo sapiens
atcagcctgagt

SEQ ID NO: 1547032 - DNA, 17 bp, Homo sapiens
atcagcctgagtctcct

SEQ ID NO: 1547033 - DNA, 20 bp, Homo sapiens
atcagcctggggcctgggga

SEQ ID NO: 1547034 - DNA, 14 bp, Homo sapiens
atcagcctgtgcca

SEQ ID NO: 1547035 - DNA, 22 bp, Homo sapiens
atcagcgggtctcctcccagcg

SEQ ID NO: 1547036 - DNA, 17 bp, Homo sapiens
atcagctattttgtgaa

SEQ ID NO: 1547037 - DNA, 16 bp, Homo sapiens
atcagctctctgcaga

SEQ ID NO: 1547038 - DNA, 12 bp, Homo sapiens
atcagctgaatt

SEQ ID NO: 1547039 - DNA, 17 bp, Homo sapiens
atcagctgctgaaacaa

SEQ ID NO: 1547040 - DNA, 23 bp, Homo sapiens
atcagctgctgaaacaacaaata

SEQ ID NO: 1547041 - DNA, 16 bp, Homo sapiens
atcagctgtttgtcat

SEQ ID NO: 1547042 - DNA, 21 bp, Homo sapiens
atcagctttgataattgtgta

SEQ ID NO: 1547043 - DNA, 20 bp, Homo sapiens
atcagcttttgttctagact

SEQ ID NO: 1547044 - DNA, 15 bp, Homo sapiens
atcaggaagcctgtg

SEQ ID NO: 1547045 - DNA, 19 bp, Homo sapiens
atcaggaatattttccaaa

SEQ ID NO: 1547046 - DNA, 21 bp, Homo sapiens
atcaggaattgtcaaatgatg

SEQ ID NO: 1547047 - DNA, 16 bp, Homo sapiens
atcaggcactggtggc

SEQ ID NO: 1547048 - DNA, 14 bp, Homo sapiens
atcaggcttcctgg

SEQ ID NO: 1547049 - DNA, 18 bp, Homo sapiens
atcaggcttcctggtgag

SEQ ID NO: 1547050 - DNA, 22 bp, Homo sapiens
atcaggcttcctggtgagaact

SEQ ID NO: 1547051 - DNA, 21 bp, Homo sapiens
atcagggtaaaaggtgcaggt

SEQ ID NO: 1547052 - DNA, 13 bp, Homo sapiens
atcaggtaacttt

SEQ ID NO: 1547053 - DNA, 16 bp, Homo sapiens
atcaggtcctcagaga

SEQ ID NO: 1547054 - DNA, 13 bp, Homo sapiens
atcaggtgcaggt

SEQ ID NO: 1547055 - DNA, 15 bp, Homo sapiens
atcaggttccatccc

SEQ ID NO: 1547056 - DNA, 15 bp, Homo sapiens
atcagtacttgtttc

SEQ ID NO: 1547057 - DNA, 21 bp, Homo sapiens
atcagtagtttgcatttcaga

SEQ ID NO: 1547058 - DNA, 23 bp, Homo sapiens
atcagtattctgacatgtaagaa

SEQ ID NO: 1547059 - DNA, 13 bp, Homo sapiens
atcagtcccctcc

SEQ ID NO: 1547060 - DNA, 21 bp, Homo sapiens
atcagtccctatgtatttgca

SEQ ID NO: 1547061 - DNA, 17 bp, Homo sapiens
atcagtcgttttagtgt

SEQ ID NO: 1547062 - DNA, 14 bp, Homo sapiens
atcagtgaggaggg

SEQ ID NO: 1547063 - DNA, 14 bp, Homo sapiens
atcagtgattttca

SEQ ID NO: 1547064 - DNA, 19 bp, Homo sapiens
atcagtggttatttaggga

SEQ ID NO: 1547065 - DNA, 12 bp, Homo sapiens
atcagtgttaaa

SEQ ID NO: 1547066 - DNA, 13 bp, Homo sapiens
atcagtgtttaca

SEQ ID NO: 1547067 - DNA, 22 bp, Homo sapiens
atcagttacccactcggtccca

SEQ ID NO: 1547068 - DNA, 23 bp, Homo sapiens
atcagttacccactcggtcccag

SEQ ID NO: 1547069 - DNA, 15 bp, Homo sapiens
atcagttactcagcc

SEQ ID NO: 1547070 - DNA, 21 bp, Homo sapiens
atcagttcattagaaatattt

SEQ ID NO: 1547071 - DNA, 19 bp, Homo sapiens
atcagttcccccagtacct

SEQ ID NO: 1547072 - DNA, 20 bp, Homo sapiens
atcagttcccccagtacctc

SEQ ID NO: 1547073 - DNA, 22 bp, Homo sapiens
atcagttgaggccaggagttta

SEQ ID NO: 1547074 - DNA, 18 bp, Homo sapiens
atcagttgcaataatact

SEQ ID NO: 1547075 - DNA, 21 bp, Homo sapiens
atcagttgcaataatacttct

SEQ ID NO: 1547076 - DNA, 23 bp, Homo sapiens
atcagttggagtttgtgtctgtt

SEQ ID NO: 1547077 - DNA, 22 bp, Homo sapiens
atcataaaaataaaatctgtaa

SEQ ID NO: 1547078 - DNA, 15 bp, Homo sapiens
atcataaaacttgat

SEQ ID NO: 1547079 - DNA, 14 bp, Homo sapiens
atcataaagtcagt

SEQ ID NO: 1547080 - DNA, 17 bp, Homo sapiens
atcataagtatttggaa

SEQ ID NO: 1547081 - DNA, 19 bp, Homo sapiens
atcataagtatttggaatt

SEQ ID NO: 1547082 - DNA, 14 bp, Homo sapiens
atcataattacatt

SEQ ID NO: 1547083 - DNA, 19 bp, Homo sapiens
atcataattacattcctaa

SEQ ID NO: 1547084 - DNA, 15 bp, Homo sapiens
atcatacaaactctc

SEQ ID NO: 1547085 - DNA, 14 bp, Homo sapiens
atcatactcttcta

SEQ ID NO: 1547086 - DNA, 16 bp, Homo sapiens
atcatactcttctaaa

SEQ ID NO: 1547087 - DNA, 20 bp, Homo sapiens
atcatataataaatgtacat

SEQ ID NO: 1547088 - DNA, 21 bp, Homo sapiens
atcatatatttaacaatgaca

SEQ ID NO: 1547089 - DNA, 19 bp, Homo sapiens
atcatatgattctgctttt

SEQ ID NO: 1547090 - DNA, 21 bp, Homo sapiens
atcatatgattctgcttttac

SEQ ID NO: 1547091 - DNA, 14 bp, Homo sapiens
atcatattattatc

SEQ ID NO: 1547092 - DNA, 14 bp, Homo sapiens
atcatatttctgtg

SEQ ID NO: 1547093 - DNA, 14 bp, Homo sapiens
atcatcaagaaggg

SEQ ID NO: 1547094 - DNA, 14 bp, Homo sapiens
atcatcaatacttt

SEQ ID NO: 1547095 - DNA, 14 bp, Homo sapiens
atcatcactgtaaa

SEQ ID NO: 1547096 - DNA, 15 bp, Homo sapiens
atcatcatagaaaaa

SEQ ID NO: 1547097 - DNA, 22 bp, Homo sapiens
atcatcatcgttgttattaaag

SEQ ID NO: 1547098 - DNA, 14 bp, Homo sapiens
atcatccagaagtt

SEQ ID NO: 1547099 - DNA, 14 bp, Homo sapiens
atcatccctattct

SEQ ID NO: 1547100 - DNA, 13 bp, Homo sapiens
atcatcctcatgt

SEQ ID NO: 1547101 - DNA, 16 bp, Homo sapiens
atcatcctttgttctg

SEQ ID NO: 1547102 - DNA, 20 bp, Homo sapiens
atcatcctttgttctgagca

SEQ ID NO: 1547103 - DNA, 13 bp, Homo sapiens
atcatcgccagag

SEQ ID NO: 1547104 - DNA, 15 bp, Homo sapiens
atcatcgccagaggt

SEQ ID NO: 1547105 - DNA, 13 bp, Homo sapiens
atcatctcagctc

SEQ ID NO: 1547106 - DNA, 14 bp, Homo sapiens
atcatctcagctca

SEQ ID NO: 1547107 - DNA, 17 bp, Homo sapiens
atcatctgcattcctga

SEQ ID NO: 1547108 - DNA, 18 bp, Homo sapiens
atcatcttggaactgcat

SEQ ID NO: 1547109 - DNA, 13 bp, Homo sapiens
atcatgaaacact

SEQ ID NO: 1547110 - DNA, 14 bp, Homo sapiens
atcatgaaatatgc

SEQ ID NO: 1547111 - DNA, 15 bp, Homo sapiens
atcatgaaatatgca

SEQ ID NO: 1547112 - DNA, 18 bp, Homo sapiens
atcatgaaatatgcatct

SEQ ID NO: 1547113 - DNA, 18 bp, Homo sapiens
atcatgaatgcttttagt

SEQ ID NO: 1547114 - DNA, 17 bp, Homo sapiens
atcatgaattttaaagt

SEQ ID NO: 1547115 - DNA, 19 bp, Homo sapiens
atcatgaattttaaagtat

SEQ ID NO: 1547116 - DNA, 17 bp, Homo sapiens
atcatgaccagcaaata

SEQ ID NO: 1547117 - DNA, 17 bp, Homo sapiens
atcatgagcctgctgga

SEQ ID NO: 1547118 - DNA, 19 bp, Homo sapiens
atcatgcaaatgctgtatt

SEQ ID NO: 1547119 - DNA, 19 bp, Homo sapiens
atcatgcactttttctcct

SEQ ID NO: 1547120 - DNA, 21 bp, Homo sapiens
atcatgcatgtcctgtaaagg

SEQ ID NO: 1547121 - DNA, 14 bp, Homo sapiens
atcatgccctgcct

SEQ ID NO: 1547122 - DNA, 16 bp, Homo sapiens
atcatgcgttttatat

SEQ ID NO: 1547123 - DNA, 15 bp, Homo sapiens
gggtggctggagtga

SEQ ID NO: 1547124 - DNA, 14 bp, Homo sapiens
gggtgggaagaaag

SEQ ID NO: 1547125 - DNA, 12 bp, Homo sapiens
gggtgggaagag

SEQ ID NO: 1547126 - DNA, 15 bp, Homo sapiens
gggtgggaagagaag

SEQ ID NO: 1547127 - DNA, 14 bp, Homo sapiens
gggtgggagagccc

SEQ ID NO: 1547128 - DNA, 15 bp, Homo sapiens
gggtgggaggggccc

SEQ ID NO: 1547129 - DNA, 12 bp, Homo sapiens
gggtgggcctgg

SEQ ID NO: 1547130 - DNA, 19 bp, Homo sapiens
gggtgggcctggcctgagc

SEQ ID NO: 1547131 - DNA, 12 bp, Homo sapiens
gggtggtgctgg

SEQ ID NO: 1547132 - DNA, 18 bp, Homo sapiens
gggtggtgctgggactga

SEQ ID NO: 1547133 - DNA, 16 bp, Homo sapiens
gggtggtggggggcag

SEQ ID NO: 1547134 - DNA, 20 bp, Homo sapiens
tgcacaagtctttccagagg

SEQ ID NO: 1547135 - DNA, 20 bp, Homo sapiens
tgcacaataaaaatgtttaa

SEQ ID NO: 1547136 - DNA, 17 bp, Homo sapiens
tgcacaatattgaactt

SEQ ID NO: 1547137 - DNA, 13 bp, Homo sapiens
tgcacacacagct

SEQ ID NO: 1547138 - DNA, 17 bp, Homo sapiens
tgcacacacagctcctc

SEQ ID NO: 1547139 - DNA, 14 bp, Homo sapiens
tgcacacagaatgc

SEQ ID NO: 1547140 - DNA, 22 bp, Homo sapiens
tgccttcgttaactgtgtatgt

SEQ ID NO: 1547141 - DNA, 15 bp, Homo sapiens
tgccttctctcagct

SEQ ID NO: 1547142 - DNA, 20 bp, Homo sapiens
tgccttctctcagctcccag

SEQ ID NO: 1547143 - DNA, 16 bp, Homo sapiens
tgccttctgtctgctc

SEQ ID NO: 1547144 - DNA, 13 bp, Homo sapiens
tgccttcttcacc

SEQ ID NO: 1547145 - DNA, 22 bp, Homo sapiens
tgccttcttcggggaactcctg

SEQ ID NO: 1547146 - DNA, 13 bp, Homo sapiens
tgccttctttact

SEQ ID NO: 1547147 - DNA, 13 bp, Homo sapiens
tgccttctttcca

SEQ ID NO: 1547148 - DNA, 13 bp, Homo sapiens
tgccttgctgttt

SEQ ID NO: 1547149 - DNA, 21 bp, Homo sapiens
tgccttgcttctgtatttcct

SEQ ID NO: 1547150 - DNA, 16 bp, Homo sapiens
tgccttgggcaaggac

SEQ ID NO: 1547151 - DNA, 18 bp, Homo sapiens
tgccttggggaatttcct

SEQ ID NO: 1547152 - DNA, 20 bp, Homo sapiens
tgccttggggaatttcctct

SEQ ID NO: 1547153 - DNA, 23 bp, Homo sapiens
tgccttggtttttactgctctga

SEQ ID NO: 1547154 - DNA, 18 bp, Homo sapiens
tgccttgtccctctcact

SEQ ID NO: 1547155 - DNA, 19 bp, Homo sapiens
tgccttgtgaaggaattat

SEQ ID NO: 1547156 - DNA, 17 bp, Homo sapiens
tgcctttaaagtatgaa

SEQ ID NO: 1547157 - DNA, 22 bp, Homo sapiens
tgcctttaacagaaactttcaa

SEQ ID NO: 1547158 - DNA, 23 bp, Homo sapiens
tgcctttaacagaaactttcaaa

SEQ ID NO: 1547159 - DNA, 16 bp, Homo sapiens
tgcctttaagccaaag

SEQ ID NO: 1547160 - DNA, 22 bp, Homo sapiens
tgcctttaagccaaagaaacaa

SEQ ID NO: 1547161 - DNA, 19 bp, Homo sapiens
tgcctttaattttcttgtt

SEQ ID NO: 1547162 - DNA, 20 bp, Homo sapiens
tgcctttctgcagtttttca

SEQ ID NO: 1547163 - DNA, 12 bp, Homo sapiens
tgcctttctttg

SEQ ID NO: 1547164 - DNA, 16 bp, Homo sapiens
tgcctttgaagagtga

SEQ ID NO: 1547165 - DNA, 19 bp, Homo sapiens
tgcctttgcaccacgggac

SEQ ID NO: 1547166 - DNA, 12 bp, Homo sapiens
tgcctttggcct

SEQ ID NO: 1547167 - DNA, 11 bp, Homo sapiens
tgcctttgtaa

SEQ ID NO: 1547168 - DNA, 15 bp, Homo sapiens
tgcctttgttttgat

SEQ ID NO: 1547169 - DNA, 16 bp, Homo sapiens
tgccttttaattttta

SEQ ID NO: 1547170 - DNA, 14 bp, Homo sapiens
tgccttttctgtga

SEQ ID NO: 1547171 - DNA, 21 bp, Homo sapiens
tgccttttctgtgattgggtg

SEQ ID NO: 1547172 - DNA, 19 bp, Homo sapiens
tgccttttgaatacatttg

SEQ ID NO: 1547173 - DNA, 22 bp, Homo sapiens
tgccttttgaatacatttgtat

SEQ ID NO: 1547174 - DNA, 19 bp, Homo sapiens
tgccttttgcaaccaggaa

SEQ ID NO: 1547175 - DNA, 20 bp, Homo sapiens
tgccttttgcacccctccca

SEQ ID NO: 1547176 - DNA, 17 bp, Homo sapiens
tgccttttgcagaagag

SEQ ID NO: 1547177 - DNA, 22 bp, Homo sapiens
tgccttttgcagaagagggtgt

SEQ ID NO: 1547178 - DNA, 13 bp, Homo sapiens
tgcctttttaagt

SEQ ID NO: 1547179 - DNA, 20 bp, Homo sapiens
tgcctttttaagtaaaaaag

SEQ ID NO: 1547180 - DNA, 15 bp, Homo sapiens
tgcctttttatttat

SEQ ID NO: 1547181 - DNA, 21 bp, Homo sapiens
tgcctttttatttatatgtac

SEQ ID NO: 1547182 - DNA, 15 bp, Homo sapiens
tgcctttttcctaga

SEQ ID NO: 1547183 - DNA, 13 bp, Homo sapiens
tgccttttttcta

SEQ ID NO: 1547184 - DNA, 21 bp, Homo sapiens
tgcgaaggggccctggtcctt

SEQ ID NO: 1547185 - DNA, 22 bp, Homo sapiens
tgcgaatggttccattctctct

SEQ ID NO: 1547186 - DNA, 15 bp, Homo sapiens
tgcgaccctgggggc

SEQ ID NO: 1547187 - DNA, 21 bp, Homo sapiens
tgcgaccctgggggcacagga

SEQ ID NO: 1547188 - DNA, 15 bp, Homo sapiens
tgcgacggagagaaa

SEQ ID NO: 1547189 - DNA, 19 bp, Homo sapiens
tgcgacggagagaaaaaag

SEQ ID NO: 1547190 - DNA, 15 bp, Homo sapiens
tgcgaggacatcaaa

SEQ ID NO: 1547191 - DNA, 15 bp, Homo sapiens
tgcgaggctcggagc

SEQ ID NO: 1547192 - DNA, 19 bp, Homo sapiens
tgcgaggctcggagcaccc

SEQ ID NO: 1547193 - DNA, 14 bp, Homo sapiens
tgcgatagagtctc

SEQ ID NO: 1547194 - DNA, 22 bp, Homo sapiens
tgcgatggcgtgggctgcgtga

SEQ ID NO: 1547195 - DNA, 12 bp, Homo sapiens
tgcctgagattc

SEQ ID NO: 1547196 - DNA, 20 bp, Homo sapiens
tgcctgagattctttaagga

SEQ ID NO: 1547197 - DNA, 15 bp, Homo sapiens
tgcctgagcccagga

SEQ ID NO: 1547198 - DNA, 11 bp, Homo sapiens
tgcctgaggag

SEQ ID NO: 1547199 - DNA, 20 bp, Homo sapiens
tgcctgagggcccctctgcc

SEQ ID NO: 1547200 - DNA, 19 bp, Homo sapiens
tgcctgagtcacccatgaa

SEQ ID NO: 1547201 - DNA, 18 bp, Homo sapiens
tgcctgagttataaatat

SEQ ID NO: 1547202 - DNA, 22 bp, Homo sapiens
tgcctgagttataaatattttt

SEQ ID NO: 1547203 - DNA, 18 bp, Homo sapiens
tgcctgcaagagaatctg

SEQ ID NO: 1547204 - DNA, 18 bp, Homo sapiens
tgcctgcaccaggagaca

SEQ ID NO: 1547205 - DNA, 19 bp, Homo sapiens
tgcctgcaccaggagacag

SEQ ID NO: 1547206 - DNA, 16 bp, Homo sapiens
tgcctgcacccttccc

SEQ ID NO: 1547207 - DNA, 18 bp, Homo sapiens
tgcctgcacccttccctc

SEQ ID NO: 1547208 - DNA, 15 bp, Homo sapiens
tgcctgcactccctg

SEQ ID NO: 1547209 - DNA, 14 bp, Homo sapiens
tgcctgcagagcag

SEQ ID NO: 1547210 - DNA, 20 bp, Homo sapiens
tgcctgcagcacatgcgggc

SEQ ID NO: 1547211 - DNA, 11 bp, Homo sapiens
tgcctgcagcc

SEQ ID NO: 1547212 - DNA, 23 bp, Homo sapiens
tgcctgcagggccatggctcagg

SEQ ID NO: 1547213 - DNA, 22 bp, Homo sapiens
tgcctgcaggtcagttgtaata

SEQ ID NO: 1547214 - DNA, 23 bp, Homo sapiens
tgcctgcataggagtttggagga

SEQ ID NO: 1547215 - DNA, 16 bp, Homo sapiens
tgcctgcatgctgaaa

SEQ ID NO: 1547216 - DNA, 15 bp, Homo sapiens
tgcctgccactctct

SEQ ID NO: 1547217 - DNA, 17 bp, Homo sapiens
tgcctgccactctctgg

SEQ ID NO: 1547218 - DNA, 18 bp, Homo sapiens
tgcctgccactctctggg

SEQ ID NO: 1547219 - DNA, 16 bp, Homo sapiens
tgcctgccagctgcac

SEQ ID NO: 1547220 - DNA, 17 bp, Homo sapiens
tgcctgccatactgcgc

SEQ ID NO: 1547221 - DNA, 20 bp, Homo sapiens
tgcctgcccgcaccctggcc

SEQ ID NO: 1547222 - DNA, 12 bp, Homo sapiens
tgcctgctagag

SEQ ID NO: 1547223 - DNA, 13 bp, Homo sapiens
tgcctgctagagc

SEQ ID NO: 1547224 - DNA, 14 bp, Homo sapiens
tgcctgctagagca

SEQ ID NO: 1547225 - DNA, 19 bp, Homo sapiens
tgcctgctcagcagccagt

SEQ ID NO: 1547226 - DNA, 14 bp, Homo sapiens
tgcctgctccctgt

SEQ ID NO: 1547227 - DNA, 15 bp, Homo sapiens
tgcctgctccctgtc

SEQ ID NO: 1547228 - DNA, 20 bp, Homo sapiens
tgcctgctccctgtctgtgt

SEQ ID NO: 1547229 - DNA, 23 bp, Homo sapiens
tgcctgctccctgtctgtgtccc

SEQ ID NO: 1547230 - DNA, 23 bp, Homo sapiens
tgcctgctgaatgatttccaaag

SEQ ID NO: 1547231 - DNA, 20 bp, Homo sapiens
tgcctgctgttggtcctctc

SEQ ID NO: 1547232 - DNA, 17 bp, Homo sapiens
tgcctgctttttggaaa

SEQ ID NO: 1547233 - DNA, 18 bp, Homo sapiens
tgcctggagtcaggtgtc

SEQ ID NO: 1547234 - DNA, 12 bp, Homo sapiens
tgcctggccagg

SEQ ID NO: 1547235 - DNA, 20 bp, Homo sapiens
tgcctggcctggcacacatc

SEQ ID NO: 1547236 - DNA, 16 bp, Homo sapiens
tgcctggcctggctcc

SEQ ID NO: 1547237 - DNA, 19 bp, Homo sapiens
tgcctggcctggctcccca

SEQ ID NO: 1547238 - DNA, 12 bp, Homo sapiens
tgcctggctgtg

SEQ ID NO: 1547239 - DNA, 13 bp, Homo sapiens
tgcctggctgtgg

SEQ ID NO: 1547240 - DNA, 14 bp, Homo sapiens
tgcctggctgtgga

SEQ ID NO: 1547241 - DNA, 14 bp, Homo sapiens
tgcctgggaatgta

SEQ ID NO: 1547242 - DNA, 15 bp, Homo sapiens
tgcctgggaatgtat

SEQ ID NO: 1547243 - DNA, 12 bp, Homo sapiens
tgcctgggcctg

SEQ ID NO: 1547244 - DNA, 21 bp, Homo sapiens
tgcctgggcctgtgcagcagc

SEQ ID NO: 1547245 - DNA, 12 bp, Homo sapiens
tgcctgggctgt

SEQ ID NO: 1547246 - DNA, 16 bp, Homo sapiens
tgcctgggctgttggc

SEQ ID NO: 1547247 - DNA, 23 bp, Homo sapiens
tgcctggggcctccagaagctgc

SEQ ID NO: 1547248 - DNA, 23 bp, Homo sapiens
tgcattagaaattagctgtgtga

SEQ ID NO: 1547249 - DNA, 22 bp, Homo sapiens
tgcattagggatgcctcctttc

SEQ ID NO: 1547250 - DNA, 14 bp, Homo sapiens
tgcattattaaatt

SEQ ID NO: 1547251 - DNA, 18 bp, Homo sapiens
tgcattattaaattgtaa

SEQ ID NO: 1547252 - DNA, 23 bp, Homo sapiens
tgcattcacatttagaaaagtga

SEQ ID NO: 1547253 - DNA, 16 bp, Homo sapiens
tgcattcacccagaca

SEQ ID NO: 1547254 - DNA, 12 bp, Homo sapiens
tgcattccagaa

SEQ ID NO: 1547255 - DNA, 18 bp, Homo sapiens
tgcattccagaatcttga

SEQ ID NO: 1547256 - DNA, 23 bp, Homo sapiens
tgcattcctgtgccctagatgca

SEQ ID NO: 1547257 - DNA, 15 bp, Homo sapiens
tgcattcctttgtct

SEQ ID NO: 1547258 - DNA, 18 bp, Homo sapiens
tgcattcgttgtgttttt

SEQ ID NO: 1547259 - DNA, 21 bp, Homo sapiens
tgcattctctcccatcctggg

SEQ ID NO: 1547260 - DNA, 14 bp, Homo sapiens
tgcattcttaacaa

SEQ ID NO: 1547261 - DNA, 19 bp, Homo sapiens
tgcattcttaacaaactct

SEQ ID NO: 1547262 - DNA, 13 bp, Homo sapiens
tgcattctttggt

SEQ ID NO: 1547263 - DNA, 18 bp, Homo sapiens
tgcattgcctgtaacaat

SEQ ID NO: 1547264 - DNA, 16 bp, Homo sapiens
tgcattgctagataaa

SEQ ID NO: 1547265 - DNA, 18 bp, Homo sapiens
tgcattgctagataaaag

SEQ ID NO: 1547266 - DNA, 15 bp, Homo sapiens
tgcattgctggtaga

SEQ ID NO: 1547267 - DNA, 13 bp, Homo sapiens
tgcattgctgtgt

SEQ ID NO: 1547268 - DNA, 16 bp, Homo sapiens
tgcattggcctctgta

SEQ ID NO: 1547269 - DNA, 14 bp, Homo sapiens
tgcattggcctggc

SEQ ID NO: 1547270 - DNA, 17 bp, Homo sapiens
tgcatttaaaacagaca

SEQ ID NO: 1547271 - DNA, 13 bp, Homo sapiens
tgcatttaataaa

SEQ ID NO: 1547272 - DNA, 18 bp, Homo sapiens
tgcatttaataaagatga

SEQ ID NO: 1547273 - DNA, 20 bp, Homo sapiens
tgcatttaataaagatgagt

SEQ ID NO: 1547274 - DNA, 15 bp, Homo sapiens
tgcatttcacctgtg

SEQ ID NO: 1547275 - DNA, 16 bp, Homo sapiens
tgcattttcctcttgt

SEQ ID NO: 1547276 - DNA, 20 bp, Homo sapiens
tgcattttcctcttgtcctg

SEQ ID NO: 1547277 - DNA, 18 bp, Homo sapiens
tgcattttgcagcagtga

SEQ ID NO: 1547278 - DNA, 15 bp, Homo sapiens
tgcatttttaaactt

SEQ ID NO: 1547279 - DNA, 21 bp, Homo sapiens
tgccaaaataccagagccttc

SEQ ID NO: 1547280 - DNA, 19 bp, Homo sapiens
tgccaaaattcatttctaa

SEQ ID NO: 1547281 - DNA, 23 bp, Homo sapiens
tgccaaacaaaaaggttctcagg

SEQ ID NO: 1547282 - DNA, 17 bp, Homo sapiens
tgccaaaccacaagact

SEQ ID NO: 1547283 - DNA, 14 bp, Homo sapiens
tgccaaagggaaat

SEQ ID NO: 1547284 - DNA, 16 bp, Homo sapiens
tgccaaatagccccag

SEQ ID NO: 1547285 - DNA, 17 bp, Homo sapiens
tgccaaatatgtcctgg

SEQ ID NO: 1547286 - DNA, 23 bp, Homo sapiens
tgccaaattttggccaaagtgtt

SEQ ID NO: 1547287 - DNA, 21 bp, Homo sapiens
tgccaacatgaggacagaagg

SEQ ID NO: 1547288 - DNA, 15 bp, Homo sapiens
tgccaacatggtgaa

SEQ ID NO: 1547289 - DNA, 19 bp, Homo sapiens
tgccaaccataccttcctt

SEQ ID NO: 1547290 - DNA, 13 bp, Homo sapiens
tgccaacccctct

SEQ ID NO: 1547291 - DNA, 15 bp, Homo sapiens
tgccaaccctgggct

SEQ ID NO: 1547292 - DNA, 23 bp, Homo sapiens
tgccaacctgttcttagagtgta

SEQ ID NO: 1547293 - DNA, 18 bp, Homo sapiens
tgccaactgccaggctgc

SEQ ID NO: 1547294 - DNA, 23 bp, Homo sapiens
tgccaacttgatgttccacctgc

SEQ ID NO: 1547295 - DNA, 14 bp, Homo sapiens
tgccaagaaaatga

SEQ ID NO: 1547296 - DNA, 18 bp, Homo sapiens
tgccaagattctactctt

SEQ ID NO: 1547297 - DNA, 19 bp, Homo sapiens
tgccaagcacagtgcctgc

SEQ ID NO: 1547298 - DNA, 14 bp, Homo sapiens
tgccaagcactcga

SEQ ID NO: 1547299 - DNA, 22 bp, Homo sapiens
tgccaagccagattctcttgaa

SEQ ID NO: 1547300 - DNA, 13 bp, Homo sapiens
tgccaagctccaa

SEQ ID NO: 1547301 - DNA, 15 bp, Homo sapiens
tgccaagctccaagc

SEQ ID NO: 1547302 - DNA, 16 bp, Homo sapiens
tgccaagctccaagcc

SEQ ID NO: 1547303 - DNA, 14 bp, Homo sapiens
tgccaaggagcccc

SEQ ID NO: 1547304 - DNA, 17 bp, Homo sapiens
tgccaaggcagaggcct

SEQ ID NO: 1547305 - DNA, 20 bp, Homo sapiens
tgccaaggccagagtggcct

SEQ ID NO: 1547306 - DNA, 22 bp, Homo sapiens
tgccaaggccagagtggcctgg

SEQ ID NO: 1547307 - DNA, 16 bp, Homo sapiens
tgccaagggaggcgga

SEQ ID NO: 1547308 - DNA, 23 bp, Homo sapiens
tgccaagggccccaggggcagca

SEQ ID NO: 1547309 - DNA, 23 bp, Homo sapiens
tgccaagtcatagccataaatga

SEQ ID NO: 1547310 - DNA, 21 bp, Homo sapiens
tgccaagttgctgtcactgtt

SEQ ID NO: 1547311 - DNA, 13 bp, Homo sapiens
tgccaagtttgtt

SEQ ID NO: 1547312 - DNA, 17 bp, Homo sapiens
tgccaataaagcttttg

SEQ ID NO: 1547313 - DNA, 23 bp, Homo sapiens
tgccaatccttaaatatgtgaaa

SEQ ID NO: 1547314 - DNA, 21 bp, Homo sapiens
tgccaatgaggtctgaaatgg

SEQ ID NO: 1547315 - DNA, 19 bp, Homo sapiens
tgccaatggtgtagctgtc

SEQ ID NO: 1547316 - DNA, 22 bp, Homo sapiens
tgccaatggtgtagctgtcctc

SEQ ID NO: 1547317 - DNA, 13 bp, Homo sapiens
tgccaatttcaag

SEQ ID NO: 1547318 - DNA, 19 bp, Homo sapiens
tgccaatttttgccttcat

SEQ ID NO: 1547319 - DNA, 21 bp, Homo sapiens
tgccacaaaccaccaggactg

SEQ ID NO: 1547320 - DNA, 17 bp, Homo sapiens
tgccacactcagtcccc

SEQ ID NO: 1547321 - DNA, 14 bp, Homo sapiens
tgccacactctcca

SEQ ID NO: 1547322 - DNA, 13 bp, Homo sapiens
tgccacactgatg

SEQ ID NO: 1547323 - DNA, 19 bp, Homo sapiens
tgccacactgatggctcaa

SEQ ID NO: 1547324 - DNA, 13 bp, Homo sapiens
tgccacacttcag

SEQ ID NO: 1547325 - DNA, 14 bp, Homo sapiens
tgccacacttcagg

SEQ ID NO: 1547326 - DNA, 23 bp, Homo sapiens
tgccacacttcaggctcttctcc

SEQ ID NO: 1547327 - DNA, 23 bp, Homo sapiens
tgccacagagaagtttgtagcca

SEQ ID NO: 1547328 - DNA, 11 bp, Homo sapiens
tgccacagctt

SEQ ID NO: 1547329 - DNA, 15 bp, Homo sapiens
tgccacatggagccc

SEQ ID NO: 1547330 - DNA, 17 bp, Homo sapiens
tgccaccacccacccca

SEQ ID NO: 1547331 - DNA, 15 bp, Homo sapiens
tgccaccaccctgcc

SEQ ID NO: 1547332 - DNA, 22 bp, Homo sapiens
tgccaccacgtctgccaggccc

SEQ ID NO: 1547333 - DNA, 12 bp, Homo sapiens
tgccaccaggag

SEQ ID NO: 1547334 - DNA, 13 bp, Homo sapiens
tgccaccaggaga

SEQ ID NO: 1547335 - DNA, 22 bp, Homo sapiens
tgccaccaggagaaccactaca

SEQ ID NO: 1547336 - DNA, 13 bp, Homo sapiens
tgccaccaggcca

SEQ ID NO: 1547337 - DNA, 14 bp, Homo sapiens
tgccccagcccaga

SEQ ID NO: 1547338 - DNA, 14 bp, Homo sapiens
tgccccagctctgg

SEQ ID NO: 1547339 - DNA, 15 bp, Homo sapiens
tgccccagctctgga

SEQ ID NO: 1547340 - DNA, 16 bp, Homo sapiens
tgccccagctctggat

SEQ ID NO: 1547341 - DNA, 20 bp, Homo sapiens
tgccccagctgactgtggcc

SEQ ID NO: 1547342 - DNA, 18 bp, Homo sapiens
tgccccaggaccagctca

SEQ ID NO: 1547343 - DNA, 22 bp, Homo sapiens
tgccccaggatcactctctgct

SEQ ID NO: 1547344 - DNA, 12 bp, Homo sapiens
tgccccaggccg

SEQ ID NO: 1547345 - DNA, 13 bp, Homo sapiens
tgccccaggccgg

SEQ ID NO: 1547346 - DNA, 22 bp, Homo sapiens
tgccccaggccggagcccagat

SEQ ID NO: 1547347 - DNA, 23 bp, Homo sapiens
tgccccatcattgcacctgcagg

SEQ ID NO: 1547348 - DNA, 20 bp, Homo sapiens
tgccccatccagacctggct

SEQ ID NO: 1547349 - DNA, 14 bp, Homo sapiens
tgcccccagccccg

SEQ ID NO: 1547350 - DNA, 14 bp, Homo sapiens
tgcccccaggactg

SEQ ID NO: 1547351 - DNA, 16 bp, Homo sapiens
tgcccccaggactggg

SEQ ID NO: 1547352 - DNA, 21 bp, Homo sapiens
tgcccccatggggtccttgga

SEQ ID NO: 1547353 - DNA, 21 bp, Homo sapiens
tgccccccaaggttctggttc

SEQ ID NO: 1547354 - DNA, 17 bp, Homo sapiens
tgccccccacccctgga

SEQ ID NO: 1547355 - DNA, 18 bp, Homo sapiens
tgccccccctaagagaca

SEQ ID NO: 1547356 - DNA, 19 bp, Homo sapiens
tgccccccctaagagacac

SEQ ID NO: 1547357 - DNA, 20 bp, Homo sapiens
tgccccccctaagagacaca

SEQ ID NO: 1547358 - DNA, 17 bp, Homo sapiens
tgccccccgaggctgct

SEQ ID NO: 1547359 - DNA, 22 bp, Homo sapiens
tgcccccctcaaacctcctctt

SEQ ID NO: 1547360 - DNA, 13 bp, Homo sapiens
tgcccccctcctc

SEQ ID NO: 1547361 - DNA, 16 bp, Homo sapiens
tgcccccctcctccag

SEQ ID NO: 1547362 - DNA, 18 bp, Homo sapiens
tgccccccttgccagaca

SEQ ID NO: 1547363 - DNA, 18 bp, Homo sapiens
tgcccccgacggctgtga

SEQ ID NO: 1547364 - DNA, 19 bp, Homo sapiens
tgcccccgacggctgtgac

SEQ ID NO: 1547365 - DNA, 19 bp, Homo sapiens
tgcccccgcgggttctaga

SEQ ID NO: 1547366 - DNA, 21 bp, Homo sapiens
tgcccccgcgggttctagacg

SEQ ID NO: 1547367 - DNA, 17 bp, Homo sapiens
tgcccccgttccagctg

SEQ ID NO: 1547368 - DNA, 23 bp, Homo sapiens
tgccccctaatccccttctcccc

SEQ ID NO: 1547369 - DNA, 17 bp, Homo sapiens
tgccccctcctctccca

SEQ ID NO: 1547370 - DNA, 19 bp, Homo sapiens
tgccccctcgggggcctgt

SEQ ID NO: 1547371 - DNA, 12 bp, Homo sapiens
tgccccctggtg

SEQ ID NO: 1547372 - DNA, 16 bp, Homo sapiens
tgccccgacccgggtc

SEQ ID NO: 1547373 - DNA, 18 bp, Homo sapiens
tgccccgcctgagtcagt

SEQ ID NO: 1547374 - DNA, 21 bp, Homo sapiens
tgccccgcttccccacagaac

SEQ ID NO: 1547375 - DNA, 21 bp, Homo sapiens
tgccccggccccggccccagc

SEQ ID NO: 1547376 - DNA, 15 bp, Homo sapiens
tgccccggcctcctc

SEQ ID NO: 1547377 - DNA, 19 bp, Homo sapiens
tgccccgggatattataga

SEQ ID NO: 1547378 - DNA, 17 bp, Homo sapiens
tgccccgggtccccagc

SEQ ID NO: 1547379 - DNA, 19 bp, Homo sapiens
tgccccgggtccccagctc

SEQ ID NO: 1547380 - DNA, 20 bp, Homo sapiens
tgccccgggtccccagctcc

SEQ ID NO: 1547381 - DNA, 17 bp, Homo sapiens
tgccccgttgcttcccg

SEQ ID NO: 1547382 - DNA, 18 bp, Homo sapiens
tgcccctaatctctgtag

SEQ ID NO: 1547383 - DNA, 17 bp, Homo sapiens
tgcccctaccctggact

SEQ ID NO: 1547384 - DNA, 20 bp, Homo sapiens
tgcccctaggatgctgcagc

SEQ ID NO: 1547385 - DNA, 16 bp, Homo sapiens
tgcccctcagagactg

SEQ ID NO: 1547386 - DNA, 22 bp, Homo sapiens
tgcccctcccccaacccccacc

SEQ ID NO: 1547387 - DNA, 23 bp, Homo sapiens
tgcccctcccccaacccccaccc

SEQ ID NO: 1547388 - DNA, 13 bp, Homo sapiens
tgcccctcccttc

SEQ ID NO: 1547389 - DNA, 22 bp, Homo sapiens
tgcccctcggggtgtcagaaat

SEQ ID NO: 1547390 - DNA, 20 bp, Homo sapiens
tgcccctctccttcttagct

SEQ ID NO: 1547391 - DNA, 23 bp, Homo sapiens
tgcccctgagcaatgtctgtgct

SEQ ID NO: 1547392 - DNA, 23 bp, Homo sapiens
tgcccctgatgcagcctgtggct

SEQ ID NO: 1547393 - DNA, 23 bp, Homo sapiens
tgcccctgcagttggcagaaagg

SEQ ID NO: 1547394 - DNA, 20 bp, Homo sapiens
tgcccctgcagtttggccct

SEQ ID NO: 1547395 - DNA, 16 bp, Homo sapiens
tgcccctggctttgcc

SEQ ID NO: 1547396 - DNA, 17 bp, Homo sapiens
tgcccctggctttgcct

SEQ ID NO: 1547397 - DNA, 18 bp, Homo sapiens
tgcccctggctttgcctc

SEQ ID NO: 1547398 - DNA, 19 bp, Homo sapiens
tgcccctggctttgcctct

SEQ ID NO: 1547399 - DNA, 21 bp, Homo sapiens
tgccccttaaacacaggctgt

SEQ ID NO: 1547400 - DNA, 17 bp, Homo sapiens
tgccccttaaccccaag

SEQ ID NO: 1547401 - DNA, 14 bp, Homo sapiens
tgccccttcactca

SEQ ID NO: 1547402 - DNA, 19 bp, Homo sapiens
tgccccttcccatctcttc

SEQ ID NO: 1547403 - DNA, 21 bp, Homo sapiens
tgccccttcccatctcttcct

SEQ ID NO: 1547404 - DNA, 13 bp, Homo sapiens
tgccccttgccat

SEQ ID NO: 1547405 - DNA, 20 bp, Homo sapiens
tgcccgagagagctctggcc

SEQ ID NO: 1547406 - DNA, 23 bp, Homo sapiens
tgcccgataccgggacacagaat

SEQ ID NO: 1547407 - DNA, 23 bp, Homo sapiens
tgcccgcacccctccctgcttgc

SEQ ID NO: 1547408 - DNA, 17 bp, Homo sapiens
tgcccgcaccctggcct

SEQ ID NO: 1547409 - DNA, 20 bp, Homo sapiens
tgcccgcaccctggcctggt

SEQ ID NO: 1547410 - DNA, 21 bp, Homo sapiens
tgcccgcaccctggcctggtc

SEQ ID NO: 1547411 - DNA, 18 bp, Homo sapiens
tgcccgccagcctcagtg

SEQ ID NO: 1547412 - DNA, 17 bp, Homo sapiens
tgccctccgcctgggat

SEQ ID NO: 1547413 - DNA, 11 bp, Homo sapiens
tgccctcctgg

SEQ ID NO: 1547414 - DNA, 15 bp, Homo sapiens
tgccctcgctgcttc

SEQ ID NO: 1547415 - DNA, 17 bp, Homo sapiens
tgccctcgctgcttctg

SEQ ID NO: 1547416 - DNA, 23 bp, Homo sapiens
tgccctcgggcgagtcactgcct

SEQ ID NO: 1547417 - DNA, 15 bp, Homo sapiens
tgccctcgtggccag

SEQ ID NO: 1547418 - DNA, 17 bp, Homo sapiens
tgccctcgtggccagcc

SEQ ID NO: 1547419 - DNA, 18 bp, Homo sapiens
tgccctcgtggccagccc

SEQ ID NO: 1547420 - DNA, 20 bp, Homo sapiens
tgccctcgtggccagcccgg

SEQ ID NO: 1547421 - DNA, 22 bp, Homo sapiens
tgccctctatttattagccaac

SEQ ID NO: 1547422 - DNA, 24 bp, Homo sapiens
tgccctctatttattagccaactg

SEQ ID NO: 1547423 - DNA, 16 bp, Homo sapiens
tgccctctccttcctt

SEQ ID NO: 1547424 - DNA, 13 bp, Homo sapiens
tgccctctctgcg

SEQ ID NO: 1547425 - DNA, 13 bp, Homo sapiens
tgccctctgcccc

SEQ ID NO: 1547426 - DNA, 21 bp, Homo sapiens
tgccctctgctctgcctggag

SEQ ID NO: 1547427 - DNA, 12 bp, Homo sapiens
tgccctctgctg

SEQ ID NO: 1547428 - DNA, 13 bp, Homo sapiens
tgccctctgggtc

SEQ ID NO: 1547429 - DNA, 20 bp, Homo sapiens
tgccctcttctcgtgcctcc

SEQ ID NO: 1547430 - DNA, 21 bp, Homo sapiens
tgccctgaaagggcccttccc

SEQ ID NO: 1547431 - DNA, 23 bp, Homo sapiens
tgccctgatgcgtctacccagac

SEQ ID NO: 1547432 - DNA, 14 bp, Homo sapiens
tgccctgcctgagg

SEQ ID NO: 1547433 - DNA, 13 bp, Homo sapiens
tgccctgcctgcc

SEQ ID NO: 1547434 - DNA, 15 bp, Homo sapiens
tgccctgcctgccca

SEQ ID NO: 1547435 - DNA, 18 bp, Homo sapiens
tgccctgcctgcccactt

SEQ ID NO: 1547436 - DNA, 19 bp, Homo sapiens
tgccctgccttgtccctct

SEQ ID NO: 1547437 - DNA, 18 bp, Homo sapiens
tgccctggcagcagcagg

SEQ ID NO: 1547438 - DNA, 14 bp, Homo sapiens
tgccctggccctga

SEQ ID NO: 1547439 - DNA, 18 bp, Homo sapiens
tgccctggccctgaggtg

SEQ ID NO: 1547440 - DNA, 18 bp, Homo sapiens
tgccctggctgctgcccc

SEQ ID NO: 1547441 - DNA, 19 bp, Homo sapiens
tgccctgggcgagcccctc

SEQ ID NO: 1547442 - DNA, 20 bp, Homo sapiens
tgccctgggcgagcccctcc

SEQ ID NO: 1547443 - DNA, 21 bp, Homo sapiens
tgccctgggcgagcccctcct

SEQ ID NO: 1547444 - DNA, 18 bp, Homo sapiens
tgccctggtccagggaag

SEQ ID NO: 1547445 - DNA, 17 bp, Homo sapiens
tgccctggtgctgccac

SEQ ID NO: 1547446 - DNA, 14 bp, Homo sapiens
tgccctggtggaga

SEQ ID NO: 1547447 - DNA, 15 bp, Homo sapiens
tgccctggtggagaa

SEQ ID NO: 1547448 - DNA, 13 bp, Homo sapiens
tgccctgtgtact

SEQ ID NO: 1547449 - DNA, 20 bp, Homo sapiens
tgccctgttaaaagatgaaa

SEQ ID NO: 1547450 - DNA, 15 bp, Homo sapiens
tgcccttaaatcata

SEQ ID NO: 1547451 - DNA, 13 bp, Homo sapiens
tgcccttccctgt

SEQ ID NO: 1547452 - DNA, 16 bp, Homo sapiens
tgcccttccctgtccc

SEQ ID NO: 1547453 - DNA, 17 bp, Homo sapiens
tgcccttccctgtccct

SEQ ID NO: 1547454 - DNA, 16 bp, Homo sapiens
tgcccttcctcagttt

SEQ ID NO: 1547455 - DNA, 14 bp, Homo sapiens
tgcccttctcaaga

SEQ ID NO: 1547456 - DNA, 19 bp, Homo sapiens
tgcccttctcaagacttta

SEQ ID NO: 1547457 - DNA, 12 bp, Homo sapiens
tgcccttctgat

SEQ ID NO: 1547458 - DNA, 22 bp, Homo sapiens
tgcccttctgattcccctccac

SEQ ID NO: 1547459 - DNA, 11 bp, Homo sapiens
tgcccttgggg

SEQ ID NO: 1547460 - DNA, 19 bp, Homo sapiens
tgcccttggtagcagcctg

SEQ ID NO: 1547461 - DNA, 17 bp, Homo sapiens
tgcccttgttgcctgca

SEQ ID NO: 1547462 - DNA, 18 bp, Homo sapiens
tgccctttagccagatgc

SEQ ID NO: 1547463 - DNA, 11 bp, Homo sapiens
tgccctttgag

SEQ ID NO: 1547464 - DNA, 18 bp, Homo sapiens
tgccgaacacacatccca

SEQ ID NO: 1547465 - DNA, 23 bp, Homo sapiens
tgccgacatccctcccccagcag

SEQ ID NO: 1547466 - DNA, 15 bp, Homo sapiens
tgccgaccagagccc

SEQ ID NO: 1547467 - DNA, 21 bp, Homo sapiens
tgccgaccagagccccacacg

SEQ ID NO: 1547468 - DNA, 14 bp, Homo sapiens
tgccgactggctgt

SEQ ID NO: 1547469 - DNA, 17 bp, Homo sapiens
tgccgagcctaatgaaa

SEQ ID NO: 1547470 - DNA, 13 bp, Homo sapiens
tgccgcaccccag

SEQ ID NO: 1547471 - DNA, 15 bp, Homo sapiens
tgccgcaccccagag

SEQ ID NO: 1547472 - DNA, 13 bp, Homo sapiens
tgccgcagacggg

SEQ ID NO: 1547473 - DNA, 17 bp, Homo sapiens
tgccgcagacgggcaca

SEQ ID NO: 1547474 - DNA, 19 bp, Homo sapiens
tgccgcagacgggcacaga

SEQ ID NO: 1547475 - DNA, 15 bp, Homo sapiens
tgccgcagagctggc

SEQ ID NO: 1547476 - DNA, 17 bp, Homo sapiens
tgccgcagggagggctg

SEQ ID NO: 1547477 - DNA, 18 bp, Homo sapiens
tgccgcagggagggctgt

SEQ ID NO: 1547478 - DNA, 21 bp, Homo sapiens
tgccgccagctgccgcaccag

SEQ ID NO: 1547479 - DNA, 16 bp, Homo sapiens
tgccgcccccgcctgg

SEQ ID NO: 1547480 - DNA, 19 bp, Homo sapiens
tgccgcccccgcctgggca

SEQ ID NO: 1547481 - DNA, 20 bp, Homo sapiens
tgccgcccccgcctgggcac

SEQ ID NO: 1547482 - DNA, 19 bp, Homo sapiens
tgccgccccctcctgaacc

SEQ ID NO: 1547483 - DNA, 20 bp, Homo sapiens
tgccgcctcagcttctcaaa

SEQ ID NO: 1547484 - DNA, 16 bp, Homo sapiens
tgccgcctgcactcct

SEQ ID NO: 1547485 - DNA, 22 bp, Homo sapiens
tgcacctgctgcgtccccactc

SEQ ID NO: 1547486 - DNA, 18 bp, Homo sapiens
tgcacctggcctgggcca

SEQ ID NO: 1547487 - DNA, 19 bp, Homo sapiens
tgcacctggcctgggccac

SEQ ID NO: 1547488 - DNA, 13 bp, Homo sapiens
tgcacctgtcccc

SEQ ID NO: 1547489 - DNA, 16 bp, Homo sapiens
tgcacctgtccccacc

SEQ ID NO: 1547490 - DNA, 17 bp, Homo sapiens
tgcacctgtccccaccc

SEQ ID NO: 1547491 - DNA, 21 bp, Homo sapiens
tgcacctgtccccaccctcca

SEQ ID NO: 1547492 - DNA, 17 bp, Homo sapiens
tgcacgaactggactgt

SEQ ID NO: 1547493 - DNA, 20 bp, Homo sapiens
tgcacgaactggactgtgtg

SEQ ID NO: 1547494 - DNA, 18 bp, Homo sapiens
tgcacgaccgccccagtt

SEQ ID NO: 1547495 - DNA, 18 bp, Homo sapiens
tgcacgcaggcacagcag

SEQ ID NO: 1547496 - DNA, 20 bp, Homo sapiens
tgcagagacaggacctgact

SEQ ID NO: 1547497 - DNA, 13 bp, Homo sapiens
tgcagagactcat

SEQ ID NO: 1547498 - DNA, 13 bp, Homo sapiens
tgcagagatttcc

SEQ ID NO: 1547499 - DNA, 21 bp, Homo sapiens
tgcagagatttcctccatggt

SEQ ID NO: 1547500 - DNA, 15 bp, Homo sapiens
tgcagagatttctca

SEQ ID NO: 1547501 - DNA, 18 bp, Homo sapiens
tgcagagcacacaggtac

SEQ ID NO: 1547502 - DNA, 15 bp, Homo sapiens
tgcagagccttctca

SEQ ID NO: 1547503 - DNA, 22 bp, Homo sapiens
tgcagagccttctcagaagcac

SEQ ID NO: 1547504 - DNA, 18 bp, Homo sapiens
tgcagagctgacccagag

SEQ ID NO: 1547505 - DNA, 14 bp, Homo sapiens
tgcagaggccagag

SEQ ID NO: 1547506 - DNA, 15 bp, Homo sapiens
tgcagaggccagagg

SEQ ID NO: 1547507 - DNA, 23 bp, Homo sapiens
tgcagaggctcttgatggtggac

SEQ ID NO: 1547508 - DNA, 18 bp, Homo sapiens
tgcagaggggaaagactt

SEQ ID NO: 1547509 - DNA, 20 bp, Homo sapiens
tgcagaggggctttctggag

SEQ ID NO: 1547510 - DNA, 21 bp, Homo sapiens
tgcagaggggctttctggaga

SEQ ID NO: 1547511 - DNA, 14 bp, Homo sapiens
tgcagaggtctcca

SEQ ID NO: 1547512 - DNA, 15 bp, Homo sapiens
tgcagaggtctccaa

SEQ ID NO: 1547513 - DNA, 21 bp, Homo sapiens
tgcagtaactgttttttaagt

SEQ ID NO: 1547514 - DNA, 14 bp, Homo sapiens
tgcagtacaggcaa

SEQ ID NO: 1547515 - DNA, 16 bp, Homo sapiens
tgcagtagagtcatct

SEQ ID NO: 1547516 - DNA, 15 bp, Homo sapiens
tgcagtcctgaggag

SEQ ID NO: 1547517 - DNA, 17 bp, Homo sapiens
tgcagtcggcatgccag

SEQ ID NO: 1547518 - DNA, 22 bp, Homo sapiens
tgcagtcggcatgccaggaccc

SEQ ID NO: 1547519 - DNA, 16 bp, Homo sapiens
tgcagtctcatttctc

SEQ ID NO: 1547520 - DNA, 20 bp, Homo sapiens
tgcagtcttctctctggctc

SEQ ID NO: 1547521 - DNA, 22 bp, Homo sapiens
tgcagtcttctctctggctcag

SEQ ID NO: 1547522 - DNA, 23 bp, Homo sapiens
tgcagtgacacaatctcggctca

SEQ ID NO: 1547523 - DNA, 15 bp, Homo sapiens
tgcagtgagctgaga

SEQ ID NO: 1547524 - DNA, 18 bp, Homo sapiens
tgcagtgatacatgtact

SEQ ID NO: 1547525 - DNA, 16 bp, Homo sapiens
tgcagtggcctggccg

SEQ ID NO: 1547526 - DNA, 17 bp, Homo sapiens
tgcagtggcctggccgt

SEQ ID NO: 1547527 - DNA, 22 bp, Homo sapiens
tgcagtggcgcgatctcagctc

SEQ ID NO: 1547528 - DNA, 16 bp, Homo sapiens
tgcagtggcttttcat

SEQ ID NO: 1547529 - DNA, 15 bp, Homo sapiens
tgcagtgtggagttc

SEQ ID NO: 1547530 - DNA, 14 bp, Homo sapiens
tgcagttaacagga

SEQ ID NO: 1547531 - DNA, 13 bp, Homo sapiens
tgcagttacaaat

SEQ ID NO: 1547532 - DNA, 19 bp, Homo sapiens
tgcagttacaaattataat

SEQ ID NO: 1547533 - DNA, 15 bp, Homo sapiens
tgcagttcagcacca

SEQ ID NO: 1547534 - DNA, 19 bp, Homo sapiens
tgagctggaaggggccacg

SEQ ID NO: 1547535 - DNA, 21 bp, Homo sapiens
tgagctggatagacttgggat

SEQ ID NO: 1547536 - DNA, 15 bp, Homo sapiens
tgagctggcaaccag

SEQ ID NO: 1547537 - DNA, 17 bp, Homo sapiens
tgagctggcaaccagcc

SEQ ID NO: 1547538 - DNA, 18 bp, Homo sapiens
tgagctggcaaccagcca

SEQ ID NO: 1547539 - DNA, 20 bp, Homo sapiens
tgagctggcaaccagccagc

SEQ ID NO: 1547540 - DNA, 18 bp, Homo sapiens
tgagctggcctctctagc

SEQ ID NO: 1547541 - DNA, 22 bp, Homo sapiens
tgagctggggacctggtaccct

SEQ ID NO: 1547542 - DNA, 17 bp, Homo sapiens
tgagctggggactcagg

SEQ ID NO: 1547543 - DNA, 20 bp, Homo sapiens
tgagctggggactcagggac

SEQ ID NO: 1547544 - DNA, 20 bp, Homo sapiens
tgagctggggatgtctctca

SEQ ID NO: 1547545 - DNA, 15 bp, Homo sapiens
tgagctgggtactga

SEQ ID NO: 1547546 - DNA, 17 bp, Homo sapiens
tgagctgggtactgact

SEQ ID NO: 1547547 - DNA, 20 bp, Homo sapiens
tgagctgtcgctgcctccat

SEQ ID NO: 1547548 - DNA, 13 bp, Homo sapiens
tgagcttacattg

SEQ ID NO: 1547549 - DNA, 22 bp, Homo sapiens
tgagcttagccttgtgccctgc

SEQ ID NO: 1547550 - DNA, 23 bp, Homo sapiens
tgagcttagccttgtgccctgcc

SEQ ID NO: 1547551 - DNA, 18 bp, Homo sapiens
tgagcttcaatataagaa

SEQ ID NO: 1547552 - DNA, 16 bp, Homo sapiens
tgagcttctctgtgaa

SEQ ID NO: 1547553 - DNA, 14 bp, Homo sapiens
tgagcttgagctcc

SEQ ID NO: 1547554 - DNA, 15 bp, Homo sapiens
tgagcttgagctccc

SEQ ID NO: 1547555 - DNA, 20 bp, Homo sapiens
tgagctttccatgttgctgc

SEQ ID NO: 1547556 - DNA, 14 bp, Homo sapiens
tgagctttctttgc

SEQ ID NO: 1547557 - DNA, 16 bp, Homo sapiens
tgagctttctttgcac

SEQ ID NO: 1547558 - DNA, 15 bp, Homo sapiens
tgaggaaatttgcag

SEQ ID NO: 1547559 - DNA, 19 bp, Homo sapiens
tgaggaactgtagatgatg

SEQ ID NO: 1547560 - DNA, 19 bp, Homo sapiens
tgaggaagaacggggctct

SEQ ID NO: 1547561 - DNA, 15 bp, Homo sapiens
tgaggaagagtttat

SEQ ID NO: 1547562 - DNA, 19 bp, Homo sapiens
tgaggaatagcaaaattcc

SEQ ID NO: 1547563 - DNA, 20 bp, Homo sapiens
tgaggaatagttgagcccca

SEQ ID NO: 1547564 - DNA, 20 bp, Homo sapiens
tgaggaatcaacagggcagc

SEQ ID NO: 1547565 - DNA, 19 bp, Homo sapiens
tgaggaattatcatgggaa

SEQ ID NO: 1547566 - DNA, 20 bp, Homo sapiens
tgaggacaaccattccagac

SEQ ID NO: 1547567 - DNA, 21 bp, Homo sapiens
tgaggacaccagtgaaagaag

SEQ ID NO: 1547568 - DNA, 21 bp, Homo sapiens
tgaggacacgtggcctgcacc

SEQ ID NO: 1547569 - DNA, 14 bp, Homo sapiens
tgaggacagaagga

SEQ ID NO: 1547570 - DNA, 17 bp, Homo sapiens
tgaggacagaaggactg

SEQ ID NO: 1547571 - DNA, 15 bp, Homo sapiens
tgaggacagaggccg

SEQ ID NO: 1547572 - DNA, 18 bp, Homo sapiens
tgaggaccgctgataagc

SEQ ID NO: 1547573 - DNA, 21 bp, Homo sapiens
tgaggaccgctgataagcatt

SEQ ID NO: 1547574 - DNA, 15 bp, Homo sapiens
tgaggacctccctgt

SEQ ID NO: 1547575 - DNA, 17 bp, Homo sapiens
tgaggacgagaccccca

SEQ ID NO: 1547576 - DNA, 22 bp, Homo sapiens
tgaggacgagacccccatccag

SEQ ID NO: 1547577 - DNA, 20 bp, Homo sapiens
tgaggagaagctgatccagt

SEQ ID NO: 1547578 - DNA, 20 bp, Homo sapiens
tgaggagaagggggtctctg

SEQ ID NO: 1547579 - DNA, 17 bp, Homo sapiens
tgaggagacagaaagcc

SEQ ID NO: 1547580 - DNA, 18 bp, Homo sapiens
tgaggagacagaaagcct

SEQ ID NO: 1547581 - DNA, 20 bp, Homo sapiens
tgaggagacagaaagcctcc

SEQ ID NO: 1547582 - DNA, 23 bp, Homo sapiens
tgaggagagtctgaatattttca

SEQ ID NO: 1547583 - DNA, 22 bp, Homo sapiens
tgaggagatgaccagggatgct

SEQ ID NO: 1547584 - DNA, 15 bp, Homo sapiens
tgaggagccaggccg

SEQ ID NO: 1547585 - DNA, 11 bp, Homo sapiens
tgaggagcccc

SEQ ID NO: 1547586 - DNA, 14 bp, Homo sapiens
tgaggagccctgag

SEQ ID NO: 1547587 - DNA, 16 bp, Homo sapiens
tgaggagccctgagga

SEQ ID NO: 1547588 - DNA, 14 bp, Homo sapiens
tgaggagcgtggac

SEQ ID NO: 1547589 - DNA, 13 bp, Homo sapiens
tgaggagctgctg

SEQ ID NO: 1547590 - DNA, 16 bp, Homo sapiens
tgaggagctgctggct

SEQ ID NO: 1547591 - DNA, 12 bp, Homo sapiens
tgaggagctggg

SEQ ID NO: 1547592 - DNA, 20 bp, Homo sapiens
tgaggagctggggatccctc

SEQ ID NO: 1547593 - DNA, 18 bp, Homo sapiens
tgaggaggaaaaggaaaa

SEQ ID NO: 1547594 - DNA, 22 bp, Homo sapiens
tgaggaggaggacacagcacaa

SEQ ID NO: 1547595 - DNA, 13 bp, Homo sapiens
tgaggaggaggct

SEQ ID NO: 1547596 - DNA, 13 bp, Homo sapiens
tgaggagggatgt

SEQ ID NO: 1547597 - DNA, 12 bp, Homo sapiens
tgaggaggggag

SEQ ID NO: 1547598 - DNA, 18 bp, Homo sapiens
tgaggagggtggaggaag

SEQ ID NO: 1547599 - DNA, 13 bp, Homo sapiens
tgaggagggtggg

SEQ ID NO: 1547600 - DNA, 20 bp, Homo sapiens
tgaggagggtgggggaggga

SEQ ID NO: 1547601 - DNA, 21 bp, Homo sapiens
tgaggagtattaagaatgcag

SEQ ID NO: 1547602 - DNA, 15 bp, Homo sapiens
tgaggagttgcctga

SEQ ID NO: 1547603 - DNA, 16 bp, Homo sapiens
tgaggatacagctctt

SEQ ID NO: 1547604 - DNA, 20 bp, Homo sapiens
tgaggatacagctcttctca

SEQ ID NO: 1547605 - DNA, 14 bp, Homo sapiens
tgaggatgaggccg

SEQ ID NO: 1547606 - DNA, 21 bp, Homo sapiens
tgaggatggagagcagccagc

SEQ ID NO: 1547607 - DNA, 18 bp, Homo sapiens
tgaggatgggtcagagct

SEQ ID NO: 1547608 - DNA, 21 bp, Homo sapiens
tgaggatgtagagagaacagg

SEQ ID NO: 1547609 - DNA, 19 bp, Homo sapiens
tgaggattatgggtcctgc

SEQ ID NO: 1547610 - DNA, 22 bp, Homo sapiens
tgaggattgtggaaaaccagga

SEQ ID NO: 1547611 - DNA, 13 bp, Homo sapiens
tgaggcaaacagc

SEQ ID NO: 1547612 - DNA, 20 bp, Homo sapiens
tgaggcaatgtcaggaacag

SEQ ID NO: 1547613 - DNA, 21 bp, Homo sapiens
tgaggcaatgtcaggaacaga

SEQ ID NO: 1547614 - DNA, 18 bp, Homo sapiens
tgaggcaccgtccaggcc

SEQ ID NO: 1547615 - DNA, 19 bp, Homo sapiens
tgaggcaccgtccaggccc

SEQ ID NO: 1547616 - DNA, 20 bp, Homo sapiens
tgaggcaccgtccaggcccc

SEQ ID NO: 1547617 - DNA, 13 bp, Homo sapiens
tgaggcagaagaa

SEQ ID NO: 1547618 - DNA, 24 bp, Homo sapiens
tgaggcagacagcagctcaggcac

SEQ ID NO: 1547619 - DNA, 22 bp, Homo sapiens
tgaggcaggtgagaacccagag

SEQ ID NO: 1547620 - DNA, 18 bp, Homo sapiens
tgaggccaagatggctgc

SEQ ID NO: 1547621 - DNA, 13 bp, Homo sapiens
tgaggccaggagt

SEQ ID NO: 1547622 - DNA, 15 bp, Homo sapiens
tgaggccatctcagg

SEQ ID NO: 1547623 - DNA, 10 bp, Homo sapiens
tgaggcccaa

SEQ ID NO: 1547624 - DNA, 13 bp, Homo sapiens
tgaggcccaagga

SEQ ID NO: 1547625 - DNA, 15 bp, Homo sapiens
tgaggcccaaggagc

SEQ ID NO: 1547626 - DNA, 23 bp, Homo sapiens
tgaggcccccgtcagggagaggt

SEQ ID NO: 1547627 - DNA, 23 bp, Homo sapiens
tgaggcccctaggtgcccagggc

SEQ ID NO: 1547628 - DNA, 16 bp, Homo sapiens
tgaggccgctagaggc

SEQ ID NO: 1547629 - DNA, 17 bp, Homo sapiens
tgaggccgctagaggcc

SEQ ID NO: 1547630 - DNA, 20 bp, Homo sapiens
tgaggccgctagaggcctga

SEQ ID NO: 1547631 - DNA, 22 bp, Homo sapiens
tgaggccttatcattcattctt

SEQ ID NO: 1547632 - DNA, 15 bp, Homo sapiens
tgaggccttgtgtgt

SEQ ID NO: 1547633 - DNA, 22 bp, Homo sapiens
tgaggccttgtgtgtcaggccc

SEQ ID NO: 1547634 - DNA, 19 bp, Homo sapiens
tgagaattaagttttaaat

SEQ ID NO: 1547635 - DNA, 14 bp, Homo sapiens
tgagaatttgcaac

SEQ ID NO: 1547636 - DNA, 23 bp, Homo sapiens
tgagaattttaaattataactta

SEQ ID NO: 1547637 - DNA, 18 bp, Homo sapiens
tgagacaaatggaggcct

SEQ ID NO: 1547638 - DNA, 15 bp, Homo sapiens
tgagacaagccctgg

SEQ ID NO: 1547639 - DNA, 19 bp, Homo sapiens
tgagacaagccctggcaac

SEQ ID NO: 1547640 - DNA, 17 bp, Homo sapiens
tgagacacggagcccag

SEQ ID NO: 1547641 - DNA, 19 bp, Homo sapiens
tgagacagaatctcagtct

SEQ ID NO: 1547642 - DNA, 17 bp, Homo sapiens
tgagacagataagagaa

SEQ ID NO: 1547643 - DNA, 13 bp, Homo sapiens
tgagaccacagag

SEQ ID NO: 1547644 - DNA, 21 bp, Homo sapiens
tgagaccacagagagagggga

SEQ ID NO: 1547645 - DNA, 15 bp, Homo sapiens
tgagaccagcctggc

SEQ ID NO: 1547646 - DNA, 17 bp, Homo sapiens
tgagaccagcctggcca

SEQ ID NO: 1547647 - DNA, 13 bp, Homo sapiens
tgagaccaggctg

SEQ ID NO: 1547648 - DNA, 21 bp, Homo sapiens
tgagaccagttgggagcactg

SEQ ID NO: 1547649 - DNA, 23 bp, Homo sapiens
tgagaccccaaagactctggagg

SEQ ID NO: 1547650 - DNA, 14 bp, Homo sapiens
tgagacccccacac

SEQ ID NO: 1547651 - DNA, 17 bp, Homo sapiens
tgagacccccacacctc

SEQ ID NO: 1547652 - DNA, 22 bp, Homo sapiens
tgagacccccacacctcagttc

SEQ ID NO: 1547653 - DNA, 15 bp, Homo sapiens
tgagaccctgtctct

SEQ ID NO: 1547654 - DNA, 14 bp, Homo sapiens
tgagacccttttct

SEQ ID NO: 1547655 - DNA, 15 bp, Homo sapiens
tgagacccttttctc

SEQ ID NO: 1547656 - DNA, 23 bp, Homo sapiens
tgagacggagtcttgctctgtag

SEQ ID NO: 1547657 - DNA, 19 bp, Homo sapiens
tgagactacaagtgtgtgc

SEQ ID NO: 1547658 - DNA, 18 bp, Homo sapiens
tgagactcagtgcagatg

SEQ ID NO: 1547659 - DNA, 16 bp, Homo sapiens
tgagactccacctcaa

SEQ ID NO: 1547660 - DNA, 13 bp, Homo sapiens
tgagactccagaa

SEQ ID NO: 1547661 - DNA, 21 bp, Homo sapiens
tgagactccagaatctgctgt

SEQ ID NO: 1547662 - DNA, 22 bp, Homo sapiens
tgagactccagaatctgctgtt

SEQ ID NO: 1547663 - DNA, 13 bp, Homo sapiens
tgagactccatct

SEQ ID NO: 1547664 - DNA, 14 bp, Homo sapiens
tgagactccatctc

SEQ ID NO: 1547665 - DNA, 15 bp, Homo sapiens
tgagactcgagaact

SEQ ID NO: 1547666 - DNA, 21 bp, Homo sapiens
tgagactctagggtccagtgg

SEQ ID NO: 1547667 - DNA, 16 bp, Homo sapiens
tgagacttaaaacatg

SEQ ID NO: 1547668 - DNA, 15 bp, Homo sapiens
tgagactttctgctg

SEQ ID NO: 1547669 - DNA, 19 bp, Homo sapiens
tgagagaaagagagaagcc

SEQ ID NO: 1547670 - DNA, 15 bp, Homo sapiens
tgagagacccagctg

SEQ ID NO: 1547671 - DNA, 19 bp, Homo sapiens
tgagagacctgccctctct

SEQ ID NO: 1547672 - DNA, 14 bp, Homo sapiens
tgagagacctgtgt

SEQ ID NO: 1547673 - DNA, 22 bp, Homo sapiens
tgagagcaaagggaaggactga

SEQ ID NO: 1547674 - DNA, 12 bp, Homo sapiens
tgagagcaaatg

SEQ ID NO: 1547675 - DNA, 21 bp, Homo sapiens
tgagagcaaatgcaaaaataa

SEQ ID NO: 1547676 - DNA, 21 bp, Homo sapiens
tgagagccagatgcctcccca

SEQ ID NO: 1547677 - DNA, 12 bp, Homo sapiens
tgagagccccag

SEQ ID NO: 1547678 - DNA, 16 bp, Homo sapiens
tgagagccccagctga

SEQ ID NO: 1547679 - DNA, 19 bp, Homo sapiens
tgagagcccgcgtgctgga

SEQ ID NO: 1547680 - DNA, 17 bp, Homo sapiens
tgagagccctgctgtgg

SEQ ID NO: 1547681 - DNA, 22 bp, Homo sapiens
tgagagccctgctgtgggagag

SEQ ID NO: 1547682 - DNA, 18 bp, Homo sapiens
tgagagcgacacagacgt

SEQ ID NO: 1547683 - DNA, 15 bp, Homo sapiens
tgagagcgaggctga

SEQ ID NO: 1547684 - DNA, 19 bp, Homo sapiens
tgagagcgaggctgagcct

SEQ ID NO: 1547685 - DNA, 12 bp, Homo sapiens
tgagagctgctg

SEQ ID NO: 1547686 - DNA, 13 bp, Homo sapiens
tgagagctgctga

SEQ ID NO: 1547687 - DNA, 16 bp, Homo sapiens
tgagagctgctgaggg

SEQ ID NO: 1547688 - DNA, 23 bp, Homo sapiens
tgagaggagaaatgcaataactc

SEQ ID NO: 1547689 - DNA, 16 bp, Homo sapiens
tgagaggcaggcatag

SEQ ID NO: 1547690 - DNA, 15 bp, Homo sapiens
tgagaggcctggagc

SEQ ID NO: 1547691 - DNA, 16 bp, Homo sapiens
tgagaggcctggagcc

SEQ ID NO: 1547692 - DNA, 11 bp, Homo sapiens
tgagaggctga

SEQ ID NO: 1547693 - DNA, 21 bp, Homo sapiens
tgagagggcagtgtttccttt

SEQ ID NO: 1547694 - DNA, 22 bp, Homo sapiens
tgagagggcatgcgcacaaggc

SEQ ID NO: 1547695 - DNA, 12 bp, Homo sapiens
tgagaggggaag

SEQ ID NO: 1547696 - DNA, 16 bp, Homo sapiens
tgagaggggaagcggc

SEQ ID NO: 1547697 - DNA, 17 bp, Homo sapiens
tgagagtcagctctctg

SEQ ID NO: 1547698 - DNA, 19 bp, Homo sapiens
tgagagtcagctctctgcc

SEQ ID NO: 1547699 - DNA, 21 bp, Homo sapiens
tgagagtcagctctctgccct

SEQ ID NO: 1547700 - DNA, 15 bp, Homo sapiens
tgagagttccttctc

SEQ ID NO: 1547701 - DNA, 22 bp, Homo sapiens
tgagagttccttctcacttaga

SEQ ID NO: 1547702 - DNA, 15 bp, Homo sapiens
tgagataaagtcaaa

SEQ ID NO: 1547703 - DNA, 13 bp, Homo sapiens
tgagataagaaaa

SEQ ID NO: 1547704 - DNA, 14 bp, Homo sapiens
tgagataagaaaag

SEQ ID NO: 1547705 - DNA, 13 bp, Homo sapiens
tgagatacactga

SEQ ID NO: 1547706 - DNA, 18 bp, Homo sapiens
tgagataccacaaaccct

SEQ ID NO: 1547707 - DNA, 18 bp, Homo sapiens
tgagatcactgactctga

SEQ ID NO: 1547708 - DNA, 18 bp, Homo sapiens
tgagatcagcattcaaaa

SEQ ID NO: 1547709 - DNA, 21 bp, Homo sapiens
tgagatcagcattcaaaatag

SEQ ID NO: 1547710 - DNA, 20 bp, Homo sapiens
tgagatccttcacaggcagt

SEQ ID NO: 1547711 - DNA, 15 bp, Homo sapiens
tgagatctaaaaata

SEQ ID NO: 1547712 - DNA, 16 bp, Homo sapiens
tgagatctaagccttt

SEQ ID NO: 1547713 - DNA, 21 bp, Homo sapiens
tgagatctaagcctttccata

SEQ ID NO: 1547714 - DNA, 23 bp, Homo sapiens
tgagatctgcacagtcagaagga

SEQ ID NO: 1547715 - DNA, 13 bp, Homo sapiens
tgagatgagcccc

SEQ ID NO: 1547716 - DNA, 21 bp, Homo sapiens
tgagatgatcgtagacacagg

SEQ ID NO: 1547717 - DNA, 16 bp, Homo sapiens
tgagatggtatgaaat

SEQ ID NO: 1547718 - DNA, 20 bp, Homo sapiens
tgagatggtatgcacaattc

SEQ ID NO: 1547719 - DNA, 22 bp, Homo sapiens
tgagatggtatgcacaattcca

SEQ ID NO: 1547720 - DNA, 16 bp, Homo sapiens
tgagatggtgaggctg

SEQ ID NO: 1547721 - DNA, 17 bp, Homo sapiens
tgagatgtatgaaggct

SEQ ID NO: 1547722 - DNA, 18 bp, Homo sapiens
tgagatgtgaacacatca

SEQ ID NO: 1547723 - DNA, 12 bp, Homo sapiens
tgagatgtgtga

SEQ ID NO: 1547724 - DNA, 20 bp, Homo sapiens
tgagatgtgtggactgtggc

SEQ ID NO: 1547725 - DNA, 20 bp, Homo sapiens
tgagatgttattactgtttt

SEQ ID NO: 1547726 - DNA, 16 bp, Homo sapiens
tgactgctcagaactt

SEQ ID NO: 1547727 - DNA, 15 bp, Homo sapiens
tgactgctgattctc

SEQ ID NO: 1547728 - DNA, 21 bp, Homo sapiens
tgactggatcttctatcattc

SEQ ID NO: 1547729 - DNA, 22 bp, Homo sapiens
tgactggctgtctgcctgtatt

SEQ ID NO: 1547730 - DNA, 12 bp, Homo sapiens
tgactgggaaag

SEQ ID NO: 1547731 - DNA, 17 bp, Homo sapiens
tgactgtactcctccca

SEQ ID NO: 1547732 - DNA, 22 bp, Homo sapiens
tgactgtactcctcccaggcgc

SEQ ID NO: 1547733 - DNA, 19 bp, Homo sapiens
tgactgtatctgtgtagac

SEQ ID NO: 1547734 - DNA, 16 bp, Homo sapiens
tgactgtcactgttcc

SEQ ID NO: 1547735 - DNA, 15 bp, Homo sapiens
tgactgtgctgtgca

SEQ ID NO: 1547736 - DNA, 13 bp, Homo sapiens
tgactgtgttggg

SEQ ID NO: 1547737 - DNA, 15 bp, Homo sapiens
tgactgttcttggta

SEQ ID NO: 1547738 - DNA, 12 bp, Homo sapiens
tgactgtttatt

SEQ ID NO: 1547739 - DNA, 13 bp, Homo sapiens
tgactgtttattt

SEQ ID NO: 1547740 - DNA, 18 bp, Homo sapiens
tgactgtttatttaagga

SEQ ID NO: 1547741 - DNA, 20 bp, Homo sapiens
tgactgtttatttaaggatg

SEQ ID NO: 1547742 - DNA, 23 bp, Homo sapiens
tgactgtttatttaaggatggat

SEQ ID NO: 1547743 - DNA, 17 bp, Homo sapiens
tgacttaactttaactt

SEQ ID NO: 1547744 - DNA, 15 bp, Homo sapiens
tgacttaagaagcct

SEQ ID NO: 1547745 - DNA, 19 bp, Homo sapiens
tgacttaagcaaaagaaaa

SEQ ID NO: 1547746 - DNA, 13 bp, Homo sapiens
tgacttagaaact

SEQ ID NO: 1547747 - DNA, 16 bp, Homo sapiens
tgacttatctaccatt

SEQ ID NO: 1547748 - DNA, 23 bp, Homo sapiens
tgacttcaatgatagtaagaaaa

SEQ ID NO: 1547749 - DNA, 15 bp, Homo sapiens
tgacttcactgtata

SEQ ID NO: 1547750 - DNA, 23 bp, Homo sapiens
tgacttcactgtatataaacata

SEQ ID NO: 1547751 - DNA, 21 bp, Homo sapiens
tgacttcagtgaatatttttg

SEQ ID NO: 1547752 - DNA, 15 bp, Homo sapiens
tgacttcatgctata

SEQ ID NO: 1547753 - DNA, 23 bp, Homo sapiens
tgacttccctggaggagaagtat

SEQ ID NO: 1547754 - DNA, 18 bp, Homo sapiens
tgacttcctagggatctg

SEQ ID NO: 1547755 - DNA, 19 bp, Homo sapiens
tgacttcctagggatctga

SEQ ID NO: 1547756 - DNA, 20 bp, Homo sapiens
tgacttcctagggatctgaa

SEQ ID NO: 1547757 - DNA, 24 bp, Homo sapiens
tgacttctaagtaaaaccacagca

SEQ ID NO: 1547758 - DNA, 14 bp, Homo sapiens
tgacttctcccctg

SEQ ID NO: 1547759 - DNA, 21 bp, Homo sapiens
tgacttctgctggcatcaaga

SEQ ID NO: 1547760 - DNA, 12 bp, Homo sapiens
tgacttcttggt

SEQ ID NO: 1547761 - DNA, 20 bp, Homo sapiens
tgacttcttggtttggggag

SEQ ID NO: 1547762 - DNA, 13 bp, Homo sapiens
tgacttgaaaaga

SEQ ID NO: 1547763 - DNA, 18 bp, Homo sapiens
tgacttgaaaagaaagaa

SEQ ID NO: 1547764 - DNA, 12 bp, Homo sapiens
tgacttgagtgt

SEQ ID NO: 1547765 - DNA, 14 bp, Homo sapiens
tgacttgctgtcca

SEQ ID NO: 1547766 - DNA, 23 bp, Homo sapiens
tgacttggatcccaaagcaagga

SEQ ID NO: 1547767 - DNA, 13 bp, Homo sapiens
tgacttggcactt

SEQ ID NO: 1547768 - DNA, 18 bp, Homo sapiens
tgacttggggagatggag

SEQ ID NO: 1547769 - DNA, 19 bp, Homo sapiens
tgacttgtacaaacagtat

SEQ ID NO: 1547770 - DNA, 19 bp, Homo sapiens
tgactttaaactttccctt

SEQ ID NO: 1547771 - DNA, 20 bp, Homo sapiens
tgactttaagtaatcaggat

SEQ ID NO: 1547772 - DNA, 18 bp, Homo sapiens
tgactttatgttgtatga

SEQ ID NO: 1547773 - DNA, 19 bp, Homo sapiens
tgactttatgttgtatgat

SEQ ID NO: 1547774 - DNA, 12 bp, Homo sapiens
tgactttcaggt

SEQ ID NO: 1547775 - DNA, 17 bp, Homo sapiens
tgactttgacaattact

SEQ ID NO: 1547776 - DNA, 15 bp, Homo sapiens
tgactttgcttgctt

SEQ ID NO: 1547777 - DNA, 18 bp, Homo sapiens
tgactttggtttttccaa

SEQ ID NO: 1547778 - DNA, 20 bp, Homo sapiens
tgacttttaaggctaaaact

SEQ ID NO: 1547779 - DNA, 22 bp, Homo sapiens
tgacttttatatgctttttctc

SEQ ID NO: 1547780 - DNA, 20 bp, Homo sapiens
tgacttttccaaataaacat

SEQ ID NO: 1547781 - DNA, 13 bp, Homo sapiens
tgacttttctgta

SEQ ID NO: 1547782 - DNA, 22 bp, Homo sapiens
tgacttttctgtaattcaggtt

SEQ ID NO: 1547783 - DNA, 13 bp, Homo sapiens
tgacttttgcttt

SEQ ID NO: 1547784 - DNA, 14 bp, Homo sapiens
tgacttttgcttta

SEQ ID NO: 1547785 - DNA, 17 bp, Homo sapiens
tgactttttagccagtg

SEQ ID NO: 1547786 - DNA, 16 bp, Homo sapiens
tgactttttcagagtt

SEQ ID NO: 1547787 - DNA, 23 bp, Homo sapiens
tgactttttgcatttaaaacaga

SEQ ID NO: 1547788 - DNA, 15 bp, Homo sapiens
tgactttttttgtat

SEQ ID NO: 1547789 - DNA, 18 bp, Homo sapiens
tgactttttttgtatgtg

SEQ ID NO: 1547790 - DNA, 21 bp, Homo sapiens
tgagaaacagctcagccagtg

SEQ ID NO: 1547791 - DNA, 23 bp, Homo sapiens
tgagaaacagctcagccagtggg

SEQ ID NO: 1547792 - DNA, 17 bp, Homo sapiens
tgagaaacccaccagcc

SEQ ID NO: 1547793 - DNA, 23 bp, Homo sapiens
tgagaaaccttattgtacctctc

SEQ ID NO: 1547794 - DNA, 15 bp, Homo sapiens
tgagaaactgctgca

SEQ ID NO: 1547795 - DNA, 16 bp, Homo sapiens
tgagaaactgctgcag

SEQ ID NO: 1547796 - DNA, 19 bp, Homo sapiens
tgagaaacttaaatgttat

SEQ ID NO: 1547797 - DNA, 15 bp, Homo sapiens
tgagaaagactattc

SEQ ID NO: 1547798 - DNA, 20 bp, Homo sapiens
tgagaaagactattcaaaca

SEQ ID NO: 1547799 - DNA, 15 bp, Homo sapiens
tgagaaaggacagag

SEQ ID NO: 1547800 - DNA, 21 bp, Homo sapiens
tgagaaagggattgctgaggc

SEQ ID NO: 1547801 - DNA, 22 bp, Homo sapiens
tgagaaagggattgctgaggca

SEQ ID NO: 1547802 - DNA, 15 bp, Homo sapiens
tgagaaatgaataat

SEQ ID NO: 1547803 - DNA, 22 bp, Homo sapiens
tgagaaatgaataatttcccaa

SEQ ID NO: 1547804 - DNA, 19 bp, Homo sapiens
tgagaacaagtcacagctg

SEQ ID NO: 1547805 - DNA, 23 bp, Homo sapiens
tgagaacaagtcacagctgcagc

SEQ ID NO: 1547806 - DNA, 23 bp, Homo sapiens
tgagaacagataaagattgtgtg

SEQ ID NO: 1547807 - DNA, 20 bp, Homo sapiens
tgagaaccttggaccactcc

SEQ ID NO: 1547808 - DNA, 16 bp, Homo sapiens
tgagaaccttttcaaa

SEQ ID NO: 1547809 - DNA, 15 bp, Homo sapiens
tgagaactgaatttt

SEQ ID NO: 1547810 - DNA, 15 bp, Homo sapiens
tgagaactgaggagc

SEQ ID NO: 1547811 - DNA, 16 bp, Homo sapiens
tgagaactgaggagcg

SEQ ID NO: 1547812 - DNA, 20 bp, Homo sapiens
tgagaactgcatatgtttcg

SEQ ID NO: 1547813 - DNA, 23 bp, Homo sapiens
tgagaagaaaacatctattctct

SEQ ID NO: 1547814 - DNA, 14 bp, Homo sapiens
tgagcacctgggga

SEQ ID NO: 1547815 - DNA, 22 bp, Homo sapiens
tgagcactgtttatacactgtg

SEQ ID NO: 1547816 - DNA, 13 bp, Homo sapiens
tgagcagaacagg

SEQ ID NO: 1547817 - DNA, 19 bp, Homo sapiens
tgagcagaatactggtctc

SEQ ID NO: 1547818 - DNA, 23 bp, Homo sapiens
tgagcagaatgttgtacttgaaa

SEQ ID NO: 1547819 - DNA, 14 bp, Homo sapiens
tgagcagacaggct

SEQ ID NO: 1547820 - DNA, 22 bp, Homo sapiens
tgagcagagatgtactgcaaag

SEQ ID NO: 1547821 - DNA, 12 bp, Homo sapiens
tgagcagagcgg

SEQ ID NO: 1547822 - DNA, 20 bp, Homo sapiens
tgagcagagcgggactctgt

SEQ ID NO: 1547823 - DNA, 17 bp, Homo sapiens
tgagcagagggaggaag

SEQ ID NO: 1547824 - DNA, 23 bp, Homo sapiens
tgagcagccgccagctgggagca

SEQ ID NO: 1547825 - DNA, 13 bp, Homo sapiens
tgagcagcctcca

SEQ ID NO: 1547826 - DNA, 20 bp, Homo sapiens
tgagcagcctctgccaggcc

SEQ ID NO: 1547827 - DNA, 16 bp, Homo sapiens
tgagcaggcagggctg

SEQ ID NO: 1547828 - DNA, 21 bp, Homo sapiens
tgagcagggtccacagctgga

SEQ ID NO: 1547829 - DNA, 15 bp, Homo sapiens
tgagcagtcacactg

SEQ ID NO: 1547830 - DNA, 14 bp, Homo sapiens
tgagcagtggctgg

SEQ ID NO: 1547831 - DNA, 15 bp, Homo sapiens
tgagcagtggctggt

SEQ ID NO: 1547832 - DNA, 21 bp, Homo sapiens
tgagcagtgttggagtgagga

SEQ ID NO: 1547833 - DNA, 22 bp, Homo sapiens
tgagcatacatcttaaatcttt

SEQ ID NO: 1547834 - DNA, 22 bp, Homo sapiens
tgagcatcagagggctgatgga

SEQ ID NO: 1547835 - DNA, 14 bp, Homo sapiens
tgagcatgatggga

SEQ ID NO: 1547836 - DNA, 20 bp, Homo sapiens
tgagcatgcacagctgcttg

SEQ ID NO: 1547837 - DNA, 15 bp, Homo sapiens
tgagcatggggcgct

SEQ ID NO: 1547838 - DNA, 22 bp, Homo sapiens
tgagcatggggcgctcccactc

SEQ ID NO: 1547839 - DNA, 20 bp, Homo sapiens
tgagccacagaaagctcctt

SEQ ID NO: 1547840 - DNA, 17 bp, Homo sapiens
tgagccacagaccacct

SEQ ID NO: 1547841 - DNA, 19 bp, Homo sapiens
tgagccacagaccacctgc

SEQ ID NO: 1547842 - DNA, 18 bp, Homo sapiens
tgagccactgagcctggc

SEQ ID NO: 1547843 - DNA, 11 bp, Homo sapiens
tgagccactgc

SEQ ID NO: 1547844 - DNA, 15 bp, Homo sapiens
tgagccactgtgccc

SEQ ID NO: 1547845 - DNA, 17 bp, Homo sapiens
tgagccagagggagctg

SEQ ID NO: 1547846 - DNA, 20 bp, Homo sapiens
tgagccagccaggccctgcc

SEQ ID NO: 1547847 - DNA, 22 bp, Homo sapiens
tgagccagccaggccctgccag

SEQ ID NO: 1547848 - DNA, 16 bp, Homo sapiens
tgagccagggaacagc

SEQ ID NO: 1547849 - DNA, 14 bp, Homo sapiens
tgagccagtcccag

SEQ ID NO: 1547850 - DNA, 15 bp, Homo sapiens
tgagccagtgattat

SEQ ID NO: 1547851 - DNA, 21 bp, Homo sapiens
tgagccagtgctttaatggca

SEQ ID NO: 1547852 - DNA, 16 bp, Homo sapiens
tgagccatccaaagaa

SEQ ID NO: 1547853 - DNA, 14 bp, Homo sapiens
tgagccatccccag

SEQ ID NO: 1547854 - DNA, 23 bp, Homo sapiens
tgagccatgatcgagccactgca

SEQ ID NO: 1547855 - DNA, 21 bp, Homo sapiens
tgagccatgatttcccactgc

SEQ ID NO: 1547856 - DNA, 21 bp, Homo sapiens
tgagcccactgcccaccccct

SEQ ID NO: 1547857 - DNA, 22 bp, Homo sapiens
tgagcccactgcccaccccctc

SEQ ID NO: 1547858 - DNA, 22 bp, Homo sapiens
tgagcccaggagtttgagacaa

SEQ ID NO: 1547859 - DNA, 12 bp, Homo sapiens
tgagcccaggcc

SEQ ID NO: 1547860 - DNA, 14 bp, Homo sapiens
tgagccccaagtcc

SEQ ID NO: 1547861 - DNA, 22 bp, Homo sapiens
tgagccccaagtcctgaagagg

SEQ ID NO: 1547862 - DNA, 23 bp, Homo sapiens
tgagccccaagtcctgaagaggc

SEQ ID NO: 1547863 - DNA, 15 bp, Homo sapiens
tgagccccccatgcc

SEQ ID NO: 1547864 - DNA, 16 bp, Homo sapiens
tgagccccctgcaccc

SEQ ID NO: 1547865 - DNA, 18 bp, Homo sapiens
tgagccccctgcacccac

SEQ ID NO: 1547866 - DNA, 19 bp, Homo sapiens
tgagccccctgcacccacc

SEQ ID NO: 1547867 - DNA, 14 bp, Homo sapiens
tgagcccctgggga

SEQ ID NO: 1547868 - DNA, 14 bp, Homo sapiens
tgagcccgggctgc

SEQ ID NO: 1547869 - DNA, 15 bp, Homo sapiens
tgagcccttgtttca

SEQ ID NO: 1547870 - DNA, 20 bp, Homo sapiens
tgagccgagatcgcgccact

SEQ ID NO: 1547871 - DNA, 21 bp, Homo sapiens
tgagccggggccgtctgtgtg

SEQ ID NO: 1547872 - DNA, 15 bp, Homo sapiens
tgagcctagctacct

SEQ ID NO: 1547873 - DNA, 18 bp, Homo sapiens
tgagcctatatcagtcgt

SEQ ID NO: 1547874 - DNA, 19 bp, Homo sapiens
tgagcctatatcagtcgtt

SEQ ID NO: 1547875 - DNA, 12 bp, Homo sapiens
tgagcctccccc

SEQ ID NO: 1547876 - DNA, 14 bp, Homo sapiens
tgagcctcccccaa

SEQ ID NO: 1547877 - DNA, 12 bp, Homo sapiens
tgagcctctgct

SEQ ID NO: 1547878 - DNA, 16 bp, Homo sapiens
tgagcctctgctcccc

SEQ ID NO: 1547879 - DNA, 14 bp, Homo sapiens
tgagcctgagcaga

SEQ ID NO: 1547880 - DNA, 18 bp, Homo sapiens
tgagcctgaggccttcca

SEQ ID NO: 1547881 - DNA, 17 bp, Homo sapiens
tgagcctgcagggaagc

SEQ ID NO: 1547882 - DNA, 22 bp, Homo sapiens
tgagcctggcccatagaaacat

SEQ ID NO: 1547883 - DNA, 17 bp, Homo sapiens
tgagcctggctggcaca

SEQ ID NO: 1547884 - DNA, 12 bp, Homo sapiens
tgagcctgttca

SEQ ID NO: 1547885 - DNA, 21 bp, Homo sapiens
tgagcctgttcattctgatgt

SEQ ID NO: 1547886 - DNA, 14 bp, Homo sapiens
tgagccttcagtct

SEQ ID NO: 1547887 - DNA, 18 bp, Homo sapiens
tgagccttcgtgcccccc

SEQ ID NO: 1547888 - DNA, 22 bp, Homo sapiens
tgagccttgcagatatctgcat

SEQ ID NO: 1547889 - DNA, 13 bp, Homo sapiens
tgagccttggccc

SEQ ID NO: 1547890 - DNA, 19 bp, Homo sapiens
tgagccttggcccacactg

SEQ ID NO: 1547891 - DNA, 18 bp, Homo sapiens
tgagcgcctccatccaag

SEQ ID NO: 1547892 - DNA, 20 bp, Homo sapiens
tgagcgcctccatccaaggc

SEQ ID NO: 1547893 - DNA, 13 bp, Homo sapiens
tgagcgctgtgga

SEQ ID NO: 1547894 - DNA, 21 bp, Homo sapiens
tgagctaaataaagatattgt

SEQ ID NO: 1547895 - DNA, 19 bp, Homo sapiens
tgagctaccgtggatctcc

SEQ ID NO: 1547896 - DNA, 21 bp, Homo sapiens
tgagctcaaatctctgttact

SEQ ID NO: 1547897 - DNA, 16 bp, Homo sapiens
tgagctcagaccccca

SEQ ID NO: 1547898 - DNA, 20 bp, Homo sapiens
tgagctcagacccccactct

SEQ ID NO: 1547899 - DNA, 17 bp, Homo sapiens
tgagctcccacctccct

SEQ ID NO: 1547900 - DNA, 19 bp, Homo sapiens
tgagctcccacctcccttc

SEQ ID NO: 1547901 - DNA, 22 bp, Homo sapiens
tgagctcccctggagccagcag

SEQ ID NO: 1547902 - DNA, 16 bp, Homo sapiens
tgagctccctcgctgt

SEQ ID NO: 1547903 - DNA, 12 bp, Homo sapiens
tgagctcctgcg

SEQ ID NO: 1547904 - DNA, 16 bp, Homo sapiens
tgagctcctgctgcgg

SEQ ID NO: 1547905 - DNA, 17 bp, Homo sapiens
tgagctcggggggctct

SEQ ID NO: 1547906 - DNA, 19 bp, Homo sapiens
tgagctcggggggctctgc

SEQ ID NO: 1547907 - DNA, 20 bp, Homo sapiens
tgagctcggggggctctgcc

SEQ ID NO: 1547908 - DNA, 21 bp, Homo sapiens
tgagctcggtggacccaggga

SEQ ID NO: 1547909 - DNA, 21 bp, Homo sapiens
tgacctaaatccattttctaa

SEQ ID NO: 1547910 - DNA, 14 bp, Homo sapiens
tgacctaccccagc

SEQ ID NO: 1547911 - DNA, 15 bp, Homo sapiens
tgacctaccccagcc

SEQ ID NO: 1547912 - DNA, 18 bp, Homo sapiens
tgacctaccccagccagg

SEQ ID NO: 1547913 - DNA, 19 bp, Homo sapiens
tgacctaccccagccaggc

SEQ ID NO: 1547914 - DNA, 20 bp, Homo sapiens
tgacctaccccagccaggct

SEQ ID NO: 1547915 - DNA, 21 bp, Homo sapiens
tgacctaccccagccaggctc

SEQ ID NO: 1547916 - DNA, 19 bp, Homo sapiens
tgacctacctcaaagggca

SEQ ID NO: 1547917 - DNA, 23 bp, Homo sapiens
tgacctagctctttgggcctctc

SEQ ID NO: 1547918 - DNA, 20 bp, Homo sapiens
tgacctattcaccctccact

SEQ ID NO: 1547919 - DNA, 15 bp, Homo sapiens
tgacctcacagtgac

SEQ ID NO: 1547920 - DNA, 18 bp, Homo sapiens
tgacctcacctaggaagt

SEQ ID NO: 1547921 - DNA, 18 bp, Homo sapiens
tgacctcacctggtcctc

SEQ ID NO: 1547922 - DNA, 16 bp, Homo sapiens
tgacctcactgtcctg

SEQ ID NO: 1547923 - DNA, 14 bp, Homo sapiens
tgacctcactgtga

SEQ ID NO: 1547924 - DNA, 13 bp, Homo sapiens
tgacctcagctgc

SEQ ID NO: 1547925 - DNA, 14 bp, Homo sapiens
tgacctcagctgca

SEQ ID NO: 1547926 - DNA, 19 bp, Homo sapiens
tgacctcaggtgatccgcc

SEQ ID NO: 1547927 - DNA, 20 bp, Homo sapiens
tgacctcaggtgatccgcct

SEQ ID NO: 1547928 - DNA, 18 bp, Homo sapiens
tgacctccatactgggct

SEQ ID NO: 1547929 - DNA, 22 bp, Homo sapiens
tgacctccctctaatttatctt

SEQ ID NO: 1547930 - DNA, 18 bp, Homo sapiens
tgacctcgtgatctgccc

SEQ ID NO: 1547931 - DNA, 15 bp, Homo sapiens
tgacctctataaact

SEQ ID NO: 1547932 - DNA, 17 bp, Homo sapiens
tgacctctgttgtcctc

SEQ ID NO: 1547933 - DNA, 21 bp, Homo sapiens
tgacctctgttgtcctcccct

SEQ ID NO: 1547934 - DNA, 20 bp, Homo sapiens
tgacctgccccgcccagctg

SEQ ID NO: 1547935 - DNA, 15 bp, Homo sapiens
tgacctgcctctcac

SEQ ID NO: 1547936 - DNA, 21 bp, Homo sapiens
tgacctgcctctcacacacat

SEQ ID NO: 1547937 - DNA, 18 bp, Homo sapiens
tgacctgggtatcccctg

SEQ ID NO: 1547938 - DNA, 19 bp, Homo sapiens
tgacctgggtatcccctgc

SEQ ID NO: 1547939 - DNA, 21 bp, Homo sapiens
tgacctgggtatcccctgcct

SEQ ID NO: 1547940 - DNA, 15 bp, Homo sapiens
tgacctgtgaccagc

SEQ ID NO: 1547941 - DNA, 18 bp, Homo sapiens
tgacctgtgaccagcact

SEQ ID NO: 1547942 - DNA, 17 bp, Homo sapiens
tgacctgtggtaagcaa

SEQ ID NO: 1547943 - DNA, 15 bp, Homo sapiens
tgacctgtttctctg

SEQ ID NO: 1547944 - DNA, 15 bp, Homo sapiens
tgaccttagcgttct

SEQ ID NO: 1547945 - DNA, 19 bp, Homo sapiens
tgaccttggagagacacag

SEQ ID NO: 1547946 - DNA, 20 bp, Homo sapiens
tgaccttggagagacacagc

SEQ ID NO: 1547947 - DNA, 19 bp, Homo sapiens
tgacgaactggctacagta

SEQ ID NO: 1547948 - DNA, 20 bp, Homo sapiens
tgacgacaagtgctgaacag

SEQ ID NO: 1547949 - DNA, 14 bp, Homo sapiens
tgacgatgatgtac

SEQ ID NO: 1547950 - DNA, 21 bp, Homo sapiens
tgacgatgatgtacagattct

SEQ ID NO: 1547951 - DNA, 14 bp, Homo sapiens
tgacgcagccggag

SEQ ID NO: 1547952 - DNA, 12 bp, Homo sapiens
tgacgcccagct

SEQ ID NO: 1547953 - DNA, 14 bp, Homo sapiens
tgacggaagaacat

SEQ ID NO: 1547954 - DNA, 22 bp, Homo sapiens
tgacggtgttaattttgctaac

SEQ ID NO: 1547955 - DNA, 18 bp, Homo sapiens
tgacgtagaaagatcctt

SEQ ID NO: 1547956 - DNA, 19 bp, Homo sapiens
tgacgtcaagtctccttcc

SEQ ID NO: 1547957 - DNA, 23 bp, Homo sapiens
tgacgtcggccgaccaggctgga

SEQ ID NO: 1547958 - DNA, 17 bp, Homo sapiens
tgacgtgaccggacttt

SEQ ID NO: 1547959 - DNA, 18 bp, Homo sapiens
tgacgtgcacctgtactc

SEQ ID NO: 1547960 - DNA, 23 bp, Homo sapiens
tgacgtgcacctgtactcaggag

SEQ ID NO: 1547961 - DNA, 14 bp, Homo sapiens
tgacgtgcactgtg

SEQ ID NO: 1547962 - DNA, 14 bp, Homo sapiens
tgacgtgtgtggct

SEQ ID NO: 1547963 - DNA, 18 bp, Homo sapiens
tgacgtttcttctttcta

SEQ ID NO: 1547964 - DNA, 22 bp, Homo sapiens
tgactaaaaaacaaagaagaca

SEQ ID NO: 1547965 - DNA, 14 bp, Homo sapiens
tgactaaaatattt

SEQ ID NO: 1547966 - DNA, 21 bp, Homo sapiens
tgactaaactttttttctgta

SEQ ID NO: 1547967 - DNA, 17 bp, Homo sapiens
tgactaaagagagaatg

SEQ ID NO: 1547968 - DNA, 20 bp, Homo sapiens
tgactaactagacaccaaag

SEQ ID NO: 1547969 - DNA, 23 bp, Homo sapiens
tgactaactagacaccaaagttc

SEQ ID NO: 1547970 - DNA, 22 bp, Homo sapiens
tgactaactcaaatacacattt

SEQ ID NO: 1547971 - DNA, 14 bp, Homo sapiens
tgactaatgctttt

SEQ ID NO: 1547972 - DNA, 11 bp, Homo sapiens
tgactaattag

SEQ ID NO: 1547973 - DNA, 18 bp, Homo sapiens
tgactaattttacatgtt

SEQ ID NO: 1547974 - DNA, 19 bp, Homo sapiens
tgactagggattcaggctg

SEQ ID NO: 1547975 - DNA, 15 bp, Homo sapiens
tgactagtttaaaga

SEQ ID NO: 1547976 - DNA, 15 bp, Homo sapiens
tgactataaagctgt

SEQ ID NO: 1547977 - DNA, 22 bp, Homo sapiens
tgactatgccgtcttctgccct

SEQ ID NO: 1547978 - DNA, 13 bp, Homo sapiens
tgactattctgta

SEQ ID NO: 1547979 - DNA, 19 bp, Homo sapiens
tgactattcttgatgtaaa

SEQ ID NO: 1547980 - DNA, 12 bp, Homo sapiens
tgactcaagaag

SEQ ID NO: 1547981 - DNA, 15 bp, Homo sapiens
tgactcaagaagtga

SEQ ID NO: 1547982 - DNA, 22 bp, Homo sapiens
tgactcaagaagtgaagaatgc

SEQ ID NO: 1547983 - DNA, 16 bp, Homo sapiens
tgactcaattatttgc

SEQ ID NO: 1547984 - DNA, 18 bp, Homo sapiens
tgactcaattatttgcat

SEQ ID NO: 1547985 - DNA, 14 bp, Homo sapiens
tgactcacacctga

SEQ ID NO: 1547986 - DNA, 16 bp, Homo sapiens
tgactcatggcagctg

SEQ ID NO: 1547987 - DNA, 14 bp, Homo sapiens
tgactccagagtct

SEQ ID NO: 1547988 - DNA, 19 bp, Homo sapiens
tgactccagagtctgagcc

SEQ ID NO: 1547989 - DNA, 20 bp, Homo sapiens
tgactccagagtctgagccc

SEQ ID NO: 1547990 - DNA, 13 bp, Homo sapiens
tgactcctgctgg

SEQ ID NO: 1547991 - DNA, 15 bp, Homo sapiens
tgactcctgctggta

SEQ ID NO: 1547992 - DNA, 21 bp, Homo sapiens
tgactcctgctggtacctgcc

SEQ ID NO: 1547993 - DNA, 13 bp, Homo sapiens
tgaacgtgcttct

SEQ ID NO: 1547994 - DNA, 15 bp, Homo sapiens
tgaacgtgcttcttt

SEQ ID NO: 1547995 - DNA, 18 bp, Homo sapiens
tgaacgttttcttctttc

SEQ ID NO: 1547996 - DNA, 20 bp, Homo sapiens
tgaacgttttcttctttccc

SEQ ID NO: 1547997 - DNA, 17 bp, Homo sapiens
tgaactaggctgagcaa

SEQ ID NO: 1547998 - DNA, 14 bp, Homo sapiens
tgaactcaaactga

SEQ ID NO: 1547999 - DNA, 17 bp, Homo sapiens
tgaactcaactttgaca

SEQ ID NO: 1548000 - DNA, 20 bp, Homo sapiens
tgaactcaatctccagggct

SEQ ID NO: 1548001 - DNA, 19 bp, Homo sapiens
tgaactcaccctgggagcc

SEQ ID NO: 1548002 - DNA, 23 bp, Homo sapiens
tgaactcagtagctgaacctgtc

SEQ ID NO: 1548003 - DNA, 14 bp, Homo sapiens
tgaactcattctct

SEQ ID NO: 1548004 - DNA, 20 bp, Homo sapiens
tgaactcattctcttcttgc

SEQ ID NO: 1548005 - DNA, 21 bp, Homo sapiens
tgaactccaccgaccaactgc

SEQ ID NO: 1548006 - DNA, 22 bp, Homo sapiens
tgaactccaccgaccaactgcc

SEQ ID NO: 1548007 - DNA, 14 bp, Homo sapiens
tgaactccatacag

SEQ ID NO: 1548008 - DNA, 18 bp, Homo sapiens
tgaactccatacagcctc

SEQ ID NO: 1548009 - DNA, 19 bp, Homo sapiens
tgaactccatacagcctct

SEQ ID NO: 1548010 - DNA, 20 bp, Homo sapiens
tgaactccatacagcctcta

SEQ ID NO: 1548011 - DNA, 14 bp, Homo sapiens
tgaactctgagaga

SEQ ID NO: 1548012 - DNA, 17 bp, Homo sapiens
tgaactctgttccccca

SEQ ID NO: 1548013 - DNA, 21 bp, Homo sapiens
tgaactcttaatcaaatagca

SEQ ID NO: 1548014 - DNA, 18 bp, Homo sapiens
tgaactcttcaatctctt

SEQ ID NO: 1548015 - DNA, 14 bp, Homo sapiens
tgaactcttcagaa

SEQ ID NO: 1548016 - DNA, 19 bp, Homo sapiens
tgaactcttctgcaaaaat

SEQ ID NO: 1548017 - DNA, 20 bp, Homo sapiens
tgaactctttctggcctgcc

SEQ ID NO: 1548018 - DNA, 14 bp, Homo sapiens
tgaactgacaatga

SEQ ID NO: 1548019 - DNA, 20 bp, Homo sapiens
tgaactgacaatgaagggaa

SEQ ID NO: 1548020 - DNA, 22 bp, Homo sapiens
tgaactgaggccttgtgtgtca

SEQ ID NO: 1548021 - DNA, 16 bp, Homo sapiens
tgaactgcaaagcttt

SEQ ID NO: 1548022 - DNA, 18 bp, Homo sapiens
tgaactgcaacaacgcct

SEQ ID NO: 1548023 - DNA, 23 bp, Homo sapiens
tgaactgcctcaggaccccactg

SEQ ID NO: 1548024 - DNA, 16 bp, Homo sapiens
tgaactgcttttcctc

SEQ ID NO: 1548025 - DNA, 12 bp, Homo sapiens
tgaactgtacta

SEQ ID NO: 1548026 - DNA, 13 bp, Homo sapiens
tgaactgttagaa

SEQ ID NO: 1548027 - DNA, 14 bp, Homo sapiens
tgaactgttagaat

SEQ ID NO: 1548028 - DNA, 16 bp, Homo sapiens
tgaactgttagaatgt

SEQ ID NO: 1548029 - DNA, 23 bp, Homo sapiens
tgaacttaataactgtgtactgt

SEQ ID NO: 1548030 - DNA, 19 bp, Homo sapiens
tgaacttagaactatgcta

SEQ ID NO: 1548031 - DNA, 16 bp, Homo sapiens
tgaacttattctgtag

SEQ ID NO: 1548032 - DNA, 19 bp, Homo sapiens
tgaacttgattgcctatgg

SEQ ID NO: 1548033 - DNA, 12 bp, Homo sapiens
tgaacttttgta

SEQ ID NO: 1548034 - DNA, 13 bp, Homo sapiens
tgaacttttgtac

SEQ ID NO: 1548035 - DNA, 16 bp, Homo sapiens
tgaacttttgtactga

SEQ ID NO: 1548036 - DNA, 18 bp, Homo sapiens
tgaacttttgtactgaat

SEQ ID NO: 1548037 - DNA, 21 bp, Homo sapiens
tgaagaaaatcacttaggaaa

SEQ ID NO: 1548038 - DNA, 21 bp, Homo sapiens
tgaagaaacagagtggcctcc

SEQ ID NO: 1548039 - DNA, 13 bp, Homo sapiens
tgaagaaagtcaa

SEQ ID NO: 1548040 - DNA, 17 bp, Homo sapiens
tgaagaacacagcatgt

SEQ ID NO: 1548041 - DNA, 19 bp, Homo sapiens
tgaagaacacagcatgtgc

SEQ ID NO: 1548042 - DNA, 21 bp, Homo sapiens
tgaagaacacagcatgtgcca

SEQ ID NO: 1548043 - DNA, 22 bp, Homo sapiens
tgaagaacacagcatgtgccaa

SEQ ID NO: 1548044 - DNA, 13 bp, Homo sapiens
tgaagaacagtaa

SEQ ID NO: 1548045 - DNA, 21 bp, Homo sapiens
tgaagaaccctatttaaaact

SEQ ID NO: 1548046 - DNA, 20 bp, Homo sapiens
tgaagaaccctgcagggccc

SEQ ID NO: 1548047 - DNA, 19 bp, Homo sapiens
tgaagaactattttattct

SEQ ID NO: 1548048 - DNA, 13 bp, Homo sapiens
tgaagaactgagg

SEQ ID NO: 1548049 - DNA, 19 bp, Homo sapiens
tgaagaactgaggaggaaa

SEQ ID NO: 1548050 - DNA, 15 bp, Homo sapiens
tgaagaactgcaggc

SEQ ID NO: 1548051 - DNA, 19 bp, Homo sapiens
tgaacacagtgtctgttca

SEQ ID NO: 1548052 - DNA, 19 bp, Homo sapiens
tgaacacatgtgtatgata

SEQ ID NO: 1548053 - DNA, 17 bp, Homo sapiens
tgaacaccattgaaggc

SEQ ID NO: 1548054 - DNA, 20 bp, Homo sapiens
tgaacaccattgaaggctta

SEQ ID NO: 1548055 - DNA, 12 bp, Homo sapiens
tgaacactgtga

SEQ ID NO: 1548056 - DNA, 14 bp, Homo sapiens
tgaacactgtgacc

SEQ ID NO: 1548057 - DNA, 13 bp, Homo sapiens
tgaacacttataa

SEQ ID NO: 1548058 - DNA, 14 bp, Homo sapiens
tgaacagaaatatt

SEQ ID NO: 1548059 - DNA, 13 bp, Homo sapiens
tgaacagctgtgt

SEQ ID NO: 1548060 - DNA, 17 bp, Homo sapiens
tgaacagctgtgtctgc

SEQ ID NO: 1548061 - DNA, 20 bp, Homo sapiens
tgaacagctgtgtctgccaa

SEQ ID NO: 1548062 - DNA, 12 bp, Homo sapiens
tgaacagtggag

SEQ ID NO: 1548063 - DNA, 15 bp, Homo sapiens
tgaacatattcatga

SEQ ID NO: 1548064 - DNA, 16 bp, Homo sapiens
tgaacatattcatgaa

SEQ ID NO: 1548065 - DNA, 16 bp, Homo sapiens
tgaacatccaagtctt

SEQ ID NO: 1548066 - DNA, 18 bp, Homo sapiens
tgaacatgtttaatgggt

SEQ ID NO: 1548067 - DNA, 14 bp, Homo sapiens
tgaacatgtttaca

SEQ ID NO: 1548068 - DNA, 17 bp, Homo sapiens
tgaacattagttgcact

SEQ ID NO: 1548069 - DNA, 22 bp, Homo sapiens
tgaacattagttgcactaactg

SEQ ID NO: 1548070 - DNA, 19 bp, Homo sapiens
tgaacattctcctgtggaa

SEQ ID NO: 1548071 - DNA, 18 bp, Homo sapiens
tgaaccaaaaatagaaat

SEQ ID NO: 1548072 - DNA, 15 bp, Homo sapiens
tgaaccaacatcttt

SEQ ID NO: 1548073 - DNA, 19 bp, Homo sapiens
tgaaccaacccccatctcc

SEQ ID NO: 1548074 - DNA, 15 bp, Homo sapiens
tgaaccactgcttct

SEQ ID NO: 1548075 - DNA, 19 bp, Homo sapiens
tgaaccactgcttctcttt

SEQ ID NO: 1548076 - DNA, 20 bp, Homo sapiens
tgaaccactgcttctctttt

SEQ ID NO: 1548077 - DNA, 23 bp, Homo sapiens
tgaaccactgcttctcttttgaa

SEQ ID NO: 1548078 - DNA, 16 bp, Homo sapiens
tgaaccataaattcaa

SEQ ID NO: 1548079 - DNA, 21 bp, Homo sapiens
tgaaccataaattcaactttg

SEQ ID NO: 1548080 - DNA, 21 bp, Homo sapiens
tgaaccatttgggatggagaa

SEQ ID NO: 1548081 - DNA, 13 bp, Homo sapiens
tgaaccccagagg

SEQ ID NO: 1548082 - DNA, 17 bp, Homo sapiens
tgaaccccagaggcaga

SEQ ID NO: 1548083 - DNA, 13 bp, Homo sapiens
tgaaccccatggg

SEQ ID NO: 1548084 - DNA, 22 bp, Homo sapiens
tgaaccccctttccccacacct

SEQ ID NO: 1548085 - DNA, 15 bp, Homo sapiens
tgaacccctggccag

SEQ ID NO: 1548086 - DNA, 20 bp, Homo sapiens
tgaacccctggccagctctg

SEQ ID NO: 1548087 - DNA, 14 bp, Homo sapiens
tgaacccctgtgtc

SEQ ID NO: 1548088 - DNA, 16 bp, Homo sapiens
tgaacccgggggacag

SEQ ID NO: 1548089 - DNA, 13 bp, Homo sapiens
tgaaccctccagg

SEQ ID NO: 1548090 - DNA, 15 bp, Homo sapiens
tgaaccctggggcct

SEQ ID NO: 1548091 - DNA, 19 bp, Homo sapiens
tgaaccctgtgctggtgtc

SEQ ID NO: 1548092 - DNA, 16 bp, Homo sapiens
tgaacccttgtgcttg

SEQ ID NO: 1548093 - DNA, 17 bp, Homo sapiens
tgaacccttgtgcttgg

SEQ ID NO: 1548094 - DNA, 14 bp, Homo sapiens
tgaaccgcacagct

SEQ ID NO: 1548095 - DNA, 14 bp, Homo sapiens
tgaacctatccttc

SEQ ID NO: 1548096 - DNA, 15 bp, Homo sapiens
tgaacctattttcat

SEQ ID NO: 1548097 - DNA, 16 bp, Homo sapiens
tgaacctattttcatt

SEQ ID NO: 1548098 - DNA, 14 bp, Homo sapiens
tgaacctggaaatg

SEQ ID NO: 1548099 - DNA, 19 bp, Homo sapiens
tgaacctttaaagtaaagg

SEQ ID NO: 1548100 - DNA, 16 bp, Homo sapiens
tgaacgagcagcccag

SEQ ID NO: 1548101 - DNA, 17 bp, Homo sapiens
tgaacgagcagcccagg

SEQ ID NO: 1548102 - DNA, 18 bp, Homo sapiens
tgaacgagcagcccaggg

SEQ ID NO: 1548103 - DNA, 22 bp, Homo sapiens
tgaagcacttaagtcttcctta

SEQ ID NO: 1548104 - DNA, 13 bp, Homo sapiens
tgaagcagcactg

SEQ ID NO: 1548105 - DNA, 17 bp, Homo sapiens
tgaagcagcactgtgag

SEQ ID NO: 1548106 - DNA, 15 bp, Homo sapiens
tgaagcagcctctcc

SEQ ID NO: 1548107 - DNA, 20 bp, Homo sapiens
tgaagcagcctctccccagg

SEQ ID NO: 1548108 - DNA, 12 bp, Homo sapiens
tgaagcaggagg

SEQ ID NO: 1548109 - DNA, 15 bp, Homo sapiens
tgaagcaggaggccc

SEQ ID NO: 1548110 - DNA, 13 bp, Homo sapiens
tgaagcagtgcct

SEQ ID NO: 1548111 - DNA, 21 bp, Homo sapiens
tgaagcagtgcctcgaggcac

SEQ ID NO: 1548112 - DNA, 22 bp, Homo sapiens
tgaagcatttcaaagccctgcc

SEQ ID NO: 1548113 - DNA, 23 bp, Homo sapiens
tgaagccaagtggggtgctggga

SEQ ID NO: 1548114 - DNA, 19 bp, Homo sapiens
tgaagcccaataaacctct

SEQ ID NO: 1548115 - DNA, 17 bp, Homo sapiens
tgaagccgactctggcc

SEQ ID NO: 1548116 - DNA, 18 bp, Homo sapiens
tgaagccggacagctgcc

SEQ ID NO: 1548117 - DNA, 21 bp, Homo sapiens
tgaagccggacagctgcccag

SEQ ID NO: 1548118 - DNA, 21 bp, Homo sapiens
tgaagcctccacaccagctgc

SEQ ID NO: 1548119 - DNA, 15 bp, Homo sapiens
tgaagcctctctcct

SEQ ID NO: 1548120 - DNA, 20 bp, Homo sapiens
tgaagcctggattccagcag

SEQ ID NO: 1548121 - DNA, 22 bp, Homo sapiens
tgaagcctggattccagcagtg

SEQ ID NO: 1548122 - DNA, 14 bp, Homo sapiens
tgaagccttttgtt

SEQ ID NO: 1548123 - DNA, 21 bp, Homo sapiens
tgaagctaataaaattcgctt

SEQ ID NO: 1548124 - DNA, 20 bp, Homo sapiens
tgaagctgaaccccctccag

SEQ ID NO: 1548125 - DNA, 20 bp, Homo sapiens
tgaagctgctgcagccctgc

SEQ ID NO: 1548126 - DNA, 16 bp, Homo sapiens
tgaagctggagcagcg

SEQ ID NO: 1548127 - DNA, 15 bp, Homo sapiens
tgaagctgttgtgtg

SEQ ID NO: 1548128 - DNA, 16 bp, Homo sapiens
tgaagctgttgtgtga

SEQ ID NO: 1548129 - DNA, 14 bp, Homo sapiens
tgaagcttgactcc

SEQ ID NO: 1548130 - DNA, 18 bp, Homo sapiens
tgaagcttgactcccaag

SEQ ID NO: 1548131 - DNA, 21 bp, Homo sapiens
tgaaggaaaaacacaagcaaa

SEQ ID NO: 1548132 - DNA, 23 bp, Homo sapiens
tgaaggaaaaacacaagcaaaaa

SEQ ID NO: 1548133 - DNA, 12 bp, Homo sapiens
tgaaggaaaatt

SEQ ID NO: 1548134 - DNA, 15 bp, Homo sapiens
tgaaggaaaattaaa

SEQ ID NO: 1548135 - DNA, 14 bp, Homo sapiens
tgaaggaaacagtt

SEQ ID NO: 1548136 - DNA, 19 bp, Homo sapiens
tgaaggaacattccttagt

SEQ ID NO: 1548137 - DNA, 13 bp, Homo sapiens
tgaaggaagaggg

SEQ ID NO: 1548138 - DNA, 20 bp, Homo sapiens
tgaaggaatagccagagagg

SEQ ID NO: 1548139 - DNA, 12 bp, Homo sapiens
tgaaggaccctt

SEQ ID NO: 1548140 - DNA, 17 bp, Homo sapiens
tgaaggactgcagacag

SEQ ID NO: 1548141 - DNA, 14 bp, Homo sapiens
tgaaggccctgctg

SEQ ID NO: 1548142 - DNA, 20 bp, Homo sapiens
tgaaggcttttggtctccct

SEQ ID NO: 1548143 - DNA, 19 bp, Homo sapiens
tgaagggaactagaggtgt

SEQ ID NO: 1548144 - DNA, 14 bp, Homo sapiens
tgaagggaagtggg

SEQ ID NO: 1548145 - DNA, 15 bp, Homo sapiens
tgaagggaagtgggg

SEQ ID NO: 1548146 - DNA, 18 bp, Homo sapiens
tgaagggaagtggggagt

SEQ ID NO: 1548147 - DNA, 14 bp, Homo sapiens
tgaagggacagctg

SEQ ID NO: 1548148 - DNA, 20 bp, Homo sapiens
tgaagggacagctgctggga

SEQ ID NO: 1548149 - DNA, 17 bp, Homo sapiens
tgaagggagagccagct

SEQ ID NO: 1548150 - DNA, 15 bp, Homo sapiens
tgaagggcaagaaat

SEQ ID NO: 1548151 - DNA, 19 bp, Homo sapiens
tgaagggcaagaaatggcg

SEQ ID NO: 1548152 - DNA, 12 bp, Homo sapiens
tgaagggccaga

SEQ ID NO: 1548153 - DNA, 19 bp, Homo sapiens
tgaagggccagagccaggg

SEQ ID NO: 1548154 - DNA, 19 bp, Homo sapiens
tgaaggggcacaccactgc

SEQ ID NO: 1548155 - DNA, 18 bp, Homo sapiens
tgaaggtaaataaaaaga

SEQ ID NO: 1548156 - DNA, 20 bp, Homo sapiens
tgaaggtaaataaaaagaaa

SEQ ID NO: 1548157 - DNA, 20 bp, Homo sapiens
tgaaggtattttgtagatgt

SEQ ID NO: 1548158 - DNA, 16 bp, Homo sapiens
tgaaggtcccctggca

SEQ ID NO: 1548159 - DNA, 21 bp, Homo sapiens
tgaaggtctcctaaaactggg

SEQ ID NO: 1548160 - DNA, 18 bp, Homo sapiens
tgaaggtgataagggaaa

SEQ ID NO: 1548161 - DNA, 19 bp, Homo sapiens
tgaaggtgctgacggccag

SEQ ID NO: 1548162 - DNA, 15 bp, Homo sapiens
tgaaggttaggattt

SEQ ID NO: 1548163 - DNA, 20 bp, Homo sapiens
tgaaggttaggatttaacag

SEQ ID NO: 1548164 - DNA, 20 bp, Homo sapiens
tgaaggttgtatgtaaatct

SEQ ID NO: 1548165 - DNA, 17 bp, Homo sapiens
tgaaggtttttgtaaag

SEQ ID NO: 1548166 - DNA, 21 bp, Homo sapiens
tgaagtaaattaaacattttt

SEQ ID NO: 1548167 - DNA, 15 bp, Homo sapiens
tgaagtaaattatgt

SEQ ID NO: 1548168 - DNA, 18 bp, Homo sapiens
tgaagtaacccctcctgg

SEQ ID NO: 1548169 - DNA, 20 bp, Homo sapiens
tgaagtaatgaatttttatg

SEQ ID NO: 1548170 - DNA, 23 bp, Homo sapiens
tgaagtagcaataggctgtaatc

SEQ ID NO: 1548171 - DNA, 23 bp, Homo sapiens
tgaagtagcctgatctttctaga

SEQ ID NO: 1548172 - DNA, 22 bp, Homo sapiens
tgaagtatataatggtttcaaa

SEQ ID NO: 1548173 - DNA, 17 bp, Homo sapiens
tgaagtatttctcactc

SEQ ID NO: 1548174 - DNA, 19 bp, Homo sapiens
tgaagtcaccgggatgaac

SEQ ID NO: 1548175 - DNA, 21 bp, Homo sapiens
tgaagtcactgcacagtgcat

SEQ ID NO: 1548176 - DNA, 14 bp, Homo sapiens
tgaagtccaggact

SEQ ID NO: 1548177 - DNA, 16 bp, Homo sapiens
tgaagtctcttccctt

SEQ ID NO: 1548178 - DNA, 17 bp, Homo sapiens
tgaagtcttttctgtca

SEQ ID NO: 1548179 - DNA, 16 bp, Homo sapiens
tgaagtgaaaaagttt

SEQ ID NO: 1548180 - DNA, 18 bp, Homo sapiens
tgaagtgagcacagccta

SEQ ID NO: 1548181 - DNA, 19 bp, Homo sapiens
tgaagtgatctaaaatttg

SEQ ID NO: 1548182 - DNA, 19 bp, Homo sapiens
tgaagtgcacaggagccaa

SEQ ID NO: 1548183 - DNA, 20 bp, Homo sapiens
tgaagtgtataatataaaaa

SEQ ID NO: 1548184 - DNA, 17 bp, Homo sapiens
tgaagtgtatatgattc

SEQ ID NO: 1548185 - DNA, 21 bp, Homo sapiens
tgaagtgttctctagaatcca

SEQ ID NO: 1548186 - DNA, 21 bp, Homo sapiens
tgaagttagtggaaatctgaa

SEQ ID NO: 1548187 - DNA, 15 bp, Homo sapiens
tgaagttgctgttta

SEQ ID NO: 1548188 - DNA, 16 bp, Homo sapiens
tgaagttgctgtttat

SEQ ID NO: 1548189 - DNA, 21 bp, Homo sapiens
tgaagttgctgtttatttttt

SEQ ID NO: 1548190 - DNA, 23 bp, Homo sapiens
tgaagttggtttagctttggaaa

SEQ ID NO: 1548191 - DNA, 19 bp, Homo sapiens
tgaagtttaattgtctcaa

SEQ ID NO: 1548192 - DNA, 17 bp, Homo sapiens
tgaagtttacaatcaaa

SEQ ID NO: 1548193 - DNA, 14 bp, Homo sapiens
tgaagtttacattg

SEQ ID NO: 1548194 - DNA, 23 bp, Homo sapiens
tgaagtttcaagttttaaagttc

SEQ ID NO: 1548195 - DNA, 18 bp, Homo sapiens
tgaagtttccgcccccgc

SEQ ID NO: 1548196 - DNA, 14 bp, Homo sapiens
tgaataaaaaccct

SEQ ID NO: 1548197 - DNA, 23 bp, Homo sapiens
tgaataaaacaataaatgaatga

SEQ ID NO: 1548198 - DNA, 12 bp, Homo sapiens
tgaataaaacct

SEQ ID NO: 1548199 - DNA, 21 bp, Homo sapiens
tgaataaagcctttgtatctt

SEQ ID NO: 1548200 - DNA, 22 bp, Homo sapiens
tgaataatcatgtgaaatgttt

SEQ ID NO: 1548201 - DNA, 18 bp, Homo sapiens
tgaataatgctaccagga

SEQ ID NO: 1548202 - DNA, 19 bp, Homo sapiens
tgaataatggaaaatgcca

SEQ ID NO: 1548203 - DNA, 17 bp, Homo sapiens
tgaataattacagtgcc

SEQ ID NO: 1548204 - DNA, 23 bp, Homo sapiens
tgaatacattaacggtgctaaaa

SEQ ID NO: 1548205 - DNA, 19 bp, Homo sapiens
tgaatacatttgtatttat

SEQ ID NO: 1548206 - DNA, 21 bp, Homo sapiens
tgaataccattaaaactgctt

SEQ ID NO: 1548207 - DNA, 23 bp, Homo sapiens
tgaataccattaaaactgctttt

SEQ ID NO: 1548208 - DNA, 20 bp, Homo sapiens
tgaatacttactataatttg

SEQ ID NO: 1548209 - DNA, 23 bp, Homo sapiens
tgaatacttactataatttgact

SEQ ID NO: 1548210 - DNA, 18 bp, Homo sapiens
tgaatagatatgaaagct

SEQ ID NO: 1548211 - DNA, 21 bp, Homo sapiens
tgaatagatggaatttggaac

SEQ ID NO: 1548212 - DNA, 21 bp, Homo sapiens
tgaatagttgcttaattttga

SEQ ID NO: 1548213 - DNA, 12 bp, Homo sapiens
tgaatataaaaa

SEQ ID NO: 1548214 - DNA, 13 bp, Homo sapiens
tgaatataaaaaa

SEQ ID NO: 1548215 - DNA, 21 bp, Homo sapiens
tgaatatacagcaggtgctca

SEQ ID NO: 1548216 - DNA, 18 bp, Homo sapiens
tgaatatattataatctt

SEQ ID NO: 1548217 - DNA, 17 bp, Homo sapiens
tgaatatcagtcactgt

SEQ ID NO: 1548218 - DNA, 18 bp, Homo sapiens
tgaattttccaagaacat

SEQ ID NO: 1548219 - DNA, 17 bp, Homo sapiens
tgaattttctaaaagct

SEQ ID NO: 1548220 - DNA, 16 bp, Homo sapiens
tgaattttctgcagct

SEQ ID NO: 1548221 - DNA, 23 bp, Homo sapiens
tgaattttctgcagctgtttcaa

SEQ ID NO: 1548222 - DNA, 16 bp, Homo sapiens
tgaattttgagtctat

SEQ ID NO: 1548223 - DNA, 15 bp, Homo sapiens
tgaattttgcaatgt

SEQ ID NO: 1548224 - DNA, 19 bp, Homo sapiens
tgaattttgttctctggga

SEQ ID NO: 1548225 - DNA, 14 bp, Homo sapiens
tgaatttttattgt

SEQ ID NO: 1548226 - DNA, 16 bp, Homo sapiens
tgaatttttattgttg

SEQ ID NO: 1548227 - DNA, 13 bp, Homo sapiens
tgaatttttctct

SEQ ID NO: 1548228 - DNA, 23 bp, Homo sapiens
tgaatttttttcatcttctctgg

SEQ ID NO: 1548229 - DNA, 21 bp, Homo sapiens
tgaatttttttcgctatggga

SEQ ID NO: 1548230 - DNA, 23 bp, Homo sapiens
tgaatttttttcgctatgggagg

SEQ ID NO: 1548231 - DNA, 16 bp, Homo sapiens
tgaatttttttgtaat

SEQ ID NO: 1548232 - DNA, 15 bp, Homo sapiens
tgaattttttttaac

SEQ ID NO: 1548233 - DNA, 18 bp, Homo sapiens
tgaattttttttaacatt

SEQ ID NO: 1548234 - DNA, 22 bp, Homo sapiens
tgaattttttttaacattcctc

SEQ ID NO: 1548235 - DNA, 16 bp, Homo sapiens
tgaatttttttttcct

SEQ ID NO: 1548236 - DNA, 20 bp, Homo sapiens
tgaatttttttttcctagcc

SEQ ID NO: 1548237 - DNA, 13 bp, Homo sapiens
tgacaaaaatatt

SEQ ID NO: 1548238 - DNA, 16 bp, Homo sapiens
tgacaaaacctaactt

SEQ ID NO: 1548239 - DNA, 17 bp, Homo sapiens
tgacaaaactaaccttg

SEQ ID NO: 1548240 - DNA, 19 bp, Homo sapiens
tgacaaaactaaccttgaa

SEQ ID NO: 1548241 - DNA, 22 bp, Homo sapiens
tgacaaaatggggcagaagaga

SEQ ID NO: 1548242 - DNA, 17 bp, Homo sapiens
tgacaaaccatttccaa

SEQ ID NO: 1548243 - DNA, 21 bp, Homo sapiens
tgacaaacccggaagatcaga

SEQ ID NO: 1548244 - DNA, 19 bp, Homo sapiens
tgacaaacgtccccagcgg

SEQ ID NO: 1548245 - DNA, 19 bp, Homo sapiens
tgacaaagaaacccaagtg

SEQ ID NO: 1548246 - DNA, 18 bp, Homo sapiens
tgacaaaggatgaagaac

SEQ ID NO: 1548247 - DNA, 19 bp, Homo sapiens
tgacaaaggtggtaaattc

SEQ ID NO: 1548248 - DNA, 13 bp, Homo sapiens
tgacaaagtgcct

SEQ ID NO: 1548249 - DNA, 14 bp, Homo sapiens
tgacaaagttactg

SEQ ID NO: 1548250 - DNA, 23 bp, Homo sapiens
tgacaaatgtgtatcggatgctt

SEQ ID NO: 1548251 - DNA, 15 bp, Homo sapiens
tgacaaatgtttcta

SEQ ID NO: 1548252 - DNA, 21 bp, Homo sapiens
tgacaaatgtttctaaggtaa

SEQ ID NO: 1548253 - DNA, 11 bp, Homo sapiens
tgacaacagaa

SEQ ID NO: 1548254 - DNA, 18 bp, Homo sapiens
tgacaacatcccacagtg

SEQ ID NO: 1548255 - DNA, 19 bp, Homo sapiens
tgacaaccattaaagtcag

SEQ ID NO: 1548256 - DNA, 21 bp, Homo sapiens
tgacaacgtttcagcgactcc

SEQ ID NO: 1548257 - DNA, 12 bp, Homo sapiens
tgacaactgtga

SEQ ID NO: 1548258 - DNA, 16 bp, Homo sapiens
tgacaactgtgactgt

SEQ ID NO: 1548259 - DNA, 16 bp, Homo sapiens
tgacaacttagctcag

SEQ ID NO: 1548260 - DNA, 16 bp, Homo sapiens
tgacaagatgggacag

SEQ ID NO: 1548261 - DNA, 18 bp, Homo sapiens
tgacaagatgggacagca

SEQ ID NO: 1548262 - DNA, 21 bp, Homo sapiens
tgacaagatgggacagcaaca

SEQ ID NO: 1548263 - DNA, 23 bp, Homo sapiens
tgacaagatggtccatttgttcc

SEQ ID NO: 1548264 - DNA, 22 bp, Homo sapiens
tgacaagctgacttggcactta

SEQ ID NO: 1548265 - DNA, 11 bp, Homo sapiens
tgacaaggaaa

SEQ ID NO: 1548266 - DNA, 13 bp, Homo sapiens
tgacatgtaacag

SEQ ID NO: 1548267 - DNA, 19 bp, Homo sapiens
tgacatgtggggccaggtc

SEQ ID NO: 1548268 - DNA, 19 bp, Homo sapiens
tgacattaacaaataaaaa

SEQ ID NO: 1548269 - DNA, 13 bp, Homo sapiens
tgacattactgta

SEQ ID NO: 1548270 - DNA, 13 bp, Homo sapiens
tgacattcccctc

SEQ ID NO: 1548271 - DNA, 10 bp, Homo sapiens
tgacattcct

SEQ ID NO: 1548272 - DNA, 18 bp, Homo sapiens
tgacattccttgtcacca

SEQ ID NO: 1548273 - DNA, 20 bp, Homo sapiens
tgacattcggggtgatcctg

SEQ ID NO: 1548274 - DNA, 24 bp, Homo sapiens
tgacattcgtgaaaaccaaccctg

SEQ ID NO: 1548275 - DNA, 21 bp, Homo sapiens
tgacattgaatggatcaatac

SEQ ID NO: 1548276 - DNA, 14 bp, Homo sapiens
tgacatttctttgt

SEQ ID NO: 1548277 - DNA, 13 bp, Homo sapiens
tgacatttgcttt

SEQ ID NO: 1548278 - DNA, 16 bp, Homo sapiens
tgacatttgtttattt

SEQ ID NO: 1548279 - DNA, 16 bp, Homo sapiens
tgaccaaaccagcctt

SEQ ID NO: 1548280 - DNA, 17 bp, Homo sapiens
tgaccaaaccagccttc

SEQ ID NO: 1548281 - DNA, 22 bp, Homo sapiens
tgaccaaaccagccttcggagc

SEQ ID NO: 1548282 - DNA, 21 bp, Homo sapiens
tgaccaaagactgcagaaccc

SEQ ID NO: 1548283 - DNA, 18 bp, Homo sapiens
tgaccaaagtgataaatt

SEQ ID NO: 1548284 - DNA, 19 bp, Homo sapiens
tgaccaaatggccagtttt

SEQ ID NO: 1548285 - DNA, 18 bp, Homo sapiens
tgaccaacatggagaaac

SEQ ID NO: 1548286 - DNA, 23 bp, Homo sapiens
tgaccaacatggagaaaccctgt

SEQ ID NO: 1548287 - DNA, 14 bp, Homo sapiens
tgaccaagaactgc

SEQ ID NO: 1548288 - DNA, 18 bp, Homo sapiens
tgaccaagaactgcatgg

SEQ ID NO: 1548289 - DNA, 22 bp, Homo sapiens
tgaccaaggtaccgatttctgc

SEQ ID NO: 1548290 - DNA, 23 bp, Homo sapiens
tgaccaaggtaccgatttctgct

SEQ ID NO: 1548291 - DNA, 24 bp, Homo sapiens
tgaccaaggtaccgatttctgcta

SEQ ID NO: 1548292 - DNA, 13 bp, Homo sapiens
tgaccaagttata

SEQ ID NO: 1548293 - DNA, 18 bp, Homo sapiens
tgaccaatgatggtcacc

SEQ ID NO: 1548294 - DNA, 17 bp, Homo sapiens
tgaccaattgtgctgcc

SEQ ID NO: 1548295 - DNA, 19 bp, Homo sapiens
tgaccaattgtgctgccat

SEQ ID NO: 1548296 - DNA, 15 bp, Homo sapiens
tgaccacaccaacca

SEQ ID NO: 1548297 - DNA, 20 bp, Homo sapiens
tgaccacaccaaccaggcct

SEQ ID NO: 1548298 - DNA, 22 bp, Homo sapiens
tgaccacaccaaccaggccttc

SEQ ID NO: 1548299 - DNA, 17 bp, Homo sapiens
tgaccacaccttggcct

SEQ ID NO: 1548300 - DNA, 17 bp, Homo sapiens
tgaccacatacgtgtta

SEQ ID NO: 1548301 - DNA, 23 bp, Homo sapiens
tgaccaccaccccaacaaaccat

SEQ ID NO: 1548302 - DNA, 13 bp, Homo sapiens
tgaccaccctccc

SEQ ID NO: 1548303 - DNA, 16 bp, Homo sapiens
tgaccaccctcccctc

SEQ ID NO: 1548304 - DNA, 19 bp, Homo sapiens
tgaccaccctcccctctct

SEQ ID NO: 1548305 - DNA, 21 bp, Homo sapiens
tgaccacggacgtttccatca

SEQ ID NO: 1548306 - DNA, 22 bp, Homo sapiens
tgaccacggacgtttccatcag

SEQ ID NO: 1548307 - DNA, 23 bp, Homo sapiens
tgaccacggacgtttccatcagg

SEQ ID NO: 1548308 - DNA, 18 bp, Homo sapiens
tgaccacttgaggcctga

SEQ ID NO: 1548309 - DNA, 20 bp, Homo sapiens
tgaccacttgaggcctgatc

SEQ ID NO: 1548310 - DNA, 14 bp, Homo sapiens
tgaccagaaatggt

SEQ ID NO: 1548311 - DNA, 18 bp, Homo sapiens
tgaccagatctttctctt

SEQ ID NO: 1548312 - DNA, 19 bp, Homo sapiens
tgaccagcaacttgtcttt

SEQ ID NO: 1548313 - DNA, 11 bp, Homo sapiens
tgaccagccac

SEQ ID NO: 1548314 - DNA, 16 bp, Homo sapiens
tgaccagcggctgctc

SEQ ID NO: 1548315 - DNA, 17 bp, Homo sapiens
tgaccagggatgctggg

SEQ ID NO: 1548316 - DNA, 22 bp, Homo sapiens
tgaccataatcctagccccgag

SEQ ID NO: 1548317 - DNA, 14 bp, Homo sapiens
tgaccatactcaga

SEQ ID NO: 1548318 - DNA, 12 bp, Homo sapiens
tgaccatgctca

SEQ ID NO: 1548319 - DNA, 14 bp, Homo sapiens
tgaccatgtggttc

SEQ ID NO: 1548320 - DNA, 18 bp, Homo sapiens
tgaccatgttcattataa

SEQ ID NO: 1548321 - DNA, 23 bp, Homo sapiens
tgaccatttataatgttagtaga

SEQ ID NO: 1548322 - DNA, 20 bp, Homo sapiens
tgacccaactgatcctgctc

SEQ ID NO: 1548323 - DNA, 16 bp, Homo sapiens
tgacccaactgggggc

SEQ ID NO: 1548324 - DNA, 13 bp, Homo sapiens
tgacccaccagtg

SEQ ID NO: 1548325 - DNA, 15 bp, Homo sapiens
tgacccacccctgtg

SEQ ID NO: 1548326 - DNA, 17 bp, Homo sapiens
tgacccacccctgtgct

SEQ ID NO: 1548327 - DNA, 18 bp, Homo sapiens
tgacccacccctgtgctc

SEQ ID NO: 1548328 - DNA, 13 bp, Homo sapiens
tgacccactaaag

SEQ ID NO: 1548329 - DNA, 16 bp, Homo sapiens
tgacccactaaagagt

SEQ ID NO: 1548330 - DNA, 12 bp, Homo sapiens
tgacccagcatc

SEQ ID NO: 1548331 - DNA, 18 bp, Homo sapiens
tgacccagccccttgaga

SEQ ID NO: 1548332 - DNA, 17 bp, Homo sapiens
tgacccagcctgaaaga

SEQ ID NO: 1548333 - DNA, 12 bp, Homo sapiens
tgacccaggccg

SEQ ID NO: 1548334 - DNA, 22 bp, Homo sapiens
tgacccaggccgcagctcttgc

SEQ ID NO: 1548335 - DNA, 12 bp, Homo sapiens
tgacccagtccc

SEQ ID NO: 1548336 - DNA, 21 bp, Homo sapiens
tgacccagtccccgtgccccg

SEQ ID NO: 1548337 - DNA, 16 bp, Homo sapiens
tgacccagtccctggg

SEQ ID NO: 1548338 - DNA, 23 bp, Homo sapiens
tgggtaagaggagcagagggcag

SEQ ID NO: 1548339 - DNA, 22 bp, Homo sapiens
tgggtaatccaggcacagctga

SEQ ID NO: 1548340 - DNA, 21 bp, Homo sapiens
tgggtacctgcaagcagaact

SEQ ID NO: 1548341 - DNA, 20 bp, Homo sapiens
tgggtagggtgttctggctt

SEQ ID NO: 1548342 - DNA, 17 bp, Homo sapiens
tgggtatgctcaggtca

SEQ ID NO: 1548343 - DNA, 22 bp, Homo sapiens
tgggtatgctcaggtcaactga

SEQ ID NO: 1548344 - DNA, 14 bp, Homo sapiens
tgggtattgtaatc

SEQ ID NO: 1548345 - DNA, 18 bp, Homo sapiens
tgggtattttataatgtt

SEQ ID NO: 1548346 - DNA, 19 bp, Homo sapiens
tgggtcaacttgacaccac

SEQ ID NO: 1548347 - DNA, 14 bp, Homo sapiens
tgggtcacacacac

SEQ ID NO: 1548348 - DNA, 14 bp, Homo sapiens
tgggtcaccagaaa

SEQ ID NO: 1548349 - DNA, 15 bp, Homo sapiens
tgggtcactcattaa

SEQ ID NO: 1548350 - DNA, 18 bp, Homo sapiens
tgggtcagaacatgttaa

SEQ ID NO: 1548351 - DNA, 19 bp, Homo sapiens
tgggtcagaacatgttaag

SEQ ID NO: 1548352 - DNA, 17 bp, Homo sapiens
tgggtcagcccagcacc

SEQ ID NO: 1548353 - DNA, 14 bp, Homo sapiens
tgggtccagggcct

SEQ ID NO: 1548354 - DNA, 22 bp, Homo sapiens
tgggtccccctcagcaagccct

SEQ ID NO: 1548355 - DNA, 22 bp, Homo sapiens
tgggtccgcatccctgcttctg

SEQ ID NO: 1548356 - DNA, 18 bp, Homo sapiens
tgggtcctcacatctttc

SEQ ID NO: 1548357 - DNA, 13 bp, Homo sapiens
tgggtcctccaaa

SEQ ID NO: 1548358 - DNA, 15 bp, Homo sapiens
tgggtcctccaaaga

SEQ ID NO: 1548359 - DNA, 17 bp, Homo sapiens
tgggtcctgcctggtcc

SEQ ID NO: 1548360 - DNA, 19 bp, Homo sapiens
tgggtccttgatgccagag

SEQ ID NO: 1548361 - DNA, 18 bp, Homo sapiens
tgggtccttttcagaagt

SEQ ID NO: 1548362 - DNA, 18 bp, Homo sapiens
tgggtctcaccggctctc

SEQ ID NO: 1548363 - DNA, 20 bp, Homo sapiens
tgggtctcgctttgttgccc

SEQ ID NO: 1548364 - DNA, 23 bp, Homo sapiens
tgggtctctgaagggaccccccc

SEQ ID NO: 1548365 - DNA, 14 bp, Homo sapiens
tgggtctctggaag

SEQ ID NO: 1548366 - DNA, 18 bp, Homo sapiens
tgggtctgacctggtggg

SEQ ID NO: 1548367 - DNA, 19 bp, Homo sapiens
tgggtctgatattaatcaa

SEQ ID NO: 1548368 - DNA, 18 bp, Homo sapiens
tgggtctgattttctcac

SEQ ID NO: 1548369 - DNA, 21 bp, Homo sapiens
tgggtctgggagtcacacagt

SEQ ID NO: 1548370 - DNA, 14 bp, Homo sapiens
tgggtctgtgcatt

SEQ ID NO: 1548371 - DNA, 14 bp, Homo sapiens
tgggtgacagagca

SEQ ID NO: 1548372 - DNA, 17 bp, Homo sapiens
tgggtgacagagcaaga

SEQ ID NO: 1548373 - DNA, 15 bp, Homo sapiens
tgggtgacagagtga

SEQ ID NO: 1548374 - DNA, 13 bp, Homo sapiens
tgggtgagagagg

SEQ ID NO: 1548375 - DNA, 19 bp, Homo sapiens
tgggtgattcctcccagga

SEQ ID NO: 1548376 - DNA, 13 bp, Homo sapiens
tgggtgccctgaa

SEQ ID NO: 1548377 - DNA, 21 bp, Homo sapiens
tgggtgctgctaattctttgc

SEQ ID NO: 1548378 - DNA, 17 bp, Homo sapiens
tgggtggaaactaagac

SEQ ID NO: 1548379 - DNA, 14 bp, Homo sapiens
tgggtggagaaggg

SEQ ID NO: 1548380 - DNA, 18 bp, Homo sapiens
tgggtggagaagggaggg

SEQ ID NO: 1548381 - DNA, 16 bp, Homo sapiens
tgggtggcacctcctg

SEQ ID NO: 1548382 - DNA, 17 bp, Homo sapiens
tgggtggctcactactg

SEQ ID NO: 1548383 - DNA, 18 bp, Homo sapiens
tgggtggctcactactga

SEQ ID NO: 1548384 - DNA, 23 bp, Homo sapiens
tgggtggctcactactgaacaca

SEQ ID NO: 1548385 - DNA, 19 bp, Homo sapiens
tgggtgggagtgtgtctgc

SEQ ID NO: 1548386 - DNA, 18 bp, Homo sapiens
tgggtgggattttgcaaa

SEQ ID NO: 1548387 - DNA, 21 bp, Homo sapiens
tgggtgggattttttcccttt

SEQ ID NO: 1548388 - DNA, 20 bp, Homo sapiens
tgggtggggaggaaatagaa

SEQ ID NO: 1548389 - DNA, 20 bp, Homo sapiens
tgggtggggggcattgagta

SEQ ID NO: 1548390 - DNA, 19 bp, Homo sapiens
tgggtggtaactgccagcc

SEQ ID NO: 1548391 - DNA, 15 bp, Homo sapiens
tgggtggtacccagg

SEQ ID NO: 1548392 - DNA, 13 bp, Homo sapiens
tgggtggtaccct

SEQ ID NO: 1548393 - DNA, 14 bp, Homo sapiens
tgggtggtggggag

SEQ ID NO: 1548394 - DNA, 15 bp, Homo sapiens
tgggtgtattctctg

SEQ ID NO: 1548395 - DNA, 12 bp, Homo sapiens
tgggtgtcctgc

SEQ ID NO: 1548396 - DNA, 22 bp, Homo sapiens
tgggtgtgagaatgatcaagga

SEQ ID NO: 1548397 - DNA, 14 bp, Homo sapiens
tgggtgtggccagc

SEQ ID NO: 1548398 - DNA, 17 bp, Homo sapiens
tgggtgtggccagcaca

SEQ ID NO: 1548399 - DNA, 13 bp, Homo sapiens
tgggtgtgtccag

SEQ ID NO: 1548400 - DNA, 14 bp, Homo sapiens
tgggtgtgtccagg

SEQ ID NO: 1548401 - DNA, 24 bp, Homo sapiens
tgggttaaatattttgctaactgg

SEQ ID NO: 1548402 - DNA, 18 bp, Homo sapiens
tgggttatttttattaaa

SEQ ID NO: 1548403 - DNA, 21 bp, Homo sapiens
tgggttatttttattaaatgt

SEQ ID NO: 1548404 - DNA, 20 bp, Homo sapiens
tgggttcagaaatgctgcct

SEQ ID NO: 1548405 - DNA, 16 bp, Homo sapiens
tgggttccaaaatatt

SEQ ID NO: 1548406 - DNA, 14 bp, Homo sapiens
tgggttcccactcc

SEQ ID NO: 1548407 - DNA, 15 bp, Homo sapiens
tgggttcccactccc

SEQ ID NO: 1548408 - DNA, 20 bp, Homo sapiens
tgggttcccactcccggcct

SEQ ID NO: 1548409 - DNA, 20 bp, Homo sapiens
tgggttccctttccttccat

SEQ ID NO: 1548410 - DNA, 21 bp, Homo sapiens
tgggttctgcctgccagctgc

SEQ ID NO: 1548411 - DNA, 16 bp, Homo sapiens
tgggttcttgttttat

SEQ ID NO: 1548412 - DNA, 14 bp, Homo sapiens
tgggttgactttca

SEQ ID NO: 1548413 - DNA, 22 bp, Homo sapiens
tgggtttcacaagtgaaaaaca

SEQ ID NO: 1548414 - DNA, 16 bp, Homo sapiens
tgggtttcatatttct

SEQ ID NO: 1548415 - DNA, 14 bp, Homo sapiens
tgggtttctctgtg

SEQ ID NO: 1548416 - DNA, 14 bp, Homo sapiens
tgggtttggacccc

SEQ ID NO: 1548417 - DNA, 20 bp, Homo sapiens
tgggtttggaccccagctgg

SEQ ID NO: 1548418 - DNA, 19 bp, Homo sapiens
tgggttttattgtccttca

SEQ ID NO: 1548419 - DNA, 14 bp, Homo sapiens
tgggtttttccctg

SEQ ID NO: 1548420 - DNA, 22 bp, Homo sapiens
tgggtttttgttacctttatgg

SEQ ID NO: 1548421 - DNA, 17 bp, Homo sapiens
tggtaaaaatgctgctc

SEQ ID NO: 1548422 - DNA, 16 bp, Homo sapiens
tggtaaagtagttgat

SEQ ID NO: 1548423 - DNA, 18 bp, Homo sapiens
tggtaaatactgtgaaat

SEQ ID NO: 1548424 - DNA, 13 bp, Homo sapiens
tggtaaattcaga

SEQ ID NO: 1548425 - DNA, 14 bp, Homo sapiens
tggtaaattcagac

SEQ ID NO: 1548426 - DNA, 16 bp, Homo sapiens
tggtaaattcagacaa

SEQ ID NO: 1548427 - DNA, 19 bp, Homo sapiens
tggtaaattcagacaacat

SEQ ID NO: 1548428 - DNA, 20 bp, Homo sapiens
tggtaaattcagacaacatt

SEQ ID NO: 1548429 - DNA, 22 bp, Homo sapiens
tggtaactgattacctgccaat

SEQ ID NO: 1548430 - DNA, 17 bp, Homo sapiens
tggtaactgccagcctt

SEQ ID NO: 1548431 - DNA, 12 bp, Homo sapiens
tggtaagagaaa

SEQ ID NO: 1548432 - DNA, 13 bp, Homo sapiens
tggtaagagaaaa

SEQ ID NO: 1548433 - DNA, 14 bp, Homo sapiens
tggtaagagaagtg

SEQ ID NO: 1548434 - DNA, 16 bp, Homo sapiens
tggtaagcgatttgaa

SEQ ID NO: 1548435 - DNA, 20 bp, Homo sapiens
tggtaagggggtccctgtgc

SEQ ID NO: 1548436 - DNA, 16 bp, Homo sapiens
tggtaataagcactgt

SEQ ID NO: 1548437 - DNA, 15 bp, Homo sapiens
tggtaatagaatagc

SEQ ID NO: 1548438 - DNA, 21 bp, Homo sapiens
tggtaatctacaccaatgaaa

SEQ ID NO: 1548439 - DNA, 22 bp, Homo sapiens
tggtaatctttacctgtataca

SEQ ID NO: 1548440 - DNA, 18 bp, Homo sapiens
tggtaattcctctccagg

SEQ ID NO: 1548441 - DNA, 17 bp, Homo sapiens
tggtacaatctggctca

SEQ ID NO: 1548442 - DNA, 20 bp, Homo sapiens
tggtacagcttctggagcag

SEQ ID NO: 1548443 - DNA, 13 bp, Homo sapiens
tggtacaggaagg

SEQ ID NO: 1548444 - DNA, 13 bp, Homo sapiens
tggtacccagcca

SEQ ID NO: 1548445 - DNA, 14 bp, Homo sapiens
tggtacccagccat

SEQ ID NO: 1548446 - DNA, 17 bp, Homo sapiens
tggtacccagccatctg

SEQ ID NO: 1548447 - DNA, 13 bp, Homo sapiens
tggtacctgccct

SEQ ID NO: 1548448 - DNA, 14 bp, Homo sapiens
tggtacctgccctc

SEQ ID NO: 1548449 - DNA, 14 bp, Homo sapiens
tggtacctgtgctt

SEQ ID NO: 1548450 - DNA, 18 bp, Homo sapiens
tggtacggagatgtttca

SEQ ID NO: 1548451 - DNA, 21 bp, Homo sapiens
tggtactgactttgcttgctt

SEQ ID NO: 1548452 - DNA, 17 bp, Homo sapiens
tggtacttcctttctcc

SEQ ID NO: 1548453 - DNA, 19 bp, Homo sapiens
tggtactttattcttgctg

SEQ ID NO: 1548454 - DNA, 18 bp, Homo sapiens
tggtacttttgagtgtgt

SEQ ID NO: 1548455 - DNA, 14 bp, Homo sapiens
tggggatctcaggg

SEQ ID NO: 1548456 - DNA, 22 bp, Homo sapiens
tggggatcttcccacaggaggg

SEQ ID NO: 1548457 - DNA, 14 bp, Homo sapiens
tggggatgtaacca

SEQ ID NO: 1548458 - DNA, 16 bp, Homo sapiens
tggggattggtgggtc

SEQ ID NO: 1548459 - DNA, 15 bp, Homo sapiens
tggggatttctggga

SEQ ID NO: 1548460 - DNA, 20 bp, Homo sapiens
tggggcaatagggttaaatg

SEQ ID NO: 1548461 - DNA, 19 bp, Homo sapiens
tggggcagaaatctgagga

SEQ ID NO: 1548462 - DNA, 10 bp, Homo sapiens
tggggcagca

SEQ ID NO: 1548463 - DNA, 24 bp, Homo sapiens
tggggcaggagtgccaggaccagc

SEQ ID NO: 1548464 - DNA, 15 bp, Homo sapiens
tggggcaggctgggc

SEQ ID NO: 1548465 - DNA, 20 bp, Homo sapiens
tggggcaggctgggccatgt

SEQ ID NO: 1548466 - DNA, 15 bp, Homo sapiens
tggggcagggcctgg

SEQ ID NO: 1548467 - DNA, 16 bp, Homo sapiens
tggggcagggcctggg

SEQ ID NO: 1548468 - DNA, 17 bp, Homo sapiens
tggggcagggcctgggc

SEQ ID NO: 1548469 - DNA, 18 bp, Homo sapiens
tggggcagggcctgggcc

SEQ ID NO: 1548470 - DNA, 22 bp, Homo sapiens
tggggcatgtgtgcctgtggca

SEQ ID NO: 1548471 - DNA, 20 bp, Homo sapiens
tggggccaccaaagctgccc

SEQ ID NO: 1548472 - DNA, 11 bp, Homo sapiens
tggggccactt

SEQ ID NO: 1548473 - DNA, 13 bp, Homo sapiens
tggggccagcact

SEQ ID NO: 1548474 - DNA, 19 bp, Homo sapiens
tggggccagcactggaggg

SEQ ID NO: 1548475 - DNA, 12 bp, Homo sapiens
tggggccaggac

SEQ ID NO: 1548476 - DNA, 15 bp, Homo sapiens
tggggccaggtcacc

SEQ ID NO: 1548477 - DNA, 13 bp, Homo sapiens
tggggcccagtgc

SEQ ID NO: 1548478 - DNA, 12 bp, Homo sapiens
tggggccctgcc

SEQ ID NO: 1548479 - DNA, 19 bp, Homo sapiens
tggggccgccacggcctgg

SEQ ID NO: 1548480 - DNA, 19 bp, Homo sapiens
tggggccgccgcctctttc

SEQ ID NO: 1548481 - DNA, 18 bp, Homo sapiens
tggggcctagatccacac

SEQ ID NO: 1548482 - DNA, 22 bp, Homo sapiens
tggggcctagcgatctctcctg

SEQ ID NO: 1548483 - DNA, 14 bp, Homo sapiens
tggggcctccagaa

SEQ ID NO: 1548484 - DNA, 16 bp, Homo sapiens
tggggcctccagaagc

SEQ ID NO: 1548485 - DNA, 22 bp, Homo sapiens
tggggcctccttgtccaggtct

SEQ ID NO: 1548486 - DNA, 17 bp, Homo sapiens
tggggcctgactgctca

SEQ ID NO: 1548487 - DNA, 16 bp, Homo sapiens
tggggcctggacctgc

SEQ ID NO: 1548488 - DNA, 20 bp, Homo sapiens
tggggcctggacctgcctcc

SEQ ID NO: 1548489 - DNA, 14 bp, Homo sapiens
tggggcctggccca

SEQ ID NO: 1548490 - DNA, 12 bp, Homo sapiens
tggggccttggt

SEQ ID NO: 1548491 - DNA, 22 bp, Homo sapiens
tggggctcacttttcatccttc

SEQ ID NO: 1548492 - DNA, 21 bp, Homo sapiens
tggggctcagccacagcctga

SEQ ID NO: 1548493 - DNA, 21 bp, Homo sapiens
tggggctcgtggccttcccct

SEQ ID NO: 1548494 - DNA, 13 bp, Homo sapiens
tggggctctggga

SEQ ID NO: 1548495 - DNA, 15 bp, Homo sapiens
tggggctctgtgcag

SEQ ID NO: 1548496 - DNA, 17 bp, Homo sapiens
tggggctctgtgcaggg

SEQ ID NO: 1548497 - DNA, 11 bp, Homo sapiens
tggggctgaac

SEQ ID NO: 1548498 - DNA, 13 bp, Homo sapiens
tggggctgagcct

SEQ ID NO: 1548499 - DNA, 14 bp, Homo sapiens
tggggctgagcctg

SEQ ID NO: 1548500 - DNA, 16 bp, Homo sapiens
tggggctgagcctgag

SEQ ID NO: 1548501 - DNA, 15 bp, Homo sapiens
tggggctgagctggg

SEQ ID NO: 1548502 - DNA, 18 bp, Homo sapiens
tggggctgatctcaggga

SEQ ID NO: 1548503 - DNA, 19 bp, Homo sapiens
tggggctgatctcagggaa

SEQ ID NO: 1548504 - DNA, 21 bp, Homo sapiens
tggggctgatctcagggaagc

SEQ ID NO: 1548505 - DNA, 23 bp, Homo sapiens
tggggctgccggatctgggctgt

SEQ ID NO: 1548506 - DNA, 19 bp, Homo sapiens
tggggctgctcctccaggg

SEQ ID NO: 1548507 - DNA, 18 bp, Homo sapiens
tggggcttctcctgaccc

SEQ ID NO: 1548508 - DNA, 19 bp, Homo sapiens
tggggctttcccaggagaa

SEQ ID NO: 1548509 - DNA, 22 bp, Homo sapiens
tgggggaaacgggctccttccc

SEQ ID NO: 1548510 - DNA, 18 bp, Homo sapiens
tgggggaactcagatcca

SEQ ID NO: 1548511 - DNA, 16 bp, Homo sapiens
tgggggaagccctgga

SEQ ID NO: 1548512 - DNA, 14 bp, Homo sapiens
tgggggagagccgt

SEQ ID NO: 1548513 - DNA, 20 bp, Homo sapiens
tgggggagccaggagacctg

SEQ ID NO: 1548514 - DNA, 14 bp, Homo sapiens
tgggggatttcaaa

SEQ ID NO: 1548515 - DNA, 16 bp, Homo sapiens
tgggggcagagggcag

SEQ ID NO: 1548516 - DNA, 22 bp, Homo sapiens
tgggggcaggagggccctacct

SEQ ID NO: 1548517 - DNA, 18 bp, Homo sapiens
tgggggcagtgactggca

SEQ ID NO: 1548518 - DNA, 13 bp, Homo sapiens
tgggggcatgggt

SEQ ID NO: 1548519 - DNA, 14 bp, Homo sapiens
tgggggcctggatt

SEQ ID NO: 1548520 - DNA, 21 bp, Homo sapiens
tgggggctgcagcatgttgct

SEQ ID NO: 1548521 - DNA, 13 bp, Homo sapiens
tgggggctggtgc

SEQ ID NO: 1548522 - DNA, 13 bp, Homo sapiens
tgggggctgtcct

SEQ ID NO: 1548523 - DNA, 16 bp, Homo sapiens
tgggggctgtcctgct

SEQ ID NO: 1548524 - DNA, 17 bp, Homo sapiens
tgggggctgtcctgctc

SEQ ID NO: 1548525 - DNA, 20 bp, Homo sapiens
tgggggctttccttttattt

SEQ ID NO: 1548526 - DNA, 13 bp, Homo sapiens
tggggggcagggc

SEQ ID NO: 1548527 - DNA, 16 bp, Homo sapiens
tggggggcgggccagg

SEQ ID NO: 1548528 - DNA, 13 bp, Homo sapiens
tgggggggtggcc

SEQ ID NO: 1548529 - DNA, 23 bp, Homo sapiens
tgggggggtggccgctgagtggc

SEQ ID NO: 1548530 - DNA, 12 bp, Homo sapiens
tggggggtccag

SEQ ID NO: 1548531 - DNA, 15 bp, Homo sapiens
tgggggtcctctctg

SEQ ID NO: 1548532 - DNA, 15 bp, Homo sapiens
tgggggtctgtgtgt

SEQ ID NO: 1548533 - DNA, 18 bp, Homo sapiens
tgggggtggaggcttcct

SEQ ID NO: 1548534 - DNA, 19 bp, Homo sapiens
tgggggtggaggcttcctg

SEQ ID NO: 1548535 - DNA, 16 bp, Homo sapiens
tgggggttcaggcccg

SEQ ID NO: 1548536 - DNA, 18 bp, Homo sapiens
tggggtaagccagagcct

SEQ ID NO: 1548537 - DNA, 13 bp, Homo sapiens
tggggtacaggca

SEQ ID NO: 1548538 - DNA, 15 bp, Homo sapiens
tggggtacaggcagt

SEQ ID NO: 1548539 - DNA, 16 bp, Homo sapiens
tggggtagggctgact

SEQ ID NO: 1548540 - DNA, 16 bp, Homo sapiens
tggggtataggtctca

SEQ ID NO: 1548541 - DNA, 21 bp, Homo sapiens
tggggtcaagaaacagccagc

SEQ ID NO: 1548542 - DNA, 16 bp, Homo sapiens
tggggtcccccctgag

SEQ ID NO: 1548543 - DNA, 21 bp, Homo sapiens
tggggtcccccctgagtgggc

SEQ ID NO: 1548544 - DNA, 17 bp, Homo sapiens
tggggtccctccacccc

SEQ ID NO: 1548545 - DNA, 19 bp, Homo sapiens
tggggtcctcctgtgctat

SEQ ID NO: 1548546 - DNA, 23 bp, Homo sapiens
tggggtctcaaagtttgacagga

SEQ ID NO: 1548547 - DNA, 13 bp, Homo sapiens
tggggtctccctc

SEQ ID NO: 1548548 - DNA, 21 bp, Homo sapiens
tggggtctccctctcctgcct

SEQ ID NO: 1548549 - DNA, 21 bp, Homo sapiens
tggggtctggagttgatctgg

SEQ ID NO: 1548550 - DNA, 13 bp, Homo sapiens
tggggtctgttct

SEQ ID NO: 1548551 - DNA, 19 bp, Homo sapiens
tggggtgagggacagagcc

SEQ ID NO: 1548552 - DNA, 22 bp, Homo sapiens
tggggtgagggagttagggaga

SEQ ID NO: 1548553 - DNA, 16 bp, Homo sapiens
tggggtgcactcgcca

SEQ ID NO: 1548554 - DNA, 13 bp, Homo sapiens
tggggtgctggga

SEQ ID NO: 1548555 - DNA, 18 bp, Homo sapiens
tggggtgctgggaggagg

SEQ ID NO: 1548556 - DNA, 13 bp, Homo sapiens
tggggtgcttcct

SEQ ID NO: 1548557 - DNA, 15 bp, Homo sapiens
tggggtggcgtctgc

SEQ ID NO: 1548558 - DNA, 21 bp, Homo sapiens
tggggtgggagctcctccgca

SEQ ID NO: 1548559 - DNA, 22 bp, Homo sapiens
tggggtggggggatggtaagag

SEQ ID NO: 1548560 - DNA, 19 bp, Homo sapiens
tggggtgggggtggggaga

SEQ ID NO: 1548561 - DNA, 17 bp, Homo sapiens
tggggttcaagcccagg

SEQ ID NO: 1548562 - DNA, 14 bp, Homo sapiens
tggggttcagcccc

SEQ ID NO: 1548563 - DNA, 17 bp, Homo sapiens
tggggttcagcccctcc

SEQ ID NO: 1548564 - DNA, 19 bp, Homo sapiens
tggggttcagcccctcctc

SEQ ID NO: 1548565 - DNA, 21 bp, Homo sapiens
tggggttcagcccctcctctg

SEQ ID NO: 1548566 - DNA, 21 bp, Homo sapiens
tggggttcctggttgttcctg

SEQ ID NO: 1548567 - DNA, 14 bp, Homo sapiens
tggggttgtgttgt

SEQ ID NO: 1548568 - DNA, 23 bp, Homo sapiens
tggggtttgtgtttgattggctt

SEQ ID NO: 1548569 - DNA, 15 bp, Homo sapiens
tgggtaaaatacttt

SEQ ID NO: 1548570 - DNA, 16 bp, Homo sapiens
tgggtaagaagaaagc

SEQ ID NO: 1548571 - DNA, 19 bp, Homo sapiens
tgggtaagaggagcagagg

SEQ ID NO: 1548572 - DNA, 20 bp, Homo sapiens
tggcccctgctgtctctctg

SEQ ID NO: 1548573 - DNA, 18 bp, Homo sapiens
tggcccgacagcctggca

SEQ ID NO: 1548574 - DNA, 13 bp, Homo sapiens
tggcccgcccctc

SEQ ID NO: 1548575 - DNA, 22 bp, Homo sapiens
tggcccgcccctcgctgctgct

SEQ ID NO: 1548576 - DNA, 19 bp, Homo sapiens
tggccctaaatagcagaaa

SEQ ID NO: 1548577 - DNA, 12 bp, Homo sapiens
tggccctcactc

SEQ ID NO: 1548578 - DNA, 15 bp, Homo sapiens
tggccctccactcct

SEQ ID NO: 1548579 - DNA, 21 bp, Homo sapiens
tggccctcggaggtccagctg

SEQ ID NO: 1548580 - DNA, 22 bp, Homo sapiens
tggccctcggaggtccagctgg

SEQ ID NO: 1548581 - DNA, 21 bp, Homo sapiens
tggccctcttgcgggcctgga

SEQ ID NO: 1548582 - DNA, 16 bp, Homo sapiens
tggccctgaggtgtgg

SEQ ID NO: 1548583 - DNA, 23 bp, Homo sapiens
tggccctgaggtgtgggggctgc

SEQ ID NO: 1548584 - DNA, 17 bp, Homo sapiens
tggccctgcccagccca

SEQ ID NO: 1548585 - DNA, 18 bp, Homo sapiens
tggccctgccctctcctt

SEQ ID NO: 1548586 - DNA, 16 bp, Homo sapiens
tggccctgccttcttc

SEQ ID NO: 1548587 - DNA, 14 bp, Homo sapiens
tggccctgcttcct

SEQ ID NO: 1548588 - DNA, 13 bp, Homo sapiens
tggccctggagcc

SEQ ID NO: 1548589 - DNA, 18 bp, Homo sapiens
tggccctggagccagggc

SEQ ID NO: 1548590 - DNA, 13 bp, Homo sapiens
tggccctggcctg

SEQ ID NO: 1548591 - DNA, 23 bp, Homo sapiens
tggccctggggatcttcccacag

SEQ ID NO: 1548592 - DNA, 20 bp, Homo sapiens
tggccctgtgcctgggccct

SEQ ID NO: 1548593 - DNA, 19 bp, Homo sapiens
tggccctgttctcctcccc

SEQ ID NO: 1548594 - DNA, 21 bp, Homo sapiens
tggccctgttctcctccccaa

SEQ ID NO: 1548595 - DNA, 17 bp, Homo sapiens
tggcccttcagtctgct

SEQ ID NO: 1548596 - DNA, 19 bp, Homo sapiens
tggcccttcagtctgctcc

SEQ ID NO: 1548597 - DNA, 23 bp, Homo sapiens
tggcccttcagtctgctccacca

SEQ ID NO: 1548598 - DNA, 19 bp, Homo sapiens
tggcccttgcttacctctc

SEQ ID NO: 1548599 - DNA, 16 bp, Homo sapiens
tggccgaggactttga

SEQ ID NO: 1548600 - DNA, 18 bp, Homo sapiens
tggccgagggtcctggct

SEQ ID NO: 1548601 - DNA, 22 bp, Homo sapiens
tggccgcacctaaagcagccag

SEQ ID NO: 1548602 - DNA, 12 bp, Homo sapiens
tggccgccaccc

SEQ ID NO: 1548603 - DNA, 13 bp, Homo sapiens
tggccgccccctg

SEQ ID NO: 1548604 - DNA, 15 bp, Homo sapiens
tggccgcccctgagg

SEQ ID NO: 1548605 - DNA, 13 bp, Homo sapiens
tggccgcctccag

SEQ ID NO: 1548606 - DNA, 17 bp, Homo sapiens
tggccgcctccaggagc

SEQ ID NO: 1548607 - DNA, 14 bp, Homo sapiens
tggccgcctggcag

SEQ ID NO: 1548608 - DNA, 15 bp, Homo sapiens
tggccgcctggcagg

SEQ ID NO: 1548609 - DNA, 17 bp, Homo sapiens
tggccgcctggcaggtg

SEQ ID NO: 1548610 - DNA, 22 bp, Homo sapiens
tggccgcgccaaataatgtctc

SEQ ID NO: 1548611 - DNA, 23 bp, Homo sapiens
tggccgcgccaaataatgtctct

SEQ ID NO: 1548612 - DNA, 19 bp, Homo sapiens
tggccgctaagttgctgat

SEQ ID NO: 1548613 - DNA, 13 bp, Homo sapiens
tggccgggcacag

SEQ ID NO: 1548614 - DNA, 19 bp, Homo sapiens
tggccgggctgctgctgat

SEQ ID NO: 1548615 - DNA, 14 bp, Homo sapiens
tggccgtctcctcc

SEQ ID NO: 1548616 - DNA, 17 bp, Homo sapiens
tggccgtctcctccctc

SEQ ID NO: 1548617 - DNA, 17 bp, Homo sapiens
tggccgtggtccagctc

SEQ ID NO: 1548618 - DNA, 20 bp, Homo sapiens
tggccgtggtccagctcttg

SEQ ID NO: 1548619 - DNA, 22 bp, Homo sapiens
tggccgtggtccagctcttggc

SEQ ID NO: 1548620 - DNA, 14 bp, Homo sapiens
tggccgttatctgg

SEQ ID NO: 1548621 - DNA, 17 bp, Homo sapiens
tggccgttcagcctgtc

SEQ ID NO: 1548622 - DNA, 16 bp, Homo sapiens
tggcctaaaaatgcaa

SEQ ID NO: 1548623 - DNA, 21 bp, Homo sapiens
tggcctaaacctcagttatta

SEQ ID NO: 1548624 - DNA, 21 bp, Homo sapiens
tggcctatccgctgccagcct

SEQ ID NO: 1548625 - DNA, 15 bp, Homo sapiens
tggcctatgcacata

SEQ ID NO: 1548626 - DNA, 16 bp, Homo sapiens
tggcctatgtggtcta

SEQ ID NO: 1548627 - DNA, 17 bp, Homo sapiens
tggcctattccaggaat

SEQ ID NO: 1548628 - DNA, 22 bp, Homo sapiens
tggcctcacccacccctgcaca

SEQ ID NO: 1548629 - DNA, 15 bp, Homo sapiens
tggcctcactggctg

SEQ ID NO: 1548630 - DNA, 19 bp, Homo sapiens
tggcctcactggctggggc

SEQ ID NO: 1548631 - DNA, 20 bp, Homo sapiens
tggcctcatgctggagggag

SEQ ID NO: 1548632 - DNA, 13 bp, Homo sapiens
tggcctccagctc

SEQ ID NO: 1548633 - DNA, 14 bp, Homo sapiens
tggcctccagctcc

SEQ ID NO: 1548634 - DNA, 16 bp, Homo sapiens
tggcctccatttctgt

SEQ ID NO: 1548635 - DNA, 21 bp, Homo sapiens
tggcctcccacccgatgctgc

SEQ ID NO: 1548636 - DNA, 20 bp, Homo sapiens
tggcctcccctgccaccagg

SEQ ID NO: 1548637 - DNA, 13 bp, Homo sapiens
tggcctccctgct

SEQ ID NO: 1548638 - DNA, 14 bp, Homo sapiens
tggcctcccttctc

SEQ ID NO: 1548639 - DNA, 15 bp, Homo sapiens
tggcctcccttctcc

SEQ ID NO: 1548640 - DNA, 18 bp, Homo sapiens
tggcctccgcagtgtctc

SEQ ID NO: 1548641 - DNA, 18 bp, Homo sapiens
tggcctcgtgaggggcaa

SEQ ID NO: 1548642 - DNA, 19 bp, Homo sapiens
tggcctcgtgaggggcaag

SEQ ID NO: 1548643 - DNA, 23 bp, Homo sapiens
tggcctctctatcctctcttcct

SEQ ID NO: 1548644 - DNA, 14 bp, Homo sapiens
tggcctctgcctgg

SEQ ID NO: 1548645 - DNA, 14 bp, Homo sapiens
tggcctctgctttc

SEQ ID NO: 1548646 - DNA, 16 bp, Homo sapiens
tggcctctggccaggc

SEQ ID NO: 1548647 - DNA, 23 bp, Homo sapiens
tggcctcttggctatttctgtgt

SEQ ID NO: 1548648 - DNA, 16 bp, Homo sapiens
tggcctgaactgagga

SEQ ID NO: 1548649 - DNA, 17 bp, Homo sapiens
tggcctgaactgaggag

SEQ ID NO: 1548650 - DNA, 15 bp, Homo sapiens
tggcctgagagggga

SEQ ID NO: 1548651 - DNA, 11 bp, Homo sapiens
tggcctgagct

SEQ ID NO: 1548652 - DNA, 18 bp, Homo sapiens
tggcctgatgatggtggg

SEQ ID NO: 1548653 - DNA, 22 bp, Homo sapiens
tggcctgctaaggctcctcctt

SEQ ID NO: 1548654 - DNA, 13 bp, Homo sapiens
tggcctgctggga

SEQ ID NO: 1548655 - DNA, 22 bp, Homo sapiens
tggcctgctgggaaccccgcag

SEQ ID NO: 1548656 - DNA, 22 bp, Homo sapiens
tggcctgctgggctctccacct

SEQ ID NO: 1548657 - DNA, 22 bp, Homo sapiens
tggcctggactgactgcagccc

SEQ ID NO: 1548658 - DNA, 13 bp, Homo sapiens
tggcctggactgt

SEQ ID NO: 1548659 - DNA, 18 bp, Homo sapiens
tggcctggagggactttt

SEQ ID NO: 1548660 - DNA, 22 bp, Homo sapiens
tggcctggaggtggggttggga

SEQ ID NO: 1548661 - DNA, 12 bp, Homo sapiens
tggcctggatct

SEQ ID NO: 1548662 - DNA, 14 bp, Homo sapiens
tggcctggatctcc

SEQ ID NO: 1548663 - DNA, 21 bp, Homo sapiens
tggcctggatctccccactct

SEQ ID NO: 1548664 - DNA, 12 bp, Homo sapiens
tggcctggcaca

SEQ ID NO: 1548665 - DNA, 12 bp, Homo sapiens
tggcctggccag

SEQ ID NO: 1548666 - DNA, 13 bp, Homo sapiens
tggcctggccagg

SEQ ID NO: 1548667 - DNA, 13 bp, Homo sapiens
tggcctggcctcc

SEQ ID NO: 1548668 - DNA, 14 bp, Homo sapiens
tggcctggcctcca

SEQ ID NO: 1548669 - DNA, 15 bp, Homo sapiens
tggcctgggccacac

SEQ ID NO: 1548670 - DNA, 21 bp, Homo sapiens
tggcctgggccacacctgagc

SEQ ID NO: 1548671 - DNA, 18 bp, Homo sapiens
tggcctggggtgcatctc

SEQ ID NO: 1548672 - DNA, 16 bp, Homo sapiens
tgggaacactggcctg

SEQ ID NO: 1548673 - DNA, 18 bp, Homo sapiens
tgggaacactggcctggg

SEQ ID NO: 1548674 - DNA, 21 bp, Homo sapiens
tgggaacatgacccagcctga

SEQ ID NO: 1548675 - DNA, 13 bp, Homo sapiens
tgggaaccactcc

SEQ ID NO: 1548676 - DNA, 18 bp, Homo sapiens
tgggaaccactcccacca

SEQ ID NO: 1548677 - DNA, 20 bp, Homo sapiens
tgggaacccaagtccaagca

SEQ ID NO: 1548678 - DNA, 16 bp, Homo sapiens
tgggaacgtgactgcc

SEQ ID NO: 1548679 - DNA, 13 bp, Homo sapiens
tgggaagaagaag

SEQ ID NO: 1548680 - DNA, 18 bp, Homo sapiens
tgggaagaagaagacctc

SEQ ID NO: 1548681 - DNA, 16 bp, Homo sapiens
tgggaagaattggaag

SEQ ID NO: 1548682 - DNA, 14 bp, Homo sapiens
tgggaagagaagaa

SEQ ID NO: 1548683 - DNA, 22 bp, Homo sapiens
tgggaagataggctctgcacag

SEQ ID NO: 1548684 - DNA, 22 bp, Homo sapiens
tgggaagcccatcctgaccagc

SEQ ID NO: 1548685 - DNA, 14 bp, Homo sapiens
tgggaagcttgagc

SEQ ID NO: 1548686 - DNA, 18 bp, Homo sapiens
tgggaagcttgagcctcc

SEQ ID NO: 1548687 - DNA, 12 bp, Homo sapiens
tgggaaggactt

SEQ ID NO: 1548688 - DNA, 13 bp, Homo sapiens
tgggaaggacttg

SEQ ID NO: 1548689 - DNA, 16 bp, Homo sapiens
tgggaaggccacctcc

SEQ ID NO: 1548690 - DNA, 16 bp, Homo sapiens
tgggaaggccggcagc

SEQ ID NO: 1548691 - DNA, 14 bp, Homo sapiens
tgggaaggctaagt

SEQ ID NO: 1548692 - DNA, 17 bp, Homo sapiens
tgggaagtcgaggctgc

SEQ ID NO: 1548693 - DNA, 15 bp, Homo sapiens
tgggaatagggagac

SEQ ID NO: 1548694 - DNA, 15 bp, Homo sapiens
tgggaatgagacata

SEQ ID NO: 1548695 - DNA, 16 bp, Homo sapiens
tgggacaagcagtccc

SEQ ID NO: 1548696 - DNA, 18 bp, Homo sapiens
tgggacaccagggaagaa

SEQ ID NO: 1548697 - DNA, 12 bp, Homo sapiens
tgggacacctgg

SEQ ID NO: 1548698 - DNA, 14 bp, Homo sapiens
tgggacacctggga

SEQ ID NO: 1548699 - DNA, 21 bp, Homo sapiens
tgggacactgcgggacagagg

SEQ ID NO: 1548700 - DNA, 18 bp, Homo sapiens
tgggacagcccagagcct

SEQ ID NO: 1548701 - DNA, 20 bp, Homo sapiens
tgggacagcccagagcctgg

SEQ ID NO: 1548702 - DNA, 23 bp, Homo sapiens
tgggacatcaggagactgggctc

SEQ ID NO: 1548703 - DNA, 13 bp, Homo sapiens
tgggacccagcta

SEQ ID NO: 1548704 - DNA, 20 bp, Homo sapiens
tgggacccctcccaacctca

SEQ ID NO: 1548705 - DNA, 21 bp, Homo sapiens
tgggacccctcccaacctcaa

SEQ ID NO: 1548706 - DNA, 22 bp, Homo sapiens
tgggacccctcccaacctcaat

SEQ ID NO: 1548707 - DNA, 23 bp, Homo sapiens
tgggaccctccagtgctggattt

SEQ ID NO: 1548708 - DNA, 23 bp, Homo sapiens
tgggaccctgtccggcccagtgc

SEQ ID NO: 1548709 - DNA, 13 bp, Homo sapiens
tgggaccctttcc

SEQ ID NO: 1548710 - DNA, 22 bp, Homo sapiens
tgggaccttctttattctgtgt

SEQ ID NO: 1548711 - DNA, 18 bp, Homo sapiens
tgggactagagctttctt

SEQ ID NO: 1548712 - DNA, 23 bp, Homo sapiens
tgggactcagccttcagacagag

SEQ ID NO: 1548713 - DNA, 20 bp, Homo sapiens
tgggactccatgctccttga

SEQ ID NO: 1548714 - DNA, 16 bp, Homo sapiens
tgggactctcctcctc

SEQ ID NO: 1548715 - DNA, 20 bp, Homo sapiens
tgggactctcctcctcccct

SEQ ID NO: 1548716 - DNA, 14 bp, Homo sapiens
tgggactgagccag

SEQ ID NO: 1548717 - DNA, 16 bp, Homo sapiens
tgggactgagccagtc

SEQ ID NO: 1548718 - DNA, 20 bp, Homo sapiens
tgggactgagcctggcccat

SEQ ID NO: 1548719 - DNA, 11 bp, Homo sapiens
tgggactgatg

SEQ ID NO: 1548720 - DNA, 16 bp, Homo sapiens
tgggactgatgtcatc

SEQ ID NO: 1548721 - DNA, 18 bp, Homo sapiens
tgggactgatgtcatctt

SEQ ID NO: 1548722 - DNA, 13 bp, Homo sapiens
tgggactggacag

SEQ ID NO: 1548723 - DNA, 22 bp, Homo sapiens
tgggactggacagctttgctcc

SEQ ID NO: 1548724 - DNA, 21 bp, Homo sapiens
tgggactttccttccctctcc

SEQ ID NO: 1548725 - DNA, 15 bp, Homo sapiens
tgggagaaaatcatc

SEQ ID NO: 1548726 - DNA, 15 bp, Homo sapiens
tgggagaacctcagg

SEQ ID NO: 1548727 - DNA, 16 bp, Homo sapiens
tgggagaagggcagag

SEQ ID NO: 1548728 - DNA, 18 bp, Homo sapiens
tgggagaatgtcagttca

SEQ ID NO: 1548729 - DNA, 13 bp, Homo sapiens
tgggagacagcag

SEQ ID NO: 1548730 - DNA, 19 bp, Homo sapiens
tgggagacagcagcctgta

SEQ ID NO: 1548731 - DNA, 15 bp, Homo sapiens
tgggagagacttgtt

SEQ ID NO: 1548732 - DNA, 12 bp, Homo sapiens
tgggagcactgg

SEQ ID NO: 1548733 - DNA, 23 bp, Homo sapiens
tgggagcactggagtgcagggag

SEQ ID NO: 1548734 - DNA, 16 bp, Homo sapiens
tgggagccagctgctt

SEQ ID NO: 1548735 - DNA, 12 bp, Homo sapiens
tgggagccaggg

SEQ ID NO: 1548736 - DNA, 13 bp, Homo sapiens
tgggagcccagaa

SEQ ID NO: 1548737 - DNA, 19 bp, Homo sapiens
tgggagcccagagggtggc

SEQ ID NO: 1548738 - DNA, 14 bp, Homo sapiens
tgggagccccaggg

SEQ ID NO: 1548739 - DNA, 22 bp, Homo sapiens
tgggagccccagggtcttccct

SEQ ID NO: 1548740 - DNA, 23 bp, Homo sapiens
tgggagccccagggtcttcccta

SEQ ID NO: 1548741 - DNA, 18 bp, Homo sapiens
tgggagcctagctcctgc

SEQ ID NO: 1548742 - DNA, 20 bp, Homo sapiens
tgggagcctgcaaactcact

SEQ ID NO: 1548743 - DNA, 19 bp, Homo sapiens
tgggagctccactctgctt

SEQ ID NO: 1548744 - DNA, 23 bp, Homo sapiens
tgggagctcctccgcagaaggtt

SEQ ID NO: 1548745 - DNA, 16 bp, Homo sapiens
tgggagctctgcttgc

SEQ ID NO: 1548746 - DNA, 17 bp, Homo sapiens
tgggagctgaaaaatca

SEQ ID NO: 1548747 - DNA, 16 bp, Homo sapiens
tgggagctgccaagag

SEQ ID NO: 1548748 - DNA, 22 bp, Homo sapiens
tgggagctgcgccggacagagt

SEQ ID NO: 1548749 - DNA, 20 bp, Homo sapiens
tgggagctggttagaaatgc

SEQ ID NO: 1548750 - DNA, 22 bp, Homo sapiens
tgggaggaaagggcctggccag

SEQ ID NO: 1548751 - DNA, 15 bp, Homo sapiens
tgggaggaaatttga

SEQ ID NO: 1548752 - DNA, 13 bp, Homo sapiens
tgggaggaagcag

SEQ ID NO: 1548753 - DNA, 13 bp, Homo sapiens
tgggaggaaggac

SEQ ID NO: 1548754 - DNA, 13 bp, Homo sapiens
tgggaggaattca

SEQ ID NO: 1548755 - DNA, 14 bp, Homo sapiens
tgggaggcagaggt

SEQ ID NO: 1548756 - DNA, 23 bp, Homo sapiens
tgggaggcagccgaggcctggcc

SEQ ID NO: 1548757 - DNA, 11 bp, Homo sapiens
tgggaggcagg

SEQ ID NO: 1548758 - DNA, 14 bp, Homo sapiens
tgggaggccaagga

SEQ ID NO: 1548759 - DNA, 15 bp, Homo sapiens
tgggaggccaaggca

SEQ ID NO: 1548760 - DNA, 16 bp, Homo sapiens
tgggaggccaaggcag

SEQ ID NO: 1548761 - DNA, 21 bp, Homo sapiens
tgggaggcgtgcccccctcct

SEQ ID NO: 1548762 - DNA, 13 bp, Homo sapiens
tgggaggctgagg

SEQ ID NO: 1548763 - DNA, 15 bp, Homo sapiens
tgggaggctgaggcg

SEQ ID NO: 1548764 - DNA, 14 bp, Homo sapiens
tgggaggctgaggt

SEQ ID NO: 1548765 - DNA, 11 bp, Homo sapiens
tgggaggggca

SEQ ID NO: 1548766 - DNA, 16 bp, Homo sapiens
tgggaggtcaggaaac

SEQ ID NO: 1548767 - DNA, 22 bp, Homo sapiens
tgggaggtgcgtgttcagcaga

SEQ ID NO: 1548768 - DNA, 23 bp, Homo sapiens
tgggaggtgcgtgttcagcagaa

SEQ ID NO: 1548769 - DNA, 18 bp, Homo sapiens
tgggaggtggaagaaggg

SEQ ID NO: 1548770 - DNA, 13 bp, Homo sapiens
tgggagtcccctt

SEQ ID NO: 1548771 - DNA, 22 bp, Homo sapiens
tgggagtgaggatgtctgggcc

SEQ ID NO: 1548772 - DNA, 20 bp, Homo sapiens
tgggagtgtgggctgccctt

SEQ ID NO: 1548773 - DNA, 18 bp, Homo sapiens
tgggagtgtggtttcttt

SEQ ID NO: 1548774 - DNA, 15 bp, Homo sapiens
tgggagtgtgtctgc

SEQ ID NO: 1548775 - DNA, 18 bp, Homo sapiens
tgggataagagtgtgaga

SEQ ID NO: 1548776 - DNA, 18 bp, Homo sapiens
tgggatagtgttctgctc

SEQ ID NO: 1548777 - DNA, 20 bp, Homo sapiens
tgggatagtgttctgctcct

SEQ ID NO: 1548778 - DNA, 22 bp, Homo sapiens
tgggatagtgttctgctcctgc

SEQ ID NO: 1548779 - DNA, 18 bp, Homo sapiens
tgggatattgaatgttaa

SEQ ID NO: 1548780 - DNA, 13 bp, Homo sapiens
tgggatcctccct

SEQ ID NO: 1548781 - DNA, 15 bp, Homo sapiens
tgggatcctccctca

SEQ ID NO: 1548782 - DNA, 15 bp, Homo sapiens
tgggatccttcagca

SEQ ID NO: 1548783 - DNA, 18 bp, Homo sapiens
tgggatctttctgggagc

SEQ ID NO: 1548784 - DNA, 14 bp, Homo sapiens
tgggatgaatgcca

SEQ ID NO: 1548785 - DNA, 23 bp, Homo sapiens
tgggatgacaggcgcctgccatc

SEQ ID NO: 1548786 - DNA, 12 bp, Homo sapiens
tgggatggggag

SEQ ID NO: 1548787 - DNA, 15 bp, Homo sapiens
tgggatggggaggga

SEQ ID NO: 1548788 - DNA, 19 bp, Homo sapiens
tgggatggtcggatctcac

SEQ ID NO: 1548789 - DNA, 16 bp, Homo sapiens
tggtcccttaaggcac

SEQ ID NO: 1548790 - DNA, 18 bp, Homo sapiens
tggtccgtgcccaggccc

SEQ ID NO: 1548791 - DNA, 20 bp, Homo sapiens
tggtccgtgcccaggccctt

SEQ ID NO: 1548792 - DNA, 20 bp, Homo sapiens
tggtccgtgggacggtgccc

SEQ ID NO: 1548793 - DNA, 15 bp, Homo sapiens
tggtcctccctccca

SEQ ID NO: 1548794 - DNA, 14 bp, Homo sapiens
tggtcctctctctg

SEQ ID NO: 1548795 - DNA, 12 bp, Homo sapiens
tggtcctgactc

SEQ ID NO: 1548796 - DNA, 22 bp, Homo sapiens
tggtcctgactcaacatgttac

SEQ ID NO: 1548797 - DNA, 13 bp, Homo sapiens
tggtcctggctgc

SEQ ID NO: 1548798 - DNA, 11 bp, Homo sapiens
tggtcctgggg

SEQ ID NO: 1548799 - DNA, 16 bp, Homo sapiens
tggtcctgtccccgca

SEQ ID NO: 1548800 - DNA, 12 bp, Homo sapiens
tggtccttattt

SEQ ID NO: 1548801 - DNA, 18 bp, Homo sapiens
tggtccttcactggcgcc

SEQ ID NO: 1548802 - DNA, 19 bp, Homo sapiens
tggtccttcactggcgcct

SEQ ID NO: 1548803 - DNA, 21 bp, Homo sapiens
tggtccttcactggcgccttc

SEQ ID NO: 1548804 - DNA, 22 bp, Homo sapiens
tggtccttcactggcgccttct

SEQ ID NO: 1548805 - DNA, 20 bp, Homo sapiens
tggtcctttacactcaggct

SEQ ID NO: 1548806 - DNA, 21 bp, Homo sapiens
tggtcctttacactcaggctt

SEQ ID NO: 1548807 - DNA, 16 bp, Homo sapiens
tggtcgaggagtaaca

SEQ ID NO: 1548808 - DNA, 14 bp, Homo sapiens
tggtcgcccaggag

SEQ ID NO: 1548809 - DNA, 15 bp, Homo sapiens
tggtcgcccaggaga

SEQ ID NO: 1548810 - DNA, 13 bp, Homo sapiens
tggtcgctcctgc

SEQ ID NO: 1548811 - DNA, 22 bp, Homo sapiens
tggtcggggagctggggtacag

SEQ ID NO: 1548812 - DNA, 12 bp, Homo sapiens
tggtctaaaact

SEQ ID NO: 1548813 - DNA, 15 bp, Homo sapiens
tggtctactctagaa

SEQ ID NO: 1548814 - DNA, 14 bp, Homo sapiens
tggtctcaggcagc

SEQ ID NO: 1548815 - DNA, 18 bp, Homo sapiens
tggtctccatatcagctc

SEQ ID NO: 1548816 - DNA, 23 bp, Homo sapiens
tggtctcccatatgcagaaatag

SEQ ID NO: 1548817 - DNA, 17 bp, Homo sapiens
tggtctctgccccagcc

SEQ ID NO: 1548818 - DNA, 17 bp, Homo sapiens
tggtctgaggatgtaga

SEQ ID NO: 1548819 - DNA, 16 bp, Homo sapiens
tggtctgatttcagga

SEQ ID NO: 1548820 - DNA, 17 bp, Homo sapiens
tggtctgccagaatact

SEQ ID NO: 1548821 - DNA, 19 bp, Homo sapiens
tggtctgcttaaagcttcc

SEQ ID NO: 1548822 - DNA, 16 bp, Homo sapiens
tggtctggttgggcag

SEQ ID NO: 1548823 - DNA, 23 bp, Homo sapiens
tggtctgtgtgtgtgtgtgtgcg

SEQ ID NO: 1548824 - DNA, 20 bp, Homo sapiens
tggtcttaaatgctcatttt

SEQ ID NO: 1548825 - DNA, 16 bp, Homo sapiens
tggtcttccatgggat

SEQ ID NO: 1548826 - DNA, 15 bp, Homo sapiens
tggtctttctggaga

SEQ ID NO: 1548827 - DNA, 16 bp, Homo sapiens
tggtctttgctccaga

SEQ ID NO: 1548828 - DNA, 21 bp, Homo sapiens
tggtctttttctaccttgttg

SEQ ID NO: 1548829 - DNA, 21 bp, Homo sapiens
tggtgaactgagctgggcagg

SEQ ID NO: 1548830 - DNA, 15 bp, Homo sapiens
tggtgaataaaacct

SEQ ID NO: 1548831 - DNA, 16 bp, Homo sapiens
tggtgacaccagcctt

SEQ ID NO: 1548832 - DNA, 17 bp, Homo sapiens
tggtgacacctccccct

SEQ ID NO: 1548833 - DNA, 17 bp, Homo sapiens
tggtgagagtcaaagct

SEQ ID NO: 1548834 - DNA, 19 bp, Homo sapiens
tggtgagagtcaaagctga

SEQ ID NO: 1548835 - DNA, 23 bp, Homo sapiens
tggtgaggctgacatgctcacac

SEQ ID NO: 1548836 - DNA, 15 bp, Homo sapiens
tggtgaggggctttc

SEQ ID NO: 1548837 - DNA, 23 bp, Homo sapiens
tgtaaaaagcctccttgtgcaat

SEQ ID NO: 1548838 - DNA, 13 bp, Homo sapiens
tgtaaaaatcact

SEQ ID NO: 1548839 - DNA, 12 bp, Homo sapiens
tgtaaaaatctt

SEQ ID NO: 1548840 - DNA, 22 bp, Homo sapiens
tgtaaaacaatgccatgaacaa

SEQ ID NO: 1548841 - DNA, 13 bp, Homo sapiens
tgtaaaacaggta

SEQ ID NO: 1548842 - DNA, 21 bp, Homo sapiens
tgtaaaaccatcagatatttc

SEQ ID NO: 1548843 - DNA, 12 bp, Homo sapiens
tgtaaaagaaat

SEQ ID NO: 1548844 - DNA, 13 bp, Homo sapiens
tgtaaaagaaatc

SEQ ID NO: 1548845 - DNA, 15 bp, Homo sapiens
tgtaaaagatgcaga

SEQ ID NO: 1548846 - DNA, 22 bp, Homo sapiens
tgtaaaagtactctgaaaagca

SEQ ID NO: 1548847 - DNA, 22 bp, Homo sapiens
tgtaaaatcttggcacagaaac

SEQ ID NO: 1548848 - DNA, 15 bp, Homo sapiens
tgtaaaatcttgtca

SEQ ID NO: 1548849 - DNA, 22 bp, Homo sapiens
tgtaaaatgaattgaaaaacaa

SEQ ID NO: 1548850 - DNA, 20 bp, Homo sapiens
tgtaaaattgttaaccttgt

SEQ ID NO: 1548851 - DNA, 22 bp, Homo sapiens
tgtaaaatttatttatattccg

SEQ ID NO: 1548852 - DNA, 22 bp, Homo sapiens
tgtaaacaaaccacagcaggat

SEQ ID NO: 1548853 - DNA, 14 bp, Homo sapiens
tgtaaacaaatctt

SEQ ID NO: 1548854 - DNA, 17 bp, Homo sapiens
tgtaaacaacgtgtata

SEQ ID NO: 1548855 - DNA, 12 bp, Homo sapiens
tgtaaacagtgc

SEQ ID NO: 1548856 - DNA, 15 bp, Homo sapiens
tgtaaactcaaaata

SEQ ID NO: 1548857 - DNA, 19 bp, Homo sapiens
tgtaaactttatcacttaa

SEQ ID NO: 1548858 - DNA, 18 bp, Homo sapiens
tgtaaagaaaaatattta

SEQ ID NO: 1548859 - DNA, 18 bp, Homo sapiens
tgtaaagccaacaccctg

SEQ ID NO: 1548860 - DNA, 15 bp, Homo sapiens
tgtaaaggagggaga

SEQ ID NO: 1548861 - DNA, 23 bp, Homo sapiens
tgtaaaggagggagatctttccc

SEQ ID NO: 1548862 - DNA, 15 bp, Homo sapiens
tgtaaaggggcagct

SEQ ID NO: 1548863 - DNA, 17 bp, Homo sapiens
tgtaaaggggcagctga

SEQ ID NO: 1548864 - DNA, 19 bp, Homo sapiens
tgtaaagtgatttttggtc

SEQ ID NO: 1548865 - DNA, 16 bp, Homo sapiens
tgtaaagtgtaaatcc

SEQ ID NO: 1548866 - DNA, 17 bp, Homo sapiens
tgtaaagtgtaaatcct

SEQ ID NO: 1548867 - DNA, 12 bp, Homo sapiens
tgtaaagtgtgg

SEQ ID NO: 1548868 - DNA, 16 bp, Homo sapiens
tgtaaagttacactgt

SEQ ID NO: 1548869 - DNA, 16 bp, Homo sapiens
tgtaaagtttctagaa

SEQ ID NO: 1548870 - DNA, 14 bp, Homo sapiens
tgtaaataaactat

SEQ ID NO: 1548871 - DNA, 12 bp, Homo sapiens
tgtaaataagag

SEQ ID NO: 1548872 - DNA, 15 bp, Homo sapiens
tgtaaataatttatt

SEQ ID NO: 1548873 - DNA, 13 bp, Homo sapiens
tgtaaatacataa

SEQ ID NO: 1548874 - DNA, 17 bp, Homo sapiens
tgtaaatactggactca

SEQ ID NO: 1548875 - DNA, 18 bp, Homo sapiens
tgtaaatactggactcag

SEQ ID NO: 1548876 - DNA, 17 bp, Homo sapiens
tgtaaataggattttta

SEQ ID NO: 1548877 - DNA, 15 bp, Homo sapiens
tgtaaatatgtttgt

SEQ ID NO: 1548878 - DNA, 16 bp, Homo sapiens
tgtaaatattctatat

SEQ ID NO: 1548879 - DNA, 13 bp, Homo sapiens
tgtaaatatttat

SEQ ID NO: 1548880 - DNA, 18 bp, Homo sapiens
tgtaaatcacttcattgt

SEQ ID NO: 1548881 - DNA, 19 bp, Homo sapiens
tgtaaatcctttttcttta

SEQ ID NO: 1548882 - DNA, 13 bp, Homo sapiens
tgtaaatctgcca

SEQ ID NO: 1548883 - DNA, 15 bp, Homo sapiens
tgtaaatctgccaca

SEQ ID NO: 1548884 - DNA, 16 bp, Homo sapiens
tgtaaatctttttgct

SEQ ID NO: 1548885 - DNA, 17 bp, Homo sapiens
tgtaaatgcatattaaa

SEQ ID NO: 1548886 - DNA, 13 bp, Homo sapiens
tgtaaatgtttct

SEQ ID NO: 1548887 - DNA, 22 bp, Homo sapiens
tgtaaatgtttgttaaaaataa

SEQ ID NO: 1548888 - DNA, 16 bp, Homo sapiens
tgtaaattaactcacc

SEQ ID NO: 1548889 - DNA, 17 bp, Homo sapiens
tgtaaatttatgtgatg

SEQ ID NO: 1548890 - DNA, 19 bp, Homo sapiens
tgtaacaattgtgtagcct

SEQ ID NO: 1548891 - DNA, 20 bp, Homo sapiens
tgtaacaattgtgtagcctt

SEQ ID NO: 1548892 - DNA, 21 bp, Homo sapiens
tgtaacaattgtgtagccttt

SEQ ID NO: 1548893 - DNA, 17 bp, Homo sapiens
tgtaacactgcaagaag

SEQ ID NO: 1548894 - DNA, 21 bp, Homo sapiens
tgtaagtgtgagtaagagctg

SEQ ID NO: 1548895 - DNA, 22 bp, Homo sapiens
tgtaagttatttcttgtttgtt

SEQ ID NO: 1548896 - DNA, 15 bp, Homo sapiens
tgtaagtttattttt

SEQ ID NO: 1548897 - DNA, 13 bp, Homo sapiens
tgtaagtttgaat

SEQ ID NO: 1548898 - DNA, 20 bp, Homo sapiens
tgtaataaaaagtatatgtt

SEQ ID NO: 1548899 - DNA, 21 bp, Homo sapiens
tgtaataaaacttatgctagt

SEQ ID NO: 1548900 - DNA, 13 bp, Homo sapiens
tgtaataaacttt

SEQ ID NO: 1548901 - DNA, 17 bp, Homo sapiens
tgtaataaactttaata

SEQ ID NO: 1548902 - DNA, 13 bp, Homo sapiens
tgtaataaagtat

SEQ ID NO: 1548903 - DNA, 15 bp, Homo sapiens
tgtaataaagtatat

SEQ ID NO: 1548904 - DNA, 15 bp, Homo sapiens
tgtaataaattcaaa

SEQ ID NO: 1548905 - DNA, 13 bp, Homo sapiens
tgtaataagaaag

SEQ ID NO: 1548906 - DNA, 23 bp, Homo sapiens
tgtaataagaaagtataaagtca

SEQ ID NO: 1548907 - DNA, 21 bp, Homo sapiens
tgtaatacctgattgatcaca

SEQ ID NO: 1548908 - DNA, 14 bp, Homo sapiens
tgtaatagttcagt

SEQ ID NO: 1548909 - DNA, 21 bp, Homo sapiens
tgtaatataaagtattcaaca

SEQ ID NO: 1548910 - DNA, 12 bp, Homo sapiens
tgtaatataaat

SEQ ID NO: 1548911 - DNA, 22 bp, Homo sapiens
tgtaatataaatttaagcaaac

SEQ ID NO: 1548912 - DNA, 15 bp, Homo sapiens
tgtaatatattgtac

SEQ ID NO: 1548913 - DNA, 13 bp, Homo sapiens
tgtaatattgtaa

SEQ ID NO: 1548914 - DNA, 15 bp, Homo sapiens
tgtaatcaagccttt

SEQ ID NO: 1548915 - DNA, 14 bp, Homo sapiens
tgtaatcaatgttt

SEQ ID NO: 1548916 - DNA, 13 bp, Homo sapiens
tgtaatcatttat

SEQ ID NO: 1548917 - DNA, 21 bp, Homo sapiens
tgtaatcatttatcttatcta

SEQ ID NO: 1548918 - DNA, 22 bp, Homo sapiens
tgtaatcccagcactttgggag

SEQ ID NO: 1548919 - DNA, 20 bp, Homo sapiens
tgtaatcccagctactcagg

SEQ ID NO: 1548920 - DNA, 20 bp, Homo sapiens
tgtaatcccagctactcggg

SEQ ID NO: 1548921 - DNA, 15 bp, Homo sapiens
tgtaatcgtgtgcca

SEQ ID NO: 1548922 - DNA, 15 bp, Homo sapiens
tgtaatctaccagtg

SEQ ID NO: 1548923 - DNA, 20 bp, Homo sapiens
tgtaatctctctgcagctgc

SEQ ID NO: 1548924 - DNA, 15 bp, Homo sapiens
tgtaatctctgatta

SEQ ID NO: 1548925 - DNA, 14 bp, Homo sapiens
tgtaatctgaagta

SEQ ID NO: 1548926 - DNA, 14 bp, Homo sapiens
tgtaatcttaaaag

SEQ ID NO: 1548927 - DNA, 17 bp, Homo sapiens
tgtaatcttttatttaa

SEQ ID NO: 1548928 - DNA, 21 bp, Homo sapiens
tgtaatgaaaatgaatatcta

SEQ ID NO: 1548929 - DNA, 15 bp, Homo sapiens
tgtaatgacaaaaga

SEQ ID NO: 1548930 - DNA, 14 bp, Homo sapiens
tgtaatgaggaaaa

SEQ ID NO: 1548931 - DNA, 15 bp, Homo sapiens
tgtaatgaggaaaaa

SEQ ID NO: 1548932 - DNA, 12 bp, Homo sapiens
tgtaatgctgca

SEQ ID NO: 1548933 - DNA, 13 bp, Homo sapiens
tgtaatgctgcac

SEQ ID NO: 1548934 - DNA, 18 bp, Homo sapiens
tgtaatgggtaattctga

SEQ ID NO: 1548935 - DNA, 19 bp, Homo sapiens
tgtaatggtactgactttg

SEQ ID NO: 1548936 - DNA, 21 bp, Homo sapiens
tgtaatggtactgactttgct

SEQ ID NO: 1548937 - DNA, 13 bp, Homo sapiens
tgtaatgtaaata

SEQ ID NO: 1548938 - DNA, 19 bp, Homo sapiens
tgtaatgtcaccaccttcc

SEQ ID NO: 1548939 - DNA, 14 bp, Homo sapiens
tgtaattaaaagca

SEQ ID NO: 1548940 - DNA, 23 bp, Homo sapiens
tgtaattagtgccacttaatgta

SEQ ID NO: 1548941 - DNA, 23 bp, Homo sapiens
tgtaattcattgagcagttagct

SEQ ID NO: 1548942 - DNA, 15 bp, Homo sapiens
tgtaattcctacctc

SEQ ID NO: 1548943 - DNA, 14 bp, Homo sapiens
tgtaattctaaatg

SEQ ID NO: 1548944 - DNA, 14 bp, Homo sapiens
tgtaattgcttaca

SEQ ID NO: 1548945 - DNA, 14 bp, Homo sapiens
tgtaattggaatct

SEQ ID NO: 1548946 - DNA, 15 bp, Homo sapiens
tgtaattggaatctt

SEQ ID NO: 1548947 - DNA, 10 bp, Homo sapiens
tgtaattgtg

SEQ ID NO: 1548948 - DNA, 21 bp, Homo sapiens
tgtaattgtgtaaaaaatgga

SEQ ID NO: 1548949 - DNA, 16 bp, Homo sapiens
tgtaattgtgtggatt

SEQ ID NO: 1548950 - DNA, 17 bp, Homo sapiens
tgtaatttaaaattgtg

SEQ ID NO: 1548951 - DNA, 14 bp, Homo sapiens
tgtaatttaaacag

SEQ ID NO: 1548952 - DNA, 22 bp, Homo sapiens
tgtaatttaaacaggcccagca

SEQ ID NO: 1548953 - DNA, 23 bp, Homo sapiens
tgtaatttaaacatttgttcctg

SEQ ID NO: 1548954 - DNA, 16 bp, Homo sapiens
tgtaatttaaatgaaa

SEQ ID NO: 1548955 - DNA, 17 bp, Homo sapiens
tgtaatttaaatgaaag

SEQ ID NO: 1548956 - DNA, 20 bp, Homo sapiens
tgtaatttaagtgacacaga

SEQ ID NO: 1548957 - DNA, 22 bp, Homo sapiens
tgtaatttaagtgacacagaca

SEQ ID NO: 1548958 - DNA, 23 bp, Homo sapiens
tgtaatttaagtgacacagacat

SEQ ID NO: 1548959 - DNA, 23 bp, Homo sapiens
tgtaatttatattccatttacat

SEQ ID NO: 1548960 - DNA, 13 bp, Homo sapiens
tgtaatttatgca

SEQ ID NO: 1548961 - DNA, 17 bp, Homo sapiens
tgtaatttcgccttaaa

SEQ ID NO: 1548962 - DNA, 18 bp, Homo sapiens
tgtaatttcgccttaaac

SEQ ID NO: 1548963 - DNA, 21 bp, Homo sapiens
tgtaatttcgccttaaactct

SEQ ID NO: 1548964 - DNA, 22 bp, Homo sapiens
tgtaatttcgccttaaactctg

SEQ ID NO: 1548965 - DNA, 22 bp, Homo sapiens
tgtaattttaaaagtctatttt

SEQ ID NO: 1548966 - DNA, 21 bp, Homo sapiens
tgtaattttaaataaaagtga

SEQ ID NO: 1548967 - DNA, 22 bp, Homo sapiens
tgtacaaaataaacaaataaca

SEQ ID NO: 1548968 - DNA, 19 bp, Homo sapiens
tgtacaaaattaagcaaat

SEQ ID NO: 1548969 - DNA, 12 bp, Homo sapiens
tgtacaaataaa

SEQ ID NO: 1548970 - DNA, 17 bp, Homo sapiens
tgtacaagttttgtata

SEQ ID NO: 1548971 - DNA, 12 bp, Homo sapiens
tgtacaataaat

SEQ ID NO: 1548972 - DNA, 15 bp, Homo sapiens
tgtacaatacaatgt

SEQ ID NO: 1548973 - DNA, 16 bp, Homo sapiens
tgtacaatacaatgta

SEQ ID NO: 1548974 - DNA, 20 bp, Homo sapiens
tgtacaatacaatgtacaat

SEQ ID NO: 1548975 - DNA, 14 bp, Homo sapiens
tgtacaatggttta

SEQ ID NO: 1548976 - DNA, 20 bp, Homo sapiens
tgtacaatggtttattccca

SEQ ID NO: 1548977 - DNA, 21 bp, Homo sapiens
tgtacaatggtttattcccaa

SEQ ID NO: 1548978 - DNA, 13 bp, Homo sapiens
tgtacaatgtgag

SEQ ID NO: 1548979 - DNA, 21 bp, Homo sapiens
tgtacaattatgtctcttgag

SEQ ID NO: 1548980 - DNA, 21 bp, Homo sapiens
tgtacaattttaaagttctta

SEQ ID NO: 1548981 - DNA, 12 bp, Homo sapiens
tgtacacagact

SEQ ID NO: 1548982 - DNA, 12 bp, Homo sapiens
tgtacacagtca

SEQ ID NO: 1548983 - DNA, 16 bp, Homo sapiens
tgtacacattcctgca

SEQ ID NO: 1548984 - DNA, 17 bp, Homo sapiens
tgtacacgtgtcctgta

SEQ ID NO: 1548985 - DNA, 21 bp, Homo sapiens
tgtacactgaatatttatatt

SEQ ID NO: 1548986 - DNA, 20 bp, Homo sapiens
tgtacagactgttttactgt

SEQ ID NO: 1548987 - DNA, 20 bp, Homo sapiens
tgtacaggactgtaaagatt

SEQ ID NO: 1548988 - DNA, 14 bp, Homo sapiens
tgtacagtagattt

SEQ ID NO: 1548989 - DNA, 14 bp, Homo sapiens
tgtacagtctgtca

SEQ ID NO: 1548990 - DNA, 16 bp, Homo sapiens
tgtacagtctgtcatg

SEQ ID NO: 1548991 - DNA, 13 bp, Homo sapiens
tgtacataaaaga

SEQ ID NO: 1548992 - DNA, 19 bp, Homo sapiens
tgtacataactcctgtccc

SEQ ID NO: 1548993 - DNA, 20 bp, Homo sapiens
tgtacataactcctgtccct

SEQ ID NO: 1548994 - DNA, 13 bp, Homo sapiens
tgtacataactga

SEQ ID NO: 1548995 - DNA, 17 bp, Homo sapiens
tgtacataactgaaaat

SEQ ID NO: 1548996 - DNA, 18 bp, Homo sapiens
tgtacataactgaaaatg

SEQ ID NO: 1548997 - DNA, 23 bp, Homo sapiens
tgtacatacgatttaaggtattt

SEQ ID NO: 1548998 - DNA, 14 bp, Homo sapiens
tgtacatagagcaa

SEQ ID NO: 1548999 - DNA, 15 bp, Homo sapiens
tgtacatagagcaat

SEQ ID NO: 1549000 - DNA, 18 bp, Homo sapiens
tgtacatagagcaatgtt

SEQ ID NO: 1549001 - DNA, 18 bp, Homo sapiens
tgtacatagttatttatt

SEQ ID NO: 1549002 - DNA, 13 bp, Homo sapiens
tgtacatatgtaa

SEQ ID NO: 1549003 - DNA, 16 bp, Homo sapiens
tgtacatatgtaaaat

SEQ ID NO: 1549004 - DNA, 21 bp, Homo sapiens
tgtacatatgtaaaataaaat

SEQ ID NO: 1549005 - DNA, 20 bp, Homo sapiens
tgtacatatttgagactagt

SEQ ID NO: 1549006 - DNA, 15 bp, Homo sapiens
tgtacatcatgttat

SEQ ID NO: 1549007 - DNA, 17 bp, Homo sapiens
tgtacatcatgttattt

SEQ ID NO: 1549008 - DNA, 20 bp, Homo sapiens
tgtacatcatgttattttat

SEQ ID NO: 1549009 - DNA, 14 bp, Homo sapiens
tgtacatctggcct

SEQ ID NO: 1549010 - DNA, 21 bp, Homo sapiens
tgtacatggaataacatgtaa

SEQ ID NO: 1549011 - DNA, 19 bp, Homo sapiens
tgtacatggcagagtttgt

SEQ ID NO: 1549012 - DNA, 12 bp, Homo sapiens
tgtacatgtgta

SEQ ID NO: 1549013 - DNA, 16 bp, Homo sapiens
tgtacattctgcctag

SEQ ID NO: 1549014 - DNA, 17 bp, Homo sapiens
tgtacattgtgagctct

SEQ ID NO: 1549015 - DNA, 19 bp, Homo sapiens
tgtacattgtgagctctgg

SEQ ID NO: 1549016 - DNA, 22 bp, Homo sapiens
tgtacatttccaaattcacaag

SEQ ID NO: 1549017 - DNA, 19 bp, Homo sapiens
tgtacatttctaagtcaaa

SEQ ID NO: 1549018 - DNA, 15 bp, Homo sapiens
tgtaccaaaatttta

SEQ ID NO: 1549019 - DNA, 18 bp, Homo sapiens
tgtaccacatctgctcta

SEQ ID NO: 1549020 - DNA, 17 bp, Homo sapiens
tgtaccacctaatgttt

SEQ ID NO: 1549021 - DNA, 21 bp, Homo sapiens
tgtaccacttcctgaggcctc

SEQ ID NO: 1549022 - DNA, 11 bp, Homo sapiens
tgtaccagtta

SEQ ID NO: 1549023 - DNA, 20 bp, Homo sapiens
tgtaccatggtttgatatgt

SEQ ID NO: 1549024 - DNA, 12 bp, Homo sapiens
tgtaccatgtac

SEQ ID NO: 1549025 - DNA, 12 bp, Homo sapiens
tgtacccagctc

SEQ ID NO: 1549026 - DNA, 21 bp, Homo sapiens
tgtaccgggctggcctgtgcc

SEQ ID NO: 1549027 - DNA, 15 bp, Homo sapiens
tgtacctcctctcag

SEQ ID NO: 1549028 - DNA, 19 bp, Homo sapiens
tgtacctcctctcagtgtt

SEQ ID NO: 1549029 - DNA, 13 bp, Homo sapiens
tgtacctctagaa

SEQ ID NO: 1549030 - DNA, 14 bp, Homo sapiens
tgtacctctgcctc

SEQ ID NO: 1549031 - DNA, 16 bp, Homo sapiens
tgtaccttaagatatt

SEQ ID NO: 1549032 - DNA, 21 bp, Homo sapiens
tgtaccttccttaagccagga

SEQ ID NO: 1549033 - DNA, 16 bp, Homo sapiens
tgtacgtttgtatgtg

SEQ ID NO: 1549034 - DNA, 19 bp, Homo sapiens
tgtacgtttgtatgtgtgt

SEQ ID NO: 1549035 - DNA, 16 bp, Homo sapiens
tgtacgttttgcacat

SEQ ID NO: 1549036 - DNA, 21 bp, Homo sapiens
tgtacgttttgcacattttgt

SEQ ID NO: 1549037 - DNA, 22 bp, Homo sapiens
tgtactaagaatgtccttattc

SEQ ID NO: 1549038 - DNA, 13 bp, Homo sapiens
tgtactactgcct

SEQ ID NO: 1549039 - DNA, 15 bp, Homo sapiens
tgtactataagtagt

SEQ ID NO: 1549040 - DNA, 14 bp, Homo sapiens
tgtactatgtctga

SEQ ID NO: 1549041 - DNA, 18 bp, Homo sapiens
tgtactattgcagacctg

SEQ ID NO: 1549042 - DNA, 15 bp, Homo sapiens
tgtactcagagcaga

SEQ ID NO: 1549043 - DNA, 19 bp, Homo sapiens
tgtactcagagcagagcaa

SEQ ID NO: 1549044 - DNA, 14 bp, Homo sapiens
tgtactccagcctg

SEQ ID NO: 1549045 - DNA, 18 bp, Homo sapiens
tgtactccagcctgggca

SEQ ID NO: 1549046 - DNA, 20 bp, Homo sapiens
tgtactccagcctgggcaac

SEQ ID NO: 1549047 - DNA, 20 bp, Homo sapiens
tgtactcttccgatgtttgt

SEQ ID NO: 1549048 - DNA, 20 bp, Homo sapiens
tgtactctttatttctagca

SEQ ID NO: 1549049 - DNA, 12 bp, Homo sapiens
tgtactgaaaaa

SEQ ID NO: 1549050 - DNA, 20 bp, Homo sapiens
tgtactgaatttttttgtaa

SEQ ID NO: 1549051 - DNA, 19 bp, Homo sapiens
tgtactgagccttgtaatt

SEQ ID NO: 1549052 - DNA, 17 bp, Homo sapiens
tgtactgattcaagaac

SEQ ID NO: 1549053 - DNA, 22 bp, Homo sapiens
tgtactgatttttgtaagacaa

SEQ ID NO: 1549054 - DNA, 12 bp, Homo sapiens
tgtactgcatgt

SEQ ID NO: 1549055 - DNA, 20 bp, Homo sapiens
tgtactggaggctctgttct

SEQ ID NO: 1549056 - DNA, 12 bp, Homo sapiens
tgtactgggaca

SEQ ID NO: 1549057 - DNA, 15 bp, Homo sapiens
tgtactgttactggg

SEQ ID NO: 1549058 - DNA, 13 bp, Homo sapiens
tgtactgtttgct

SEQ ID NO: 1549059 - DNA, 15 bp, Homo sapiens
tgtacttaaatggta

SEQ ID NO: 1549060 - DNA, 22 bp, Homo sapiens
tgtacttaaatggtaataagca

SEQ ID NO: 1549061 - DNA, 22 bp, Homo sapiens
tgtacttaataaattcagatat

SEQ ID NO: 1549062 - DNA, 16 bp, Homo sapiens
tgtacttagctgtact

SEQ ID NO: 1549063 - DNA, 17 bp, Homo sapiens
tgtacttagctgtacta

SEQ ID NO: 1549064 - DNA, 13 bp, Homo sapiens
tgtacttcactgt

SEQ ID NO: 1549065 - DNA, 22 bp, Homo sapiens
tgtacttcccgggccagggctg

SEQ ID NO: 1549066 - DNA, 12 bp, Homo sapiens
tgtacttcctgt

SEQ ID NO: 1549067 - DNA, 16 bp, Homo sapiens
tgtacttcttattgca

SEQ ID NO: 1549068 - DNA, 19 bp, Homo sapiens
tgtactttatcatgaatgc

SEQ ID NO: 1549069 - DNA, 15 bp, Homo sapiens
tgtactttctgttaa

SEQ ID NO: 1549070 - DNA, 14 bp, Homo sapiens
tgtactttgccatt

SEQ ID NO: 1549071 - DNA, 15 bp, Homo sapiens
tgtactttgcttgct

SEQ ID NO: 1549072 - DNA, 16 bp, Homo sapiens
tgtacttttaaggcag

SEQ ID NO: 1549073 - DNA, 23 bp, Homo sapiens
tgtacttttaccagtttctttgt

SEQ ID NO: 1549074 - DNA, 15 bp, Homo sapiens
tgtactttttagtaa

SEQ ID NO: 1549075 - DNA, 13 bp, Homo sapiens
tgtacttttttct

SEQ ID NO: 1549076 - DNA, 23 bp, Homo sapiens
tgtagaaacacagttttgaaaga

SEQ ID NO: 1549077 - DNA, 15 bp, Homo sapiens
tgtagaaacacataa

SEQ ID NO: 1549078 - DNA, 21 bp, Homo sapiens
tgtagaaaggggagaatgtca

SEQ ID NO: 1549079 - DNA, 12 bp, Homo sapiens
tgtagaaatgta

SEQ ID NO: 1549080 - DNA, 17 bp, Homo sapiens
tgtagaactcactctgg

SEQ ID NO: 1549081 - DNA, 19 bp, Homo sapiens
tgtagaactcactctgggc

SEQ ID NO: 1549082 - DNA, 19 bp, Homo sapiens
tgtagaactcagcagttga

SEQ ID NO: 1549083 - DNA, 18 bp, Homo sapiens
tgtagaactgttcatttc

SEQ ID NO: 1549084 - DNA, 19 bp, Homo sapiens
tgtagaactgttcatttcc

SEQ ID NO: 1549085 - DNA, 22 bp, Homo sapiens
tgtagaactgttcatttccacc

SEQ ID NO: 1549086 - DNA, 15 bp, Homo sapiens
tgtagaactttatta

SEQ ID NO: 1549087 - DNA, 21 bp, Homo sapiens
tgtagaagatggactctgaaa

SEQ ID NO: 1549088 - DNA, 20 bp, Homo sapiens
tgtagaatctcttcatgctt

SEQ ID NO: 1549089 - DNA, 22 bp, Homo sapiens
tgtagaatctcttcatgcttga

SEQ ID NO: 1549090 - DNA, 14 bp, Homo sapiens
tgtagactgtggct

SEQ ID NO: 1549091 - DNA, 13 bp, Homo sapiens
tgtagagttgctg

SEQ ID NO: 1549092 - DNA, 22 bp, Homo sapiens
tgtagatattgttttctgtaaa

SEQ ID NO: 1549093 - DNA, 24 bp, Homo sapiens
tgtagatattgttttctgtaaata

SEQ ID NO: 1549094 - DNA, 15 bp, Homo sapiens
tgtagatgatgtatt

SEQ ID NO: 1549095 - DNA, 15 bp, Homo sapiens
tgtagattctgtgga

SEQ ID NO: 1549096 - DNA, 22 bp, Homo sapiens
tgtagattgattgtattgttga

SEQ ID NO: 1549097 - DNA, 22 bp, Homo sapiens
tgtagcaaaattcttaagtatg

SEQ ID NO: 1549098 - DNA, 14 bp, Homo sapiens
tgtagcactgaggg

SEQ ID NO: 1549099 - DNA, 20 bp, Homo sapiens
tgtagcacttacgtaaaaca

SEQ ID NO: 1549100 - DNA, 15 bp, Homo sapiens
tgtagcacttactgg

SEQ ID NO: 1549101 - DNA, 12 bp, Homo sapiens
tgtagcatactg

SEQ ID NO: 1549102 - DNA, 22 bp, Homo sapiens
tgtagcatttaaaatggaaaat

SEQ ID NO: 1549103 - DNA, 19 bp, Homo sapiens
tgtagccagccaggtgcat

SEQ ID NO: 1549104 - DNA, 20 bp, Homo sapiens
tgtagccatggctgggcgtg

SEQ ID NO: 1549105 - DNA, 23 bp, Homo sapiens
tgtagcccatccttccctttgga

SEQ ID NO: 1549106 - DNA, 19 bp, Homo sapiens
tgtagccccctggcctctg

SEQ ID NO: 1549107 - DNA, 20 bp, Homo sapiens
tgtagccccctggcctctgt

SEQ ID NO: 1549108 - DNA, 20 bp, Homo sapiens
tgtagccccttttctttggg

SEQ ID NO: 1549109 - DNA, 17 bp, Homo sapiens
tgtagcctaaagggcag

SEQ ID NO: 1549110 - DNA, 19 bp, Homo sapiens
tgtagcctaaagggcaggg

SEQ ID NO: 1549111 - DNA, 15 bp, Homo sapiens
tgtagcctgtgcatg

SEQ ID NO: 1549112 - DNA, 22 bp, Homo sapiens
tgtagcctgtgcatgtatgtct

SEQ ID NO: 1549113 - DNA, 20 bp, Homo sapiens
tgtagctataatgagcatgt

SEQ ID NO: 1549114 - DNA, 22 bp, Homo sapiens
tgtagctcaaataggtcatcat

SEQ ID NO: 1549115 - DNA, 11 bp, Homo sapiens
tgtagctcagt

SEQ ID NO: 1549116 - DNA, 17 bp, Homo sapiens
tgtagctcagtcatcaa

SEQ ID NO: 1549117 - DNA, 18 bp, Homo sapiens
tgtagctgtaagggcagt

SEQ ID NO: 1549118 - DNA, 20 bp, Homo sapiens
tgtagctgtgtggctttcct

SEQ ID NO: 1549119 - DNA, 21 bp, Homo sapiens
tgtagctgttttaagaaatct

SEQ ID NO: 1549120 - DNA, 21 bp, Homo sapiens
tgtaggaaccgtggtatgtct

SEQ ID NO: 1549121 - DNA, 20 bp, Homo sapiens
tgtaggaaggttaatgttca

SEQ ID NO: 1549122 - DNA, 18 bp, Homo sapiens
tgtaggagaaactcccat

SEQ ID NO: 1549123 - DNA, 11 bp, Homo sapiens
tgtaggagaat

SEQ ID NO: 1549124 - DNA, 12 bp, Homo sapiens
tgtaggagtgag

SEQ ID NO: 1549125 - DNA, 17 bp, Homo sapiens
tgtaggcttagtttgtg

SEQ ID NO: 1549126 - DNA, 12 bp, Homo sapiens
tgtagggaactt

SEQ ID NO: 1549127 - DNA, 15 bp, Homo sapiens
tgtagggctggacct

SEQ ID NO: 1549128 - DNA, 19 bp, Homo sapiens
tgtaggggccacctcctcc

SEQ ID NO: 1549129 - DNA, 16 bp, Homo sapiens
tgtagggttacagaga

SEQ ID NO: 1549130 - DNA, 14 bp, Homo sapiens
tgtaggtaagactg

SEQ ID NO: 1549131 - DNA, 15 bp, Homo sapiens
tgtaggtaagactgt

SEQ ID NO: 1549132 - DNA, 17 bp, Homo sapiens
tgtaggtatgaataagt

SEQ ID NO: 1549133 - DNA, 14 bp, Homo sapiens
tgtaggttgtctaa

SEQ ID NO: 1549134 - DNA, 20 bp, Homo sapiens
tgtagtaaagccgttgttta

SEQ ID NO: 1549135 - DNA, 14 bp, Homo sapiens
tgtagtaatttatt

SEQ ID NO: 1549136 - DNA, 18 bp, Homo sapiens
tgtagtcaaaaaaggaaa

SEQ ID NO: 1549137 - DNA, 15 bp, Homo sapiens
tgtagtcagttgcat

SEQ ID NO: 1549138 - DNA, 23 bp, Homo sapiens
tgtagtcccagctacttgggagg

SEQ ID NO: 1549139 - DNA, 13 bp, Homo sapiens
tgtagtctcagct

SEQ ID NO: 1549140 - DNA, 14 bp, Homo sapiens
tgtagtctcaggac

SEQ ID NO: 1549141 - DNA, 15 bp, Homo sapiens
tgtagtcttgtctta

SEQ ID NO: 1549142 - DNA, 15 bp, Homo sapiens
tgtagtggaagagca

SEQ ID NO: 1549143 - DNA, 19 bp, Homo sapiens
tgtagtggaagagcagcct

SEQ ID NO: 1549144 - DNA, 16 bp, Homo sapiens
tgtagttctgtgtact

SEQ ID NO: 1549145 - DNA, 17 bp, Homo sapiens
tgtagttctgtgtactt

SEQ ID NO: 1549146 - DNA, 20 bp, Homo sapiens
tgtagttgcgtggactctgc

SEQ ID NO: 1549147 - DNA, 19 bp, Homo sapiens
tgtagttttatttgtatta

SEQ ID NO: 1549148 - DNA, 15 bp, Homo sapiens
tgtagtttttgaaaa

SEQ ID NO: 1549149 - DNA, 19 bp, Homo sapiens
tgtataaaatctgaatttt

SEQ ID NO: 1549150 - DNA, 23 bp, Homo sapiens
tgtataaaatctgaattttgcaa

SEQ ID NO: 1549151 - DNA, 13 bp, Homo sapiens
tgtataaagaaca

SEQ ID NO: 1549152 - DNA, 12 bp, Homo sapiens
tgtataaagatt

SEQ ID NO: 1549153 - DNA, 15 bp, Homo sapiens
tgtataaagattgta

SEQ ID NO: 1549154 - DNA, 19 bp, Homo sapiens
tgtataaagattgtactta

SEQ ID NO: 1549155 - DNA, 20 bp, Homo sapiens
tgtataaataataaagaact

SEQ ID NO: 1549156 - DNA, 21 bp, Homo sapiens
tgtataaataataaagaactc

SEQ ID NO: 1549157 - DNA, 19 bp, Homo sapiens
tgtataaatatacagtata

SEQ ID NO: 1549158 - DNA, 18 bp, Homo sapiens
tgtataagtcaagcacat

SEQ ID NO: 1549159 - DNA, 21 bp, Homo sapiens
tgtataagtcaagcacatgta

SEQ ID NO: 1549160 - DNA, 13 bp, Homo sapiens
tgtataagttatt

SEQ ID NO: 1549161 - DNA, 22 bp, Homo sapiens
tgtataagttgaaggaaaatgt

SEQ ID NO: 1549162 - DNA, 16 bp, Homo sapiens
tgtataatataaaaaa

SEQ ID NO: 1549163 - DNA, 20 bp, Homo sapiens
tgtataatcccacccacctc

SEQ ID NO: 1549164 - DNA, 22 bp, Homo sapiens
tgtatacagtgcagagccttct

SEQ ID NO: 1549165 - DNA, 13 bp, Homo sapiens
tgtatacatgcca

SEQ ID NO: 1549166 - DNA, 15 bp, Homo sapiens
tgtatacatgccagt

SEQ ID NO: 1549167 - DNA, 12 bp, Homo sapiens
tgtatacatgtg

SEQ ID NO: 1549168 - DNA, 16 bp, Homo sapiens
tgtatacattttgtta

SEQ ID NO: 1549169 - DNA, 17 bp, Homo sapiens
tgtatacattttgttat

SEQ ID NO: 1549170 - DNA, 23 bp, Homo sapiens
tgtatagaccaaagcaaagaaaa

SEQ ID NO: 1549171 - DNA, 23 bp, Homo sapiens
tgtatagtaaagtgataatttct

SEQ ID NO: 1549172 - DNA, 15 bp, Homo sapiens
tgtatagtactggca

SEQ ID NO: 1549173 - DNA, 21 bp, Homo sapiens
tgtatagtactggcatggtac

SEQ ID NO: 1549174 - DNA, 11 bp, Homo sapiens
tgtatagtgtt

SEQ ID NO: 1549175 - DNA, 14 bp, Homo sapiens
tgtatagtgttcac

SEQ ID NO: 1549176 - DNA, 15 bp, Homo sapiens
tgtatagtgttcaca

SEQ ID NO: 1549177 - DNA, 22 bp, Homo sapiens
tgtatagtgttcacaaactgtg

SEQ ID NO: 1549178 - DNA, 13 bp, Homo sapiens
tgtatagttgctt

SEQ ID NO: 1549179 - DNA, 18 bp, Homo sapiens
tgtatagttgcttgcctg

SEQ ID NO: 1549180 - DNA, 16 bp, Homo sapiens
tgtatataaacatatt

SEQ ID NO: 1549181 - DNA, 19 bp, Homo sapiens
tgtatataaacatattttt

SEQ ID NO: 1549182 - DNA, 14 bp, Homo sapiens
tgtatatatatata

SEQ ID NO: 1549183 - DNA, 20 bp, Homo sapiens
tgtatatattattataatct

SEQ ID NO: 1549184 - DNA, 18 bp, Homo sapiens
tgtatatcctttctaaca

SEQ ID NO: 1549185 - DNA, 18 bp, Homo sapiens
tgtatatgattctctgtg

SEQ ID NO: 1549186 - DNA, 20 bp, Homo sapiens
tgtatatggtatatatacat

SEQ ID NO: 1549187 - DNA, 14 bp, Homo sapiens
tgtatatgtatata

SEQ ID NO: 1549188 - DNA, 17 bp, Homo sapiens
tgtatatgtattccctt

SEQ ID NO: 1549189 - DNA, 18 bp, Homo sapiens
tgggatgtcacagtccaa

SEQ ID NO: 1549190 - DNA, 22 bp, Homo sapiens
tgggatgtcacagtccaaccag

SEQ ID NO: 1549191 - DNA, 22 bp, Homo sapiens
tgggatgttcagcactgtccct

SEQ ID NO: 1549192 - DNA, 17 bp, Homo sapiens
tgggattaagaaacctt

SEQ ID NO: 1549193 - DNA, 22 bp, Homo sapiens
tgggattaagaaaccttgctct

SEQ ID NO: 1549194 - DNA, 14 bp, Homo sapiens
tgggattaagggca

SEQ ID NO: 1549195 - DNA, 15 bp, Homo sapiens
tgggattaagggcaa

SEQ ID NO: 1549196 - DNA, 17 bp, Homo sapiens
tgggattatatatccct

SEQ ID NO: 1549197 - DNA, 15 bp, Homo sapiens
tgggattcctgaccc

SEQ ID NO: 1549198 - DNA, 21 bp, Homo sapiens
tgggattgggggctggtgcca

SEQ ID NO: 1549199 - DNA, 21 bp, Homo sapiens
tgggatttcttcgctgctcta

SEQ ID NO: 1549200 - DNA, 14 bp, Homo sapiens
tgggcaaagcttgt

SEQ ID NO: 1549201 - DNA, 18 bp, Homo sapiens
tgggcaagacctcttccc

SEQ ID NO: 1549202 - DNA, 16 bp, Homo sapiens
tgggcaaggtgggtga

SEQ ID NO: 1549203 - DNA, 15 bp, Homo sapiens
tgggcaagtgattga

SEQ ID NO: 1549204 - DNA, 17 bp, Homo sapiens
tgggcacccacctccac

SEQ ID NO: 1549205 - DNA, 19 bp, Homo sapiens
tgggcacccacctccaccc

SEQ ID NO: 1549206 - DNA, 21 bp, Homo sapiens
tgggcaccgggaccccctcac

SEQ ID NO: 1549207 - DNA, 23 bp, Homo sapiens
tgggcactccgcgccgatgccac

SEQ ID NO: 1549208 - DNA, 17 bp, Homo sapiens
tgggcactggtgggcca

SEQ ID NO: 1549209 - DNA, 14 bp, Homo sapiens
tgggcagagctggc

SEQ ID NO: 1549210 - DNA, 16 bp, Homo sapiens
tgggcagagctggctc

SEQ ID NO: 1549211 - DNA, 13 bp, Homo sapiens
tgggcagcaaggc

SEQ ID NO: 1549212 - DNA, 16 bp, Homo sapiens
tgggcagcatagcaag

SEQ ID NO: 1549213 - DNA, 12 bp, Homo sapiens
tgggcagccaga

SEQ ID NO: 1549214 - DNA, 21 bp, Homo sapiens
tgggcagccagaccagcaggc

SEQ ID NO: 1549215 - DNA, 16 bp, Homo sapiens
tgggcagcccaacagc

SEQ ID NO: 1549216 - DNA, 12 bp, Homo sapiens
tgggcagctggg

SEQ ID NO: 1549217 - DNA, 14 bp, Homo sapiens
tgggcagctgggcc

SEQ ID NO: 1549218 - DNA, 15 bp, Homo sapiens
tgggcagctgggccc

SEQ ID NO: 1549219 - DNA, 22 bp, Homo sapiens
tgggcagctggggggctgtcct

SEQ ID NO: 1549220 - DNA, 12 bp, Homo sapiens
tgggcaggaagg

SEQ ID NO: 1549221 - DNA, 12 bp, Homo sapiens
tgggcagggtga

SEQ ID NO: 1549222 - DNA, 15 bp, Homo sapiens
tgggcaggtggccac

SEQ ID NO: 1549223 - DNA, 20 bp, Homo sapiens
tgggcaggtggccgcccctg

SEQ ID NO: 1549224 - DNA, 19 bp, Homo sapiens
tgggcaggtgggagctgaa

SEQ ID NO: 1549225 - DNA, 17 bp, Homo sapiens
tgggcaggtggtggcac

SEQ ID NO: 1549226 - DNA, 18 bp, Homo sapiens
tgggcagtgccacccgca

SEQ ID NO: 1549227 - DNA, 14 bp, Homo sapiens
tgggcagtgtggcc

SEQ ID NO: 1549228 - DNA, 15 bp, Homo sapiens
tgggcagttttttga

SEQ ID NO: 1549229 - DNA, 16 bp, Homo sapiens
tgggcagttttttgaa

SEQ ID NO: 1549230 - DNA, 16 bp, Homo sapiens
tgggcatccacccagt

SEQ ID NO: 1549231 - DNA, 18 bp, Homo sapiens
tgggcatccacccagtgc

SEQ ID NO: 1549232 - DNA, 20 bp, Homo sapiens
tgggcatccacccagtgctg

SEQ ID NO: 1549233 - DNA, 18 bp, Homo sapiens
tgggcatcttttgtatta

SEQ ID NO: 1549234 - DNA, 20 bp, Homo sapiens
tgggcatgacatcctttctt

SEQ ID NO: 1549235 - DNA, 18 bp, Homo sapiens
tgggcatgggtccagggc

SEQ ID NO: 1549236 - DNA, 15 bp, Homo sapiens
tgggcattgccatgt

SEQ ID NO: 1549237 - DNA, 20 bp, Homo sapiens
tgggcattgctttccactga

SEQ ID NO: 1549238 - DNA, 17 bp, Homo sapiens
tgggcattgggctgaca

SEQ ID NO: 1549239 - DNA, 18 bp, Homo sapiens
tgggcattgggctgacac

SEQ ID NO: 1549240 - DNA, 15 bp, Homo sapiens
tgggcatttggtgag

SEQ ID NO: 1549241 - DNA, 14 bp, Homo sapiens
tgggccactgggga

SEQ ID NO: 1549242 - DNA, 15 bp, Homo sapiens
tgggccactgtggtg

SEQ ID NO: 1549243 - DNA, 20 bp, Homo sapiens
tgggccagaagtaccagact

SEQ ID NO: 1549244 - DNA, 12 bp, Homo sapiens
tgggccagagct

SEQ ID NO: 1549245 - DNA, 13 bp, Homo sapiens
tgggccagagctg

SEQ ID NO: 1549246 - DNA, 16 bp, Homo sapiens
tgggccagagctgaac

SEQ ID NO: 1549247 - DNA, 16 bp, Homo sapiens
tgggccagtctgtgga

SEQ ID NO: 1549248 - DNA, 14 bp, Homo sapiens
tgggccatgtccaa

SEQ ID NO: 1549249 - DNA, 18 bp, Homo sapiens
tgggccatgtccaaagag

SEQ ID NO: 1549250 - DNA, 13 bp, Homo sapiens
tgggcccaagtga

SEQ ID NO: 1549251 - DNA, 22 bp, Homo sapiens
tgggcccagaccactgtctcca

SEQ ID NO: 1549252 - DNA, 13 bp, Homo sapiens
tgggcccagatct

SEQ ID NO: 1549253 - DNA, 12 bp, Homo sapiens
tgggcccagctg

SEQ ID NO: 1549254 - DNA, 19 bp, Homo sapiens
tgggcccagctgggctctg

SEQ ID NO: 1549255 - DNA, 19 bp, Homo sapiens
tgggcccaggaccagctgg

SEQ ID NO: 1549256 - DNA, 23 bp, Homo sapiens
tgggcccaggaccagctggggcg

SEQ ID NO: 1549257 - DNA, 17 bp, Homo sapiens
tgggcccaggcaggtct

SEQ ID NO: 1549258 - DNA, 18 bp, Homo sapiens
tgggccccaccacctagg

SEQ ID NO: 1549259 - DNA, 17 bp, Homo sapiens
tgggccccaccatttat

SEQ ID NO: 1549260 - DNA, 13 bp, Homo sapiens
tgggccccatgct

SEQ ID NO: 1549261 - DNA, 20 bp, Homo sapiens
tgggccccatgctctgcccc

SEQ ID NO: 1549262 - DNA, 23 bp, Homo sapiens
tgggccccgggctggagaaagag

SEQ ID NO: 1549263 - DNA, 14 bp, Homo sapiens
tgggcccctgagga

SEQ ID NO: 1549264 - DNA, 16 bp, Homo sapiens
tgggcccctgaggagc

SEQ ID NO: 1549265 - DNA, 17 bp, Homo sapiens
tgggcccctgaggagct

SEQ ID NO: 1549266 - DNA, 15 bp, Homo sapiens
tgggcccctggcccc

SEQ ID NO: 1549267 - DNA, 19 bp, Homo sapiens
tgggccctatgtctcagga

SEQ ID NO: 1549268 - DNA, 23 bp, Homo sapiens
tgggccctatgtctcaggagtgg

SEQ ID NO: 1549269 - DNA, 16 bp, Homo sapiens
tgggccctctctctgg

SEQ ID NO: 1549270 - DNA, 20 bp, Homo sapiens
tgggccctgcattggcctgg

SEQ ID NO: 1549271 - DNA, 22 bp, Homo sapiens
tgggccctgcattggcctggcc

SEQ ID NO: 1549272 - DNA, 14 bp, Homo sapiens
tgggccgaaagaga

SEQ ID NO: 1549273 - DNA, 14 bp, Homo sapiens
tgggccgcccctgg

SEQ ID NO: 1549274 - DNA, 20 bp, Homo sapiens
tgggccggctgagtggcagc

SEQ ID NO: 1549275 - DNA, 23 bp, Homo sapiens
tgggcctccatgccccagctctg

SEQ ID NO: 1549276 - DNA, 20 bp, Homo sapiens
tgggcctgagggtccacctg

SEQ ID NO: 1549277 - DNA, 22 bp, Homo sapiens
tgggcctgagggtccacctgga

SEQ ID NO: 1549278 - DNA, 20 bp, Homo sapiens
tgggcctgcccaatgctttg

SEQ ID NO: 1549279 - DNA, 15 bp, Homo sapiens
tgggcctgctccaga

SEQ ID NO: 1549280 - DNA, 18 bp, Homo sapiens
tgggcctgctccagacct

SEQ ID NO: 1549281 - DNA, 19 bp, Homo sapiens
tgggcctgctccagacctg

SEQ ID NO: 1549282 - DNA, 23 bp, Homo sapiens
tgggcctgcttttccaggatcct

SEQ ID NO: 1549283 - DNA, 11 bp, Homo sapiens
tgggcctggcc

SEQ ID NO: 1549284 - DNA, 13 bp, Homo sapiens
tgggcctggccag

SEQ ID NO: 1549285 - DNA, 20 bp, Homo sapiens
tgggcctggcctgagctggg

SEQ ID NO: 1549286 - DNA, 21 bp, Homo sapiens
tgggcctgtcgtgccagtcct

SEQ ID NO: 1549287 - DNA, 15 bp, Homo sapiens
tgggcctgtgcagca

SEQ ID NO: 1549288 - DNA, 16 bp, Homo sapiens
tgggcctgtgcagcag

SEQ ID NO: 1549289 - DNA, 11 bp, Homo sapiens
tgggcctgttc

SEQ ID NO: 1549290 - DNA, 17 bp, Homo sapiens
tgggccttgctttgggc

SEQ ID NO: 1549291 - DNA, 16 bp, Homo sapiens
tgggcgcaaaggtgcc

SEQ ID NO: 1549292 - DNA, 15 bp, Homo sapiens
tgggcgcccaccctg

SEQ ID NO: 1549293 - DNA, 21 bp, Homo sapiens
tgggcgcccaccctgggctcc

SEQ ID NO: 1549294 - DNA, 15 bp, Homo sapiens
tgggcgctctcccta

SEQ ID NO: 1549295 - DNA, 12 bp, Homo sapiens
tgggcggctgag

SEQ ID NO: 1549296 - DNA, 14 bp, Homo sapiens
tgggcggctgagag

SEQ ID NO: 1549297 - DNA, 16 bp, Homo sapiens
tgggcggctgagagcc

SEQ ID NO: 1549298 - DNA, 17 bp, Homo sapiens
tgggcgtctgagctggg

SEQ ID NO: 1549299 - DNA, 22 bp, Homo sapiens
tgggcgtggtagtgcaagctga

SEQ ID NO: 1549300 - DNA, 14 bp, Homo sapiens
tgggcgtgtgtgac

SEQ ID NO: 1549301 - DNA, 18 bp, Homo sapiens
tgggcgtgtgtgacactg

SEQ ID NO: 1549302 - DNA, 19 bp, Homo sapiens
tgggctacatgctggggtc

SEQ ID NO: 1549303 - DNA, 17 bp, Homo sapiens
tgggctaccatctgcat

SEQ ID NO: 1549304 - DNA, 18 bp, Homo sapiens
tgggctaccctaaaggga

SEQ ID NO: 1549305 - DNA, 19 bp, Homo sapiens
tgggctactggcagctcct

SEQ ID NO: 1549306 - DNA, 19 bp, Homo sapiens
tgggctagtgtgagtggca

SEQ ID NO: 1549307 - DNA, 21 bp, Homo sapiens
tgggctagtgtgagtggcagc

SEQ ID NO: 1549308 - DNA, 22 bp, Homo sapiens
tgggctagtgtgagtggcagcc

SEQ ID NO: 1549309 - DNA, 15 bp, Homo sapiens
tgggctataaaatat

SEQ ID NO: 1549310 - DNA, 17 bp, Homo sapiens
tgggctatagcacacag

SEQ ID NO: 1549311 - DNA, 19 bp, Homo sapiens
tgggctatttggactcagg

SEQ ID NO: 1549312 - DNA, 20 bp, Homo sapiens
tgggctcaaatgatcctccc

SEQ ID NO: 1549313 - DNA, 16 bp, Homo sapiens
tgggctcactgtgctg

SEQ ID NO: 1549314 - DNA, 16 bp, Homo sapiens
tgggctcagggttggc

SEQ ID NO: 1549315 - DNA, 20 bp, Homo sapiens
tgggctcagggttggccatt

SEQ ID NO: 1549316 - DNA, 15 bp, Homo sapiens
tgggctccacacagc

SEQ ID NO: 1549317 - DNA, 22 bp, Homo sapiens
tgggctccacacagcagtgtcc

SEQ ID NO: 1549318 - DNA, 14 bp, Homo sapiens
tgggctcccaccct

SEQ ID NO: 1549319 - DNA, 17 bp, Homo sapiens
tgggctcctggaaccaa

SEQ ID NO: 1549320 - DNA, 20 bp, Homo sapiens
tgggctcctggctgccaggc

SEQ ID NO: 1549321 - DNA, 21 bp, Homo sapiens
tgggctcgccgtgtctcagcc

SEQ ID NO: 1549322 - DNA, 14 bp, Homo sapiens
tgggctctccacct

SEQ ID NO: 1549323 - DNA, 15 bp, Homo sapiens
tgggctctccacctc

SEQ ID NO: 1549324 - DNA, 16 bp, Homo sapiens
tgggctctccacctca

SEQ ID NO: 1549325 - DNA, 17 bp, Homo sapiens
tgggctctccacctcag

SEQ ID NO: 1549326 - DNA, 18 bp, Homo sapiens
tgggctctccacctcagc

SEQ ID NO: 1549327 - DNA, 11 bp, Homo sapiens
tgggctctgac

SEQ ID NO: 1549328 - DNA, 22 bp, Homo sapiens
tgggctctgcaattcccctctg

SEQ ID NO: 1549329 - DNA, 15 bp, Homo sapiens
tgggctctgccccag

SEQ ID NO: 1549330 - DNA, 14 bp, Homo sapiens
tgggctctggctct

SEQ ID NO: 1549331 - DNA, 22 bp, Homo sapiens
tgggctctggttttctggtggg

SEQ ID NO: 1549332 - DNA, 12 bp, Homo sapiens
tgggctctgtgc

SEQ ID NO: 1549333 - DNA, 18 bp, Homo sapiens
tgggctctgtgcagtcac

SEQ ID NO: 1549334 - DNA, 21 bp, Homo sapiens
tgggctgaactgagcctagct

SEQ ID NO: 1549335 - DNA, 14 bp, Homo sapiens
tgggctgaagtgtt

SEQ ID NO: 1549336 - DNA, 13 bp, Homo sapiens
tgggctgacacct

SEQ ID NO: 1549337 - DNA, 21 bp, Homo sapiens
tgggctgacacctaccatgct

SEQ ID NO: 1549338 - DNA, 14 bp, Homo sapiens
tgggctgagcccct

SEQ ID NO: 1549339 - DNA, 15 bp, Homo sapiens
tgggctgagccctgg

SEQ ID NO: 1549340 - DNA, 17 bp, Homo sapiens
tgggctgagccctggca

SEQ ID NO: 1549341 - DNA, 12 bp, Homo sapiens
tgggctgagtga

SEQ ID NO: 1549342 - DNA, 17 bp, Homo sapiens
tgggctgagtgacacaa

SEQ ID NO: 1549343 - DNA, 13 bp, Homo sapiens
tgggctgccctgg

SEQ ID NO: 1549344 - DNA, 14 bp, Homo sapiens
tgggctgccctggt

SEQ ID NO: 1549345 - DNA, 20 bp, Homo sapiens
tgggctggaacgtgaactca

SEQ ID NO: 1549346 - DNA, 22 bp, Homo sapiens
tgggctgggccctctcttctca

SEQ ID NO: 1549347 - DNA, 18 bp, Homo sapiens
tgggctggggaggaggag

SEQ ID NO: 1549348 - DNA, 21 bp, Homo sapiens
tgggctggggaggaggagaga

SEQ ID NO: 1549349 - DNA, 18 bp, Homo sapiens
tgggctgggtggcccctg

SEQ ID NO: 1549350 - DNA, 14 bp, Homo sapiens
tgggctggtatctc

SEQ ID NO: 1549351 - DNA, 18 bp, Homo sapiens
tgggctggtatctcagaa

SEQ ID NO: 1549352 - DNA, 23 bp, Homo sapiens
tgggctggtatctcagaaagtgc

SEQ ID NO: 1549353 - DNA, 16 bp, Homo sapiens
tgggctggttgctgta

SEQ ID NO: 1549354 - DNA, 20 bp, Homo sapiens
tgggctgtaacgtggcactg

SEQ ID NO: 1549355 - DNA, 22 bp, Homo sapiens
tgggctgtgagtgtaagtgtga

SEQ ID NO: 1549356 - DNA, 14 bp, Homo sapiens
tgggcttaagaaat

SEQ ID NO: 1549357 - DNA, 16 bp, Homo sapiens
tgggcttagtatttct

SEQ ID NO: 1549358 - DNA, 19 bp, Homo sapiens
tgggcttagtatttctcag

SEQ ID NO: 1549359 - DNA, 20 bp, Homo sapiens
tgggcttagtatttctcagg

SEQ ID NO: 1549360 - DNA, 23 bp, Homo sapiens
tgggcttagtatttctcaggaag

SEQ ID NO: 1549361 - DNA, 20 bp, Homo sapiens
tgggcttatatctggcctct

SEQ ID NO: 1549362 - DNA, 22 bp, Homo sapiens
tgggcttatatctggcctctgc

SEQ ID NO: 1549363 - DNA, 17 bp, Homo sapiens
tgggcttatgtctctgc

SEQ ID NO: 1549364 - DNA, 22 bp, Homo sapiens
tgggcttcaatcactgtaacct

SEQ ID NO: 1549365 - DNA, 15 bp, Homo sapiens
tgggcttcattccgg

SEQ ID NO: 1549366 - DNA, 17 bp, Homo sapiens
tgggcttcattctggaa

SEQ ID NO: 1549367 - DNA, 18 bp, Homo sapiens
tgggcttcattctggaaa

SEQ ID NO: 1549368 - DNA, 11 bp, Homo sapiens
tgggcttgaca

SEQ ID NO: 1549369 - DNA, 21 bp, Homo sapiens
tgggcttgacacctgtcttga

SEQ ID NO: 1549370 - DNA, 16 bp, Homo sapiens
tgggcttggcctgctg

SEQ ID NO: 1549371 - DNA, 17 bp, Homo sapiens
tgggctttgcaggctct

SEQ ID NO: 1549372 - DNA, 20 bp, Homo sapiens
tgggctttgcaggctctggg

SEQ ID NO: 1549373 - DNA, 22 bp, Homo sapiens
tgggctttgcaggctctgggct

SEQ ID NO: 1549374 - DNA, 19 bp, Homo sapiens
tggggaaaatggccatgca

SEQ ID NO: 1549375 - DNA, 23 bp, Homo sapiens
tggggaaaatggccatgcaggag

SEQ ID NO: 1549376 - DNA, 21 bp, Homo sapiens
tggggaaaccctggagccatc

SEQ ID NO: 1549377 - DNA, 22 bp, Homo sapiens
tggggaaagacactgcctgggc

SEQ ID NO: 1549378 - DNA, 21 bp, Homo sapiens
tggggaacatggctggcctgg

SEQ ID NO: 1549379 - DNA, 18 bp, Homo sapiens
tggggaagacagtggccc

SEQ ID NO: 1549380 - DNA, 19 bp, Homo sapiens
tggggaagaggatgagcag

SEQ ID NO: 1549381 - DNA, 21 bp, Homo sapiens
tggggaagaggatgagcagag

SEQ ID NO: 1549382 - DNA, 23 bp, Homo sapiens
tggggaaggtggagcagctgcag

SEQ ID NO: 1549383 - DNA, 16 bp, Homo sapiens
tggggaatttcctcta

SEQ ID NO: 1549384 - DNA, 22 bp, Homo sapiens
tggggacagcttcctcacaccc

SEQ ID NO: 1549385 - DNA, 15 bp, Homo sapiens
tggggacagttggca

SEQ ID NO: 1549386 - DNA, 19 bp, Homo sapiens
tggggacagttggcagaga

SEQ ID NO: 1549387 - DNA, 14 bp, Homo sapiens
tggggaccaggagc

SEQ ID NO: 1549388 - DNA, 18 bp, Homo sapiens
tggggacgggggctgctt

SEQ ID NO: 1549389 - DNA, 20 bp, Homo sapiens
tggggacgggggctgcttct

SEQ ID NO: 1549390 - DNA, 21 bp, Homo sapiens
tggggacgggggctgcttctc

SEQ ID NO: 1549391 - DNA, 16 bp, Homo sapiens
tggggactcaggacca

SEQ ID NO: 1549392 - DNA, 22 bp, Homo sapiens
tggggactcaggaccagatgtc

SEQ ID NO: 1549393 - DNA, 11 bp, Homo sapiens
tggggagaaat

SEQ ID NO: 1549394 - DNA, 21 bp, Homo sapiens
tggggagacagttgagagcgg

SEQ ID NO: 1549395 - DNA, 19 bp, Homo sapiens
tggggagagcggctggaga

SEQ ID NO: 1549396 - DNA, 20 bp, Homo sapiens
tggggagagcggctggagaa

SEQ ID NO: 1549397 - DNA, 17 bp, Homo sapiens
tggggagcagagacact

SEQ ID NO: 1549398 - DNA, 20 bp, Homo sapiens
tggggagcagttttcccctg

SEQ ID NO: 1549399 - DNA, 22 bp, Homo sapiens
tggggagcagttttcccctggc

SEQ ID NO: 1549400 - DNA, 22 bp, Homo sapiens
tggggagccaacagaagcttcc

SEQ ID NO: 1549401 - DNA, 18 bp, Homo sapiens
tggggagcccgtctcagt

SEQ ID NO: 1549402 - DNA, 19 bp, Homo sapiens
tggggagcccgtctcagtg

SEQ ID NO: 1549403 - DNA, 21 bp, Homo sapiens
tggggagcccgtctcagtgtt

SEQ ID NO: 1549404 - DNA, 21 bp, Homo sapiens
tggggagccgagggcgtcaga

SEQ ID NO: 1549405 - DNA, 13 bp, Homo sapiens
tggggaggcaggc

SEQ ID NO: 1549406 - DNA, 16 bp, Homo sapiens
tggggagggagcctcg

SEQ ID NO: 1549407 - DNA, 22 bp, Homo sapiens
tggggagggatttggggctcag

SEQ ID NO: 1549408 - DNA, 21 bp, Homo sapiens
tggggagggccgtaccccacc

SEQ ID NO: 1549409 - DNA, 15 bp, Homo sapiens
tggggaggggcgctg

SEQ ID NO: 1549410 - DNA, 19 bp, Homo sapiens
tggggaggggcgctggccc

SEQ ID NO: 1549411 - DNA, 23 bp, Homo sapiens
tggggaggggcgctggcccagcc

SEQ ID NO: 1549412 - DNA, 22 bp, Homo sapiens
tggggagggggaagagaaattt

SEQ ID NO: 1549413 - DNA, 21 bp, Homo sapiens
tggggaggggggtaatagtga

SEQ ID NO: 1549414 - DNA, 22 bp, Homo sapiens
tggggagtcctcattgaatcct

SEQ ID NO: 1549415 - DNA, 18 bp, Homo sapiens
tggggagttaagacctgg

SEQ ID NO: 1549416 - DNA, 15 bp, Homo sapiens
tggggatagaggaaa

SEQ ID NO: 1549417 - DNA, 17 bp, Homo sapiens
tggggatagatgtgtgg

SEQ ID NO: 1549418 - DNA, 18 bp, Homo sapiens
tggggatagatgtgtgga

SEQ ID NO: 1549419 - DNA, 23 bp, Homo sapiens
tggggatccccgcctggccagga

SEQ ID NO: 1549420 - DNA, 14 bp, Homo sapiens
tggggatcgatgtg

SEQ ID NO: 1549421 - DNA, 20 bp, Homo sapiens
tggctgcttaaactggaaag

SEQ ID NO: 1549422 - DNA, 16 bp, Homo sapiens
tggctgcttcctgtga

SEQ ID NO: 1549423 - DNA, 19 bp, Homo sapiens
tggctggaagatcctgcgg

SEQ ID NO: 1549424 - DNA, 17 bp, Homo sapiens
tggctggagagctgcta

SEQ ID NO: 1549425 - DNA, 19 bp, Homo sapiens
tggctggcctcacccaccc

SEQ ID NO: 1549426 - DNA, 11 bp, Homo sapiens
tggctggcctg

SEQ ID NO: 1549427 - DNA, 23 bp, Homo sapiens
tggctggcttgtttgatttcaac

SEQ ID NO: 1549428 - DNA, 20 bp, Homo sapiens
tggctgggaacatgacccag

SEQ ID NO: 1549429 - DNA, 20 bp, Homo sapiens
tggctgggcagagctgcatc

SEQ ID NO: 1549430 - DNA, 12 bp, Homo sapiens
tggctgggcatg

SEQ ID NO: 1549431 - DNA, 13 bp, Homo sapiens
tggctgggcccag

SEQ ID NO: 1549432 - DNA, 15 bp, Homo sapiens
tggctgggcccagca

SEQ ID NO: 1549433 - DNA, 18 bp, Homo sapiens
tggctgggcccagcaggg

SEQ ID NO: 1549434 - DNA, 16 bp, Homo sapiens
tggctgggccttcacc

SEQ ID NO: 1549435 - DNA, 20 bp, Homo sapiens
tggctgggctggctgaagaa

SEQ ID NO: 1549436 - DNA, 16 bp, Homo sapiens
tggctggggcagaggg

SEQ ID NO: 1549437 - DNA, 14 bp, Homo sapiens
tggctgggtcaggg

SEQ ID NO: 1549438 - DNA, 20 bp, Homo sapiens
tggctgggtcagggccagac

SEQ ID NO: 1549439 - DNA, 23 bp, Homo sapiens
tggctgggtcagggccagactgg

SEQ ID NO: 1549440 - DNA, 22 bp, Homo sapiens
tggctgggtccttgggcctggc

SEQ ID NO: 1549441 - DNA, 19 bp, Homo sapiens
tggctgggtgccctctcag

SEQ ID NO: 1549442 - DNA, 21 bp, Homo sapiens
tggctggtagcagcaggctca

SEQ ID NO: 1549443 - DNA, 17 bp, Homo sapiens
tggctggtgggaaggcc

SEQ ID NO: 1549444 - DNA, 14 bp, Homo sapiens
tggctggtgtatgc

SEQ ID NO: 1549445 - DNA, 19 bp, Homo sapiens
tggctgtaaggctctagat

SEQ ID NO: 1549446 - DNA, 21 bp, Homo sapiens
tggctgtaaggctctagatca

SEQ ID NO: 1549447 - DNA, 20 bp, Homo sapiens
tggctgtaatgacaaaagat

SEQ ID NO: 1549448 - DNA, 22 bp, Homo sapiens
tggctgtcaggacaccagcctg

SEQ ID NO: 1549449 - DNA, 16 bp, Homo sapiens
tggctgtctagaatgt

SEQ ID NO: 1549450 - DNA, 21 bp, Homo sapiens
tggctgtctgaccagagaatg

SEQ ID NO: 1549451 - DNA, 17 bp, Homo sapiens
tggctgtctgtgggccg

SEQ ID NO: 1549452 - DNA, 22 bp, Homo sapiens
tggctgtgaatgccaaagccat

SEQ ID NO: 1549453 - DNA, 11 bp, Homo sapiens
tggctgtgaca

SEQ ID NO: 1549454 - DNA, 18 bp, Homo sapiens
tggctgtgacacctggtg

SEQ ID NO: 1549455 - DNA, 19 bp, Homo sapiens
tggctgtgacacctggtgc

SEQ ID NO: 1549456 - DNA, 16 bp, Homo sapiens
tggctgtgatgagtgt

SEQ ID NO: 1549457 - DNA, 15 bp, Homo sapiens
tggctgtgcccagca

SEQ ID NO: 1549458 - DNA, 16 bp, Homo sapiens
tggctgtgcccagcag

SEQ ID NO: 1549459 - DNA, 20 bp, Homo sapiens
tggctgtgcccagcaggccc

SEQ ID NO: 1549460 - DNA, 22 bp, Homo sapiens
tggctgtgcccagcaggcccag

SEQ ID NO: 1549461 - DNA, 13 bp, Homo sapiens
tggctgtgcccct

SEQ ID NO: 1549462 - DNA, 16 bp, Homo sapiens
tggctgtgcccctgat

SEQ ID NO: 1549463 - DNA, 19 bp, Homo sapiens
tggctgtgcccctgatgca

SEQ ID NO: 1549464 - DNA, 14 bp, Homo sapiens
tggctgtggcacag

SEQ ID NO: 1549465 - DNA, 23 bp, Homo sapiens
tggctgtggcacagacttctgga

SEQ ID NO: 1549466 - DNA, 19 bp, Homo sapiens
tggctgtggcatttccaaa

SEQ ID NO: 1549467 - DNA, 14 bp, Homo sapiens
tggctgtgtgacag

SEQ ID NO: 1549468 - DNA, 21 bp, Homo sapiens
tggctgtgtttgcagcctgct

SEQ ID NO: 1549469 - DNA, 22 bp, Homo sapiens
tggctgttaagaagtttgttat

SEQ ID NO: 1549470 - DNA, 23 bp, Homo sapiens
tggctgttgagatgtgctttgct

SEQ ID NO: 1549471 - DNA, 21 bp, Homo sapiens
tggcttaaagggatggacttg

SEQ ID NO: 1549472 - DNA, 21 bp, Homo sapiens
tggcttaagtgagcagaacag

SEQ ID NO: 1549473 - DNA, 14 bp, Homo sapiens
tggcttaatgttta

SEQ ID NO: 1549474 - DNA, 13 bp, Homo sapiens
tggcttatttcta

SEQ ID NO: 1549475 - DNA, 17 bp, Homo sapiens
tggcttcaaaatagaga

SEQ ID NO: 1549476 - DNA, 16 bp, Homo sapiens
tggcttcagcccccac

SEQ ID NO: 1549477 - DNA, 18 bp, Homo sapiens
tggcttcagcccccacca

SEQ ID NO: 1549478 - DNA, 20 bp, Homo sapiens
tggcttcagcccccaccagg

SEQ ID NO: 1549479 - DNA, 16 bp, Homo sapiens
tggcttccatgatggt

SEQ ID NO: 1549480 - DNA, 20 bp, Homo sapiens
tggcttcccgctcagccctc

SEQ ID NO: 1549481 - DNA, 15 bp, Homo sapiens
tggcttcctccgtcc

SEQ ID NO: 1549482 - DNA, 14 bp, Homo sapiens
tggcttcctcctga

SEQ ID NO: 1549483 - DNA, 18 bp, Homo sapiens
tggcttctagtttgcaac

SEQ ID NO: 1549484 - DNA, 15 bp, Homo sapiens
tggcttctcctgtga

SEQ ID NO: 1549485 - DNA, 11 bp, Homo sapiens
tggcttctctc

SEQ ID NO: 1549486 - DNA, 13 bp, Homo sapiens
tggcttctctctt

SEQ ID NO: 1549487 - DNA, 21 bp, Homo sapiens
tggcttctgcttgtcatccac

SEQ ID NO: 1549488 - DNA, 13 bp, Homo sapiens
tggcttctgtgat

SEQ ID NO: 1549489 - DNA, 14 bp, Homo sapiens
tggcttgctccagg

SEQ ID NO: 1549490 - DNA, 11 bp, Homo sapiens
tggcttggagg

SEQ ID NO: 1549491 - DNA, 17 bp, Homo sapiens
tggcttggagtggccaa

SEQ ID NO: 1549492 - DNA, 20 bp, Homo sapiens
tggcttggggattgtacacg

SEQ ID NO: 1549493 - DNA, 17 bp, Homo sapiens
tggcttgtaactccacc

SEQ ID NO: 1549494 - DNA, 13 bp, Homo sapiens
tggcttgtacatt

SEQ ID NO: 1549495 - DNA, 22 bp, Homo sapiens
tggcttgtacatttttaaattc

SEQ ID NO: 1549496 - DNA, 24 bp, Homo sapiens
tggcttgtatcaacactgttactt

SEQ ID NO: 1549497 - DNA, 15 bp, Homo sapiens
tggcttgtttgattt

SEQ ID NO: 1549498 - DNA, 17 bp, Homo sapiens
tggcttgtttgatttca

SEQ ID NO: 1549499 - DNA, 15 bp, Homo sapiens
tggctttaagccttc

SEQ ID NO: 1549500 - DNA, 23 bp, Homo sapiens
tggctttaagccttcaaaactat

SEQ ID NO: 1549501 - DNA, 14 bp, Homo sapiens
tggctttaattgta

SEQ ID NO: 1549502 - DNA, 19 bp, Homo sapiens
tggctttatgcaaatacaa

SEQ ID NO: 1549503 - DNA, 14 bp, Homo sapiens
tggctttcagagcc

SEQ ID NO: 1549504 - DNA, 14 bp, Homo sapiens
tggctttctctctg

SEQ ID NO: 1549505 - DNA, 20 bp, Homo sapiens
tggctttctctctggcttct

SEQ ID NO: 1549506 - DNA, 21 bp, Homo sapiens
tggctttctctctggcttctc

SEQ ID NO: 1549507 - DNA, 22 bp, Homo sapiens
tggctttctctctggcttctct

SEQ ID NO: 1549508 - DNA, 13 bp, Homo sapiens
tggctttgcccac

SEQ ID NO: 1549509 - DNA, 18 bp, Homo sapiens
tggctttgcccacccctc

SEQ ID NO: 1549510 - DNA, 12 bp, Homo sapiens
tggctttgcctc

SEQ ID NO: 1549511 - DNA, 22 bp, Homo sapiens
tggctttgctctattaagattg

SEQ ID NO: 1549512 - DNA, 15 bp, Homo sapiens
tggctttggcagtgt

SEQ ID NO: 1549513 - DNA, 17 bp, Homo sapiens
tggcttttacccttttt

SEQ ID NO: 1549514 - DNA, 12 bp, Homo sapiens
tggcttttactt

SEQ ID NO: 1549515 - DNA, 20 bp, Homo sapiens
tggcttttactttattaata

SEQ ID NO: 1549516 - DNA, 16 bp, Homo sapiens
tggcttttcactgctg

SEQ ID NO: 1549517 - DNA, 21 bp, Homo sapiens
tggcttttcactgctggctgc

SEQ ID NO: 1549518 - DNA, 19 bp, Homo sapiens
tggcttttgcctgtaagaa

SEQ ID NO: 1549519 - DNA, 17 bp, Homo sapiens
tggcttttgctttccct

SEQ ID NO: 1549520 - DNA, 15 bp, Homo sapiens
tggctttttctgcca

SEQ ID NO: 1549521 - DNA, 23 bp, Homo sapiens
tggctttttctgccactgaggag

SEQ ID NO: 1549522 - DNA, 18 bp, Homo sapiens
tggctttttgttcagaat

SEQ ID NO: 1549523 - DNA, 17 bp, Homo sapiens
tggcttttttgtggggt

SEQ ID NO: 1549524 - DNA, 21 bp, Homo sapiens
tgggaaaaaagttttgatgaa

SEQ ID NO: 1549525 - DNA, 22 bp, Homo sapiens
tgggaaaaaagttttgatgaaa

SEQ ID NO: 1549526 - DNA, 19 bp, Homo sapiens
tgggaaaatatttcctgac

SEQ ID NO: 1549527 - DNA, 20 bp, Homo sapiens
tgggaaactgggtttctcat

SEQ ID NO: 1549528 - DNA, 21 bp, Homo sapiens
tgggaaagaaggcaaagtccc

SEQ ID NO: 1549529 - DNA, 14 bp, Homo sapiens
tgggaaagcattgt

SEQ ID NO: 1549530 - DNA, 18 bp, Homo sapiens
tgggaaagcattgtaaat

SEQ ID NO: 1549531 - DNA, 21 bp, Homo sapiens
tgggaaagcattgtaaatgtg

SEQ ID NO: 1549532 - DNA, 20 bp, Homo sapiens
tgggaaagcggcgccacaga

SEQ ID NO: 1549533 - DNA, 21 bp, Homo sapiens
tgggaaaggaggcatgcctct

SEQ ID NO: 1549534 - DNA, 16 bp, Homo sapiens
tgggaaaggagtagaa

SEQ ID NO: 1549535 - DNA, 16 bp, Homo sapiens
tgggaaagtattctgt

SEQ ID NO: 1549536 - DNA, 13 bp, Homo sapiens
tgggaacactggc

SEQ ID NO: 1549537 - DNA, 15 bp, Homo sapiens
tggcatcacagggca

SEQ ID NO: 1549538 - DNA, 20 bp, Homo sapiens
tggcatcacagggcagagcc

SEQ ID NO: 1549539 - DNA, 23 bp, Homo sapiens
tggcatcgaccacaccagcctcc

SEQ ID NO: 1549540 - DNA, 17 bp, Homo sapiens
tggcatctcctgtcctg

SEQ ID NO: 1549541 - DNA, 17 bp, Homo sapiens
tggcatcttcaatatga

SEQ ID NO: 1549542 - DNA, 16 bp, Homo sapiens
tggcatcttctggaga

SEQ ID NO: 1549543 - DNA, 16 bp, Homo sapiens
tggcatgcttaaattt

SEQ ID NO: 1549544 - DNA, 16 bp, Homo sapiens
tggcatggaaggggct

SEQ ID NO: 1549545 - DNA, 18 bp, Homo sapiens
tggcatggaaggggcttc

SEQ ID NO: 1549546 - DNA, 14 bp, Homo sapiens
tggcatggcacctg

SEQ ID NO: 1549547 - DNA, 15 bp, Homo sapiens
tggcatgttgatttc

SEQ ID NO: 1549548 - DNA, 13 bp, Homo sapiens
tggcatgttttga

SEQ ID NO: 1549549 - DNA, 17 bp, Homo sapiens
tggcattagaattattt

SEQ ID NO: 1549550 - DNA, 18 bp, Homo sapiens
tggcattatgtccactgt

SEQ ID NO: 1549551 - DNA, 14 bp, Homo sapiens
tggcattgatctta

SEQ ID NO: 1549552 - DNA, 16 bp, Homo sapiens
tggcattgatcttaaa

SEQ ID NO: 1549553 - DNA, 21 bp, Homo sapiens
tggcatttcaattcctggccc

SEQ ID NO: 1549554 - DNA, 14 bp, Homo sapiens
tggcatttccaaac

SEQ ID NO: 1549555 - DNA, 12 bp, Homo sapiens
tggcatttctat

SEQ ID NO: 1549556 - DNA, 16 bp, Homo sapiens
tggcatttctatactt

SEQ ID NO: 1549557 - DNA, 17 bp, Homo sapiens
tggcatttctatacttt

SEQ ID NO: 1549558 - DNA, 16 bp, Homo sapiens
tggcatttctctttaa

SEQ ID NO: 1549559 - DNA, 23 bp, Homo sapiens
tggcatttctctttaaactatgt

SEQ ID NO: 1549560 - DNA, 18 bp, Homo sapiens
tggcatttggtctcaggc

SEQ ID NO: 1549561 - DNA, 21 bp, Homo sapiens
tggcatttggtctcaggcagc

SEQ ID NO: 1549562 - DNA, 21 bp, Homo sapiens
tggccaaacatcagacctgtc

SEQ ID NO: 1549563 - DNA, 21 bp, Homo sapiens
tggccaaataggagggagact

SEQ ID NO: 1549564 - DNA, 15 bp, Homo sapiens
tggccaacatggtga

SEQ ID NO: 1549565 - DNA, 23 bp, Homo sapiens
tggccaactgcaaaaaaagcctc

SEQ ID NO: 1549566 - DNA, 13 bp, Homo sapiens
tggccaagcagaa

SEQ ID NO: 1549567 - DNA, 21 bp, Homo sapiens
tggccaaggtgtccagggtcc

SEQ ID NO: 1549568 - DNA, 20 bp, Homo sapiens
tggccacaaggaaaaggagg

SEQ ID NO: 1549569 - DNA, 22 bp, Homo sapiens
tggccacaaggaaaaggaggag

SEQ ID NO: 1549570 - DNA, 14 bp, Homo sapiens
tggccacagccccc

SEQ ID NO: 1549571 - DNA, 22 bp, Homo sapiens
tggccacatttaatatcttcag

SEQ ID NO: 1549572 - DNA, 12 bp, Homo sapiens
tggccaccaggc

SEQ ID NO: 1549573 - DNA, 15 bp, Homo sapiens
tggccaccaggctgg

SEQ ID NO: 1549574 - DNA, 18 bp, Homo sapiens
tggccaccaggctggcgc

SEQ ID NO: 1549575 - DNA, 11 bp, Homo sapiens
tggccaccagt

SEQ ID NO: 1549576 - DNA, 20 bp, Homo sapiens
tggccaccccgtgccacccg

SEQ ID NO: 1549577 - DNA, 19 bp, Homo sapiens
tggccacccgttctgctgg

SEQ ID NO: 1549578 - DNA, 22 bp, Homo sapiens
tggccacccgttctgctggcct

SEQ ID NO: 1549579 - DNA, 14 bp, Homo sapiens
tggccaccctggcc

SEQ ID NO: 1549580 - DNA, 21 bp, Homo sapiens
tggccacctagaagtctccct

SEQ ID NO: 1549581 - DNA, 20 bp, Homo sapiens
tggccacctctctcctttgc

SEQ ID NO: 1549582 - DNA, 17 bp, Homo sapiens
tggccacctgaggtggg

SEQ ID NO: 1549583 - DNA, 21 bp, Homo sapiens
tggccacctgaggtgggccca

SEQ ID NO: 1549584 - DNA, 15 bp, Homo sapiens
tggccacgcagccag

SEQ ID NO: 1549585 - DNA, 19 bp, Homo sapiens
tggccacgcagccaggaca

SEQ ID NO: 1549586 - DNA, 18 bp, Homo sapiens
tggccactccgagaggtg

SEQ ID NO: 1549587 - DNA, 20 bp, Homo sapiens
tggccactccgagaggtggg

SEQ ID NO: 1549588 - DNA, 20 bp, Homo sapiens
tggccactgggtctcactcc

SEQ ID NO: 1549589 - DNA, 16 bp, Homo sapiens
tggccagaagagcttg

SEQ ID NO: 1549590 - DNA, 12 bp, Homo sapiens
tggccagacaca

SEQ ID NO: 1549591 - DNA, 18 bp, Homo sapiens
tggccagacacaggccct

SEQ ID NO: 1549592 - DNA, 12 bp, Homo sapiens
tggccagagctg

SEQ ID NO: 1549593 - DNA, 21 bp, Homo sapiens
tggccagagctggaaggcagg

SEQ ID NO: 1549594 - DNA, 22 bp, Homo sapiens
tggccagagctggaaggcaggg

SEQ ID NO: 1549595 - DNA, 23 bp, Homo sapiens
tggccagcactagtaaaggagga

SEQ ID NO: 1549596 - DNA, 15 bp, Homo sapiens
tggccagcccggctg

SEQ ID NO: 1549597 - DNA, 20 bp, Homo sapiens
tggccagcccggctggtttt

SEQ ID NO: 1549598 - DNA, 14 bp, Homo sapiens
tggccagctctgag

SEQ ID NO: 1549599 - DNA, 22 bp, Homo sapiens
tggccaggaggttggtgactga

SEQ ID NO: 1549600 - DNA, 14 bp, Homo sapiens
tggccaggatggag

SEQ ID NO: 1549601 - DNA, 16 bp, Homo sapiens
tggccaggcagatctg

SEQ ID NO: 1549602 - DNA, 17 bp, Homo sapiens
tggccaggcagatctgt

SEQ ID NO: 1549603 - DNA, 23 bp, Homo sapiens
tggccaggcagatctgtgcccca

SEQ ID NO: 1549604 - DNA, 22 bp, Homo sapiens
tggccaggcagggagtgtctgc

SEQ ID NO: 1549605 - DNA, 15 bp, Homo sapiens
tggccaggccctggg

SEQ ID NO: 1549606 - DNA, 22 bp, Homo sapiens
tggccagggtagacttggagct

SEQ ID NO: 1549607 - DNA, 11 bp, Homo sapiens
tggccaggtgg

SEQ ID NO: 1549608 - DNA, 19 bp, Homo sapiens
tggccaggtggttgtctta

SEQ ID NO: 1549609 - DNA, 20 bp, Homo sapiens
tggccagtctggtctcgaac

SEQ ID NO: 1549610 - DNA, 15 bp, Homo sapiens
tggccagtgctgccc

SEQ ID NO: 1549611 - DNA, 14 bp, Homo sapiens
tggccagtggctgg

SEQ ID NO: 1549612 - DNA, 23 bp, Homo sapiens
tggccagtggctggatctgtgag

SEQ ID NO: 1549613 - DNA, 19 bp, Homo sapiens
tggccatccttctgtgtac

SEQ ID NO: 1549614 - DNA, 16 bp, Homo sapiens
tggccatcttaaaaag

SEQ ID NO: 1549615 - DNA, 17 bp, Homo sapiens
tggccatgttatgctgg

SEQ ID NO: 1549616 - DNA, 19 bp, Homo sapiens
tggccatgttatgctggtg

SEQ ID NO: 1549617 - DNA, 22 bp, Homo sapiens
tggccatttccaagaggctgta

SEQ ID NO: 1549618 - DNA, 19 bp, Homo sapiens
tggccatttgctagttctg

SEQ ID NO: 1549619 - DNA, 14 bp, Homo sapiens
tggccatttgcttt

SEQ ID NO: 1549620 - DNA, 17 bp, Homo sapiens
tggccatttttctgggg

SEQ ID NO: 1549621 - DNA, 19 bp, Homo sapiens
tggcccaaaacgtcttatt

SEQ ID NO: 1549622 - DNA, 21 bp, Homo sapiens
tggcccacccagtccatgctc

SEQ ID NO: 1549623 - DNA, 12 bp, Homo sapiens
tggcccacgccc

SEQ ID NO: 1549624 - DNA, 16 bp, Homo sapiens
tggcccactgctggct

SEQ ID NO: 1549625 - DNA, 17 bp, Homo sapiens
tggcccagaaacaacag

SEQ ID NO: 1549626 - DNA, 13 bp, Homo sapiens
tggcccagaaagc

SEQ ID NO: 1549627 - DNA, 10 bp, Homo sapiens
tggcccagcc

SEQ ID NO: 1549628 - DNA, 22 bp, Homo sapiens
tggcccagccaaaccctgtctg

SEQ ID NO: 1549629 - DNA, 22 bp, Homo sapiens
tggcccagccggcctctctggc

SEQ ID NO: 1549630 - DNA, 17 bp, Homo sapiens
tggcccagcggcccctc

SEQ ID NO: 1549631 - DNA, 13 bp, Homo sapiens
tggcccaggagct

SEQ ID NO: 1549632 - DNA, 19 bp, Homo sapiens
tggcccaggagctctgcgc

SEQ ID NO: 1549633 - DNA, 16 bp, Homo sapiens
tggcccagggcccaga

SEQ ID NO: 1549634 - DNA, 21 bp, Homo sapiens
tggcccagggggcctggagca

SEQ ID NO: 1549635 - DNA, 22 bp, Homo sapiens
tggcccagggggcctggagcat

SEQ ID NO: 1549636 - DNA, 22 bp, Homo sapiens
tggcccatagaaacatgacact

SEQ ID NO: 1549637 - DNA, 13 bp, Homo sapiens
tggccccagcaca

SEQ ID NO: 1549638 - DNA, 14 bp, Homo sapiens
tggccccagcacag

SEQ ID NO: 1549639 - DNA, 18 bp, Homo sapiens
tggccccagcacagcttg

SEQ ID NO: 1549640 - DNA, 19 bp, Homo sapiens
tggccccagccctgctggg

SEQ ID NO: 1549641 - DNA, 20 bp, Homo sapiens
tggcaccagccccctggatg

SEQ ID NO: 1549642 - DNA, 13 bp, Homo sapiens
tggcaccatgtgc

SEQ ID NO: 1549643 - DNA, 20 bp, Homo sapiens
tggcacccaccgtggaggag

SEQ ID NO: 1549644 - DNA, 22 bp, Homo sapiens
tggcacccaccgtggaggagga

SEQ ID NO: 1549645 - DNA, 17 bp, Homo sapiens
tggcacctcaggctgag

SEQ ID NO: 1549646 - DNA, 14 bp, Homo sapiens
tggcacctcctgag

SEQ ID NO: 1549647 - DNA, 15 bp, Homo sapiens
tggcacctcctgaga

SEQ ID NO: 1549648 - DNA, 18 bp, Homo sapiens
tggcacctcctgagaagg

SEQ ID NO: 1549649 - DNA, 20 bp, Homo sapiens
tggcacctgtcgcccagtgc

SEQ ID NO: 1549650 - DNA, 18 bp, Homo sapiens
tggcacgcatctgtagtt

SEQ ID NO: 1549651 - DNA, 14 bp, Homo sapiens
tggcacgccctact

SEQ ID NO: 1549652 - DNA, 15 bp, Homo sapiens
tggcacggagagaag

SEQ ID NO: 1549653 - DNA, 19 bp, Homo sapiens
tggcacggtggctcaggcc

SEQ ID NO: 1549654 - DNA, 15 bp, Homo sapiens
tggcacgtattgctg

SEQ ID NO: 1549655 - DNA, 22 bp, Homo sapiens
tggcactaacgttgagcccctg

SEQ ID NO: 1549656 - DNA, 21 bp, Homo sapiens
tggcactataatgtaagctct

SEQ ID NO: 1549657 - DNA, 15 bp, Homo sapiens
tggcactcaactctg

SEQ ID NO: 1549658 - DNA, 17 bp, Homo sapiens
tggcactcacagacctg

SEQ ID NO: 1549659 - DNA, 18 bp, Homo sapiens
tggcactcacagacctgg

SEQ ID NO: 1549660 - DNA, 19 bp, Homo sapiens
tggcactcacagacctgga

SEQ ID NO: 1549661 - DNA, 22 bp, Homo sapiens
tggcactcacagacctggagcc

SEQ ID NO: 1549662 - DNA, 22 bp, Homo sapiens
tggcactgagatatttattgtt

SEQ ID NO: 1549663 - DNA, 10 bp, Homo sapiens
tggcactgat

SEQ ID NO: 1549664 - DNA, 19 bp, Homo sapiens
tggcactgcatacaatctg

SEQ ID NO: 1549665 - DNA, 20 bp, Homo sapiens
tggcactggggcacttggca

SEQ ID NO: 1549666 - DNA, 21 bp, Homo sapiens
tggcactggtaggttgggaca

SEQ ID NO: 1549667 - DNA, 20 bp, Homo sapiens
tggcactgttaatacacagt

SEQ ID NO: 1549668 - DNA, 20 bp, Homo sapiens
tggcacttaagtgcactttt

SEQ ID NO: 1549669 - DNA, 16 bp, Homo sapiens
tggcacttgctaacaa

SEQ ID NO: 1549670 - DNA, 12 bp, Homo sapiens
tggcacttgtat

SEQ ID NO: 1549671 - DNA, 14 bp, Homo sapiens
tggcacttgtattt

SEQ ID NO: 1549672 - DNA, 11 bp, Homo sapiens
tggcactttga

SEQ ID NO: 1549673 - DNA, 16 bp, Homo sapiens
tggcactttgaagggg

SEQ ID NO: 1549674 - DNA, 19 bp, Homo sapiens
tggcacttttttaaatata

SEQ ID NO: 1549675 - DNA, 21 bp, Homo sapiens
tggcacttttttaaatataaa

SEQ ID NO: 1549676 - DNA, 21 bp, Homo sapiens
tggcagaaaaaatgtctgtaa

SEQ ID NO: 1549677 - DNA, 12 bp, Homo sapiens
tggcagaaaaga

SEQ ID NO: 1549678 - DNA, 19 bp, Homo sapiens
tggcagaaaagaggagacc

SEQ ID NO: 1549679 - DNA, 23 bp, Homo sapiens
tggcagaagcattgcctggactg

SEQ ID NO: 1549680 - DNA, 21 bp, Homo sapiens
tggcagaagggaattgctcag

SEQ ID NO: 1549681 - DNA, 22 bp, Homo sapiens
tggcagacaaacagaccataaa

SEQ ID NO: 1549682 - DNA, 12 bp, Homo sapiens
tggcagagaagg

SEQ ID NO: 1549683 - DNA, 14 bp, Homo sapiens
tggcagagaaggcc

SEQ ID NO: 1549684 - DNA, 16 bp, Homo sapiens
tggcagagaaggcctc

SEQ ID NO: 1549685 - DNA, 18 bp, Homo sapiens
tggcagagaaggcctctt

SEQ ID NO: 1549686 - DNA, 12 bp, Homo sapiens
tggcagagccag

SEQ ID NO: 1549687 - DNA, 14 bp, Homo sapiens
tggcagagccaggc

SEQ ID NO: 1549688 - DNA, 12 bp, Homo sapiens
tggcagagttac

SEQ ID NO: 1549689 - DNA, 22 bp, Homo sapiens
tggcagagtttgtgtgttgtct

SEQ ID NO: 1549690 - DNA, 20 bp, Homo sapiens
tggcagatactccttttgcc

SEQ ID NO: 1549691 - DNA, 18 bp, Homo sapiens
tggcagattcccactgcc

SEQ ID NO: 1549692 - DNA, 20 bp, Homo sapiens
tggcagattttacaaaagat

SEQ ID NO: 1549693 - DNA, 20 bp, Homo sapiens
tggcagcaacggcacagcta

SEQ ID NO: 1549694 - DNA, 19 bp, Homo sapiens
tggcagcagcaggtgtggc

SEQ ID NO: 1549695 - DNA, 13 bp, Homo sapiens
tggcagcagccag

SEQ ID NO: 1549696 - DNA, 15 bp, Homo sapiens
tggcagcagccaggg

SEQ ID NO: 1549697 - DNA, 20 bp, Homo sapiens
tggcagcagccccccttgcc

SEQ ID NO: 1549698 - DNA, 12 bp, Homo sapiens
tggcagccatgc

SEQ ID NO: 1549699 - DNA, 11 bp, Homo sapiens
tggcagccctg

SEQ ID NO: 1549700 - DNA, 15 bp, Homo sapiens
tggcagccgtcccag

SEQ ID NO: 1549701 - DNA, 18 bp, Homo sapiens
tggcagccgtcccaggcc

SEQ ID NO: 1549702 - DNA, 19 bp, Homo sapiens
tggcagccgtcccaggcca

SEQ ID NO: 1549703 - DNA, 18 bp, Homo sapiens
tggcagccgtgccttcag

SEQ ID NO: 1549704 - DNA, 20 bp, Homo sapiens
tggcagccgtgccttcagct

SEQ ID NO: 1549705 - DNA, 21 bp, Homo sapiens
tggcagccgtgccttcagctc

SEQ ID NO: 1549706 - DNA, 22 bp, Homo sapiens
tggcagccgtgccttcagctct

SEQ ID NO: 1549707 - DNA, 17 bp, Homo sapiens
tggcagcctgcacctgg

SEQ ID NO: 1549708 - DNA, 18 bp, Homo sapiens
tggcagcctgcacctggt

SEQ ID NO: 1549709 - DNA, 18 bp, Homo sapiens
tggcagctgagagccctg

SEQ ID NO: 1549710 - DNA, 19 bp, Homo sapiens
tggcagctgagagccctgc

SEQ ID NO: 1549711 - DNA, 23 bp, Homo sapiens
tggcagctgagagccctgctgtg

SEQ ID NO: 1549712 - DNA, 19 bp, Homo sapiens
tggcagctgcccctggcac

SEQ ID NO: 1549713 - DNA, 22 bp, Homo sapiens
tggcagctgcccctggcacctg

SEQ ID NO: 1549714 - DNA, 17 bp, Homo sapiens
tggcagctggggagcag

SEQ ID NO: 1549715 - DNA, 19 bp, Homo sapiens
tggcagctggggagcagct

SEQ ID NO: 1549716 - DNA, 14 bp, Homo sapiens
tggcagctgtttct

SEQ ID NO: 1549717 - DNA, 15 bp, Homo sapiens
tggcagctgtttctc

SEQ ID NO: 1549718 - DNA, 19 bp, Homo sapiens
tggcagctgtttctcatga

SEQ ID NO: 1549719 - DNA, 20 bp, Homo sapiens
tggcagctgtttctcatgaa

SEQ ID NO: 1549720 - DNA, 12 bp, Homo sapiens
tggcaggacaca

SEQ ID NO: 1549721 - DNA, 18 bp, Homo sapiens
tggcaggagctcctggaa

SEQ ID NO: 1549722 - DNA, 12 bp, Homo sapiens
tggcaggaggct

SEQ ID NO: 1549723 - DNA, 17 bp, Homo sapiens
tggcaggattcttcccg

SEQ ID NO: 1549724 - DNA, 18 bp, Homo sapiens
tggcaggcagttctagaa

SEQ ID NO: 1549725 - DNA, 13 bp, Homo sapiens
tggcaggcccact

SEQ ID NO: 1549726 - DNA, 18 bp, Homo sapiens
tggcaggcccactcccca

SEQ ID NO: 1549727 - DNA, 19 bp, Homo sapiens
tggcaggcccactccccag

SEQ ID NO: 1549728 - DNA, 12 bp, Homo sapiens
tggcaggctggc

SEQ ID NO: 1549729 - DNA, 15 bp, Homo sapiens
tggcaggctggccag

SEQ ID NO: 1549730 - DNA, 14 bp, Homo sapiens
tggcaggctgggtg

SEQ ID NO: 1549731 - DNA, 16 bp, Homo sapiens
tggcagggacctgaga

SEQ ID NO: 1549732 - DNA, 13 bp, Homo sapiens
tggcaggggagca

SEQ ID NO: 1549733 - DNA, 15 bp, Homo sapiens
tggcaggggagcagg

SEQ ID NO: 1549734 - DNA, 23 bp, Homo sapiens
tggcaggggtggctgcctcattt

SEQ ID NO: 1549735 - DNA, 17 bp, Homo sapiens
tggcagggtgggatgga

SEQ ID NO: 1549736 - DNA, 22 bp, Homo sapiens
tggcaggtcactgtcactgccg

SEQ ID NO: 1549737 - DNA, 14 bp, Homo sapiens
tggcaggtgggctg

SEQ ID NO: 1549738 - DNA, 15 bp, Homo sapiens
tggcaggtgggctgc

SEQ ID NO: 1549739 - DNA, 15 bp, Homo sapiens
tggcaggtgtcatat

SEQ ID NO: 1549740 - DNA, 14 bp, Homo sapiens
tggcaggtgtggga

SEQ ID NO: 1549741 - DNA, 15 bp, Homo sapiens
tggcagtccagccag

SEQ ID NO: 1549742 - DNA, 16 bp, Homo sapiens
tggcagtccagccagc

SEQ ID NO: 1549743 - DNA, 18 bp, Homo sapiens
tggcagtccagccagctc

SEQ ID NO: 1549744 - DNA, 14 bp, Homo sapiens
tggcagtcctggag

SEQ ID NO: 1549745 - DNA, 15 bp, Homo sapiens
tggcagtcctggagg

SEQ ID NO: 1549746 - DNA, 16 bp, Homo sapiens
tggcagtcctggaggc

SEQ ID NO: 1549747 - DNA, 12 bp, Homo sapiens
tggcagtggagg

SEQ ID NO: 1549748 - DNA, 14 bp, Homo sapiens
tggcagtggccagg

SEQ ID NO: 1549749 - DNA, 22 bp, Homo sapiens
tggcagtggccaggcagggagt

SEQ ID NO: 1549750 - DNA, 12 bp, Homo sapiens
tggcagtggttt

SEQ ID NO: 1549751 - DNA, 18 bp, Homo sapiens
tggcagtgttttggttca

SEQ ID NO: 1549752 - DNA, 15 bp, Homo sapiens
tggcataaattgcat

SEQ ID NO: 1549753 - DNA, 19 bp, Homo sapiens
tggcataactgtgattctt

SEQ ID NO: 1549754 - DNA, 19 bp, Homo sapiens
tggcatacaaaatatttaa

SEQ ID NO: 1549755 - DNA, 22 bp, Homo sapiens
tggcatacgcctgtagtcctag

SEQ ID NO: 1549756 - DNA, 19 bp, Homo sapiens
tggcatatgtttctgctag

SEQ ID NO: 1549757 - DNA, 17 bp, Homo sapiens
tggcatatttttcacat

SEQ ID NO: 1549758 - DNA, 15 bp, Homo sapiens
tggagctcttgggtc

SEQ ID NO: 1549759 - DNA, 23 bp, Homo sapiens
ttctagacatggaggttctaagg

SEQ ID NO: 1549760 - DNA, 18 bp, Homo sapiens
ttctagacgcccctccca

SEQ ID NO: 1549761 - DNA, 19 bp, Homo sapiens
ttctagacgcccctcccaa

SEQ ID NO: 1549762 - DNA, 14 bp, Homo sapiens
ttctagacttcccc

SEQ ID NO: 1549763 - DNA, 15 bp, Homo sapiens
ttctagacttcccca

SEQ ID NO: 1549764 - DNA, 23 bp, Homo sapiens
ttctagagggagacttgttctag

SEQ ID NO: 1549765 - DNA, 14 bp, Homo sapiens
ttctagagttcaga

SEQ ID NO: 1549766 - DNA, 19 bp, Homo sapiens
ttctagagttcagagtcct

SEQ ID NO: 1549767 - DNA, 19 bp, Homo sapiens
ttctagatcctgcacccca

SEQ ID NO: 1549768 - DNA, 22 bp, Homo sapiens
ttctagatcctgcaccccagca

SEQ ID NO: 1549769 - DNA, 16 bp, Homo sapiens
ttctagattatgtctt

SEQ ID NO: 1549770 - DNA, 17 bp, Homo sapiens
ttctagattcactgtct

SEQ ID NO: 1549771 - DNA, 13 bp, Homo sapiens
ttctagcaatttt

SEQ ID NO: 1549772 - DNA, 14 bp, Homo sapiens
ttctagcatggcat

SEQ ID NO: 1549773 - DNA, 18 bp, Homo sapiens
ttctagcccatggacttc

SEQ ID NO: 1549774 - DNA, 18 bp, Homo sapiens
ttctagctagaaatatga

SEQ ID NO: 1549775 - DNA, 19 bp, Homo sapiens
ttctagctagaaatatgat

SEQ ID NO: 1549776 - DNA, 20 bp, Homo sapiens
ttgtagaactcactctgggc

SEQ ID NO: 1549777 - DNA, 18 bp, Homo sapiens
ttgtagagtgtagactgt

SEQ ID NO: 1549778 - DNA, 15 bp, Homo sapiens
ttgtagattgattgt

SEQ ID NO: 1549779 - DNA, 14 bp, Homo sapiens
ttgtagcactgaca

SEQ ID NO: 1549780 - DNA, 17 bp, Homo sapiens
ttgtagcactgacagat

SEQ ID NO: 1549781 - DNA, 17 bp, Homo sapiens
ttgtagcatttaaaatg

SEQ ID NO: 1549782 - DNA, 22 bp, Homo sapiens
ttgtagcatttaaaatggaaaa

SEQ ID NO: 1549783 - DNA, 16 bp, Homo sapiens
ttgtagctttatcaaa

SEQ ID NO: 1549784 - DNA, 17 bp, Homo sapiens
ttgtagctttatcaaag

SEQ ID NO: 1549785 - DNA, 16 bp, Homo sapiens
ttgtagggttacagag

SEQ ID NO: 1549786 - DNA, 16 bp, Homo sapiens
ttgtagtaaaagtggt

SEQ ID NO: 1549787 - DNA, 20 bp, Homo sapiens
ttgtagtataatttcaagga

SEQ ID NO: 1549788 - DNA, 19 bp, Homo sapiens
ttgtagtgccactgttgtt

SEQ ID NO: 1549789 - DNA, 23 bp, Homo sapiens
ttgtagttacgagttttccctca

SEQ ID NO: 1549790 - DNA, 19 bp, Homo sapiens
ttgtagttttatttgtatt

SEQ ID NO: 1549791 - DNA, 11 bp, Homo sapiens
ttgtataaaat

SEQ ID NO: 1549792 - DNA, 22 bp, Homo sapiens
ttgtataaaatctgaattttgc

SEQ ID NO: 1549793 - DNA, 15 bp, Homo sapiens
ttgtataatattgaa

SEQ ID NO: 1549794 - DNA, 16 bp, Homo sapiens
ttgtataatattgaaa

SEQ ID NO: 1549795 - DNA, 17 bp, Homo sapiens
ttgtatacttattttct

SEQ ID NO: 1549796 - DNA, 14 bp, Homo sapiens
ttgtatagtaaagt

SEQ ID NO: 1549797 - DNA, 14 bp, Homo sapiens
ttgtatagttgctt

SEQ ID NO: 1549798 - DNA, 20 bp, Homo sapiens
ttgtatagttgcttgcctga

SEQ ID NO: 1549799 - DNA, 23 bp, Homo sapiens
ttgtatagttttataaaactcag

SEQ ID NO: 1549800 - DNA, 18 bp, Homo sapiens
ttgtatattgtaggaatc

SEQ ID NO: 1549801 - DNA, 20 bp, Homo sapiens
ttgtatattgtggatgtgtt

SEQ ID NO: 1549802 - DNA, 13 bp, Homo sapiens
ttgtatatttgta

SEQ ID NO: 1549803 - DNA, 16 bp, Homo sapiens
ttgtatatttgtacaa

SEQ ID NO: 1549804 - DNA, 20 bp, Homo sapiens
ttgtatctcagtctaaggtc

SEQ ID NO: 1549805 - DNA, 16 bp, Homo sapiens
ttgtatctcatactgt

SEQ ID NO: 1549806 - DNA, 18 bp, Homo sapiens
tttacattgtgactgtgt

SEQ ID NO: 1549807 - DNA, 22 bp, Homo sapiens
tttacattgtgactgtgtttgc

SEQ ID NO: 1549808 - DNA, 23 bp, Homo sapiens
tttacattgtgactgtgtttgca

SEQ ID NO: 1549809 - DNA, 22 bp, Homo sapiens
tttacattttatatttttgtac

SEQ ID NO: 1549810 - DNA, 13 bp, Homo sapiens
tttaccaaagcat

SEQ ID NO: 1549811 - DNA, 14 bp, Homo sapiens
tttaccaaagcatc

SEQ ID NO: 1549812 - DNA, 23 bp, Homo sapiens
tttaccagagagagcaaggaagc

SEQ ID NO: 1549813 - DNA, 15 bp, Homo sapiens
tttaccataatctta

SEQ ID NO: 1549814 - DNA, 23 bp, Homo sapiens
tttaccataatcttatagcactt

SEQ ID NO: 1549815 - DNA, 16 bp, Homo sapiens
tttaccatcatctctg

SEQ ID NO: 1549816 - DNA, 14 bp, Homo sapiens
tttaccatttgtaa

SEQ ID NO: 1549817 - DNA, 16 bp, Homo sapiens
tttaccatttgtaata

SEQ ID NO: 1549818 - DNA, 17 bp, Homo sapiens
tttacccttttccccct

SEQ ID NO: 1549819 - DNA, 17 bp, Homo sapiens
tttacctttcagtgcag

SEQ ID NO: 1549820 - DNA, 16 bp, Homo sapiens
tttaccttttaattaa

SEQ ID NO: 1549821 - DNA, 19 bp, Homo sapiens
tttactaactaaataccat

SEQ ID NO: 1549822 - DNA, 11 bp, Homo sapiens
tttactactgt

SEQ ID NO: 1549823 - DNA, 18 bp, Homo sapiens
tttactactgtggaaaga

SEQ ID NO: 1549824 - DNA, 21 bp, Homo sapiens
tttactcaaaatctgtcataa

SEQ ID NO: 1549825 - DNA, 19 bp, Homo sapiens
tttactcccttcctggcct

SEQ ID NO: 1549826 - DNA, 20 bp, Homo sapiens
tttactcccttcctggcctc

SEQ ID NO: 1549827 - DNA, 17 bp, Homo sapiens
tttactccgtaacagat

SEQ ID NO: 1549828 - DNA, 18 bp, Homo sapiens
tttactcggcgtgctcct

SEQ ID NO: 1549829 - DNA, 12 bp, Homo sapiens
tttactctctcc

SEQ ID NO: 1549830 - DNA, 13 bp, Homo sapiens
tttactctgccta

SEQ ID NO: 1549831 - DNA, 15 bp, Homo sapiens
tttactgaaacattg

SEQ ID NO: 1549832 - DNA, 14 bp, Homo sapiens
tttactgacaagaa

SEQ ID NO: 1549833 - DNA, 14 bp, Homo sapiens
tttactgagcttct

SEQ ID NO: 1549834 - DNA, 12 bp, Homo sapiens
tttactgtaaat

SEQ ID NO: 1549835 - DNA, 13 bp, Homo sapiens
tttactgtaatat

SEQ ID NO: 1549836 - DNA, 18 bp, Homo sapiens
tttactgtctatggattt

SEQ ID NO: 1549837 - DNA, 23 bp, Homo sapiens
tttactgtctattaatattcagg

SEQ ID NO: 1549838 - DNA, 22 bp, Homo sapiens
tttactgtttgatataccaaat

SEQ ID NO: 1549839 - DNA, 18 bp, Homo sapiens
tttactgttttaattgta

SEQ ID NO: 1549840 - DNA, 20 bp, Homo sapiens
tttactgttttgaaatcaat

SEQ ID NO: 1549841 - DNA, 21 bp, Homo sapiens
tttacttatctctcaaaacaa

SEQ ID NO: 1549842 - DNA, 16 bp, Homo sapiens
tttacttatcttatgc

SEQ ID NO: 1549843 - DNA, 17 bp, Homo sapiens
tttacttatcttatgcc

SEQ ID NO: 1549844 - DNA, 23 bp, Homo sapiens
tttacttcaatgggctcttccaa

SEQ ID NO: 1549845 - DNA, 18 bp, Homo sapiens
tttacttgcattgaatat

SEQ ID NO: 1549846 - DNA, 21 bp, Homo sapiens
tttacttgcattgaatatatt

SEQ ID NO: 1549847 - DNA, 13 bp, Homo sapiens
tttacttgtctgt

SEQ ID NO: 1549848 - DNA, 16 bp, Homo sapiens
tttacttttaaactgt

SEQ ID NO: 1549849 - DNA, 19 bp, Homo sapiens
tttacttttttttttttct

SEQ ID NO: 1549850 - DNA, 13 bp, Homo sapiens
tttagaaccagcc

SEQ ID NO: 1549851 - DNA, 19 bp, Homo sapiens
tttagaacctaacttttat

SEQ ID NO: 1549852 - DNA, 22 bp, Homo sapiens
tttagaagccaactatgattat

SEQ ID NO: 1549853 - DNA, 17 bp, Homo sapiens
tttagaagtgagagaaa

SEQ ID NO: 1549854 - DNA, 18 bp, Homo sapiens
tttagaatggtgatttta

SEQ ID NO: 1549855 - DNA, 23 bp, Homo sapiens
tttagacaaccatagaactgtcc

SEQ ID NO: 1549856 - DNA, 14 bp, Homo sapiens
tttagacaactaga

SEQ ID NO: 1549857 - DNA, 22 bp, Homo sapiens
ttttgagctgaaatgctgcatt

SEQ ID NO: 1549858 - DNA, 15 bp, Homo sapiens
ttttgaggagcccca

SEQ ID NO: 1549859 - DNA, 18 bp, Homo sapiens
ttttgaggcttctccttc

SEQ ID NO: 1549860 - DNA, 14 bp, Homo sapiens
ttttgagttctaca

SEQ ID NO: 1549861 - DNA, 21 bp, Homo sapiens
ttttgataaagtttctcagat

SEQ ID NO: 1549862 - DNA, 15 bp, Homo sapiens
ttttgatagttgtgt

SEQ ID NO: 1549863 - DNA, 17 bp, Homo sapiens
ttttgatatacattgtg

SEQ ID NO: 1549864 - DNA, 15 bp, Homo sapiens
ttttgatgtttgtgg

SEQ ID NO: 1549865 - DNA, 18 bp, Homo sapiens
ttttccaactactaatag

SEQ ID NO: 1549866 - DNA, 23 bp, Homo sapiens
ttttccaagtaaagtgatgtttg

SEQ ID NO: 1549867 - DNA, 15 bp, Homo sapiens
ttttccactactgct

SEQ ID NO: 1549868 - DNA, 11 bp, Homo sapiens
ttttccagagg

SEQ ID NO: 1549869 - DNA, 13 bp, Homo sapiens
ttttccagtctgt

SEQ ID NO: 1549870 - DNA, 15 bp, Homo sapiens
ttttccatctaaaaa

SEQ ID NO: 1549871 - DNA, 15 bp, Homo sapiens
ttttccatctaaaat

SEQ ID NO: 1549872 - DNA, 18 bp, Homo sapiens
ttttccatctaaaatact

SEQ ID NO: 1549873 - DNA, 20 bp, Homo sapiens
ttttccattgaccagctctc

SEQ ID NO: 1549874 - DNA, 16 bp, Homo sapiens
ttttccattggtttac

SEQ ID NO: 1549875 - DNA, 20 bp, Homo sapiens
ttttcccaaagcatccctct

SEQ ID NO: 1549876 - DNA, 12 bp, Homo sapiens
ttttcccacgag

SEQ ID NO: 1549877 - DNA, 20 bp, Homo sapiens
ttttcccagatacttcccat

SEQ ID NO: 1549878 - DNA, 22 bp, Homo sapiens
ttttcccccagcaacgcccctc

SEQ ID NO: 1549879 - DNA, 18 bp, Homo sapiens
ttttccccccactctccc

SEQ ID NO: 1549880 - DNA, 19 bp, Homo sapiens
ttttccccccactctcccc

SEQ ID NO: 1549881 - DNA, 17 bp, Homo sapiens
ttttccccctgttttta

SEQ ID NO: 1549882 - DNA, 17 bp, Homo sapiens
ttttcccctttcctgtc

SEQ ID NO: 1549883 - DNA, 22 bp, Homo sapiens
ttttccctgaagttatgtgtat

SEQ ID NO: 1549884 - DNA, 14 bp, Homo sapiens
ttttccctggaact

SEQ ID NO: 1549885 - DNA, 22 bp, Homo sapiens
ttttccctggaactcctggcct

SEQ ID NO: 1549886 - DNA, 16 bp, Homo sapiens
ttttcccttaaataca

SEQ ID NO: 1549887 - DNA, 14 bp, Homo sapiens
ttttcccttgcctt

SEQ ID NO: 1549888 - DNA, 16 bp, Homo sapiens
ttttccgtcacttaaa

SEQ ID NO: 1549889 - DNA, 17 bp, Homo sapiens
ttttcctcatgtaacat

SEQ ID NO: 1549890 - DNA, 13 bp, Homo sapiens
ttttcctccctca

SEQ ID NO: 1549891 - DNA, 20 bp, Homo sapiens
ttttcctctgttcacaaact

SEQ ID NO: 1549892 - DNA, 12 bp, Homo sapiens
ttttcctcttgt

SEQ ID NO: 1549893 - DNA, 14 bp, Homo sapiens
ttttcctgcatgtt

SEQ ID NO: 1549894 - DNA, 18 bp, Homo sapiens
ttttcctgcatgttctgt

SEQ ID NO: 1549895 - DNA, 20 bp, Homo sapiens
ttttcctggaattgccagct

SEQ ID NO: 1549896 - DNA, 18 bp, Homo sapiens
ttttcctggaatttttcc

SEQ ID NO: 1549897 - DNA, 14 bp, Homo sapiens
ttttcctgttcagt

SEQ ID NO: 1549898 - DNA, 16 bp, Homo sapiens
ttttccttatttgcct

SEQ ID NO: 1549899 - DNA, 12 bp, Homo sapiens
ttttccttctgt

SEQ ID NO: 1549900 - DNA, 20 bp, Homo sapiens
ttttcctttcttctagtatt

SEQ ID NO: 1549901 - DNA, 13 bp, Homo sapiens
ttttcctttgaac

SEQ ID NO: 1549902 - DNA, 13 bp, Homo sapiens
ttttccttttcac

SEQ ID NO: 1549903 - DNA, 13 bp, Homo sapiens
ttttctaaaagct

SEQ ID NO: 1549904 - DNA, 14 bp, Homo sapiens
ttttctaaaagctt

SEQ ID NO: 1549905 - DNA, 23 bp, Homo sapiens
ttttctaaactgttttcatgtgt

SEQ ID NO: 1549906 - DNA, 23 bp, Homo sapiens
ttttctaacagaaagcatgattt

SEQ ID NO: 1549907 - DNA, 20 bp, Homo sapiens
ttttctacacagtaaaaact

SEQ ID NO: 1549908 - DNA, 18 bp, Homo sapiens
ttttctacagtggtttta

SEQ ID NO: 1549909 - DNA, 21 bp, Homo sapiens
ttttctacataattgtgacca

SEQ ID NO: 1549910 - DNA, 16 bp, Homo sapiens
ttttctaccctagcca

SEQ ID NO: 1549911 - DNA, 17 bp, Homo sapiens
ttttctaccctagccat

SEQ ID NO: 1549912 - DNA, 22 bp, Homo sapiens
ttttctagcaattttctttgtt

SEQ ID NO: 1549913 - DNA, 20 bp, Homo sapiens
ttttctagtttcagtaaata

SEQ ID NO: 1549914 - DNA, 14 bp, Homo sapiens
ttttctataaatca

SEQ ID NO: 1549915 - DNA, 17 bp, Homo sapiens
ttttctatatcaaaaaa

SEQ ID NO: 1549916 - DNA, 12 bp, Homo sapiens
ttttctattttg

SEQ ID NO: 1549917 - DNA, 12 bp, Homo sapiens
ttttctcccaag

SEQ ID NO: 1549918 - DNA, 21 bp, Homo sapiens
ttttctcctcactgtatccag

SEQ ID NO: 1549919 - DNA, 13 bp, Homo sapiens
ttttctcctccca

SEQ ID NO: 1549920 - DNA, 15 bp, Homo sapiens
ttttctctttctctc

SEQ ID NO: 1549921 - DNA, 12 bp, Homo sapiens
ttttctcttttt

SEQ ID NO: 1549922 - DNA, 16 bp, Homo sapiens
ttttctgagcccgggc

SEQ ID NO: 1549923 - DNA, 14 bp, Homo sapiens
ttttctgcagctgt

SEQ ID NO: 1549924 - DNA, 18 bp, Homo sapiens
ttttctggaatgtaatca

SEQ ID NO: 1549925 - DNA, 23 bp, Homo sapiens
ttttctggggaaagacactgcct

SEQ ID NO: 1549926 - DNA, 21 bp, Homo sapiens
ttttctggtggggctgtcctg

SEQ ID NO: 1549927 - DNA, 12 bp, Homo sapiens
ttttctgtattt

SEQ ID NO: 1549928 - DNA, 17 bp, Homo sapiens
ttttctgtgcctgaata

SEQ ID NO: 1549929 - DNA, 16 bp, Homo sapiens
ttttcttcaaatgttt

SEQ ID NO: 1549930 - DNA, 18 bp, Homo sapiens
ttttcttcttccctccct

SEQ ID NO: 1549931 - DNA, 16 bp, Homo sapiens
ttttcttgaggaaaat

SEQ ID NO: 1549932 - DNA, 21 bp, Homo sapiens
ttttcttgcctctgtcccctt

SEQ ID NO: 1549933 - DNA, 14 bp, Homo sapiens
ttttcttgtaaatg

SEQ ID NO: 1549934 - DNA, 13 bp, Homo sapiens
ttttcttgtaatt

SEQ ID NO: 1549935 - DNA, 18 bp, Homo sapiens
ttttctttaaagaagttg

SEQ ID NO: 1549936 - DNA, 12 bp, Homo sapiens
ttttctttaata

SEQ ID NO: 1549937 - DNA, 14 bp, Homo sapiens
ttttctttctatgt

SEQ ID NO: 1549938 - DNA, 14 bp, Homo sapiens
ttttctttgaaatt

SEQ ID NO: 1549939 - DNA, 15 bp, Homo sapiens
ttttctttgaccaga

SEQ ID NO: 1549940 - DNA, 17 bp, Homo sapiens
ttttcttttatatctgt

SEQ ID NO: 1549941 - DNA, 13 bp, Homo sapiens
ttttcttttgtaa

SEQ ID NO: 1549942 - DNA, 17 bp, Homo sapiens
ttttctttttactgttg

SEQ ID NO: 1549943 - DNA, 18 bp, Homo sapiens
ttttctttttttaactgg

SEQ ID NO: 1549944 - DNA, 18 bp, Homo sapiens
ttttgaaaaaaaagtttt

SEQ ID NO: 1549945 - DNA, 12 bp, Homo sapiens
ttttgaaaaggc

SEQ ID NO: 1549946 - DNA, 12 bp, Homo sapiens
ttttgaaagaat

SEQ ID NO: 1549947 - DNA, 22 bp, Homo sapiens
ttttgaaatattaaaccctgga

SEQ ID NO: 1549948 - DNA, 18 bp, Homo sapiens
ttttgaaatgctgaaaat

SEQ ID NO: 1549949 - DNA, 13 bp, Homo sapiens
ttttgaactgcct

SEQ ID NO: 1549950 - DNA, 16 bp, Homo sapiens
ttttgaacttgtcacg

SEQ ID NO: 1549951 - DNA, 19 bp, Homo sapiens
ttttgaatacatttgtatt

SEQ ID NO: 1549952 - DNA, 21 bp, Homo sapiens
ttttgaataccattaaaactg

SEQ ID NO: 1549953 - DNA, 16 bp, Homo sapiens
ttttgaatctttaatt

SEQ ID NO: 1549954 - DNA, 18 bp, Homo sapiens
ttttgaatgcttcctgac

SEQ ID NO: 1549955 - DNA, 22 bp, Homo sapiens
ttttgaatgcttcctgacaatc

SEQ ID NO: 1549956 - DNA, 18 bp, Homo sapiens
ttttgaatttaaataaag

SEQ ID NO: 1549957 - DNA, 19 bp, Homo sapiens
ttttgaatttaaataaagt

SEQ ID NO: 1549958 - DNA, 11 bp, Homo sapiens
ttttgaatttt

SEQ ID NO: 1549959 - DNA, 18 bp, Homo sapiens
ttttgacactatatctgt

SEQ ID NO: 1549960 - DNA, 12 bp, Homo sapiens
ttttgacactga

SEQ ID NO: 1549961 - DNA, 13 bp, Homo sapiens
ttttgacactgaa

SEQ ID NO: 1549962 - DNA, 18 bp, Homo sapiens
ttttgacactgaaagttt

SEQ ID NO: 1549963 - DNA, 19 bp, Homo sapiens
ttttgacagactatttgct

SEQ ID NO: 1549964 - DNA, 23 bp, Homo sapiens
ttttgacagtgttgaaaatgttc

SEQ ID NO: 1549965 - DNA, 20 bp, Homo sapiens
ttttgacggatgattggatt

SEQ ID NO: 1549966 - DNA, 20 bp, Homo sapiens
ttttgactaaagctatgtta

SEQ ID NO: 1549967 - DNA, 13 bp, Homo sapiens
ttttgagaaactg

SEQ ID NO: 1549968 - DNA, 16 bp, Homo sapiens
ttttgagcccttgttt

SEQ ID NO: 1549969 - DNA, 17 bp, Homo sapiens
ttgctattagagcattg

SEQ ID NO: 1549970 - DNA, 19 bp, Homo sapiens
ttgctattttatttgtatt

SEQ ID NO: 1549971 - DNA, 20 bp, Homo sapiens
ttgctattttatttgtattc

SEQ ID NO: 1549972 - DNA, 22 bp, Homo sapiens
ttgctcaaaattgcttctaaaa

SEQ ID NO: 1549973 - DNA, 21 bp, Homo sapiens
ttgctcaagttcattgatgac

SEQ ID NO: 1549974 - DNA, 15 bp, Homo sapiens
ttgctcacagctgta

SEQ ID NO: 1549975 - DNA, 17 bp, Homo sapiens
ttgctcagagaaggaaa

SEQ ID NO: 1549976 - DNA, 14 bp, Homo sapiens
ttgctcagcccgct

SEQ ID NO: 1549977 - DNA, 15 bp, Homo sapiens
ttgctcagcccgctt

SEQ ID NO: 1549978 - DNA, 16 bp, Homo sapiens
ttgctcagtgtccagc

SEQ ID NO: 1549979 - DNA, 23 bp, Homo sapiens
ttgctcagtgtccagcttccaaa

SEQ ID NO: 1549980 - DNA, 12 bp, Homo sapiens
ttgctccagata

SEQ ID NO: 1549981 - DNA, 17 bp, Homo sapiens
ttgctccagattctgat

SEQ ID NO: 1549982 - DNA, 19 bp, Homo sapiens
ttgctcgcccagacaccat

SEQ ID NO: 1549983 - DNA, 20 bp, Homo sapiens
ttgctcgcccagacaccatg

SEQ ID NO: 1549984 - DNA, 14 bp, Homo sapiens
ttgctctacaatga

SEQ ID NO: 1549985 - DNA, 14 bp, Homo sapiens
ttgctctaggaaga

SEQ ID NO: 1549986 - DNA, 12 bp, Homo sapiens
ttgctctatgtc

SEQ ID NO: 1549987 - DNA, 13 bp, Homo sapiens
ttgctctcccggt

SEQ ID NO: 1549988 - DNA, 20 bp, Homo sapiens
ttgctctcccggttcttcca

SEQ ID NO: 1549989 - DNA, 23 bp, Homo sapiens
ttgctctcccggttcttccagtg

SEQ ID NO: 1549990 - DNA, 12 bp, Homo sapiens
ttgctctcctca

SEQ ID NO: 1549991 - DNA, 17 bp, Homo sapiens
ttgctctctgtgaccct

SEQ ID NO: 1549992 - DNA, 13 bp, Homo sapiens
ttgctctggagca

SEQ ID NO: 1549993 - DNA, 17 bp, Homo sapiens
ttgctcttcagatgcca

SEQ ID NO: 1549994 - DNA, 17 bp, Homo sapiens
ttgctcttctttctgag

SEQ ID NO: 1549995 - DNA, 16 bp, Homo sapiens
ttgctgaaattttata

SEQ ID NO: 1549996 - DNA, 11 bp, Homo sapiens
ttgctgaattc

SEQ ID NO: 1549997 - DNA, 11 bp, Homo sapiens
ttgctgagagc

SEQ ID NO: 1549998 - DNA, 14 bp, Homo sapiens
ttgctgagcctctg

SEQ ID NO: 1549999 - DNA, 16 bp, Homo sapiens
ttgctgagttgttcta

SEQ ID NO: 1550000 - DNA, 21 bp, Homo sapiens
ttgctgatcagagttcctcct

SEQ ID NO: 1550001 - DNA, 18 bp, Homo sapiens
ttgctgatggctgctaga

SEQ ID NO: 1550002 - DNA, 17 bp, Homo sapiens
ttgctgatttcccctct

SEQ ID NO: 1550003 - DNA, 20 bp, Homo sapiens
ttgctgattttattcttgat

SEQ ID NO: 1550004 - DNA, 13 bp, Homo sapiens
ttgctgcaaacct

SEQ ID NO: 1550005 - DNA, 15 bp, Homo sapiens
ttgctgcaaacctga

SEQ ID NO: 1550006 - DNA, 19 bp, Homo sapiens
ttgctgcagtcatctactt

SEQ ID NO: 1550007 - DNA, 20 bp, Homo sapiens
ttgctgccattacagaggta

SEQ ID NO: 1550008 - DNA, 16 bp, Homo sapiens
ttgctgcctcagagca

SEQ ID NO: 1550009 - DNA, 12 bp, Homo sapiens
ttgctgctgcct

SEQ ID NO: 1550010 - DNA, 11 bp, Homo sapiens
ttgctgctgct

SEQ ID NO: 1550011 - DNA, 14 bp, Homo sapiens
ttgctgctgctacc

SEQ ID NO: 1550012 - DNA, 10 bp, Homo sapiens
ttgctgctgt

SEQ ID NO: 1550013 - DNA, 12 bp, Homo sapiens
ttgctgctgtct

SEQ ID NO: 1550014 - DNA, 12 bp, Homo sapiens
ttgctgcttgga

SEQ ID NO: 1550015 - DNA, 15 bp, Homo sapiens
ttgctgctttagtcc

SEQ ID NO: 1550016 - DNA, 17 bp, Homo sapiens
ttgctggatgcattttt

SEQ ID NO: 1550017 - DNA, 18 bp, Homo sapiens
ttgctggatgcattttta

SEQ ID NO: 1550018 - DNA, 14 bp, Homo sapiens
ttgctggccccagc

SEQ ID NO: 1550019 - DNA, 23 bp, Homo sapiens
ttgctggccccagccctgctggg

SEQ ID NO: 1550020 - DNA, 16 bp, Homo sapiens
ttgctggctctgagaa

SEQ ID NO: 1550021 - DNA, 12 bp, Homo sapiens
ttgctgggcttt

SEQ ID NO: 1550022 - DNA, 23 bp, Homo sapiens
ttgctggtagagacccccaggcc

SEQ ID NO: 1550023 - DNA, 19 bp, Homo sapiens
ttgctggtgcaaagataga

SEQ ID NO: 1550024 - DNA, 21 bp, Homo sapiens
ttgctgtaccacatctgctct

SEQ ID NO: 1550025 - DNA, 19 bp, Homo sapiens
ttgctgtactcttgctgat

SEQ ID NO: 1550026 - DNA, 12 bp, Homo sapiens
ttgctgtagaaa

SEQ ID NO: 1550027 - DNA, 13 bp, Homo sapiens
ttgctgtcactgt

SEQ ID NO: 1550028 - DNA, 15 bp, Homo sapiens
ttgctgtcacttctt

SEQ ID NO: 1550029 - DNA, 19 bp, Homo sapiens
ttgctgtctacagtagctg

SEQ ID NO: 1550030 - DNA, 13 bp, Homo sapiens
ttgctgtctctta

SEQ ID NO: 1550031 - DNA, 15 bp, Homo sapiens
ttgctgtgaggctgt

SEQ ID NO: 1550032 - DNA, 12 bp, Homo sapiens
ttgctgtggctc

SEQ ID NO: 1550033 - DNA, 23 bp, Homo sapiens
ttgctgtgtctcctctcagagtg

SEQ ID NO: 1550034 - DNA, 18 bp, Homo sapiens
ttgctgtgtgaccctggg

SEQ ID NO: 1550035 - DNA, 19 bp, Homo sapiens
ttgctgtgtgtcccaggca

SEQ ID NO: 1550036 - DNA, 16 bp, Homo sapiens
ttgctgttttttggag

SEQ ID NO: 1550037 - DNA, 18 bp, Homo sapiens
ttgcttaaaccacttaaa

SEQ ID NO: 1550038 - DNA, 14 bp, Homo sapiens
ttgcttaaatttct

SEQ ID NO: 1550039 - DNA, 22 bp, Homo sapiens
ttgcttagatgagggtgactgt

SEQ ID NO: 1550040 - DNA, 13 bp, Homo sapiens
ttgcttagtaagt

SEQ ID NO: 1550041 - DNA, 21 bp, Homo sapiens
ttgcttagtatggttctcaga

SEQ ID NO: 1550042 - DNA, 13 bp, Homo sapiens
ttgcttcagtgga

SEQ ID NO: 1550043 - DNA, 14 bp, Homo sapiens
ttgcttcataaatg

SEQ ID NO: 1550044 - DNA, 14 bp, Homo sapiens
ttgcttcattgtta

SEQ ID NO: 1550045 - DNA, 15 bp, Homo sapiens
ttgcttccgccactc

SEQ ID NO: 1550046 - DNA, 12 bp, Homo sapiens
ttgcttctttct

SEQ ID NO: 1550047 - DNA, 17 bp, Homo sapiens
ttgcttctttctagaaa

SEQ ID NO: 1550048 - DNA, 16 bp, Homo sapiens
ttgcttgagcccagga

SEQ ID NO: 1550049 - DNA, 18 bp, Homo sapiens
ttgcttgagcccaggagt

SEQ ID NO: 1550050 - DNA, 18 bp, Homo sapiens
ttgcttgcctgatataaa

SEQ ID NO: 1550051 - DNA, 16 bp, Homo sapiens
ttgctttaaatcttaa

SEQ ID NO: 1550052 - DNA, 19 bp, Homo sapiens
ttgctttaacctgaacctt

SEQ ID NO: 1550053 - DNA, 21 bp, Homo sapiens
ttgctttaattccatgaatgt

SEQ ID NO: 1550054 - DNA, 23 bp, Homo sapiens
ttgctttaattgctttaaatctt

SEQ ID NO: 1550055 - DNA, 16 bp, Homo sapiens
ttgctttactgtcaaa

SEQ ID NO: 1550056 - DNA, 23 bp, Homo sapiens
ttgctttatgggggggagggagg

SEQ ID NO: 1550057 - DNA, 10 bp, Homo sapiens
ttgctttcct

SEQ ID NO: 1550058 - DNA, 14 bp, Homo sapiens
ttgctttgaaaata

SEQ ID NO: 1550059 - DNA, 15 bp, Homo sapiens
ttgctttgaaaatat

SEQ ID NO: 1550060 - DNA, 15 bp, Homo sapiens
ttgctttgccagagc

SEQ ID NO: 1550061 - DNA, 19 bp, Homo sapiens
ttgctttggttaaaaatgg

SEQ ID NO: 1550062 - DNA, 13 bp, Homo sapiens
ttgctttgtatgc

SEQ ID NO: 1550063 - DNA, 16 bp, Homo sapiens
ttgctttgtatgcact

SEQ ID NO: 1550064 - DNA, 15 bp, Homo sapiens
ttgcttttgtttttt

SEQ ID NO: 1550065 - DNA, 19 bp, Homo sapiens
ttgcttttgtttttttcct

SEQ ID NO: 1550066 - DNA, 19 bp, Homo sapiens
ttgcttttttgtattggtt

SEQ ID NO: 1550067 - DNA, 14 bp, Homo sapiens
ttggcctgctgtga

SEQ ID NO: 1550068 - DNA, 16 bp, Homo sapiens
ttggcctggaggtggg

SEQ ID NO: 1550069 - DNA, 15 bp, Homo sapiens
ttggcctggcctcca

SEQ ID NO: 1550070 - DNA, 18 bp, Homo sapiens
ttggcctggggtgcatct

SEQ ID NO: 1550071 - DNA, 21 bp, Homo sapiens
ttggcctgtttgatgtatgtg

SEQ ID NO: 1550072 - DNA, 22 bp, Homo sapiens
ttggcgtagcagagttaaatct

SEQ ID NO: 1550073 - DNA, 17 bp, Homo sapiens
ttggctataagtgctca

SEQ ID NO: 1550074 - DNA, 20 bp, Homo sapiens
ttggctatgatggtgacatg

SEQ ID NO: 1550075 - DNA, 14 bp, Homo sapiens
ttggctcaatcctc

SEQ ID NO: 1550076 - DNA, 13 bp, Homo sapiens
ttggctcaggcag

SEQ ID NO: 1550077 - DNA, 22 bp, Homo sapiens
ttggctcccattcactcttcca

SEQ ID NO: 1550078 - DNA, 11 bp, Homo sapiens
ttggctctttc

SEQ ID NO: 1550079 - DNA, 14 bp, Homo sapiens
ttggctctttcaga

SEQ ID NO: 1550080 - DNA, 18 bp, Homo sapiens
ttggctgagacctgggat

SEQ ID NO: 1550081 - DNA, 11 bp, Homo sapiens
ttggctgcagg

SEQ ID NO: 1550082 - DNA, 22 bp, Homo sapiens
ttggctgcaggaagaaactttt

SEQ ID NO: 1550083 - DNA, 20 bp, Homo sapiens
ttggctgcttaaactggaaa

SEQ ID NO: 1550084 - DNA, 16 bp, Homo sapiens
ttggctgcttcctgtg

SEQ ID NO: 1550085 - DNA, 21 bp, Homo sapiens
ttggctggtagcagcaggctc

SEQ ID NO: 1550086 - DNA, 15 bp, Homo sapiens
ttggctgtctgacca

SEQ ID NO: 1550087 - DNA, 16 bp, Homo sapiens
ttggctgttccagact

SEQ ID NO: 1550088 - DNA, 14 bp, Homo sapiens
ttggcttctcctgt

SEQ ID NO: 1550089 - DNA, 13 bp, Homo sapiens
ttgtgcaattgtc

SEQ ID NO: 1550090 - DNA, 15 bp, Homo sapiens
ttgtgcaattgtctt

SEQ ID NO: 1550091 - DNA, 21 bp, Homo sapiens
ttgtgcaccctctatcccaat

SEQ ID NO: 1550092 - DNA, 21 bp, Homo sapiens
ttgtgcatatctgcctcccct

SEQ ID NO: 1550093 - DNA, 14 bp, Homo sapiens
ttgtgcattctgga

SEQ ID NO: 1550094 - DNA, 16 bp, Homo sapiens
ttgtgcattctttggt

SEQ ID NO: 1550095 - DNA, 17 bp, Homo sapiens
ttgtgcattctttggta

SEQ ID NO: 1550096 - DNA, 22 bp, Homo sapiens
ttgtgcattctttggtaatttt

SEQ ID NO: 1550097 - DNA, 22 bp, Homo sapiens
ttgtgccaactgccaggctgcc

SEQ ID NO: 1550098 - DNA, 13 bp, Homo sapiens
ttgtgccagagga

SEQ ID NO: 1550099 - DNA, 19 bp, Homo sapiens
ttgtgccgtaattatgtac

SEQ ID NO: 1550100 - DNA, 13 bp, Homo sapiens
ttgtgcctggggt

SEQ ID NO: 1550101 - DNA, 21 bp, Homo sapiens
ttgtgccttcccttctctggt

SEQ ID NO: 1550102 - DNA, 18 bp, Homo sapiens
ttgtgctagaaattttca

SEQ ID NO: 1550103 - DNA, 11 bp, Homo sapiens
ttgtgctgcca

SEQ ID NO: 1550104 - DNA, 15 bp, Homo sapiens
ttgtgcttagaattg

SEQ ID NO: 1550105 - DNA, 21 bp, Homo sapiens
ttgtgcttcacagtagagcca

SEQ ID NO: 1550106 - DNA, 13 bp, Homo sapiens
ttgtgcttcttca

SEQ ID NO: 1550107 - DNA, 16 bp, Homo sapiens
ttgtgctttctagcaa

SEQ ID NO: 1550108 - DNA, 21 bp, Homo sapiens
ttgtggaattgggagcttggg

SEQ ID NO: 1550109 - DNA, 14 bp, Homo sapiens
ttgtggactggctg

SEQ ID NO: 1550110 - DNA, 14 bp, Homo sapiens
ttgtggagagaatg

SEQ ID NO: 1550111 - DNA, 15 bp, Homo sapiens
ttgtggatgctccag

SEQ ID NO: 1550112 - DNA, 17 bp, Homo sapiens
ttgtggatgctccaggg

SEQ ID NO: 1550113 - DNA, 16 bp, Homo sapiens
ttgtggatgtgttcat

SEQ ID NO: 1550114 - DNA, 22 bp, Homo sapiens
ttgtggctgttgagatgtgctt

SEQ ID NO: 1550115 - DNA, 15 bp, Homo sapiens
ttgtgggagacagca

SEQ ID NO: 1550116 - DNA, 13 bp, Homo sapiens
ttgtggggccagg

SEQ ID NO: 1550117 - DNA, 20 bp, Homo sapiens
ttgtggtgtgaccatgttca

SEQ ID NO: 1550118 - DNA, 14 bp, Homo sapiens
ttgtggtgttcctg

SEQ ID NO: 1550119 - DNA, 15 bp, Homo sapiens
ttgtggtgttcctga

SEQ ID NO: 1550120 - DNA, 13 bp, Homo sapiens
ttgtggttaatct

SEQ ID NO: 1550121 - DNA, 22 bp, Homo sapiens
ttgtggttccatgcagccttgg

SEQ ID NO: 1550122 - DNA, 19 bp, Homo sapiens
ttgtgtaaaaaatggaaaa

SEQ ID NO: 1550123 - DNA, 23 bp, Homo sapiens
ttgtgtaactaatttgtggtaaa

SEQ ID NO: 1550124 - DNA, 24 bp, Homo sapiens
ttgtgtaatgaaaatgaatatcta

SEQ ID NO: 1550125 - DNA, 21 bp, Homo sapiens
ttgtgtacatagagcaatgtt

SEQ ID NO: 1550126 - DNA, 14 bp, Homo sapiens
ttgtgtagcctttt

SEQ ID NO: 1550127 - DNA, 19 bp, Homo sapiens
ttgtgtagtatcttgaaat

SEQ ID NO: 1550128 - DNA, 14 bp, Homo sapiens
ttgtgtatgtactt

SEQ ID NO: 1550129 - DNA, 20 bp, Homo sapiens
ttgtgtatgtacttagctgt

SEQ ID NO: 1550130 - DNA, 15 bp, Homo sapiens
ttgtgtcaagacatt

SEQ ID NO: 1550131 - DNA, 20 bp, Homo sapiens
ttgtgtcagaaacatgaaat

SEQ ID NO: 1550132 - DNA, 19 bp, Homo sapiens
ttgtgtcataccagaaagc

SEQ ID NO: 1550133 - DNA, 21 bp, Homo sapiens
ttgtgtcatttattcaagtat

SEQ ID NO: 1550134 - DNA, 17 bp, Homo sapiens
ttgtgtctggtgcagaa

SEQ ID NO: 1550135 - DNA, 18 bp, Homo sapiens
ttgtgtgaaaaaagaaaa

SEQ ID NO: 1550136 - DNA, 14 bp, Homo sapiens
ttgtgtgagactta

SEQ ID NO: 1550137 - DNA, 17 bp, Homo sapiens
ttgtgtgatatttcaga

SEQ ID NO: 1550138 - DNA, 16 bp, Homo sapiens
ttgtgtgcgctgcctg

SEQ ID NO: 1550139 - DNA, 22 bp, Homo sapiens
ttgtgtggctgccccacctgcc

SEQ ID NO: 1550140 - DNA, 14 bp, Homo sapiens
ttgtgtgtatttgt

SEQ ID NO: 1550141 - DNA, 21 bp, Homo sapiens
ttgtgtgtatttgtattaata

SEQ ID NO: 1550142 - DNA, 16 bp, Homo sapiens
ttgtgtgtcaggccct

SEQ ID NO: 1550143 - DNA, 13 bp, Homo sapiens
ttgtgtgtgggag

SEQ ID NO: 1550144 - DNA, 19 bp, Homo sapiens
ttgtgtgtgggctgtgagt

SEQ ID NO: 1550145 - DNA, 20 bp, Homo sapiens
ttgtgtgtgtgtcagctgag

SEQ ID NO: 1550146 - DNA, 16 bp, Homo sapiens
ttgtgtgttatttaaa

SEQ ID NO: 1550147 - DNA, 15 bp, Homo sapiens
ttgtgtgttgtctct

SEQ ID NO: 1550148 - DNA, 18 bp, Homo sapiens
ttgtgtgtttatttcact

SEQ ID NO: 1550149 - DNA, 18 bp, Homo sapiens
ttgtgtgttttgtacact

SEQ ID NO: 1550150 - DNA, 20 bp, Homo sapiens
ttgtgttaagtatgtgtaaa

SEQ ID NO: 1550151 - DNA, 22 bp, Homo sapiens
ttgtgttcagctctttccaaat

SEQ ID NO: 1550152 - DNA, 16 bp, Homo sapiens
ttgtgttcatttcatt

SEQ ID NO: 1550153 - DNA, 13 bp, Homo sapiens
ttgtgttctgctc

SEQ ID NO: 1550154 - DNA, 18 bp, Homo sapiens
ttgtgttgaagagcagct

SEQ ID NO: 1550155 - DNA, 12 bp, Homo sapiens
ttgtgtttagga

SEQ ID NO: 1550156 - DNA, 14 bp, Homo sapiens
ttgtgtttattctt

SEQ ID NO: 1550157 - DNA, 17 bp, Homo sapiens
ttgtgttttcttgtaaa

SEQ ID NO: 1550158 - DNA, 16 bp, Homo sapiens
ttgtgttttttaagat

SEQ ID NO: 1550159 - DNA, 15 bp, Homo sapiens
ttgttaaaaatgtca

SEQ ID NO: 1550160 - DNA, 12 bp, Homo sapiens
ttgttaaaacat

SEQ ID NO: 1550161 - DNA, 16 bp, Homo sapiens
ttgttaaaataactag

SEQ ID NO: 1550162 - DNA, 12 bp, Homo sapiens
ttgttaaagctg

SEQ ID NO: 1550163 - DNA, 21 bp, Homo sapiens
ttgttaaagctggaacatttg

SEQ ID NO: 1550164 - DNA, 17 bp, Homo sapiens
ttgttaaaggcaatggt

SEQ ID NO: 1550165 - DNA, 22 bp, Homo sapiens
ttgttaacgtgatgtgccacta

SEQ ID NO: 1550166 - DNA, 18 bp, Homo sapiens
ttgttaactcttgtctat

SEQ ID NO: 1550167 - DNA, 17 bp, Homo sapiens
ttgttaagtccttggct

SEQ ID NO: 1550168 - DNA, 13 bp, Homo sapiens
ttgttaatgtcat

SEQ ID NO: 1550169 - DNA, 16 bp, Homo sapiens
ttgttaatgtcattgc

SEQ ID NO: 1550170 - DNA, 20 bp, Homo sapiens
ttgttaatgtcattgctaaa

SEQ ID NO: 1550171 - DNA, 22 bp, Homo sapiens
ttgttaatttttcctatattgc

SEQ ID NO: 1550172 - DNA, 15 bp, Homo sapiens
ttgttacaggaagtc

SEQ ID NO: 1550173 - DNA, 20 bp, Homo sapiens
ttgttacctgtcattttgca

SEQ ID NO: 1550174 - DNA, 12 bp, Homo sapiens
ttgttaccttta

SEQ ID NO: 1550175 - DNA, 14 bp, Homo sapiens
ttgttactccctgt

SEQ ID NO: 1550176 - DNA, 17 bp, Homo sapiens
ttgttactgctgattct

SEQ ID NO: 1550177 - DNA, 14 bp, Homo sapiens
ttgttacttctgag

SEQ ID NO: 1550178 - DNA, 17 bp, Homo sapiens
ttgttagcccttcagat

SEQ ID NO: 1550179 - DNA, 21 bp, Homo sapiens
ttgttagggctgcttttctta

SEQ ID NO: 1550180 - DNA, 23 bp, Homo sapiens
ttgttagggctgcttttcttaag

SEQ ID NO: 1550181 - DNA, 16 bp, Homo sapiens
ttgttagtttagtgtg

SEQ ID NO: 1550182 - DNA, 14 bp, Homo sapiens
ttgttatggcttaa

SEQ ID NO: 1550183 - DNA, 18 bp, Homo sapiens
ttgttatgtagataacaa

SEQ ID NO: 1550184 - DNA, 23 bp, Homo sapiens
ttgttattgatgttgctgttatt

SEQ ID NO: 1550185 - DNA, 17 bp, Homo sapiens
ttgttatttacactggt

SEQ ID NO: 1550186 - DNA, 19 bp, Homo sapiens
ttgttcaataataaatatt

SEQ ID NO: 1550187 - DNA, 15 bp, Homo sapiens
ttgttcaatgttcca

SEQ ID NO: 1550188 - DNA, 17 bp, Homo sapiens
ttgttcaatgttccatt

SEQ ID NO: 1550189 - DNA, 21 bp, Homo sapiens
ttgttcactgaaggtgattca

SEQ ID NO: 1550190 - DNA, 19 bp, Homo sapiens
ttgttcattttgagctgaa

SEQ ID NO: 1550191 - DNA, 21 bp, Homo sapiens
ttgttccacttgtttgcactg

SEQ ID NO: 1550192 - DNA, 22 bp, Homo sapiens
ttgttccacttgtttgcactgt

SEQ ID NO: 1550193 - DNA, 16 bp, Homo sapiens
ttgttcccctcctcca

SEQ ID NO: 1550194 - DNA, 14 bp, Homo sapiens
ttgttccctctccc

SEQ ID NO: 1550195 - DNA, 11 bp, Homo sapiens
ttgttctagac

SEQ ID NO: 1550196 - DNA, 18 bp, Homo sapiens
ttgttctagacttcccca

SEQ ID NO: 1550197 - DNA, 21 bp, Homo sapiens
ttgttctagacttccccatcc

SEQ ID NO: 1550198 - DNA, 14 bp, Homo sapiens
ttgttctagagagg

SEQ ID NO: 1550199 - DNA, 11 bp, Homo sapiens
ttgttctcatt

SEQ ID NO: 1550200 - DNA, 12 bp, Homo sapiens
ttgttctctggg

SEQ ID NO: 1550201 - DNA, 12 bp, Homo sapiens
ttgttctgagca

SEQ ID NO: 1550202 - DNA, 23 bp, Homo sapiens
ttgttctgtggttttcccctccc

SEQ ID NO: 1550203 - DNA, 13 bp, Homo sapiens
ttgttcttaaaaa

SEQ ID NO: 1550204 - DNA, 14 bp, Homo sapiens
ttgttctttaaagt

SEQ ID NO: 1550205 - DNA, 15 bp, Homo sapiens
ttgttctttgtttag

SEQ ID NO: 1550206 - DNA, 20 bp, Homo sapiens
ttgtatctcttttgaatcca

SEQ ID NO: 1550207 - DNA, 15 bp, Homo sapiens
ttgtatgcagggagc

SEQ ID NO: 1550208 - DNA, 12 bp, Homo sapiens
ttgtatgccttt

SEQ ID NO: 1550209 - DNA, 21 bp, Homo sapiens
ttgtatgcctttaaatctgtg

SEQ ID NO: 1550210 - DNA, 15 bp, Homo sapiens
ttgtatgctgaattt

SEQ ID NO: 1550211 - DNA, 18 bp, Homo sapiens
ttgtatgctgaatttcta

SEQ ID NO: 1550212 - DNA, 20 bp, Homo sapiens
ttgtatggggaggcaagtgt

SEQ ID NO: 1550213 - DNA, 12 bp, Homo sapiens
ttgtatgtaagt

SEQ ID NO: 1550214 - DNA, 12 bp, Homo sapiens
ttgtatgtctgt

SEQ ID NO: 1550215 - DNA, 12 bp, Homo sapiens
ttgtatgttaaa

SEQ ID NO: 1550216 - DNA, 15 bp, Homo sapiens
ttgtattaataaagc

SEQ ID NO: 1550217 - DNA, 14 bp, Homo sapiens
ttgtattacagatg

SEQ ID NO: 1550218 - DNA, 14 bp, Homo sapiens
ttgtattacatcta

SEQ ID NO: 1550219 - DNA, 16 bp, Homo sapiens
ttgtattacatctaat

SEQ ID NO: 1550220 - DNA, 14 bp, Homo sapiens
ttgtattaggaaaa

SEQ ID NO: 1550221 - DNA, 17 bp, Homo sapiens
ttgtattcatgttcatg

SEQ ID NO: 1550222 - DNA, 13 bp, Homo sapiens
ttgtattgttgaa

SEQ ID NO: 1550223 - DNA, 13 bp, Homo sapiens
ttgtattgttttc

SEQ ID NO: 1550224 - DNA, 15 bp, Homo sapiens
ttgtatttctcttgt

SEQ ID NO: 1550225 - DNA, 16 bp, Homo sapiens
ttgtattttcatgaaa

SEQ ID NO: 1550226 - DNA, 17 bp, Homo sapiens
ttgtattttcatgaaaa

SEQ ID NO: 1550227 - DNA, 18 bp, Homo sapiens
ttgtattttcatgaaaat

SEQ ID NO: 1550228 - DNA, 12 bp, Homo sapiens
ttgtattttgca

SEQ ID NO: 1550229 - DNA, 15 bp, Homo sapiens
ttgtattttgttaaa

SEQ ID NO: 1550230 - DNA, 15 bp, Homo sapiens
ttgtatttttaatgg

SEQ ID NO: 1550231 - DNA, 14 bp, Homo sapiens
ttgtcaatattaaa

SEQ ID NO: 1550232 - DNA, 23 bp, Homo sapiens
ttgtcacaatcctaacacattat

SEQ ID NO: 1550233 - DNA, 17 bp, Homo sapiens
ttgtcacagaaatcaga

SEQ ID NO: 1550234 - DNA, 20 bp, Homo sapiens
ttgtcacagaaatcagagga

SEQ ID NO: 1550235 - DNA, 17 bp, Homo sapiens
ttgtcacctctctctga

SEQ ID NO: 1550236 - DNA, 18 bp, Homo sapiens
ttgtcacgatcacaggcc

SEQ ID NO: 1550237 - DNA, 14 bp, Homo sapiens
ttgtcagactttaa

SEQ ID NO: 1550238 - DNA, 22 bp, Homo sapiens
ttgtcagcatctgaccatctgt

SEQ ID NO: 1550239 - DNA, 21 bp, Homo sapiens
ttgtcagggatttagcccatg

SEQ ID NO: 1550240 - DNA, 22 bp, Homo sapiens
ttgtcatccacacaacaccagg

SEQ ID NO: 1550241 - DNA, 23 bp, Homo sapiens
ttgtcatccctgatgaatgtaaa

SEQ ID NO: 1550242 - DNA, 21 bp, Homo sapiens
ttgtcatggggatcaattttc

SEQ ID NO: 1550243 - DNA, 16 bp, Homo sapiens
ttgtcatgtaccatca

SEQ ID NO: 1550244 - DNA, 16 bp, Homo sapiens
ttgtcatgtagctgtt

SEQ ID NO: 1550245 - DNA, 13 bp, Homo sapiens
ttgtcatgtgtat

SEQ ID NO: 1550246 - DNA, 14 bp, Homo sapiens
ttgtcatgtgtata

SEQ ID NO: 1550247 - DNA, 22 bp, Homo sapiens
ttgtcatttcctttgttgtcta

SEQ ID NO: 1550248 - DNA, 16 bp, Homo sapiens
ttgtccaaataaattc

SEQ ID NO: 1550249 - DNA, 13 bp, Homo sapiens
ttgtccaatttgt

SEQ ID NO: 1550250 - DNA, 18 bp, Homo sapiens
ttgtccatcagattctgt

SEQ ID NO: 1550251 - DNA, 14 bp, Homo sapiens
ttgtccatgtcccc

SEQ ID NO: 1550252 - DNA, 17 bp, Homo sapiens
ttgtcccagcctggggc

SEQ ID NO: 1550253 - DNA, 18 bp, Homo sapiens
ttgtcccagcctggggct

SEQ ID NO: 1550254 - DNA, 14 bp, Homo sapiens
ttgtcccatttcct

SEQ ID NO: 1550255 - DNA, 15 bp, Homo sapiens
ttgtcccatttcctt

SEQ ID NO: 1550256 - DNA, 19 bp, Homo sapiens
ttgtcccatttccttggag

SEQ ID NO: 1550257 - DNA, 21 bp, Homo sapiens
ttgtcccctaagagtgtttaa

SEQ ID NO: 1550258 - DNA, 16 bp, Homo sapiens
ttgtccgctgggtggt

SEQ ID NO: 1550259 - DNA, 13 bp, Homo sapiens
ttgtcctggccct

SEQ ID NO: 1550260 - DNA, 13 bp, Homo sapiens
ttgtcctgtagct

SEQ ID NO: 1550261 - DNA, 16 bp, Homo sapiens
ttgtccttcagagctc

SEQ ID NO: 1550262 - DNA, 20 bp, Homo sapiens
ttgtcctttaaaaaagaaaa

SEQ ID NO: 1550263 - DNA, 15 bp, Homo sapiens
ttgtcctttatattt

SEQ ID NO: 1550264 - DNA, 17 bp, Homo sapiens
ttgtcctttcccttcag

SEQ ID NO: 1550265 - DNA, 17 bp, Homo sapiens
ttgtccttttatttctc

SEQ ID NO: 1550266 - DNA, 18 bp, Homo sapiens
ttgtcctttttcaggaga

SEQ ID NO: 1550267 - DNA, 23 bp, Homo sapiens
ttgtcgaaaagagtcttccaatt

SEQ ID NO: 1550268 - DNA, 19 bp, Homo sapiens
ttgtctaactcagaattat

SEQ ID NO: 1550269 - DNA, 19 bp, Homo sapiens
ttgtctatgaagttgctgt

SEQ ID NO: 1550270 - DNA, 17 bp, Homo sapiens
ttgtctattctgagcct

SEQ ID NO: 1550271 - DNA, 18 bp, Homo sapiens
ttgtctattctgagcctt

SEQ ID NO: 1550272 - DNA, 18 bp, Homo sapiens
ttgtctcaacgcctcccc

SEQ ID NO: 1550273 - DNA, 20 bp, Homo sapiens
ttgtctcaacgcctccccct

SEQ ID NO: 1550274 - DNA, 23 bp, Homo sapiens
ttgtctcaacgcctccccctccc

SEQ ID NO: 1550275 - DNA, 15 bp, Homo sapiens
ttgtctgaacttgca

SEQ ID NO: 1550276 - DNA, 12 bp, Homo sapiens
ttgtctgagcct

SEQ ID NO: 1550277 - DNA, 14 bp, Homo sapiens
ttgtctgaggcctc

SEQ ID NO: 1550278 - DNA, 19 bp, Homo sapiens
ttgtctgaggcctcatccc

SEQ ID NO: 1550279 - DNA, 20 bp, Homo sapiens
ttgtctgcgcctgaaaaggg

SEQ ID NO: 1550280 - DNA, 16 bp, Homo sapiens
ttgtctgggaattgtg

SEQ ID NO: 1550281 - DNA, 17 bp, Homo sapiens
ttgtctgtaaaaaatgg

SEQ ID NO: 1550282 - DNA, 16 bp, Homo sapiens
ttgtctgtcaaatgtt

SEQ ID NO: 1550283 - DNA, 22 bp, Homo sapiens
ttgtctgtcaaatgtttcctta

SEQ ID NO: 1550284 - DNA, 17 bp, Homo sapiens
ttgtctgtttgtttcaa

SEQ ID NO: 1550285 - DNA, 17 bp, Homo sapiens
ttgtcttaagtgtttct

SEQ ID NO: 1550286 - DNA, 15 bp, Homo sapiens
ttgtcttatatatat

SEQ ID NO: 1550287 - DNA, 20 bp, Homo sapiens
ttgtcttatgtgaaaaatta

SEQ ID NO: 1550288 - DNA, 17 bp, Homo sapiens
ttgtcttcaaactgtga

SEQ ID NO: 1550289 - DNA, 20 bp, Homo sapiens
ttggtgtaatttgaagattg

SEQ ID NO: 1550290 - DNA, 22 bp, Homo sapiens
ttggtgtacagaccacctttca

SEQ ID NO: 1550291 - DNA, 16 bp, Homo sapiens
ttggtgttcctggaag

SEQ ID NO: 1550292 - DNA, 15 bp, Homo sapiens
ttggttaaaactgta

SEQ ID NO: 1550293 - DNA, 20 bp, Homo sapiens
ttggttagaggaaggctgaa

SEQ ID NO: 1550294 - DNA, 21 bp, Homo sapiens
ttggttcaataaagcactgag

SEQ ID NO: 1550295 - DNA, 17 bp, Homo sapiens
ttggttcatcagtgtta

SEQ ID NO: 1550296 - DNA, 21 bp, Homo sapiens
ttggttccaagtctttgctat

SEQ ID NO: 1550297 - DNA, 22 bp, Homo sapiens
ttggttccaagtctttgctatt

SEQ ID NO: 1550298 - DNA, 15 bp, Homo sapiens
ttggttccttctctg

SEQ ID NO: 1550299 - DNA, 19 bp, Homo sapiens
ttggttctaatagaactca

SEQ ID NO: 1550300 - DNA, 19 bp, Homo sapiens
ttggttctgcttcaataaa

SEQ ID NO: 1550301 - DNA, 13 bp, Homo sapiens
ttggttggaagct

SEQ ID NO: 1550302 - DNA, 18 bp, Homo sapiens
ttggttgtcaatattaaa

SEQ ID NO: 1550303 - DNA, 15 bp, Homo sapiens
ttggttgtgccttcc

SEQ ID NO: 1550304 - DNA, 17 bp, Homo sapiens
ttggtttaaagaaagtg

SEQ ID NO: 1550305 - DNA, 23 bp, Homo sapiens
ttggtttaaagaaagtgtatttg

SEQ ID NO: 1550306 - DNA, 17 bp, Homo sapiens
ttggtttagctttggaa

SEQ ID NO: 1550307 - DNA, 13 bp, Homo sapiens
ttggtttccccaa

SEQ ID NO: 1550308 - DNA, 16 bp, Homo sapiens
ttggtttgtatgagat

SEQ ID NO: 1550309 - DNA, 14 bp, Homo sapiens
ttggtttgtttata

SEQ ID NO: 1550310 - DNA, 16 bp, Homo sapiens
ttggttttacacagga

SEQ ID NO: 1550311 - DNA, 15 bp, Homo sapiens
ttggttttttataaa

SEQ ID NO: 1550312 - DNA, 15 bp, Homo sapiens
ttgtaaaaaaagcaa

SEQ ID NO: 1550313 - DNA, 19 bp, Homo sapiens
ttgtaaaaaaagcaaaaat

SEQ ID NO: 1550314 - DNA, 21 bp, Homo sapiens
ttgtaaaaaaagcaaaaatga

SEQ ID NO: 1550315 - DNA, 15 bp, Homo sapiens
ttgccaagagcccgt

SEQ ID NO: 1550316 - DNA, 18 bp, Homo sapiens
ttgccaaggcagcgggat

SEQ ID NO: 1550317 - DNA, 20 bp, Homo sapiens
ttgccaataaagcttttgga

SEQ ID NO: 1550318 - DNA, 13 bp, Homo sapiens
ttgccaccaggag

SEQ ID NO: 1550319 - DNA, 14 bp, Homo sapiens
ttgccaccaggaga

SEQ ID NO: 1550320 - DNA, 17 bp, Homo sapiens
ttgccactctcctcccc

SEQ ID NO: 1550321 - DNA, 17 bp, Homo sapiens
ttgccactttggcttct

SEQ ID NO: 1550322 - DNA, 22 bp, Homo sapiens
ttgccagacatgtggtgggaca

SEQ ID NO: 1550323 - DNA, 19 bp, Homo sapiens
ttgccagagatccaaaaga

SEQ ID NO: 1550324 - DNA, 12 bp, Homo sapiens
ttgccagcacag

SEQ ID NO: 1550325 - DNA, 14 bp, Homo sapiens
ttgccagcacaggg

SEQ ID NO: 1550326 - DNA, 13 bp, Homo sapiens
ttgccagccagaa

SEQ ID NO: 1550327 - DNA, 21 bp, Homo sapiens
ttgccagccagaagcctctgc

SEQ ID NO: 1550328 - DNA, 13 bp, Homo sapiens
ttgccagtcagca

SEQ ID NO: 1550329 - DNA, 17 bp, Homo sapiens
ttgccatagccccatat

SEQ ID NO: 1550330 - DNA, 23 bp, Homo sapiens
ttgccatcccctatggaccagaa

SEQ ID NO: 1550331 - DNA, 12 bp, Homo sapiens
ttgcccacccct

SEQ ID NO: 1550332 - DNA, 13 bp, Homo sapiens
ttgcccacccctc

SEQ ID NO: 1550333 - DNA, 15 bp, Homo sapiens
ttgcccacccctcac

SEQ ID NO: 1550334 - DNA, 19 bp, Homo sapiens
ttgcccacccctcactccc

SEQ ID NO: 1550335 - DNA, 17 bp, Homo sapiens
ttgcccaggctggagtg

SEQ ID NO: 1550336 - DNA, 19 bp, Homo sapiens
ttgcccagggctcagcctg

SEQ ID NO: 1550337 - DNA, 16 bp, Homo sapiens
ttgcccatcctgactg

SEQ ID NO: 1550338 - DNA, 14 bp, Homo sapiens
ttgccccagtgtgg

SEQ ID NO: 1550339 - DNA, 22 bp, Homo sapiens
ttgccccatccagacctggctc

SEQ ID NO: 1550340 - DNA, 13 bp, Homo sapiens
ttgcccccatccc

SEQ ID NO: 1550341 - DNA, 23 bp, Homo sapiens
ttgcccccatggggtccttggag

SEQ ID NO: 1550342 - DNA, 16 bp, Homo sapiens
ttgccccctctcactt

SEQ ID NO: 1550343 - DNA, 23 bp, Homo sapiens
ttgccccgactccgcttcccctg

SEQ ID NO: 1550344 - DNA, 22 bp, Homo sapiens
ttgccccggccccggccccagc

SEQ ID NO: 1550345 - DNA, 21 bp, Homo sapiens
ttgcccctccgatgctgaggc

SEQ ID NO: 1550346 - DNA, 22 bp, Homo sapiens
ttgcccctccgatgctgaggcc

SEQ ID NO: 1550347 - DNA, 23 bp, Homo sapiens
ttgcccctccgatgctgaggcca

SEQ ID NO: 1550348 - DNA, 17 bp, Homo sapiens
ttgcccctggctttgcc

SEQ ID NO: 1550349 - DNA, 19 bp, Homo sapiens
ttgcccctttctcttttcc

SEQ ID NO: 1550350 - DNA, 16 bp, Homo sapiens
ttgcccgcacccctcc

SEQ ID NO: 1550351 - DNA, 21 bp, Homo sapiens
ttgcccgcacccctccctgct

SEQ ID NO: 1550352 - DNA, 15 bp, Homo sapiens
ttgcccgccagcctc

SEQ ID NO: 1550353 - DNA, 16 bp, Homo sapiens
ttgcccgccagcctca

SEQ ID NO: 1550354 - DNA, 17 bp, Homo sapiens
ttgcccggattctggga

SEQ ID NO: 1550355 - DNA, 19 bp, Homo sapiens
ttgcccggctgtgattgct

SEQ ID NO: 1550356 - DNA, 22 bp, Homo sapiens
ttgccctccctttctctctcca

SEQ ID NO: 1550357 - DNA, 18 bp, Homo sapiens
ttgccctccgcctgggat

SEQ ID NO: 1550358 - DNA, 16 bp, Homo sapiens
ttgcccttcacagtgt

SEQ ID NO: 1550359 - DNA, 17 bp, Homo sapiens
ttgcccttccctgtccc

SEQ ID NO: 1550360 - DNA, 18 bp, Homo sapiens
ttgccgagcctaatgaaa

SEQ ID NO: 1550361 - DNA, 17 bp, Homo sapiens
ttgccgggcctgggcct

SEQ ID NO: 1550362 - DNA, 18 bp, Homo sapiens
ttgcctaaatttaatgct

SEQ ID NO: 1550363 - DNA, 18 bp, Homo sapiens
ttgcctacaataaaaaga

SEQ ID NO: 1550364 - DNA, 22 bp, Homo sapiens
ttgcctagaaatatctttctct

SEQ ID NO: 1550365 - DNA, 21 bp, Homo sapiens
ttgcctaggctggaaatagga

SEQ ID NO: 1550366 - DNA, 15 bp, Homo sapiens
ttgcctcatttccct

SEQ ID NO: 1550367 - DNA, 16 bp, Homo sapiens
ttgcctcatttcccta

SEQ ID NO: 1550368 - DNA, 20 bp, Homo sapiens
ttgcctccaggtgcagaggt

SEQ ID NO: 1550369 - DNA, 19 bp, Homo sapiens
ttgcctcctgttctgccca

SEQ ID NO: 1550370 - DNA, 15 bp, Homo sapiens
ttgcctccttttttc

SEQ ID NO: 1550371 - DNA, 14 bp, Homo sapiens
ttgcctctgccctg

SEQ ID NO: 1550372 - DNA, 18 bp, Homo sapiens
ttgcctctgtccccttct

SEQ ID NO: 1550373 - DNA, 19 bp, Homo sapiens
ttgcctctgtccccttctc

SEQ ID NO: 1550374 - DNA, 19 bp, Homo sapiens
ttgcctctgtgctgtgtgt

SEQ ID NO: 1550375 - DNA, 19 bp, Homo sapiens
ttgcctcttccagtcttcc

SEQ ID NO: 1550376 - DNA, 12 bp, Homo sapiens
ttgcctcttctt

SEQ ID NO: 1550377 - DNA, 15 bp, Homo sapiens
ttgcctcttctttgt

SEQ ID NO: 1550378 - DNA, 22 bp, Homo sapiens
ttgcctgaacatccttccttcc

SEQ ID NO: 1550379 - DNA, 19 bp, Homo sapiens
ttgcctgaactcctgccat

SEQ ID NO: 1550380 - DNA, 17 bp, Homo sapiens
ttgcctgcacccttccc

SEQ ID NO: 1550381 - DNA, 19 bp, Homo sapiens
ttgcctgcacccttccctc

SEQ ID NO: 1550382 - DNA, 21 bp, Homo sapiens
ttgcctgcacccttccctctt

SEQ ID NO: 1550383 - DNA, 12 bp, Homo sapiens
ttgcctggactg

SEQ ID NO: 1550384 - DNA, 16 bp, Homo sapiens
ttgcctggactgacca

SEQ ID NO: 1550385 - DNA, 11 bp, Homo sapiens
ttgcctggcct

SEQ ID NO: 1550386 - DNA, 12 bp, Homo sapiens
ttgcctggctgt

SEQ ID NO: 1550387 - DNA, 16 bp, Homo sapiens
ttgcctggctgtggag

SEQ ID NO: 1550388 - DNA, 21 bp, Homo sapiens
ttgcctggctgtggaggcctg

SEQ ID NO: 1550389 - DNA, 12 bp, Homo sapiens
ttgcctgttctg

SEQ ID NO: 1550390 - DNA, 15 bp, Homo sapiens
ttgcctgttctgctt

SEQ ID NO: 1550391 - DNA, 18 bp, Homo sapiens
ttgcctgttggctgctgc

SEQ ID NO: 1550392 - DNA, 21 bp, Homo sapiens
ttgcctgtttctgatttgctg

SEQ ID NO: 1550393 - DNA, 20 bp, Homo sapiens
ttgccttaataaatatgtaa

SEQ ID NO: 1550394 - DNA, 22 bp, Homo sapiens
ttgccttaataaatatgtaata

SEQ ID NO: 1550395 - DNA, 12 bp, Homo sapiens
ttgccttatttg

SEQ ID NO: 1550396 - DNA, 19 bp, Homo sapiens
ttgccttatttgtctgtaa

SEQ ID NO: 1550397 - DNA, 20 bp, Homo sapiens
ttgccttatttgtctgtaaa

SEQ ID NO: 1550398 - DNA, 21 bp, Homo sapiens
ttgccttctggagctgggaga

SEQ ID NO: 1550399 - DNA, 15 bp, Homo sapiens
ttgccttctttactc

SEQ ID NO: 1550400 - DNA, 18 bp, Homo sapiens
ttgcctttatctctgagg

SEQ ID NO: 1550401 - DNA, 20 bp, Homo sapiens
ttgcctttatctctgaggct

SEQ ID NO: 1550402 - DNA, 18 bp, Homo sapiens
ttgcctttcgaggcctga

SEQ ID NO: 1550403 - DNA, 12 bp, Homo sapiens
ttgcctttctgt

SEQ ID NO: 1550404 - DNA, 14 bp, Homo sapiens
ttgcctttgaagag

SEQ ID NO: 1550405 - DNA, 17 bp, Homo sapiens
ttgcctttgttttgatg

SEQ ID NO: 1550406 - DNA, 15 bp, Homo sapiens
ttgccttttaatttt

SEQ ID NO: 1550407 - DNA, 22 bp, Homo sapiens
ttgcctttttaagtaaaaaaga

SEQ ID NO: 1550408 - DNA, 19 bp, Homo sapiens
ttgcgatagagtctcactg

SEQ ID NO: 1550409 - DNA, 20 bp, Homo sapiens
ttgcgctctcaagaccagag

SEQ ID NO: 1550410 - DNA, 16 bp, Homo sapiens
ttgcgctggtggacca

SEQ ID NO: 1550411 - DNA, 16 bp, Homo sapiens
ttgcggcaaaaggaaa

SEQ ID NO: 1550412 - DNA, 18 bp, Homo sapiens
ttgcgtagaggctacagg

SEQ ID NO: 1550413 - DNA, 15 bp, Homo sapiens
ttgcgtggactctgc

SEQ ID NO: 1550414 - DNA, 18 bp, Homo sapiens
ttgcgtggactctgcaca

SEQ ID NO: 1550415 - DNA, 23 bp, Homo sapiens
ttgctaaaaaagcatatataact

SEQ ID NO: 1550416 - DNA, 13 bp, Homo sapiens
ttgctaaactgat

SEQ ID NO: 1550417 - DNA, 16 bp, Homo sapiens
ttgctaaagcactttg

SEQ ID NO: 1550418 - DNA, 17 bp, Homo sapiens
ttgctaatttttattaa

SEQ ID NO: 1550419 - DNA, 23 bp, Homo sapiens
ttgctacaaatttatgcatttca

SEQ ID NO: 1550420 - DNA, 19 bp, Homo sapiens
ttgctaccacagacttgca

SEQ ID NO: 1550421 - DNA, 15 bp, Homo sapiens
ttgctaccagtattt

SEQ ID NO: 1550422 - DNA, 20 bp, Homo sapiens
ttgctaccagtatttagaag

SEQ ID NO: 1550423 - DNA, 22 bp, Homo sapiens
ttgctaccagtatttagaagcc

SEQ ID NO: 1550424 - DNA, 21 bp, Homo sapiens
ttgctacccatttacaaataa

SEQ ID NO: 1550425 - DNA, 19 bp, Homo sapiens
ttgctacctgtgagcatcc

SEQ ID NO: 1550426 - DNA, 17 bp, Homo sapiens
ttgctacgattccactg

SEQ ID NO: 1550427 - DNA, 22 bp, Homo sapiens
ttgctatcaacaataaaatttt

SEQ ID NO: 1550428 - DNA, 23 bp, Homo sapiens
ttgctatggcaggataagaaagc

SEQ ID NO: 1550429 - DNA, 14 bp, Homo sapiens
ttgctatgtaaggg

SEQ ID NO: 1550430 - DNA, 23 bp, Homo sapiens
ttgctatgttactattttctaca

SEQ ID NO: 1550431 - DNA, 20 bp, Homo sapiens
ttctgcagatcttccgtggt

SEQ ID NO: 1550432 - DNA, 21 bp, Homo sapiens
ttctgcagcatgacctgtgac

SEQ ID NO: 1550433 - DNA, 20 bp, Homo sapiens
ttctgcatcatctgtagata

SEQ ID NO: 1550434 - DNA, 18 bp, Homo sapiens
ttctgcatggattcagca

SEQ ID NO: 1550435 - DNA, 20 bp, Homo sapiens
ttctgcatggattcagcatg

SEQ ID NO: 1550436 - DNA, 15 bp, Homo sapiens
ttctgccacataaaa

SEQ ID NO: 1550437 - DNA, 15 bp, Homo sapiens
ttctgccactgagga

SEQ ID NO: 1550438 - DNA, 19 bp, Homo sapiens
ttctgccactgaggagaca

SEQ ID NO: 1550439 - DNA, 20 bp, Homo sapiens
ttctgccactgaggagacag

SEQ ID NO: 1550440 - DNA, 14 bp, Homo sapiens
ttgattattatgtt

SEQ ID NO: 1550441 - DNA, 20 bp, Homo sapiens
ttgattattctgattccact

SEQ ID NO: 1550442 - DNA, 17 bp, Homo sapiens
ttgattcaaggctcaga

SEQ ID NO: 1550443 - DNA, 21 bp, Homo sapiens
ttgattcacagtggtcccatt

SEQ ID NO: 1550444 - DNA, 14 bp, Homo sapiens
ttgattcagcaaaa

SEQ ID NO: 1550445 - DNA, 17 bp, Homo sapiens
ttgattcagtcttctgg

SEQ ID NO: 1550446 - DNA, 13 bp, Homo sapiens
ttgattcctggct

SEQ ID NO: 1550447 - DNA, 22 bp, Homo sapiens
ttgattcgtatgatcagtactg

SEQ ID NO: 1550448 - DNA, 17 bp, Homo sapiens
ttgattctccttcagcc

SEQ ID NO: 1550449 - DNA, 11 bp, Homo sapiens
ttcctgctgca

SEQ ID NO: 1550450 - DNA, 23 bp, Homo sapiens
ttcctgctgctgtaactgctgag

SEQ ID NO: 1550451 - DNA, 17 bp, Homo sapiens
ttcctgctgtcctggtg

SEQ ID NO: 1550452 - DNA, 12 bp, Homo sapiens
ttcctgcttccc

SEQ ID NO: 1550453 - DNA, 17 bp, Homo sapiens
ttcctgcttcctcagag

SEQ ID NO: 1550454 - DNA, 16 bp, Homo sapiens
ttcctggaaacagcat

SEQ ID NO: 1550455 - DNA, 17 bp, Homo sapiens
ttcctggaaacagcatg

SEQ ID NO: 1550456 - DNA, 19 bp, Homo sapiens
ttcctggaaacagcatgaa

SEQ ID NO: 1550457 - DNA, 21 bp, Homo sapiens
ttcctggaaacagcatgaata

SEQ ID NO: 1550458 - DNA, 17 bp, Homo sapiens
ttcctggaattgccagc

SEQ ID NO: 1550459 - DNA, 22 bp, Homo sapiens
ttcctggaattgccagctgaca

SEQ ID NO: 1550460 - DNA, 15 bp, Homo sapiens
ttcctggagcccaga

SEQ ID NO: 1550461 - DNA, 13 bp, Homo sapiens
ttcctggagcccg

SEQ ID NO: 1550462 - DNA, 20 bp, Homo sapiens
ttcctggagcccgaggcacc

SEQ ID NO: 1550463 - DNA, 18 bp, Homo sapiens
ttcctggattttctttct

SEQ ID NO: 1550464 - DNA, 19 bp, Homo sapiens
ttcctggattttctttcta

SEQ ID NO: 1550465 - DNA, 21 bp, Homo sapiens
ttcctggattttctttctatg

SEQ ID NO: 1550466 - DNA, 22 bp, Homo sapiens
ttcctggattttctttctatgt

SEQ ID NO: 1550467 - DNA, 21 bp, Homo sapiens
ttcctggcccactctgtaata

SEQ ID NO: 1550468 - DNA, 24 bp, Homo sapiens
ttcctggccccgggctctggccac

SEQ ID NO: 1550469 - DNA, 16 bp, Homo sapiens
ttcctggccctccact

SEQ ID NO: 1550470 - DNA, 10 bp, Homo sapiens
ttcctggcct

SEQ ID NO: 1550471 - DNA, 21 bp, Homo sapiens
ttcctggcctcactggctggg

SEQ ID NO: 1550472 - DNA, 12 bp, Homo sapiens
ttcctggcctcc

SEQ ID NO: 1550473 - DNA, 13 bp, Homo sapiens
ttcctggcctccc

SEQ ID NO: 1550474 - DNA, 20 bp, Homo sapiens
ttcctggcctcccttctcct

SEQ ID NO: 1550475 - DNA, 23 bp, Homo sapiens
ttcctggctctaccctgtctgtc

SEQ ID NO: 1550476 - DNA, 20 bp, Homo sapiens
ttcctggctgatgatccaga

SEQ ID NO: 1550477 - DNA, 16 bp, Homo sapiens
ttcctgggaacatcac

SEQ ID NO: 1550478 - DNA, 14 bp, Homo sapiens
ttcctgggcctgtc

SEQ ID NO: 1550479 - DNA, 16 bp, Homo sapiens
ttcctgggcctgtccc

SEQ ID NO: 1550480 - DNA, 14 bp, Homo sapiens
ttcctggggatgtc

SEQ ID NO: 1550481 - DNA, 17 bp, Homo sapiens
ttcctggggatgtcata

SEQ ID NO: 1550482 - DNA, 17 bp, Homo sapiens
ttcctgggtcctgcctg

SEQ ID NO: 1550483 - DNA, 16 bp, Homo sapiens
ttcctggtacccagcc

SEQ ID NO: 1550484 - DNA, 21 bp, Homo sapiens
ttcctggtacccagccatctg

SEQ ID NO: 1550485 - DNA, 18 bp, Homo sapiens
ttcctgtaaataagagtt

SEQ ID NO: 1550486 - DNA, 20 bp, Homo sapiens
ttcctgtaaataagagttgc

SEQ ID NO: 1550487 - DNA, 16 bp, Homo sapiens
ttcctgtactactgcc

SEQ ID NO: 1550488 - DNA, 17 bp, Homo sapiens
ttcctgtactactgcct

SEQ ID NO: 1550489 - DNA, 16 bp, Homo sapiens
ttcctgtactgtgtct

SEQ ID NO: 1550490 - DNA, 16 bp, Homo sapiens
ttcctgtccagctcca

SEQ ID NO: 1550491 - DNA, 17 bp, Homo sapiens
ttcctgtccagctccaa

SEQ ID NO: 1550492 - DNA, 14 bp, Homo sapiens
ttcctgtcttcctg

SEQ ID NO: 1550493 - DNA, 17 bp, Homo sapiens
ttcctgtgatccaccca

SEQ ID NO: 1550494 - DNA, 15 bp, Homo sapiens
ttcctgtgccctaga

SEQ ID NO: 1550495 - DNA, 16 bp, Homo sapiens
ttcctgtgtccatgtg

SEQ ID NO: 1550496 - DNA, 14 bp, Homo sapiens
ttcctgttcagtaa

SEQ ID NO: 1550497 - DNA, 19 bp, Homo sapiens
ttcctgttcagtaataaaa

SEQ ID NO: 1550498 - DNA, 19 bp, Homo sapiens
ttcctgtttcagacccccc

SEQ ID NO: 1550499 - DNA, 17 bp, Homo sapiens
ttcctgtttgggaagag

SEQ ID NO: 1550500 - DNA, 15 bp, Homo sapiens
ttccttaaactgtgt

SEQ ID NO: 1550501 - DNA, 17 bp, Homo sapiens
ttccttaaatgactttt

SEQ ID NO: 1550502 - DNA, 18 bp, Homo sapiens
ttccttacagaactactt

SEQ ID NO: 1550503 - DNA, 18 bp, Homo sapiens
ttccttagacccgccagg

SEQ ID NO: 1550504 - DNA, 14 bp, Homo sapiens
ttccttatccctct

SEQ ID NO: 1550505 - DNA, 18 bp, Homo sapiens
ttccttatccctctcttc

SEQ ID NO: 1550506 - DNA, 17 bp, Homo sapiens
ttccttcacatcctgtg

SEQ ID NO: 1550507 - DNA, 13 bp, Homo sapiens
ttccttcaggttt

SEQ ID NO: 1550508 - DNA, 14 bp, Homo sapiens
ttccttcagtttgt

SEQ ID NO: 1550509 - DNA, 18 bp, Homo sapiens
ttccttcagtttgtaaag

SEQ ID NO: 1550510 - DNA, 20 bp, Homo sapiens
ttccttccatccctaccccc

SEQ ID NO: 1550511 - DNA, 14 bp, Homo sapiens
ttccttcccaggcc

SEQ ID NO: 1550512 - DNA, 21 bp, Homo sapiens
ttccttcccaggccctttggc

SEQ ID NO: 1550513 - DNA, 12 bp, Homo sapiens
ttccttccctgg

SEQ ID NO: 1550514 - DNA, 14 bp, Homo sapiens
ttccttccctggct

SEQ ID NO: 1550515 - DNA, 13 bp, Homo sapiens
ttccttccctggg

SEQ ID NO: 1550516 - DNA, 20 bp, Homo sapiens
ttccttccctgggctgtgct

SEQ ID NO: 1550517 - DNA, 20 bp, Homo sapiens
ttccttcgaaaggccttcag

SEQ ID NO: 1550518 - DNA, 21 bp, Homo sapiens
ttccttcgaaaggccttcaga

SEQ ID NO: 1550519 - DNA, 14 bp, Homo sapiens
ttccttctcatctg

SEQ ID NO: 1550520 - DNA, 13 bp, Homo sapiens
ttccttctctggg

SEQ ID NO: 1550521 - DNA, 13 bp, Homo sapiens
ttccttctggcct

SEQ ID NO: 1550522 - DNA, 20 bp, Homo sapiens
ttccttctgggactggacag

SEQ ID NO: 1550523 - DNA, 20 bp, Homo sapiens
ttccttctgtgaaagtacat

SEQ ID NO: 1550524 - DNA, 19 bp, Homo sapiens
ttccttgaaaataaaaaga

SEQ ID NO: 1550525 - DNA, 22 bp, Homo sapiens
ttccttgagacacggagcccag

SEQ ID NO: 1550526 - DNA, 12 bp, Homo sapiens
ttccttgcctta

SEQ ID NO: 1550527 - DNA, 13 bp, Homo sapiens
ttccttgccttct

SEQ ID NO: 1550528 - DNA, 18 bp, Homo sapiens
ttccttgctgtcctaggc

SEQ ID NO: 1550529 - DNA, 20 bp, Homo sapiens
ttccttgctgtcctaggcca

SEQ ID NO: 1550530 - DNA, 20 bp, Homo sapiens
ttccttggactcattttaaa

SEQ ID NO: 1550531 - DNA, 18 bp, Homo sapiens
ttccttgtatttaaatat

SEQ ID NO: 1550532 - DNA, 13 bp, Homo sapiens
ttccttgtcacca

SEQ ID NO: 1550533 - DNA, 16 bp, Homo sapiens
ttccttgtcaccagca

SEQ ID NO: 1550534 - DNA, 13 bp, Homo sapiens
ttcctttaaaaaa

SEQ ID NO: 1550535 - DNA, 13 bp, Homo sapiens
ttcctttataatg

SEQ ID NO: 1550536 - DNA, 15 bp, Homo sapiens
ttcctttatgtgaat

SEQ ID NO: 1550537 - DNA, 20 bp, Homo sapiens
ttcctttcatctctctacct

SEQ ID NO: 1550538 - DNA, 14 bp, Homo sapiens
ttcctttccttttc

SEQ ID NO: 1550539 - DNA, 20 bp, Homo sapiens
ttgattctccttcagccctc

SEQ ID NO: 1550540 - DNA, 11 bp, Homo sapiens
ttgattctgat

SEQ ID NO: 1550541 - DNA, 19 bp, Homo sapiens
ttgattgactgcccattca

SEQ ID NO: 1550542 - DNA, 13 bp, Homo sapiens
ttgattgaggagc

SEQ ID NO: 1550543 - DNA, 12 bp, Homo sapiens
ttgattggcttt

SEQ ID NO: 1550544 - DNA, 19 bp, Homo sapiens
ttgattgggaaaacatttg

SEQ ID NO: 1550545 - DNA, 17 bp, Homo sapiens
ttgattgtcagctacta

SEQ ID NO: 1550546 - DNA, 17 bp, Homo sapiens
ttgatttaaacacacag

SEQ ID NO: 1550547 - DNA, 12 bp, Homo sapiens
ttgatttcaaca

SEQ ID NO: 1550548 - DNA, 19 bp, Homo sapiens
ttgatttccatcttaatgt

SEQ ID NO: 1550549 - DNA, 19 bp, Homo sapiens
ttgattttaaaatgtacat

SEQ ID NO: 1550550 - DNA, 14 bp, Homo sapiens
ttgattttcaagct

SEQ ID NO: 1550551 - DNA, 22 bp, Homo sapiens
ttgattttccatctaaaaatat

SEQ ID NO: 1550552 - DNA, 16 bp, Homo sapiens
ttgattttggaaagat

SEQ ID NO: 1550553 - DNA, 17 bp, Homo sapiens
ttgatttttctcttcat

SEQ ID NO: 1550554 - DNA, 20 bp, Homo sapiens
ttgatttttgcctcttccag

SEQ ID NO: 1550555 - DNA, 15 bp, Homo sapiens
ttgcaaaagtgtatg

SEQ ID NO: 1550556 - DNA, 11 bp, Homo sapiens
ttgcaaaattt

SEQ ID NO: 1550557 - DNA, 23 bp, Homo sapiens
ttgcaaaatttccagtacctttg

SEQ ID NO: 1550558 - DNA, 17 bp, Homo sapiens
ttgcaaagggaaacagg

SEQ ID NO: 1550559 - DNA, 20 bp, Homo sapiens
ttgcaaattattctagtcaa

SEQ ID NO: 1550560 - DNA, 12 bp, Homo sapiens
ttgcaacaaaat

SEQ ID NO: 1550561 - DNA, 21 bp, Homo sapiens
ttgcaacaggggaggaaaaaa

SEQ ID NO: 1550562 - DNA, 14 bp, Homo sapiens
ttgcaaccgtctgt

SEQ ID NO: 1550563 - DNA, 16 bp, Homo sapiens
ttgcaagatgtgaatt

SEQ ID NO: 1550564 - DNA, 19 bp, Homo sapiens
ttgcaagatgtgaattatt

SEQ ID NO: 1550565 - DNA, 16 bp, Homo sapiens
ttgcaaggcagtctct

SEQ ID NO: 1550566 - DNA, 13 bp, Homo sapiens
ttgcaataacttc

SEQ ID NO: 1550567 - DNA, 18 bp, Homo sapiens
ttgcaataacttctatat

SEQ ID NO: 1550568 - DNA, 13 bp, Homo sapiens
ttgcaataatact

SEQ ID NO: 1550569 - DNA, 15 bp, Homo sapiens
ttgcaatatctgaag

SEQ ID NO: 1550570 - DNA, 14 bp, Homo sapiens
ttgcaatgtattta

SEQ ID NO: 1550571 - DNA, 22 bp, Homo sapiens
ttgcaatgtcacaacctctctg

SEQ ID NO: 1550572 - DNA, 24 bp, Homo sapiens
ttgcacaaacttgtgagcatcaga

SEQ ID NO: 1550573 - DNA, 16 bp, Homo sapiens
ttgcacacagtacaca

SEQ ID NO: 1550574 - DNA, 13 bp, Homo sapiens
ttgcacacttccc

SEQ ID NO: 1550575 - DNA, 18 bp, Homo sapiens
ttgcacagccaaatttaa

SEQ ID NO: 1550576 - DNA, 16 bp, Homo sapiens
ttgcacatgtttcctc

SEQ ID NO: 1550577 - DNA, 12 bp, Homo sapiens
ttgcacattttg

SEQ ID NO: 1550578 - DNA, 22 bp, Homo sapiens
ttgcaccatactccttgcttcc

SEQ ID NO: 1550579 - DNA, 16 bp, Homo sapiens
ttgcacccctcccatt

SEQ ID NO: 1550580 - DNA, 16 bp, Homo sapiens
ttgcacccgcctctcc

SEQ ID NO: 1550581 - DNA, 16 bp, Homo sapiens
ttgcacctctgctgat

SEQ ID NO: 1550582 - DNA, 14 bp, Homo sapiens
ttgcacctgagacc

SEQ ID NO: 1550583 - DNA, 13 bp, Homo sapiens
ttgcacctgtccc

SEQ ID NO: 1550584 - DNA, 20 bp, Homo sapiens
ttgcactcaaatcttaagaa

SEQ ID NO: 1550585 - DNA, 21 bp, Homo sapiens
ttgcactcaaatcttaagaaa

SEQ ID NO: 1550586 - DNA, 17 bp, Homo sapiens
ttgcactccacacatct

SEQ ID NO: 1550587 - DNA, 22 bp, Homo sapiens
ttgcactccacacatctttctt

SEQ ID NO: 1550588 - DNA, 15 bp, Homo sapiens
ttgcactccagcctg

SEQ ID NO: 1550589 - DNA, 17 bp, Homo sapiens
ttgcactggagttctat

SEQ ID NO: 1550590 - DNA, 12 bp, Homo sapiens
ttgcactgtaat

SEQ ID NO: 1550591 - DNA, 21 bp, Homo sapiens
ttgcactgtgtgctgactgaa

SEQ ID NO: 1550592 - DNA, 18 bp, Homo sapiens
ttgcacttattgtcccct

SEQ ID NO: 1550593 - DNA, 17 bp, Homo sapiens
ttgcacttgtgattatt

SEQ ID NO: 1550594 - DNA, 21 bp, Homo sapiens
ttgcactttcagactctctct

SEQ ID NO: 1550595 - DNA, 20 bp, Homo sapiens
ttgcactttttaagtttgaa

SEQ ID NO: 1550596 - DNA, 19 bp, Homo sapiens
ttgcagaaaagcacctgcc

SEQ ID NO: 1550597 - DNA, 12 bp, Homo sapiens
ttgcagaaagga

SEQ ID NO: 1550598 - DNA, 19 bp, Homo sapiens
ttgcagaactaaactcatt

SEQ ID NO: 1550599 - DNA, 16 bp, Homo sapiens
ttgcagaactgtagct

SEQ ID NO: 1550600 - DNA, 13 bp, Homo sapiens
ttgcagactagaa

SEQ ID NO: 1550601 - DNA, 14 bp, Homo sapiens
ttgcagagacagga

SEQ ID NO: 1550602 - DNA, 19 bp, Homo sapiens
ttgcagagacaggacctga

SEQ ID NO: 1550603 - DNA, 20 bp, Homo sapiens
ttgcagagatttcctccatg

SEQ ID NO: 1550604 - DNA, 23 bp, Homo sapiens
ttgcagataaactgatgtttgaa

SEQ ID NO: 1550605 - DNA, 12 bp, Homo sapiens
ttgcagcagtga

SEQ ID NO: 1550606 - DNA, 14 bp, Homo sapiens
ttgcagcagtgagt

SEQ ID NO: 1550607 - DNA, 23 bp, Homo sapiens
ttgcagcagtgagtctcttcaga

SEQ ID NO: 1550608 - DNA, 18 bp, Homo sapiens
ttgcagccggcacagggt

SEQ ID NO: 1550609 - DNA, 22 bp, Homo sapiens
ttgcagcctgctctagtgggac

SEQ ID NO: 1550610 - DNA, 23 bp, Homo sapiens
ttgcagcctgctctagtgggaca

SEQ ID NO: 1550611 - DNA, 11 bp, Homo sapiens
ttgcagctgtg

SEQ ID NO: 1550612 - DNA, 22 bp, Homo sapiens
ttgcagcttttggttaatatgt

SEQ ID NO: 1550613 - DNA, 23 bp, Homo sapiens
ttgcagggtcctcttctgggcct

SEQ ID NO: 1550614 - DNA, 12 bp, Homo sapiens
ttgcaggtcagc

SEQ ID NO: 1550615 - DNA, 20 bp, Homo sapiens
ttgcagtagagtcatctcca

SEQ ID NO: 1550616 - DNA, 14 bp, Homo sapiens
ttgcagtatgaact

SEQ ID NO: 1550617 - DNA, 21 bp, Homo sapiens
ttgcagtccagctctttagaa

SEQ ID NO: 1550618 - DNA, 13 bp, Homo sapiens
ttgcagtgagcca

SEQ ID NO: 1550619 - DNA, 15 bp, Homo sapiens
ttgcagtggcctggc

SEQ ID NO: 1550620 - DNA, 17 bp, Homo sapiens
ttgcagtggcctggccg

SEQ ID NO: 1550621 - DNA, 22 bp, Homo sapiens
ttgcagttagccccagaaaatg

SEQ ID NO: 1550622 - DNA, 20 bp, Homo sapiens
ttgcagttcaaatcctcacc

SEQ ID NO: 1550623 - DNA, 21 bp, Homo sapiens
ttgcagttggactctcaggga

SEQ ID NO: 1550624 - DNA, 16 bp, Homo sapiens
ttgcataagattaaag

SEQ ID NO: 1550625 - DNA, 23 bp, Homo sapiens
ttgcataagattaaaggaaggaa

SEQ ID NO: 1550626 - DNA, 20 bp, Homo sapiens
ttgcataataagctaaagag

SEQ ID NO: 1550627 - DNA, 19 bp, Homo sapiens
ttgcataggctcttaagca

SEQ ID NO: 1550628 - DNA, 20 bp, Homo sapiens
ttgcataggctcttaagcag

SEQ ID NO: 1550629 - DNA, 21 bp, Homo sapiens
ttgcatatcacccttccctgc

SEQ ID NO: 1550630 - DNA, 18 bp, Homo sapiens
ttgcatattttgagaaac

SEQ ID NO: 1550631 - DNA, 20 bp, Homo sapiens
ttgcatattttgagaaactg

SEQ ID NO: 1550632 - DNA, 20 bp, Homo sapiens
ttgcatcactgtatcatttt

SEQ ID NO: 1550633 - DNA, 22 bp, Homo sapiens
ttgcatcacttaacggaccaaa

SEQ ID NO: 1550634 - DNA, 18 bp, Homo sapiens
ttgcatccaactccagga

SEQ ID NO: 1550635 - DNA, 23 bp, Homo sapiens
ttgcatcccaaaccacgcctctt

SEQ ID NO: 1550636 - DNA, 18 bp, Homo sapiens
ttgcatgaattactgtat

SEQ ID NO: 1550637 - DNA, 13 bp, Homo sapiens
ttgcatgatatct

SEQ ID NO: 1550638 - DNA, 17 bp, Homo sapiens
ttgcatgcatgcaaatg

SEQ ID NO: 1550639 - DNA, 17 bp, Homo sapiens
ttgcatgtagtaacact

SEQ ID NO: 1550640 - DNA, 21 bp, Homo sapiens
ttgcatgtagtaacactaata

SEQ ID NO: 1550641 - DNA, 20 bp, Homo sapiens
ttgcatgtgaaaatcaaata

SEQ ID NO: 1550642 - DNA, 13 bp, Homo sapiens
ttgcattccagaa

SEQ ID NO: 1550643 - DNA, 21 bp, Homo sapiens
ttgcattccagaatcttgact

SEQ ID NO: 1550644 - DNA, 14 bp, Homo sapiens
ttgcattgaatata

SEQ ID NO: 1550645 - DNA, 16 bp, Homo sapiens
ttgcattgattgctac

SEQ ID NO: 1550646 - DNA, 15 bp, Homo sapiens
ttgcattgtatgaaa

SEQ ID NO: 1550647 - DNA, 15 bp, Homo sapiens
ttgcatttgctcttt

SEQ ID NO: 1550648 - DNA, 22 bp, Homo sapiens
ttgcatttgtggtaatctacac

SEQ ID NO: 1550649 - DNA, 18 bp, Homo sapiens
ttgccaaaataccagagc

SEQ ID NO: 1550650 - DNA, 16 bp, Homo sapiens
ttgccaaagtacagaa

SEQ ID NO: 1550651 - DNA, 18 bp, Homo sapiens
ttgccaaatatgtcctgg

SEQ ID NO: 1550652 - DNA, 23 bp, Homo sapiens
ttgccaaattgctgcatatttgt

SEQ ID NO: 1550653 - DNA, 14 bp, Homo sapiens
ttgccaacagttgt

SEQ ID NO: 1550654 - DNA, 20 bp, Homo sapiens
ttgccaacagttgtatgttt

SEQ ID NO: 1550655 - DNA, 12 bp, Homo sapiens
ttccctggacag

SEQ ID NO: 1550656 - DNA, 16 bp, Homo sapiens
ttccctggaggagaag

SEQ ID NO: 1550657 - DNA, 14 bp, Homo sapiens
ttccctgggaaggc

SEQ ID NO: 1550658 - DNA, 21 bp, Homo sapiens
ttccctgttgaattggtgaat

SEQ ID NO: 1550659 - DNA, 15 bp, Homo sapiens
ttcccttagcctctc

SEQ ID NO: 1550660 - DNA, 17 bp, Homo sapiens
ttcccttagcctctccc

SEQ ID NO: 1550661 - DNA, 18 bp, Homo sapiens
ttcccttagcctctccca

SEQ ID NO: 1550662 - DNA, 22 bp, Homo sapiens
ttcccttagcctctcccacccg

SEQ ID NO: 1550663 - DNA, 22 bp, Homo sapiens
ttcccttcctcttcctgccctt

SEQ ID NO: 1550664 - DNA, 17 bp, Homo sapiens
ttcccttctccccagcc

SEQ ID NO: 1550665 - DNA, 18 bp, Homo sapiens
ttcccttctccccagcca

SEQ ID NO: 1550666 - DNA, 20 bp, Homo sapiens
ttcccttctccccagccaga

SEQ ID NO: 1550667 - DNA, 16 bp, Homo sapiens
ttcccttctcccttgc

SEQ ID NO: 1550668 - DNA, 11 bp, Homo sapiens
ttcccttctct

SEQ ID NO: 1550669 - DNA, 16 bp, Homo sapiens
ttcccttctctggtct

SEQ ID NO: 1550670 - DNA, 15 bp, Homo sapiens
ttcccttctcttggg

SEQ ID NO: 1550671 - DNA, 14 bp, Homo sapiens
ttcccttctgggct

SEQ ID NO: 1550672 - DNA, 13 bp, Homo sapiens
ttcccttgctgta

SEQ ID NO: 1550673 - DNA, 20 bp, Homo sapiens
ttcccttggaatgcatatcg

SEQ ID NO: 1550674 - DNA, 15 bp, Homo sapiens
ttcccttggcctcag

SEQ ID NO: 1550675 - DNA, 15 bp, Homo sapiens
ttccctttagctgtg

SEQ ID NO: 1550676 - DNA, 18 bp, Homo sapiens
ttccctttgccacactgt

SEQ ID NO: 1550677 - DNA, 19 bp, Homo sapiens
ttcccttttaatcaactgt

SEQ ID NO: 1550678 - DNA, 23 bp, Homo sapiens
ttccgaagagggaatggatgggg

SEQ ID NO: 1550679 - DNA, 18 bp, Homo sapiens
ttccgagatccccagggc

SEQ ID NO: 1550680 - DNA, 20 bp, Homo sapiens
ttccgagatccccagggcag

SEQ ID NO: 1550681 - DNA, 21 bp, Homo sapiens
ttccgagatccccagggcagc

SEQ ID NO: 1550682 - DNA, 22 bp, Homo sapiens
ttccgatcaacatttatgacct

SEQ ID NO: 1550683 - DNA, 13 bp, Homo sapiens
ttccgcctcctgt

SEQ ID NO: 1550684 - DNA, 12 bp, Homo sapiens
ttccgctgaggg

SEQ ID NO: 1550685 - DNA, 19 bp, Homo sapiens
ttccgctttgaaagaagca

SEQ ID NO: 1550686 - DNA, 20 bp, Homo sapiens
ttccgggtctcgcagcctga

SEQ ID NO: 1550687 - DNA, 23 bp, Homo sapiens
ttccgggtctcgcagcctgaagc

SEQ ID NO: 1550688 - DNA, 16 bp, Homo sapiens
ttccgtagactgttta

SEQ ID NO: 1550689 - DNA, 19 bp, Homo sapiens
ttccgtggtcagagtgcca

SEQ ID NO: 1550690 - DNA, 20 bp, Homo sapiens
ttccgtggtcagagtgccac

SEQ ID NO: 1550691 - DNA, 14 bp, Homo sapiens
ttccgttgtctgtg

SEQ ID NO: 1550692 - DNA, 12 bp, Homo sapiens
ttcctaaacata

SEQ ID NO: 1550693 - DNA, 16 bp, Homo sapiens
ttcctaaacccaatga

SEQ ID NO: 1550694 - DNA, 13 bp, Homo sapiens
ttcctaaatgcag

SEQ ID NO: 1550695 - DNA, 14 bp, Homo sapiens
ttcctaaatgcagt

SEQ ID NO: 1550696 - DNA, 16 bp, Homo sapiens
ttcctaaatgcagtga

SEQ ID NO: 1550697 - DNA, 14 bp, Homo sapiens
ttcctaacaaaatg

SEQ ID NO: 1550698 - DNA, 13 bp, Homo sapiens
ttcctaactagaa

SEQ ID NO: 1550699 - DNA, 17 bp, Homo sapiens
ttcctaactagaattag

SEQ ID NO: 1550700 - DNA, 17 bp, Homo sapiens
ttcctaaggcacccaca

SEQ ID NO: 1550701 - DNA, 21 bp, Homo sapiens
ttcctaatggctatttttgaa

SEQ ID NO: 1550702 - DNA, 22 bp, Homo sapiens
ttcctacaagagcagcctgtgg

SEQ ID NO: 1550703 - DNA, 23 bp, Homo sapiens
ttcctacaagagcagcctgtggc

SEQ ID NO: 1550704 - DNA, 22 bp, Homo sapiens
ttcctacagaaatactgctctg

SEQ ID NO: 1550705 - DNA, 17 bp, Homo sapiens
ttcctacccaaccactc

SEQ ID NO: 1550706 - DNA, 13 bp, Homo sapiens
ttcctacctccct

SEQ ID NO: 1550707 - DNA, 15 bp, Homo sapiens
ttcctacctccctgc

SEQ ID NO: 1550708 - DNA, 17 bp, Homo sapiens
ttcctactgtcctcaga

SEQ ID NO: 1550709 - DNA, 16 bp, Homo sapiens
ttcctagaaattgaac

SEQ ID NO: 1550710 - DNA, 17 bp, Homo sapiens
ttcctagataaaaagat

SEQ ID NO: 1550711 - DNA, 22 bp, Homo sapiens
ttcctagatctgcaggctgcac

SEQ ID NO: 1550712 - DNA, 13 bp, Homo sapiens
ttcctagatgtgt

SEQ ID NO: 1550713 - DNA, 18 bp, Homo sapiens
ttcctagccctctcacat

SEQ ID NO: 1550714 - DNA, 15 bp, Homo sapiens
ttcctataacactgt

SEQ ID NO: 1550715 - DNA, 22 bp, Homo sapiens
ttcctatatagtttattgacaa

SEQ ID NO: 1550716 - DNA, 14 bp, Homo sapiens
ttcctatgacacag

SEQ ID NO: 1550717 - DNA, 15 bp, Homo sapiens
ttcctatttcagaag

SEQ ID NO: 1550718 - DNA, 22 bp, Homo sapiens
ttcctatttcagtgttacctgt

SEQ ID NO: 1550719 - DNA, 16 bp, Homo sapiens
ttcctatttctttcag

SEQ ID NO: 1550720 - DNA, 20 bp, Homo sapiens
ttcctcaaaataaagaagta

SEQ ID NO: 1550721 - DNA, 20 bp, Homo sapiens
ttcctcaaatcagtgataat

SEQ ID NO: 1550722 - DNA, 18 bp, Homo sapiens
ttcctcaagtatcttcta

SEQ ID NO: 1550723 - DNA, 15 bp, Homo sapiens
ttcctcacacccctg

SEQ ID NO: 1550724 - DNA, 23 bp, Homo sapiens
ttcctcacacccctgtcccaccc

SEQ ID NO: 1550725 - DNA, 23 bp, Homo sapiens
ttcctcacgtgcaggacagctct

SEQ ID NO: 1550726 - DNA, 13 bp, Homo sapiens
ttcctcagctgcc

SEQ ID NO: 1550727 - DNA, 14 bp, Homo sapiens
ttcctcagctgcca

SEQ ID NO: 1550728 - DNA, 20 bp, Homo sapiens
ttcctcatcccctcgtcctg

SEQ ID NO: 1550729 - DNA, 14 bp, Homo sapiens
ttcctcatgaatgt

SEQ ID NO: 1550730 - DNA, 15 bp, Homo sapiens
ttcctcatgaatgta

SEQ ID NO: 1550731 - DNA, 16 bp, Homo sapiens
ttcctcatgaatgtaa

SEQ ID NO: 1550732 - DNA, 14 bp, Homo sapiens
ttcctccattttta

SEQ ID NO: 1550733 - DNA, 19 bp, Homo sapiens
ttcctccccacactccact

SEQ ID NO: 1550734 - DNA, 22 bp, Homo sapiens
ttcctccccacactccactctg

SEQ ID NO: 1550735 - DNA, 15 bp, Homo sapiens
ttcctccccctgcaa

SEQ ID NO: 1550736 - DNA, 20 bp, Homo sapiens
ttcctcccggggccttcctt

SEQ ID NO: 1550737 - DNA, 15 bp, Homo sapiens
ttcctccctgggggc

SEQ ID NO: 1550738 - DNA, 19 bp, Homo sapiens
ttcctccctgggggcccca

SEQ ID NO: 1550739 - DNA, 16 bp, Homo sapiens
ttcctcctccacagtg

SEQ ID NO: 1550740 - DNA, 19 bp, Homo sapiens
ttcctcctccacccacccc

SEQ ID NO: 1550741 - DNA, 14 bp, Homo sapiens
ttcctcctccccac

SEQ ID NO: 1550742 - DNA, 16 bp, Homo sapiens
ttcctcctccccactt

SEQ ID NO: 1550743 - DNA, 14 bp, Homo sapiens
ttcctcctggaaat

SEQ ID NO: 1550744 - DNA, 18 bp, Homo sapiens
ttcctcggtgggccagag

SEQ ID NO: 1550745 - DNA, 20 bp, Homo sapiens
ttcctcggtgggccagagct

SEQ ID NO: 1550746 - DNA, 22 bp, Homo sapiens
ttcctcggtgggccagagctga

SEQ ID NO: 1550747 - DNA, 17 bp, Homo sapiens
ttcctctagttctttgt

SEQ ID NO: 1550748 - DNA, 17 bp, Homo sapiens
ttcctctatactttgtt

SEQ ID NO: 1550749 - DNA, 21 bp, Homo sapiens
ttcctctatactttgttctgt

SEQ ID NO: 1550750 - DNA, 17 bp, Homo sapiens
ttcctctattgatgtac

SEQ ID NO: 1550751 - DNA, 12 bp, Homo sapiens
ttcctctccact

SEQ ID NO: 1550752 - DNA, 20 bp, Homo sapiens
ttcctctcgcggccctcagt

SEQ ID NO: 1550753 - DNA, 21 bp, Homo sapiens
ttcctctcgcggccctcagta

SEQ ID NO: 1550754 - DNA, 14 bp, Homo sapiens
ttcctctctaagtg

SEQ ID NO: 1550755 - DNA, 23 bp, Homo sapiens
ttcctctcttggcaattcctctt

SEQ ID NO: 1550756 - DNA, 13 bp, Homo sapiens
ttcctctgcctgc

SEQ ID NO: 1550757 - DNA, 15 bp, Homo sapiens
ttcctctgcctgccc

SEQ ID NO: 1550758 - DNA, 11 bp, Homo sapiens
ttcctctggat

SEQ ID NO: 1550759 - DNA, 18 bp, Homo sapiens
ttcctcttagcctctgga

SEQ ID NO: 1550760 - DNA, 12 bp, Homo sapiens
ttcctcttccaa

SEQ ID NO: 1550761 - DNA, 13 bp, Homo sapiens
ttcctcttcctgc

SEQ ID NO: 1550762 - DNA, 15 bp, Homo sapiens
ttcctcttcctgccc

SEQ ID NO: 1550763 - DNA, 20 bp, Homo sapiens
ttcctcttcctgcccttgaa

SEQ ID NO: 1550764 - DNA, 17 bp, Homo sapiens
ttcctcttgtcctggcc

SEQ ID NO: 1550765 - DNA, 18 bp, Homo sapiens
ttcctcttgtcctggccc

SEQ ID NO: 1550766 - DNA, 19 bp, Homo sapiens
ttcctctttaactgaggag

SEQ ID NO: 1550767 - DNA, 20 bp, Homo sapiens
ttcctctttctgctctgcca

SEQ ID NO: 1550768 - DNA, 13 bp, Homo sapiens
ttcctctttcttc

SEQ ID NO: 1550769 - DNA, 21 bp, Homo sapiens
ttcctcttttgtgctgcttct

SEQ ID NO: 1550770 - DNA, 12 bp, Homo sapiens
ttcctgaaagaa

SEQ ID NO: 1550771 - DNA, 18 bp, Homo sapiens
ttcctgaaagaaacagtt

SEQ ID NO: 1550772 - DNA, 15 bp, Homo sapiens
ttcaatattgacatt

SEQ ID NO: 1550773 - DNA, 20 bp, Homo sapiens
ttcaatatttagaaaatttt

SEQ ID NO: 1550774 - DNA, 16 bp, Homo sapiens
ttcaatattttctttt

SEQ ID NO: 1550775 - DNA, 19 bp, Homo sapiens
ttcaatcaactttactgta

SEQ ID NO: 1550776 - DNA, 11 bp, Homo sapiens
ttcaatcactg

SEQ ID NO: 1550777 - DNA, 20 bp, Homo sapiens
ttcaatcactgtaacctgat

SEQ ID NO: 1550778 - DNA, 12 bp, Homo sapiens
ttcaatctctgg

SEQ ID NO: 1550779 - DNA, 13 bp, Homo sapiens
ttcaatctctgtt

SEQ ID NO: 1550780 - DNA, 16 bp, Homo sapiens
ttcaatgatagtaaga

SEQ ID NO: 1550781 - DNA, 22 bp, Homo sapiens
ttcaatggtagattcgctgtcc

SEQ ID NO: 1550782 - DNA, 13 bp, Homo sapiens
ttcaattaatgct

SEQ ID NO: 1550783 - DNA, 15 bp, Homo sapiens
ttcaattatattgtt

SEQ ID NO: 1550784 - DNA, 16 bp, Homo sapiens
ttcaattcctctggga

SEQ ID NO: 1550785 - DNA, 15 bp, Homo sapiens
ttcacaaaatttcca

SEQ ID NO: 1550786 - DNA, 14 bp, Homo sapiens
ttcacaaactgtga

SEQ ID NO: 1550787 - DNA, 14 bp, Homo sapiens
ttcacaaatatagt

SEQ ID NO: 1550788 - DNA, 18 bp, Homo sapiens
ttcacaaatgtcattgtc

SEQ ID NO: 1550789 - DNA, 19 bp, Homo sapiens
ttcacaaatgtcattgtct

SEQ ID NO: 1550790 - DNA, 13 bp, Homo sapiens
ttcacaatagaaa

SEQ ID NO: 1550791 - DNA, 19 bp, Homo sapiens
ttcacaatcttggggctga

SEQ ID NO: 1550792 - DNA, 21 bp, Homo sapiens
ttcacaatcttggggctgatg

SEQ ID NO: 1550793 - DNA, 15 bp, Homo sapiens
ttcacaatgtgaaac

SEQ ID NO: 1550794 - DNA, 23 bp, Homo sapiens
ttcacaatgtgaaactgaaggtc

SEQ ID NO: 1550795 - DNA, 13 bp, Homo sapiens
ttcacacacccct

SEQ ID NO: 1550796 - DNA, 14 bp, Homo sapiens
ttcacacacccctc

SEQ ID NO: 1550797 - DNA, 14 bp, Homo sapiens
ttcacacagcccag

SEQ ID NO: 1550798 - DNA, 14 bp, Homo sapiens
ttcacacctgactc

SEQ ID NO: 1550799 - DNA, 19 bp, Homo sapiens
ttcacacctgactctgaaa

SEQ ID NO: 1550800 - DNA, 15 bp, Homo sapiens
ttcacacttccacca

SEQ ID NO: 1550801 - DNA, 18 bp, Homo sapiens
ttcacacttccaccagcc

SEQ ID NO: 1550802 - DNA, 20 bp, Homo sapiens
ttcacacttccaccagcctg

SEQ ID NO: 1550803 - DNA, 15 bp, Homo sapiens
ttcacagaaaaagca

SEQ ID NO: 1550804 - DNA, 12 bp, Homo sapiens
ttcacagagcac

SEQ ID NO: 1550805 - DNA, 16 bp, Homo sapiens
ttcacagagcacgcct

SEQ ID NO: 1550806 - DNA, 19 bp, Homo sapiens
ttcacagagcacgcctgcc

SEQ ID NO: 1550807 - DNA, 17 bp, Homo sapiens
ttcacaggcagtgcatg

SEQ ID NO: 1550808 - DNA, 20 bp, Homo sapiens
ttcacagtagagccagcttg

SEQ ID NO: 1550809 - DNA, 16 bp, Homo sapiens
ttcacagtcactgatg

SEQ ID NO: 1550810 - DNA, 17 bp, Homo sapiens
ttcacagtctctggaaa

SEQ ID NO: 1550811 - DNA, 17 bp, Homo sapiens
ttcacagtgaagtgcct

SEQ ID NO: 1550812 - DNA, 18 bp, Homo sapiens
ttcacagtgaagtgcctt

SEQ ID NO: 1550813 - DNA, 12 bp, Homo sapiens
ttcacagtgttt

SEQ ID NO: 1550814 - DNA, 13 bp, Homo sapiens
ttcacagtttttc

SEQ ID NO: 1550815 - DNA, 15 bp, Homo sapiens
ttcacatagctgtct

SEQ ID NO: 1550816 - DNA, 17 bp, Homo sapiens
ttcacatatttgtagct

SEQ ID NO: 1550817 - DNA, 17 bp, Homo sapiens
ttcacatcccattggga

SEQ ID NO: 1550818 - DNA, 19 bp, Homo sapiens
ttcacatcctgtgtttcta

SEQ ID NO: 1550819 - DNA, 14 bp, Homo sapiens
ttcacatgccttgc

SEQ ID NO: 1550820 - DNA, 15 bp, Homo sapiens
ttcaccaaaattatc

SEQ ID NO: 1550821 - DNA, 16 bp, Homo sapiens
ttcaccaaaattatcc

SEQ ID NO: 1550822 - DNA, 16 bp, Homo sapiens
ttcaccaagtgcaata

SEQ ID NO: 1550823 - DNA, 14 bp, Homo sapiens
ttcccacgaggaat

SEQ ID NO: 1550824 - DNA, 15 bp, Homo sapiens
ttcccactgtttaag

SEQ ID NO: 1550825 - DNA, 18 bp, Homo sapiens
ttcccacttcccaccctg

SEQ ID NO: 1550826 - DNA, 17 bp, Homo sapiens
ttcccagaatctctgag

SEQ ID NO: 1550827 - DNA, 15 bp, Homo sapiens
ttcccagagacagga

SEQ ID NO: 1550828 - DNA, 19 bp, Homo sapiens
ttcccagagacaggaaaat

SEQ ID NO: 1550829 - DNA, 22 bp, Homo sapiens
ttcccagagtcagaggagaaga

SEQ ID NO: 1550830 - DNA, 14 bp, Homo sapiens
ttcccagcacatga

SEQ ID NO: 1550831 - DNA, 16 bp, Homo sapiens
ttcccagcccatatct

SEQ ID NO: 1550832 - DNA, 15 bp, Homo sapiens
ttcccagctcccccc

SEQ ID NO: 1550833 - DNA, 18 bp, Homo sapiens
ttcccagcttctgccaca

SEQ ID NO: 1550834 - DNA, 11 bp, Homo sapiens
ttcccaggacc

SEQ ID NO: 1550835 - DNA, 20 bp, Homo sapiens
ttcccaggaccctgaagggg

SEQ ID NO: 1550836 - DNA, 14 bp, Homo sapiens
ttcccaggagaaag

SEQ ID NO: 1550837 - DNA, 18 bp, Homo sapiens
ttcccaggccctttggct

SEQ ID NO: 1550838 - DNA, 17 bp, Homo sapiens
ttcccagtgaattcttg

SEQ ID NO: 1550839 - DNA, 11 bp, Homo sapiens
ttcccataatt

SEQ ID NO: 1550840 - DNA, 14 bp, Homo sapiens
ttcccatctgcacc

SEQ ID NO: 1550841 - DNA, 14 bp, Homo sapiens
ttcccatctggctt

SEQ ID NO: 1550842 - DNA, 18 bp, Homo sapiens
ttcccatctggctttttc

SEQ ID NO: 1550843 - DNA, 20 bp, Homo sapiens
ttcccatctggctttttctg

SEQ ID NO: 1550844 - DNA, 19 bp, Homo sapiens
ttcccatgcctgtctctgt

SEQ ID NO: 1550845 - DNA, 14 bp, Homo sapiens
ttcccatggggagg

SEQ ID NO: 1550846 - DNA, 15 bp, Homo sapiens
ttcccatggggaggg

SEQ ID NO: 1550847 - DNA, 17 bp, Homo sapiens
ttcccatgtcccaccct

SEQ ID NO: 1550848 - DNA, 19 bp, Homo sapiens
ttcccattggttcacctgt

SEQ ID NO: 1550849 - DNA, 22 bp, Homo sapiens
ttcccatttagaatggtgattt

SEQ ID NO: 1550850 - DNA, 17 bp, Homo sapiens
ttcccatttgtaatttg

SEQ ID NO: 1550851 - DNA, 13 bp, Homo sapiens
ttcccattttgga

SEQ ID NO: 1550852 - DNA, 18 bp, Homo sapiens
ttccccaaccacttcatt

SEQ ID NO: 1550853 - DNA, 16 bp, Homo sapiens
ttccccaacttcccta

SEQ ID NO: 1550854 - DNA, 17 bp, Homo sapiens
ttccccaagggccctgg

SEQ ID NO: 1550855 - DNA, 11 bp, Homo sapiens
ttccccacaga

SEQ ID NO: 1550856 - DNA, 22 bp, Homo sapiens
ttccccaccccagctcatgccc

SEQ ID NO: 1550857 - DNA, 14 bp, Homo sapiens
ttccccactccccc

SEQ ID NO: 1550858 - DNA, 13 bp, Homo sapiens
ttccccagacttg

SEQ ID NO: 1550859 - DNA, 14 bp, Homo sapiens
ttccccagccacag

SEQ ID NO: 1550860 - DNA, 18 bp, Homo sapiens
ttccccagccacaggcca

SEQ ID NO: 1550861 - DNA, 19 bp, Homo sapiens
ttccccagctttgctgcct

SEQ ID NO: 1550862 - DNA, 16 bp, Homo sapiens
ttccccaggcccacca

SEQ ID NO: 1550863 - DNA, 12 bp, Homo sapiens
ttccccatcccg

SEQ ID NO: 1550864 - DNA, 19 bp, Homo sapiens
ttccccatccctgtcattt

SEQ ID NO: 1550865 - DNA, 17 bp, Homo sapiens
ttccccatctttgatcc

SEQ ID NO: 1550866 - DNA, 22 bp, Homo sapiens
ttccccatctttgatccttctg

SEQ ID NO: 1550867 - DNA, 12 bp, Homo sapiens
ttcccccaccac

SEQ ID NO: 1550868 - DNA, 23 bp, Homo sapiens
ttcccccaccaccaaaactgctc

SEQ ID NO: 1550869 - DNA, 18 bp, Homo sapiens
ttcccccacccctccacg

SEQ ID NO: 1550870 - DNA, 23 bp, Homo sapiens
ttcccccagcaacgcccctccaa

SEQ ID NO: 1550871 - DNA, 13 bp, Homo sapiens
ttcccccagccca

SEQ ID NO: 1550872 - DNA, 14 bp, Homo sapiens
ttcccccagcccaa

SEQ ID NO: 1550873 - DNA, 21 bp, Homo sapiens
ttcccccagcccaataaaggt

SEQ ID NO: 1550874 - DNA, 21 bp, Homo sapiens
ttcccccagtacctccaagca

SEQ ID NO: 1550875 - DNA, 17 bp, Homo sapiens
ttcccccatgtggctga

SEQ ID NO: 1550876 - DNA, 12 bp, Homo sapiens
ttccccccactc

SEQ ID NO: 1550877 - DNA, 18 bp, Homo sapiens
ttccccccactctcccca

SEQ ID NO: 1550878 - DNA, 21 bp, Homo sapiens
ttccccccactctccccacac

SEQ ID NO: 1550879 - DNA, 15 bp, Homo sapiens
ttccccctcccaggg

SEQ ID NO: 1550880 - DNA, 20 bp, Homo sapiens
ttccccctccccctcctgct

SEQ ID NO: 1550881 - DNA, 21 bp, Homo sapiens
ttccccctcttcttctgaaga

SEQ ID NO: 1550882 - DNA, 12 bp, Homo sapiens
ttcccccttccc

SEQ ID NO: 1550883 - DNA, 22 bp, Homo sapiens
ttcccccttgaggattgtggaa

SEQ ID NO: 1550884 - DNA, 17 bp, Homo sapiens
ttccccggtcccttgag

SEQ ID NO: 1550885 - DNA, 18 bp, Homo sapiens
ttcccctagcttactgat

SEQ ID NO: 1550886 - DNA, 17 bp, Homo sapiens
ttcccctccaagaccct

SEQ ID NO: 1550887 - DNA, 20 bp, Homo sapiens
ttcccctcccaatcctctct

SEQ ID NO: 1550888 - DNA, 14 bp, Homo sapiens
ttcccctcccacct

SEQ ID NO: 1550889 - DNA, 16 bp, Homo sapiens
ttcccctcccccactc

SEQ ID NO: 1550890 - DNA, 16 bp, Homo sapiens
ttcccctccctggctc

SEQ ID NO: 1550891 - DNA, 14 bp, Homo sapiens
ttcccctctgctgc

SEQ ID NO: 1550892 - DNA, 12 bp, Homo sapiens
ttcccctggcct

SEQ ID NO: 1550893 - DNA, 14 bp, Homo sapiens
ttcccctggcctta

SEQ ID NO: 1550894 - DNA, 14 bp, Homo sapiens
ttcccctgttcact

SEQ ID NO: 1550895 - DNA, 17 bp, Homo sapiens
ttcccctgttcactcta

SEQ ID NO: 1550896 - DNA, 15 bp, Homo sapiens
ttccccttcccttat

SEQ ID NO: 1550897 - DNA, 12 bp, Homo sapiens
ttccccttcctg

SEQ ID NO: 1550898 - DNA, 22 bp, Homo sapiens
ttccccttgcccagggctcagc

SEQ ID NO: 1550899 - DNA, 17 bp, Homo sapiens
ttcccctttactcagcc

SEQ ID NO: 1550900 - DNA, 22 bp, Homo sapiens
ttcccctttactcagcccagct

SEQ ID NO: 1550901 - DNA, 15 bp, Homo sapiens
ttcccctttgcactg

SEQ ID NO: 1550902 - DNA, 12 bp, Homo sapiens
ttcccgcctccc

SEQ ID NO: 1550903 - DNA, 14 bp, Homo sapiens
ttcccgctcagccc

SEQ ID NO: 1550904 - DNA, 16 bp, Homo sapiens
ttcccgctcagccctc

SEQ ID NO: 1550905 - DNA, 18 bp, Homo sapiens
ttcccgctcagccctccc

SEQ ID NO: 1550906 - DNA, 18 bp, Homo sapiens
ttcccggagcacagccct

SEQ ID NO: 1550907 - DNA, 23 bp, Homo sapiens
ttcccggagcacagccctgggag

SEQ ID NO: 1550908 - DNA, 17 bp, Homo sapiens
ttcccggttcaggacca

SEQ ID NO: 1550909 - DNA, 20 bp, Homo sapiens
ttcccgtctcagaatctaaa

SEQ ID NO: 1550910 - DNA, 22 bp, Homo sapiens
ttcccgtggtctccttgcactt

SEQ ID NO: 1550911 - DNA, 15 bp, Homo sapiens
ttcccgtttctccac

SEQ ID NO: 1550912 - DNA, 16 bp, Homo sapiens
ttccctaatctatggt

SEQ ID NO: 1550913 - DNA, 15 bp, Homo sapiens
ttccctacctcaggc

SEQ ID NO: 1550914 - DNA, 11 bp, Homo sapiens
ttccctagaga

SEQ ID NO: 1550915 - DNA, 16 bp, Homo sapiens
ttccctagagagaata

SEQ ID NO: 1550916 - DNA, 18 bp, Homo sapiens
ttccctagagagaataaa

SEQ ID NO: 1550917 - DNA, 19 bp, Homo sapiens
ttccctagagagaataaat

SEQ ID NO: 1550918 - DNA, 20 bp, Homo sapiens
ttccctagagagaataaatt

SEQ ID NO: 1550919 - DNA, 13 bp, Homo sapiens
ttccctatctttt

SEQ ID NO: 1550920 - DNA, 16 bp, Homo sapiens
ttccctattttgaatg

SEQ ID NO: 1550921 - DNA, 23 bp, Homo sapiens
ttccctccatttttctcccaaga

SEQ ID NO: 1550922 - DNA, 23 bp, Homo sapiens
ttccctcgtagttggcaggagct

SEQ ID NO: 1550923 - DNA, 14 bp, Homo sapiens
ttccctcgtccgtc

SEQ ID NO: 1550924 - DNA, 18 bp, Homo sapiens
ttccctctccctctctct

SEQ ID NO: 1550925 - DNA, 20 bp, Homo sapiens
ttccctctccctctctctgg

SEQ ID NO: 1550926 - DNA, 12 bp, Homo sapiens
ttccctctcctg

SEQ ID NO: 1550927 - DNA, 13 bp, Homo sapiens
ttccctctcctgc

SEQ ID NO: 1550928 - DNA, 23 bp, Homo sapiens
ttccctctgggcctgttctcttg

SEQ ID NO: 1550929 - DNA, 14 bp, Homo sapiens
ttccctctttggct

SEQ ID NO: 1550930 - DNA, 20 bp, Homo sapiens
ttccctgaacgttttcttct

SEQ ID NO: 1550931 - DNA, 21 bp, Homo sapiens
ttccctgaacgttttcttctt

SEQ ID NO: 1550932 - DNA, 21 bp, Homo sapiens
ttccctgagaaacccaccagc

SEQ ID NO: 1550933 - DNA, 16 bp, Homo sapiens
ttccctgagtcaccag

SEQ ID NO: 1550934 - DNA, 15 bp, Homo sapiens
ttccctgcaccctgg

SEQ ID NO: 1550935 - DNA, 19 bp, Homo sapiens
ttccctgccacttcaaccc

SEQ ID NO: 1550936 - DNA, 15 bp, Homo sapiens
ttccctgctcttgca

SEQ ID NO: 1550937 - DNA, 12 bp, Homo sapiens
ttccctgctgaa

SEQ ID NO: 1550938 - DNA, 15 bp, Homo sapiens
ttccctgcttccagg

SEQ ID NO: 1550939 - DNA, 23 bp, Homo sapiens
ttccctggaaaccttccacccag

SEQ ID NO: 1550940 - DNA, 18 bp, Homo sapiens
ttattgtgacttcactgt

SEQ ID NO: 1550941 - DNA, 21 bp, Homo sapiens
ttattgtgtgcgctgcctggc

SEQ ID NO: 1550942 - DNA, 13 bp, Homo sapiens
ttatttaaaaaag

SEQ ID NO: 1550943 - DNA, 14 bp, Homo sapiens
ttatttaaaaatat

SEQ ID NO: 1550944 - DNA, 14 bp, Homo sapiens
ttatttaaaagatt

SEQ ID NO: 1550945 - DNA, 14 bp, Homo sapiens
ttatttaactggta

SEQ ID NO: 1550946 - DNA, 12 bp, Homo sapiens
ttatttaaggat

SEQ ID NO: 1550947 - DNA, 19 bp, Homo sapiens
ttatttaaggatggatggc

SEQ ID NO: 1550948 - DNA, 13 bp, Homo sapiens
ttatttaatagct

SEQ ID NO: 1550949 - DNA, 15 bp, Homo sapiens
ttatttacagatgaa

SEQ ID NO: 1550950 - DNA, 12 bp, Homo sapiens
ttatttagagat

SEQ ID NO: 1550951 - DNA, 18 bp, Homo sapiens
ttatttagggaactgctt

SEQ ID NO: 1550952 - DNA, 21 bp, Homo sapiens
ttatttatatggggaatatat

SEQ ID NO: 1550953 - DNA, 14 bp, Homo sapiens
ttatttatatgtac

SEQ ID NO: 1550954 - DNA, 18 bp, Homo sapiens
ttatttatatgtactgtt

SEQ ID NO: 1550955 - DNA, 12 bp, Homo sapiens
ttatttatattc

SEQ ID NO: 1550956 - DNA, 18 bp, Homo sapiens
ttatttatcaatttttcc

SEQ ID NO: 1550957 - DNA, 14 bp, Homo sapiens
ttatttatcagtga

SEQ ID NO: 1550958 - DNA, 18 bp, Homo sapiens
ttatttatcagtgacaga

SEQ ID NO: 1550959 - DNA, 22 bp, Homo sapiens
ttatttatgaaaaaatatgaac

SEQ ID NO: 1550960 - DNA, 21 bp, Homo sapiens
ttatttcatcttttattcaag

SEQ ID NO: 1550961 - DNA, 19 bp, Homo sapiens
ttatttcatgattagaaat

SEQ ID NO: 1550962 - DNA, 14 bp, Homo sapiens
ttatttccagtggt

SEQ ID NO: 1550963 - DNA, 18 bp, Homo sapiens
ttatttccccagccacag

SEQ ID NO: 1550964 - DNA, 15 bp, Homo sapiens
ttatttcctgattac

SEQ ID NO: 1550965 - DNA, 16 bp, Homo sapiens
ttatttctgctctgga

SEQ ID NO: 1550966 - DNA, 13 bp, Homo sapiens
ttatttcttccct

SEQ ID NO: 1550967 - DNA, 20 bp, Homo sapiens
ttatttgaatgaacactatg

SEQ ID NO: 1550968 - DNA, 17 bp, Homo sapiens
ttatttggcataactgt

SEQ ID NO: 1550969 - DNA, 23 bp, Homo sapiens
ttatttgggccagttatagctta

SEQ ID NO: 1550970 - DNA, 16 bp, Homo sapiens
ttatttgtctgtaaaa

SEQ ID NO: 1550971 - DNA, 19 bp, Homo sapiens
ttatttgttctttttctga

SEQ ID NO: 1550972 - DNA, 18 bp, Homo sapiens
ttattttaaaatatatga

SEQ ID NO: 1550973 - DNA, 16 bp, Homo sapiens
ttattttacacagaaa

SEQ ID NO: 1550974 - DNA, 17 bp, Homo sapiens
ttattttacacagaaac

SEQ ID NO: 1550975 - DNA, 19 bp, Homo sapiens
ttattttacacagaaacac

SEQ ID NO: 1550976 - DNA, 12 bp, Homo sapiens
ttattttacatt

SEQ ID NO: 1550977 - DNA, 13 bp, Homo sapiens
ttattttagtata

SEQ ID NO: 1550978 - DNA, 12 bp, Homo sapiens
ttattttcaaga

SEQ ID NO: 1550979 - DNA, 13 bp, Homo sapiens
ttattttcaagaa

SEQ ID NO: 1550980 - DNA, 13 bp, Homo sapiens
ttattttctgttc

SEQ ID NO: 1550981 - DNA, 17 bp, Homo sapiens
ttattttctttgaaatt

SEQ ID NO: 1550982 - DNA, 13 bp, Homo sapiens
ttattttgaatgt

SEQ ID NO: 1550983 - DNA, 20 bp, Homo sapiens
ttattttgactgtgatttat

SEQ ID NO: 1550984 - DNA, 23 bp, Homo sapiens
ttattttgagtcctaggacttaa

SEQ ID NO: 1550985 - DNA, 14 bp, Homo sapiens
ttattttgctgagt

SEQ ID NO: 1550986 - DNA, 15 bp, Homo sapiens
ttattttgctgagtt

SEQ ID NO: 1550987 - DNA, 20 bp, Homo sapiens
ttattttgctgagttgttct

SEQ ID NO: 1550988 - DNA, 22 bp, Homo sapiens
ttattttggaaaataaattatt

SEQ ID NO: 1550989 - DNA, 18 bp, Homo sapiens
ttattttggaactatgaa

SEQ ID NO: 1550990 - DNA, 20 bp, Homo sapiens
ttattttgggcctgttcctt

SEQ ID NO: 1550991 - DNA, 22 bp, Homo sapiens
ttattttgtattacatctaatg

SEQ ID NO: 1550992 - DNA, 13 bp, Homo sapiens
ttattttgtattc

SEQ ID NO: 1550993 - DNA, 21 bp, Homo sapiens
ttattttgttcatacatattt

SEQ ID NO: 1550994 - DNA, 16 bp, Homo sapiens
ttatttttaaaaagaa

SEQ ID NO: 1550995 - DNA, 19 bp, Homo sapiens
ttatttttacagcaaaaga

SEQ ID NO: 1550996 - DNA, 14 bp, Homo sapiens
ttatttttataatt

SEQ ID NO: 1550997 - DNA, 21 bp, Homo sapiens
ttatttttataattgtacaaa

SEQ ID NO: 1550998 - DNA, 17 bp, Homo sapiens
ttatttttattaaatgt

SEQ ID NO: 1550999 - DNA, 23 bp, Homo sapiens
tgtatatgtattcccttgtattt

SEQ ID NO: 1551000 - DNA, 14 bp, Homo sapiens
tgtatatgttgtaa

SEQ ID NO: 1551001 - DNA, 16 bp, Homo sapiens
tgtatatgttgtaata

SEQ ID NO: 1551002 - DNA, 21 bp, Homo sapiens
tgtatattatggaagatttta

SEQ ID NO: 1551003 - DNA, 22 bp, Homo sapiens
tgtatattccaccattcacatt

SEQ ID NO: 1551004 - DNA, 13 bp, Homo sapiens
tgtatattgtaat

SEQ ID NO: 1551005 - DNA, 17 bp, Homo sapiens
tgtatattgtaatttaa

SEQ ID NO: 1551006 - DNA, 19 bp, Homo sapiens
tgtatattgtcagatattt

SEQ ID NO: 1551007 - DNA, 13 bp, Homo sapiens
tgtatatttattc

SEQ ID NO: 1551008 - DNA, 16 bp, Homo sapiens
tgtatatttattcata

SEQ ID NO: 1551009 - DNA, 17 bp, Homo sapiens
tgtatatttattcataa

SEQ ID NO: 1551010 - DNA, 19 bp, Homo sapiens
tgtatatttgtaatatatg

SEQ ID NO: 1551011 - DNA, 14 bp, Homo sapiens
tgtatatttgtaca

SEQ ID NO: 1551012 - DNA, 16 bp, Homo sapiens
tgtatatttgtacaaa

SEQ ID NO: 1551013 - DNA, 16 bp, Homo sapiens
tgtatcagtgtccttt

SEQ ID NO: 1551014 - DNA, 19 bp, Homo sapiens
tgtatcagtgtcctttcca

SEQ ID NO: 1551015 - DNA, 20 bp, Homo sapiens
tgtatcagtgtcctttccag

SEQ ID NO: 1551016 - DNA, 17 bp, Homo sapiens
tgtatcatagaaatgta

SEQ ID NO: 1551017 - DNA, 17 bp, Homo sapiens
tgtatcatttgaacaac

SEQ ID NO: 1551018 - DNA, 22 bp, Homo sapiens
tgtatccaaggaaacattttat

SEQ ID NO: 1551019 - DNA, 13 bp, Homo sapiens
tgtatccgtgaat

SEQ ID NO: 1551020 - DNA, 20 bp, Homo sapiens
tgtatccgtgaattgcttta

SEQ ID NO: 1551021 - DNA, 22 bp, Homo sapiens
tgtatcctccctggcagacaca

SEQ ID NO: 1551022 - DNA, 13 bp, Homo sapiens
tgtatcctggggc

SEQ ID NO: 1551023 - DNA, 15 bp, Homo sapiens
tgtatcctggggctc

SEQ ID NO: 1551024 - DNA, 18 bp, Homo sapiens
tgtatcctggggctccct

SEQ ID NO: 1551025 - DNA, 15 bp, Homo sapiens
tgtatcggagacagt

SEQ ID NO: 1551026 - DNA, 18 bp, Homo sapiens
tgtatcggagacagtgat

SEQ ID NO: 1551027 - DNA, 14 bp, Homo sapiens
tgtatctagctcta

SEQ ID NO: 1551028 - DNA, 16 bp, Homo sapiens
tgtatctatttgtaca

SEQ ID NO: 1551029 - DNA, 16 bp, Homo sapiens
tgtatctctttcacat

SEQ ID NO: 1551030 - DNA, 12 bp, Homo sapiens
tgtatctttatg

SEQ ID NO: 1551031 - DNA, 22 bp, Homo sapiens
tgtatctttattaaaacaaaag

SEQ ID NO: 1551032 - DNA, 18 bp, Homo sapiens
tgtatctttctttctcta

SEQ ID NO: 1551033 - DNA, 15 bp, Homo sapiens
tgtatgaaaatcctt

SEQ ID NO: 1551034 - DNA, 21 bp, Homo sapiens
tgtatgaaaatccttttaacc

SEQ ID NO: 1551035 - DNA, 18 bp, Homo sapiens
tgtatgaaattataatct

SEQ ID NO: 1551036 - DNA, 12 bp, Homo sapiens
tgtatgaatgta

SEQ ID NO: 1551037 - DNA, 17 bp, Homo sapiens
tgtatgactgcacatga

SEQ ID NO: 1551038 - DNA, 18 bp, Homo sapiens
tgtatgagatggttaaaa

SEQ ID NO: 1551039 - DNA, 17 bp, Homo sapiens
tgtatttatgtgtgagg

SEQ ID NO: 1551040 - DNA, 15 bp, Homo sapiens
tgtatttatttaaaa

SEQ ID NO: 1551041 - DNA, 20 bp, Homo sapiens
tgtatttatttaaaagattc

SEQ ID NO: 1551042 - DNA, 22 bp, Homo sapiens
tgtatttccaaacctggttcat

SEQ ID NO: 1551043 - DNA, 15 bp, Homo sapiens
tgtatttccaacaaa

SEQ ID NO: 1551044 - DNA, 20 bp, Homo sapiens
tgtatttcctgcttccctgt

SEQ ID NO: 1551045 - DNA, 14 bp, Homo sapiens
tgtatttgagagac

SEQ ID NO: 1551046 - DNA, 14 bp, Homo sapiens
tgtatttgcttttt

SEQ ID NO: 1551047 - DNA, 12 bp, Homo sapiens
tgtatttggaaa

SEQ ID NO: 1551048 - DNA, 13 bp, Homo sapiens
tgtatttggaaat

SEQ ID NO: 1551049 - DNA, 21 bp, Homo sapiens
tgtatttggaaataaagtcag

SEQ ID NO: 1551050 - DNA, 13 bp, Homo sapiens
tgtatttgtatta

SEQ ID NO: 1551051 - DNA, 14 bp, Homo sapiens
tgtatttgtattaa

SEQ ID NO: 1551052 - DNA, 15 bp, Homo sapiens
tgtattttaacactt

SEQ ID NO: 1551053 - DNA, 20 bp, Homo sapiens
tgtattttaacactttgtat

SEQ ID NO: 1551054 - DNA, 22 bp, Homo sapiens
tgtattttaagatccagaaata

SEQ ID NO: 1551055 - DNA, 14 bp, Homo sapiens
tgtattttcaactt

SEQ ID NO: 1551056 - DNA, 16 bp, Homo sapiens
tgtattttcatgaaaa

SEQ ID NO: 1551057 - DNA, 12 bp, Homo sapiens
tgtattttccta

SEQ ID NO: 1551058 - DNA, 23 bp, Homo sapiens
tgtattttcttttatatctgtaa

SEQ ID NO: 1551059 - DNA, 14 bp, Homo sapiens
tgtattttgattat

SEQ ID NO: 1551060 - DNA, 14 bp, Homo sapiens
tgtattttgcatac

SEQ ID NO: 1551061 - DNA, 15 bp, Homo sapiens
tgtattttgcatact

SEQ ID NO: 1551062 - DNA, 16 bp, Homo sapiens
tgtattttgttaaagc

SEQ ID NO: 1551063 - DNA, 18 bp, Homo sapiens
tgtattttgttaaagctg

SEQ ID NO: 1551064 - DNA, 21 bp, Homo sapiens
tgtatttttcaaggcatttat

SEQ ID NO: 1551065 - DNA, 15 bp, Homo sapiens
tgtattttttaaaat

SEQ ID NO: 1551066 - DNA, 14 bp, Homo sapiens
tgtattttttaaag

SEQ ID NO: 1551067 - DNA, 16 bp, Homo sapiens
tgtattttttaaagct

SEQ ID NO: 1551068 - DNA, 18 bp, Homo sapiens
tgtattttttatttacat

SEQ ID NO: 1551069 - DNA, 23 bp, Homo sapiens
tgtcaaaaatgtcttgggtaggc

SEQ ID NO: 1551070 - DNA, 19 bp, Homo sapiens
tgtcaaaactactgacagg

SEQ ID NO: 1551071 - DNA, 13 bp, Homo sapiens
tgtcaaaactggt

SEQ ID NO: 1551072 - DNA, 16 bp, Homo sapiens
tgtcaaactgtagaaa

SEQ ID NO: 1551073 - DNA, 19 bp, Homo sapiens
tgtcaagctgctctgagcc

SEQ ID NO: 1551074 - DNA, 19 bp, Homo sapiens
tgtcaaggtgaagcacata

SEQ ID NO: 1551075 - DNA, 19 bp, Homo sapiens
tgtcaagtacaagcaagac

SEQ ID NO: 1551076 - DNA, 21 bp, Homo sapiens
ttatatttgacttgaaaagaa

SEQ ID NO: 1551077 - DNA, 17 bp, Homo sapiens
ttatattttatgaacat

SEQ ID NO: 1551078 - DNA, 21 bp, Homo sapiens
ttatattttatgaacattgta

SEQ ID NO: 1551079 - DNA, 22 bp, Homo sapiens
ttatcaaaaagtattatcattg

SEQ ID NO: 1551080 - DNA, 18 bp, Homo sapiens
ttatcaaaccctagcctt

SEQ ID NO: 1551081 - DNA, 22 bp, Homo sapiens
ttatcaaagggtgaaaattatt

SEQ ID NO: 1551082 - DNA, 14 bp, Homo sapiens
ttatcaacatttgt

SEQ ID NO: 1551083 - DNA, 16 bp, Homo sapiens
ttatcaatatctaata

SEQ ID NO: 1551084 - DNA, 22 bp, Homo sapiens
ttatcaatatctaatatatatg

SEQ ID NO: 1551085 - DNA, 18 bp, Homo sapiens
ttatcaccacagtaagtt

SEQ ID NO: 1551086 - DNA, 18 bp, Homo sapiens
ttatcacccccttgttgt

SEQ ID NO: 1551087 - DNA, 18 bp, Homo sapiens
ttatcactgacacaaaaa

SEQ ID NO: 1551088 - DNA, 14 bp, Homo sapiens
ttatcagtgcttcc

SEQ ID NO: 1551089 - DNA, 14 bp, Homo sapiens
ttatcatcaagcag

SEQ ID NO: 1551090 - DNA, 11 bp, Homo sapiens
ttatcatgcaa

SEQ ID NO: 1551091 - DNA, 22 bp, Homo sapiens
ttatcatggaatttaatgctga

SEQ ID NO: 1551092 - DNA, 23 bp, Homo sapiens
ttatcatggaatttaatgctgaa

SEQ ID NO: 1551093 - DNA, 19 bp, Homo sapiens
ttatcattttttcctgttt

SEQ ID NO: 1551094 - DNA, 16 bp, Homo sapiens
ttatccaaaatgtgta

SEQ ID NO: 1551095 - DNA, 18 bp, Homo sapiens
ttatccaaaatgtgtatt

SEQ ID NO: 1551096 - DNA, 18 bp, Homo sapiens
ttatccacatgaaaataa

SEQ ID NO: 1551097 - DNA, 18 bp, Homo sapiens
ttatccctctcttcccct

SEQ ID NO: 1551098 - DNA, 16 bp, Homo sapiens
ttatcccttaagaatg

SEQ ID NO: 1551099 - DNA, 20 bp, Homo sapiens
ttatcctcctgttctgaaac

SEQ ID NO: 1551100 - DNA, 12 bp, Homo sapiens
ttatcctctctc

SEQ ID NO: 1551101 - DNA, 14 bp, Homo sapiens
ttatcctgtattct

SEQ ID NO: 1551102 - DNA, 16 bp, Homo sapiens
ttatcctgtattcttg

SEQ ID NO: 1551103 - DNA, 14 bp, Homo sapiens
ttatcggaagcagt

SEQ ID NO: 1551104 - DNA, 16 bp, Homo sapiens
ttatcgggaacagtgt

SEQ ID NO: 1551105 - DNA, 17 bp, Homo sapiens
ttatcgggaacagtgtt

SEQ ID NO: 1551106 - DNA, 16 bp, Homo sapiens
ttatcgggagcagtgt

SEQ ID NO: 1551107 - DNA, 18 bp, Homo sapiens
ttatcgggagcagtgtct

SEQ ID NO: 1551108 - DNA, 23 bp, Homo sapiens
ttatcgggagcagtgtcttccat

SEQ ID NO: 1551109 - DNA, 15 bp, Homo sapiens
ttatcgtttttgtat

SEQ ID NO: 1551110 - DNA, 19 bp, Homo sapiens
ttatctaatacctctgtgt

SEQ ID NO: 1551111 - DNA, 16 bp, Homo sapiens
ttatctaatttataaa

SEQ ID NO: 1551112 - DNA, 14 bp, Homo sapiens
ttatctaccattga

SEQ ID NO: 1551113 - DNA, 13 bp, Homo sapiens
ttatctataaaag

SEQ ID NO: 1551114 - DNA, 14 bp, Homo sapiens
ttatctataattta

SEQ ID NO: 1551115 - DNA, 17 bp, Homo sapiens
ttatctataatttacct

SEQ ID NO: 1551116 - DNA, 20 bp, Homo sapiens
ttatctattctgagaaaaca

SEQ ID NO: 1551117 - DNA, 18 bp, Homo sapiens
ttatctcagatatttgca

SEQ ID NO: 1551118 - DNA, 18 bp, Homo sapiens
ttatctgcctggcctggc

SEQ ID NO: 1551119 - DNA, 21 bp, Homo sapiens
ttatctgcctggcctggctcc

SEQ ID NO: 1551120 - DNA, 19 bp, Homo sapiens
ttatctggaatattgtgat

SEQ ID NO: 1551121 - DNA, 23 bp, Homo sapiens
ttatctgggattatggttttgtg

SEQ ID NO: 1551122 - DNA, 18 bp, Homo sapiens
ttatctgtgtttttgaaa

SEQ ID NO: 1551123 - DNA, 12 bp, Homo sapiens
ttatctgtttcc

SEQ ID NO: 1551124 - DNA, 16 bp, Homo sapiens
ttatcttggactgaca

SEQ ID NO: 1551125 - DNA, 16 bp, Homo sapiens
ttatcttgtctctggg

SEQ ID NO: 1551126 - DNA, 23 bp, Homo sapiens
ttatctttaccaaaaaccatgtt

SEQ ID NO: 1551127 - DNA, 16 bp, Homo sapiens
ttatctttacttttaa

SEQ ID NO: 1551128 - DNA, 19 bp, Homo sapiens
ttatgaaaaaatatgaacc

SEQ ID NO: 1551129 - DNA, 18 bp, Homo sapiens
ttatgaacagaaatattg

SEQ ID NO: 1551130 - DNA, 11 bp, Homo sapiens
ttatgaacagc

SEQ ID NO: 1551131 - DNA, 14 bp, Homo sapiens
ttatgaacagctgt

SEQ ID NO: 1551132 - DNA, 15 bp, Homo sapiens
ttatgaacagctgtg

SEQ ID NO: 1551133 - DNA, 17 bp, Homo sapiens
ttatgaacagctgtgtc

SEQ ID NO: 1551134 - DNA, 18 bp, Homo sapiens
ttatgaacagctgtgtct

SEQ ID NO: 1551135 - DNA, 18 bp, Homo sapiens
ttatgaacattgtactgt

SEQ ID NO: 1551136 - DNA, 22 bp, Homo sapiens
ttatgaacattgtactgttgct

SEQ ID NO: 1551137 - DNA, 13 bp, Homo sapiens
ttatgaagaaaat

SEQ ID NO: 1551138 - DNA, 20 bp, Homo sapiens
ttatgaagaaaatacttaaa

SEQ ID NO: 1551139 - DNA, 19 bp, Homo sapiens
ttatgaatatttataacag

SEQ ID NO: 1551140 - DNA, 14 bp, Homo sapiens
ttatgaatgaaaaa

SEQ ID NO: 1551141 - DNA, 16 bp, Homo sapiens
ttatgacatcacttgt

SEQ ID NO: 1551142 - DNA, 22 bp, Homo sapiens
ttatgacctaagtcaggtaata

SEQ ID NO: 1551143 - DNA, 22 bp, Homo sapiens
ttatgacctgaaataatatatt

SEQ ID NO: 1551144 - DNA, 22 bp, Homo sapiens
ttatgagaaacttaaatgttat

SEQ ID NO: 1551145 - DNA, 21 bp, Homo sapiens
ttatgagtttttgatagcttt

SEQ ID NO: 1551146 - DNA, 16 bp, Homo sapiens
ttatgataatagattc

SEQ ID NO: 1551147 - DNA, 14 bp, Homo sapiens
ttatgatatttctt

SEQ ID NO: 1551148 - DNA, 15 bp, Homo sapiens
ttatgatcagtgttg

SEQ ID NO: 1551149 - DNA, 15 bp, Homo sapiens
ttatgatctaataaa

SEQ ID NO: 1551150 - DNA, 16 bp, Homo sapiens
ttatgatctaataaac

SEQ ID NO: 1551151 - DNA, 19 bp, Homo sapiens
ttatgatctaataaacttt

SEQ ID NO: 1551152 - DNA, 13 bp, Homo sapiens
ttatgatctggcc

SEQ ID NO: 1551153 - DNA, 17 bp, Homo sapiens
ttatgatgctaagctga

SEQ ID NO: 1551154 - DNA, 15 bp, Homo sapiens
ttatgattatttaaa

SEQ ID NO: 1551155 - DNA, 18 bp, Homo sapiens
ttatgatttttttttcat

SEQ ID NO: 1551156 - DNA, 18 bp, Homo sapiens
ttatgcaaggaaggaaag

SEQ ID NO: 1551157 - DNA, 13 bp, Homo sapiens
ttatgcactgcct

SEQ ID NO: 1551158 - DNA, 20 bp, Homo sapiens
ttatgcactgtggtttcaga

SEQ ID NO: 1551159 - DNA, 19 bp, Homo sapiens
ttatgcacttttagaaatg

SEQ ID NO: 1551160 - DNA, 20 bp, Homo sapiens
ttatgcacttttagaaatgc

SEQ ID NO: 1551161 - DNA, 21 bp, Homo sapiens
ttatgcacttttagaaatgca

SEQ ID NO: 1551162 - DNA, 22 bp, Homo sapiens
ttatgcacttttagaaatgcat

SEQ ID NO: 1551163 - DNA, 15 bp, Homo sapiens
ttatgcagacagtct

SEQ ID NO: 1551164 - DNA, 23 bp, Homo sapiens
ttatgcagacagtctgttatgca

SEQ ID NO: 1551165 - DNA, 20 bp, Homo sapiens
ttatgcagcaaatatatgat

SEQ ID NO: 1551166 - DNA, 15 bp, Homo sapiens
ttatgcatgaaatga

SEQ ID NO: 1551167 - DNA, 18 bp, Homo sapiens
ttatgcatgaaatgaatg

SEQ ID NO: 1551168 - DNA, 21 bp, Homo sapiens
ttatgcatgaaatgaatgtct

SEQ ID NO: 1551169 - DNA, 23 bp, Homo sapiens
ttatgcatgaaatgaatgtctga

SEQ ID NO: 1551170 - DNA, 13 bp, Homo sapiens
ttatgcatttcat

SEQ ID NO: 1551171 - DNA, 20 bp, Homo sapiens
ttatgcctgagttataaata

SEQ ID NO: 1551172 - DNA, 21 bp, Homo sapiens
ttatgctgtattttaacactt

SEQ ID NO: 1551173 - DNA, 22 bp, Homo sapiens
ttatgctgtattttaacacttt

SEQ ID NO: 1551174 - DNA, 22 bp, Homo sapiens
ttatggaagattttaaattcac

SEQ ID NO: 1551175 - DNA, 14 bp, Homo sapiens
ttatggatatgctg

SEQ ID NO: 1551176 - DNA, 16 bp, Homo sapiens
ttatggatatgctgct

SEQ ID NO: 1551177 - DNA, 17 bp, Homo sapiens
ttatggatgatttaagt

SEQ ID NO: 1551178 - DNA, 21 bp, Homo sapiens
ttatggcaagtgatatcacct

SEQ ID NO: 1551179 - DNA, 14 bp, Homo sapiens
ttatggcatttcta

SEQ ID NO: 1551180 - DNA, 15 bp, Homo sapiens
ttatggcctcagctg

SEQ ID NO: 1551181 - DNA, 13 bp, Homo sapiens
ttatgggtcacag

SEQ ID NO: 1551182 - DNA, 13 bp, Homo sapiens
ttatggtccagaa

SEQ ID NO: 1551183 - DNA, 17 bp, Homo sapiens
ttatggtccagaaactc

SEQ ID NO: 1551184 - DNA, 16 bp, Homo sapiens
ttatggtgatgactta

SEQ ID NO: 1551185 - DNA, 14 bp, Homo sapiens
ggcatagtcagtgt

SEQ ID NO: 1551186 - DNA, 19 bp, Homo sapiens
ggcatatacagtgaagagt

SEQ ID NO: 1551187 - DNA, 20 bp, Homo sapiens
ggcatcaggcactggtggca

SEQ ID NO: 1551188 - DNA, 17 bp, Homo sapiens
ggcatcatctcagctca

SEQ ID NO: 1551189 - DNA, 23 bp, Homo sapiens
ggcatcatctcagctcactgcaa

SEQ ID NO: 1551190 - DNA, 23 bp, Homo sapiens
ggcatcatgcatcttactgaagg

SEQ ID NO: 1551191 - DNA, 13 bp, Homo sapiens
ggcatccacccag

SEQ ID NO: 1551192 - DNA, 16 bp, Homo sapiens
ggcatccacccagtgc

SEQ ID NO: 1551193 - DNA, 21 bp, Homo sapiens
ggcatccacccagtgctgcca

SEQ ID NO: 1551194 - DNA, 21 bp, Homo sapiens
ggcatccaggccagggctcct

SEQ ID NO: 1551195 - DNA, 12 bp, Homo sapiens
ggcatcctggat

SEQ ID NO: 1551196 - DNA, 21 bp, Homo sapiens
ggcatcgaccacaccagcctc

SEQ ID NO: 1551197 - DNA, 21 bp, Homo sapiens
ggcatcgcaccattctgactc

SEQ ID NO: 1551198 - DNA, 16 bp, Homo sapiens
ggcatcgtagaagaga

SEQ ID NO: 1551199 - DNA, 22 bp, Homo sapiens
ggcatctacacagcctggactt

SEQ ID NO: 1551200 - DNA, 16 bp, Homo sapiens
ggcatctatctgtgct

SEQ ID NO: 1551201 - DNA, 18 bp, Homo sapiens
ggcatctatctgtgctag

SEQ ID NO: 1551202 - DNA, 15 bp, Homo sapiens
ggcatctcccctagc

SEQ ID NO: 1551203 - DNA, 14 bp, Homo sapiens
ggcatctcctgtgc

SEQ ID NO: 1551204 - DNA, 20 bp, Homo sapiens
ggcatctgacacaaaaaaag

SEQ ID NO: 1551205 - DNA, 19 bp, Homo sapiens
ggcatctgcccctccccca

SEQ ID NO: 1551206 - DNA, 14 bp, Homo sapiens
ggcatcttctggag

SEQ ID NO: 1551207 - DNA, 15 bp, Homo sapiens
ggcatcttgctggct

SEQ ID NO: 1551208 - DNA, 17 bp, Homo sapiens
ggcatcttgctggctac

SEQ ID NO: 1551209 - DNA, 17 bp, Homo sapiens
ggcatctttgccttggg

SEQ ID NO: 1551210 - DNA, 21 bp, Homo sapiens
ggcatctttgccttgggctgc

SEQ ID NO: 1551211 - DNA, 22 bp, Homo sapiens
ggcatctttgccttgggctgct

SEQ ID NO: 1551212 - DNA, 23 bp, Homo sapiens
ggcatctttgccttgggctgctc

SEQ ID NO: 1551213 - DNA, 19 bp, Homo sapiens
ggcatcttttctagagaca

SEQ ID NO: 1551214 - DNA, 16 bp, Homo sapiens
cttttgtggtgtcttc

SEQ ID NO: 1551215 - DNA, 17 bp, Homo sapiens
cttttgtgtgaattgac

SEQ ID NO: 1551216 - DNA, 13 bp, Homo sapiens
cttttgttgtgac

SEQ ID NO: 1551217 - DNA, 17 bp, Homo sapiens
cttttgttgtgactttt

SEQ ID NO: 1551218 - DNA, 19 bp, Homo sapiens
cttttgtttagagccctcc

SEQ ID NO: 1551219 - DNA, 21 bp, Homo sapiens
cttttgtttcccttgctttgt

SEQ ID NO: 1551220 - DNA, 15 bp, Homo sapiens
cttttgtttggtaaa

SEQ ID NO: 1551221 - DNA, 18 bp, Homo sapiens
cttttgttttcctgctgg

SEQ ID NO: 1551222 - DNA, 15 bp, Homo sapiens
cttttgtttttttcc

SEQ ID NO: 1551223 - DNA, 19 bp, Homo sapiens
cttttgtttttttcctcat

SEQ ID NO: 1551224 - DNA, 14 bp, Homo sapiens
ctttttaataaaaa

SEQ ID NO: 1551225 - DNA, 14 bp, Homo sapiens
ctttttaatatgct

SEQ ID NO: 1551226 - DNA, 17 bp, Homo sapiens
ctttttaattcaccaaa

SEQ ID NO: 1551227 - DNA, 18 bp, Homo sapiens
ctttttatactccataca

SEQ ID NO: 1551228 - DNA, 19 bp, Homo sapiens
ctttttataggttttataa

SEQ ID NO: 1551229 - DNA, 20 bp, Homo sapiens
ctttttatttatatgtactg

SEQ ID NO: 1551230 - DNA, 21 bp, Homo sapiens
ctttttcaaaaaccagccagg

SEQ ID NO: 1551231 - DNA, 22 bp, Homo sapiens
ctttttcaaaaaccagccaggc

SEQ ID NO: 1551232 - DNA, 16 bp, Homo sapiens
ctttttcactttgaaa

SEQ ID NO: 1551233 - DNA, 21 bp, Homo sapiens
ctttttcagagttgctttaaa

SEQ ID NO: 1551234 - DNA, 17 bp, Homo sapiens
ctttttcaggagaatta

SEQ ID NO: 1551235 - DNA, 12 bp, Homo sapiens
ctttttcattta

SEQ ID NO: 1551236 - DNA, 13 bp, Homo sapiens
ctttttcatttat

SEQ ID NO: 1551237 - DNA, 22 bp, Homo sapiens
ctttttccaactcagaaattca

SEQ ID NO: 1551238 - DNA, 12 bp, Homo sapiens
ctttttccacaa

SEQ ID NO: 1551239 - DNA, 11 bp, Homo sapiens
ctttttccagt

SEQ ID NO: 1551240 - DNA, 17 bp, Homo sapiens
ctttttccagtgttcta

SEQ ID NO: 1551241 - DNA, 23 bp, Homo sapiens
ctttttccagtgttctatttgct

SEQ ID NO: 1551242 - DNA, 17 bp, Homo sapiens
ctttttcccaataaatt

SEQ ID NO: 1551243 - DNA, 13 bp, Homo sapiens
ctttttcccttcc

SEQ ID NO: 1551244 - DNA, 16 bp, Homo sapiens
ctttttcgtctatata

SEQ ID NO: 1551245 - DNA, 21 bp, Homo sapiens
ctttttctaccttgttgtgtt

SEQ ID NO: 1551246 - DNA, 13 bp, Homo sapiens
ctttttctcagat

SEQ ID NO: 1551247 - DNA, 15 bp, Homo sapiens
ctttttcttaatcat

SEQ ID NO: 1551248 - DNA, 22 bp, Homo sapiens
ctttttcttgatcttaaagatc

SEQ ID NO: 1551249 - DNA, 13 bp, Homo sapiens
ctttttctttctt

SEQ ID NO: 1551250 - DNA, 18 bp, Homo sapiens
ctttttctttttctttct

SEQ ID NO: 1551251 - DNA, 15 bp, Homo sapiens
ctttttgacactgaa

SEQ ID NO: 1551252 - DNA, 15 bp, Homo sapiens
ctttttgctctaaaa

SEQ ID NO: 1551253 - DNA, 17 bp, Homo sapiens
ctttttgggagagactt

SEQ ID NO: 1551254 - DNA, 20 bp, Homo sapiens
ctttttgggagagacttgtt

SEQ ID NO: 1551255 - DNA, 23 bp, Homo sapiens
ctttttggtcgaggagtaacaat

SEQ ID NO: 1551256 - DNA, 18 bp, Homo sapiens
ctttttgtacttggaagt

SEQ ID NO: 1551257 - DNA, 15 bp, Homo sapiens
ctttttgttcagaat

SEQ ID NO: 1551258 - DNA, 21 bp, Homo sapiens
ctttttgttgtaaaacaaaat

SEQ ID NO: 1551259 - DNA, 14 bp, Homo sapiens
cttttttaaaaaca

SEQ ID NO: 1551260 - DNA, 18 bp, Homo sapiens
cttttttaaaaacaaaca

SEQ ID NO: 1551261 - DNA, 20 bp, Homo sapiens
cttttttaggctacagtgtc

SEQ ID NO: 1551262 - DNA, 12 bp, Homo sapiens
cttttttcaaaa

SEQ ID NO: 1551263 - DNA, 16 bp, Homo sapiens
cttttttcaaaagaaa

SEQ ID NO: 1551264 - DNA, 13 bp, Homo sapiens
cttttttgaacca

SEQ ID NO: 1551265 - DNA, 19 bp, Homo sapiens
cttttttgataaagtttct

SEQ ID NO: 1551266 - DNA, 11 bp, Homo sapiens
cttttttgtct

SEQ ID NO: 1551267 - DNA, 19 bp, Homo sapiens
ggctgggtccgtctgagtg

SEQ ID NO: 1551268 - DNA, 21 bp, Homo sapiens
ggctgggtccttgggcctggc

SEQ ID NO: 1551269 - DNA, 22 bp, Homo sapiens
ggctgggtgaccgactacccca

SEQ ID NO: 1551270 - DNA, 14 bp, Homo sapiens
ggctgggtggcccc

SEQ ID NO: 1551271 - DNA, 20 bp, Homo sapiens
ggctgggtgtttcagtttga

SEQ ID NO: 1551272 - DNA, 19 bp, Homo sapiens
ggctggtaacagttcatgt

SEQ ID NO: 1551273 - DNA, 20 bp, Homo sapiens
ggctggtacaacggaggcct

SEQ ID NO: 1551274 - DNA, 21 bp, Homo sapiens
ggctggtagaaaaaggggcct

SEQ ID NO: 1551275 - DNA, 15 bp, Homo sapiens
ggctggtagcagcag

SEQ ID NO: 1551276 - DNA, 16 bp, Homo sapiens
ggctggtagcagcagg

SEQ ID NO: 1551277 - DNA, 17 bp, Homo sapiens
ggctggtagcagcaggc

SEQ ID NO: 1551278 - DNA, 18 bp, Homo sapiens
ggctggtagcagcaggct

SEQ ID NO: 1551279 - DNA, 16 bp, Homo sapiens
ggctggtatctcagaa

SEQ ID NO: 1551280 - DNA, 18 bp, Homo sapiens
ggctggtatctcagaaag

SEQ ID NO: 1551281 - DNA, 13 bp, Homo sapiens
ggctggtccaggg

SEQ ID NO: 1551282 - DNA, 14 bp, Homo sapiens
ggctggtgcagggc

SEQ ID NO: 1551283 - DNA, 15 bp, Homo sapiens
ggctggtggccttgg

SEQ ID NO: 1551284 - DNA, 16 bp, Homo sapiens
ggctggtgggaaggcc

SEQ ID NO: 1551285 - DNA, 18 bp, Homo sapiens
ggctggtgggaaggccgg

SEQ ID NO: 1551286 - DNA, 13 bp, Homo sapiens
ggctggtgggccc

SEQ ID NO: 1551287 - DNA, 21 bp, Homo sapiens
ggctggttttgtaagatgctg

SEQ ID NO: 1551288 - DNA, 23 bp, Homo sapiens
ggctggttttgtaagatgctggg

SEQ ID NO: 1551289 - DNA, 20 bp, Homo sapiens
ggctgtaactgagagaaaga

SEQ ID NO: 1551290 - DNA, 19 bp, Homo sapiens
ggctgtaatgacaaaagat

SEQ ID NO: 1551291 - DNA, 14 bp, Homo sapiens
ggctgtatttgctg

SEQ ID NO: 1551292 - DNA, 14 bp, Homo sapiens
ggctgtattttctt

SEQ ID NO: 1551293 - DNA, 16 bp, Homo sapiens
ggctgtcctgagcccc

SEQ ID NO: 1551294 - DNA, 14 bp, Homo sapiens
ggctgtcctgctca

SEQ ID NO: 1551295 - DNA, 15 bp, Homo sapiens
ggctgtcctgctgcc

SEQ ID NO: 1551296 - DNA, 21 bp, Homo sapiens
ggctgtccttaacccacctct

SEQ ID NO: 1551297 - DNA, 12 bp, Homo sapiens
ggctgtctagaa

SEQ ID NO: 1551298 - DNA, 16 bp, Homo sapiens
ggctgtctagaatgtg

SEQ ID NO: 1551299 - DNA, 19 bp, Homo sapiens
ggctgtctgaccagagaat

SEQ ID NO: 1551300 - DNA, 19 bp, Homo sapiens
ggctgtctgtctgcagtgc

SEQ ID NO: 1551301 - DNA, 18 bp, Homo sapiens
ggctgtcttaaaagatat

SEQ ID NO: 1551302 - DNA, 18 bp, Homo sapiens
ggctgtcttctcaggctc

SEQ ID NO: 1551303 - DNA, 19 bp, Homo sapiens
ggctgtcttctcaggctct

SEQ ID NO: 1551304 - DNA, 18 bp, Homo sapiens
ggctgtgactctgggcag

SEQ ID NO: 1551305 - DNA, 19 bp, Homo sapiens
ggctgtgactctgggcagg

SEQ ID NO: 1551306 - DNA, 21 bp, Homo sapiens
ggctgtgactctgggcaggga

SEQ ID NO: 1551307 - DNA, 19 bp, Homo sapiens
ggctgtgagcagcctccac

SEQ ID NO: 1551308 - DNA, 20 bp, Homo sapiens
ggctgtgagcatcctggcag

SEQ ID NO: 1551309 - DNA, 14 bp, Homo sapiens
ggctgtgattgctg

SEQ ID NO: 1551310 - DNA, 17 bp, Homo sapiens
ggctgtgattgctgcca

SEQ ID NO: 1551311 - DNA, 18 bp, Homo sapiens
ggctgtgcccagcaggcc

SEQ ID NO: 1551312 - DNA, 19 bp, Homo sapiens
ggctgtgcccagcaggccc

SEQ ID NO: 1551313 - DNA, 10 bp, Homo sapiens
ggctgtgcta

SEQ ID NO: 1551314 - DNA, 14 bp, Homo sapiens
ggctgtggaggcct

SEQ ID NO: 1551315 - DNA, 22 bp, Homo sapiens
ggctgtggaggcctgatgctgc

SEQ ID NO: 1551316 - DNA, 19 bp, Homo sapiens
ggctgtgggcgagcatggg

SEQ ID NO: 1551317 - DNA, 19 bp, Homo sapiens
ggctgtgtcctaaggccca

SEQ ID NO: 1551318 - DNA, 20 bp, Homo sapiens
ggctgtgtcctaaggcccat

SEQ ID NO: 1551319 - DNA, 20 bp, Homo sapiens
ggctgtgttatgaaaatata

SEQ ID NO: 1551320 - DNA, 13 bp, Homo sapiens
ggctgttctgcac

SEQ ID NO: 1551321 - DNA, 11 bp, Homo sapiens
ggctgttcttc

SEQ ID NO: 1551322 - DNA, 23 bp, Homo sapiens
ggctgttcttcaactcctgggct

SEQ ID NO: 1551323 - DNA, 21 bp, Homo sapiens
ggctgttgagggccacttttt

SEQ ID NO: 1551324 - DNA, 17 bp, Homo sapiens
ggctgttggacagctgc

SEQ ID NO: 1551325 - DNA, 20 bp, Homo sapiens
ggctgttggacagctgcttg

SEQ ID NO: 1551326 - DNA, 23 bp, Homo sapiens
ggctgttggcactcacagacctg

SEQ ID NO: 1551327 - DNA, 21 bp, Homo sapiens
ggctgtttactgcttttcatt

SEQ ID NO: 1551328 - DNA, 19 bp, Homo sapiens
ggcttaaagcatcctcctc

SEQ ID NO: 1551329 - DNA, 15 bp, Homo sapiens
ggcttaaagggatgg

SEQ ID NO: 1551330 - DNA, 15 bp, Homo sapiens
ggcttaaatccagtt

SEQ ID NO: 1551331 - DNA, 19 bp, Homo sapiens
ggcttaagaaatctagtat

SEQ ID NO: 1551332 - DNA, 14 bp, Homo sapiens
ggcttaatcatttt

SEQ ID NO: 1551333 - DNA, 14 bp, Homo sapiens
ggcttaatgtttat

SEQ ID NO: 1551334 - DNA, 19 bp, Homo sapiens
ggctgaggggcaacgaaga

SEQ ID NO: 1551335 - DNA, 16 bp, Homo sapiens
ggctgaggttcctctg

SEQ ID NO: 1551336 - DNA, 21 bp, Homo sapiens
ggctgaggttcctctgcctgc

SEQ ID NO: 1551337 - DNA, 17 bp, Homo sapiens
ggctgagtagctctgcc

SEQ ID NO: 1551338 - DNA, 16 bp, Homo sapiens
ggctgagtctccaggg

SEQ ID NO: 1551339 - DNA, 17 bp, Homo sapiens
ggctgagtgagccacag

SEQ ID NO: 1551340 - DNA, 15 bp, Homo sapiens
ggctgagtggcagca

SEQ ID NO: 1551341 - DNA, 16 bp, Homo sapiens
ggctgagtggcagcag

SEQ ID NO: 1551342 - DNA, 15 bp, Homo sapiens
ggctgatctcaggga

SEQ ID NO: 1551343 - DNA, 13 bp, Homo sapiens
ggctgcacagcat

SEQ ID NO: 1551344 - DNA, 21 bp, Homo sapiens
ggctgcacattgcctgttctg

SEQ ID NO: 1551345 - DNA, 22 bp, Homo sapiens
ggctgcacctctggctagagcc

SEQ ID NO: 1551346 - DNA, 19 bp, Homo sapiens
ggctgcagaggccagaggc

SEQ ID NO: 1551347 - DNA, 13 bp, Homo sapiens
ggctgcagcaggt

SEQ ID NO: 1551348 - DNA, 21 bp, Homo sapiens
ggctgcagcaggtgctgggct

SEQ ID NO: 1551349 - DNA, 12 bp, Homo sapiens
ggctgcagcatg

SEQ ID NO: 1551350 - DNA, 13 bp, Homo sapiens
ggctgcagcctcc

SEQ ID NO: 1551351 - DNA, 21 bp, Homo sapiens
ggctgcagcctccacttccct

SEQ ID NO: 1551352 - DNA, 13 bp, Homo sapiens
ggctgcaggtgtt

SEQ ID NO: 1551353 - DNA, 17 bp, Homo sapiens
ggctgcagtcagccctg

SEQ ID NO: 1551354 - DNA, 16 bp, Homo sapiens
ggctgcatgatgtttg

SEQ ID NO: 1551355 - DNA, 15 bp, Homo sapiens
ggctgcatgctctgg

SEQ ID NO: 1551356 - DNA, 20 bp, Homo sapiens
ggctgcatgctctggaagcc

SEQ ID NO: 1551357 - DNA, 13 bp, Homo sapiens
ggctgcccaggag

SEQ ID NO: 1551358 - DNA, 19 bp, Homo sapiens
ggctgccccaacctgctga

SEQ ID NO: 1551359 - DNA, 12 bp, Homo sapiens
ggctgccccagg

SEQ ID NO: 1551360 - DNA, 19 bp, Homo sapiens
ggctgccccaggccggagc

SEQ ID NO: 1551361 - DNA, 20 bp, Homo sapiens
ggctgccccaggccggagcc

SEQ ID NO: 1551362 - DNA, 21 bp, Homo sapiens
ggctgccccaggccggagccc

SEQ ID NO: 1551363 - DNA, 17 bp, Homo sapiens
ggctgccccggcctcct

SEQ ID NO: 1551364 - DNA, 23 bp, Homo sapiens
ggctgccccgggtccccagctcc

SEQ ID NO: 1551365 - DNA, 20 bp, Homo sapiens
ggctgcccctaatctctgta

SEQ ID NO: 1551366 - DNA, 22 bp, Homo sapiens
ggctgcccctaatctctgtagg

SEQ ID NO: 1551367 - DNA, 21 bp, Homo sapiens
ggctgccctggccctgaggtg

SEQ ID NO: 1551368 - DNA, 13 bp, Homo sapiens
ggctgccctggtg

SEQ ID NO: 1551369 - DNA, 14 bp, Homo sapiens
ggctgccctggtgc

SEQ ID NO: 1551370 - DNA, 15 bp, Homo sapiens
ggctgccctggtgct

SEQ ID NO: 1551371 - DNA, 18 bp, Homo sapiens
ggctgcccttgggccacc

SEQ ID NO: 1551372 - DNA, 20 bp, Homo sapiens
ggctgcccttgttgcctgca

SEQ ID NO: 1551373 - DNA, 16 bp, Homo sapiens
ggctgccgatgggaaa

SEQ ID NO: 1551374 - DNA, 21 bp, Homo sapiens
ggctgccgggttctagtctcc

SEQ ID NO: 1551375 - DNA, 23 bp, Homo sapiens
ggctgccgtggggccgccgcctc

SEQ ID NO: 1551376 - DNA, 16 bp, Homo sapiens
ggctgcctcagccagt

SEQ ID NO: 1551377 - DNA, 18 bp, Homo sapiens
ggctgcctcagccagtgg

SEQ ID NO: 1551378 - DNA, 16 bp, Homo sapiens
ggctgcctgccgccca

SEQ ID NO: 1551379 - DNA, 16 bp, Homo sapiens
ggctgccttagaacct

SEQ ID NO: 1551380 - DNA, 16 bp, Homo sapiens
ggctgccttctggcct

SEQ ID NO: 1551381 - DNA, 18 bp, Homo sapiens
ggctgccttctttccatc

SEQ ID NO: 1551382 - DNA, 16 bp, Homo sapiens
ggctgctacccagaaa

SEQ ID NO: 1551383 - DNA, 22 bp, Homo sapiens
ggctgctcaagccgcaagctct

SEQ ID NO: 1551384 - DNA, 15 bp, Homo sapiens
ggctgctcagggctg

SEQ ID NO: 1551385 - DNA, 12 bp, Homo sapiens
ggctgctcctcc

SEQ ID NO: 1551386 - DNA, 15 bp, Homo sapiens
ggctgctgcaggccg

SEQ ID NO: 1551387 - DNA, 10 bp, Homo sapiens
ggctgctgcc

SEQ ID NO: 1551388 - DNA, 13 bp, Homo sapiens
ggctgctgccccc

SEQ ID NO: 1551389 - DNA, 18 bp, Homo sapiens
ggctgctgcccccacccc

SEQ ID NO: 1551390 - DNA, 12 bp, Homo sapiens
ggctgctgccgg

SEQ ID NO: 1551391 - DNA, 12 bp, Homo sapiens
ggctgctgcctg

SEQ ID NO: 1551392 - DNA, 14 bp, Homo sapiens
ggctgctgcctgct

SEQ ID NO: 1551393 - DNA, 18 bp, Homo sapiens
ggctgctgcggctgtggg

SEQ ID NO: 1551394 - DNA, 19 bp, Homo sapiens
ggctgctgcggctgtgggc

SEQ ID NO: 1551395 - DNA, 19 bp, Homo sapiens
ggctgctgctgatgtagga

SEQ ID NO: 1551396 - DNA, 16 bp, Homo sapiens
ggctgcttcccagagg

SEQ ID NO: 1551397 - DNA, 19 bp, Homo sapiens
ggccactgtggccagagct

SEQ ID NO: 1551398 - DNA, 20 bp, Homo sapiens
ggccacttagtcgtcttttt

SEQ ID NO: 1551399 - DNA, 20 bp, Homo sapiens
ggccagaaggagggcagagc

SEQ ID NO: 1551400 - DNA, 24 bp, Homo sapiens
ggccagaaggagggcagagccatg

SEQ ID NO: 1551401 - DNA, 17 bp, Homo sapiens
ggccagacacaggccct

SEQ ID NO: 1551402 - DNA, 18 bp, Homo sapiens
ggccagacacaggccctc

SEQ ID NO: 1551403 - DNA, 18 bp, Homo sapiens
ggccagacatgccacaag

SEQ ID NO: 1551404 - DNA, 12 bp, Homo sapiens
ggccagagccag

SEQ ID NO: 1551405 - DNA, 14 bp, Homo sapiens
ggccagagctgaac

SEQ ID NO: 1551406 - DNA, 15 bp, Homo sapiens
ggccagagctggaag

SEQ ID NO: 1551407 - DNA, 22 bp, Homo sapiens
ggccagagctggaaggcagggc

SEQ ID NO: 1551408 - DNA, 19 bp, Homo sapiens
ggccagaggcccccagccc

SEQ ID NO: 1551409 - DNA, 22 bp, Homo sapiens
ggccagaggcccccagcccagg

SEQ ID NO: 1551410 - DNA, 18 bp, Homo sapiens
ggccagagggcagtggcc

SEQ ID NO: 1551411 - DNA, 14 bp, Homo sapiens
ggccagagtggcct

SEQ ID NO: 1551412 - DNA, 15 bp, Homo sapiens
ggccagagtggcctg

SEQ ID NO: 1551413 - DNA, 12 bp, Homo sapiens
ggccagatccag

SEQ ID NO: 1551414 - DNA, 13 bp, Homo sapiens
ggccagatccagc

SEQ ID NO: 1551415 - DNA, 17 bp, Homo sapiens
ggccagatccagcctgg

SEQ ID NO: 1551416 - DNA, 18 bp, Homo sapiens
ggccagcaccatctcttt

SEQ ID NO: 1551417 - DNA, 15 bp, Homo sapiens
ggccagcactggagg

SEQ ID NO: 1551418 - DNA, 13 bp, Homo sapiens
ggccagcaggctc

SEQ ID NO: 1551419 - DNA, 15 bp, Homo sapiens
ggccagcaggctcct

SEQ ID NO: 1551420 - DNA, 23 bp, Homo sapiens
ggccagcaggctcctggctgtgc

SEQ ID NO: 1551421 - DNA, 13 bp, Homo sapiens
ggccagccaggcg

SEQ ID NO: 1551422 - DNA, 13 bp, Homo sapiens
ggccagcccagcc

SEQ ID NO: 1551423 - DNA, 16 bp, Homo sapiens
ggccagccccacccag

SEQ ID NO: 1551424 - DNA, 21 bp, Homo sapiens
ggccagccccacccaggaggg

SEQ ID NO: 1551425 - DNA, 16 bp, Homo sapiens
ggccagcccggctggt

SEQ ID NO: 1551426 - DNA, 12 bp, Homo sapiens
ggccagccctcc

SEQ ID NO: 1551427 - DNA, 15 bp, Homo sapiens
ggccagccctccctg

SEQ ID NO: 1551428 - DNA, 17 bp, Homo sapiens
ggccagccctccctggc

SEQ ID NO: 1551429 - DNA, 16 bp, Homo sapiens
ggccagcctccgagag

SEQ ID NO: 1551430 - DNA, 13 bp, Homo sapiens
ggccagcctggat

SEQ ID NO: 1551431 - DNA, 14 bp, Homo sapiens
ggccagcgggcaca

SEQ ID NO: 1551432 - DNA, 16 bp, Homo sapiens
ggccagcgtcccaggg

SEQ ID NO: 1551433 - DNA, 24 bp, Homo sapiens
ggccagctctgaggggaggcacct

SEQ ID NO: 1551434 - DNA, 12 bp, Homo sapiens
ggccagctctgg

SEQ ID NO: 1551435 - DNA, 18 bp, Homo sapiens
ggccaggagccgggcctc

SEQ ID NO: 1551436 - DNA, 13 bp, Homo sapiens
ggccaggagctct

SEQ ID NO: 1551437 - DNA, 19 bp, Homo sapiens
ggccaggagtttgagacca

SEQ ID NO: 1551438 - DNA, 13 bp, Homo sapiens
ggccaggcacagg

SEQ ID NO: 1551439 - DNA, 15 bp, Homo sapiens
ggccaggcacccatg

SEQ ID NO: 1551440 - DNA, 20 bp, Homo sapiens
ggccaggcgcggtggctcac

SEQ ID NO: 1551441 - DNA, 11 bp, Homo sapiens
ggccaggctcc

SEQ ID NO: 1551442 - DNA, 18 bp, Homo sapiens
ggccagggaaagcccgtg

SEQ ID NO: 1551443 - DNA, 13 bp, Homo sapiens
ggccagggaccca

SEQ ID NO: 1551444 - DNA, 15 bp, Homo sapiens
ggccagggacccagg

SEQ ID NO: 1551445 - DNA, 17 bp, Homo sapiens
ggccagggagaagctcc

SEQ ID NO: 1551446 - DNA, 16 bp, Homo sapiens
ggccagggatctctct

SEQ ID NO: 1551447 - DNA, 22 bp, Homo sapiens
ggccagggatctctctacaaga

SEQ ID NO: 1551448 - DNA, 23 bp, Homo sapiens
ggccagggcccctcaccctgcct

SEQ ID NO: 1551449 - DNA, 15 bp, Homo sapiens
ggccagggcctctcc

SEQ ID NO: 1551450 - DNA, 11 bp, Homo sapiens
ggccagggctg

SEQ ID NO: 1551451 - DNA, 22 bp, Homo sapiens
ggccagggtagacttggagctg

SEQ ID NO: 1551452 - DNA, 16 bp, Homo sapiens
ggccaggtgcagacct

SEQ ID NO: 1551453 - DNA, 15 bp, Homo sapiens
ggccaggtgggaacg

SEQ ID NO: 1551454 - DNA, 17 bp, Homo sapiens
ggccaggtttctgccca

SEQ ID NO: 1551455 - DNA, 21 bp, Homo sapiens
ggccagtatctatatatgtgt

SEQ ID NO: 1551456 - DNA, 23 bp, Homo sapiens
ggccagtccccgaggagctgggc

SEQ ID NO: 1551457 - DNA, 16 bp, Homo sapiens
ggccagtcctgcctgg

SEQ ID NO: 1551458 - DNA, 22 bp, Homo sapiens
ggccagtcctgcctggccaggc

SEQ ID NO: 1551459 - DNA, 15 bp, Homo sapiens
ggccagtcctggtcc

SEQ ID NO: 1551460 - DNA, 16 bp, Homo sapiens
ggccagtcctggtcct

SEQ ID NO: 1551461 - DNA, 17 bp, Homo sapiens
ggccagtcctggtcctg

SEQ ID NO: 1551462 - DNA, 22 bp, Homo sapiens
ggccagtcctggtcctggctgc

SEQ ID NO: 1551463 - DNA, 17 bp, Homo sapiens
ggccagtctgggctgcc

SEQ ID NO: 1551464 - DNA, 16 bp, Homo sapiens
ggccagtcttcctctt

SEQ ID NO: 1551465 - DNA, 22 bp, Homo sapiens
ggccagtcttcctcttagcctc

SEQ ID NO: 1551466 - DNA, 20 bp, Homo sapiens
ggccagtgctgcccatgagc

SEQ ID NO: 1551467 - DNA, 19 bp, Homo sapiens
ggccagtgtgatcccaagt

SEQ ID NO: 1551468 - DNA, 14 bp, Homo sapiens
ggccatagaggccc

SEQ ID NO: 1551469 - DNA, 15 bp, Homo sapiens
ggccatccactgtga

SEQ ID NO: 1551470 - DNA, 16 bp, Homo sapiens
ggccatccactgtgac

SEQ ID NO: 1551471 - DNA, 14 bp, Homo sapiens
ggccatctcaggag

SEQ ID NO: 1551472 - DNA, 22 bp, Homo sapiens
ggccatgatggcaacagatctg

SEQ ID NO: 1551473 - DNA, 13 bp, Homo sapiens
ggccatgcagacc

SEQ ID NO: 1551474 - DNA, 13 bp, Homo sapiens
ggccatgcaggag

SEQ ID NO: 1551475 - DNA, 14 bp, Homo sapiens
ggccatgctgaggc

SEQ ID NO: 1551476 - DNA, 18 bp, Homo sapiens
ggccatgctgaggcctgg

SEQ ID NO: 1551477 - DNA, 15 bp, Homo sapiens
ggatctagaagggac

SEQ ID NO: 1551478 - DNA, 15 bp, Homo sapiens
ggatctataggcagc

SEQ ID NO: 1551479 - DNA, 13 bp, Homo sapiens
ggatctcaagcca

SEQ ID NO: 1551480 - DNA, 15 bp, Homo sapiens
ggatctcagctttga

SEQ ID NO: 1551481 - DNA, 16 bp, Homo sapiens
ggatctcctgctgcct

SEQ ID NO: 1551482 - DNA, 14 bp, Homo sapiens
ggatctccttccct

SEQ ID NO: 1551483 - DNA, 21 bp, Homo sapiens
ggatctccttcccttctcttg

SEQ ID NO: 1551484 - DNA, 23 bp, Homo sapiens
ggatctctctagtgatggtcaga

SEQ ID NO: 1551485 - DNA, 14 bp, Homo sapiens
ggatctgagctccc

SEQ ID NO: 1551486 - DNA, 14 bp, Homo sapiens
ggatctgctgaggc

SEQ ID NO: 1551487 - DNA, 15 bp, Homo sapiens
ggatctgctgaggcc

SEQ ID NO: 1551488 - DNA, 21 bp, Homo sapiens
ggatctgctgaggcccagtgc

SEQ ID NO: 1551489 - DNA, 19 bp, Homo sapiens
ggatctgggaccctttcct

SEQ ID NO: 1551490 - DNA, 20 bp, Homo sapiens
ggatctggggagagcggctg

SEQ ID NO: 1551491 - DNA, 17 bp, Homo sapiens
ggatctgtgattggctg

SEQ ID NO: 1551492 - DNA, 19 bp, Homo sapiens
ggatctgtgattggctggt

SEQ ID NO: 1551493 - DNA, 15 bp, Homo sapiens
ggatcttcccacagg

SEQ ID NO: 1551494 - DNA, 20 bp, Homo sapiens
ggatcttctatcattccaat

SEQ ID NO: 1551495 - DNA, 14 bp, Homo sapiens
ggatctttgactga

SEQ ID NO: 1551496 - DNA, 22 bp, Homo sapiens
ggatgaatgaggtcccaggcag

SEQ ID NO: 1551497 - DNA, 17 bp, Homo sapiens
ggatgacaccctggcct

SEQ ID NO: 1551498 - DNA, 18 bp, Homo sapiens
ggatgactagaggcaggg

SEQ ID NO: 1551499 - DNA, 19 bp, Homo sapiens
ggatgactagaggcaggga

SEQ ID NO: 1551500 - DNA, 17 bp, Homo sapiens
ggatgagaaacagctca

SEQ ID NO: 1551501 - DNA, 21 bp, Homo sapiens
ggatgagaaacagctcagcca

SEQ ID NO: 1551502 - DNA, 22 bp, Homo sapiens
ggatgagaaacagctcagccag

SEQ ID NO: 1551503 - DNA, 14 bp, Homo sapiens
ggatgaggacagag

SEQ ID NO: 1551504 - DNA, 18 bp, Homo sapiens
ggatgagggaagcgaagg

SEQ ID NO: 1551505 - DNA, 16 bp, Homo sapiens
ggatgattcagaaatt

SEQ ID NO: 1551506 - DNA, 13 bp, Homo sapiens
ggatgatttaagt

SEQ ID NO: 1551507 - DNA, 16 bp, Homo sapiens
ggatgcacagatgcca

SEQ ID NO: 1551508 - DNA, 20 bp, Homo sapiens
ggatgcacagatgccatggc

SEQ ID NO: 1551509 - DNA, 13 bp, Homo sapiens
ggatgcacatttc

SEQ ID NO: 1551510 - DNA, 18 bp, Homo sapiens
ggatgccaaggagcccct

SEQ ID NO: 1551511 - DNA, 17 bp, Homo sapiens
ggatgccacgcctggaa

SEQ ID NO: 1551512 - DNA, 19 bp, Homo sapiens
ggatgcccagatgaactga

SEQ ID NO: 1551513 - DNA, 14 bp, Homo sapiens
ggatgcgcagtgcc

SEQ ID NO: 1551514 - DNA, 21 bp, Homo sapiens
ggatgcggatcctgctggggc

SEQ ID NO: 1551515 - DNA, 19 bp, Homo sapiens
ggatgctaaagatgatgat

SEQ ID NO: 1551516 - DNA, 13 bp, Homo sapiens
ggatgctccaggg

SEQ ID NO: 1551517 - DNA, 15 bp, Homo sapiens
ggatgctccagggca

SEQ ID NO: 1551518 - DNA, 16 bp, Homo sapiens
ggatgctccagggcag

SEQ ID NO: 1551519 - DNA, 23 bp, Homo sapiens
ggatgctctttcccaggacggat

SEQ ID NO: 1551520 - DNA, 12 bp, Homo sapiens
ggatgctgctcc

SEQ ID NO: 1551521 - DNA, 16 bp, Homo sapiens
ggatgctgctccgccc

SEQ ID NO: 1551522 - DNA, 14 bp, Homo sapiens
ggatgctgggctgg

SEQ ID NO: 1551523 - DNA, 14 bp, Homo sapiens
ggatgcttattaga

SEQ ID NO: 1551524 - DNA, 15 bp, Homo sapiens
ggatggaaggagact

SEQ ID NO: 1551525 - DNA, 16 bp, Homo sapiens
ggatggagaaagaagt

SEQ ID NO: 1551526 - DNA, 18 bp, Homo sapiens
ggatggagagcagccagc

SEQ ID NO: 1551527 - DNA, 21 bp, Homo sapiens
ggatggaggggtggtcctgac

SEQ ID NO: 1551528 - DNA, 19 bp, Homo sapiens
ggatggatcttttctaaat

SEQ ID NO: 1551529 - DNA, 11 bp, Homo sapiens
ggatggatggc

SEQ ID NO: 1551530 - DNA, 12 bp, Homo sapiens
ggatggatggca

SEQ ID NO: 1551531 - DNA, 14 bp, Homo sapiens
ggatggatggcacc

SEQ ID NO: 1551532 - DNA, 13 bp, Homo sapiens
ggatggcaccctg

SEQ ID NO: 1551533 - DNA, 15 bp, Homo sapiens
ggatggcaccctgga

SEQ ID NO: 1551534 - DNA, 21 bp, Homo sapiens
ggatggcaccctggaaccggg

SEQ ID NO: 1551535 - DNA, 17 bp, Homo sapiens
ggatggccgggctgctg

SEQ ID NO: 1551536 - DNA, 14 bp, Homo sapiens
ggatggcttgtcta

SEQ ID NO: 1551537 - DNA, 15 bp, Homo sapiens
ggatgggagtgagac

SEQ ID NO: 1551538 - DNA, 18 bp, Homo sapiens
ggatgggcagcccaacag

SEQ ID NO: 1551539 - DNA, 19 bp, Homo sapiens
ggatggggagaatggtcaa

SEQ ID NO: 1551540 - DNA, 17 bp, Homo sapiens
ggatgggggtgcaggca

SEQ ID NO: 1551541 - DNA, 17 bp, Homo sapiens
ggatggggttctggaaa

SEQ ID NO: 1551542 - DNA, 20 bp, Homo sapiens
ggatggtcctggggctctgt

SEQ ID NO: 1551543 - DNA, 18 bp, Homo sapiens
ggatggtgggcaggatct

SEQ ID NO: 1551544 - DNA, 18 bp, Homo sapiens
ggatggtggttattttaa

SEQ ID NO: 1551545 - DNA, 17 bp, Homo sapiens
ggatgtaaacagtgcct

SEQ ID NO: 1551546 - DNA, 11 bp, Homo sapiens
ggatgtagaac

SEQ ID NO: 1551547 - DNA, 20 bp, Homo sapiens
ggatgtagagagaacaggtg

SEQ ID NO: 1551548 - DNA, 18 bp, Homo sapiens
ggatgtccacagatgcct

SEQ ID NO: 1551549 - DNA, 20 bp, Homo sapiens
ggatgtcccctgtcccacca

SEQ ID NO: 1551550 - DNA, 16 bp, Homo sapiens
ggatgttatgaacagc

SEQ ID NO: 1551551 - DNA, 23 bp, Homo sapiens
ggatgttattatccttgggggct

SEQ ID NO: 1551552 - DNA, 14 bp, Homo sapiens
ggatgttgctcaga

SEQ ID NO: 1551553 - DNA, 23 bp, Homo sapiens
ggatgtttggaaaaaactctgaa

SEQ ID NO: 1551554 - DNA, 17 bp, Homo sapiens
ggattagggagagaaga

SEQ ID NO: 1551555 - DNA, 15 bp, Homo sapiens
ggattattcatttaa

SEQ ID NO: 1551556 - DNA, 21 bp, Homo sapiens
ggattcacccccctctgctgc

SEQ ID NO: 1551557 - DNA, 22 bp, Homo sapiens
ggattcacccccctctgctgcc

SEQ ID NO: 1551558 - DNA, 23 bp, Homo sapiens
ggattcacccccctctgctgccg

SEQ ID NO: 1551559 - DNA, 16 bp, Homo sapiens
ggattcagcatgtcca

SEQ ID NO: 1551560 - DNA, 13 bp, Homo sapiens
ggattcaggctgc

SEQ ID NO: 1551561 - DNA, 20 bp, Homo sapiens
ggattcataatcacaaatat

SEQ ID NO: 1551562 - DNA, 13 bp, Homo sapiens
ggattcatttcct

SEQ ID NO: 1551563 - DNA, 18 bp, Homo sapiens
ggattcatttcctgccct

SEQ ID NO: 1551564 - DNA, 19 bp, Homo sapiens
ggattcctgacccaggccg

SEQ ID NO: 1551565 - DNA, 14 bp, Homo sapiens
ggattctaaataca

SEQ ID NO: 1551566 - DNA, 20 bp, Homo sapiens
ggattctgaggccctgccca

SEQ ID NO: 1551567 - DNA, 19 bp, Homo sapiens
ggattctgggaggaagcag

SEQ ID NO: 1551568 - DNA, 14 bp, Homo sapiens
ggattctggttcca

SEQ ID NO: 1551569 - DNA, 18 bp, Homo sapiens
ggattctggttccagggt

SEQ ID NO: 1551570 - DNA, 19 bp, Homo sapiens
ggattcttaattctctgca

SEQ ID NO: 1551571 - DNA, 20 bp, Homo sapiens
ggattcttcccgctccccac

SEQ ID NO: 1551572 - DNA, 18 bp, Homo sapiens
ggattctttccattatga

SEQ ID NO: 1551573 - DNA, 19 bp, Homo sapiens
ggattgaaaatgtccagga

SEQ ID NO: 1551574 - DNA, 20 bp, Homo sapiens
ggattgattcagtcttctgg

SEQ ID NO: 1551575 - DNA, 15 bp, Homo sapiens
ggattgcctctgaaa

SEQ ID NO: 1551576 - DNA, 14 bp, Homo sapiens
ggattgctgccact

SEQ ID NO: 1551577 - DNA, 23 bp, Homo sapiens
ggattggcaactcttcagacgga

SEQ ID NO: 1551578 - DNA, 19 bp, Homo sapiens
ggattggggaagactgtgg

SEQ ID NO: 1551579 - DNA, 18 bp, Homo sapiens
ggattgggggctggtgcc

SEQ ID NO: 1551580 - DNA, 23 bp, Homo sapiens
ggatttcaaacttaaacaaaaaa

SEQ ID NO: 1551581 - DNA, 22 bp, Homo sapiens
ggatttgaacttgctctttttg

SEQ ID NO: 1551582 - DNA, 19 bp, Homo sapiens
ggatttgattcattttcct

SEQ ID NO: 1551583 - DNA, 14 bp, Homo sapiens
ggatttgccccttc

SEQ ID NO: 1551584 - DNA, 22 bp, Homo sapiens
ggatttggggtgttacagtagc

SEQ ID NO: 1551585 - DNA, 16 bp, Homo sapiens
ggattttcatcagggg

SEQ ID NO: 1551586 - DNA, 13 bp, Homo sapiens
ggattttcctgaa

SEQ ID NO: 1551587 - DNA, 15 bp, Homo sapiens
ggcaaaacaggaagg

SEQ ID NO: 1551588 - DNA, 18 bp, Homo sapiens
ggcaaaatcttgttaatg

SEQ ID NO: 1551589 - DNA, 21 bp, Homo sapiens
ggcaaacattttctcttagaa

SEQ ID NO: 1551590 - DNA, 16 bp, Homo sapiens
ggcaaaccctcccaga

SEQ ID NO: 1551591 - DNA, 16 bp, Homo sapiens
ggcaaaggaaggtgga

SEQ ID NO: 1551592 - DNA, 19 bp, Homo sapiens
ggcaaaggaaggtggatgg

SEQ ID NO: 1551593 - DNA, 21 bp, Homo sapiens
ggcaaaggcccggctgagccc

SEQ ID NO: 1551594 - DNA, 14 bp, Homo sapiens
ggcttgaagctgtg

SEQ ID NO: 1551595 - DNA, 21 bp, Homo sapiens
ggcttgaaggactgcagacag

SEQ ID NO: 1551596 - DNA, 15 bp, Homo sapiens
ggcttgactcaggat

SEQ ID NO: 1551597 - DNA, 21 bp, Homo sapiens
ggcttgcccactgcctgcctc

SEQ ID NO: 1551598 - DNA, 13 bp, Homo sapiens
ggcttgctccagg

SEQ ID NO: 1551599 - DNA, 14 bp, Homo sapiens
ggcttgctccaggg

SEQ ID NO: 1551600 - DNA, 15 bp, Homo sapiens
ggcttgctccagggt

SEQ ID NO: 1551601 - DNA, 14 bp, Homo sapiens
ggcttgctgctccg

SEQ ID NO: 1551602 - DNA, 17 bp, Homo sapiens
ggcttgcttgccgagcc

SEQ ID NO: 1551603 - DNA, 17 bp, Homo sapiens
ggcttggagtggccaaa

SEQ ID NO: 1551604 - DNA, 15 bp, Homo sapiens
ggcttggatcctggg

SEQ ID NO: 1551605 - DNA, 19 bp, Homo sapiens
ggcttggatcctgggctgg

SEQ ID NO: 1551606 - DNA, 13 bp, Homo sapiens
ggcttggcctgct

SEQ ID NO: 1551607 - DNA, 16 bp, Homo sapiens
ggcttggcctgctgtg

SEQ ID NO: 1551608 - DNA, 16 bp, Homo sapiens
ggcttgggccctgcac

SEQ ID NO: 1551609 - DNA, 18 bp, Homo sapiens
ggcttgggccctgcacag

SEQ ID NO: 1551610 - DNA, 23 bp, Homo sapiens
ggcttggggaaaatggccatgca

SEQ ID NO: 1551611 - DNA, 19 bp, Homo sapiens
ggcttggggattgtacacg

SEQ ID NO: 1551612 - DNA, 16 bp, Homo sapiens
ggcttggggtgtgggg

SEQ ID NO: 1551613 - DNA, 21 bp, Homo sapiens
ggcttggtggctcacgcctgt

SEQ ID NO: 1551614 - DNA, 18 bp, Homo sapiens
ggcttgtaactccaccaa

SEQ ID NO: 1551615 - DNA, 17 bp, Homo sapiens
ggcttgtacatttttaa

SEQ ID NO: 1551616 - DNA, 21 bp, Homo sapiens
ggcttgtacatttttaaattc

SEQ ID NO: 1551617 - DNA, 23 bp, Homo sapiens
ggcttgtacatttttaaattctt

SEQ ID NO: 1551618 - DNA, 16 bp, Homo sapiens
ggcttgtcactagcag

SEQ ID NO: 1551619 - DNA, 12 bp, Homo sapiens
ggctttaaaatt

SEQ ID NO: 1551620 - DNA, 20 bp, Homo sapiens
ggctttatgataatagattc

SEQ ID NO: 1551621 - DNA, 23 bp, Homo sapiens
ggctttcccacttcccaccctgc

SEQ ID NO: 1551622 - DNA, 24 bp, Homo sapiens
ggctttctccggggtctgtgctgt

SEQ ID NO: 1551623 - DNA, 12 bp, Homo sapiens
ggctttctctct

SEQ ID NO: 1551624 - DNA, 13 bp, Homo sapiens
ggctttctctctg

SEQ ID NO: 1551625 - DNA, 22 bp, Homo sapiens
ggctttctctctggcttctctc

SEQ ID NO: 1551626 - DNA, 14 bp, Homo sapiens
ggctttctggagag

SEQ ID NO: 1551627 - DNA, 16 bp, Homo sapiens
ggctttgcaggctctg

SEQ ID NO: 1551628 - DNA, 15 bp, Homo sapiens
ggctttgtgcttggg

SEQ ID NO: 1551629 - DNA, 22 bp, Homo sapiens
ggcttttcactgcctgtagaga

SEQ ID NO: 1551630 - DNA, 21 bp, Homo sapiens
gggaaaaaagttttgatgaaa

SEQ ID NO: 1551631 - DNA, 14 bp, Homo sapiens
gggaaacaaagaag

SEQ ID NO: 1551632 - DNA, 15 bp, Homo sapiens
gggaaagaagggatc

SEQ ID NO: 1551633 - DNA, 22 bp, Homo sapiens
gggaaagacactgcctgggctg

SEQ ID NO: 1551634 - DNA, 16 bp, Homo sapiens
gggaaagcctctggcc

SEQ ID NO: 1551635 - DNA, 17 bp, Homo sapiens
gggaaagcctctggccg

SEQ ID NO: 1551636 - DNA, 16 bp, Homo sapiens
gggaaagggctggctg

SEQ ID NO: 1551637 - DNA, 13 bp, Homo sapiens
gggaaaggggaca

SEQ ID NO: 1551638 - DNA, 13 bp, Homo sapiens
gggaaaggggtgc

SEQ ID NO: 1551639 - DNA, 17 bp, Homo sapiens
gggaaatagtctgattt

SEQ ID NO: 1551640 - DNA, 19 bp, Homo sapiens
gggaacaaattagaggaga

SEQ ID NO: 1551641 - DNA, 16 bp, Homo sapiens
gggaacagacaggaga

SEQ ID NO: 1551642 - DNA, 23 bp, Homo sapiens
gggaacagtaaagaaagcagaat

SEQ ID NO: 1551643 - DNA, 12 bp, Homo sapiens
gggaacagtgtt

SEQ ID NO: 1551644 - DNA, 20 bp, Homo sapiens
gggaacagtgtttcccataa

SEQ ID NO: 1551645 - DNA, 17 bp, Homo sapiens
gggaacatgacccagcc

SEQ ID NO: 1551646 - DNA, 20 bp, Homo sapiens
gggaacatgacccagcctga

SEQ ID NO: 1551647 - DNA, 16 bp, Homo sapiens
gggaacatggctggcc

SEQ ID NO: 1551648 - DNA, 15 bp, Homo sapiens
gggaaccactcccac

SEQ ID NO: 1551649 - DNA, 21 bp, Homo sapiens
gggaaccactcccaccacagg

SEQ ID NO: 1551650 - DNA, 17 bp, Homo sapiens
gggaaccccgcagcccg

SEQ ID NO: 1551651 - DNA, 13 bp, Homo sapiens
gggaacctggaac

SEQ ID NO: 1551652 - DNA, 14 bp, Homo sapiens
gggaacgtgactgc

SEQ ID NO: 1551653 - DNA, 16 bp, Homo sapiens
gggaactcagatccag

SEQ ID NO: 1551654 - DNA, 15 bp, Homo sapiens
gggaactccactctc

SEQ ID NO: 1551655 - DNA, 19 bp, Homo sapiens
gggaactctgacaagggct

SEQ ID NO: 1551656 - DNA, 14 bp, Homo sapiens
gggaagacagtggc

SEQ ID NO: 1551657 - DNA, 12 bp, Homo sapiens
gggaagagggca

SEQ ID NO: 1551658 - DNA, 15 bp, Homo sapiens
gggaagagggcagta

SEQ ID NO: 1551659 - DNA, 22 bp, Homo sapiens
gggaagagtttttgtgatgggg

SEQ ID NO: 1551660 - DNA, 14 bp, Homo sapiens
gggaagatggagac

SEQ ID NO: 1551661 - DNA, 17 bp, Homo sapiens
gggaagcagccagctcc

SEQ ID NO: 1551662 - DNA, 19 bp, Homo sapiens
gggaagcccagctccaggg

SEQ ID NO: 1551663 - DNA, 19 bp, Homo sapiens
gggaagcctgtgccagcac

SEQ ID NO: 1551664 - DNA, 16 bp, Homo sapiens
gggaagctggcctgag

SEQ ID NO: 1551665 - DNA, 18 bp, Homo sapiens
gggaagctgtactcagag

SEQ ID NO: 1551666 - DNA, 22 bp, Homo sapiens
gggaagcttgagcctcccccaa

SEQ ID NO: 1551667 - DNA, 13 bp, Homo sapiens
gggaaggacagga

SEQ ID NO: 1551668 - DNA, 22 bp, Homo sapiens
gggaaggacaggaccctcagga

SEQ ID NO: 1551669 - DNA, 23 bp, Homo sapiens
gggaaggacaggaccctcaggaa

SEQ ID NO: 1551670 - DNA, 17 bp, Homo sapiens
gggaccagagccagatg

SEQ ID NO: 1551671 - DNA, 18 bp, Homo sapiens
gggaccagggccaccgca

SEQ ID NO: 1551672 - DNA, 20 bp, Homo sapiens
gggaccattgacctcagctg

SEQ ID NO: 1551673 - DNA, 22 bp, Homo sapiens
gggaccattgacctcagctgca

SEQ ID NO: 1551674 - DNA, 22 bp, Homo sapiens
gggacccacctccccctccccg

SEQ ID NO: 1551675 - DNA, 24 bp, Homo sapiens
gggacccagctactctgtccaggc

SEQ ID NO: 1551676 - DNA, 22 bp, Homo sapiens
gggacccaggtgtgcctgtgct

SEQ ID NO: 1551677 - DNA, 15 bp, Homo sapiens
gggacccagtgcaga

SEQ ID NO: 1551678 - DNA, 20 bp, Homo sapiens
gggaccccactccctgctct

SEQ ID NO: 1551679 - DNA, 20 bp, Homo sapiens
gggaccccacttcagaaggt

SEQ ID NO: 1551680 - DNA, 22 bp, Homo sapiens
gggaccccgagaaccctgagca

SEQ ID NO: 1551681 - DNA, 19 bp, Homo sapiens
gggacccctcccaacctca

SEQ ID NO: 1551682 - DNA, 22 bp, Homo sapiens
gggacccctcccaacctcaatg

SEQ ID NO: 1551683 - DNA, 17 bp, Homo sapiens
gggacccgaggatttct

SEQ ID NO: 1551684 - DNA, 23 bp, Homo sapiens
gggacccggggtctcctggacct

SEQ ID NO: 1551685 - DNA, 22 bp, Homo sapiens
gggaccctgtccggcccagtgc

SEQ ID NO: 1551686 - DNA, 19 bp, Homo sapiens
gggaccggtgctgcaggag

SEQ ID NO: 1551687 - DNA, 20 bp, Homo sapiens
gggaccggtgctgcaggagt

SEQ ID NO: 1551688 - DNA, 18 bp, Homo sapiens
gggaccgtccaggggaga

SEQ ID NO: 1551689 - DNA, 21 bp, Homo sapiens
gggacctggtaccctcctggc

SEQ ID NO: 1551690 - DNA, 22 bp, Homo sapiens
gggaccttaagtgatttgcctg

SEQ ID NO: 1551691 - DNA, 14 bp, Homo sapiens
gggaccttggagag

SEQ ID NO: 1551692 - DNA, 17 bp, Homo sapiens
gggaccttgtgggacca

SEQ ID NO: 1551693 - DNA, 22 bp, Homo sapiens
gggaccttgtgggaccagtccc

SEQ ID NO: 1551694 - DNA, 19 bp, Homo sapiens
gggactaacccaatgcctg

SEQ ID NO: 1551695 - DNA, 17 bp, Homo sapiens
gggactcagccctgagg

SEQ ID NO: 1551696 - DNA, 18 bp, Homo sapiens
gggactcagtgagctggg

SEQ ID NO: 1551697 - DNA, 16 bp, Homo sapiens
gggactcggtgagccg

SEQ ID NO: 1551698 - DNA, 16 bp, Homo sapiens
gggactctgtccaaca

SEQ ID NO: 1551699 - DNA, 16 bp, Homo sapiens
gggactgtctcagaag

SEQ ID NO: 1551700 - DNA, 18 bp, Homo sapiens
gggacttgtttagagagc

SEQ ID NO: 1551701 - DNA, 23 bp, Homo sapiens
gggacttgtttagagagcctgtc

SEQ ID NO: 1551702 - DNA, 21 bp, Homo sapiens
gggactttccttccctctcct

SEQ ID NO: 1551703 - DNA, 22 bp, Homo sapiens
gggactttccttccctctcctg

SEQ ID NO: 1551704 - DNA, 14 bp, Homo sapiens
gggagaacctcagg

SEQ ID NO: 1551705 - DNA, 15 bp, Homo sapiens
gggagaacctcaggc

SEQ ID NO: 1551706 - DNA, 13 bp, Homo sapiens
gggagaactgaag

SEQ ID NO: 1551707 - DNA, 20 bp, Homo sapiens
gggagaaggaagggcagaga

SEQ ID NO: 1551708 - DNA, 14 bp, Homo sapiens
gggagacactggcc

SEQ ID NO: 1551709 - DNA, 12 bp, Homo sapiens
gggagacagcag

SEQ ID NO: 1551710 - DNA, 13 bp, Homo sapiens
gggagacagcagc

SEQ ID NO: 1551711 - DNA, 14 bp, Homo sapiens
gggagacagcagcc

SEQ ID NO: 1551712 - DNA, 15 bp, Homo sapiens
gggagacagcagcct

SEQ ID NO: 1551713 - DNA, 16 bp, Homo sapiens
gggagacagcagcctg

SEQ ID NO: 1551714 - DNA, 19 bp, Homo sapiens
gggagacagttgagagcgg

SEQ ID NO: 1551715 - DNA, 20 bp, Homo sapiens
gggagacagttgagagcggg

SEQ ID NO: 1551716 - DNA, 21 bp, Homo sapiens
gggagacggtttccagggagg

SEQ ID NO: 1551717 - DNA, 22 bp, Homo sapiens
gggagacggtttccagggaggg

SEQ ID NO: 1551718 - DNA, 13 bp, Homo sapiens
gggagacttgttc

SEQ ID NO: 1551719 - DNA, 13 bp, Homo sapiens
gggagagaccctt

SEQ ID NO: 1551720 - DNA, 13 bp, Homo sapiens
gggagagagaagc

SEQ ID NO: 1551721 - DNA, 15 bp, Homo sapiens
gggagagagaagcag

SEQ ID NO: 1551722 - DNA, 20 bp, Homo sapiens
gggagagagaagcaggcaga

SEQ ID NO: 1551723 - DNA, 12 bp, Homo sapiens
gggagagccagc

SEQ ID NO: 1551724 - DNA, 12 bp, Homo sapiens
gggagagcctgc

SEQ ID NO: 1551725 - DNA, 16 bp, Homo sapiens
gggagagcctgctggc

SEQ ID NO: 1551726 - DNA, 14 bp, Homo sapiens
gggagagcggctgg

SEQ ID NO: 1551727 - DNA, 15 bp, Homo sapiens
gggagagggtctgga

SEQ ID NO: 1551728 - DNA, 18 bp, Homo sapiens
gggagagggtgaaggagg

SEQ ID NO: 1551729 - DNA, 14 bp, Homo sapiens
gggagatggtcagt

SEQ ID NO: 1551730 - DNA, 15 bp, Homo sapiens
gggagatggtcagtg

SEQ ID NO: 1551731 - DNA, 20 bp, Homo sapiens
gggagcacttgcgtcctgca

SEQ ID NO: 1551732 - DNA, 15 bp, Homo sapiens
gggagcagggaaggc

SEQ ID NO: 1551733 - DNA, 20 bp, Homo sapiens
gggagcagtgtcttccataa

SEQ ID NO: 1551734 - DNA, 21 bp, Homo sapiens
gggagcagttttcccctggcc

SEQ ID NO: 1551735 - DNA, 19 bp, Homo sapiens
gggagccacttctccccag

SEQ ID NO: 1551736 - DNA, 11 bp, Homo sapiens
gggagccagct

SEQ ID NO: 1551737 - DNA, 10 bp, Homo sapiens
gggagccagg

SEQ ID NO: 1551738 - DNA, 19 bp, Homo sapiens
gggagccatgcgccccctc

SEQ ID NO: 1551739 - DNA, 10 bp, Homo sapiens
gggagcccac

SEQ ID NO: 1551740 - DNA, 20 bp, Homo sapiens
gggagcccactgtcctgggc

SEQ ID NO: 1551741 - DNA, 21 bp, Homo sapiens
gggagcccactgtcctgggcc

SEQ ID NO: 1551742 - DNA, 14 bp, Homo sapiens
gggagccgagggcg

SEQ ID NO: 1551743 - DNA, 18 bp, Homo sapiens
gggagccttagccgccca

SEQ ID NO: 1551744 - DNA, 18 bp, Homo sapiens
gggagcgcctgaccctgg

SEQ ID NO: 1551745 - DNA, 13 bp, Homo sapiens
gggagcggaggtt

SEQ ID NO: 1551746 - DNA, 23 bp, Homo sapiens
gggagctccactctgcttctctg

SEQ ID NO: 1551747 - DNA, 15 bp, Homo sapiens
gggagctcctccgca

SEQ ID NO: 1551748 - DNA, 14 bp, Homo sapiens
gggagctctgcttg

SEQ ID NO: 1551749 - DNA, 14 bp, Homo sapiens
gggagctctgggga

SEQ ID NO: 1551750 - DNA, 17 bp, Homo sapiens
gggagctctggggacag

SEQ ID NO: 1551751 - DNA, 15 bp, Homo sapiens
gggagctgagctgga

SEQ ID NO: 1551752 - DNA, 19 bp, Homo sapiens
gggagctggttagaaatgc

SEQ ID NO: 1551753 - DNA, 22 bp, Homo sapiens
gggagcttccgctttgaaagaa

SEQ ID NO: 1551754 - DNA, 20 bp, Homo sapiens
gggaggaaagggcctggcca

SEQ ID NO: 1551755 - DNA, 24 bp, Homo sapiens
gggaggaaatttgaatgggtccat

SEQ ID NO: 1551756 - DNA, 23 bp, Homo sapiens
gggaggaagcaggttgaggggct

SEQ ID NO: 1551757 - DNA, 21 bp, Homo sapiens
gggaggagaggggaagggcca

SEQ ID NO: 1551758 - DNA, 15 bp, Homo sapiens
gggaggagcctgtgc

SEQ ID NO: 1551759 - DNA, 18 bp, Homo sapiens
gggaggagggagagggag

SEQ ID NO: 1551760 - DNA, 15 bp, Homo sapiens
gggaggatacagagg

SEQ ID NO: 1551761 - DNA, 17 bp, Homo sapiens
gggaggatcactggagc

SEQ ID NO: 1551762 - DNA, 17 bp, Homo sapiens
gggaggcaagaaaagga

SEQ ID NO: 1551763 - DNA, 12 bp, Homo sapiens
gggaggcaccag

SEQ ID NO: 1551764 - DNA, 16 bp, Homo sapiens
gggaggcaccagctct

SEQ ID NO: 1551765 - DNA, 15 bp, Homo sapiens
gggaggcacctccag

SEQ ID NO: 1551766 - DNA, 13 bp, Homo sapiens
gggaggcagcaga

SEQ ID NO: 1551767 - DNA, 14 bp, Homo sapiens
gggaggccaaggca

SEQ ID NO: 1551768 - DNA, 14 bp, Homo sapiens
gggaggccccaggg

SEQ ID NO: 1551769 - DNA, 17 bp, Homo sapiens
gggaggctgaggcagga

SEQ ID NO: 1551770 - DNA, 13 bp, Homo sapiens
gggagggaggtgg

SEQ ID NO: 1551771 - DNA, 22 bp, Homo sapiens
gggagggcggcaggggcctgga

SEQ ID NO: 1551772 - DNA, 12 bp, Homo sapiens
gggaggggcagg

SEQ ID NO: 1551773 - DNA, 16 bp, Homo sapiens
gggaggggcctaggga

SEQ ID NO: 1551774 - DNA, 18 bp, Homo sapiens
gggaggggcgctggccca

SEQ ID NO: 1551775 - DNA, 13 bp, Homo sapiens
gggagggggaggg

SEQ ID NO: 1551776 - DNA, 21 bp, Homo sapiens
gggagggggttacaaactgca

SEQ ID NO: 1551777 - DNA, 18 bp, Homo sapiens
gggagggttcccctggcc

SEQ ID NO: 1551778 - DNA, 13 bp, Homo sapiens
gggaggtccaagc

SEQ ID NO: 1551779 - DNA, 16 bp, Homo sapiens
gggaggtcgaggtagg

SEQ ID NO: 1551780 - DNA, 13 bp, Homo sapiens
gggagtacctgct

SEQ ID NO: 1551781 - DNA, 14 bp, Homo sapiens
gggagtagccaagc

SEQ ID NO: 1551782 - DNA, 17 bp, Homo sapiens
gggagtccccttttctt

SEQ ID NO: 1551783 - DNA, 23 bp, Homo sapiens
gggagtgactcaagaagtgaaga

SEQ ID NO: 1551784 - DNA, 11 bp, Homo sapiens
gggagtgggtg

SEQ ID NO: 1551785 - DNA, 13 bp, Homo sapiens
gggcagctgggcc

SEQ ID NO: 1551786 - DNA, 15 bp, Homo sapiens
gggcagctgtccctt

SEQ ID NO: 1551787 - DNA, 15 bp, Homo sapiens
gggcaggagtgccag

SEQ ID NO: 1551788 - DNA, 19 bp, Homo sapiens
gggcaggagtgccaggacc

SEQ ID NO: 1551789 - DNA, 20 bp, Homo sapiens
gggcaggagtgccaggacca

SEQ ID NO: 1551790 - DNA, 20 bp, Homo sapiens
gggcaggatctcaagccagc

SEQ ID NO: 1551791 - DNA, 14 bp, Homo sapiens
gggcaggctgggcc

SEQ ID NO: 1551792 - DNA, 12 bp, Homo sapiens
gggcaggcttgg

SEQ ID NO: 1551793 - DNA, 18 bp, Homo sapiens
gggcagggagctgggccc

SEQ ID NO: 1551794 - DNA, 20 bp, Homo sapiens
gggcagggagctgggcccga

SEQ ID NO: 1551795 - DNA, 23 bp, Homo sapiens
gggcagggccgcccgggcccaga

SEQ ID NO: 1551796 - DNA, 18 bp, Homo sapiens
gggcagggcctgggcctc

SEQ ID NO: 1551797 - DNA, 14 bp, Homo sapiens
gggcaggggtgctg

SEQ ID NO: 1551798 - DNA, 14 bp, Homo sapiens
gggcagggtgaccc

SEQ ID NO: 1551799 - DNA, 20 bp, Homo sapiens
gggcaggtctagtgttcctg

SEQ ID NO: 1551800 - DNA, 16 bp, Homo sapiens
gggcaggtgggagctg

SEQ ID NO: 1551801 - DNA, 17 bp, Homo sapiens
gggcaggtgggagctga

SEQ ID NO: 1551802 - DNA, 19 bp, Homo sapiens
gggcagtggaggctgctgt

SEQ ID NO: 1551803 - DNA, 21 bp, Homo sapiens
gggcagtggaggctgctgtga

SEQ ID NO: 1551804 - DNA, 13 bp, Homo sapiens
gggcatcaggcac

SEQ ID NO: 1551805 - DNA, 17 bp, Homo sapiens
gggcatcaggcactggt

SEQ ID NO: 1551806 - DNA, 13 bp, Homo sapiens
gggcatcatgcat

SEQ ID NO: 1551807 - DNA, 23 bp, Homo sapiens
gggcatccacccagtgctgccat

SEQ ID NO: 1551808 - DNA, 23 bp, Homo sapiens
gggcatcctggatgatttcatct

SEQ ID NO: 1551809 - DNA, 20 bp, Homo sapiens
gggcatctgcccctccccca

SEQ ID NO: 1551810 - DNA, 17 bp, Homo sapiens
gggcatgcacacggctg

SEQ ID NO: 1551811 - DNA, 22 bp, Homo sapiens
gggcatggacgttcggggcatg

SEQ ID NO: 1551812 - DNA, 15 bp, Homo sapiens
gggcatggccaggtg

SEQ ID NO: 1551813 - DNA, 14 bp, Homo sapiens
gggcatggcgtgga

SEQ ID NO: 1551814 - DNA, 20 bp, Homo sapiens
gggcatgtcctttccatctg

SEQ ID NO: 1551815 - DNA, 14 bp, Homo sapiens
gggcattgctcagc

SEQ ID NO: 1551816 - DNA, 16 bp, Homo sapiens
gggcctgagcagctgg

SEQ ID NO: 1551817 - DNA, 21 bp, Homo sapiens
gggcctgagggtccacctgga

SEQ ID NO: 1551818 - DNA, 23 bp, Homo sapiens
gggcctgagggtccacctggaga

SEQ ID NO: 1551819 - DNA, 20 bp, Homo sapiens
gggcctgagtggaggattat

SEQ ID NO: 1551820 - DNA, 13 bp, Homo sapiens
gggcctgcccctg

SEQ ID NO: 1551821 - DNA, 21 bp, Homo sapiens
gggcctgccgggctgagggcc

SEQ ID NO: 1551822 - DNA, 17 bp, Homo sapiens
gggcctgctccagacct

SEQ ID NO: 1551823 - DNA, 14 bp, Homo sapiens
gggcctggagcccc

SEQ ID NO: 1551824 - DNA, 21 bp, Homo sapiens
gggcctggagccctgggcgga

SEQ ID NO: 1551825 - DNA, 16 bp, Homo sapiens
gggcctggaggtctgg

SEQ ID NO: 1551826 - DNA, 19 bp, Homo sapiens
gggcctggaggtctggctg

SEQ ID NO: 1551827 - DNA, 20 bp, Homo sapiens
gggcctggaggtctggctga

SEQ ID NO: 1551828 - DNA, 21 bp, Homo sapiens
gggcctggattcatttcctgc

SEQ ID NO: 1551829 - DNA, 22 bp, Homo sapiens
gggcctggcagccgtgccttca

SEQ ID NO: 1551830 - DNA, 12 bp, Homo sapiens
gggcctggccag

SEQ ID NO: 1551831 - DNA, 15 bp, Homo sapiens
gggcctggccagtcc

SEQ ID NO: 1551832 - DNA, 16 bp, Homo sapiens
gggcctggccagtcct

SEQ ID NO: 1551833 - DNA, 17 bp, Homo sapiens
gggcctggcctgagctg

SEQ ID NO: 1551834 - DNA, 21 bp, Homo sapiens
gggcctggcttgctccagggt

SEQ ID NO: 1551835 - DNA, 12 bp, Homo sapiens
gggcctgggagg

SEQ ID NO: 1551836 - DNA, 16 bp, Homo sapiens
gggcctgggcctcatg

SEQ ID NO: 1551837 - DNA, 15 bp, Homo sapiens
gggcctgggcctgct

SEQ ID NO: 1551838 - DNA, 22 bp, Homo sapiens
gggcctgggggcagtgactggc

SEQ ID NO: 1551839 - DNA, 16 bp, Homo sapiens
gggcctggtccctggg

SEQ ID NO: 1551840 - DNA, 19 bp, Homo sapiens
gggcctggtccctgggagg

SEQ ID NO: 1551841 - DNA, 16 bp, Homo sapiens
gggcctgtcgtgccag

SEQ ID NO: 1551842 - DNA, 16 bp, Homo sapiens
gggcctgtgcagcagc

SEQ ID NO: 1551843 - DNA, 17 bp, Homo sapiens
gggcctgtgcagcagcc

SEQ ID NO: 1551844 - DNA, 18 bp, Homo sapiens
gggcctgtgcagcagccc

SEQ ID NO: 1551845 - DNA, 16 bp, Homo sapiens
gggcctgttctcttgg

SEQ ID NO: 1551846 - DNA, 20 bp, Homo sapiens
gggccttccttttgaggagc

SEQ ID NO: 1551847 - DNA, 21 bp, Homo sapiens
gggccttccttttgaggagct

SEQ ID NO: 1551848 - DNA, 17 bp, Homo sapiens
gggccttgaagactccc

SEQ ID NO: 1551849 - DNA, 20 bp, Homo sapiens
gggccttgaagactccctga

SEQ ID NO: 1551850 - DNA, 17 bp, Homo sapiens
gggccttgcccagagat

SEQ ID NO: 1551851 - DNA, 13 bp, Homo sapiens
gggccttgctaaa

SEQ ID NO: 1551852 - DNA, 23 bp, Homo sapiens
gggccttgctacctcaaggggga

SEQ ID NO: 1551853 - DNA, 21 bp, Homo sapiens
gggccttttctggcaccgcag

SEQ ID NO: 1551854 - DNA, 16 bp, Homo sapiens
gggccttttggatatg

SEQ ID NO: 1551855 - DNA, 20 bp, Homo sapiens
gggcgagcccctccttctcc

SEQ ID NO: 1551856 - DNA, 14 bp, Homo sapiens
gggcgcccaccctg

SEQ ID NO: 1551857 - DNA, 16 bp, Homo sapiens
gggcgcccaccctggg

SEQ ID NO: 1551858 - DNA, 22 bp, Homo sapiens
gggcgcccattcgtctgtccca

SEQ ID NO: 1551859 - DNA, 13 bp, Homo sapiens
gggcgccctctct

SEQ ID NO: 1551860 - DNA, 15 bp, Homo sapiens
gggcgccctggaagc

SEQ ID NO: 1551861 - DNA, 16 bp, Homo sapiens
gggcgcggtggctcac

SEQ ID NO: 1551862 - DNA, 15 bp, Homo sapiens
gggcgctcagacggc

SEQ ID NO: 1551863 - DNA, 18 bp, Homo sapiens
gggcgctcagacggcggc

SEQ ID NO: 1551864 - DNA, 12 bp, Homo sapiens
gggcgctcagga

SEQ ID NO: 1551865 - DNA, 15 bp, Homo sapiens
gggcgctcaggaccc

SEQ ID NO: 1551866 - DNA, 21 bp, Homo sapiens
gggcgctcaggacccaggccc

SEQ ID NO: 1551867 - DNA, 15 bp, Homo sapiens
gggcgctcgctcagg

SEQ ID NO: 1551868 - DNA, 18 bp, Homo sapiens
gggcgctgcagcctccct

SEQ ID NO: 1551869 - DNA, 23 bp, Homo sapiens
gggcgctggacactctctgccct

SEQ ID NO: 1551870 - DNA, 13 bp, Homo sapiens
gggcgctggccca

SEQ ID NO: 1551871 - DNA, 17 bp, Homo sapiens
gggcgctggcccagccg

SEQ ID NO: 1551872 - DNA, 18 bp, Homo sapiens
gggcgctggcccagccgg

SEQ ID NO: 1551873 - DNA, 15 bp, Homo sapiens
gggcggacggctgtg

SEQ ID NO: 1551874 - DNA, 15 bp, Homo sapiens
gggcggcaggaggga

SEQ ID NO: 1551875 - DNA, 13 bp, Homo sapiens
gggcggctgagag

SEQ ID NO: 1551876 - DNA, 12 bp, Homo sapiens
gggcggctgggt

SEQ ID NO: 1551877 - DNA, 12 bp, Homo sapiens
gggcgggccagg

SEQ ID NO: 1551878 - DNA, 13 bp, Homo sapiens
gggcgggccaggg

SEQ ID NO: 1551879 - DNA, 20 bp, Homo sapiens
gggcggtcacagcatggagg

SEQ ID NO: 1551880 - DNA, 22 bp, Homo sapiens
gggcggtcacagcatggaggag

SEQ ID NO: 1551881 - DNA, 14 bp, Homo sapiens
gggcgtcagagaga

SEQ ID NO: 1551882 - DNA, 14 bp, Homo sapiens
gggcgtctgagctg

SEQ ID NO: 1551883 - DNA, 22 bp, Homo sapiens
gggcgtgctagaggttgcagca

SEQ ID NO: 1551884 - DNA, 13 bp, Homo sapiens
gggcgtggaggga

SEQ ID NO: 1551885 - DNA, 15 bp, Homo sapiens
gggcgtggagggagg

SEQ ID NO: 1551886 - DNA, 21 bp, Homo sapiens
gggcgtggagggaggccccag

SEQ ID NO: 1551887 - DNA, 21 bp, Homo sapiens
gggcgtggatcgagtgtagct

SEQ ID NO: 1551888 - DNA, 21 bp, Homo sapiens
gggcgtgtgtgacactgatga

SEQ ID NO: 1551889 - DNA, 14 bp, Homo sapiens
gggcgttgggagcc

SEQ ID NO: 1551890 - DNA, 22 bp, Homo sapiens
gggctaattatatattttgttg

SEQ ID NO: 1551891 - DNA, 13 bp, Homo sapiens
gggctaatttaac

SEQ ID NO: 1551892 - DNA, 16 bp, Homo sapiens
gggctaccatctgcat

SEQ ID NO: 1551893 - DNA, 19 bp, Homo sapiens
gggctaccctaaagggaga

SEQ ID NO: 1551894 - DNA, 14 bp, Homo sapiens
gggctactggcagc

SEQ ID NO: 1551895 - DNA, 22 bp, Homo sapiens
gggctactggcagctcctctcc

SEQ ID NO: 1551896 - DNA, 21 bp, Homo sapiens
gggctagtgtgagtggcagcc

SEQ ID NO: 1551897 - DNA, 22 bp, Homo sapiens
gggctcaccagctggggtcctg

SEQ ID NO: 1551898 - DNA, 23 bp, Homo sapiens
gggctcacttttcatccttcccc

SEQ ID NO: 1551899 - DNA, 13 bp, Homo sapiens
gggctcagcaatg

SEQ ID NO: 1551900 - DNA, 13 bp, Homo sapiens
gggctcagcctgg

SEQ ID NO: 1551901 - DNA, 20 bp, Homo sapiens
gggctcagcctggtgggcct

SEQ ID NO: 1551902 - DNA, 13 bp, Homo sapiens
gggctcagggttg

SEQ ID NO: 1551903 - DNA, 22 bp, Homo sapiens
gggctcaggtcacataaaactt

SEQ ID NO: 1551904 - DNA, 16 bp, Homo sapiens
gggctccacacagcag

SEQ ID NO: 1551905 - DNA, 18 bp, Homo sapiens
ggggcagtgactggcagg

SEQ ID NO: 1551906 - DNA, 14 bp, Homo sapiens
ggggcatctgcccc

SEQ ID NO: 1551907 - DNA, 17 bp, Homo sapiens
ggggcatgggtggaggg

SEQ ID NO: 1551908 - DNA, 19 bp, Homo sapiens
ggggcatgtattggcctgg

SEQ ID NO: 1551909 - DNA, 19 bp, Homo sapiens
ggggcattgagtattgttt

SEQ ID NO: 1551910 - DNA, 16 bp, Homo sapiens
ggggccacctcctccc

SEQ ID NO: 1551911 - DNA, 13 bp, Homo sapiens
ggggccagatcca

SEQ ID NO: 1551912 - DNA, 12 bp, Homo sapiens
ggggccaggagc

SEQ ID NO: 1551913 - DNA, 18 bp, Homo sapiens
ggggcccagcgctctcct

SEQ ID NO: 1551914 - DNA, 12 bp, Homo sapiens
ggggcccagtgc

SEQ ID NO: 1551915 - DNA, 18 bp, Homo sapiens
ggggcccccgtgttcagg

SEQ ID NO: 1551916 - DNA, 14 bp, Homo sapiens
ggggccccgccagg

SEQ ID NO: 1551917 - DNA, 15 bp, Homo sapiens
ggggccccgccaggg

SEQ ID NO: 1551918 - DNA, 22 bp, Homo sapiens
ggggccccgccagggctgggga

SEQ ID NO: 1551919 - DNA, 15 bp, Homo sapiens
ggggcccctggccca

SEQ ID NO: 1551920 - DNA, 14 bp, Homo sapiens
ggggcccgaacagg

SEQ ID NO: 1551921 - DNA, 14 bp, Homo sapiens
ggggccctgccctg

SEQ ID NO: 1551922 - DNA, 21 bp, Homo sapiens
ggggcccttgggccacgctct

SEQ ID NO: 1551923 - DNA, 19 bp, Homo sapiens
ggggccgccacggcctggc

SEQ ID NO: 1551924 - DNA, 16 bp, Homo sapiens
ggggccgctggggtcc

SEQ ID NO: 1551925 - DNA, 21 bp, Homo sapiens
ggggcctagcgatctctcctg

SEQ ID NO: 1551926 - DNA, 13 bp, Homo sapiens
ggggcctagggag

SEQ ID NO: 1551927 - DNA, 21 bp, Homo sapiens
ggggcctgcagaaggaaagaa

SEQ ID NO: 1551928 - DNA, 19 bp, Homo sapiens
ggggcctggagatcctcct

SEQ ID NO: 1551929 - DNA, 12 bp, Homo sapiens
ggggcctggcag

SEQ ID NO: 1551930 - DNA, 13 bp, Homo sapiens
ggggcctggcttg

SEQ ID NO: 1551931 - DNA, 21 bp, Homo sapiens
ggggcctggcttgctccaggg

SEQ ID NO: 1551932 - DNA, 23 bp, Homo sapiens
ggggccttagggcactgggctgt

SEQ ID NO: 1551933 - DNA, 24 bp, Homo sapiens
ggggcgctcaggacccaggccctc

SEQ ID NO: 1551934 - DNA, 13 bp, Homo sapiens
ggggcgctggccc

SEQ ID NO: 1551935 - DNA, 18 bp, Homo sapiens
ggggcgctggcccagccg

SEQ ID NO: 1551936 - DNA, 14 bp, Homo sapiens
ggggcgggccaggg

SEQ ID NO: 1551937 - DNA, 15 bp, Homo sapiens
ggggcgggccagggt

SEQ ID NO: 1551938 - DNA, 16 bp, Homo sapiens
ggggcgggccagggtg

SEQ ID NO: 1551939 - DNA, 24 bp, Homo sapiens
ggggctaaggtttccagtcagatg

SEQ ID NO: 1551940 - DNA, 19 bp, Homo sapiens
ggggctccccgggtctctc

SEQ ID NO: 1551941 - DNA, 23 bp, Homo sapiens
ggggctccccgggtctctcactg

SEQ ID NO: 1551942 - DNA, 13 bp, Homo sapiens
ggggctcccgccc

SEQ ID NO: 1551943 - DNA, 13 bp, Homo sapiens
ggggctcctgagt

SEQ ID NO: 1551944 - DNA, 22 bp, Homo sapiens
ggggctcctttctccagccagc

SEQ ID NO: 1551945 - DNA, 19 bp, Homo sapiens
ggggctctgccccaggccc

SEQ ID NO: 1551946 - DNA, 13 bp, Homo sapiens
ggggctctgcctt

SEQ ID NO: 1551947 - DNA, 20 bp, Homo sapiens
ggggctctgcttcctcagcc

SEQ ID NO: 1551948 - DNA, 14 bp, Homo sapiens
ggggctcttctcat

SEQ ID NO: 1551949 - DNA, 18 bp, Homo sapiens
ggggctgaacggggagaa

SEQ ID NO: 1551950 - DNA, 12 bp, Homo sapiens
ggggctgagcct

SEQ ID NO: 1551951 - DNA, 20 bp, Homo sapiens
ggggctgaggacgagacccc

SEQ ID NO: 1551952 - DNA, 14 bp, Homo sapiens
ggggctgaggggca

SEQ ID NO: 1551953 - DNA, 18 bp, Homo sapiens
ggggctgagtctccaggg

SEQ ID NO: 1551954 - DNA, 16 bp, Homo sapiens
ggggctgatgaagaag

SEQ ID NO: 1551955 - DNA, 13 bp, Homo sapiens
ggggctgcagcat

SEQ ID NO: 1551956 - DNA, 16 bp, Homo sapiens
ggggctgccagcgtct

SEQ ID NO: 1551957 - DNA, 18 bp, Homo sapiens
ggggctgcccttgggcca

SEQ ID NO: 1551958 - DNA, 15 bp, Homo sapiens
ggggctgctcctcca

SEQ ID NO: 1551959 - DNA, 20 bp, Homo sapiens
ggggctgctcctccagggcc

SEQ ID NO: 1551960 - DNA, 18 bp, Homo sapiens
ggggctgcttcctcctgg

SEQ ID NO: 1551961 - DNA, 19 bp, Homo sapiens
ggggctggcggctactcag

SEQ ID NO: 1551962 - DNA, 19 bp, Homo sapiens
ggggctgtcctgagccccc

SEQ ID NO: 1551963 - DNA, 15 bp, Homo sapiens
ggggctgtcctgctg

SEQ ID NO: 1551964 - DNA, 20 bp, Homo sapiens
ggggctgtgactctgggcag

SEQ ID NO: 1551965 - DNA, 21 bp, Homo sapiens
ggggcttcaccagtctgtcta

SEQ ID NO: 1551966 - DNA, 24 bp, Homo sapiens
ggggcttcaccagtctgtctactg

SEQ ID NO: 1551967 - DNA, 19 bp, Homo sapiens
ggggcttcatctgcaaagg

SEQ ID NO: 1551968 - DNA, 21 bp, Homo sapiens
ggggcttctggacctagggtg

SEQ ID NO: 1551969 - DNA, 22 bp, Homo sapiens
ggggcttgcccactgcctgcct

SEQ ID NO: 1551970 - DNA, 23 bp, Homo sapiens
ggggcttgcccactgcctgcctc

SEQ ID NO: 1551971 - DNA, 14 bp, Homo sapiens
ggggcttggggctc

SEQ ID NO: 1551972 - DNA, 21 bp, Homo sapiens
ggggctttctcttccccttcc

SEQ ID NO: 1551973 - DNA, 17 bp, Homo sapiens
gggggaactcagatcca

SEQ ID NO: 1551974 - DNA, 15 bp, Homo sapiens
gggggagggagggct

SEQ ID NO: 1551975 - DNA, 16 bp, Homo sapiens
gggggagtagccaagc

SEQ ID NO: 1551976 - DNA, 22 bp, Homo sapiens
gggggatgccactcctccctcc

SEQ ID NO: 1551977 - DNA, 22 bp, Homo sapiens
gggggcacttggaggacctggc

SEQ ID NO: 1551978 - DNA, 13 bp, Homo sapiens
gggggctggccta

SEQ ID NO: 1551979 - DNA, 21 bp, Homo sapiens
gggggctggtgccagccttcc

SEQ ID NO: 1551980 - DNA, 15 bp, Homo sapiens
ggggggacagtgccc

SEQ ID NO: 1551981 - DNA, 18 bp, Homo sapiens
gggggtcccagtgggagg

SEQ ID NO: 1551982 - DNA, 13 bp, Homo sapiens
gggggtgctggcc

SEQ ID NO: 1551983 - DNA, 14 bp, Homo sapiens
gggggtgggggtgc

SEQ ID NO: 1551984 - DNA, 18 bp, Homo sapiens
ggggtaagccagagcctg

SEQ ID NO: 1551985 - DNA, 20 bp, Homo sapiens
ggggtacatttctctgagca

SEQ ID NO: 1551986 - DNA, 15 bp, Homo sapiens
ggggtataggtctca

SEQ ID NO: 1551987 - DNA, 20 bp, Homo sapiens
ggggtataggtctcatctct

SEQ ID NO: 1551988 - DNA, 20 bp, Homo sapiens
ggggtatttcaattaccttc

SEQ ID NO: 1551989 - DNA, 13 bp, Homo sapiens
ggggtccagtctg

SEQ ID NO: 1551990 - DNA, 13 bp, Homo sapiens
ggggtcccagtgg

SEQ ID NO: 1551991 - DNA, 17 bp, Homo sapiens
ggggtccctcaggttcc

SEQ ID NO: 1551992 - DNA, 14 bp, Homo sapiens
ggggtcctctctga

SEQ ID NO: 1551993 - DNA, 22 bp, Homo sapiens
ggggtcctctctgagtcaaatc

SEQ ID NO: 1551994 - DNA, 22 bp, Homo sapiens
ggggtccttcaagttagctcag

SEQ ID NO: 1551995 - DNA, 12 bp, Homo sapiens
ggggtccttgga

SEQ ID NO: 1551996 - DNA, 17 bp, Homo sapiens
ggggtctcacccatgca

SEQ ID NO: 1551997 - DNA, 19 bp, Homo sapiens
ggggtctccctctcctgcc

SEQ ID NO: 1551998 - DNA, 21 bp, Homo sapiens
ggggtctccctggctccctcc

SEQ ID NO: 1551999 - DNA, 20 bp, Homo sapiens
ggggtctggagttgatctgg

SEQ ID NO: 1552000 - DNA, 13 bp, Homo sapiens
ggggtctgtgctg

SEQ ID NO: 1552001 - DNA, 20 bp, Homo sapiens
ggggtgaacagctggtgcca

SEQ ID NO: 1552002 - DNA, 13 bp, Homo sapiens
ggggtgagggagt

SEQ ID NO: 1552003 - DNA, 14 bp, Homo sapiens
ggggtgagtcccct

SEQ ID NO: 1552004 - DNA, 13 bp, Homo sapiens
ggagccagctgct

SEQ ID NO: 1552005 - DNA, 14 bp, Homo sapiens
ggagccagctgctt

SEQ ID NO: 1552006 - DNA, 13 bp, Homo sapiens
ggagccagggcct

SEQ ID NO: 1552007 - DNA, 20 bp, Homo sapiens
ggagccatcccttcggagcc

SEQ ID NO: 1552008 - DNA, 14 bp, Homo sapiens
ggagccatttgaga

SEQ ID NO: 1552009 - DNA, 15 bp, Homo sapiens
ggagcccacaacctt

SEQ ID NO: 1552010 - DNA, 14 bp, Homo sapiens
ggagcccactgtcc

SEQ ID NO: 1552011 - DNA, 17 bp, Homo sapiens
ggagcccactgtcctgg

SEQ ID NO: 1552012 - DNA, 18 bp, Homo sapiens
ggagcccactgtcctggg

SEQ ID NO: 1552013 - DNA, 22 bp, Homo sapiens
ggagcccactgtcctgggcctg

SEQ ID NO: 1552014 - DNA, 16 bp, Homo sapiens
ggagcccagccctccc

SEQ ID NO: 1552015 - DNA, 17 bp, Homo sapiens
ggagcccagcctgggag

SEQ ID NO: 1552016 - DNA, 12 bp, Homo sapiens
ggagcccagggc

SEQ ID NO: 1552017 - DNA, 13 bp, Homo sapiens
ggagcccagggca

SEQ ID NO: 1552018 - DNA, 20 bp, Homo sapiens
ggagccccaccttgtctgct

SEQ ID NO: 1552019 - DNA, 12 bp, Homo sapiens
ggagccccagct

SEQ ID NO: 1552020 - DNA, 13 bp, Homo sapiens
ggagccccagctt

SEQ ID NO: 1552021 - DNA, 16 bp, Homo sapiens
ggagccccgccacagc

SEQ ID NO: 1552022 - DNA, 23 bp, Homo sapiens
ggagcccctcctctgagcagcct

SEQ ID NO: 1552023 - DNA, 22 bp, Homo sapiens
ggagcccctgggtgggtggtgg

SEQ ID NO: 1552024 - DNA, 13 bp, Homo sapiens
ggagcccgcactg

SEQ ID NO: 1552025 - DNA, 19 bp, Homo sapiens
ggagcccgcactgtcccag

SEQ ID NO: 1552026 - DNA, 16 bp, Homo sapiens
ggagccctgaggacct

SEQ ID NO: 1552027 - DNA, 21 bp, Homo sapiens
ggagccctgaggacctctcag

SEQ ID NO: 1552028 - DNA, 22 bp, Homo sapiens
ggagcctagcggagcccagcct

SEQ ID NO: 1552029 - DNA, 14 bp, Homo sapiens
ggagcctagctcct

SEQ ID NO: 1552030 - DNA, 15 bp, Homo sapiens
ggagcctagctcctg

SEQ ID NO: 1552031 - DNA, 18 bp, Homo sapiens
ggagcctagctcctgcca

SEQ ID NO: 1552032 - DNA, 12 bp, Homo sapiens
ggagcctcagaa

SEQ ID NO: 1552033 - DNA, 19 bp, Homo sapiens
ggagcctcagaagaaaaca

SEQ ID NO: 1552034 - DNA, 20 bp, Homo sapiens
ggagcctcatccgaggcagg

SEQ ID NO: 1552035 - DNA, 22 bp, Homo sapiens
ggagcctccgacgctgcctctc

SEQ ID NO: 1552036 - DNA, 11 bp, Homo sapiens
ggagcctgcag

SEQ ID NO: 1552037 - DNA, 16 bp, Homo sapiens
ggagcctgcagggtgg

SEQ ID NO: 1552038 - DNA, 21 bp, Homo sapiens
ggagcctgcagggtggtgctg

SEQ ID NO: 1552039 - DNA, 13 bp, Homo sapiens
ggagcctggcaca

SEQ ID NO: 1552040 - DNA, 13 bp, Homo sapiens
ggagcctgggtgg

SEQ ID NO: 1552041 - DNA, 21 bp, Homo sapiens
ggagcctgtgcgtcccagctg

SEQ ID NO: 1552042 - DNA, 22 bp, Homo sapiens
ggagcctgtgcgtcccagctga

SEQ ID NO: 1552043 - DNA, 22 bp, Homo sapiens
ggagccttcccaagttgtgctt

SEQ ID NO: 1552044 - DNA, 20 bp, Homo sapiens
ggagcctttggttctggcca

SEQ ID NO: 1552045 - DNA, 19 bp, Homo sapiens
ggagcctttttaaaacaca

SEQ ID NO: 1552046 - DNA, 22 bp, Homo sapiens
ggagcgagcatgtcgtggacac

SEQ ID NO: 1552047 - DNA, 23 bp, Homo sapiens
ggagcgcacctgccccctggtgg

SEQ ID NO: 1552048 - DNA, 20 bp, Homo sapiens
ggagctaaggctctatgagt

SEQ ID NO: 1552049 - DNA, 13 bp, Homo sapiens
ggagctagaggcc

SEQ ID NO: 1552050 - DNA, 17 bp, Homo sapiens
ggagctagttctcagct

SEQ ID NO: 1552051 - DNA, 22 bp, Homo sapiens
ggagctatcaggaacagctatg

SEQ ID NO: 1552052 - DNA, 16 bp, Homo sapiens
ggagctatcagtgctt

SEQ ID NO: 1552053 - DNA, 12 bp, Homo sapiens
ggagctcaccct

SEQ ID NO: 1552054 - DNA, 20 bp, Homo sapiens
ggagctcaccctgcccgctc

SEQ ID NO: 1552055 - DNA, 14 bp, Homo sapiens
ggagctctgcgcca

SEQ ID NO: 1552056 - DNA, 16 bp, Homo sapiens
ggagctctgcgccagg

SEQ ID NO: 1552057 - DNA, 17 bp, Homo sapiens
ggagctctgcgccaggc

SEQ ID NO: 1552058 - DNA, 18 bp, Homo sapiens
ggagctctgcgccaggca

SEQ ID NO: 1552059 - DNA, 11 bp, Homo sapiens
ggagctctgct

SEQ ID NO: 1552060 - DNA, 23 bp, Homo sapiens
ggagctctgggaatttggagtga

SEQ ID NO: 1552061 - DNA, 14 bp, Homo sapiens
ggagctctggggac

SEQ ID NO: 1552062 - DNA, 21 bp, Homo sapiens
ggagctctgtgggtctctgga

SEQ ID NO: 1552063 - DNA, 20 bp, Homo sapiens
ggagctcttggaagagctct

SEQ ID NO: 1552064 - DNA, 11 bp, Homo sapiens
ggagctgagat

SEQ ID NO: 1552065 - DNA, 15 bp, Homo sapiens
ggagctgatggcagc

SEQ ID NO: 1552066 - DNA, 17 bp, Homo sapiens
ggagctgatttccaggc

SEQ ID NO: 1552067 - DNA, 18 bp, Homo sapiens
ggagctgatttccaggcc

SEQ ID NO: 1552068 - DNA, 15 bp, Homo sapiens
ggagctgccacagag

SEQ ID NO: 1552069 - DNA, 13 bp, Homo sapiens
ggagctgcccaga

SEQ ID NO: 1552070 - DNA, 21 bp, Homo sapiens
ggagctgcctgcttggcccgg

SEQ ID NO: 1552071 - DNA, 20 bp, Homo sapiens
ggagctgcgcttccctgcag

SEQ ID NO: 1552072 - DNA, 13 bp, Homo sapiens
ggagctgctggct

SEQ ID NO: 1552073 - DNA, 12 bp, Homo sapiens
ggagctggaacc

SEQ ID NO: 1552074 - DNA, 19 bp, Homo sapiens
ggagctggaggggtgggga

SEQ ID NO: 1552075 - DNA, 20 bp, Homo sapiens
ggagctggaggggtggggag

SEQ ID NO: 1552076 - DNA, 21 bp, Homo sapiens
ggagctggaggggtggggagc

SEQ ID NO: 1552077 - DNA, 15 bp, Homo sapiens
ggagctggccccgct

SEQ ID NO: 1552078 - DNA, 15 bp, Homo sapiens
ggagctggctggcag

SEQ ID NO: 1552079 - DNA, 17 bp, Homo sapiens
ggagctggctggcaggt

SEQ ID NO: 1552080 - DNA, 16 bp, Homo sapiens
ggagctgggcccctgc

SEQ ID NO: 1552081 - DNA, 17 bp, Homo sapiens
ggagctgggggaaggca

SEQ ID NO: 1552082 - DNA, 14 bp, Homo sapiens
ggagcttacccaag

SEQ ID NO: 1552083 - DNA, 16 bp, Homo sapiens
ggagcttacccaagct

SEQ ID NO: 1552084 - DNA, 21 bp, Homo sapiens
ggagcttacccaagctgtggc

SEQ ID NO: 1552085 - DNA, 18 bp, Homo sapiens
ggagcttcccacacctgc

SEQ ID NO: 1552086 - DNA, 21 bp, Homo sapiens
ggagcttcccacacctgcctg

SEQ ID NO: 1552087 - DNA, 23 bp, Homo sapiens
ggagcttcccacacctgcctgcg

SEQ ID NO: 1552088 - DNA, 17 bp, Homo sapiens
ggagcttctcccagtgt

SEQ ID NO: 1552089 - DNA, 23 bp, Homo sapiens
ggagctttctcaatgtcttccca

SEQ ID NO: 1552090 - DNA, 13 bp, Homo sapiens
ggagctttctgta

SEQ ID NO: 1552091 - DNA, 12 bp, Homo sapiens
ggaggaaaaaag

SEQ ID NO: 1552092 - DNA, 17 bp, Homo sapiens
ggaggaaaaaagaacca

SEQ ID NO: 1552093 - DNA, 15 bp, Homo sapiens
ggaggaaagggagga

SEQ ID NO: 1552094 - DNA, 16 bp, Homo sapiens
ggaggaaagggcctgg

SEQ ID NO: 1552095 - DNA, 14 bp, Homo sapiens
ggaggaagagccac

SEQ ID NO: 1552096 - DNA, 16 bp, Homo sapiens
ggaggaagagccacct

SEQ ID NO: 1552097 - DNA, 18 bp, Homo sapiens
ggaggaagagccacctgc

SEQ ID NO: 1552098 - DNA, 23 bp, Homo sapiens
ggaggaagagccacctgcaagat

SEQ ID NO: 1552099 - DNA, 19 bp, Homo sapiens
ggaggaagcaggttgaggg

SEQ ID NO: 1552100 - DNA, 13 bp, Homo sapiens
ggaggaaggcaag

SEQ ID NO: 1552101 - DNA, 21 bp, Homo sapiens
ggaggaaggcctttcttctgt

SEQ ID NO: 1552102 - DNA, 10 bp, Homo sapiens
ggaggaaggg

SEQ ID NO: 1552103 - DNA, 18 bp, Homo sapiens
ggaggaaggtgctgagct

SEQ ID NO: 1552104 - DNA, 18 bp, Homo sapiens
ggaggaatagtgcttgct

SEQ ID NO: 1552105 - DNA, 16 bp, Homo sapiens
ggaggaatgctggact

SEQ ID NO: 1552106 - DNA, 16 bp, Homo sapiens
ggaggaatttactttc

SEQ ID NO: 1552107 - DNA, 19 bp, Homo sapiens
ggaggaatttactttcttc

SEQ ID NO: 1552108 - DNA, 23 bp, Homo sapiens
ggaggacctggcgtgctcagacc

SEQ ID NO: 1552109 - DNA, 14 bp, Homo sapiens
ggaggagaccagct

SEQ ID NO: 1552110 - DNA, 16 bp, Homo sapiens
ggaggagaccagctca

SEQ ID NO: 1552111 - DNA, 18 bp, Homo sapiens
ggaggagaccagctcaga

SEQ ID NO: 1552112 - DNA, 12 bp, Homo sapiens
ggaggagagaga

SEQ ID NO: 1552113 - DNA, 13 bp, Homo sapiens
ggaggagagagac

SEQ ID NO: 1552114 - DNA, 14 bp, Homo sapiens
ggaggagagagacc

SEQ ID NO: 1552115 - DNA, 19 bp, Homo sapiens
ggaggagccttgctgggcc

SEQ ID NO: 1552116 - DNA, 22 bp, Homo sapiens
ggaggagccttgctgggccagg

SEQ ID NO: 1552117 - DNA, 17 bp, Homo sapiens
ggaggtggcagccctgt

SEQ ID NO: 1552118 - DNA, 18 bp, Homo sapiens
ggaggtggctatggccac

SEQ ID NO: 1552119 - DNA, 14 bp, Homo sapiens
ggaggtggggaagg

SEQ ID NO: 1552120 - DNA, 18 bp, Homo sapiens
ggaggttccagtgagccg

SEQ ID NO: 1552121 - DNA, 12 bp, Homo sapiens
ggaggttctaag

SEQ ID NO: 1552122 - DNA, 14 bp, Homo sapiens
ggaggttctgggcc

SEQ ID NO: 1552123 - DNA, 21 bp, Homo sapiens
ggatccccgcctggccaggag

SEQ ID NO: 1552124 - DNA, 15 bp, Homo sapiens
ggatccctcctgagc

SEQ ID NO: 1552125 - DNA, 17 bp, Homo sapiens
ggatccgactgctttgg

SEQ ID NO: 1552126 - DNA, 21 bp, Homo sapiens
ggatccgactgctttggacct

SEQ ID NO: 1552127 - DNA, 14 bp, Homo sapiens
ggatccgctgccac

SEQ ID NO: 1552128 - DNA, 16 bp, Homo sapiens
ggatccgctgccacca

SEQ ID NO: 1552129 - DNA, 17 bp, Homo sapiens
ggatccgctgccaccac

SEQ ID NO: 1552130 - DNA, 15 bp, Homo sapiens
ggatcctccacagag

SEQ ID NO: 1552131 - DNA, 12 bp, Homo sapiens
ggatcctccctc

SEQ ID NO: 1552132 - DNA, 16 bp, Homo sapiens
ggatcctgtgtggaga

SEQ ID NO: 1552133 - DNA, 17 bp, Homo sapiens
ggatccttcagcacagg

SEQ ID NO: 1552134 - DNA, 18 bp, Homo sapiens
ggatccttcagcacagga

SEQ ID NO: 1552135 - DNA, 21 bp, Homo sapiens
ggatcgaagggtttttagaga

SEQ ID NO: 1552136 - DNA, 15 bp, Homo sapiens
ggatcgaggcatggg

SEQ ID NO: 1552137 - DNA, 19 bp, Homo sapiens
ggatcgagtgtagctgtga

SEQ ID NO: 1552138 - DNA, 17 bp, Homo sapiens
ggatctaagaagggctg

SEQ ID NO: 1552139 - DNA, 18 bp, Homo sapiens
ggatctaccagcataaat

SEQ ID NO: 1552140 - DNA, 16 bp, Homo sapiens
ggactcagccctgagg

SEQ ID NO: 1552141 - DNA, 21 bp, Homo sapiens
ggactcagccttcagacagag

SEQ ID NO: 1552142 - DNA, 15 bp, Homo sapiens
ggactcaggaacttt

SEQ ID NO: 1552143 - DNA, 24 bp, Homo sapiens
ggactcaggaacttttgttaggaa

SEQ ID NO: 1552144 - DNA, 18 bp, Homo sapiens
ggactcaggatgcccagg

SEQ ID NO: 1552145 - DNA, 22 bp, Homo sapiens
ggactcattttaaaaaatggaa

SEQ ID NO: 1552146 - DNA, 18 bp, Homo sapiens
ggactccagaatctaaag

SEQ ID NO: 1552147 - DNA, 11 bp, Homo sapiens
ggactccaggc

SEQ ID NO: 1552148 - DNA, 14 bp, Homo sapiens
ggactccaggccca

SEQ ID NO: 1552149 - DNA, 15 bp, Homo sapiens
ggactccaggcctga

SEQ ID NO: 1552150 - DNA, 11 bp, Homo sapiens
ggactccatct

SEQ ID NO: 1552151 - DNA, 21 bp, Homo sapiens
ggactcccaaccctggcttgg

SEQ ID NO: 1552152 - DNA, 15 bp, Homo sapiens
ggactcccactcttt

SEQ ID NO: 1552153 - DNA, 12 bp, Homo sapiens
ggactcccctcc

SEQ ID NO: 1552154 - DNA, 13 bp, Homo sapiens
ggactcctgacca

SEQ ID NO: 1552155 - DNA, 17 bp, Homo sapiens
ggactctaagctggagc

SEQ ID NO: 1552156 - DNA, 11 bp, Homo sapiens
ggactctcagg

SEQ ID NO: 1552157 - DNA, 14 bp, Homo sapiens
ggactctcctcctc

SEQ ID NO: 1552158 - DNA, 18 bp, Homo sapiens
ggactctcctcctcccct

SEQ ID NO: 1552159 - DNA, 21 bp, Homo sapiens
ggactctgcacatgtcttgta

SEQ ID NO: 1552160 - DNA, 14 bp, Homo sapiens
ggactctgccccaa

SEQ ID NO: 1552161 - DNA, 16 bp, Homo sapiens
ggactctgccccaatc

SEQ ID NO: 1552162 - DNA, 18 bp, Homo sapiens
ggactctgctagactcct

SEQ ID NO: 1552163 - DNA, 17 bp, Homo sapiens
ggactctggtgcctcca

SEQ ID NO: 1552164 - DNA, 14 bp, Homo sapiens
ggactgaagcctgc

SEQ ID NO: 1552165 - DNA, 19 bp, Homo sapiens
ggactgaagcctgcaggag

SEQ ID NO: 1552166 - DNA, 19 bp, Homo sapiens
ggactgaattgtccccagt

SEQ ID NO: 1552167 - DNA, 17 bp, Homo sapiens
ggactgaccaaagactg

SEQ ID NO: 1552168 - DNA, 18 bp, Homo sapiens
ggactgaccaaagactgc

SEQ ID NO: 1552169 - DNA, 22 bp, Homo sapiens
ggactgactgtgttgggcaaga

SEQ ID NO: 1552170 - DNA, 18 bp, Homo sapiens
ggactgagccagtcccag

SEQ ID NO: 1552171 - DNA, 17 bp, Homo sapiens
ggactgagcctggccca

SEQ ID NO: 1552172 - DNA, 16 bp, Homo sapiens
ggactgagctggggga

SEQ ID NO: 1552173 - DNA, 14 bp, Homo sapiens
ggactgaggcctga

SEQ ID NO: 1552174 - DNA, 14 bp, Homo sapiens
ggactgagggcagt

SEQ ID NO: 1552175 - DNA, 22 bp, Homo sapiens
ggactgagtcccctccaggaag

SEQ ID NO: 1552176 - DNA, 18 bp, Homo sapiens
ggactgagtgggaagccc

SEQ ID NO: 1552177 - DNA, 18 bp, Homo sapiens
ggactgatgtcatcttga

SEQ ID NO: 1552178 - DNA, 20 bp, Homo sapiens
ggactgcagtcggcatgcca

SEQ ID NO: 1552179 - DNA, 21 bp, Homo sapiens
ggactgcagtcggcatgccag

SEQ ID NO: 1552180 - DNA, 23 bp, Homo sapiens
ggactgcagtcggcatgccagga

SEQ ID NO: 1552181 - DNA, 12 bp, Homo sapiens
ggactgcagtgt

SEQ ID NO: 1552182 - DNA, 20 bp, Homo sapiens
ggactgcatggggaggcagc

SEQ ID NO: 1552183 - DNA, 22 bp, Homo sapiens
ggactgcatggggaggcagcag

SEQ ID NO: 1552184 - DNA, 11 bp, Homo sapiens
ggactgccaaa

SEQ ID NO: 1552185 - DNA, 24 bp, Homo sapiens
ggactggacagctttgctccgctc

SEQ ID NO: 1552186 - DNA, 23 bp, Homo sapiens
ggactggcagaagcattgcctgg

SEQ ID NO: 1552187 - DNA, 19 bp, Homo sapiens
ggactggccatttttctgg

SEQ ID NO: 1552188 - DNA, 20 bp, Homo sapiens
ggactggctagagtcctcac

SEQ ID NO: 1552189 - DNA, 16 bp, Homo sapiens
ggactggctgtgcccc

SEQ ID NO: 1552190 - DNA, 23 bp, Homo sapiens
ggactgggccacttctgggtggg

SEQ ID NO: 1552191 - DNA, 19 bp, Homo sapiens
ggactgggtctgacctggt

SEQ ID NO: 1552192 - DNA, 22 bp, Homo sapiens
ggactgggtctgacctggtggg

SEQ ID NO: 1552193 - DNA, 23 bp, Homo sapiens
ggactgggtttggaccccagctg

SEQ ID NO: 1552194 - DNA, 15 bp, Homo sapiens
ggactggtgccctcc

SEQ ID NO: 1552195 - DNA, 12 bp, Homo sapiens
ggactgtaaaca

SEQ ID NO: 1552196 - DNA, 15 bp, Homo sapiens
ggactgtaagggatt

SEQ ID NO: 1552197 - DNA, 20 bp, Homo sapiens
ggactgtctttcagatacat

SEQ ID NO: 1552198 - DNA, 19 bp, Homo sapiens
ggactgtgcctcaggccag

SEQ ID NO: 1552199 - DNA, 20 bp, Homo sapiens
ggactgtgcctcaggccagg

SEQ ID NO: 1552200 - DNA, 14 bp, Homo sapiens
ggactgtggagggt

SEQ ID NO: 1552201 - DNA, 21 bp, Homo sapiens
ggactgttcacggcagaccag

SEQ ID NO: 1552202 - DNA, 21 bp, Homo sapiens
ggactgttgtggtactggcaa

SEQ ID NO: 1552203 - DNA, 22 bp, Homo sapiens
ggactgttgtggtactggcaat

SEQ ID NO: 1552204 - DNA, 15 bp, Homo sapiens
ggacttaacggctcc

SEQ ID NO: 1552205 - DNA, 22 bp, Homo sapiens
ggacttaagacaaatgggactg

SEQ ID NO: 1552206 - DNA, 13 bp, Homo sapiens
ggacttacaaaat

SEQ ID NO: 1552207 - DNA, 16 bp, Homo sapiens
ggacttcctggggccc

SEQ ID NO: 1552208 - DNA, 14 bp, Homo sapiens
ggacttcctgtcat

SEQ ID NO: 1552209 - DNA, 17 bp, Homo sapiens
ggacttctacctgccct

SEQ ID NO: 1552210 - DNA, 15 bp, Homo sapiens
ggacttggcgcgccc

SEQ ID NO: 1552211 - DNA, 20 bp, Homo sapiens
ggacttgtatatttgtacaa

SEQ ID NO: 1552212 - DNA, 17 bp, Homo sapiens
ggacttgtatgctgccc

SEQ ID NO: 1552213 - DNA, 19 bp, Homo sapiens
ggacttgtgattggctgca

SEQ ID NO: 1552214 - DNA, 21 bp, Homo sapiens
ggacttgtgattggctgcagg

SEQ ID NO: 1552215 - DNA, 22 bp, Homo sapiens
ggacttgtgattggctgcagga

SEQ ID NO: 1552216 - DNA, 12 bp, Homo sapiens
ggacttgtgtct

SEQ ID NO: 1552217 - DNA, 16 bp, Homo sapiens
ggacttgtgtctctgt

SEQ ID NO: 1552218 - DNA, 12 bp, Homo sapiens
ggacttgtttta

SEQ ID NO: 1552219 - DNA, 15 bp, Homo sapiens
ggacttgttttaacg

SEQ ID NO: 1552220 - DNA, 23 bp, Homo sapiens
ggactttcttgcatgaatcagat

SEQ ID NO: 1552221 - DNA, 22 bp, Homo sapiens
ggactttgcagccggcacaggg

SEQ ID NO: 1552222 - DNA, 21 bp, Homo sapiens
ggactttggttctctccagga

SEQ ID NO: 1552223 - DNA, 22 bp, Homo sapiens
ggacttttcgttaacattgacc

SEQ ID NO: 1552224 - DNA, 17 bp, Homo sapiens
ggagaaaacccctccca

SEQ ID NO: 1552225 - DNA, 18 bp, Homo sapiens
ggagaaaatcatcaagaa

SEQ ID NO: 1552226 - DNA, 23 bp, Homo sapiens
ggagaaaattggaactctactca

SEQ ID NO: 1552227 - DNA, 14 bp, Homo sapiens
ggagaaacagagac

SEQ ID NO: 1552228 - DNA, 12 bp, Homo sapiens
ggagaaagaagt

SEQ ID NO: 1552229 - DNA, 12 bp, Homo sapiens
ggagaaagagct

SEQ ID NO: 1552230 - DNA, 13 bp, Homo sapiens
ggagaaagagctg

SEQ ID NO: 1552231 - DNA, 16 bp, Homo sapiens
ggagaaagagctgcct

SEQ ID NO: 1552232 - DNA, 14 bp, Homo sapiens
ggagaaagatgcag

SEQ ID NO: 1552233 - DNA, 17 bp, Homo sapiens
ggagaaagcactgacct

SEQ ID NO: 1552234 - DNA, 16 bp, Homo sapiens
ggagaaagggcaaatt

SEQ ID NO: 1552235 - DNA, 17 bp, Homo sapiens
ggagaaatgcaataact

SEQ ID NO: 1552236 - DNA, 18 bp, Homo sapiens
ggagaaatgcaataactc

SEQ ID NO: 1552237 - DNA, 21 bp, Homo sapiens
ggagaaccagggctcttctca

SEQ ID NO: 1552238 - DNA, 23 bp, Homo sapiens
ggagaactggggttcaagcccag

SEQ ID NO: 1552239 - DNA, 15 bp, Homo sapiens
ggagaagaatggctt

SEQ ID NO: 1552240 - DNA, 15 bp, Homo sapiens
ggagaagagctgttc

SEQ ID NO: 1552241 - DNA, 18 bp, Homo sapiens
ggagaagagtatttttaa

SEQ ID NO: 1552242 - DNA, 16 bp, Homo sapiens
ggagaagcagtgagcc

SEQ ID NO: 1552243 - DNA, 18 bp, Homo sapiens
ggagaagccacaggcctg

SEQ ID NO: 1552244 - DNA, 18 bp, Homo sapiens
ggagaagcccgtgtgaga

SEQ ID NO: 1552245 - DNA, 19 bp, Homo sapiens
ggagaaggaagggcagaga

SEQ ID NO: 1552246 - DNA, 14 bp, Homo sapiens
ggagaagggatgga

SEQ ID NO: 1552247 - DNA, 15 bp, Homo sapiens
ggaccacagctgctg

SEQ ID NO: 1552248 - DNA, 16 bp, Homo sapiens
ggaccacagctgctgg

SEQ ID NO: 1552249 - DNA, 17 bp, Homo sapiens
ggaccacagtgggtggc

SEQ ID NO: 1552250 - DNA, 20 bp, Homo sapiens
ggaccaccagccccagcaag

SEQ ID NO: 1552251 - DNA, 16 bp, Homo sapiens
ggaccaccctgagccg

SEQ ID NO: 1552252 - DNA, 14 bp, Homo sapiens
ggaccactcctgtc

SEQ ID NO: 1552253 - DNA, 21 bp, Homo sapiens
ggaccactgcatgagctttta

SEQ ID NO: 1552254 - DNA, 17 bp, Homo sapiens
ggaccagagccagatgc

SEQ ID NO: 1552255 - DNA, 15 bp, Homo sapiens
ggaccagccagcagc

SEQ ID NO: 1552256 - DNA, 16 bp, Homo sapiens
ggaccagcctgtacct

SEQ ID NO: 1552257 - DNA, 18 bp, Homo sapiens
ggaccagctcaggacaga

SEQ ID NO: 1552258 - DNA, 19 bp, Homo sapiens
ggaccagctcaggacagat

SEQ ID NO: 1552259 - DNA, 22 bp, Homo sapiens
ggaccagctcaggacagatgcc

SEQ ID NO: 1552260 - DNA, 12 bp, Homo sapiens
ggaccagctggg

SEQ ID NO: 1552261 - DNA, 22 bp, Homo sapiens
ggaccagctggggcgtggggag

SEQ ID NO: 1552262 - DNA, 15 bp, Homo sapiens
ggaccaggactccct

SEQ ID NO: 1552263 - DNA, 17 bp, Homo sapiens
ggaccaggactccctcc

SEQ ID NO: 1552264 - DNA, 12 bp, Homo sapiens
ggaccaggagct

SEQ ID NO: 1552265 - DNA, 18 bp, Homo sapiens
ggaccagggcaagtgcat

SEQ ID NO: 1552266 - DNA, 15 bp, Homo sapiens
ggaccaggggagagg

SEQ ID NO: 1552267 - DNA, 16 bp, Homo sapiens
ggaccagtggctggtc

SEQ ID NO: 1552268 - DNA, 18 bp, Homo sapiens
ggaccattgacctcagct

SEQ ID NO: 1552269 - DNA, 18 bp, Homo sapiens
ggacccaaaacacaggaa

SEQ ID NO: 1552270 - DNA, 19 bp, Homo sapiens
ggacccaaaacacaggaag

SEQ ID NO: 1552271 - DNA, 21 bp, Homo sapiens
ggacccaccccaactctcccc

SEQ ID NO: 1552272 - DNA, 15 bp, Homo sapiens
ggacccacctccccc

SEQ ID NO: 1552273 - DNA, 23 bp, Homo sapiens
ggacccagctactctgtccaggc

SEQ ID NO: 1552274 - DNA, 12 bp, Homo sapiens
ggacccaggccc

SEQ ID NO: 1552275 - DNA, 18 bp, Homo sapiens
ggacccaggccctccatg

SEQ ID NO: 1552276 - DNA, 22 bp, Homo sapiens
ggacccaggccctccatgggct

SEQ ID NO: 1552277 - DNA, 14 bp, Homo sapiens
ggacccagggatga

SEQ ID NO: 1552278 - DNA, 19 bp, Homo sapiens
ggacccatggtcatctctg

SEQ ID NO: 1552279 - DNA, 20 bp, Homo sapiens
ggaccccagctgggaggcaa

SEQ ID NO: 1552280 - DNA, 21 bp, Homo sapiens
ggaccccagctgggaggcaag

SEQ ID NO: 1552281 - DNA, 13 bp, Homo sapiens
ggacccccagaac

SEQ ID NO: 1552282 - DNA, 20 bp, Homo sapiens
ggaccccctcaccatccagt

SEQ ID NO: 1552283 - DNA, 22 bp, Homo sapiens
ggaccccctgagtcaactggag

SEQ ID NO: 1552284 - DNA, 18 bp, Homo sapiens
ggaccccctggccctgcc

SEQ ID NO: 1552285 - DNA, 20 bp, Homo sapiens
ggaccccgtttcatttttac

SEQ ID NO: 1552286 - DNA, 13 bp, Homo sapiens
ggacccctcccaa

SEQ ID NO: 1552287 - DNA, 14 bp, Homo sapiens
ggacccctgccagt

SEQ ID NO: 1552288 - DNA, 14 bp, Homo sapiens
ggacccctggctct

SEQ ID NO: 1552289 - DNA, 21 bp, Homo sapiens
ggaccccttaatcttgctttc

SEQ ID NO: 1552290 - DNA, 23 bp, Homo sapiens
ggacccgaccccccgtgggctcc

SEQ ID NO: 1552291 - DNA, 20 bp, Homo sapiens
ggacccggcggccctgctga

SEQ ID NO: 1552292 - DNA, 17 bp, Homo sapiens
ggacccgggaccacagc

SEQ ID NO: 1552293 - DNA, 21 bp, Homo sapiens
ggacccggggtctcctggacc

SEQ ID NO: 1552294 - DNA, 22 bp, Homo sapiens
ggaccctgtccggcccagtgcc

SEQ ID NO: 1552295 - DNA, 22 bp, Homo sapiens
ggaccctgtgacatggtgcctg

SEQ ID NO: 1552296 - DNA, 13 bp, Homo sapiens
ggaccctgtgagc

SEQ ID NO: 1552297 - DNA, 15 bp, Homo sapiens
ggaccctgtgagccg

SEQ ID NO: 1552298 - DNA, 16 bp, Homo sapiens
ggacccttataaaatc

SEQ ID NO: 1552299 - DNA, 15 bp, Homo sapiens
ggacccttcaggtgt

SEQ ID NO: 1552300 - DNA, 12 bp, Homo sapiens
ggaccctttcct

SEQ ID NO: 1552301 - DNA, 21 bp, Homo sapiens
ggaccctttccttccttccct

SEQ ID NO: 1552302 - DNA, 23 bp, Homo sapiens
ggaccctttccttccttccctgg

SEQ ID NO: 1552303 - DNA, 18 bp, Homo sapiens
ggaccgggtgggcctggc

SEQ ID NO: 1552304 - DNA, 20 bp, Homo sapiens
ggaccgggtgggcctggcct

SEQ ID NO: 1552305 - DNA, 19 bp, Homo sapiens
ggaccggtgctgcaggagt

SEQ ID NO: 1552306 - DNA, 20 bp, Homo sapiens
ggaccggtgctgcaggagtg

SEQ ID NO: 1552307 - DNA, 15 bp, Homo sapiens
ggaccgtggacaggc

SEQ ID NO: 1552308 - DNA, 16 bp, Homo sapiens
ggaccgtggacaggcc

SEQ ID NO: 1552309 - DNA, 20 bp, Homo sapiens
ggaccgtggacaggcccagc

SEQ ID NO: 1552310 - DNA, 20 bp, Homo sapiens
ggaccgtggccctgccctct

SEQ ID NO: 1552311 - DNA, 22 bp, Homo sapiens
ggacctaaatggcctcatgtgg

SEQ ID NO: 1552312 - DNA, 21 bp, Homo sapiens
ggacctatgtcctaaggacac

SEQ ID NO: 1552313 - DNA, 22 bp, Homo sapiens
ggacctctcagcatagcctgcc

SEQ ID NO: 1552314 - DNA, 17 bp, Homo sapiens
ggacctctgtaggcagc

SEQ ID NO: 1552315 - DNA, 21 bp, Homo sapiens
ggacctctttactctctccga

SEQ ID NO: 1552316 - DNA, 13 bp, Homo sapiens
ggacctgagagca

SEQ ID NO: 1552317 - DNA, 17 bp, Homo sapiens
ggacctgagagcatctc

SEQ ID NO: 1552318 - DNA, 23 bp, Homo sapiens
ggacctgcatccttcctggggac

SEQ ID NO: 1552319 - DNA, 14 bp, Homo sapiens
ggacctgccaggca

SEQ ID NO: 1552320 - DNA, 19 bp, Homo sapiens
ggacctgcctcctgcctgc

SEQ ID NO: 1552321 - DNA, 12 bp, Homo sapiens
ggacctgctcat

SEQ ID NO: 1552322 - DNA, 21 bp, Homo sapiens
ggaccttaggccttcctctct

SEQ ID NO: 1552323 - DNA, 18 bp, Homo sapiens
ggaccttcgggctgtgcc

SEQ ID NO: 1552324 - DNA, 20 bp, Homo sapiens
ggaccttcgggctgtgcccg

SEQ ID NO: 1552325 - DNA, 22 bp, Homo sapiens
ggaccttctttattctgtgtta

SEQ ID NO: 1552326 - DNA, 14 bp, Homo sapiens
ggaccttggcgctt

SEQ ID NO: 1552327 - DNA, 22 bp, Homo sapiens
ggaccttgtgggaccagtccca

SEQ ID NO: 1552328 - DNA, 21 bp, Homo sapiens
ggacctttaacttttttttct

SEQ ID NO: 1552329 - DNA, 18 bp, Homo sapiens
ggacctttccaccacagc

SEQ ID NO: 1552330 - DNA, 19 bp, Homo sapiens
ggacctttccaccacagcc

SEQ ID NO: 1552331 - DNA, 22 bp, Homo sapiens
ggacgaagcggagagagccaag

SEQ ID NO: 1552332 - DNA, 23 bp, Homo sapiens
ggacgaagcggagagagccaaga

SEQ ID NO: 1552333 - DNA, 17 bp, Homo sapiens
ggacgagacccccatcc

SEQ ID NO: 1552334 - DNA, 24 bp, Homo sapiens
ggacgagacccccatccagcctcc

SEQ ID NO: 1552335 - DNA, 16 bp, Homo sapiens
ggacgagagggctgtg

SEQ ID NO: 1552336 - DNA, 19 bp, Homo sapiens
ggacgcaggtgctgcggcg

SEQ ID NO: 1552337 - DNA, 18 bp, Homo sapiens
ggacggcattcctgctta

SEQ ID NO: 1552338 - DNA, 12 bp, Homo sapiens
ggacggccaaga

SEQ ID NO: 1552339 - DNA, 21 bp, Homo sapiens
ggacggccaatggtgcttccc

SEQ ID NO: 1552340 - DNA, 22 bp, Homo sapiens
ggacggcctgatgctccctccc

SEQ ID NO: 1552341 - DNA, 19 bp, Homo sapiens
ggacggtgcccaagccaga

SEQ ID NO: 1552342 - DNA, 21 bp, Homo sapiens
ggacggtgcccaagccagagg

SEQ ID NO: 1552343 - DNA, 18 bp, Homo sapiens
ggacgtggtcagggcagg

SEQ ID NO: 1552344 - DNA, 21 bp, Homo sapiens
ggacgtgttacccactgccat

SEQ ID NO: 1552345 - DNA, 14 bp, Homo sapiens
ggacgtttctggaa

SEQ ID NO: 1552346 - DNA, 21 bp, Homo sapiens
ggacgtttctggaactgtctg

SEQ ID NO: 1552347 - DNA, 20 bp, Homo sapiens
ggactaaaacattttgacta

SEQ ID NO: 1552348 - DNA, 21 bp, Homo sapiens
ggactaacataaaatctgtga

SEQ ID NO: 1552349 - DNA, 15 bp, Homo sapiens
ggaataaagttgcag

SEQ ID NO: 1552350 - DNA, 17 bp, Homo sapiens
ggaataaagttgcagat

SEQ ID NO: 1552351 - DNA, 20 bp, Homo sapiens
ggaataaggccttaatatgt

SEQ ID NO: 1552352 - DNA, 17 bp, Homo sapiens
ggaatagatgtctcaaa

SEQ ID NO: 1552353 - DNA, 14 bp, Homo sapiens
ggaatagccagaga

SEQ ID NO: 1552354 - DNA, 20 bp, Homo sapiens
ggaatagccagagaggagca

SEQ ID NO: 1552355 - DNA, 12 bp, Homo sapiens
ggaatagggaga

SEQ ID NO: 1552356 - DNA, 14 bp, Homo sapiens
ggaatagggagaca

SEQ ID NO: 1552357 - DNA, 16 bp, Homo sapiens
ggaatagggagacagg

SEQ ID NO: 1552358 - DNA, 15 bp, Homo sapiens
ggaatagttctgtat

SEQ ID NO: 1552359 - DNA, 15 bp, Homo sapiens
ggaatattaaaaaac

SEQ ID NO: 1552360 - DNA, 22 bp, Homo sapiens
ggaatattcccctatctctaga

SEQ ID NO: 1552361 - DNA, 16 bp, Homo sapiens
ggaatcaacagggcag

SEQ ID NO: 1552362 - DNA, 17 bp, Homo sapiens
ggaatcaacagggcagc

SEQ ID NO: 1552363 - DNA, 18 bp, Homo sapiens
ggaatcaacagggcagca

SEQ ID NO: 1552364 - DNA, 17 bp, Homo sapiens
ggaatcccttgtatatg

SEQ ID NO: 1552365 - DNA, 16 bp, Homo sapiens
ggaatcctcctccagg

SEQ ID NO: 1552366 - DNA, 19 bp, Homo sapiens
ggaatcctcctccagggtg

SEQ ID NO: 1552367 - DNA, 12 bp, Homo sapiens
ggaatcctggca

SEQ ID NO: 1552368 - DNA, 16 bp, Homo sapiens
ggaatctgtttctctg

SEQ ID NO: 1552369 - DNA, 15 bp, Homo sapiens
ggaatcttcacctca

SEQ ID NO: 1552370 - DNA, 16 bp, Homo sapiens
ggaatgaggaaaattc

SEQ ID NO: 1552371 - DNA, 14 bp, Homo sapiens
ggaatgcagcagga

SEQ ID NO: 1552372 - DNA, 21 bp, Homo sapiens
ggaatgcagggaagagggcag

SEQ ID NO: 1552373 - DNA, 23 bp, Homo sapiens
ggaatgcattatttattgctgtg

SEQ ID NO: 1552374 - DNA, 14 bp, Homo sapiens
ggaatgctgtgtta

SEQ ID NO: 1552375 - DNA, 16 bp, Homo sapiens
ggaatgcttcctagaa

SEQ ID NO: 1552376 - DNA, 19 bp, Homo sapiens
ggaatggatttttctttaa

SEQ ID NO: 1552377 - DNA, 22 bp, Homo sapiens
ggaatggatttttctttaactg

SEQ ID NO: 1552378 - DNA, 16 bp, Homo sapiens
ggaatgggagaggggt

SEQ ID NO: 1552379 - DNA, 20 bp, Homo sapiens
ggaatgtaactgctgaaaac

SEQ ID NO: 1552380 - DNA, 21 bp, Homo sapiens
ggaattattttgaatgtcaca

SEQ ID NO: 1552381 - DNA, 20 bp, Homo sapiens
ggaattcagcaccctgggtg

SEQ ID NO: 1552382 - DNA, 22 bp, Homo sapiens
ggaattcagcaccctgggtgcc

SEQ ID NO: 1552383 - DNA, 13 bp, Homo sapiens
ggaattccctccc

SEQ ID NO: 1552384 - DNA, 16 bp, Homo sapiens
ggaattccctccccct

SEQ ID NO: 1552385 - DNA, 18 bp, Homo sapiens
ggaattccctccccctcc

SEQ ID NO: 1552386 - DNA, 18 bp, Homo sapiens
ggaattctcaagacctga

SEQ ID NO: 1552387 - DNA, 14 bp, Homo sapiens
ggaattgaaaaaaa

SEQ ID NO: 1552388 - DNA, 23 bp, Homo sapiens
ggaattggtggcagattttacaa

SEQ ID NO: 1552389 - DNA, 14 bp, Homo sapiens
ggaatttaaaatta

SEQ ID NO: 1552390 - DNA, 17 bp, Homo sapiens
ggaatttcccaggaccc

SEQ ID NO: 1552391 - DNA, 23 bp, Homo sapiens
ggaatttctcccagtcatttaat

SEQ ID NO: 1552392 - DNA, 22 bp, Homo sapiens
ggaatttcttaacttcttgctt

SEQ ID NO: 1552393 - DNA, 20 bp, Homo sapiens
ggaatttgtacgtttatacc

SEQ ID NO: 1552394 - DNA, 11 bp, Homo sapiens
ggaattttatt

SEQ ID NO: 1552395 - DNA, 15 bp, Homo sapiens
ggacaaagtctccag

SEQ ID NO: 1552396 - DNA, 16 bp, Homo sapiens
ggacaaagtctccagc

SEQ ID NO: 1552397 - DNA, 17 bp, Homo sapiens
ggacaaagtctccagcc

SEQ ID NO: 1552398 - DNA, 19 bp, Homo sapiens
ggacaaagtctccagccca

SEQ ID NO: 1552399 - DNA, 18 bp, Homo sapiens
ggacaaatcacatatttt

SEQ ID NO: 1552400 - DNA, 21 bp, Homo sapiens
ggacaaatcacatattttaaa

SEQ ID NO: 1552401 - DNA, 15 bp, Homo sapiens
ggacaacttatttaa

SEQ ID NO: 1552402 - DNA, 21 bp, Homo sapiens
ggacaacttatttaaaaatat

SEQ ID NO: 1552403 - DNA, 22 bp, Homo sapiens
ggacaagagggttcacacagcc

SEQ ID NO: 1552404 - DNA, 17 bp, Homo sapiens
ggacaagcagtccctta

SEQ ID NO: 1552405 - DNA, 19 bp, Homo sapiens
ggacaagggattctgggaa

SEQ ID NO: 1552406 - DNA, 17 bp, Homo sapiens
ggacaatcagtcccctc

SEQ ID NO: 1552407 - DNA, 20 bp, Homo sapiens
ggacacaacagcagtctcct

SEQ ID NO: 1552408 - DNA, 24 bp, Homo sapiens
ggacacaacagcagtctccttcag

SEQ ID NO: 1552409 - DNA, 21 bp, Homo sapiens
ggacacacaaggtgcaaatca

SEQ ID NO: 1552410 - DNA, 13 bp, Homo sapiens
ggacacagcacaa

SEQ ID NO: 1552411 - DNA, 11 bp, Homo sapiens
ggacacagctc

SEQ ID NO: 1552412 - DNA, 16 bp, Homo sapiens
ggacacagctcttcat

SEQ ID NO: 1552413 - DNA, 21 bp, Homo sapiens
ggacacagttcctgggaacat

SEQ ID NO: 1552414 - DNA, 15 bp, Homo sapiens
ggacacatcccggcc

SEQ ID NO: 1552415 - DNA, 13 bp, Homo sapiens
ggacaccctctgc

SEQ ID NO: 1552416 - DNA, 23 bp, Homo sapiens
ggacacctcgcccttcagcccac

SEQ ID NO: 1552417 - DNA, 13 bp, Homo sapiens
ggacacctggccg

SEQ ID NO: 1552418 - DNA, 17 bp, Homo sapiens
ggacacctggccgcctc

SEQ ID NO: 1552419 - DNA, 17 bp, Homo sapiens
ggacacctgtacattct

SEQ ID NO: 1552420 - DNA, 22 bp, Homo sapiens
ggacacggcttcactgaccagc

SEQ ID NO: 1552421 - DNA, 22 bp, Homo sapiens
ggacacggggcagtggcaacct

SEQ ID NO: 1552422 - DNA, 20 bp, Homo sapiens
ggacactgtggagactttct

SEQ ID NO: 1552423 - DNA, 19 bp, Homo sapiens
ggacagaattctcccagcg

SEQ ID NO: 1552424 - DNA, 22 bp, Homo sapiens
ggacagacagatgttgggagga

SEQ ID NO: 1552425 - DNA, 20 bp, Homo sapiens
ggacagagacacctgcacct

SEQ ID NO: 1552426 - DNA, 12 bp, Homo sapiens
ggacagagccag

SEQ ID NO: 1552427 - DNA, 14 bp, Homo sapiens
ggacagaggcccca

SEQ ID NO: 1552428 - DNA, 15 bp, Homo sapiens
ggacagaggccccag

SEQ ID NO: 1552429 - DNA, 16 bp, Homo sapiens
ggacagaggccccagc

SEQ ID NO: 1552430 - DNA, 20 bp, Homo sapiens
ggacagaggccccagcctcc

SEQ ID NO: 1552431 - DNA, 12 bp, Homo sapiens
ggacagagggtg

SEQ ID NO: 1552432 - DNA, 16 bp, Homo sapiens
ggacagagtatgaaca

SEQ ID NO: 1552433 - DNA, 21 bp, Homo sapiens
ggacagattgcctgtttctga

SEQ ID NO: 1552434 - DNA, 17 bp, Homo sapiens
ggacagcaagtgagcag

SEQ ID NO: 1552435 - DNA, 13 bp, Homo sapiens
ggacagcagctgg

SEQ ID NO: 1552436 - DNA, 17 bp, Homo sapiens
ggacagcccagagcctg

SEQ ID NO: 1552437 - DNA, 15 bp, Homo sapiens
ggacagccccaccct

SEQ ID NO: 1552438 - DNA, 13 bp, Homo sapiens
ggacagccccctt

SEQ ID NO: 1552439 - DNA, 19 bp, Homo sapiens
ggacagcccttttgtgaac

SEQ ID NO: 1552440 - DNA, 21 bp, Homo sapiens
ggacagcctgtggcggtgcct

SEQ ID NO: 1552441 - DNA, 11 bp, Homo sapiens
ggacagccttc

SEQ ID NO: 1552442 - DNA, 15 bp, Homo sapiens
ggacagcgggaaaaa

SEQ ID NO: 1552443 - DNA, 22 bp, Homo sapiens
ggacagctgcccagacacatgg

SEQ ID NO: 1552444 - DNA, 14 bp, Homo sapiens
ggacagctgctggg

SEQ ID NO: 1552445 - DNA, 13 bp, Homo sapiens
ggacagctgcttg

SEQ ID NO: 1552446 - DNA, 12 bp, Homo sapiens
ggacagctggct

SEQ ID NO: 1552447 - DNA, 13 bp, Homo sapiens
ggacagctggctg

SEQ ID NO: 1552448 - DNA, 14 bp, Homo sapiens
ggacagctggctgg

SEQ ID NO: 1552449 - DNA, 16 bp, Homo sapiens
ggacagcttcctcaca

SEQ ID NO: 1552450 - DNA, 14 bp, Homo sapiens
ggacaggaagctgg

SEQ ID NO: 1552451 - DNA, 23 bp, Homo sapiens
ggacaggaagctggcagaacgga

SEQ ID NO: 1552452 - DNA, 15 bp, Homo sapiens
ggacaggaccctcag

SEQ ID NO: 1552453 - DNA, 16 bp, Homo sapiens
ggacaggaccctcagg

SEQ ID NO: 1552454 - DNA, 15 bp, Homo sapiens
ggacaggagaagaga

SEQ ID NO: 1552455 - DNA, 18 bp, Homo sapiens
ggacaggatgaggacaga

SEQ ID NO: 1552456 - DNA, 19 bp, Homo sapiens
ggacaggatgaggacagag

SEQ ID NO: 1552457 - DNA, 13 bp, Homo sapiens
ggacaggcccagc

SEQ ID NO: 1552458 - DNA, 11 bp, Homo sapiens
ggacaggcccg

SEQ ID NO: 1552459 - DNA, 13 bp, Homo sapiens
ggacaggctctgc

SEQ ID NO: 1552460 - DNA, 19 bp, Homo sapiens
ggacaggctgaagagaggg

SEQ ID NO: 1552461 - DNA, 22 bp, Homo sapiens
ggacagggcatggccaggtggc

SEQ ID NO: 1552462 - DNA, 19 bp, Homo sapiens
ggacagtcctgggagaacc

SEQ ID NO: 1552463 - DNA, 16 bp, Homo sapiens
ggacagtgcttcagcc

SEQ ID NO: 1552464 - DNA, 14 bp, Homo sapiens
ggacagttggcaga

SEQ ID NO: 1552465 - DNA, 21 bp, Homo sapiens
ggacatcacagggtgggcctc

SEQ ID NO: 1552466 - DNA, 15 bp, Homo sapiens
gcttcagaggcctgg

SEQ ID NO: 1552467 - DNA, 20 bp, Homo sapiens
gcttcagagtttgtgtgtat

SEQ ID NO: 1552468 - DNA, 15 bp, Homo sapiens
gcttcagccaggagc

SEQ ID NO: 1552469 - DNA, 22 bp, Homo sapiens
gcttcagcccccaccaggggaa

SEQ ID NO: 1552470 - DNA, 14 bp, Homo sapiens
gcttcagcctgagg

SEQ ID NO: 1552471 - DNA, 23 bp, Homo sapiens
gcttcagcctgaggctgagactg

SEQ ID NO: 1552472 - DNA, 15 bp, Homo sapiens
gcttcagttgcttgt

SEQ ID NO: 1552473 - DNA, 14 bp, Homo sapiens
gcttcataaatgaa

SEQ ID NO: 1552474 - DNA, 16 bp, Homo sapiens
gcttcatctgcaaagg

SEQ ID NO: 1552475 - DNA, 20 bp, Homo sapiens
gcttcattccaaatgctttc

SEQ ID NO: 1552476 - DNA, 16 bp, Homo sapiens
gcttcattccggactg

SEQ ID NO: 1552477 - DNA, 15 bp, Homo sapiens
gcttcattctggaaa

SEQ ID NO: 1552478 - DNA, 12 bp, Homo sapiens
gcttccaaagcc

SEQ ID NO: 1552479 - DNA, 19 bp, Homo sapiens
gcttccaaagcctagacaa

SEQ ID NO: 1552480 - DNA, 12 bp, Homo sapiens
gcttccaaatgt

SEQ ID NO: 1552481 - DNA, 12 bp, Homo sapiens
gcttccaatttt

SEQ ID NO: 1552482 - DNA, 13 bp, Homo sapiens
gcttccacaaaat

SEQ ID NO: 1552483 - DNA, 21 bp, Homo sapiens
gcttccacaggcaaaactcag

SEQ ID NO: 1552484 - DNA, 13 bp, Homo sapiens
gcttccaggctct

SEQ ID NO: 1552485 - DNA, 19 bp, Homo sapiens
gcttccaggctgggcagca

SEQ ID NO: 1552486 - DNA, 12 bp, Homo sapiens
gcttccatgcct

SEQ ID NO: 1552487 - DNA, 19 bp, Homo sapiens
gcttccattttaattttaa

SEQ ID NO: 1552488 - DNA, 19 bp, Homo sapiens
gcttcccacacctgcctgc

SEQ ID NO: 1552489 - DNA, 19 bp, Homo sapiens
gcttcccattgtggctcct

SEQ ID NO: 1552490 - DNA, 15 bp, Homo sapiens
gcttccccacagaac

SEQ ID NO: 1552491 - DNA, 24 bp, Homo sapiens
gcttccccacagaactgcttacta

SEQ ID NO: 1552492 - DNA, 17 bp, Homo sapiens
gcttcccgctcagccct

SEQ ID NO: 1552493 - DNA, 22 bp, Homo sapiens
gcttcccgggataaactgagcc

SEQ ID NO: 1552494 - DNA, 23 bp, Homo sapiens
gcttcccgggataaactgagcct

SEQ ID NO: 1552495 - DNA, 17 bp, Homo sapiens
gcttccctccatccccc

SEQ ID NO: 1552496 - DNA, 14 bp, Homo sapiens
gcttccctggaagc

SEQ ID NO: 1552497 - DNA, 19 bp, Homo sapiens
gcttcccttctccccagcc

SEQ ID NO: 1552498 - DNA, 13 bp, Homo sapiens
gcttccgccactc

SEQ ID NO: 1552499 - DNA, 21 bp, Homo sapiens
gcttcctagaagttactgaat

SEQ ID NO: 1552500 - DNA, 23 bp, Homo sapiens
gcttcctagaagttactgaatgc

SEQ ID NO: 1552501 - DNA, 13 bp, Homo sapiens
gcttcctcacacc

SEQ ID NO: 1552502 - DNA, 18 bp, Homo sapiens
gcttcctcacacccctgt

SEQ ID NO: 1552503 - DNA, 17 bp, Homo sapiens
ggaagagcccgcagggc

SEQ ID NO: 1552504 - DNA, 18 bp, Homo sapiens
ggaagagcccgcagggcc

SEQ ID NO: 1552505 - DNA, 12 bp, Homo sapiens
ggaagaggccca

SEQ ID NO: 1552506 - DNA, 14 bp, Homo sapiens
ggaagaggcccact

SEQ ID NO: 1552507 - DNA, 20 bp, Homo sapiens
ggaagagggcagtacctggg

SEQ ID NO: 1552508 - DNA, 18 bp, Homo sapiens
ggaagaggggctggggca

SEQ ID NO: 1552509 - DNA, 22 bp, Homo sapiens
ggaagagtttttgtgatggggg

SEQ ID NO: 1552510 - DNA, 18 bp, Homo sapiens
ggaagataggctctgcac

SEQ ID NO: 1552511 - DNA, 15 bp, Homo sapiens
ggaagatcactgtag

SEQ ID NO: 1552512 - DNA, 22 bp, Homo sapiens
ggaagatcctgcgggtggggct

SEQ ID NO: 1552513 - DNA, 15 bp, Homo sapiens
ggaagatcttgagag

SEQ ID NO: 1552514 - DNA, 17 bp, Homo sapiens
ggaagatcttgagagct

SEQ ID NO: 1552515 - DNA, 18 bp, Homo sapiens
ggaagatcttgagagctg

SEQ ID NO: 1552516 - DNA, 21 bp, Homo sapiens
ggaagatttaccttttctgtt

SEQ ID NO: 1552517 - DNA, 18 bp, Homo sapiens
ggaagattttaaattcac

SEQ ID NO: 1552518 - DNA, 23 bp, Homo sapiens
ggaagcactgccattagactgaa

SEQ ID NO: 1552519 - DNA, 23 bp, Homo sapiens
ggaagcagagcaaaatgctcttg

SEQ ID NO: 1552520 - DNA, 12 bp, Homo sapiens
ggaagcagccag

SEQ ID NO: 1552521 - DNA, 20 bp, Homo sapiens
ggaagcaggtgctacaacat

SEQ ID NO: 1552522 - DNA, 11 bp, Homo sapiens
ggaagcagtgc

SEQ ID NO: 1552523 - DNA, 20 bp, Homo sapiens
ggaagcagtgccttccataa

SEQ ID NO: 1552524 - DNA, 21 bp, Homo sapiens
ggaagcagtgccttccataat

SEQ ID NO: 1552525 - DNA, 21 bp, Homo sapiens
ggaagcatgtaggagaatcca

SEQ ID NO: 1552526 - DNA, 22 bp, Homo sapiens
ggaagcattgtaaaataattct

SEQ ID NO: 1552527 - DNA, 16 bp, Homo sapiens
ggaagccaaaggcagc

SEQ ID NO: 1552528 - DNA, 18 bp, Homo sapiens
ggaagccaggtacaggag

SEQ ID NO: 1552529 - DNA, 23 bp, Homo sapiens
ggaagccatccctttttttacat

SEQ ID NO: 1552530 - DNA, 14 bp, Homo sapiens
ggaagcccagctcc

SEQ ID NO: 1552531 - DNA, 13 bp, Homo sapiens
ggaagccccacat

SEQ ID NO: 1552532 - DNA, 18 bp, Homo sapiens
ggaagccccctcttcctc

SEQ ID NO: 1552533 - DNA, 22 bp, Homo sapiens
ggaagccccctcttcctccctg

SEQ ID NO: 1552534 - DNA, 11 bp, Homo sapiens
ggaagccctcc

SEQ ID NO: 1552535 - DNA, 11 bp, Homo sapiens
ggaagccctgg

SEQ ID NO: 1552536 - DNA, 15 bp, Homo sapiens
ggaagccctggattt

SEQ ID NO: 1552537 - DNA, 20 bp, Homo sapiens
ggaagccggcggcccaagcc

SEQ ID NO: 1552538 - DNA, 15 bp, Homo sapiens
ggaagccgtcctggc

SEQ ID NO: 1552539 - DNA, 17 bp, Homo sapiens
ggaagccgtctgactcc

SEQ ID NO: 1552540 - DNA, 13 bp, Homo sapiens
ggaagcctgaact

SEQ ID NO: 1552541 - DNA, 20 bp, Homo sapiens
ggaagcctgaactgaggcct

SEQ ID NO: 1552542 - DNA, 14 bp, Homo sapiens
ggaagcctgcagtc

SEQ ID NO: 1552543 - DNA, 20 bp, Homo sapiens
ggaagcctggactctaagct

SEQ ID NO: 1552544 - DNA, 17 bp, Homo sapiens
ggaagcctgtgccagca

SEQ ID NO: 1552545 - DNA, 23 bp, Homo sapiens
ggaagcgatgaatttggagactc

SEQ ID NO: 1552546 - DNA, 12 bp, Homo sapiens
ggaagctcagcc

SEQ ID NO: 1552547 - DNA, 18 bp, Homo sapiens
ggaagctctgaagtcaca

SEQ ID NO: 1552548 - DNA, 12 bp, Homo sapiens
ggaagctggaag

SEQ ID NO: 1552549 - DNA, 20 bp, Homo sapiens
ggaagctgtactcagagcag

SEQ ID NO: 1552550 - DNA, 17 bp, Homo sapiens
ggaagctgtgtccttgc

SEQ ID NO: 1552551 - DNA, 23 bp, Homo sapiens
ggaagctgtgtccttgcacctgc

SEQ ID NO: 1552552 - DNA, 15 bp, Homo sapiens
ggaagcttgagcctc

SEQ ID NO: 1552553 - DNA, 14 bp, Homo sapiens
ggaagcttggcttc

SEQ ID NO: 1552554 - DNA, 17 bp, Homo sapiens
ggaaggaaggagggcac

SEQ ID NO: 1552555 - DNA, 21 bp, Homo sapiens
ggaaggacaggaccctcagga

SEQ ID NO: 1552556 - DNA, 15 bp, Homo sapiens
ggaaggagactcacc

SEQ ID NO: 1552557 - DNA, 22 bp, Homo sapiens
ggaaggagactcacctctgcct

SEQ ID NO: 1552558 - DNA, 15 bp, Homo sapiens
ggaaggagacttagg

SEQ ID NO: 1552559 - DNA, 14 bp, Homo sapiens
ggaaggagagcctg

SEQ ID NO: 1552560 - DNA, 12 bp, Homo sapiens
ggaaggagcaca

SEQ ID NO: 1552561 - DNA, 21 bp, Homo sapiens
ggaaggaggccaaccagcccg

SEQ ID NO: 1552562 - DNA, 14 bp, Homo sapiens
ggaaggagggagct

SEQ ID NO: 1552563 - DNA, 18 bp, Homo sapiens
ggaaggagggagctgctc

SEQ ID NO: 1552564 - DNA, 13 bp, Homo sapiens
ggaaggatctgct

SEQ ID NO: 1552565 - DNA, 15 bp, Homo sapiens
ggaaggatctgctga

SEQ ID NO: 1552566 - DNA, 18 bp, Homo sapiens
ggaaggatctgctgaggc

SEQ ID NO: 1552567 - DNA, 15 bp, Homo sapiens
ggaaggcagagaaat

SEQ ID NO: 1552568 - DNA, 15 bp, Homo sapiens
ggaaggcagctgctc

SEQ ID NO: 1552569 - DNA, 15 bp, Homo sapiens
ggaaggcaggagcct

SEQ ID NO: 1552570 - DNA, 14 bp, Homo sapiens
ggaaggcagggcag

SEQ ID NO: 1552571 - DNA, 17 bp, Homo sapiens
ggaaggcagggcagagg

SEQ ID NO: 1552572 - DNA, 20 bp, Homo sapiens
ggaaggcagggcagagggaa

SEQ ID NO: 1552573 - DNA, 21 bp, Homo sapiens
ggaaggccacctcccactcct

SEQ ID NO: 1552574 - DNA, 20 bp, Homo sapiens
ggaaggcctgacttctgctg

SEQ ID NO: 1552575 - DNA, 14 bp, Homo sapiens
ggaaggcctttctt

SEQ ID NO: 1552576 - DNA, 16 bp, Homo sapiens
ggaaggcctttcttct

SEQ ID NO: 1552577 - DNA, 14 bp, Homo sapiens
ggaaggccttttca

SEQ ID NO: 1552578 - DNA, 20 bp, Homo sapiens
ggaaggctaagcatggcctg

SEQ ID NO: 1552579 - DNA, 21 bp, Homo sapiens
ggaaggctaagcatggcctgg

SEQ ID NO: 1552580 - DNA, 20 bp, Homo sapiens
ggaaggctgaactcttcaga

SEQ ID NO: 1552581 - DNA, 13 bp, Homo sapiens
ggaaggctggctg

SEQ ID NO: 1552582 - DNA, 17 bp, Homo sapiens
ggaagggaaagtttttt

SEQ ID NO: 1552583 - DNA, 15 bp, Homo sapiens
ggaagggaccaaggc

SEQ ID NO: 1552584 - DNA, 13 bp, Homo sapiens
ggaagggcatgca

SEQ ID NO: 1552585 - DNA, 20 bp, Homo sapiens
ggaagggctttggttccttc

SEQ ID NO: 1552586 - DNA, 24 bp, Homo sapiens
ggaagggctttggttccttctctg

SEQ ID NO: 1552587 - DNA, 23 bp, Homo sapiens
ggaaggggctgaggacgagaccc

SEQ ID NO: 1552588 - DNA, 16 bp, Homo sapiens
ggaaggggcttctgga

SEQ ID NO: 1552589 - DNA, 15 bp, Homo sapiens
ggaagggggtgtgcg

SEQ ID NO: 1552590 - DNA, 19 bp, Homo sapiens
ggaaggggttcctcaaatt

SEQ ID NO: 1552591 - DNA, 21 bp, Homo sapiens
ggaaggggttcctcaaatttt

SEQ ID NO: 1552592 - DNA, 22 bp, Homo sapiens
ggaaggggttcctcaaattttt

SEQ ID NO: 1552593 - DNA, 14 bp, Homo sapiens
ggaagggtggcctg

SEQ ID NO: 1552594 - DNA, 15 bp, Homo sapiens
ggaagggtttctcta

SEQ ID NO: 1552595 - DNA, 17 bp, Homo sapiens
ggaaggtagcccagcac

SEQ ID NO: 1552596 - DNA, 22 bp, Homo sapiens
ggaaggtgaggcagaagcattg

SEQ ID NO: 1552597 - DNA, 18 bp, Homo sapiens
ggaaggtggggccctgcc

SEQ ID NO: 1552598 - DNA, 16 bp, Homo sapiens
ggaaggttcttcatga

SEQ ID NO: 1552599 - DNA, 18 bp, Homo sapiens
ggaaggtttgtatattgt

SEQ ID NO: 1552600 - DNA, 14 bp, Homo sapiens
ggaagtctccatga

SEQ ID NO: 1552601 - DNA, 23 bp, Homo sapiens
ggaagtgaagagggagaagggat

SEQ ID NO: 1552602 - DNA, 16 bp, Homo sapiens
ggaagtgaggcccaag

SEQ ID NO: 1552603 - DNA, 15 bp, Homo sapiens
ggaagtgcccagccc

SEQ ID NO: 1552604 - DNA, 23 bp, Homo sapiens
ggaagtggattctggatggccgg

SEQ ID NO: 1552605 - DNA, 18 bp, Homo sapiens
ggaagtggggtgttcttc

SEQ ID NO: 1552606 - DNA, 19 bp, Homo sapiens
ggaagtggtccagaaacaa

SEQ ID NO: 1552607 - DNA, 17 bp, Homo sapiens
ggaagtgtaacagctga

SEQ ID NO: 1552608 - DNA, 22 bp, Homo sapiens
ggaagtgtgggtctgtgtgtgt

SEQ ID NO: 1552609 - DNA, 12 bp, Homo sapiens
ggaagtgttcaa

SEQ ID NO: 1552610 - DNA, 16 bp, Homo sapiens
ggaagtgttcaagaaa

SEQ ID NO: 1552611 - DNA, 17 bp, Homo sapiens
ggaagttacatgctgta

SEQ ID NO: 1552612 - DNA, 21 bp, Homo sapiens
ggaagttgattcttatttgat

SEQ ID NO: 1552613 - DNA, 23 bp, Homo sapiens
ggaagttgtggatatcagggtat

SEQ ID NO: 1552614 - DNA, 23 bp, Homo sapiens
ggaagttttaactttaatacagc

SEQ ID NO: 1552615 - DNA, 11 bp, Homo sapiens
ggaagttttca

SEQ ID NO: 1552616 - DNA, 18 bp, Homo sapiens
ggaagttttgcatttatg

SEQ ID NO: 1552617 - DNA, 22 bp, Homo sapiens
ggaataaaaggcttgaagctgt

SEQ ID NO: 1552618 - DNA, 20 bp, Homo sapiens
ggaataaacattaattttgt

SEQ ID NO: 1552619 - DNA, 19 bp, Homo sapiens
gctgtggggcagctgagca

SEQ ID NO: 1552620 - DNA, 22 bp, Homo sapiens
gctgtggggcagctgagcagct

SEQ ID NO: 1552621 - DNA, 13 bp, Homo sapiens
gctgtgtctgcca

SEQ ID NO: 1552622 - DNA, 14 bp, Homo sapiens
gctgtgtgccccac

SEQ ID NO: 1552623 - DNA, 14 bp, Homo sapiens
gctgtgtgtcccag

SEQ ID NO: 1552624 - DNA, 13 bp, Homo sapiens
gctgtgtgtctgt

SEQ ID NO: 1552625 - DNA, 16 bp, Homo sapiens
gctgtgttaagaggac

SEQ ID NO: 1552626 - DNA, 17 bp, Homo sapiens
gctgtgttaagaggact

SEQ ID NO: 1552627 - DNA, 22 bp, Homo sapiens
gctgtgtttatatggaagaaag

SEQ ID NO: 1552628 - DNA, 19 bp, Homo sapiens
gctgtgtttgcagcctgct

SEQ ID NO: 1552629 - DNA, 19 bp, Homo sapiens
gctgtgttttgtctgagcc

SEQ ID NO: 1552630 - DNA, 16 bp, Homo sapiens
gctgttaaatacagga

SEQ ID NO: 1552631 - DNA, 22 bp, Homo sapiens
gctgttaaatacaggaaacagt

SEQ ID NO: 1552632 - DNA, 18 bp, Homo sapiens
gctgttaccattcacaat

SEQ ID NO: 1552633 - DNA, 23 bp, Homo sapiens
gctgttagggctgaatcttctgg

SEQ ID NO: 1552634 - DNA, 18 bp, Homo sapiens
gctgttattcttgttata

SEQ ID NO: 1552635 - DNA, 18 bp, Homo sapiens
gctgttatttcttccctg

SEQ ID NO: 1552636 - DNA, 16 bp, Homo sapiens
gctgttcacagccaga

SEQ ID NO: 1552637 - DNA, 22 bp, Homo sapiens
gctgttcacccacagggctaag

SEQ ID NO: 1552638 - DNA, 14 bp, Homo sapiens
gctgttccagactc

SEQ ID NO: 1552639 - DNA, 18 bp, Homo sapiens
gctgttccagactcaggt

SEQ ID NO: 1552640 - DNA, 16 bp, Homo sapiens
gctgttcctgctccat

SEQ ID NO: 1552641 - DNA, 13 bp, Homo sapiens
gctgttctgcact

SEQ ID NO: 1552642 - DNA, 17 bp, Homo sapiens
gctgttctgcactgaaa

SEQ ID NO: 1552643 - DNA, 12 bp, Homo sapiens
gctgttctgtgg

SEQ ID NO: 1552644 - DNA, 19 bp, Homo sapiens
gctgttcttcaactcctgg

SEQ ID NO: 1552645 - DNA, 22 bp, Homo sapiens
gctgttcttcaactcctgggct

SEQ ID NO: 1552646 - DNA, 12 bp, Homo sapiens
gctgttcttctg

SEQ ID NO: 1552647 - DNA, 19 bp, Homo sapiens
gctgttgagatgtgctttg

SEQ ID NO: 1552648 - DNA, 16 bp, Homo sapiens
gctgttgagctgtttt

SEQ ID NO: 1552649 - DNA, 15 bp, Homo sapiens
gctgttgaggtggct

SEQ ID NO: 1552650 - DNA, 17 bp, Homo sapiens
gctgttgaggtggctgt

SEQ ID NO: 1552651 - DNA, 18 bp, Homo sapiens
gctgttgaggtggctgta

SEQ ID NO: 1552652 - DNA, 15 bp, Homo sapiens
gctgttgccatagcc

SEQ ID NO: 1552653 - DNA, 13 bp, Homo sapiens
gctgttgcctcat

SEQ ID NO: 1552654 - DNA, 15 bp, Homo sapiens
gctgttgcctcatct

SEQ ID NO: 1552655 - DNA, 16 bp, Homo sapiens
gctgttgctatttgta

SEQ ID NO: 1552656 - DNA, 17 bp, Homo sapiens
gctgttgctatttgtat

SEQ ID NO: 1552657 - DNA, 19 bp, Homo sapiens
gctgttgcttaaaccactt

SEQ ID NO: 1552658 - DNA, 18 bp, Homo sapiens
gctgttggacagctgctt

SEQ ID NO: 1552659 - DNA, 16 bp, Homo sapiens
gctgttggcactcaca

SEQ ID NO: 1552660 - DNA, 22 bp, Homo sapiens
gctgttggcactcacagacctg

SEQ ID NO: 1552661 - DNA, 19 bp, Homo sapiens
gctgttggtcctctctctg

SEQ ID NO: 1552662 - DNA, 22 bp, Homo sapiens
gctgttggtcctctctctgtgg

SEQ ID NO: 1552663 - DNA, 17 bp, Homo sapiens
gctgtttatttattcac

SEQ ID NO: 1552664 - DNA, 19 bp, Homo sapiens
gctgtttctcatgaagcta

SEQ ID NO: 1552665 - DNA, 19 bp, Homo sapiens
gctgtttgagattctcaaa

SEQ ID NO: 1552666 - DNA, 13 bp, Homo sapiens
gctgtttgaggat

SEQ ID NO: 1552667 - DNA, 16 bp, Homo sapiens
gctgtttgcgtgaatg

SEQ ID NO: 1552668 - DNA, 12 bp, Homo sapiens
gctgtttggaaa

SEQ ID NO: 1552669 - DNA, 14 bp, Homo sapiens
gctgtttggaaaag

SEQ ID NO: 1552670 - DNA, 21 bp, Homo sapiens
gctgtttgtttgacaaagaaa

SEQ ID NO: 1552671 - DNA, 17 bp, Homo sapiens
gcttaaacccatacaat

SEQ ID NO: 1552672 - DNA, 22 bp, Homo sapiens
gcttaaagggatggacttgtga

SEQ ID NO: 1552673 - DNA, 16 bp, Homo sapiens
gcttaaatttcttatg

SEQ ID NO: 1552674 - DNA, 21 bp, Homo sapiens
gcttaaatttcttatgtgaca

SEQ ID NO: 1552675 - DNA, 14 bp, Homo sapiens
gcttaaattttaac

SEQ ID NO: 1552676 - DNA, 18 bp, Homo sapiens
gcttaagtgagcagaaca

SEQ ID NO: 1552677 - DNA, 20 bp, Homo sapiens
gcttaagtgagcagaacagg

SEQ ID NO: 1552678 - DNA, 12 bp, Homo sapiens
gcttaatgttta

SEQ ID NO: 1552679 - DNA, 17 bp, Homo sapiens
gcttaatgtttattcct

SEQ ID NO: 1552680 - DNA, 19 bp, Homo sapiens
gcttacaagccagctggag

SEQ ID NO: 1552681 - DNA, 15 bp, Homo sapiens
gctgctctgcgtggc

SEQ ID NO: 1552682 - DNA, 13 bp, Homo sapiens
gctgctcttgcat

SEQ ID NO: 1552683 - DNA, 23 bp, Homo sapiens
gctgctgacacgcagcctgctct

SEQ ID NO: 1552684 - DNA, 21 bp, Homo sapiens
gctgctgaccaattgtgctgc

SEQ ID NO: 1552685 - DNA, 22 bp, Homo sapiens
gctgctgaccaattgtgctgcc

SEQ ID NO: 1552686 - DNA, 22 bp, Homo sapiens
gctgctgagggaccttggagag

SEQ ID NO: 1552687 - DNA, 19 bp, Homo sapiens
gctgctgatgtaggagctg

SEQ ID NO: 1552688 - DNA, 19 bp, Homo sapiens
gctgctgcagccctgccag

SEQ ID NO: 1552689 - DNA, 20 bp, Homo sapiens
gctgctgcagccctgccagt

SEQ ID NO: 1552690 - DNA, 12 bp, Homo sapiens
gctgctgcaggc

SEQ ID NO: 1552691 - DNA, 17 bp, Homo sapiens
gctgctgcccccacccc

SEQ ID NO: 1552692 - DNA, 14 bp, Homo sapiens
gctgctgccgccgc

SEQ ID NO: 1552693 - DNA, 17 bp, Homo sapiens
gctgctgcctccctggg

SEQ ID NO: 1552694 - DNA, 18 bp, Homo sapiens
gctgctgcctccctgggg

SEQ ID NO: 1552695 - DNA, 13 bp, Homo sapiens
gctgctgccttca

SEQ ID NO: 1552696 - DNA, 15 bp, Homo sapiens
gctgctgctgcccca

SEQ ID NO: 1552697 - DNA, 14 bp, Homo sapiens
gctgctgctgctgc

SEQ ID NO: 1552698 - DNA, 14 bp, Homo sapiens
gctgctgctggaga

SEQ ID NO: 1552699 - DNA, 15 bp, Homo sapiens
gctgctgctggagat

SEQ ID NO: 1552700 - DNA, 14 bp, Homo sapiens
gctgctggagaata

SEQ ID NO: 1552701 - DNA, 14 bp, Homo sapiens
gctgctggagcccg

SEQ ID NO: 1552702 - DNA, 12 bp, Homo sapiens
gctgctggccag

SEQ ID NO: 1552703 - DNA, 11 bp, Homo sapiens
gctgctggctt

SEQ ID NO: 1552704 - DNA, 18 bp, Homo sapiens
gctgctggggaagacagt

SEQ ID NO: 1552705 - DNA, 21 bp, Homo sapiens
gctgctggggaagacagtggc

SEQ ID NO: 1552706 - DNA, 12 bp, Homo sapiens
gctgctggggca

SEQ ID NO: 1552707 - DNA, 22 bp, Homo sapiens
gctgctggggcatgtgtgcctg

SEQ ID NO: 1552708 - DNA, 19 bp, Homo sapiens
gctgctgtaactgctgagc

SEQ ID NO: 1552709 - DNA, 22 bp, Homo sapiens
gctgctgtaactgctgagccac

SEQ ID NO: 1552710 - DNA, 15 bp, Homo sapiens
gctgctgtccctccc

SEQ ID NO: 1552711 - DNA, 22 bp, Homo sapiens
gctgctgtccctcccccttgtc

SEQ ID NO: 1552712 - DNA, 19 bp, Homo sapiens
gctgcttaggtctcatgga

SEQ ID NO: 1552713 - DNA, 10 bp, Homo sapiens
gctgcttcca

SEQ ID NO: 1552714 - DNA, 18 bp, Homo sapiens
gctgcttccaggctgggc

SEQ ID NO: 1552715 - DNA, 13 bp, Homo sapiens
gctgcttcctcct

SEQ ID NO: 1552716 - DNA, 21 bp, Homo sapiens
gctgcttcctgtaatgcagga

SEQ ID NO: 1552717 - DNA, 23 bp, Homo sapiens
gctgcttcctgtgacagtgaaat

SEQ ID NO: 1552718 - DNA, 16 bp, Homo sapiens
gctgcttctccacctc

SEQ ID NO: 1552719 - DNA, 14 bp, Homo sapiens
gctgcttgtcctgg

SEQ ID NO: 1552720 - DNA, 15 bp, Homo sapiens
gctgcttgtgggccc

SEQ ID NO: 1552721 - DNA, 19 bp, Homo sapiens
gctgctttcccctgtgggg

SEQ ID NO: 1552722 - DNA, 20 bp, Homo sapiens
gctgctttgccaagttgctg

SEQ ID NO: 1552723 - DNA, 15 bp, Homo sapiens
gctgcttttcttaag

SEQ ID NO: 1552724 - DNA, 17 bp, Homo sapiens
gctggaaagttgggccc

SEQ ID NO: 1552725 - DNA, 12 bp, Homo sapiens
gctggaacattt

SEQ ID NO: 1552726 - DNA, 16 bp, Homo sapiens
gctggaagaaccactg

SEQ ID NO: 1552727 - DNA, 17 bp, Homo sapiens
gctggaagaaccactgt

SEQ ID NO: 1552728 - DNA, 19 bp, Homo sapiens
gctggaagaaccactgtct

SEQ ID NO: 1552729 - DNA, 17 bp, Homo sapiens
gctggaagatcctgcgg

SEQ ID NO: 1552730 - DNA, 12 bp, Homo sapiens
gctggaagccca

SEQ ID NO: 1552731 - DNA, 22 bp, Homo sapiens
gctggaagggaggaaggccttt

SEQ ID NO: 1552732 - DNA, 17 bp, Homo sapiens
gctggaaggggcagcag

SEQ ID NO: 1552733 - DNA, 20 bp, Homo sapiens
gctggaaggggcagcaggag

SEQ ID NO: 1552734 - DNA, 20 bp, Homo sapiens
gctggaaggggccacgtgga

SEQ ID NO: 1552735 - DNA, 22 bp, Homo sapiens
gctggaattccacagggaccag

SEQ ID NO: 1552736 - DNA, 14 bp, Homo sapiens
gctggacaccctct

SEQ ID NO: 1552737 - DNA, 17 bp, Homo sapiens
gctggacaccctctgcc

SEQ ID NO: 1552738 - DNA, 13 bp, Homo sapiens
gctggacagctta

SEQ ID NO: 1552739 - DNA, 19 bp, Homo sapiens
gctggacatgagatggaga

SEQ ID NO: 1552740 - DNA, 21 bp, Homo sapiens
gctggacatgagatggagagg

SEQ ID NO: 1552741 - DNA, 23 bp, Homo sapiens
gctggaccttttcccttgctgta

SEQ ID NO: 1552742 - DNA, 17 bp, Homo sapiens
gctggactattgtgcca

SEQ ID NO: 1552743 - DNA, 16 bp, Homo sapiens
gctggactgaggcctg

SEQ ID NO: 1552744 - DNA, 23 bp, Homo sapiens
gctggactggaggcccctggagc

SEQ ID NO: 1552745 - DNA, 13 bp, Homo sapiens
gctggactggcca

SEQ ID NO: 1552746 - DNA, 14 bp, Homo sapiens
gctggactggccat

SEQ ID NO: 1552747 - DNA, 15 bp, Homo sapiens
gctggactgtggagg

SEQ ID NO: 1552748 - DNA, 17 bp, Homo sapiens
gctggagaaagagctgc

SEQ ID NO: 1552749 - DNA, 13 bp, Homo sapiens
gctggagaaagat

SEQ ID NO: 1552750 - DNA, 20 bp, Homo sapiens
gctggagaataaatttggga

SEQ ID NO: 1552751 - DNA, 15 bp, Homo sapiens
gctggagatgtttta

SEQ ID NO: 1552752 - DNA, 23 bp, Homo sapiens
gctggagcagcggattgctctgg

SEQ ID NO: 1552753 - DNA, 13 bp, Homo sapiens
gctggagctcttg

SEQ ID NO: 1552754 - DNA, 16 bp, Homo sapiens
gctggaggagctggcc

SEQ ID NO: 1552755 - DNA, 12 bp, Homo sapiens
gctggaggcagg

SEQ ID NO: 1552756 - DNA, 13 bp, Homo sapiens
gctggaggcaggg

SEQ ID NO: 1552757 - DNA, 15 bp, Homo sapiens
gctggaggcagggcc

SEQ ID NO: 1552758 - DNA, 16 bp, Homo sapiens
gctggaggcagggcct

SEQ ID NO: 1552759 - DNA, 12 bp, Homo sapiens
gctggaggcctc

SEQ ID NO: 1552760 - DNA, 23 bp, Homo sapiens
gctggagggaggcgggggctgcc

SEQ ID NO: 1552761 - DNA, 15 bp, Homo sapiens
gctggaggggtgggg

SEQ ID NO: 1552762 - DNA, 20 bp, Homo sapiens
gctggaggggtggggagcta

SEQ ID NO: 1552763 - DNA, 16 bp, Homo sapiens
gctggagtgcagtggc

SEQ ID NO: 1552764 - DNA, 19 bp, Homo sapiens
gctggagtgcagtggtgca

SEQ ID NO: 1552765 - DNA, 18 bp, Homo sapiens
gctggagttcagcagtga

SEQ ID NO: 1552766 - DNA, 13 bp, Homo sapiens
gctggatctgtga

SEQ ID NO: 1552767 - DNA, 16 bp, Homo sapiens
gctggatttgggagct

SEQ ID NO: 1552768 - DNA, 19 bp, Homo sapiens
gctggatttgggagctctg

SEQ ID NO: 1552769 - DNA, 15 bp, Homo sapiens
gctggcaaccagcca

SEQ ID NO: 1552770 - DNA, 15 bp, Homo sapiens
gctgagtcacctcct

SEQ ID NO: 1552771 - DNA, 19 bp, Homo sapiens
gctgagtcacctcctccac

SEQ ID NO: 1552772 - DNA, 14 bp, Homo sapiens
gctgagtctccagg

SEQ ID NO: 1552773 - DNA, 20 bp, Homo sapiens
gctgagtgacacaagcactt

SEQ ID NO: 1552774 - DNA, 16 bp, Homo sapiens
gctgagtgagccacag

SEQ ID NO: 1552775 - DNA, 17 bp, Homo sapiens
gctgagtgagccacaga

SEQ ID NO: 1552776 - DNA, 14 bp, Homo sapiens
gctgagtggcagca

SEQ ID NO: 1552777 - DNA, 19 bp, Homo sapiens
gctgagtggcaggggacag

SEQ ID NO: 1552778 - DNA, 22 bp, Homo sapiens
gctgagtggggggtcgtgggcc

SEQ ID NO: 1552779 - DNA, 12 bp, Homo sapiens
gctgagttctgg

SEQ ID NO: 1552780 - DNA, 16 bp, Homo sapiens
gctgagttgttctaac

SEQ ID NO: 1552781 - DNA, 18 bp, Homo sapiens
gctgatatatgtgttttt

SEQ ID NO: 1552782 - DNA, 18 bp, Homo sapiens
gctgatatcaacagcttc

SEQ ID NO: 1552783 - DNA, 20 bp, Homo sapiens
gctgatattatggcaagtga

SEQ ID NO: 1552784 - DNA, 19 bp, Homo sapiens
gctgatattatttcttctc

SEQ ID NO: 1552785 - DNA, 20 bp, Homo sapiens
gctgatattatttcttctct

SEQ ID NO: 1552786 - DNA, 18 bp, Homo sapiens
gctgatcatcgccagagg

SEQ ID NO: 1552787 - DNA, 20 bp, Homo sapiens
gctgatcatcgccagaggtg

SEQ ID NO: 1552788 - DNA, 16 bp, Homo sapiens
gctgatccctgctctc

SEQ ID NO: 1552789 - DNA, 12 bp, Homo sapiens
gctgatctcagg

SEQ ID NO: 1552790 - DNA, 17 bp, Homo sapiens
gctgatctcagggaagc

SEQ ID NO: 1552791 - DNA, 22 bp, Homo sapiens
gctgatgaaactcctgattttg

SEQ ID NO: 1552792 - DNA, 23 bp, Homo sapiens
gctgatgaaactcctgattttgt

SEQ ID NO: 1552793 - DNA, 12 bp, Homo sapiens
gctgatgcagac

SEQ ID NO: 1552794 - DNA, 23 bp, Homo sapiens
gctgatgcagccgtccatagcag

SEQ ID NO: 1552795 - DNA, 15 bp, Homo sapiens
gctgatggagcccca

SEQ ID NO: 1552796 - DNA, 20 bp, Homo sapiens
gctgatggattccaaaccag

SEQ ID NO: 1552797 - DNA, 15 bp, Homo sapiens
gctgatggcagctgg

SEQ ID NO: 1552798 - DNA, 16 bp, Homo sapiens
gctgatggcccctcca

SEQ ID NO: 1552799 - DNA, 17 bp, Homo sapiens
gctgatggcccctccag

SEQ ID NO: 1552800 - DNA, 19 bp, Homo sapiens
gctgatggcccctccagca

SEQ ID NO: 1552801 - DNA, 13 bp, Homo sapiens
gctgatggctgct

SEQ ID NO: 1552802 - DNA, 16 bp, Homo sapiens
gctgatgtaggagctg

SEQ ID NO: 1552803 - DNA, 14 bp, Homo sapiens
gctgatgtcaaagt

SEQ ID NO: 1552804 - DNA, 14 bp, Homo sapiens
gctgatgtggactg

SEQ ID NO: 1552805 - DNA, 16 bp, Homo sapiens
gctgatgtggactgtc

SEQ ID NO: 1552806 - DNA, 20 bp, Homo sapiens
gctgatgttggaagagaaag

SEQ ID NO: 1552807 - DNA, 21 bp, Homo sapiens
gctgattactgtcaataaaca

SEQ ID NO: 1552808 - DNA, 22 bp, Homo sapiens
gctgattactgtcaataaacag

SEQ ID NO: 1552809 - DNA, 13 bp, Homo sapiens
gctgattatttat

SEQ ID NO: 1552810 - DNA, 21 bp, Homo sapiens
gctgattcttgtaaatctttt

SEQ ID NO: 1552811 - DNA, 22 bp, Homo sapiens
gctgattcttgtaaatcttttt

SEQ ID NO: 1552812 - DNA, 14 bp, Homo sapiens
gctgattgtattta

SEQ ID NO: 1552813 - DNA, 17 bp, Homo sapiens
gctgatttccaggcccc

SEQ ID NO: 1552814 - DNA, 19 bp, Homo sapiens
gctgatttccaggcccctg

SEQ ID NO: 1552815 - DNA, 23 bp, Homo sapiens
gctgatttccaggcccctgagga

SEQ ID NO: 1552816 - DNA, 17 bp, Homo sapiens
gctgatttggtgaccaa

SEQ ID NO: 1552817 - DNA, 12 bp, Homo sapiens
gctgattttatt

SEQ ID NO: 1552818 - DNA, 16 bp, Homo sapiens
gctgattttattcttg

SEQ ID NO: 1552819 - DNA, 14 bp, Homo sapiens
gctgcaaaggagaa

SEQ ID NO: 1552820 - DNA, 12 bp, Homo sapiens
gctgcaaggtac

SEQ ID NO: 1552821 - DNA, 20 bp, Homo sapiens
gctgcaaggtactctggtga

SEQ ID NO: 1552822 - DNA, 18 bp, Homo sapiens
gctgcaatccatttattt

SEQ ID NO: 1552823 - DNA, 19 bp, Homo sapiens
gctgcacaggccctgggga

SEQ ID NO: 1552824 - DNA, 17 bp, Homo sapiens
gctgcacattcctggcc

SEQ ID NO: 1552825 - DNA, 18 bp, Homo sapiens
gctgcacattcctggccc

SEQ ID NO: 1552826 - DNA, 20 bp, Homo sapiens
gctgcacattcctggccccg

SEQ ID NO: 1552827 - DNA, 23 bp, Homo sapiens
gctgcacattgcctgttctgctt

SEQ ID NO: 1552828 - DNA, 22 bp, Homo sapiens
gctgcaccagagtgaaagggct

SEQ ID NO: 1552829 - DNA, 17 bp, Homo sapiens
gctgcacctgccagcct

SEQ ID NO: 1552830 - DNA, 20 bp, Homo sapiens
gctgcactatcacgagcctt

SEQ ID NO: 1552831 - DNA, 20 bp, Homo sapiens
gctgcactgaggcagcgacc

SEQ ID NO: 1552832 - DNA, 16 bp, Homo sapiens
gctgcagaccatgcca

SEQ ID NO: 1552833 - DNA, 18 bp, Homo sapiens
gctgcagaggcacctcaa

SEQ ID NO: 1552834 - DNA, 21 bp, Homo sapiens
gctgcagattagttctttttg

SEQ ID NO: 1552835 - DNA, 16 bp, Homo sapiens
gctgcagcaccgaggg

SEQ ID NO: 1552836 - DNA, 20 bp, Homo sapiens
gctgcagcaccgaggggcct

SEQ ID NO: 1552837 - DNA, 21 bp, Homo sapiens
gctgcagcaggtgctgggctg

SEQ ID NO: 1552838 - DNA, 12 bp, Homo sapiens
gctgcagcatgt

SEQ ID NO: 1552839 - DNA, 17 bp, Homo sapiens
gctgcagccctgccagt

SEQ ID NO: 1552840 - DNA, 12 bp, Homo sapiens
gctgcagcctcc

SEQ ID NO: 1552841 - DNA, 14 bp, Homo sapiens
gctgcagcctccct

SEQ ID NO: 1552842 - DNA, 14 bp, Homo sapiens
gctgcagcctgcat

SEQ ID NO: 1552843 - DNA, 20 bp, Homo sapiens
gctgcagctgatccatagga

SEQ ID NO: 1552844 - DNA, 17 bp, Homo sapiens
gctgcaggacttgagaa

SEQ ID NO: 1552845 - DNA, 12 bp, Homo sapiens
gctgcaggagtg

SEQ ID NO: 1552846 - DNA, 19 bp, Homo sapiens
gctgcagggctcccatggg

SEQ ID NO: 1552847 - DNA, 19 bp, Homo sapiens
gctgcagggctttaaaatt

SEQ ID NO: 1552848 - DNA, 19 bp, Homo sapiens
gctgcaggtgttctgctga

SEQ ID NO: 1552849 - DNA, 19 bp, Homo sapiens
gctgcagtcaacagttcaa

SEQ ID NO: 1552850 - DNA, 23 bp, Homo sapiens
gctgcagtcaacagttcaaagaa

SEQ ID NO: 1552851 - DNA, 13 bp, Homo sapiens
gctgcagtcagcc

SEQ ID NO: 1552852 - DNA, 19 bp, Homo sapiens
gctgcagtcttctctctgg

SEQ ID NO: 1552853 - DNA, 20 bp, Homo sapiens
gctgcagtcttctctctggc

SEQ ID NO: 1552854 - DNA, 19 bp, Homo sapiens
gctgcagttggtctccctg

SEQ ID NO: 1552855 - DNA, 17 bp, Homo sapiens
gctgcagttttgctatc

SEQ ID NO: 1552856 - DNA, 21 bp, Homo sapiens
gctgcagttttgctatctggg

SEQ ID NO: 1552857 - DNA, 18 bp, Homo sapiens
gctgcatatttgaccttt

SEQ ID NO: 1552858 - DNA, 15 bp, Homo sapiens
gctgcatatttgtgc

SEQ ID NO: 1552859 - DNA, 14 bp, Homo sapiens
gctgcatccagagg

SEQ ID NO: 1552860 - DNA, 14 bp, Homo sapiens
gctgcatccctgtg

SEQ ID NO: 1552861 - DNA, 18 bp, Homo sapiens
gctgcatcctccaagaat

SEQ ID NO: 1552862 - DNA, 14 bp, Homo sapiens
gctgcatgctctgg

SEQ ID NO: 1552863 - DNA, 15 bp, Homo sapiens
gctgcatgctctgga

SEQ ID NO: 1552864 - DNA, 19 bp, Homo sapiens
gctgcatgctctggaagcc

SEQ ID NO: 1552865 - DNA, 23 bp, Homo sapiens
gctgcattaccagcttaaaacac

SEQ ID NO: 1552866 - DNA, 21 bp, Homo sapiens
gctactcagaagcctgaggct

SEQ ID NO: 1552867 - DNA, 16 bp, Homo sapiens
gctactcagcagccct

SEQ ID NO: 1552868 - DNA, 18 bp, Homo sapiens
gctactcagcagccctcc

SEQ ID NO: 1552869 - DNA, 19 bp, Homo sapiens
gctactcagcagccctcct

SEQ ID NO: 1552870 - DNA, 22 bp, Homo sapiens
gctactcagcagccctcctcac

SEQ ID NO: 1552871 - DNA, 24 bp, Homo sapiens
gctactcagcagccctcctcaccc

SEQ ID NO: 1552872 - DNA, 12 bp, Homo sapiens
gctactcaggag

SEQ ID NO: 1552873 - DNA, 23 bp, Homo sapiens
gctactcagtggggctggcatca

SEQ ID NO: 1552874 - DNA, 13 bp, Homo sapiens
gctactcctgtgc

SEQ ID NO: 1552875 - DNA, 14 bp, Homo sapiens
gctactcctgtgct

SEQ ID NO: 1552876 - DNA, 20 bp, Homo sapiens
gctactcgggaggctgaggc

SEQ ID NO: 1552877 - DNA, 22 bp, Homo sapiens
gctactcgggaggctgaggcag

SEQ ID NO: 1552878 - DNA, 22 bp, Homo sapiens
gctactctccccacgagggctg

SEQ ID NO: 1552879 - DNA, 19 bp, Homo sapiens
gctactctgtccaggccac

SEQ ID NO: 1552880 - DNA, 18 bp, Homo sapiens
gctactctgttccttcac

SEQ ID NO: 1552881 - DNA, 16 bp, Homo sapiens
gctactgagacttgga

SEQ ID NO: 1552882 - DNA, 21 bp, Homo sapiens
gctactgagacttggaacctc

SEQ ID NO: 1552883 - DNA, 21 bp, Homo sapiens
gctactgcactccagcctggg

SEQ ID NO: 1552884 - DNA, 16 bp, Homo sapiens
gctactggcagctcct

SEQ ID NO: 1552885 - DNA, 19 bp, Homo sapiens
gctactggcagctcctctc

SEQ ID NO: 1552886 - DNA, 18 bp, Homo sapiens
gctactggggaggctgag

SEQ ID NO: 1552887 - DNA, 15 bp, Homo sapiens
gctactgtcagctcc

SEQ ID NO: 1552888 - DNA, 18 bp, Homo sapiens
gctactgttgtaagaatt

SEQ ID NO: 1552889 - DNA, 21 bp, Homo sapiens
gctacttccccagctctcagt

SEQ ID NO: 1552890 - DNA, 16 bp, Homo sapiens
gctacttgggaggctg

SEQ ID NO: 1552891 - DNA, 22 bp, Homo sapiens
gctactttggtttctgtctgta

SEQ ID NO: 1552892 - DNA, 18 bp, Homo sapiens
gctagaaaaatgttcttt

SEQ ID NO: 1552893 - DNA, 18 bp, Homo sapiens
gctagaaatatgatttta

SEQ ID NO: 1552894 - DNA, 21 bp, Homo sapiens
gctagaagtgggccaggacag

SEQ ID NO: 1552895 - DNA, 16 bp, Homo sapiens
gctagacacatgaagg

SEQ ID NO: 1552896 - DNA, 22 bp, Homo sapiens
gctagacacatgaaggtaaata

SEQ ID NO: 1552897 - DNA, 15 bp, Homo sapiens
gctagacaggaaccc

SEQ ID NO: 1552898 - DNA, 15 bp, Homo sapiens
gctagactcctcagg

SEQ ID NO: 1552899 - DNA, 16 bp, Homo sapiens
gctagactcctcagga

SEQ ID NO: 1552900 - DNA, 20 bp, Homo sapiens
gctagagaaatcagctgcta

SEQ ID NO: 1552901 - DNA, 15 bp, Homo sapiens
gctgaggctggggga

SEQ ID NO: 1552902 - DNA, 22 bp, Homo sapiens
gctgaggctgggggagagccgt

SEQ ID NO: 1552903 - DNA, 15 bp, Homo sapiens
gctgagggaccagcc

SEQ ID NO: 1552904 - DNA, 18 bp, Homo sapiens
gctgagggaccgagccca

SEQ ID NO: 1552905 - DNA, 20 bp, Homo sapiens
gctgagggaccttggagagc

SEQ ID NO: 1552906 - DNA, 15 bp, Homo sapiens
gctgagggccctgtg

SEQ ID NO: 1552907 - DNA, 17 bp, Homo sapiens
gctgagggccctgtgga

SEQ ID NO: 1552908 - DNA, 15 bp, Homo sapiens
gctgagggcctgctg

SEQ ID NO: 1552909 - DNA, 17 bp, Homo sapiens
gctgagggcctgctgga

SEQ ID NO: 1552910 - DNA, 22 bp, Homo sapiens
gctgagggcctgctggaggcct

SEQ ID NO: 1552911 - DNA, 23 bp, Homo sapiens
gctgagggcctgctggaggcctc

SEQ ID NO: 1552912 - DNA, 11 bp, Homo sapiens
gctgaggggca

SEQ ID NO: 1552913 - DNA, 23 bp, Homo sapiens
gctgaggggcaacgaagaaaaaa

SEQ ID NO: 1552914 - DNA, 21 bp, Homo sapiens
gctgaggggtctcggatgaca

SEQ ID NO: 1552915 - DNA, 13 bp, Homo sapiens
gctgaggttcctc

SEQ ID NO: 1552916 - DNA, 15 bp, Homo sapiens
gctgagtaaacataa

SEQ ID NO: 1552917 - DNA, 15 bp, Homo sapiens
gctgagtagctctgc

SEQ ID NO: 1552918 - DNA, 23 bp, Homo sapiens
gcctggggctcctttctccagcc

SEQ ID NO: 1552919 - DNA, 20 bp, Homo sapiens
gcctgggggacccctggctc

SEQ ID NO: 1552920 - DNA, 21 bp, Homo sapiens
gcctgggggacccctggctct

SEQ ID NO: 1552921 - DNA, 23 bp, Homo sapiens
gcctgggggacccctggctctgg

SEQ ID NO: 1552922 - DNA, 19 bp, Homo sapiens
gcctgggggcagtgactgg

SEQ ID NO: 1552923 - DNA, 20 bp, Homo sapiens
gcctgggggcagtgactggc

SEQ ID NO: 1552924 - DNA, 14 bp, Homo sapiens
gcctggggtctgga

SEQ ID NO: 1552925 - DNA, 17 bp, Homo sapiens
gcctggggtgcatctcc

SEQ ID NO: 1552926 - DNA, 20 bp, Homo sapiens
gcctgggtgacagagcaaga

SEQ ID NO: 1552927 - DNA, 20 bp, Homo sapiens
gcctgggtgacagagtgaga

SEQ ID NO: 1552928 - DNA, 15 bp, Homo sapiens
gcctgggtgacagtg

SEQ ID NO: 1552929 - DNA, 14 bp, Homo sapiens
gcctgggtgctggc

SEQ ID NO: 1552930 - DNA, 15 bp, Homo sapiens
gcctgggtgctggct

SEQ ID NO: 1552931 - DNA, 15 bp, Homo sapiens
gcctgggtggggctg

SEQ ID NO: 1552932 - DNA, 22 bp, Homo sapiens
gcctgggtggggctgctcctcc

SEQ ID NO: 1552933 - DNA, 14 bp, Homo sapiens
gcctggtattttca

SEQ ID NO: 1552934 - DNA, 19 bp, Homo sapiens
gccttcctctgcagctgac

SEQ ID NO: 1552935 - DNA, 18 bp, Homo sapiens
gccttcctttctcctgcc

SEQ ID NO: 1552936 - DNA, 18 bp, Homo sapiens
gccttcgaccacagcaag

SEQ ID NO: 1552937 - DNA, 18 bp, Homo sapiens
gccttcgatacaccgggc

SEQ ID NO: 1552938 - DNA, 20 bp, Homo sapiens
gccttcgcttcttgcctctg

SEQ ID NO: 1552939 - DNA, 19 bp, Homo sapiens
gccttcgtctttcccatgg

SEQ ID NO: 1552940 - DNA, 17 bp, Homo sapiens
gccttctagattcactg

SEQ ID NO: 1552941 - DNA, 16 bp, Homo sapiens
gccttctcagaagcac

SEQ ID NO: 1552942 - DNA, 16 bp, Homo sapiens
gccttctcaggccccg

SEQ ID NO: 1552943 - DNA, 13 bp, Homo sapiens
gccttctcctccc

SEQ ID NO: 1552944 - DNA, 21 bp, Homo sapiens
gccttctcggagctggcccag

SEQ ID NO: 1552945 - DNA, 21 bp, Homo sapiens
gccttctctattgggcacagc

SEQ ID NO: 1552946 - DNA, 14 bp, Homo sapiens
gccttctctcagct

SEQ ID NO: 1552947 - DNA, 17 bp, Homo sapiens
gccttctctgcccacag

SEQ ID NO: 1552948 - DNA, 15 bp, Homo sapiens
gccttctgaactcca

SEQ ID NO: 1552949 - DNA, 16 bp, Homo sapiens
gccttctgaactccat

SEQ ID NO: 1552950 - DNA, 21 bp, Homo sapiens
gccttcttattctcactccac

SEQ ID NO: 1552951 - DNA, 15 bp, Homo sapiens
gccttcttcacccag

SEQ ID NO: 1552952 - DNA, 23 bp, Homo sapiens
gccttcttcggggaactcctgga

SEQ ID NO: 1552953 - DNA, 17 bp, Homo sapiens
gccttgaagactccctg

SEQ ID NO: 1552954 - DNA, 18 bp, Homo sapiens
gccttgcagatatctgca

SEQ ID NO: 1552955 - DNA, 21 bp, Homo sapiens
gccttgcagatatctgcatgt

SEQ ID NO: 1552956 - DNA, 16 bp, Homo sapiens
gccttgcagctggccc

SEQ ID NO: 1552957 - DNA, 18 bp, Homo sapiens
gccttgcagctggcccac

SEQ ID NO: 1552958 - DNA, 13 bp, Homo sapiens
gccttgccagaga

SEQ ID NO: 1552959 - DNA, 14 bp, Homo sapiens
gccttgccagagat

SEQ ID NO: 1552960 - DNA, 17 bp, Homo sapiens
gccttgccagagatcca

SEQ ID NO: 1552961 - DNA, 16 bp, Homo sapiens
gccttgcccagagatg

SEQ ID NO: 1552962 - DNA, 20 bp, Homo sapiens
gccttgcccagagatgcctc

SEQ ID NO: 1552963 - DNA, 16 bp, Homo sapiens
gccttgcccgccagcc

SEQ ID NO: 1552964 - DNA, 18 bp, Homo sapiens
gccttgcccgccagcctc

SEQ ID NO: 1552965 - DNA, 23 bp, Homo sapiens
gccttgcctaaatttaatgctgc

SEQ ID NO: 1552966 - DNA, 15 bp, Homo sapiens
gccttgctgctctgc

SEQ ID NO: 1552967 - DNA, 18 bp, Homo sapiens
gccttgctgctctgcgtg

SEQ ID NO: 1552968 - DNA, 16 bp, Homo sapiens
gccttgctgggccagg

SEQ ID NO: 1552969 - DNA, 19 bp, Homo sapiens
gccttgctgtttgtcctga

SEQ ID NO: 1552970 - DNA, 22 bp, Homo sapiens
gccttgctgtttgtcctgagat

SEQ ID NO: 1552971 - DNA, 23 bp, Homo sapiens
gccttggataatgctgttgcctc

SEQ ID NO: 1552972 - DNA, 23 bp, Homo sapiens
gccttggatcgctaagctggctc

SEQ ID NO: 1552973 - DNA, 16 bp, Homo sapiens
gccttggccttgcagc

SEQ ID NO: 1552974 - DNA, 12 bp, Homo sapiens
gccttggctcag

SEQ ID NO: 1552975 - DNA, 17 bp, Homo sapiens
gccttggctcgttctct

SEQ ID NO: 1552976 - DNA, 20 bp, Homo sapiens
gccttggctgacatgaagct

SEQ ID NO: 1552977 - DNA, 13 bp, Homo sapiens
gccttgggccttg

SEQ ID NO: 1552978 - DNA, 18 bp, Homo sapiens
gccttgggctgctcctca

SEQ ID NO: 1552979 - DNA, 19 bp, Homo sapiens
gccttggggaatttcctct

SEQ ID NO: 1552980 - DNA, 21 bp, Homo sapiens
gccttggtctctccttcctct

SEQ ID NO: 1552981 - DNA, 16 bp, Homo sapiens
gccttggtgtccacct

SEQ ID NO: 1552982 - DNA, 19 bp, Homo sapiens
gccttggttcatcagtgtt

SEQ ID NO: 1552983 - DNA, 17 bp, Homo sapiens
gccttggtttttactgc

SEQ ID NO: 1552984 - DNA, 15 bp, Homo sapiens
gccttgtccctctca

SEQ ID NO: 1552985 - DNA, 13 bp, Homo sapiens
gccttgtgccctg

SEQ ID NO: 1552986 - DNA, 12 bp, Homo sapiens
gccttgtgtaca

SEQ ID NO: 1552987 - DNA, 16 bp, Homo sapiens
gccttgtgtgtcaggc

SEQ ID NO: 1552988 - DNA, 18 bp, Homo sapiens
gcctttaaagtatgaatc

SEQ ID NO: 1552989 - DNA, 14 bp, Homo sapiens
gcctttaacagaaa

SEQ ID NO: 1552990 - DNA, 18 bp, Homo sapiens
gcctttagcgtgtaaatg

SEQ ID NO: 1552991 - DNA, 23 bp, Homo sapiens
gcctttatttttggcgtggctga

SEQ ID NO: 1552992 - DNA, 18 bp, Homo sapiens
gcctttcattttgcttta

SEQ ID NO: 1552993 - DNA, 21 bp, Homo sapiens
gcctttccataaggaatgtag

SEQ ID NO: 1552994 - DNA, 21 bp, Homo sapiens
gcctttccctcctaaagctga

SEQ ID NO: 1552995 - DNA, 15 bp, Homo sapiens
gcctttcgaggcctg

SEQ ID NO: 1552996 - DNA, 22 bp, Homo sapiens
gcctttctcccaggccaggctc

SEQ ID NO: 1552997 - DNA, 23 bp, Homo sapiens
gcctttctcccaggccaggctcc

SEQ ID NO: 1552998 - DNA, 13 bp, Homo sapiens
gcctttcttctgt

SEQ ID NO: 1552999 - DNA, 14 bp, Homo sapiens
gcctttcttctgtg

SEQ ID NO: 1553000 - DNA, 18 bp, Homo sapiens
gcctttctttgcctctgc

SEQ ID NO: 1553001 - DNA, 17 bp, Homo sapiens
gcctttgatgttacaga

SEQ ID NO: 1553002 - DNA, 22 bp, Homo sapiens
gcctttgcagttggactctcag

SEQ ID NO: 1553003 - DNA, 12 bp, Homo sapiens
gcctttgccctg

SEQ ID NO: 1553004 - DNA, 15 bp, Homo sapiens
gcctttgcctccccg

SEQ ID NO: 1553005 - DNA, 22 bp, Homo sapiens
gcctttggcctggggtgcatct

SEQ ID NO: 1553006 - DNA, 23 bp, Homo sapiens
gcctttgtatctttctttctcta

SEQ ID NO: 1553007 - DNA, 15 bp, Homo sapiens
gcctttgtcttgtac

SEQ ID NO: 1553008 - DNA, 18 bp, Homo sapiens
gcctttgtcttgtacttc

SEQ ID NO: 1553009 - DNA, 22 bp, Homo sapiens
gccttttcacgggaactctcca

SEQ ID NO: 1553010 - DNA, 17 bp, Homo sapiens
gccttttccacacgcat

SEQ ID NO: 1553011 - DNA, 13 bp, Homo sapiens
gccttttctgtga

SEQ ID NO: 1553012 - DNA, 15 bp, Homo sapiens
gccttttgcacccct

SEQ ID NO: 1553013 - DNA, 18 bp, Homo sapiens
gccttttgcacccctccc

SEQ ID NO: 1553014 - DNA, 19 bp, Homo sapiens
gccttttgcacccctccca

SEQ ID NO: 1553015 - DNA, 20 bp, Homo sapiens
gccttttgcacccctcccat

SEQ ID NO: 1553016 - DNA, 16 bp, Homo sapiens
gccttttgcagaagag

SEQ ID NO: 1553017 - DNA, 14 bp, Homo sapiens
gccttttggatatg

SEQ ID NO: 1553018 - DNA, 14 bp, Homo sapiens
gccttttgtttaaa

SEQ ID NO: 1553019 - DNA, 17 bp, Homo sapiens
gccttttgtttctagaa

SEQ ID NO: 1553020 - DNA, 20 bp, Homo sapiens
gcctttttagatgtattttt

SEQ ID NO: 1553021 - DNA, 17 bp, Homo sapiens
gcctttttcatttatct

SEQ ID NO: 1553022 - DNA, 22 bp, Homo sapiens
gcgaactgggttctttggaagc

SEQ ID NO: 1553023 - DNA, 19 bp, Homo sapiens
gcgaagaccctcttgccca

SEQ ID NO: 1553024 - DNA, 22 bp, Homo sapiens
gcgaagaccctcttgcccatcc

SEQ ID NO: 1553025 - DNA, 23 bp, Homo sapiens
gcgacagcgtccggggtggtgga

SEQ ID NO: 1553026 - DNA, 21 bp, Homo sapiens
gcggagtccccggggttcccc

SEQ ID NO: 1553027 - DNA, 18 bp, Homo sapiens
gcggagtgaagaggggca

SEQ ID NO: 1553028 - DNA, 20 bp, Homo sapiens
gcggagtgaagaggggcagc

SEQ ID NO: 1553029 - DNA, 20 bp, Homo sapiens
gcggatctctggagtgagct

SEQ ID NO: 1553030 - DNA, 18 bp, Homo sapiens
gcggattaatttgcatct

SEQ ID NO: 1553031 - DNA, 19 bp, Homo sapiens
gcggattgctctggagcag

SEQ ID NO: 1553032 - DNA, 14 bp, Homo sapiens
gcggcaaaaggaaa

SEQ ID NO: 1553033 - DNA, 18 bp, Homo sapiens
gcggcacccaggcctccc

SEQ ID NO: 1553034 - DNA, 17 bp, Homo sapiens
gcggcacgtccttgggc

SEQ ID NO: 1553035 - DNA, 17 bp, Homo sapiens
gcggcagagcaattcca

SEQ ID NO: 1553036 - DNA, 15 bp, Homo sapiens
gcggcagccccactt

SEQ ID NO: 1553037 - DNA, 12 bp, Homo sapiens
gcggcagctggg

SEQ ID NO: 1553038 - DNA, 16 bp, Homo sapiens
gcggcaggggcctgga

SEQ ID NO: 1553039 - DNA, 19 bp, Homo sapiens
gcggccacgcactgggcca

SEQ ID NO: 1553040 - DNA, 14 bp, Homo sapiens
gcggccaggcacag

SEQ ID NO: 1553041 - DNA, 16 bp, Homo sapiens
gcggccaggcacaggg

SEQ ID NO: 1553042 - DNA, 17 bp, Homo sapiens
gcggccaggcacagggc

SEQ ID NO: 1553043 - DNA, 18 bp, Homo sapiens
gcggccaggcacagggcc

SEQ ID NO: 1553044 - DNA, 16 bp, Homo sapiens
gcggccaggcacccat

SEQ ID NO: 1553045 - DNA, 22 bp, Homo sapiens
gcggccaggcacccatgtgggc

SEQ ID NO: 1553046 - DNA, 22 bp, Homo sapiens
gcggcccaagcccgacttgctg

SEQ ID NO: 1553047 - DNA, 20 bp, Homo sapiens
gcggccccccgcacagccac

SEQ ID NO: 1553048 - DNA, 22 bp, Homo sapiens
gcggccccccgcacagccaccc

SEQ ID NO: 1553049 - DNA, 16 bp, Homo sapiens
gcggcccggccagcgg

SEQ ID NO: 1553050 - DNA, 22 bp, Homo sapiens
gcggcccggccagcgggcacag

SEQ ID NO: 1553051 - DNA, 13 bp, Homo sapiens
gcggccctcagta

SEQ ID NO: 1553052 - DNA, 24 bp, Homo sapiens
gcggccctgctgaagctgctgcag

SEQ ID NO: 1553053 - DNA, 19 bp, Homo sapiens
gcggccgcattccctgagt

SEQ ID NO: 1553054 - DNA, 16 bp, Homo sapiens
gctcaggggcctggag

SEQ ID NO: 1553055 - DNA, 17 bp, Homo sapiens
gctcaggggcctggagg

SEQ ID NO: 1553056 - DNA, 18 bp, Homo sapiens
gctcaggggcctggaggt

SEQ ID NO: 1553057 - DNA, 21 bp, Homo sapiens
gctcaggggcctggaggtctg

SEQ ID NO: 1553058 - DNA, 21 bp, Homo sapiens
gctcaggtttgtcctggtcat

SEQ ID NO: 1553059 - DNA, 22 bp, Homo sapiens
gctcagtaaacgggaacatgcc

SEQ ID NO: 1553060 - DNA, 20 bp, Homo sapiens
gctcagtaacataactgctt

SEQ ID NO: 1553061 - DNA, 21 bp, Homo sapiens
gctcagtaatttgaggacaac

SEQ ID NO: 1553062 - DNA, 14 bp, Homo sapiens
gctcagtctcagga

SEQ ID NO: 1553063 - DNA, 20 bp, Homo sapiens
gctcagtctcaggagcatgg

SEQ ID NO: 1553064 - DNA, 15 bp, Homo sapiens
gctcagtgaagtaca

SEQ ID NO: 1553065 - DNA, 13 bp, Homo sapiens
gctcagtgccttc

SEQ ID NO: 1553066 - DNA, 16 bp, Homo sapiens
gctcagtgccttcctc

SEQ ID NO: 1553067 - DNA, 13 bp, Homo sapiens
gctcagtgtccag

SEQ ID NO: 1553068 - DNA, 16 bp, Homo sapiens
gctcagtgtccagctt

SEQ ID NO: 1553069 - DNA, 23 bp, Homo sapiens
gctcagttttacgcaacactaaa

SEQ ID NO: 1553070 - DNA, 20 bp, Homo sapiens
gctcatacaggaatgaagcc

SEQ ID NO: 1553071 - DNA, 19 bp, Homo sapiens
gctcataggacctgcatcc

SEQ ID NO: 1553072 - DNA, 15 bp, Homo sapiens
gctcatcatattcca

SEQ ID NO: 1553073 - DNA, 19 bp, Homo sapiens
gctcatcccccctgctgcc

SEQ ID NO: 1553074 - DNA, 20 bp, Homo sapiens
gctcatcccccctgctgccc

SEQ ID NO: 1553075 - DNA, 16 bp, Homo sapiens
gctcatctgctggtcc

SEQ ID NO: 1553076 - DNA, 17 bp, Homo sapiens
gctcatctgtacatact

SEQ ID NO: 1553077 - DNA, 15 bp, Homo sapiens
gctcatgagggccca

SEQ ID NO: 1553078 - DNA, 20 bp, Homo sapiens
gctcatggcgtaatgggcct

SEQ ID NO: 1553079 - DNA, 20 bp, Homo sapiens
gctcatggctgtgtccactg

SEQ ID NO: 1553080 - DNA, 14 bp, Homo sapiens
gctcatgtcctgtc

SEQ ID NO: 1553081 - DNA, 15 bp, Homo sapiens
gctcatgtcctgtcc

SEQ ID NO: 1553082 - DNA, 16 bp, Homo sapiens
gctcatgtcctgtcct

SEQ ID NO: 1553083 - DNA, 17 bp, Homo sapiens
gctcatgtgtgcaacag

SEQ ID NO: 1553084 - DNA, 16 bp, Homo sapiens
gctcatgttgagccag

SEQ ID NO: 1553085 - DNA, 23 bp, Homo sapiens
gctcattacagttctttcctctt

SEQ ID NO: 1553086 - DNA, 13 bp, Homo sapiens
gctcattcttttc

SEQ ID NO: 1553087 - DNA, 21 bp, Homo sapiens
gctcattttcctgacatttgt

SEQ ID NO: 1553088 - DNA, 15 bp, Homo sapiens
gctcattttctggtt

SEQ ID NO: 1553089 - DNA, 21 bp, Homo sapiens
gctccaactcctttcagccac

SEQ ID NO: 1553090 - DNA, 15 bp, Homo sapiens
gctccaagattctag

SEQ ID NO: 1553091 - DNA, 16 bp, Homo sapiens
gctccaagccccatct

SEQ ID NO: 1553092 - DNA, 23 bp, Homo sapiens
gctccaaggggaatcagaactca

SEQ ID NO: 1553093 - DNA, 14 bp, Homo sapiens
gctccaatttcccc

SEQ ID NO: 1553094 - DNA, 13 bp, Homo sapiens
gctccacacagca

SEQ ID NO: 1553095 - DNA, 15 bp, Homo sapiens
gctccacacagcagt

SEQ ID NO: 1553096 - DNA, 23 bp, Homo sapiens
gctccacaccctctcccaggacc

SEQ ID NO: 1553097 - DNA, 15 bp, Homo sapiens
gctccaccacatcct

SEQ ID NO: 1553098 - DNA, 18 bp, Homo sapiens
gctccaccagcatcacct

SEQ ID NO: 1553099 - DNA, 23 bp, Homo sapiens
gctccaccagcatcacctgcctg

SEQ ID NO: 1553100 - DNA, 16 bp, Homo sapiens
gctccacccttggcct

SEQ ID NO: 1553101 - DNA, 17 bp, Homo sapiens
gctccacccttggcctg

SEQ ID NO: 1553102 - DNA, 23 bp, Homo sapiens
gctccacccttggcctgtctcat

SEQ ID NO: 1553103 - DNA, 13 bp, Homo sapiens
gctccacctctgg

SEQ ID NO: 1553104 - DNA, 13 bp, Homo sapiens
gctccactctgct

SEQ ID NO: 1553105 - DNA, 16 bp, Homo sapiens
gctccactctgcttct

SEQ ID NO: 1553106 - DNA, 21 bp, Homo sapiens
gctccactcttgatctctctt

SEQ ID NO: 1553107 - DNA, 17 bp, Homo sapiens
gctccagaagatgccag

SEQ ID NO: 1553108 - DNA, 12 bp, Homo sapiens
gctccagacctg

SEQ ID NO: 1553109 - DNA, 13 bp, Homo sapiens
gctccagacctga

SEQ ID NO: 1553110 - DNA, 18 bp, Homo sapiens
gctccagataactctctt

SEQ ID NO: 1553111 - DNA, 22 bp, Homo sapiens
gctccagataactctctttcct

SEQ ID NO: 1553112 - DNA, 17 bp, Homo sapiens
gctccagattctgatgc

SEQ ID NO: 1553113 - DNA, 18 bp, Homo sapiens
gctccagattctgatgca

SEQ ID NO: 1553114 - DNA, 21 bp, Homo sapiens
gctccagcaactgcccttcca

SEQ ID NO: 1553115 - DNA, 22 bp, Homo sapiens
gctccagcaactgcccttccag

SEQ ID NO: 1553116 - DNA, 16 bp, Homo sapiens
gctccagcagcacacc

SEQ ID NO: 1553117 - DNA, 21 bp, Homo sapiens
gctccagcagcacacctcagc

SEQ ID NO: 1553118 - DNA, 13 bp, Homo sapiens
gctccagcatcca

SEQ ID NO: 1553119 - DNA, 18 bp, Homo sapiens
gctccagcatccagcctg

SEQ ID NO: 1553120 - DNA, 16 bp, Homo sapiens
gctccagcccctcttg

SEQ ID NO: 1553121 - DNA, 12 bp, Homo sapiens
gctccagctgcc

SEQ ID NO: 1553122 - DNA, 16 bp, Homo sapiens
gctccaggatctttga

SEQ ID NO: 1553123 - DNA, 16 bp, Homo sapiens
gctccagggcagcctc

SEQ ID NO: 1553124 - DNA, 18 bp, Homo sapiens
gctccagggtcaggcgga

SEQ ID NO: 1553125 - DNA, 19 bp, Homo sapiens
gctccagggtcttgggcta

SEQ ID NO: 1553126 - DNA, 20 bp, Homo sapiens
gctccatatttgatttctaa

SEQ ID NO: 1553127 - DNA, 21 bp, Homo sapiens
gctccatatttgatttctaat

SEQ ID NO: 1553128 - DNA, 16 bp, Homo sapiens
gctccatgcacctccc

SEQ ID NO: 1553129 - DNA, 22 bp, Homo sapiens
gctccatgcacctcccttccct

SEQ ID NO: 1553130 - DNA, 23 bp, Homo sapiens
gctccatgcacctcccttccctc

SEQ ID NO: 1553131 - DNA, 14 bp, Homo sapiens
gctccattttttct

SEQ ID NO: 1553132 - DNA, 19 bp, Homo sapiens
gctcccaacagaggcctcc

SEQ ID NO: 1553133 - DNA, 18 bp, Homo sapiens
gctcccaacccccctcct

SEQ ID NO: 1553134 - DNA, 15 bp, Homo sapiens
gctcccacaggccct

SEQ ID NO: 1553135 - DNA, 21 bp, Homo sapiens
gctcccacaggcccttcctct

SEQ ID NO: 1553136 - DNA, 15 bp, Homo sapiens
gctcccacccacctg

SEQ ID NO: 1553137 - DNA, 15 bp, Homo sapiens
gctcccaccgccccc

SEQ ID NO: 1553138 - DNA, 20 bp, Homo sapiens
gctcccaccgcccccacccc

SEQ ID NO: 1553139 - DNA, 20 bp, Homo sapiens
gctcccacctagtgccccag

SEQ ID NO: 1553140 - DNA, 13 bp, Homo sapiens
gctcccactcaga

SEQ ID NO: 1553141 - DNA, 23 bp, Homo sapiens
gctcccagcagccctaaggatct

SEQ ID NO: 1553142 - DNA, 12 bp, Homo sapiens
gctcccagggca

SEQ ID NO: 1553143 - DNA, 18 bp, Homo sapiens
gctcccaggggtctccct

SEQ ID NO: 1553144 - DNA, 20 bp, Homo sapiens
gctcccaggttcccccagca

SEQ ID NO: 1553145 - DNA, 22 bp, Homo sapiens
gctcccaggttcccccagcaag

SEQ ID NO: 1553146 - DNA, 20 bp, Homo sapiens
gctcccagtgggagcttccc

SEQ ID NO: 1553147 - DNA, 21 bp, Homo sapiens
gctcccatcattccttctggc

SEQ ID NO: 1553148 - DNA, 16 bp, Homo sapiens
gctcccattcctccct

SEQ ID NO: 1553149 - DNA, 21 bp, Homo sapiens
gctccccacaccttccagggc

SEQ ID NO: 1553150 - DNA, 22 bp, Homo sapiens
gctccccacccgcctcccgcct

SEQ ID NO: 1553151 - DNA, 12 bp, Homo sapiens
gctccccaccta

SEQ ID NO: 1553152 - DNA, 14 bp, Homo sapiens
gctccccaggactc

SEQ ID NO: 1553153 - DNA, 14 bp, Homo sapiens
gctccccatgtgtc

SEQ ID NO: 1553154 - DNA, 13 bp, Homo sapiens
gctccccccgccc

SEQ ID NO: 1553155 - DNA, 16 bp, Homo sapiens
gctccccccgcccacc

SEQ ID NO: 1553156 - DNA, 20 bp, Homo sapiens
gctccccccgcccacccacg

SEQ ID NO: 1553157 - DNA, 15 bp, Homo sapiens
gctcccccgcagtcc

SEQ ID NO: 1553158 - DNA, 17 bp, Homo sapiens
gctccccctctgcttct

SEQ ID NO: 1553159 - DNA, 20 bp, Homo sapiens
gctccccgcctccactctag

SEQ ID NO: 1553160 - DNA, 18 bp, Homo sapiens
gctcccctaaccctactt

SEQ ID NO: 1553161 - DNA, 12 bp, Homo sapiens
gctcccctccaa

SEQ ID NO: 1553162 - DNA, 18 bp, Homo sapiens
gctcccctcccaggggag

SEQ ID NO: 1553163 - DNA, 18 bp, Homo sapiens
gctcccctcggagaagag

SEQ ID NO: 1553164 - DNA, 14 bp, Homo sapiens
gctcccctgccaca

SEQ ID NO: 1553165 - DNA, 15 bp, Homo sapiens
gctcccctgccacac

SEQ ID NO: 1553166 - DNA, 18 bp, Homo sapiens
gctcccctgccacactga

SEQ ID NO: 1553167 - DNA, 15 bp, Homo sapiens
gctcccctggagcca

SEQ ID NO: 1553168 - DNA, 19 bp, Homo sapiens
gctcccctggagccagcag

SEQ ID NO: 1553169 - DNA, 15 bp, Homo sapiens
gctcccgcagggctg

SEQ ID NO: 1553170 - DNA, 14 bp, Homo sapiens
gctcccgctcccag

SEQ ID NO: 1553171 - DNA, 15 bp, Homo sapiens
gctcccggcaagcgc

SEQ ID NO: 1553172 - DNA, 20 bp, Homo sapiens
gctcccggggcagggcagcc

SEQ ID NO: 1553173 - DNA, 12 bp, Homo sapiens
gctccctcctcc

SEQ ID NO: 1553174 - DNA, 16 bp, Homo sapiens
gctccctcctccaggc

SEQ ID NO: 1553175 - DNA, 18 bp, Homo sapiens
gctccctcctccaggcct

SEQ ID NO: 1553176 - DNA, 22 bp, Homo sapiens
gctccctcctccaggcctgcct

SEQ ID NO: 1553177 - DNA, 14 bp, Homo sapiens
gctccctcctccca

SEQ ID NO: 1553178 - DNA, 15 bp, Homo sapiens
gctccctcctcccat

SEQ ID NO: 1553179 - DNA, 20 bp, Homo sapiens
gctccctcctcccatctcct

SEQ ID NO: 1553180 - DNA, 18 bp, Homo sapiens
gctccctctctggtttcc

SEQ ID NO: 1553181 - DNA, 12 bp, Homo sapiens
gctccctggaag

SEQ ID NO: 1553182 - DNA, 21 bp, Homo sapiens
gctccctggaggcacgcacca

SEQ ID NO: 1553183 - DNA, 19 bp, Homo sapiens
gctccctgtagctctgcct

SEQ ID NO: 1553184 - DNA, 23 bp, Homo sapiens
gctccctgtagctctgcctccct

SEQ ID NO: 1553185 - DNA, 17 bp, Homo sapiens
gctccctgtagggtcca

SEQ ID NO: 1553186 - DNA, 23 bp, Homo sapiens
gctccctgtagggtccaaccaga

SEQ ID NO: 1553187 - DNA, 21 bp, Homo sapiens
gctccctgtggggcaggagtg

SEQ ID NO: 1553188 - DNA, 16 bp, Homo sapiens
gctccgaggacccagg

SEQ ID NO: 1553189 - DNA, 13 bp, Homo sapiens
gctccgctcccac

SEQ ID NO: 1553190 - DNA, 16 bp, Homo sapiens
gctccgctcccaccgc

SEQ ID NO: 1553191 - DNA, 15 bp, Homo sapiens
gctccgctgccgtgc

SEQ ID NO: 1553192 - DNA, 15 bp, Homo sapiens
gctccgctgcctgga

SEQ ID NO: 1553193 - DNA, 21 bp, Homo sapiens
gctccggcctctgcctttgca

SEQ ID NO: 1553194 - DNA, 13 bp, Homo sapiens
gctccgtctctgt

SEQ ID NO: 1553195 - DNA, 17 bp, Homo sapiens
gctccgtctctgtcctc

SEQ ID NO: 1553196 - DNA, 14 bp, Homo sapiens
gctccgtgcctcca

SEQ ID NO: 1553197 - DNA, 16 bp, Homo sapiens
gctccgtgcctccacc

SEQ ID NO: 1553198 - DNA, 17 bp, Homo sapiens
gctccgtgcctccacca

SEQ ID NO: 1553199 - DNA, 22 bp, Homo sapiens
gctcctacctgtctgctgccag

SEQ ID NO: 1553200 - DNA, 18 bp, Homo sapiens
gctcctcaactcacctaa

SEQ ID NO: 1553201 - DNA, 11 bp, Homo sapiens
gctcctcaccc

SEQ ID NO: 1553202 - DNA, 16 bp, Homo sapiens
gctcctcacctgtcta

SEQ ID NO: 1553203 - DNA, 20 bp, Homo sapiens
gctcctcactggaggagcag

SEQ ID NO: 1553204 - DNA, 23 bp, Homo sapiens
gctcctcactggaggagcagctt

SEQ ID NO: 1553205 - DNA, 14 bp, Homo sapiens
gctcctccagggcc

SEQ ID NO: 1553206 - DNA, 15 bp, Homo sapiens
gctcctccccttcct

SEQ ID NO: 1553207 - DNA, 11 bp, Homo sapiens
gctcctccctg

SEQ ID NO: 1553208 - DNA, 22 bp, Homo sapiens
gctcctccctgccccccaaggt

SEQ ID NO: 1553209 - DNA, 14 bp, Homo sapiens
gctcctccctggct

SEQ ID NO: 1553210 - DNA, 16 bp, Homo sapiens
gctcctccctggctgc

SEQ ID NO: 1553211 - DNA, 17 bp, Homo sapiens
gctcctccctggctgcc

SEQ ID NO: 1553212 - DNA, 23 bp, Homo sapiens
gctcctccctggctgccctggcc

SEQ ID NO: 1553213 - DNA, 14 bp, Homo sapiens
gctcctcctaggaa

SEQ ID NO: 1553214 - DNA, 17 bp, Homo sapiens
gccaggacgaattgaga

SEQ ID NO: 1553215 - DNA, 22 bp, Homo sapiens
gccaggacgtctggggtgtggg

SEQ ID NO: 1553216 - DNA, 12 bp, Homo sapiens
gccaggactgtg

SEQ ID NO: 1553217 - DNA, 15 bp, Homo sapiens
gccaggagccgggcc

SEQ ID NO: 1553218 - DNA, 19 bp, Homo sapiens
gccaggaggttggtgactg

SEQ ID NO: 1553219 - DNA, 20 bp, Homo sapiens
gccaggaggttggtgactga

SEQ ID NO: 1553220 - DNA, 15 bp, Homo sapiens
gccaggagtctgtgc

SEQ ID NO: 1553221 - DNA, 16 bp, Homo sapiens
gccaggagtctgtgct

SEQ ID NO: 1553222 - DNA, 19 bp, Homo sapiens
gccaggagtttgagaccag

SEQ ID NO: 1553223 - DNA, 14 bp, Homo sapiens
gccaggatgcccag

SEQ ID NO: 1553224 - DNA, 15 bp, Homo sapiens
gccaggcacagggcc

SEQ ID NO: 1553225 - DNA, 16 bp, Homo sapiens
gccaggcacagggccc

SEQ ID NO: 1553226 - DNA, 17 bp, Homo sapiens
gccaggcacagggcccg

SEQ ID NO: 1553227 - DNA, 14 bp, Homo sapiens
gccaggcacccatg

SEQ ID NO: 1553228 - DNA, 23 bp, Homo sapiens
gccaggcacctggcctgctggga

SEQ ID NO: 1553229 - DNA, 15 bp, Homo sapiens
gccaggcagagctga

SEQ ID NO: 1553230 - DNA, 15 bp, Homo sapiens
gccaggcagatctgt

SEQ ID NO: 1553231 - DNA, 23 bp, Homo sapiens
gccaggcaggcgggggctgctca

SEQ ID NO: 1553232 - DNA, 15 bp, Homo sapiens
gccaggcaggggtgg

SEQ ID NO: 1553233 - DNA, 22 bp, Homo sapiens
gccaggccaacagcacctcccc

SEQ ID NO: 1553234 - DNA, 24 bp, Homo sapiens
gccaggccaatgttgctgatggcc

SEQ ID NO: 1553235 - DNA, 13 bp, Homo sapiens
gccaggccagcct

SEQ ID NO: 1553236 - DNA, 14 bp, Homo sapiens
gccaggccagcctc

SEQ ID NO: 1553237 - DNA, 15 bp, Homo sapiens
gccaggccagcctcc

SEQ ID NO: 1553238 - DNA, 19 bp, Homo sapiens
gccaggccagcctccgaga

SEQ ID NO: 1553239 - DNA, 22 bp, Homo sapiens
gccaggcccgcaccccggcctc

SEQ ID NO: 1553240 - DNA, 17 bp, Homo sapiens
gccaggcccggggctgg

SEQ ID NO: 1553241 - DNA, 18 bp, Homo sapiens
gccaggccgcgcccagca

SEQ ID NO: 1553242 - DNA, 19 bp, Homo sapiens
gccaggccgcgcccagcag

SEQ ID NO: 1553243 - DNA, 13 bp, Homo sapiens
gccaggccgggcc

SEQ ID NO: 1553244 - DNA, 22 bp, Homo sapiens
gccaggcgcggtggctcacgcc

SEQ ID NO: 1553245 - DNA, 14 bp, Homo sapiens
gccaggcgctgcag

SEQ ID NO: 1553246 - DNA, 17 bp, Homo sapiens
gccaggctcactcacag

SEQ ID NO: 1553247 - DNA, 19 bp, Homo sapiens
gccaggctccttcctgtct

SEQ ID NO: 1553248 - DNA, 14 bp, Homo sapiens
gccaggctgttgga

SEQ ID NO: 1553249 - DNA, 18 bp, Homo sapiens
gccagggaacagccccag

SEQ ID NO: 1553250 - DNA, 14 bp, Homo sapiens
gccagggacccagg

SEQ ID NO: 1553251 - DNA, 16 bp, Homo sapiens
gccagggacccaggtg

SEQ ID NO: 1553252 - DNA, 20 bp, Homo sapiens
gccagggacccaggtgtgcc

SEQ ID NO: 1553253 - DNA, 16 bp, Homo sapiens
gccagggacccccaga

SEQ ID NO: 1553254 - DNA, 16 bp, Homo sapiens
gccagggagaagctcc

SEQ ID NO: 1553255 - DNA, 11 bp, Homo sapiens
gccagggagct

SEQ ID NO: 1553256 - DNA, 23 bp, Homo sapiens
gccagggatgggcagcccaacag

SEQ ID NO: 1553257 - DNA, 16 bp, Homo sapiens
gccagggcagaggaat

SEQ ID NO: 1553258 - DNA, 12 bp, Homo sapiens
gccagggcagca

SEQ ID NO: 1553259 - DNA, 20 bp, Homo sapiens
gccagggccacgctccagct

SEQ ID NO: 1553260 - DNA, 15 bp, Homo sapiens
gccagggccctgcag

SEQ ID NO: 1553261 - DNA, 14 bp, Homo sapiens
gccagggccgcggc

SEQ ID NO: 1553262 - DNA, 20 bp, Homo sapiens
gccagggccgcggccgcccg

SEQ ID NO: 1553263 - DNA, 18 bp, Homo sapiens
gccagggctcaccagctg

SEQ ID NO: 1553264 - DNA, 23 bp, Homo sapiens
gccagggctcctgtggcagctgc

SEQ ID NO: 1553265 - DNA, 10 bp, Homo sapiens
gccagggctg

SEQ ID NO: 1553266 - DNA, 11 bp, Homo sapiens
gccagggctgc

SEQ ID NO: 1553267 - DNA, 12 bp, Homo sapiens
gccagggctggg

SEQ ID NO: 1553268 - DNA, 14 bp, Homo sapiens
gccagggctgggga

SEQ ID NO: 1553269 - DNA, 19 bp, Homo sapiens
gccagggctggggacagag

SEQ ID NO: 1553270 - DNA, 21 bp, Homo sapiens
gccagggctggggacagaggg

SEQ ID NO: 1553271 - DNA, 13 bp, Homo sapiens
gccaggggcgagg

SEQ ID NO: 1553272 - DNA, 19 bp, Homo sapiens
gccaggggcgaggcccttc

SEQ ID NO: 1553273 - DNA, 22 bp, Homo sapiens
gccagggtgggaagagaagaaa

SEQ ID NO: 1553274 - DNA, 22 bp, Homo sapiens
gccagggttgtgctttctagca

SEQ ID NO: 1553275 - DNA, 19 bp, Homo sapiens
gccaggtacaggagaggca

SEQ ID NO: 1553276 - DNA, 23 bp, Homo sapiens
gccaggtactgcattctctccca

SEQ ID NO: 1553277 - DNA, 18 bp, Homo sapiens
gccaggtccctggaccag

SEQ ID NO: 1553278 - DNA, 20 bp, Homo sapiens
gccaggtccctggaccagcc

SEQ ID NO: 1553279 - DNA, 20 bp, Homo sapiens
gccagtaacgcgtcttcctg

SEQ ID NO: 1553280 - DNA, 15 bp, Homo sapiens
gccagtaggagacac

SEQ ID NO: 1553281 - DNA, 22 bp, Homo sapiens
gccagtaggagacacgacagca

SEQ ID NO: 1553282 - DNA, 21 bp, Homo sapiens
gccagtatctatatatgtgta

SEQ ID NO: 1553283 - DNA, 22 bp, Homo sapiens
gccagtatctatatatgtgtat

SEQ ID NO: 1553284 - DNA, 18 bp, Homo sapiens
gccagtcactgctgcaag

SEQ ID NO: 1553285 - DNA, 14 bp, Homo sapiens
gccagtccaggctg

SEQ ID NO: 1553286 - DNA, 21 bp, Homo sapiens
gccagtccaggctgccgtggg

SEQ ID NO: 1553287 - DNA, 22 bp, Homo sapiens
gccagtccccgaggagctgggc

SEQ ID NO: 1553288 - DNA, 18 bp, Homo sapiens
gccagtccccgctagtgg

SEQ ID NO: 1553289 - DNA, 18 bp, Homo sapiens
gccagtcctgcctggcca

SEQ ID NO: 1553290 - DNA, 20 bp, Homo sapiens
gccagtcctgcctggccagg

SEQ ID NO: 1553291 - DNA, 15 bp, Homo sapiens
gccagtcctgctacc

SEQ ID NO: 1553292 - DNA, 14 bp, Homo sapiens
gccagtctcagaga

SEQ ID NO: 1553293 - DNA, 18 bp, Homo sapiens
gccagtctcagagaccag

SEQ ID NO: 1553294 - DNA, 23 bp, Homo sapiens
gccagtctcagagaccagcactc

SEQ ID NO: 1553295 - DNA, 14 bp, Homo sapiens
gccagtctgcccga

SEQ ID NO: 1553296 - DNA, 15 bp, Homo sapiens
gccagtcttcctctt

SEQ ID NO: 1553297 - DNA, 19 bp, Homo sapiens
gccagtcttgcctaggcca

SEQ ID NO: 1553298 - DNA, 15 bp, Homo sapiens
gccacgctccagctg

SEQ ID NO: 1553299 - DNA, 16 bp, Homo sapiens
gccacgctccagctgc

SEQ ID NO: 1553300 - DNA, 14 bp, Homo sapiens
gccacggccccggg

SEQ ID NO: 1553301 - DNA, 17 bp, Homo sapiens
gccacggcctggctggt

SEQ ID NO: 1553302 - DNA, 16 bp, Homo sapiens
gccagcgtctgttgtg

SEQ ID NO: 1553303 - DNA, 15 bp, Homo sapiens
gccagcgtgtggagc

SEQ ID NO: 1553304 - DNA, 17 bp, Homo sapiens
gccagcgtgtggagcag

SEQ ID NO: 1553305 - DNA, 13 bp, Homo sapiens
gccagctccctct

SEQ ID NO: 1553306 - DNA, 22 bp, Homo sapiens
gccagctccttggggcagggcc

SEQ ID NO: 1553307 - DNA, 16 bp, Homo sapiens
gccagctctagttttc

SEQ ID NO: 1553308 - DNA, 13 bp, Homo sapiens
gccagctctcagc

SEQ ID NO: 1553309 - DNA, 15 bp, Homo sapiens
gccagctctcagcca

SEQ ID NO: 1553310 - DNA, 22 bp, Homo sapiens
gccagctgccctatgggcctgc

SEQ ID NO: 1553311 - DNA, 15 bp, Homo sapiens
gccagctgccgacca

SEQ ID NO: 1553312 - DNA, 13 bp, Homo sapiens
gccagctgccttc

SEQ ID NO: 1553313 - DNA, 13 bp, Homo sapiens
gccagctgcttga

SEQ ID NO: 1553314 - DNA, 13 bp, Homo sapiens
gccagctgctttt

SEQ ID NO: 1553315 - DNA, 16 bp, Homo sapiens
gccagctgggcccagc

SEQ ID NO: 1553316 - DNA, 15 bp, Homo sapiens
gccagcttctctctc

SEQ ID NO: 1553317 - DNA, 16 bp, Homo sapiens
gccagcttctctctcc

SEQ ID NO: 1553318 - DNA, 18 bp, Homo sapiens
gccagcttggggccacca

SEQ ID NO: 1553319 - DNA, 20 bp, Homo sapiens
gccaggacaccgggcagggc

SEQ ID NO: 1553320 - DNA, 15 bp, Homo sapiens
gccaggacaggcccg

SEQ ID NO: 1553321 - DNA, 14 bp, Homo sapiens
gccaggaccagcct

SEQ ID NO: 1553322 - DNA, 15 bp, Homo sapiens
gccaggaccagcctg

SEQ ID NO: 1553323 - DNA, 16 bp, Homo sapiens
gccaggaccagcctgt

SEQ ID NO: 1553324 - DNA, 18 bp, Homo sapiens
gccaggaccctgacctcc

SEQ ID NO: 1553325 - DNA, 13 bp, Homo sapiens
gcactgagggcca

SEQ ID NO: 1553326 - DNA, 15 bp, Homo sapiens
gcactgagggccaca

SEQ ID NO: 1553327 - DNA, 19 bp, Homo sapiens
gcactgatggaaaatacca

SEQ ID NO: 1553328 - DNA, 17 bp, Homo sapiens
gcactgatgttgtgttt

SEQ ID NO: 1553329 - DNA, 20 bp, Homo sapiens
gcactgatgttgtgttttta

SEQ ID NO: 1553330 - DNA, 20 bp, Homo sapiens
gcactgatttcacaacagat

SEQ ID NO: 1553331 - DNA, 19 bp, Homo sapiens
gcactgcattcctgtgccc

SEQ ID NO: 1553332 - DNA, 18 bp, Homo sapiens
gcactgcctgcatgagct

SEQ ID NO: 1553333 - DNA, 13 bp, Homo sapiens
gcactgcgcctgt

SEQ ID NO: 1553334 - DNA, 17 bp, Homo sapiens
gcactggaaccacctgg

SEQ ID NO: 1553335 - DNA, 20 bp, Homo sapiens
gcactggaggggcccaccca

SEQ ID NO: 1553336 - DNA, 12 bp, Homo sapiens
gcactggccaga

SEQ ID NO: 1553337 - DNA, 13 bp, Homo sapiens
gcactggccagag

SEQ ID NO: 1553338 - DNA, 18 bp, Homo sapiens
gcactgggccacggagga

SEQ ID NO: 1553339 - DNA, 15 bp, Homo sapiens
gcactggggagcccg

SEQ ID NO: 1553340 - DNA, 14 bp, Homo sapiens
gcactggggtgggg

SEQ ID NO: 1553341 - DNA, 19 bp, Homo sapiens
gcactggtggcccgacagc

SEQ ID NO: 1553342 - DNA, 22 bp, Homo sapiens
gcactggtggcccgacagcctg

SEQ ID NO: 1553343 - DNA, 9 bp, Homo sapiens
gcactgtaa

SEQ ID NO: 1553344 - DNA, 16 bp, Homo sapiens
gcactgtaaaatgtgg

SEQ ID NO: 1553345 - DNA, 23 bp, Homo sapiens
gcactgtaaaatgtgggattatg

SEQ ID NO: 1553346 - DNA, 19 bp, Homo sapiens
gcactgtaatgaggaaaaa

SEQ ID NO: 1553347 - DNA, 16 bp, Homo sapiens
gcactgtagttctaag

SEQ ID NO: 1553348 - DNA, 18 bp, Homo sapiens
gcactgtagttctaagac

SEQ ID NO: 1553349 - DNA, 22 bp, Homo sapiens
gcactgtcccagtagccaaggc

SEQ ID NO: 1553350 - DNA, 22 bp, Homo sapiens
gcactgtgaacctgggcactcc

SEQ ID NO: 1553351 - DNA, 16 bp, Homo sapiens
gcactgtgaaggaccc

SEQ ID NO: 1553352 - DNA, 17 bp, Homo sapiens
gcactgtgaatcctggc

SEQ ID NO: 1553353 - DNA, 18 bp, Homo sapiens
gcactgttgagaaggaga

SEQ ID NO: 1553354 - DNA, 14 bp, Homo sapiens
gcacttaaacagaa

SEQ ID NO: 1553355 - DNA, 19 bp, Homo sapiens
gcacttaaggcactctgtt

SEQ ID NO: 1553356 - DNA, 16 bp, Homo sapiens
gcacttaagtgcactt

SEQ ID NO: 1553357 - DNA, 20 bp, Homo sapiens
gcacttatcagcatgaagaa

SEQ ID NO: 1553358 - DNA, 16 bp, Homo sapiens
gcacttatgatttcat

SEQ ID NO: 1553359 - DNA, 13 bp, Homo sapiens
gcacttgcctggg

SEQ ID NO: 1553360 - DNA, 22 bp, Homo sapiens
gcacttgcctgttggctgctgc

SEQ ID NO: 1553361 - DNA, 16 bp, Homo sapiens
gcacttggagccaagg

SEQ ID NO: 1553362 - DNA, 22 bp, Homo sapiens
gcacttggagccaagggttcag

SEQ ID NO: 1553363 - DNA, 22 bp, Homo sapiens
gcacttgggggttcaggcccgg

SEQ ID NO: 1553364 - DNA, 15 bp, Homo sapiens
gcacttgtatatacg

SEQ ID NO: 1553365 - DNA, 14 bp, Homo sapiens
gcacttgtatttaa

SEQ ID NO: 1553366 - DNA, 17 bp, Homo sapiens
gcacttgtatttaattc

SEQ ID NO: 1553367 - DNA, 21 bp, Homo sapiens
gcacttgtgattatttattat

SEQ ID NO: 1553368 - DNA, 16 bp, Homo sapiens
gcactttcccccttcc

SEQ ID NO: 1553369 - DNA, 18 bp, Homo sapiens
gcactttcccccttcccg

SEQ ID NO: 1553370 - DNA, 15 bp, Homo sapiens
gcactttgagaggct

SEQ ID NO: 1553371 - DNA, 14 bp, Homo sapiens
gcactttgcactta

SEQ ID NO: 1553372 - DNA, 15 bp, Homo sapiens
gcactttgcacttaa

SEQ ID NO: 1553373 - DNA, 17 bp, Homo sapiens
gcactttgggaggcagg

SEQ ID NO: 1553374 - DNA, 22 bp, Homo sapiens
gcactttgggaggccgaggcgg

SEQ ID NO: 1553375 - DNA, 14 bp, Homo sapiens
gcacttttagaaat

SEQ ID NO: 1553376 - DNA, 20 bp, Homo sapiens
gcacttttttatgaagaaaa

SEQ ID NO: 1553377 - DNA, 14 bp, Homo sapiens
gcagaaaagaggag

SEQ ID NO: 1553378 - DNA, 15 bp, Homo sapiens
gcagaaaagcacctg

SEQ ID NO: 1553379 - DNA, 16 bp, Homo sapiens
gcagaaaagcacctgc

SEQ ID NO: 1553380 - DNA, 17 bp, Homo sapiens
gcagaaaagcacctgcc

SEQ ID NO: 1553381 - DNA, 20 bp, Homo sapiens
gcagaaagatacagacattc

SEQ ID NO: 1553382 - DNA, 23 bp, Homo sapiens
gcagaaagcaaatgtgacctgtg

SEQ ID NO: 1553383 - DNA, 19 bp, Homo sapiens
gcagaaagcatccctcacc

SEQ ID NO: 1553384 - DNA, 20 bp, Homo sapiens
gcagaaagcatccctcaccc

SEQ ID NO: 1553385 - DNA, 16 bp, Homo sapiens
gcagaaagggccaccc

SEQ ID NO: 1553386 - DNA, 19 bp, Homo sapiens
gcagaaatcctgcaatgaa

SEQ ID NO: 1553387 - DNA, 16 bp, Homo sapiens
gcagaaatcgagagtg

SEQ ID NO: 1553388 - DNA, 14 bp, Homo sapiens
gcagaaatctagaa

SEQ ID NO: 1553389 - DNA, 15 bp, Homo sapiens
gcagaaatctagaag

SEQ ID NO: 1553390 - DNA, 16 bp, Homo sapiens
gcagaaatctgaggaa

SEQ ID NO: 1553391 - DNA, 15 bp, Homo sapiens
gcagaaattctgttt

SEQ ID NO: 1553392 - DNA, 16 bp, Homo sapiens
gcagaaattctgtttt

SEQ ID NO: 1553393 - DNA, 14 bp, Homo sapiens
gcagaacaaatgtg

SEQ ID NO: 1553394 - DNA, 20 bp, Homo sapiens
gcagaacactgcagtcagat

SEQ ID NO: 1553395 - DNA, 16 bp, Homo sapiens
gcagaacccccaggtg

SEQ ID NO: 1553396 - DNA, 18 bp, Homo sapiens
gcagaacctgcacacagg

SEQ ID NO: 1553397 - DNA, 21 bp, Homo sapiens
gcagaacctgcacacaggaca

SEQ ID NO: 1553398 - DNA, 23 bp, Homo sapiens
gcagaacctgcacacaggacagc

SEQ ID NO: 1553399 - DNA, 19 bp, Homo sapiens
gcagaacggaggaggctgc

SEQ ID NO: 1553400 - DNA, 21 bp, Homo sapiens
gcagaacgtattggtccagct

SEQ ID NO: 1553401 - DNA, 22 bp, Homo sapiens
gcagaagaatgggaatatttta

SEQ ID NO: 1553402 - DNA, 21 bp, Homo sapiens
gcagaagagagtggggcctgc

SEQ ID NO: 1553403 - DNA, 14 bp, Homo sapiens
gcagaagagggtgt

SEQ ID NO: 1553404 - DNA, 18 bp, Homo sapiens
gcagaagcattgcctgga

SEQ ID NO: 1553405 - DNA, 21 bp, Homo sapiens
gcagaagcattgcctggactg

SEQ ID NO: 1553406 - DNA, 19 bp, Homo sapiens
gcagaagccaagggaagac

SEQ ID NO: 1553407 - DNA, 22 bp, Homo sapiens
gcagaagccaagggaagacagt

SEQ ID NO: 1553408 - DNA, 21 bp, Homo sapiens
gcagaaggaaagaagggggcc

SEQ ID NO: 1553409 - DNA, 23 bp, Homo sapiens
gcagaaggaaagaagggggccct

SEQ ID NO: 1553410 - DNA, 12 bp, Homo sapiens
gcagaaggagag

SEQ ID NO: 1553411 - DNA, 13 bp, Homo sapiens
gcagaagggaatt

SEQ ID NO: 1553412 - DNA, 14 bp, Homo sapiens
gcagaagggggtgg

SEQ ID NO: 1553413 - DNA, 15 bp, Homo sapiens
gcagaagtctggctt

SEQ ID NO: 1553414 - DNA, 16 bp, Homo sapiens
gcagaagtgctctttg

SEQ ID NO: 1553415 - DNA, 15 bp, Homo sapiens
gcagaatactggtct

SEQ ID NO: 1553416 - DNA, 20 bp, Homo sapiens
gcagaatatgacaatctacc

SEQ ID NO: 1553417 - DNA, 17 bp, Homo sapiens
gcagaatggaggcaggg

SEQ ID NO: 1553418 - DNA, 18 bp, Homo sapiens
gcagacaaagccctgtcc

SEQ ID NO: 1553419 - DNA, 19 bp, Homo sapiens
gcagacaaagccctgtcct

SEQ ID NO: 1553420 - DNA, 22 bp, Homo sapiens
gcagacaatagtatagaagtct

SEQ ID NO: 1553421 - DNA, 15 bp, Homo sapiens
gcagacaccttggac

SEQ ID NO: 1553422 - DNA, 20 bp, Homo sapiens
gcagacacgccttcccctca

SEQ ID NO: 1553423 - DNA, 15 bp, Homo sapiens
gcagacagagccagg

SEQ ID NO: 1553424 - DNA, 17 bp, Homo sapiens
gcagacagagccaggag

SEQ ID NO: 1553425 - DNA, 14 bp, Homo sapiens
gcagacagagggga

SEQ ID NO: 1553426 - DNA, 18 bp, Homo sapiens
gcagacagcagctcaggc

SEQ ID NO: 1553427 - DNA, 19 bp, Homo sapiens
gcagacagcagctcaggca

SEQ ID NO: 1553428 - DNA, 19 bp, Homo sapiens
gcagacagccatgcgtggc

SEQ ID NO: 1553429 - DNA, 21 bp, Homo sapiens
gcagacagtctgttatgcact

SEQ ID NO: 1553430 - DNA, 22 bp, Homo sapiens
gcagacccagcttagagttctt

SEQ ID NO: 1553431 - DNA, 14 bp, Homo sapiens
gcagacctcatgcc

SEQ ID NO: 1553432 - DNA, 16 bp, Homo sapiens
gcagacgggcacagac

SEQ ID NO: 1553433 - DNA, 22 bp, Homo sapiens
gcagactccaatggggccagca

SEQ ID NO: 1553434 - DNA, 17 bp, Homo sapiens
gcagactgtgaacttga

SEQ ID NO: 1553435 - DNA, 22 bp, Homo sapiens
gcagactgtgaacttgactggg

SEQ ID NO: 1553436 - DNA, 16 bp, Homo sapiens
gcagacttcccagcta

SEQ ID NO: 1553437 - DNA, 14 bp, Homo sapiens
gcagagaaggcctc

SEQ ID NO: 1553438 - DNA, 20 bp, Homo sapiens
gcagagaatggctgggtcag

SEQ ID NO: 1553439 - DNA, 17 bp, Homo sapiens
gcagagacactttgtct

SEQ ID NO: 1553440 - DNA, 18 bp, Homo sapiens
gcagagagccaaatctga

SEQ ID NO: 1553441 - DNA, 20 bp, Homo sapiens
gcaggatcgaagggttttta

SEQ ID NO: 1553442 - DNA, 17 bp, Homo sapiens
gcaggatctcaagccag

SEQ ID NO: 1553443 - DNA, 20 bp, Homo sapiens
gcaggatctcaagccagccc

SEQ ID NO: 1553444 - DNA, 16 bp, Homo sapiens
gcaggattcccttctg

SEQ ID NO: 1553445 - DNA, 15 bp, Homo sapiens
gcaggattcttcccg

SEQ ID NO: 1553446 - DNA, 22 bp, Homo sapiens
gcaggattcttcccgctcccca

SEQ ID NO: 1553447 - DNA, 23 bp, Homo sapiens
gcaggattcttcccgctccccac

SEQ ID NO: 1553448 - DNA, 14 bp, Homo sapiens
gcaggattgaaaat

SEQ ID NO: 1553449 - DNA, 22 bp, Homo sapiens
gcaggattgaaaatgtccagga

SEQ ID NO: 1553450 - DNA, 15 bp, Homo sapiens
gcaggcacatggagg

SEQ ID NO: 1553451 - DNA, 14 bp, Homo sapiens
gcaggcaccgccac

SEQ ID NO: 1553452 - DNA, 16 bp, Homo sapiens
gcaggcagccttgacc

SEQ ID NO: 1553453 - DNA, 16 bp, Homo sapiens
gcaggcaggtggactg

SEQ ID NO: 1553454 - DNA, 13 bp, Homo sapiens
gcaggcatggccc

SEQ ID NO: 1553455 - DNA, 15 bp, Homo sapiens
gcaggcatggccctg

SEQ ID NO: 1553456 - DNA, 21 bp, Homo sapiens
gcaggccaaggccttctcctc

SEQ ID NO: 1553457 - DNA, 16 bp, Homo sapiens
gcaggcccactcccca

SEQ ID NO: 1553458 - DNA, 20 bp, Homo sapiens
gcaggcccactccccagccc

SEQ ID NO: 1553459 - DNA, 15 bp, Homo sapiens
gcaggcccagcatgc

SEQ ID NO: 1553460 - DNA, 23 bp, Homo sapiens
gcaggcccttcccattctgcccc

SEQ ID NO: 1553461 - DNA, 23 bp, Homo sapiens
gcaggcctccaacgcccctgtgg

SEQ ID NO: 1553462 - DNA, 12 bp, Homo sapiens
gcaggcctgaga

SEQ ID NO: 1553463 - DNA, 12 bp, Homo sapiens
gcaggcctggga

SEQ ID NO: 1553464 - DNA, 18 bp, Homo sapiens
gcaggcctgggacccagc

SEQ ID NO: 1553465 - DNA, 20 bp, Homo sapiens
gcaggcctgggacccagcta

SEQ ID NO: 1553466 - DNA, 23 bp, Homo sapiens
gcaggcgacaaaatctcctggct

SEQ ID NO: 1553467 - DNA, 21 bp, Homo sapiens
gcaggcgcctataatcccagc

SEQ ID NO: 1553468 - DNA, 17 bp, Homo sapiens
gcaggctcactgccagg

SEQ ID NO: 1553469 - DNA, 19 bp, Homo sapiens
gcaggctcactgccaggcc

SEQ ID NO: 1553470 - DNA, 23 bp, Homo sapiens
gcaggctcactgccaggccagcc

SEQ ID NO: 1553471 - DNA, 20 bp, Homo sapiens
gcaggctccatgcacctccc

SEQ ID NO: 1553472 - DNA, 23 bp, Homo sapiens
gcaggctccatgcacctcccttc

SEQ ID NO: 1553473 - DNA, 19 bp, Homo sapiens
gcaggctcctggctgtgcc

SEQ ID NO: 1553474 - DNA, 20 bp, Homo sapiens
gcaggctcctggctgtgccc

SEQ ID NO: 1553475 - DNA, 12 bp, Homo sapiens
gcaggctctggg

SEQ ID NO: 1553476 - DNA, 13 bp, Homo sapiens
gcaggctctgggc

SEQ ID NO: 1553477 - DNA, 15 bp, Homo sapiens
gcaggctctgggctc

SEQ ID NO: 1553478 - DNA, 21 bp, Homo sapiens
gcaggctctgggctcagggct

SEQ ID NO: 1553479 - DNA, 22 bp, Homo sapiens
gcaggctctgggctcagggctg

SEQ ID NO: 1553480 - DNA, 14 bp, Homo sapiens
gcaggctggccagt

SEQ ID NO: 1553481 - DNA, 12 bp, Homo sapiens
gcaggctgggcc

SEQ ID NO: 1553482 - DNA, 14 bp, Homo sapiens
gcaggctgggccat

SEQ ID NO: 1553483 - DNA, 15 bp, Homo sapiens
gcaggcttggggaaa

SEQ ID NO: 1553484 - DNA, 21 bp, Homo sapiens
gcaggcttggggaaaatggcc

SEQ ID NO: 1553485 - DNA, 15 bp, Homo sapiens
gcagggaaagctcca

SEQ ID NO: 1553486 - DNA, 16 bp, Homo sapiens
gcagggaaagctccac

SEQ ID NO: 1553487 - DNA, 23 bp, Homo sapiens
gcagggaagccccacatgtccag

SEQ ID NO: 1553488 - DNA, 19 bp, Homo sapiens
gcagggaaggacaggaccc

SEQ ID NO: 1553489 - DNA, 14 bp, Homo sapiens
gcagggaaggcctg

SEQ ID NO: 1553490 - DNA, 15 bp, Homo sapiens
gcagggaatgcagca

SEQ ID NO: 1553491 - DNA, 17 bp, Homo sapiens
gcagggaatgcagcagg

SEQ ID NO: 1553492 - DNA, 22 bp, Homo sapiens
gcagggaatgcagcaggaagga

SEQ ID NO: 1553493 - DNA, 21 bp, Homo sapiens
gcagggacccggggtctcctg

SEQ ID NO: 1553494 - DNA, 22 bp, Homo sapiens
gcagggacccggggtctcctgg

SEQ ID NO: 1553495 - DNA, 23 bp, Homo sapiens
gcagggacccggggtctcctgga

SEQ ID NO: 1553496 - DNA, 15 bp, Homo sapiens
gcagggacctgagag

SEQ ID NO: 1553497 - DNA, 17 bp, Homo sapiens
gcagggacctgagagca

SEQ ID NO: 1553498 - DNA, 14 bp, Homo sapiens
gcagggagggcagt

SEQ ID NO: 1553499 - DNA, 15 bp, Homo sapiens
gcagggaggggacta

SEQ ID NO: 1553500 - DNA, 14 bp, Homo sapiens
gcagggaggggagg

SEQ ID NO: 1553501 - DNA, 17 bp, Homo sapiens
gcagggagtgtctgcag

SEQ ID NO: 1553502 - DNA, 21 bp, Homo sapiens
gcagggatgatggcagagcca

SEQ ID NO: 1553503 - DNA, 15 bp, Homo sapiens
gcagggattgctgcc

SEQ ID NO: 1553504 - DNA, 15 bp, Homo sapiens
gcagggcagagggaa

SEQ ID NO: 1553505 - DNA, 19 bp, Homo sapiens
gcagggccaaagcacagct

SEQ ID NO: 1553506 - DNA, 14 bp, Homo sapiens
gcagggccatccac

SEQ ID NO: 1553507 - DNA, 21 bp, Homo sapiens
gcagggccatgcagacctcat

SEQ ID NO: 1553508 - DNA, 13 bp, Homo sapiens
gcagggccatggc

SEQ ID NO: 1553509 - DNA, 16 bp, Homo sapiens
gcagggccatggctca

SEQ ID NO: 1553510 - DNA, 21 bp, Homo sapiens
gcagggccgcccgggcccaga

SEQ ID NO: 1553511 - DNA, 21 bp, Homo sapiens
gcagggcggtctcactcccag

SEQ ID NO: 1553512 - DNA, 17 bp, Homo sapiens
gcagggctcccacagag

SEQ ID NO: 1553513 - DNA, 13 bp, Homo sapiens
gcagggctgtgct

SEQ ID NO: 1553514 - DNA, 20 bp, Homo sapiens
gcaggggaattccctccccc

SEQ ID NO: 1553515 - DNA, 19 bp, Homo sapiens
gcaggggaattttctctcc

SEQ ID NO: 1553516 - DNA, 21 bp, Homo sapiens
gcaggggaattttctctccat

SEQ ID NO: 1553517 - DNA, 14 bp, Homo sapiens
gcaggggactgtct

SEQ ID NO: 1553518 - DNA, 14 bp, Homo sapiens
gcaggggcctctgt

SEQ ID NO: 1553519 - DNA, 13 bp, Homo sapiens
gcaggggcctgga

SEQ ID NO: 1553520 - DNA, 14 bp, Homo sapiens
gcaggggcctggag

SEQ ID NO: 1553521 - DNA, 20 bp, Homo sapiens
gcaggggcttgttgcaggct

SEQ ID NO: 1553522 - DNA, 20 bp, Homo sapiens
gcagggggccccgccagggc

SEQ ID NO: 1553523 - DNA, 17 bp, Homo sapiens
gcaggggggctgtgcca

SEQ ID NO: 1553524 - DNA, 19 bp, Homo sapiens
gcaggggtcagtgcagcag

SEQ ID NO: 1553525 - DNA, 18 bp, Homo sapiens
gcaggggtgctgtggaca

SEQ ID NO: 1553526 - DNA, 22 bp, Homo sapiens
gcaggggtggctgcctcattta

SEQ ID NO: 1553527 - DNA, 21 bp, Homo sapiens
gcaggggtgggggtggaggct

SEQ ID NO: 1553528 - DNA, 23 bp, Homo sapiens
gcaggggtgggggtggaggcttc

SEQ ID NO: 1553529 - DNA, 14 bp, Homo sapiens
gcagggtcttcctg

SEQ ID NO: 1553530 - DNA, 20 bp, Homo sapiens
gcagggtcttcctgcagtgc

SEQ ID NO: 1553531 - DNA, 13 bp, Homo sapiens
gcagggtgcagga

SEQ ID NO: 1553532 - DNA, 14 bp, Homo sapiens
gcagggtgcaggag

SEQ ID NO: 1553533 - DNA, 15 bp, Homo sapiens
gcagggtggtgctgg

SEQ ID NO: 1553534 - DNA, 19 bp, Homo sapiens
gcaggtggactgactgtgt

SEQ ID NO: 1553535 - DNA, 22 bp, Homo sapiens
gcaggtggactgactgtgttgg

SEQ ID NO: 1553536 - DNA, 19 bp, Homo sapiens
gcaggtggatctatttcat

SEQ ID NO: 1553537 - DNA, 18 bp, Homo sapiens
gcaggtggccgcccctga

SEQ ID NO: 1553538 - DNA, 15 bp, Homo sapiens
gcaggtgggagctga

SEQ ID NO: 1553539 - DNA, 15 bp, Homo sapiens
gcaggtgggctgcct

SEQ ID NO: 1553540 - DNA, 22 bp, Homo sapiens
gcaggtgggctgcctgctgtgt

SEQ ID NO: 1553541 - DNA, 17 bp, Homo sapiens
gcaggtgggctggactt

SEQ ID NO: 1553542 - DNA, 20 bp, Homo sapiens
gcaggtggtggcactgagcc

SEQ ID NO: 1553543 - DNA, 21 bp, Homo sapiens
gcaggtgtcatatgactgatt

SEQ ID NO: 1553544 - DNA, 13 bp, Homo sapiens
gcaggtgtttctt

SEQ ID NO: 1553545 - DNA, 18 bp, Homo sapiens
gcaggttatgtcagcagc

SEQ ID NO: 1553546 - DNA, 19 bp, Homo sapiens
gcaggttatgtcagcagct

SEQ ID NO: 1553547 - DNA, 15 bp, Homo sapiens
gcaggttccccaagg

SEQ ID NO: 1553548 - DNA, 20 bp, Homo sapiens
gcaggttccccaagggccct

SEQ ID NO: 1553549 - DNA, 23 bp, Homo sapiens
gcaggttccccaagggccctggc

SEQ ID NO: 1553550 - DNA, 15 bp, Homo sapiens
gcaggttcttgatgt

SEQ ID NO: 1553551 - DNA, 20 bp, Homo sapiens
gcaggttgaggggctcctgg

SEQ ID NO: 1553552 - DNA, 21 bp, Homo sapiens
gcaggttgaggggctcctgga

SEQ ID NO: 1553553 - DNA, 14 bp, Homo sapiens
gcagtaaaaactgt

SEQ ID NO: 1553554 - DNA, 15 bp, Homo sapiens
gcagtaaatttgcta

SEQ ID NO: 1553555 - DNA, 16 bp, Homo sapiens
gcagtaacttgggagt

SEQ ID NO: 1553556 - DNA, 14 bp, Homo sapiens
gcagtacctgggaa

SEQ ID NO: 1553557 - DNA, 18 bp, Homo sapiens
gcagtacctgggaaagga

SEQ ID NO: 1553558 - DNA, 17 bp, Homo sapiens
gcagtatgatggcagga

SEQ ID NO: 1553559 - DNA, 17 bp, Homo sapiens
gcagtattttgtgtcct

SEQ ID NO: 1553560 - DNA, 19 bp, Homo sapiens
gcagtcaacagttcaaaga

SEQ ID NO: 1553561 - DNA, 13 bp, Homo sapiens
gcagtcagccctg

SEQ ID NO: 1553562 - DNA, 16 bp, Homo sapiens
gcagtccccagccctt

SEQ ID NO: 1553563 - DNA, 16 bp, Homo sapiens
gcagtcctcaggaagg

SEQ ID NO: 1553564 - DNA, 14 bp, Homo sapiens
gcagtcctggaggc

SEQ ID NO: 1553565 - DNA, 20 bp, Homo sapiens
gcagtcctggtggggctgag

SEQ ID NO: 1553566 - DNA, 16 bp, Homo sapiens
gcagtcggcatgccag

SEQ ID NO: 1553567 - DNA, 16 bp, Homo sapiens
gcagtcgggggctggc

SEQ ID NO: 1553568 - DNA, 19 bp, Homo sapiens
gcagtcgtgcctgtgtcca

SEQ ID NO: 1553569 - DNA, 17 bp, Homo sapiens
gcagtctccttcagcac

SEQ ID NO: 1553570 - DNA, 18 bp, Homo sapiens
gcagtctccttcagcacg

SEQ ID NO: 1553571 - DNA, 18 bp, Homo sapiens
gcagtctcgggtggctag

SEQ ID NO: 1553572 - DNA, 22 bp, Homo sapiens
gcagtctgaacccttgtgcttg

SEQ ID NO: 1553573 - DNA, 22 bp, Homo sapiens
gcagtctgcttcagtgcagtga

SEQ ID NO: 1553574 - DNA, 14 bp, Homo sapiens
gcagtcttgctctg

SEQ ID NO: 1553575 - DNA, 14 bp, Homo sapiens
gcagtgaactattt

SEQ ID NO: 1553576 - DNA, 14 bp, Homo sapiens
gcagtgaattgtga

SEQ ID NO: 1553577 - DNA, 18 bp, Homo sapiens
gcagtgacgtgcacctgt

SEQ ID NO: 1553578 - DNA, 15 bp, Homo sapiens
gcagtgactggcagg

SEQ ID NO: 1553579 - DNA, 21 bp, Homo sapiens
gcagtgagccgcatcttctcc

SEQ ID NO: 1553580 - DNA, 15 bp, Homo sapiens
gcagtgatacatgta

SEQ ID NO: 1553581 - DNA, 21 bp, Homo sapiens
gcagtgatggcgcgggaggca

SEQ ID NO: 1553582 - DNA, 21 bp, Homo sapiens
gcagtgatggttgccaggacg

SEQ ID NO: 1553583 - DNA, 19 bp, Homo sapiens
gcagtgcccatgtgtacat

SEQ ID NO: 1553584 - DNA, 18 bp, Homo sapiens
gcagtgcctcgaggcacc

SEQ ID NO: 1553585 - DNA, 20 bp, Homo sapiens
gcagtgcctcgaggcaccgg

SEQ ID NO: 1553586 - DNA, 21 bp, Homo sapiens
gcagtgcctcgaggcaccggc

SEQ ID NO: 1553587 - DNA, 15 bp, Homo sapiens
gcagtgcctgataag

SEQ ID NO: 1553588 - DNA, 22 bp, Homo sapiens
gcagtgccttccataattatga

SEQ ID NO: 1553589 - DNA, 13 bp, Homo sapiens
gcagtgccttgca

SEQ ID NO: 1553590 - DNA, 23 bp, Homo sapiens
gcagtgccttggggaatttcctc

SEQ ID NO: 1553591 - DNA, 22 bp, Homo sapiens
gcagtgctgagggaccgagccc

SEQ ID NO: 1553592 - DNA, 15 bp, Homo sapiens
gcagtggagagggac

SEQ ID NO: 1553593 - DNA, 14 bp, Homo sapiens
gcagtggaggctgc

SEQ ID NO: 1553594 - DNA, 17 bp, Homo sapiens
gcagtggaggctgctgt

SEQ ID NO: 1553595 - DNA, 16 bp, Homo sapiens
gcagtggcaggggagc

SEQ ID NO: 1553596 - DNA, 13 bp, Homo sapiens
gcagtggccaggc

SEQ ID NO: 1553597 - DNA, 18 bp, Homo sapiens
gcagtggcccctattgag

SEQ ID NO: 1553598 - DNA, 13 bp, Homo sapiens
gcagtggcctggc

SEQ ID NO: 1553599 - DNA, 19 bp, Homo sapiens
gcagtggcgcaatctcggc

SEQ ID NO: 1553600 - DNA, 20 bp, Homo sapiens
gcagtggcgcgatctcagct

SEQ ID NO: 1553601 - DNA, 16 bp, Homo sapiens
gcagtggctcacgcct

SEQ ID NO: 1553602 - DNA, 14 bp, Homo sapiens
gcagtgggcaggtg

SEQ ID NO: 1553603 - DNA, 19 bp, Homo sapiens
gcagtgtcccctgccccag

SEQ ID NO: 1553604 - DNA, 22 bp, Homo sapiens
gcagtgtcccctgccccagagg

SEQ ID NO: 1553605 - DNA, 13 bp, Homo sapiens
gcagtgtgaggac

SEQ ID NO: 1553606 - DNA, 20 bp, Homo sapiens
gcagtgtggttatgttccca

SEQ ID NO: 1553607 - DNA, 23 bp, Homo sapiens
gcagtgttacctgttagctccct

SEQ ID NO: 1553608 - DNA, 14 bp, Homo sapiens
gcagtgtttccttt

SEQ ID NO: 1553609 - DNA, 15 bp, Homo sapiens
gcagtgtttcctttt

SEQ ID NO: 1553610 - DNA, 17 bp, Homo sapiens
gcagtgttttggttcag

SEQ ID NO: 1553611 - DNA, 20 bp, Homo sapiens
gcagttacaaattataatgt

SEQ ID NO: 1553612 - DNA, 22 bp, Homo sapiens
gcagttagctgaagaattgaaa

SEQ ID NO: 1553613 - DNA, 20 bp, Homo sapiens
gcagttatggtgatgactta

SEQ ID NO: 1553614 - DNA, 17 bp, Homo sapiens
gcagttcattgcagaca

SEQ ID NO: 1553615 - DNA, 16 bp, Homo sapiens
gcagttctagtttgca

SEQ ID NO: 1553616 - DNA, 16 bp, Homo sapiens
gcagttgaaaagactc

SEQ ID NO: 1553617 - DNA, 19 bp, Homo sapiens
gcagttggactctcaggga

SEQ ID NO: 1553618 - DNA, 16 bp, Homo sapiens
gcagttggcagaaagg

SEQ ID NO: 1553619 - DNA, 14 bp, Homo sapiens
gcagttgtgatttc

SEQ ID NO: 1553620 - DNA, 13 bp, Homo sapiens
gcagttgttaagt

SEQ ID NO: 1553621 - DNA, 13 bp, Homo sapiens
gcagtttaaagca

SEQ ID NO: 1553622 - DNA, 19 bp, Homo sapiens
gcagtttggccctggagcc

SEQ ID NO: 1553623 - DNA, 22 bp, Homo sapiens
gcagtttggccctggagccagg

SEQ ID NO: 1553624 - DNA, 16 bp, Homo sapiens
gcagttttaagaattg

SEQ ID NO: 1553625 - DNA, 15 bp, Homo sapiens
gcagttttgtaaatg

SEQ ID NO: 1553626 - DNA, 22 bp, Homo sapiens
gcagtttttcagagtggaatgc

SEQ ID NO: 1553627 - DNA, 18 bp, Homo sapiens
gcagttttttgaaaatgg

SEQ ID NO: 1553628 - DNA, 20 bp, Homo sapiens
gcataaagaattaatgactt

SEQ ID NO: 1553629 - DNA, 21 bp, Homo sapiens
gcataaagctcaaatgaaatg

SEQ ID NO: 1553630 - DNA, 13 bp, Homo sapiens
gcataagattaaa

SEQ ID NO: 1553631 - DNA, 19 bp, Homo sapiens
gcataagattaaaggaagg

SEQ ID NO: 1553632 - DNA, 14 bp, Homo sapiens
gcataataagctaa

SEQ ID NO: 1553633 - DNA, 18 bp, Homo sapiens
gcataataagctaaagag

SEQ ID NO: 1553634 - DNA, 21 bp, Homo sapiens
gcatgcctgtagtctcagcta

SEQ ID NO: 1553635 - DNA, 12 bp, Homo sapiens
gcatgcgacagc

SEQ ID NO: 1553636 - DNA, 14 bp, Homo sapiens
gcatgcgcacaagg

SEQ ID NO: 1553637 - DNA, 21 bp, Homo sapiens
gcatgcgcacaaggctgacca

SEQ ID NO: 1553638 - DNA, 15 bp, Homo sapiens
gcatgcgcagaggcc

SEQ ID NO: 1553639 - DNA, 15 bp, Homo sapiens
gcatgcgcgctgtgg

SEQ ID NO: 1553640 - DNA, 14 bp, Homo sapiens
gcatgctccctcct

SEQ ID NO: 1553641 - DNA, 15 bp, Homo sapiens
gcatgctctctgcag

SEQ ID NO: 1553642 - DNA, 17 bp, Homo sapiens
gcatgctctctgcagcc

SEQ ID NO: 1553643 - DNA, 21 bp, Homo sapiens
gcatgctctctgcagccagcc

SEQ ID NO: 1553644 - DNA, 22 bp, Homo sapiens
gcatgctctctgcagccagccc

SEQ ID NO: 1553645 - DNA, 14 bp, Homo sapiens
gcatgctctggaag

SEQ ID NO: 1553646 - DNA, 22 bp, Homo sapiens
gcatgctgaatgccccctgctt

SEQ ID NO: 1553647 - DNA, 14 bp, Homo sapiens
gcatgctgctttgc

SEQ ID NO: 1553648 - DNA, 13 bp, Homo sapiens
gcatgctggggca

SEQ ID NO: 1553649 - DNA, 15 bp, Homo sapiens
gcatgctggggcaag

SEQ ID NO: 1553650 - DNA, 16 bp, Homo sapiens
gcatgctggggcaagt

SEQ ID NO: 1553651 - DNA, 14 bp, Homo sapiens
gcatgcttaaattt

SEQ ID NO: 1553652 - DNA, 18 bp, Homo sapiens
gcatgcttcctttctctc

SEQ ID NO: 1553653 - DNA, 22 bp, Homo sapiens
gcatgcttcctttctctcctgg

SEQ ID NO: 1553654 - DNA, 20 bp, Homo sapiens
gcatgcttgggctgacccag

SEQ ID NO: 1553655 - DNA, 14 bp, Homo sapiens
gcatgctttgctgc

SEQ ID NO: 1553656 - DNA, 12 bp, Homo sapiens
gcatggaaaaat

SEQ ID NO: 1553657 - DNA, 14 bp, Homo sapiens
gcatggaaaaatgg

SEQ ID NO: 1553658 - DNA, 16 bp, Homo sapiens
gcatggaacacttcga

SEQ ID NO: 1553659 - DNA, 17 bp, Homo sapiens
gcatggacctaacattc

SEQ ID NO: 1553660 - DNA, 12 bp, Homo sapiens
gcatggagaagg

SEQ ID NO: 1553661 - DNA, 20 bp, Homo sapiens
gcatggagaagggttctgcc

SEQ ID NO: 1553662 - DNA, 21 bp, Homo sapiens
gcatggagagcctcttagtga

SEQ ID NO: 1553663 - DNA, 21 bp, Homo sapiens
gcatggcacctgtcgcccagt

SEQ ID NO: 1553664 - DNA, 22 bp, Homo sapiens
gcatggcacctgtcgcccagtg

SEQ ID NO: 1553665 - DNA, 16 bp, Homo sapiens
gcatggcactgactga

SEQ ID NO: 1553666 - DNA, 13 bp, Homo sapiens
gcatggccaggtg

SEQ ID NO: 1553667 - DNA, 21 bp, Homo sapiens
gcatggcctctaagagtgccc

SEQ ID NO: 1553668 - DNA, 22 bp, Homo sapiens
gcatggctcagatcggccacag

SEQ ID NO: 1553669 - DNA, 17 bp, Homo sapiens
gcatggctccagaaatg

SEQ ID NO: 1553670 - DNA, 19 bp, Homo sapiens
gcatggctccagaaatgtc

SEQ ID NO: 1553671 - DNA, 18 bp, Homo sapiens
gcatggggaggcagcaga

SEQ ID NO: 1553672 - DNA, 16 bp, Homo sapiens
gcatggggcatgtcct

SEQ ID NO: 1553673 - DNA, 14 bp, Homo sapiens
gcatggggcccctg

SEQ ID NO: 1553674 - DNA, 19 bp, Homo sapiens
gcatggggcccctggccca

SEQ ID NO: 1553675 - DNA, 22 bp, Homo sapiens
gcatggggcccctggcccagag

SEQ ID NO: 1553676 - DNA, 18 bp, Homo sapiens
gcatggggctggggtcct

SEQ ID NO: 1553677 - DNA, 21 bp, Homo sapiens
gcatgggggctgccagcgtct

SEQ ID NO: 1553678 - DNA, 21 bp, Homo sapiens
gcatgggtccagggcctgaca

SEQ ID NO: 1553679 - DNA, 21 bp, Homo sapiens
gcatgggtccttgatgccaga

SEQ ID NO: 1553680 - DNA, 22 bp, Homo sapiens
gcatgggtccttgatgccagag

SEQ ID NO: 1553681 - DNA, 15 bp, Homo sapiens
gcatgggtggagggt

SEQ ID NO: 1553682 - DNA, 15 bp, Homo sapiens
gcatgggtgtgccct

SEQ ID NO: 1553683 - DNA, 20 bp, Homo sapiens
gcatggtcacaagcacaaag

SEQ ID NO: 1553684 - DNA, 15 bp, Homo sapiens
gcatggtggcaggcg

SEQ ID NO: 1553685 - DNA, 18 bp, Homo sapiens
gcatggtggctcatgcct

SEQ ID NO: 1553686 - DNA, 21 bp, Homo sapiens
gcatggtggctcatgcctgta

SEQ ID NO: 1553687 - DNA, 19 bp, Homo sapiens
gcatggttccttccctggg

SEQ ID NO: 1553688 - DNA, 22 bp, Homo sapiens
gcatggttccttccctgggaag

SEQ ID NO: 1553689 - DNA, 19 bp, Homo sapiens
gcatggttttgtgccatct

SEQ ID NO: 1553690 - DNA, 19 bp, Homo sapiens
gcatgtaatcccagctact

SEQ ID NO: 1553691 - DNA, 20 bp, Homo sapiens
gcatgtaccatttgcatggc

SEQ ID NO: 1553692 - DNA, 14 bp, Homo sapiens
gcatgtatgaatgt

SEQ ID NO: 1553693 - DNA, 18 bp, Homo sapiens
gcatgtattggcctggag

SEQ ID NO: 1553694 - DNA, 19 bp, Homo sapiens
gcatgtattggcctggagg

SEQ ID NO: 1553695 - DNA, 20 bp, Homo sapiens
gcatgtattggcctggaggt

SEQ ID NO: 1553696 - DNA, 13 bp, Homo sapiens
gcatgtcccaccc

SEQ ID NO: 1553697 - DNA, 15 bp, Homo sapiens
gcatgtcccacccac

SEQ ID NO: 1553698 - DNA, 17 bp, Homo sapiens
gcatgtcccacccaccc

SEQ ID NO: 1553699 - DNA, 19 bp, Homo sapiens
gcatgtcccacccacccgc

SEQ ID NO: 1553700 - DNA, 13 bp, Homo sapiens
gcatgtcctttcc

SEQ ID NO: 1553701 - DNA, 19 bp, Homo sapiens
gcatgtcctttccatctgt

SEQ ID NO: 1553702 - DNA, 22 bp, Homo sapiens
gcatgtcctttccatctgtcca

SEQ ID NO: 1553703 - DNA, 14 bp, Homo sapiens
gcatgtctactgct

SEQ ID NO: 1553704 - DNA, 14 bp, Homo sapiens
gcatgtcttttaaa

SEQ ID NO: 1553705 - DNA, 21 bp, Homo sapiens
gcatgtgaaaatcaaatacat

SEQ ID NO: 1553706 - DNA, 23 bp, Homo sapiens
gcatgtgacttctcccctgccct

SEQ ID NO: 1553707 - DNA, 14 bp, Homo sapiens
gcatgtgagcacat

SEQ ID NO: 1553708 - DNA, 21 bp, Homo sapiens
gcatgtgctgtgtgagtgagc

SEQ ID NO: 1553709 - DNA, 16 bp, Homo sapiens
gcatgtgtgcctgtgg

SEQ ID NO: 1553710 - DNA, 19 bp, Homo sapiens
gcatgtgtgcctgtggcag

SEQ ID NO: 1553711 - DNA, 11 bp, Homo sapiens
gcatgtgtgtg

SEQ ID NO: 1553712 - DNA, 19 bp, Homo sapiens
gcatgtgtgtgtctgtctt

SEQ ID NO: 1553713 - DNA, 14 bp, Homo sapiens
gcatgtgtgtgtgt

SEQ ID NO: 1553714 - DNA, 13 bp, Homo sapiens
gcatgttacataa

SEQ ID NO: 1553715 - DNA, 13 bp, Homo sapiens
gcatgttcctcct

SEQ ID NO: 1553716 - DNA, 12 bp, Homo sapiens
gcattaatgttt

SEQ ID NO: 1553717 - DNA, 14 bp, Homo sapiens
gcattactttatag

SEQ ID NO: 1553718 - DNA, 13 bp, Homo sapiens
gcattagaaatta

SEQ ID NO: 1553719 - DNA, 18 bp, Homo sapiens
gcattagaattatttaaa

SEQ ID NO: 1553720 - DNA, 18 bp, Homo sapiens
gcattatataccctggtg

SEQ ID NO: 1553721 - DNA, 19 bp, Homo sapiens
gcattatgtccactgtgta

SEQ ID NO: 1553722 - DNA, 14 bp, Homo sapiens
gcattattaaattg

SEQ ID NO: 1553723 - DNA, 14 bp, Homo sapiens
gcattattgcatta

SEQ ID NO: 1553724 - DNA, 14 bp, Homo sapiens
gcattcaaaatctt

SEQ ID NO: 1553725 - DNA, 14 bp, Homo sapiens
gcattcagcacaca

SEQ ID NO: 1553726 - DNA, 22 bp, Homo sapiens
gcattcatgcaagagtttcttg

SEQ ID NO: 1553727 - DNA, 14 bp, Homo sapiens
gcattccagagtta

SEQ ID NO: 1553728 - DNA, 12 bp, Homo sapiens
gcattccagccc

SEQ ID NO: 1553729 - DNA, 14 bp, Homo sapiens
gcattccagctctg

SEQ ID NO: 1553730 - DNA, 13 bp, Homo sapiens
gcattccctgagt

SEQ ID NO: 1553731 - DNA, 19 bp, Homo sapiens
gcattcctgatatgattta

SEQ ID NO: 1553732 - DNA, 18 bp, Homo sapiens
gcattcctgtgccctaga

SEQ ID NO: 1553733 - DNA, 23 bp, Homo sapiens
gcattcgttgtgttttttaagat

SEQ ID NO: 1553734 - DNA, 13 bp, Homo sapiens
gcattctagtact

SEQ ID NO: 1553735 - DNA, 20 bp, Homo sapiens
gcattctgccgtgtgccctc

SEQ ID NO: 1553736 - DNA, 12 bp, Homo sapiens
gcattgagaact

SEQ ID NO: 1553737 - DNA, 10 bp, Homo sapiens
gcattgagta

SEQ ID NO: 1553738 - DNA, 17 bp, Homo sapiens
gcattgagtattgttta

SEQ ID NO: 1553739 - DNA, 22 bp, Homo sapiens
gcattgccacggaaacatacag

SEQ ID NO: 1553740 - DNA, 13 bp, Homo sapiens
gcattgcctggac

SEQ ID NO: 1553741 - DNA, 14 bp, Homo sapiens
gcattgcctggact

SEQ ID NO: 1553742 - DNA, 16 bp, Homo sapiens
gcattgcctggactga

SEQ ID NO: 1553743 - DNA, 19 bp, Homo sapiens
gcattgcctggactgacca

SEQ ID NO: 1553744 - DNA, 19 bp, Homo sapiens
gattctgtttattcttcca

SEQ ID NO: 1553745 - DNA, 22 bp, Homo sapiens
gattctgtttattcttccagaa

SEQ ID NO: 1553746 - DNA, 18 bp, Homo sapiens
gattcttatttgatggtg

SEQ ID NO: 1553747 - DNA, 21 bp, Homo sapiens
gattcttcccgctccccacct

SEQ ID NO: 1553748 - DNA, 20 bp, Homo sapiens
gattcttctgtgtttataaa

SEQ ID NO: 1553749 - DNA, 16 bp, Homo sapiens
gattcttgtaaatctt

SEQ ID NO: 1553750 - DNA, 19 bp, Homo sapiens
gattcttgtaaatcttttt

SEQ ID NO: 1553751 - DNA, 15 bp, Homo sapiens
gattctttaaggaga

SEQ ID NO: 1553752 - DNA, 16 bp, Homo sapiens
gattctttaaggagat

SEQ ID NO: 1553753 - DNA, 15 bp, Homo sapiens
gattgaaaacttttc

SEQ ID NO: 1553754 - DNA, 20 bp, Homo sapiens
gattgaaaacttttctcaga

SEQ ID NO: 1553755 - DNA, 22 bp, Homo sapiens
gattgaaaagaagaaagtctat

SEQ ID NO: 1553756 - DNA, 16 bp, Homo sapiens
gattgaagggtcctgc

SEQ ID NO: 1553757 - DNA, 16 bp, Homo sapiens
gattgacacacagcac

SEQ ID NO: 1553758 - DNA, 14 bp, Homo sapiens
gattgagaagccat

SEQ ID NO: 1553759 - DNA, 16 bp, Homo sapiens
gattgaggagttgcct

SEQ ID NO: 1553760 - DNA, 19 bp, Homo sapiens
gattgaggagttgcctgac

SEQ ID NO: 1553761 - DNA, 14 bp, Homo sapiens
gattgagtgagggc

SEQ ID NO: 1553762 - DNA, 22 bp, Homo sapiens
gattgatagaaaatccttcagc

SEQ ID NO: 1553763 - DNA, 17 bp, Homo sapiens
gattgatcacacagtgt

SEQ ID NO: 1553764 - DNA, 21 bp, Homo sapiens
gattgatcacacagtgttagt

SEQ ID NO: 1553765 - DNA, 14 bp, Homo sapiens
gattgcacattgtt

SEQ ID NO: 1553766 - DNA, 15 bp, Homo sapiens
gattgcacgtggcct

SEQ ID NO: 1553767 - DNA, 16 bp, Homo sapiens
gattgcacgtggcctc

SEQ ID NO: 1553768 - DNA, 17 bp, Homo sapiens
gattgcacgtggcctct

SEQ ID NO: 1553769 - DNA, 13 bp, Homo sapiens
gattgcagaattg

SEQ ID NO: 1553770 - DNA, 19 bp, Homo sapiens
gattgcagaattgtttaga

SEQ ID NO: 1553771 - DNA, 12 bp, Homo sapiens
gattgcagcttt

SEQ ID NO: 1553772 - DNA, 19 bp, Homo sapiens
gattgcccctggctttgcc

SEQ ID NO: 1553773 - DNA, 22 bp, Homo sapiens
gattgcccctggctttgcctct

SEQ ID NO: 1553774 - DNA, 16 bp, Homo sapiens
gattgctctggagcag

SEQ ID NO: 1553775 - DNA, 19 bp, Homo sapiens
gattgctctggagcagcca

SEQ ID NO: 1553776 - DNA, 20 bp, Homo sapiens
gattgctctggagcagccaa

SEQ ID NO: 1553777 - DNA, 23 bp, Homo sapiens
gattgctctggagcagccaaggc

SEQ ID NO: 1553778 - DNA, 21 bp, Homo sapiens
gattgctgaggcaccgtccag

SEQ ID NO: 1553779 - DNA, 14 bp, Homo sapiens
gattgcttaaaata

SEQ ID NO: 1553780 - DNA, 16 bp, Homo sapiens
gattgcttgagcccag

SEQ ID NO: 1553781 - DNA, 19 bp, Homo sapiens
gattgcttgagcccaggag

SEQ ID NO: 1553782 - DNA, 16 bp, Homo sapiens
gattgcttgagctcag

SEQ ID NO: 1553783 - DNA, 22 bp, Homo sapiens
gattgcttttgttttcctgctg

SEQ ID NO: 1553784 - DNA, 23 bp, Homo sapiens
gattgcttttgttttcctgctgg

SEQ ID NO: 1553785 - DNA, 14 bp, Homo sapiens
gattggacattttc

SEQ ID NO: 1553786 - DNA, 23 bp, Homo sapiens
gattggacggcctgatgctccct

SEQ ID NO: 1553787 - DNA, 15 bp, Homo sapiens
gattggattattcat

SEQ ID NO: 1553788 - DNA, 13 bp, Homo sapiens
gattggcatggct

SEQ ID NO: 1553789 - DNA, 16 bp, Homo sapiens
gattggcctgtagagt

SEQ ID NO: 1553790 - DNA, 13 bp, Homo sapiens
gattggctgcagg

SEQ ID NO: 1553791 - DNA, 22 bp, Homo sapiens
gattggctgcttaaactggaaa

SEQ ID NO: 1553792 - DNA, 23 bp, Homo sapiens
gattggctttgtgcttggggcta

SEQ ID NO: 1553793 - DNA, 18 bp, Homo sapiens
gattgggggctggtgcca

SEQ ID NO: 1553794 - DNA, 10 bp, Homo sapiens
gattgtattg

SEQ ID NO: 1553795 - DNA, 22 bp, Homo sapiens
gattgtgtacatagagcaatgt

SEQ ID NO: 1553796 - DNA, 21 bp, Homo sapiens
gattgttaagtctaaatattt

SEQ ID NO: 1553797 - DNA, 23 bp, Homo sapiens
gatttaaaaacaaccaacagaaa

SEQ ID NO: 1553798 - DNA, 16 bp, Homo sapiens
gatttaaaaactggaa

SEQ ID NO: 1553799 - DNA, 18 bp, Homo sapiens
gatttaaaagcctgctca

SEQ ID NO: 1553800 - DNA, 14 bp, Homo sapiens
gatttaaactctga

SEQ ID NO: 1553801 - DNA, 20 bp, Homo sapiens
gatttaaagtgaacacacac

SEQ ID NO: 1553802 - DNA, 17 bp, Homo sapiens
gatttaacagtcattta

SEQ ID NO: 1553803 - DNA, 17 bp, Homo sapiens
gatttaagccttacaaa

SEQ ID NO: 1553804 - DNA, 22 bp, Homo sapiens
gatttaagggatggaaaaggaa

SEQ ID NO: 1553805 - DNA, 15 bp, Homo sapiens
gatttaaggtattta

SEQ ID NO: 1553806 - DNA, 17 bp, Homo sapiens
gatttaagtgaatacat

SEQ ID NO: 1553807 - DNA, 19 bp, Homo sapiens
gatttaatctgccaagggc

SEQ ID NO: 1553808 - DNA, 21 bp, Homo sapiens
gatttaattaatcatgaatgt

SEQ ID NO: 1553809 - DNA, 13 bp, Homo sapiens
gatttagctattt

SEQ ID NO: 1553810 - DNA, 17 bp, Homo sapiens
gatttataaaactttgg

SEQ ID NO: 1553811 - DNA, 15 bp, Homo sapiens
gatttatactcattt

SEQ ID NO: 1553812 - DNA, 13 bp, Homo sapiens
gatttatcaaatc

SEQ ID NO: 1553813 - DNA, 12 bp, Homo sapiens
gatttatctttc

SEQ ID NO: 1553814 - DNA, 20 bp, Homo sapiens
gatttatgaacagaaatatt

SEQ ID NO: 1553815 - DNA, 15 bp, Homo sapiens
gatttattgaaattt

SEQ ID NO: 1553816 - DNA, 15 bp, Homo sapiens
gatttcaaacttaaa

SEQ ID NO: 1553817 - DNA, 19 bp, Homo sapiens
gatttcatggtgattccag

SEQ ID NO: 1553818 - DNA, 13 bp, Homo sapiens
gatttccatattt

SEQ ID NO: 1553819 - DNA, 16 bp, Homo sapiens
gatttccatgggcccc

SEQ ID NO: 1553820 - DNA, 22 bp, Homo sapiens
gatttcccactgcactccagcc

SEQ ID NO: 1553821 - DNA, 14 bp, Homo sapiens
gatttcctaaacat

SEQ ID NO: 1553822 - DNA, 15 bp, Homo sapiens
gatttcctaaacata

SEQ ID NO: 1553823 - DNA, 22 bp, Homo sapiens
gatttcctccatggtggaaggg

SEQ ID NO: 1553824 - DNA, 21 bp, Homo sapiens
gatttcctcctcccagtgcct

SEQ ID NO: 1553825 - DNA, 15 bp, Homo sapiens
gatttccttgtgcaa

SEQ ID NO: 1553826 - DNA, 22 bp, Homo sapiens
gatttctaattgtaagtgaaat

SEQ ID NO: 1553827 - DNA, 13 bp, Homo sapiens
gatttctgctaag

SEQ ID NO: 1553828 - DNA, 13 bp, Homo sapiens
gatttcttaaata

SEQ ID NO: 1553829 - DNA, 17 bp, Homo sapiens
gatttcttcgctgctct

SEQ ID NO: 1553830 - DNA, 24 bp, Homo sapiens
gatttcttcgctgctctagctggc

SEQ ID NO: 1553831 - DNA, 19 bp, Homo sapiens
gatttctttccttcccaat

SEQ ID NO: 1553832 - DNA, 23 bp, Homo sapiens
gatttctttccttcccaataggt

SEQ ID NO: 1553833 - DNA, 22 bp, Homo sapiens
gatttctttctttgcaccaaag

SEQ ID NO: 1553834 - DNA, 21 bp, Homo sapiens
gatttgaaaaatataaaatta

SEQ ID NO: 1553835 - DNA, 23 bp, Homo sapiens
gatttgatgagttaactgtgaaa

SEQ ID NO: 1553836 - DNA, 22 bp, Homo sapiens
gatttgcaggattcccttctgg

SEQ ID NO: 1553837 - DNA, 14 bp, Homo sapiens
gatttgccagcaca

SEQ ID NO: 1553838 - DNA, 17 bp, Homo sapiens
gatttgccagcacaggg

SEQ ID NO: 1553839 - DNA, 20 bp, Homo sapiens
gatttgccagcacaggggcc

SEQ ID NO: 1553840 - DNA, 12 bp, Homo sapiens
gatttggaaaaa

SEQ ID NO: 1553841 - DNA, 15 bp, Homo sapiens
gatttgggagaaggg

SEQ ID NO: 1553842 - DNA, 17 bp, Homo sapiens
gatttgggagctctgct

SEQ ID NO: 1553843 - DNA, 18 bp, Homo sapiens
gatttggggcctcaagaa

SEQ ID NO: 1553844 - DNA, 20 bp, Homo sapiens
gatttggggcctcaagaaat

SEQ ID NO: 1553845 - DNA, 22 bp, Homo sapiens
gatttggtacttttgagtgtgt

SEQ ID NO: 1553846 - DNA, 17 bp, Homo sapiens
gatttgtagcactgagg

SEQ ID NO: 1553847 - DNA, 22 bp, Homo sapiens
gatttgttgacagcaaaatgtt

SEQ ID NO: 1553848 - DNA, 14 bp, Homo sapiens
gatttgtttttgta

SEQ ID NO: 1553849 - DNA, 22 bp, Homo sapiens
gattttaaaatgtacatgtatt

SEQ ID NO: 1553850 - DNA, 20 bp, Homo sapiens
gattttaacaaaagcaagac

SEQ ID NO: 1553851 - DNA, 22 bp, Homo sapiens
gattttaatgaaatcaaatgta

SEQ ID NO: 1553852 - DNA, 14 bp, Homo sapiens
gcacaggcagctgg

SEQ ID NO: 1553853 - DNA, 15 bp, Homo sapiens
gcacaggccctagct

SEQ ID NO: 1553854 - DNA, 12 bp, Homo sapiens
gcacaggcctct

SEQ ID NO: 1553855 - DNA, 16 bp, Homo sapiens
gcacaggcctctgcct

SEQ ID NO: 1553856 - DNA, 18 bp, Homo sapiens
gcacaggcctctgcctgc

SEQ ID NO: 1553857 - DNA, 17 bp, Homo sapiens
gcacagggagtgcacat

SEQ ID NO: 1553858 - DNA, 13 bp, Homo sapiens
gcacagggcacca

SEQ ID NO: 1553859 - DNA, 15 bp, Homo sapiens
gcacagggcaccaga

SEQ ID NO: 1553860 - DNA, 19 bp, Homo sapiens
gcacagggcaccagaggcc

SEQ ID NO: 1553861 - DNA, 15 bp, Homo sapiens
gcacaggggccccag

SEQ ID NO: 1553862 - DNA, 16 bp, Homo sapiens
gcacaggggccccaga

SEQ ID NO: 1553863 - DNA, 20 bp, Homo sapiens
gcacaggggccccagatctg

SEQ ID NO: 1553864 - DNA, 12 bp, Homo sapiens
gcacagggtctg

SEQ ID NO: 1553865 - DNA, 13 bp, Homo sapiens
gcacaggtgggag

SEQ ID NO: 1553866 - DNA, 14 bp, Homo sapiens
gcacaggtgggagg

SEQ ID NO: 1553867 - DNA, 16 bp, Homo sapiens
gcacagtacaataatg

SEQ ID NO: 1553868 - DNA, 23 bp, Homo sapiens
gcacagtacaataatgtactcac

SEQ ID NO: 1553869 - DNA, 15 bp, Homo sapiens
gcacagtcagaagga

SEQ ID NO: 1553870 - DNA, 17 bp, Homo sapiens
gcacagtgacttctgag

SEQ ID NO: 1553871 - DNA, 18 bp, Homo sapiens
gcacagtgacttctgaga

SEQ ID NO: 1553872 - DNA, 15 bp, Homo sapiens
gcacagtgcatctca

SEQ ID NO: 1553873 - DNA, 20 bp, Homo sapiens
gcacagtggactcagcagtg

SEQ ID NO: 1553874 - DNA, 17 bp, Homo sapiens
gcacagtggctcacgcc

SEQ ID NO: 1553875 - DNA, 12 bp, Homo sapiens
gcacagtggctt

SEQ ID NO: 1553876 - DNA, 18 bp, Homo sapiens
gcacagtgggagctgagc

SEQ ID NO: 1553877 - DNA, 23 bp, Homo sapiens
gcacagtgggcctgtgtgtgtgc

SEQ ID NO: 1553878 - DNA, 13 bp, Homo sapiens
gcacagtgtgtga

SEQ ID NO: 1553879 - DNA, 22 bp, Homo sapiens
gcacagttagttgtgaaagaaa

SEQ ID NO: 1553880 - DNA, 22 bp, Homo sapiens
gcacagttgtctattctgagcc

SEQ ID NO: 1553881 - DNA, 12 bp, Homo sapiens
gcacagtttgaa

SEQ ID NO: 1553882 - DNA, 13 bp, Homo sapiens
gcacagtttgaac

SEQ ID NO: 1553883 - DNA, 14 bp, Homo sapiens
gcacagtttgaaca

SEQ ID NO: 1553884 - DNA, 14 bp, Homo sapiens
gcacagttttctga

SEQ ID NO: 1553885 - DNA, 16 bp, Homo sapiens
gcacataccttcatgt

SEQ ID NO: 1553886 - DNA, 23 bp, Homo sapiens
gcacatacgggctttaatagtca

SEQ ID NO: 1553887 - DNA, 22 bp, Homo sapiens
gcacatactacctagaagtaag

SEQ ID NO: 1553888 - DNA, 23 bp, Homo sapiens
gcacatagaaagtaaataaaagg

SEQ ID NO: 1553889 - DNA, 14 bp, Homo sapiens
gcacatagagaggg

SEQ ID NO: 1553890 - DNA, 21 bp, Homo sapiens
gcacatagagctttttaatag

SEQ ID NO: 1553891 - DNA, 12 bp, Homo sapiens
gcacatcacctc

SEQ ID NO: 1553892 - DNA, 13 bp, Homo sapiens
gcacatcacctct

SEQ ID NO: 1553893 - DNA, 20 bp, Homo sapiens
gcacatccgcgtgtgcctgt

SEQ ID NO: 1553894 - DNA, 23 bp, Homo sapiens
gcacatccgcgtgtgcctgtgtg

SEQ ID NO: 1553895 - DNA, 21 bp, Homo sapiens
gcacatctgcattttcacccc

SEQ ID NO: 1553896 - DNA, 13 bp, Homo sapiens
gcacatgaaagtt

SEQ ID NO: 1553897 - DNA, 19 bp, Homo sapiens
gcacatgaacagcttgcca

SEQ ID NO: 1553898 - DNA, 20 bp, Homo sapiens
gcacatgaataatttcactt

SEQ ID NO: 1553899 - DNA, 18 bp, Homo sapiens
gcacatgccttaagccag

SEQ ID NO: 1553900 - DNA, 21 bp, Homo sapiens
gcacatgctgtctggccctgg

SEQ ID NO: 1553901 - DNA, 20 bp, Homo sapiens
gcacatggacagacttcaca

SEQ ID NO: 1553902 - DNA, 21 bp, Homo sapiens
gcacatggccatagaggccca

SEQ ID NO: 1553903 - DNA, 22 bp, Homo sapiens
gcacatggccatagaggcccag

SEQ ID NO: 1553904 - DNA, 15 bp, Homo sapiens
gcacatgtaataaat

SEQ ID NO: 1553905 - DNA, 23 bp, Homo sapiens
gcacattaactccctccaccagc

SEQ ID NO: 1553906 - DNA, 16 bp, Homo sapiens
gcacattcctggcccc

SEQ ID NO: 1553907 - DNA, 21 bp, Homo sapiens
gcacattcgggaccaatatat

SEQ ID NO: 1553908 - DNA, 17 bp, Homo sapiens
gcacattgcccatggct

SEQ ID NO: 1553909 - DNA, 18 bp, Homo sapiens
gcacattgcccatggctg

SEQ ID NO: 1553910 - DNA, 20 bp, Homo sapiens
gcacattgcctgttctgctt

SEQ ID NO: 1553911 - DNA, 22 bp, Homo sapiens
gcacattgcctgttctgcttcg

SEQ ID NO: 1553912 - DNA, 19 bp, Homo sapiens
gcacattttgtggctgttg

SEQ ID NO: 1553913 - DNA, 24 bp, Homo sapiens
gcaccaaacctaagtccttccacc

SEQ ID NO: 1553914 - DNA, 15 bp, Homo sapiens
gcaccaaccacagca

SEQ ID NO: 1553915 - DNA, 19 bp, Homo sapiens
gcaccaagggacaggagaa

SEQ ID NO: 1553916 - DNA, 16 bp, Homo sapiens
gcaccaattatcatct

SEQ ID NO: 1553917 - DNA, 15 bp, Homo sapiens
gcaccacactgggtg

SEQ ID NO: 1553918 - DNA, 18 bp, Homo sapiens
gcaccaccaagccaaggg

SEQ ID NO: 1553919 - DNA, 18 bp, Homo sapiens
gcaccaccaggagcagca

SEQ ID NO: 1553920 - DNA, 20 bp, Homo sapiens
gcaccaccaggagcagcagc

SEQ ID NO: 1553921 - DNA, 22 bp, Homo sapiens
gcaccaccaggagcagcagcca

SEQ ID NO: 1553922 - DNA, 20 bp, Homo sapiens
gcaccaccctagtcccttcc

SEQ ID NO: 1553923 - DNA, 16 bp, Homo sapiens
gcaccacctctgtggg

SEQ ID NO: 1553924 - DNA, 21 bp, Homo sapiens
gcaccactgcactccagcctg

SEQ ID NO: 1553925 - DNA, 15 bp, Homo sapiens
gcaccactgcttccc

SEQ ID NO: 1553926 - DNA, 19 bp, Homo sapiens
gcaccactgcttcccactg

SEQ ID NO: 1553927 - DNA, 19 bp, Homo sapiens
gcaccagacacccaggact

SEQ ID NO: 1553928 - DNA, 21 bp, Homo sapiens
gcaccagacacccaggactta

SEQ ID NO: 1553929 - DNA, 16 bp, Homo sapiens
gcaccagatgacacat

SEQ ID NO: 1553930 - DNA, 16 bp, Homo sapiens
gcaccagccccctgga

SEQ ID NO: 1553931 - DNA, 18 bp, Homo sapiens
gcaccagcgcccccagaa

SEQ ID NO: 1553932 - DNA, 14 bp, Homo sapiens
gcaccagctctgtg

SEQ ID NO: 1553933 - DNA, 15 bp, Homo sapiens
gcaccagctctgtgg

SEQ ID NO: 1553934 - DNA, 20 bp, Homo sapiens
gcaccagctctgtggcctgt

SEQ ID NO: 1553935 - DNA, 13 bp, Homo sapiens
gcaccagctgctc

SEQ ID NO: 1553936 - DNA, 15 bp, Homo sapiens
gcaccagctgctctg

SEQ ID NO: 1553937 - DNA, 14 bp, Homo sapiens
gcaccaggaagccg

SEQ ID NO: 1553938 - DNA, 12 bp, Homo sapiens
gcaccaggagac

SEQ ID NO: 1553939 - DNA, 14 bp, Homo sapiens
gcaactgaggcaga

SEQ ID NO: 1553940 - DNA, 15 bp, Homo sapiens
gcaactgaggcagac

SEQ ID NO: 1553941 - DNA, 21 bp, Homo sapiens
gcaactgaggcagacagcagc

SEQ ID NO: 1553942 - DNA, 22 bp, Homo sapiens
gcaactgaggcagacagcagct

SEQ ID NO: 1553943 - DNA, 16 bp, Homo sapiens
gcaactgcccttccag

SEQ ID NO: 1553944 - DNA, 22 bp, Homo sapiens
gcaactggagccagcaaccagc

SEQ ID NO: 1553945 - DNA, 20 bp, Homo sapiens
gcaacttccgcctcctgtgt

SEQ ID NO: 1553946 - DNA, 14 bp, Homo sapiens
gcaacttcttctcc

SEQ ID NO: 1553947 - DNA, 14 bp, Homo sapiens
gcaagaaagcttga

SEQ ID NO: 1553948 - DNA, 21 bp, Homo sapiens
gcaagaaatggcgtctgctct

SEQ ID NO: 1553949 - DNA, 16 bp, Homo sapiens
gcaagaataaaaaaga

SEQ ID NO: 1553950 - DNA, 19 bp, Homo sapiens
gcaagacagaaaagtgcct

SEQ ID NO: 1553951 - DNA, 20 bp, Homo sapiens
gcaagacagaaaagtgcctg

SEQ ID NO: 1553952 - DNA, 18 bp, Homo sapiens
gcaagaccacggagggag

SEQ ID NO: 1553953 - DNA, 15 bp, Homo sapiens
gcaagaccagtcact

SEQ ID NO: 1553954 - DNA, 14 bp, Homo sapiens
gcaagacctcatct

SEQ ID NO: 1553955 - DNA, 21 bp, Homo sapiens
gcaagacctcatctgtggagc

SEQ ID NO: 1553956 - DNA, 12 bp, Homo sapiens
gcaagacctctt

SEQ ID NO: 1553957 - DNA, 21 bp, Homo sapiens
gcaagacctcttccctctggg

SEQ ID NO: 1553958 - DNA, 23 bp, Homo sapiens
gcaagacctcttccctctgggcc

SEQ ID NO: 1553959 - DNA, 18 bp, Homo sapiens
gcaagactgttgctcaaa

SEQ ID NO: 1553960 - DNA, 19 bp, Homo sapiens
gcaagagaattgcttgaac

SEQ ID NO: 1553961 - DNA, 22 bp, Homo sapiens
gcaagagccttggtgtccacct

SEQ ID NO: 1553962 - DNA, 23 bp, Homo sapiens
gcaagagccttggtgtccacctg

SEQ ID NO: 1553963 - DNA, 18 bp, Homo sapiens
gcaagaggcaagctgaaa

SEQ ID NO: 1553964 - DNA, 22 bp, Homo sapiens
gcaagagggggtggaggggtgt

SEQ ID NO: 1553965 - DNA, 17 bp, Homo sapiens
gcaagagtaagcagtgt

SEQ ID NO: 1553966 - DNA, 20 bp, Homo sapiens
gcaagagtaagcagtgttac

SEQ ID NO: 1553967 - DNA, 19 bp, Homo sapiens
gcaagagtgtggaggctga

SEQ ID NO: 1553968 - DNA, 19 bp, Homo sapiens
gcaagatagatttggaata

SEQ ID NO: 1553969 - DNA, 16 bp, Homo sapiens
gcaagatatttatata

SEQ ID NO: 1553970 - DNA, 15 bp, Homo sapiens
gcaagatgtgaatta

SEQ ID NO: 1553971 - DNA, 19 bp, Homo sapiens
gcaagatgttttgtataaa

SEQ ID NO: 1553972 - DNA, 22 bp, Homo sapiens
gcaagattttccacaagattcc

SEQ ID NO: 1553973 - DNA, 21 bp, Homo sapiens
gcaagcagaggaccagggcct

SEQ ID NO: 1553974 - DNA, 12 bp, Homo sapiens
gcaagcagggaa

SEQ ID NO: 1553975 - DNA, 15 bp, Homo sapiens
gcaagcatgcttgtg

SEQ ID NO: 1553976 - DNA, 13 bp, Homo sapiens
gcaagccaggctc

SEQ ID NO: 1553977 - DNA, 17 bp, Homo sapiens
gcaagccatcatcctcc

SEQ ID NO: 1553978 - DNA, 15 bp, Homo sapiens
gcaagccccagggcc

SEQ ID NO: 1553979 - DNA, 16 bp, Homo sapiens
gcaagccccagggcct

SEQ ID NO: 1553980 - DNA, 21 bp, Homo sapiens
gcaagccccagggcctggggg

SEQ ID NO: 1553981 - DNA, 17 bp, Homo sapiens
gcaagcccctcagccct

SEQ ID NO: 1553982 - DNA, 15 bp, Homo sapiens
gcaagccctacagag

SEQ ID NO: 1553983 - DNA, 19 bp, Homo sapiens
gcaagcctgtaatcccagc

SEQ ID NO: 1553984 - DNA, 20 bp, Homo sapiens
gcaagcctgtaatcccagct

SEQ ID NO: 1553985 - DNA, 16 bp, Homo sapiens
gcaagctaggccccag

SEQ ID NO: 1553986 - DNA, 17 bp, Homo sapiens
gcaagctaggccccaga

SEQ ID NO: 1553987 - DNA, 23 bp, Homo sapiens
gcaagctaggccccagaggccct

SEQ ID NO: 1553988 - DNA, 14 bp, Homo sapiens
gcaagctctcagca

SEQ ID NO: 1553989 - DNA, 22 bp, Homo sapiens
gcaagctgccgaaccaaaagaa

SEQ ID NO: 1553990 - DNA, 14 bp, Homo sapiens
gcaagcttcttgct

SEQ ID NO: 1553991 - DNA, 18 bp, Homo sapiens
gcaagcttgaggccaaga

SEQ ID NO: 1553992 - DNA, 20 bp, Homo sapiens
gcaaggaaggtaaaaagtta

SEQ ID NO: 1553993 - DNA, 16 bp, Homo sapiens
gcaaggactttgtaca

SEQ ID NO: 1553994 - DNA, 19 bp, Homo sapiens
gcaaggactttgtacattt

SEQ ID NO: 1553995 - DNA, 20 bp, Homo sapiens
gcaaggagtttattacaatg

SEQ ID NO: 1553996 - DNA, 22 bp, Homo sapiens
gcaaggagtttattacaatgta

SEQ ID NO: 1553997 - DNA, 11 bp, Homo sapiens
gcaaggcaggt

SEQ ID NO: 1553998 - DNA, 20 bp, Homo sapiens
gcaaggcaggtgcctccagg

SEQ ID NO: 1553999 - DNA, 21 bp, Homo sapiens
gcaaggcaggtgcctccaggt

SEQ ID NO: 1554000 - DNA, 21 bp, Homo sapiens
gcaaggcagtctctatattat

SEQ ID NO: 1554001 - DNA, 21 bp, Homo sapiens
gcaaggccgctgttcacccac

SEQ ID NO: 1554002 - DNA, 13 bp, Homo sapiens
gcaaggcctgtgc

SEQ ID NO: 1554003 - DNA, 15 bp, Homo sapiens
gcaaggctatgtgat

SEQ ID NO: 1554004 - DNA, 13 bp, Homo sapiens
gcaaggctgctgc

SEQ ID NO: 1554005 - DNA, 16 bp, Homo sapiens
gcaaggctgctgccgg

SEQ ID NO: 1554006 - DNA, 17 bp, Homo sapiens
gcaaggctgctgccgga

SEQ ID NO: 1554007 - DNA, 20 bp, Homo sapiens
gcaaggctggggtcttgggt

SEQ ID NO: 1554008 - DNA, 15 bp, Homo sapiens
gcaagggacctgctc

SEQ ID NO: 1554009 - DNA, 20 bp, Homo sapiens
gcaagggacctgctcatcat

SEQ ID NO: 1554010 - DNA, 13 bp, Homo sapiens
gcaagggaccttc

SEQ ID NO: 1554011 - DNA, 14 bp, Homo sapiens
gcaagggagaaaag

SEQ ID NO: 1554012 - DNA, 15 bp, Homo sapiens
gcaagggagaaaaga

SEQ ID NO: 1554013 - DNA, 13 bp, Homo sapiens
gcaagggaggcgc

SEQ ID NO: 1554014 - DNA, 18 bp, Homo sapiens
gcaagggcatcaggcact

SEQ ID NO: 1554015 - DNA, 11 bp, Homo sapiens
gcaagggctcc

SEQ ID NO: 1554016 - DNA, 21 bp, Homo sapiens
gcaagggctccagcatccagc

SEQ ID NO: 1554017 - DNA, 23 bp, Homo sapiens
gcaaggggaccccgagaaccctg

SEQ ID NO: 1554018 - DNA, 16 bp, Homo sapiens
gcaaggggctggctgg

SEQ ID NO: 1554019 - DNA, 23 bp, Homo sapiens
gcaagggggtgtcatctgaggag

SEQ ID NO: 1554020 - DNA, 18 bp, Homo sapiens
gcaagggttaaggcctga

SEQ ID NO: 1554021 - DNA, 14 bp, Homo sapiens
gcaaggtaaaattt

SEQ ID NO: 1554022 - DNA, 15 bp, Homo sapiens
gcaaggtactctggt

SEQ ID NO: 1554023 - DNA, 21 bp, Homo sapiens
gcaaggtatttctccagttgg

SEQ ID NO: 1554024 - DNA, 22 bp, Homo sapiens
gcaaggtctccttactctgagc

SEQ ID NO: 1554025 - DNA, 15 bp, Homo sapiens
gcaaggtggccacag

SEQ ID NO: 1554026 - DNA, 20 bp, Homo sapiens
gcaaggtggcctctgcctgg

SEQ ID NO: 1554027 - DNA, 23 bp, Homo sapiens
gcaaggtgggtgattcctcccag

SEQ ID NO: 1554028 - DNA, 19 bp, Homo sapiens
gcaaggtgtccctgccttc

SEQ ID NO: 1554029 - DNA, 19 bp, Homo sapiens
gcaaggtttacactgcgga

SEQ ID NO: 1554030 - DNA, 22 bp, Homo sapiens
gcaagtccctgactctctgtga

SEQ ID NO: 1554031 - DNA, 23 bp, Homo sapiens
gcaagtcccttcagactggccct

SEQ ID NO: 1554032 - DNA, 17 bp, Homo sapiens
gcaagtctggatctggg

SEQ ID NO: 1554033 - DNA, 11 bp, Homo sapiens
gcaagtcttaa

SEQ ID NO: 1554034 - DNA, 13 bp, Homo sapiens
gcaagtgagcaga

SEQ ID NO: 1554035 - DNA, 18 bp, Homo sapiens
gcaagtgatatcacctct

SEQ ID NO: 1554036 - DNA, 16 bp, Homo sapiens
gcaagtggatgggaat

SEQ ID NO: 1554037 - DNA, 22 bp, Homo sapiens
gcaagtgtggggggtccttctc

SEQ ID NO: 1554038 - DNA, 14 bp, Homo sapiens
gcacactttctggc

SEQ ID NO: 1554039 - DNA, 19 bp, Homo sapiens
gcacagacaagcagccctt

SEQ ID NO: 1554040 - DNA, 18 bp, Homo sapiens
gcacagacttctggaagg

SEQ ID NO: 1554041 - DNA, 19 bp, Homo sapiens
gcacagacttctggaaggc

SEQ ID NO: 1554042 - DNA, 18 bp, Homo sapiens
gcacagagcgtccttccc

SEQ ID NO: 1554043 - DNA, 18 bp, Homo sapiens
gcacagatggatttgcct

SEQ ID NO: 1554044 - DNA, 19 bp, Homo sapiens
gcacagatggatttgcctg

SEQ ID NO: 1554045 - DNA, 22 bp, Homo sapiens
gcacagatggatttgcctgtgc

SEQ ID NO: 1554046 - DNA, 24 bp, Homo sapiens
gcacagatggatttgcctgtgcca

SEQ ID NO: 1554047 - DNA, 13 bp, Homo sapiens
gcacagcagcatc

SEQ ID NO: 1554048 - DNA, 18 bp, Homo sapiens
gcacagccaacgagacac

SEQ ID NO: 1554049 - DNA, 24 bp, Homo sapiens
gcacagccctgagtgtcccaagcc

SEQ ID NO: 1554050 - DNA, 15 bp, Homo sapiens
gcacagcgctgagca

SEQ ID NO: 1554051 - DNA, 15 bp, Homo sapiens
gcacagctcaggagg

SEQ ID NO: 1554052 - DNA, 14 bp, Homo sapiens
gcacagctcccggc

SEQ ID NO: 1554053 - DNA, 17 bp, Homo sapiens
gcacagctcctgccagg

SEQ ID NO: 1554054 - DNA, 14 bp, Homo sapiens
gcacagctgcttgt

SEQ ID NO: 1554055 - DNA, 23 bp, Homo sapiens
gcacagctgcttgtcctgctctc

SEQ ID NO: 1554056 - DNA, 14 bp, Homo sapiens
gcacagctgggcat

SEQ ID NO: 1554057 - DNA, 21 bp, Homo sapiens
gcacagcttgacctgaggctg

SEQ ID NO: 1554058 - DNA, 18 bp, Homo sapiens
gcacaggaaaaggtagct

SEQ ID NO: 1554059 - DNA, 19 bp, Homo sapiens
gcacaggacacctggccgc

SEQ ID NO: 1554060 - DNA, 16 bp, Homo sapiens
gcacaggagactccaa

SEQ ID NO: 1554061 - DNA, 21 bp, Homo sapiens
gcacaggagactccaaggagc

SEQ ID NO: 1554062 - DNA, 20 bp, Homo sapiens
gcacaggagtgtcctcttcc

SEQ ID NO: 1554063 - DNA, 13 bp, Homo sapiens
gattttctttcta

SEQ ID NO: 1554064 - DNA, 17 bp, Homo sapiens
gattttctttctatgta

SEQ ID NO: 1554065 - DNA, 19 bp, Homo sapiens
gattttggttttgttcccc

SEQ ID NO: 1554066 - DNA, 13 bp, Homo sapiens
gattttgtgttta

SEQ ID NO: 1554067 - DNA, 20 bp, Homo sapiens
gatttttaagagaattagac

SEQ ID NO: 1554068 - DNA, 16 bp, Homo sapiens
gatttttactgtgttt

SEQ ID NO: 1554069 - DNA, 23 bp, Homo sapiens
gatttttctaaccttgaatgctg

SEQ ID NO: 1554070 - DNA, 12 bp, Homo sapiens
gatttttctctt

SEQ ID NO: 1554071 - DNA, 15 bp, Homo sapiens
gatttttctcttcat

SEQ ID NO: 1554072 - DNA, 15 bp, Homo sapiens
gatttttctttaact

SEQ ID NO: 1554073 - DNA, 15 bp, Homo sapiens
gattttttaagcaga

SEQ ID NO: 1554074 - DNA, 19 bp, Homo sapiens
gattttttaaggagctggg

SEQ ID NO: 1554075 - DNA, 13 bp, Homo sapiens
gatttttttcctg

SEQ ID NO: 1554076 - DNA, 18 bp, Homo sapiens
gcaaaaaaaaaaaaaagc

SEQ ID NO: 1554077 - DNA, 17 bp, Homo sapiens
gcaaaaaatgtttttgg

SEQ ID NO: 1554078 - DNA, 15 bp, Homo sapiens
gcaaaaacatgtatg

SEQ ID NO: 1554079 - DNA, 19 bp, Homo sapiens
gcaaaaactacattttgca

SEQ ID NO: 1554080 - DNA, 18 bp, Homo sapiens
gcaaaaactgtactgtgt

SEQ ID NO: 1554081 - DNA, 18 bp, Homo sapiens
gcaaaaagcaagggagaa

SEQ ID NO: 1554082 - DNA, 22 bp, Homo sapiens
gcaaaaagcaagggagaaaaga

SEQ ID NO: 1554083 - DNA, 21 bp, Homo sapiens
gcaaaaatgacaacagaaaaa

SEQ ID NO: 1554084 - DNA, 15 bp, Homo sapiens
gcaaaactcacagag

SEQ ID NO: 1554085 - DNA, 16 bp, Homo sapiens
gcaaaagacttgagcc

SEQ ID NO: 1554086 - DNA, 21 bp, Homo sapiens
gcaaaagacttgagccatcca

SEQ ID NO: 1554087 - DNA, 23 bp, Homo sapiens
gcaaaagagggtttattttcagt

SEQ ID NO: 1554088 - DNA, 12 bp, Homo sapiens
gcaaaatacatc

SEQ ID NO: 1554089 - DNA, 15 bp, Homo sapiens
gcaaaattcctgtgt

SEQ ID NO: 1554090 - DNA, 12 bp, Homo sapiens
gcaaaattgttt

SEQ ID NO: 1554091 - DNA, 16 bp, Homo sapiens
gcaaaattgttttcac

SEQ ID NO: 1554092 - DNA, 17 bp, Homo sapiens
gcaaaattgttttcact

SEQ ID NO: 1554093 - DNA, 23 bp, Homo sapiens
gcaaaattgttttcacttgtatt

SEQ ID NO: 1554094 - DNA, 15 bp, Homo sapiens
gcaaacactccaccc

SEQ ID NO: 1554095 - DNA, 12 bp, Homo sapiens
gcaaacacttaa

SEQ ID NO: 1554096 - DNA, 21 bp, Homo sapiens
gcaaacattttctcttagaaa

SEQ ID NO: 1554097 - DNA, 20 bp, Homo sapiens
gcaaacccagaggtggatgt

SEQ ID NO: 1554098 - DNA, 22 bp, Homo sapiens
gcaaaccctcccagaaacatct

SEQ ID NO: 1554099 - DNA, 23 bp, Homo sapiens
gcaaaccctcccagaaacatctc

SEQ ID NO: 1554100 - DNA, 21 bp, Homo sapiens
gcaaacctgacccctgctcag

SEQ ID NO: 1554101 - DNA, 14 bp, Homo sapiens
gcaaacgctaaaga

SEQ ID NO: 1554102 - DNA, 17 bp, Homo sapiens
gcaaagagtgagaaaga

SEQ ID NO: 1554103 - DNA, 15 bp, Homo sapiens
gcaaagatctctaga

SEQ ID NO: 1554104 - DNA, 21 bp, Homo sapiens
gcaaagatctgtcctcagcct

SEQ ID NO: 1554105 - DNA, 21 bp, Homo sapiens
gcaaagcaaaaggctgagaag

SEQ ID NO: 1554106 - DNA, 18 bp, Homo sapiens
gcaaagccaaggcagcga

SEQ ID NO: 1554107 - DNA, 23 bp, Homo sapiens
gcaaagcccttggaacaccctgg

SEQ ID NO: 1554108 - DNA, 19 bp, Homo sapiens
gcaaagcgcccacccaggt

SEQ ID NO: 1554109 - DNA, 15 bp, Homo sapiens
gcaaaggaaggtgga

SEQ ID NO: 1554110 - DNA, 19 bp, Homo sapiens
gcaaaggacccttgagtaa

SEQ ID NO: 1554111 - DNA, 20 bp, Homo sapiens
gcaaaggagaagcacagctc

SEQ ID NO: 1554112 - DNA, 14 bp, Homo sapiens
gcaaaggcccggct

SEQ ID NO: 1554113 - DNA, 13 bp, Homo sapiens
gcaaaggggacag

SEQ ID NO: 1554114 - DNA, 23 bp, Homo sapiens
gcaaaggtgcctcatagcatagc

SEQ ID NO: 1554115 - DNA, 20 bp, Homo sapiens
gcaaagtcacttctccatca

SEQ ID NO: 1554116 - DNA, 18 bp, Homo sapiens
gcaaagtcgccagtcact

SEQ ID NO: 1554117 - DNA, 22 bp, Homo sapiens
gcaaagtcgccagtcactgctg

SEQ ID NO: 1554118 - DNA, 22 bp, Homo sapiens
gcaaagtgaagttgcttcttct

SEQ ID NO: 1554119 - DNA, 23 bp, Homo sapiens
gcaaagtgttttctcagaacagc

SEQ ID NO: 1554120 - DNA, 15 bp, Homo sapiens
gcaaagttttacaga

SEQ ID NO: 1554121 - DNA, 20 bp, Homo sapiens
gcaaagttttacagagagga

SEQ ID NO: 1554122 - DNA, 16 bp, Homo sapiens
gcaaataatggaaaaa

SEQ ID NO: 1554123 - DNA, 14 bp, Homo sapiens
gcaaatatatgatt

SEQ ID NO: 1554124 - DNA, 16 bp, Homo sapiens
gcaaatattaaaattg

SEQ ID NO: 1554125 - DNA, 15 bp, Homo sapiens
gcaaatattgaagtt

SEQ ID NO: 1554126 - DNA, 12 bp, Homo sapiens
gcaaatcaatgc

SEQ ID NO: 1554127 - DNA, 15 bp, Homo sapiens
gcaaatcagaaactt

SEQ ID NO: 1554128 - DNA, 14 bp, Homo sapiens
gcaaatcatctgca

SEQ ID NO: 1554129 - DNA, 19 bp, Homo sapiens
gcaaatctaaaatttaaaa

SEQ ID NO: 1554130 - DNA, 13 bp, Homo sapiens
gcaaatctctttt

SEQ ID NO: 1554131 - DNA, 19 bp, Homo sapiens
gcaaatgacagatttctgt

SEQ ID NO: 1554132 - DNA, 21 bp, Homo sapiens
gcaaatgacagatttctgtaa

SEQ ID NO: 1554133 - DNA, 16 bp, Homo sapiens
gcaaatgacatgcact

SEQ ID NO: 1554134 - DNA, 16 bp, Homo sapiens
gcaaatgagctctgaa

SEQ ID NO: 1554135 - DNA, 14 bp, Homo sapiens
gcaaatgagggagg

SEQ ID NO: 1554136 - DNA, 14 bp, Homo sapiens
gcaaatggagataa

SEQ ID NO: 1554137 - DNA, 23 bp, Homo sapiens
gcaaatggagataaaagcaattc

SEQ ID NO: 1554138 - DNA, 11 bp, Homo sapiens
gcaaattaaaa

SEQ ID NO: 1554139 - DNA, 13 bp, Homo sapiens
gcaaattattcta

SEQ ID NO: 1554140 - DNA, 14 bp, Homo sapiens
gcaaattattttaa

SEQ ID NO: 1554141 - DNA, 20 bp, Homo sapiens
gcaaattgctagtcagggtg

SEQ ID NO: 1554142 - DNA, 23 bp, Homo sapiens
gcaacaaatacctccattaaatg

SEQ ID NO: 1554143 - DNA, 18 bp, Homo sapiens
gcaacaagactgccaggt

SEQ ID NO: 1554144 - DNA, 14 bp, Homo sapiens
gcaacaatttatga

SEQ ID NO: 1554145 - DNA, 15 bp, Homo sapiens
gcaacacagcctggg

SEQ ID NO: 1554146 - DNA, 17 bp, Homo sapiens
gcaacactctatattta

SEQ ID NO: 1554147 - DNA, 15 bp, Homo sapiens
gcaacagaaaaatgg

SEQ ID NO: 1554148 - DNA, 17 bp, Homo sapiens
gcaacagaaaaatggag

SEQ ID NO: 1554149 - DNA, 14 bp, Homo sapiens
gcaacagagtgaga

SEQ ID NO: 1554150 - DNA, 19 bp, Homo sapiens
gcaacagagtgagaccctg

SEQ ID NO: 1554151 - DNA, 16 bp, Homo sapiens
gcaacagatctggaac

SEQ ID NO: 1554152 - DNA, 22 bp, Homo sapiens
gcaacagatctggaacctcagc

SEQ ID NO: 1554153 - DNA, 16 bp, Homo sapiens
gcaacaggaatctcag

SEQ ID NO: 1554154 - DNA, 20 bp, Homo sapiens
gcaacaggaatctcagagac

SEQ ID NO: 1554155 - DNA, 21 bp, Homo sapiens
gcaacaggaatctcagagaca

SEQ ID NO: 1554156 - DNA, 18 bp, Homo sapiens
gcaacaggggaggaaaaa

SEQ ID NO: 1554157 - DNA, 13 bp, Homo sapiens
gcaacatagcaaa

SEQ ID NO: 1554158 - DNA, 21 bp, Homo sapiens
gcaacatctcgagccccctgg

SEQ ID NO: 1554159 - DNA, 15 bp, Homo sapiens
gcaacatctctgaat

SEQ ID NO: 1554160 - DNA, 17 bp, Homo sapiens
gcaacatctctgaatcc

SEQ ID NO: 1554161 - DNA, 14 bp, Homo sapiens
gcaacattggcaca

SEQ ID NO: 1554162 - DNA, 14 bp, Homo sapiens
gcaaccactaagaa

SEQ ID NO: 1554163 - DNA, 12 bp, Homo sapiens
gcaaccagccag

SEQ ID NO: 1554164 - DNA, 13 bp, Homo sapiens
gcaaccagccagc

SEQ ID NO: 1554165 - DNA, 14 bp, Homo sapiens
gcaaccagccagcg

SEQ ID NO: 1554166 - DNA, 15 bp, Homo sapiens
gcaaccaggaacagc

SEQ ID NO: 1554167 - DNA, 18 bp, Homo sapiens
gattaaatatttgaagag

SEQ ID NO: 1554168 - DNA, 20 bp, Homo sapiens
gattaaatttaatatactgc

SEQ ID NO: 1554169 - DNA, 17 bp, Homo sapiens
gattaacttatttagag

SEQ ID NO: 1554170 - DNA, 11 bp, Homo sapiens
gattaagaaac

SEQ ID NO: 1554171 - DNA, 12 bp, Homo sapiens
gattaagggcaa

SEQ ID NO: 1554172 - DNA, 20 bp, Homo sapiens
gattaatcaaaggcatatct

SEQ ID NO: 1554173 - DNA, 21 bp, Homo sapiens
gattaatctctaaaattctag

SEQ ID NO: 1554174 - DNA, 14 bp, Homo sapiens
gattaatggcactg

SEQ ID NO: 1554175 - DNA, 17 bp, Homo sapiens
gattacaaatcagaagt

SEQ ID NO: 1554176 - DNA, 20 bp, Homo sapiens
gattacaaatcagaagtcat

SEQ ID NO: 1554177 - DNA, 23 bp, Homo sapiens
gattacaaatcagaagtcatctt

SEQ ID NO: 1554178 - DNA, 23 bp, Homo sapiens
gattaccagggactatctttgct

SEQ ID NO: 1554179 - DNA, 17 bp, Homo sapiens
gattactgaattgtatc

SEQ ID NO: 1554180 - DNA, 15 bp, Homo sapiens
gattactgatgtgat

SEQ ID NO: 1554181 - DNA, 22 bp, Homo sapiens
gattactgatgtgatattctgt

SEQ ID NO: 1554182 - DNA, 22 bp, Homo sapiens
gattactggcctttttcattta

SEQ ID NO: 1554183 - DNA, 22 bp, Homo sapiens
gattacttcttatttttcttac

SEQ ID NO: 1554184 - DNA, 15 bp, Homo sapiens
gattagaaattacct

SEQ ID NO: 1554185 - DNA, 13 bp, Homo sapiens
gattagataaaga

SEQ ID NO: 1554186 - DNA, 16 bp, Homo sapiens
gattagattgcaaagc

SEQ ID NO: 1554187 - DNA, 17 bp, Homo sapiens
gattagggagagaagat

SEQ ID NO: 1554188 - DNA, 23 bp, Homo sapiens
gattataaaaaatgtaacatcat

SEQ ID NO: 1554189 - DNA, 18 bp, Homo sapiens
gattatagattctaaaga

SEQ ID NO: 1554190 - DNA, 21 bp, Homo sapiens
gattatataaagacctataaa

SEQ ID NO: 1554191 - DNA, 13 bp, Homo sapiens
gattatcttcagc

SEQ ID NO: 1554192 - DNA, 14 bp, Homo sapiens
gattatgatgcata

SEQ ID NO: 1554193 - DNA, 19 bp, Homo sapiens
gattatgatgcatacagtt

SEQ ID NO: 1554194 - DNA, 14 bp, Homo sapiens
gattatgggtcaca

SEQ ID NO: 1554195 - DNA, 16 bp, Homo sapiens
gattatgggtcacagg

SEQ ID NO: 1554196 - DNA, 13 bp, Homo sapiens
gattatgggtcct

SEQ ID NO: 1554197 - DNA, 16 bp, Homo sapiens
gattatggttttgtga

SEQ ID NO: 1554198 - DNA, 13 bp, Homo sapiens
gattatgtctttc

SEQ ID NO: 1554199 - DNA, 21 bp, Homo sapiens
gattatgttatacaaggcaag

SEQ ID NO: 1554200 - DNA, 17 bp, Homo sapiens
gattatgttcctgctgt

SEQ ID NO: 1554201 - DNA, 18 bp, Homo sapiens
gattatgttcctgctgta

SEQ ID NO: 1554202 - DNA, 19 bp, Homo sapiens
gattatgttcctgctgtat

SEQ ID NO: 1554203 - DNA, 20 bp, Homo sapiens
gattattagccaggtaatgt

SEQ ID NO: 1554204 - DNA, 12 bp, Homo sapiens
gattattataaa

SEQ ID NO: 1554205 - DNA, 22 bp, Homo sapiens
gattattataaactataaactt

SEQ ID NO: 1554206 - DNA, 21 bp, Homo sapiens
gattattcatttaaaatgatt

SEQ ID NO: 1554207 - DNA, 22 bp, Homo sapiens
gattattcatttaaaatgatta

SEQ ID NO: 1554208 - DNA, 13 bp, Homo sapiens
gattattgaatgt

SEQ ID NO: 1554209 - DNA, 22 bp, Homo sapiens
gattattgtgacttcactgtat

SEQ ID NO: 1554210 - DNA, 18 bp, Homo sapiens
gattatttgtatttacag

SEQ ID NO: 1554211 - DNA, 19 bp, Homo sapiens
gattcaaactgctccaagt

SEQ ID NO: 1554212 - DNA, 13 bp, Homo sapiens
gattcaaaggttc

SEQ ID NO: 1554213 - DNA, 15 bp, Homo sapiens
gattcaaagtgttgt

SEQ ID NO: 1554214 - DNA, 17 bp, Homo sapiens
gattcaaggctcagaag

SEQ ID NO: 1554215 - DNA, 16 bp, Homo sapiens
gattcaatctgtaaac

SEQ ID NO: 1554216 - DNA, 18 bp, Homo sapiens
gattcaatctgtaaactg

SEQ ID NO: 1554217 - DNA, 16 bp, Homo sapiens
gattcacctcttcctc

SEQ ID NO: 1554218 - DNA, 20 bp, Homo sapiens
gattcacctcttcctctggt

SEQ ID NO: 1554219 - DNA, 19 bp, Homo sapiens
gattcagaatgagaatgga

SEQ ID NO: 1554220 - DNA, 18 bp, Homo sapiens
gattcagattgttatcta

SEQ ID NO: 1554221 - DNA, 12 bp, Homo sapiens
gattcagcaaaa

SEQ ID NO: 1554222 - DNA, 18 bp, Homo sapiens
gattcaggcagcagtgtc

SEQ ID NO: 1554223 - DNA, 19 bp, Homo sapiens
gattcaggccagcccagcc

SEQ ID NO: 1554224 - DNA, 21 bp, Homo sapiens
gattcaggccagcccagccag

SEQ ID NO: 1554225 - DNA, 17 bp, Homo sapiens
gattcaggtatgttgcc

SEQ ID NO: 1554226 - DNA, 14 bp, Homo sapiens
gattcagtcttctg

SEQ ID NO: 1554227 - DNA, 15 bp, Homo sapiens
gattcatagtaaaat

SEQ ID NO: 1554228 - DNA, 17 bp, Homo sapiens
gattcatatttacttct

SEQ ID NO: 1554229 - DNA, 19 bp, Homo sapiens
gattcatatttacttctta

SEQ ID NO: 1554230 - DNA, 22 bp, Homo sapiens
gattcatcctgggatgtaaacc

SEQ ID NO: 1554231 - DNA, 16 bp, Homo sapiens
gattcatttcctgccc

SEQ ID NO: 1554232 - DNA, 21 bp, Homo sapiens
gattcatttcctgcccttcct

SEQ ID NO: 1554233 - DNA, 10 bp, Homo sapiens
gattcatttt

SEQ ID NO: 1554234 - DNA, 14 bp, Homo sapiens
gattcattttcctg

SEQ ID NO: 1554235 - DNA, 15 bp, Homo sapiens
gattcattttcctgt

SEQ ID NO: 1554236 - DNA, 20 bp, Homo sapiens
gattccagagagtggctcct

SEQ ID NO: 1554237 - DNA, 18 bp, Homo sapiens
gattccagcagtgaatgc

SEQ ID NO: 1554238 - DNA, 15 bp, Homo sapiens
gattccagcccacat

SEQ ID NO: 1554239 - DNA, 13 bp, Homo sapiens
gattcccagagac

SEQ ID NO: 1554240 - DNA, 13 bp, Homo sapiens
gattcccagagca

SEQ ID NO: 1554241 - DNA, 13 bp, Homo sapiens
gattcccctccac

SEQ ID NO: 1554242 - DNA, 21 bp, Homo sapiens
gattccctcctgctactctgt

SEQ ID NO: 1554243 - DNA, 18 bp, Homo sapiens
gattcccttctgggcttc

SEQ ID NO: 1554244 - DNA, 15 bp, Homo sapiens
gattccggatcctaa

SEQ ID NO: 1554245 - DNA, 18 bp, Homo sapiens
gattccggatcctaagca

SEQ ID NO: 1554246 - DNA, 22 bp, Homo sapiens
gattcctaagccacttgaaatg

SEQ ID NO: 1554247 - DNA, 13 bp, Homo sapiens
gattcctcccagg

SEQ ID NO: 1554248 - DNA, 12 bp, Homo sapiens
gattcctgaccc

SEQ ID NO: 1554249 - DNA, 13 bp, Homo sapiens
gattcctgaccca

SEQ ID NO: 1554250 - DNA, 15 bp, Homo sapiens
gattcctgacccagg

SEQ ID NO: 1554251 - DNA, 16 bp, Homo sapiens
gattcctgacccaggc

SEQ ID NO: 1554252 - DNA, 19 bp, Homo sapiens
gattcctgacccaggccgc

SEQ ID NO: 1554253 - DNA, 12 bp, Homo sapiens
gattcgctgtcc

SEQ ID NO: 1554254 - DNA, 17 bp, Homo sapiens
gattcggtatcccccca

SEQ ID NO: 1554255 - DNA, 14 bp, Homo sapiens
gattctaaaacatt

SEQ ID NO: 1554256 - DNA, 19 bp, Homo sapiens
gattctaaaacattcttta

SEQ ID NO: 1554257 - DNA, 20 bp, Homo sapiens
gattctaaaacattctttaa

SEQ ID NO: 1554258 - DNA, 11 bp, Homo sapiens
gattctaaaat

SEQ ID NO: 1554259 - DNA, 11 bp, Homo sapiens
gattctaaaga

SEQ ID NO: 1554260 - DNA, 12 bp, Homo sapiens
gattctaaagat

SEQ ID NO: 1554261 - DNA, 14 bp, Homo sapiens
gattctaaagattc

SEQ ID NO: 1554262 - DNA, 16 bp, Homo sapiens
gattctaaagattcta

SEQ ID NO: 1554263 - DNA, 21 bp, Homo sapiens
gattctacaaaaaaccaggat

SEQ ID NO: 1554264 - DNA, 18 bp, Homo sapiens
gattctatatttcatatt

SEQ ID NO: 1554265 - DNA, 18 bp, Homo sapiens
gattctatgcctgtattt

SEQ ID NO: 1554266 - DNA, 22 bp, Homo sapiens
gattctatgcctgtatttccaa

SEQ ID NO: 1554267 - DNA, 20 bp, Homo sapiens
gattctatttcccctcttct

SEQ ID NO: 1554268 - DNA, 17 bp, Homo sapiens
gattctcccgcctcagc

SEQ ID NO: 1554269 - DNA, 13 bp, Homo sapiens
gattctccctggg

SEQ ID NO: 1554270 - DNA, 15 bp, Homo sapiens
gattctcctgtctca

SEQ ID NO: 1554271 - DNA, 22 bp, Homo sapiens
gattctctggctgtaaggctct

SEQ ID NO: 1554272 - DNA, 15 bp, Homo sapiens
gattctctgtgtcta

SEQ ID NO: 1554273 - DNA, 19 bp, Homo sapiens
gattctcttagctactgta

SEQ ID NO: 1554274 - DNA, 20 bp, Homo sapiens
gattctcttagctactgtat

SEQ ID NO: 1554275 - DNA, 19 bp, Homo sapiens
gattctgataatgctcact

SEQ ID NO: 1554276 - DNA, 15 bp, Homo sapiens
gattctgatgcatac

SEQ ID NO: 1554277 - DNA, 15 bp, Homo sapiens
gattctgatttcagt

SEQ ID NO: 1554278 - DNA, 16 bp, Homo sapiens
gattctgatttcagtt

SEQ ID NO: 1554279 - DNA, 20 bp, Homo sapiens
gattctgatttcagtttttc

SEQ ID NO: 1554280 - DNA, 15 bp, Homo sapiens
gattctgcagctgct

SEQ ID NO: 1554281 - DNA, 13 bp, Homo sapiens
gattctgctttta

SEQ ID NO: 1554282 - DNA, 17 bp, Homo sapiens
gatcaacatcttttctt

SEQ ID NO: 1554283 - DNA, 20 bp, Homo sapiens
gatcaagaaaaaaagggaga

SEQ ID NO: 1554284 - DNA, 14 bp, Homo sapiens
gatcaagaaagtgt

SEQ ID NO: 1554285 - DNA, 21 bp, Homo sapiens
gatcaagttgttgactgtgat

SEQ ID NO: 1554286 - DNA, 14 bp, Homo sapiens
gatcaataaaatgt

SEQ ID NO: 1554287 - DNA, 13 bp, Homo sapiens
gatcaataaatgt

SEQ ID NO: 1554288 - DNA, 16 bp, Homo sapiens
gatcaattaaatgtag

SEQ ID NO: 1554289 - DNA, 17 bp, Homo sapiens
gatcacaagatggaatt

SEQ ID NO: 1554290 - DNA, 13 bp, Homo sapiens
gatcacacagtgt

SEQ ID NO: 1554291 - DNA, 14 bp, Homo sapiens
gatcacacagtgtt

SEQ ID NO: 1554292 - DNA, 15 bp, Homo sapiens
gatcacacagtgtta

SEQ ID NO: 1554293 - DNA, 20 bp, Homo sapiens
gatcacacctcagtgggaag

SEQ ID NO: 1554294 - DNA, 19 bp, Homo sapiens
gatcacagcttcagccagg

SEQ ID NO: 1554295 - DNA, 21 bp, Homo sapiens
gatcacagcttcagccaggag

SEQ ID NO: 1554296 - DNA, 14 bp, Homo sapiens
gatcaccagcccgg

SEQ ID NO: 1554297 - DNA, 20 bp, Homo sapiens
gatcaccagcccggcctgct

SEQ ID NO: 1554298 - DNA, 14 bp, Homo sapiens
gatcacctgaggtc

SEQ ID NO: 1554299 - DNA, 19 bp, Homo sapiens
gatcacctgaggtcaggag

SEQ ID NO: 1554300 - DNA, 13 bp, Homo sapiens
gatcactgaattt

SEQ ID NO: 1554301 - DNA, 21 bp, Homo sapiens
gatcagaacattcagctctgg

SEQ ID NO: 1554302 - DNA, 23 bp, Homo sapiens
gatcagaacattcagctctggag

SEQ ID NO: 1554303 - DNA, 16 bp, Homo sapiens
gatcagaccataatgt

SEQ ID NO: 1554304 - DNA, 22 bp, Homo sapiens
gatcagatgctccaagattcta

SEQ ID NO: 1554305 - DNA, 15 bp, Homo sapiens
gatcagcagcgtgca

SEQ ID NO: 1554306 - DNA, 16 bp, Homo sapiens
gatcagctgtttgtca

SEQ ID NO: 1554307 - DNA, 18 bp, Homo sapiens
gatcagctgtttgtcata

SEQ ID NO: 1554308 - DNA, 13 bp, Homo sapiens
gatcaggtttgcc

SEQ ID NO: 1554309 - DNA, 16 bp, Homo sapiens
gatcagtagtttgcat

SEQ ID NO: 1554310 - DNA, 17 bp, Homo sapiens
gatcagtagtttgcatt

SEQ ID NO: 1554311 - DNA, 13 bp, Homo sapiens
gatcagtgatttt

SEQ ID NO: 1554312 - DNA, 23 bp, Homo sapiens
gatcagtgggcctccaaggaggg

SEQ ID NO: 1554313 - DNA, 18 bp, Homo sapiens
gatcagttataagtagca

SEQ ID NO: 1554314 - DNA, 17 bp, Homo sapiens
gatcataaggcttcaaa

SEQ ID NO: 1554315 - DNA, 22 bp, Homo sapiens
gatcatatttaaagatctttta

SEQ ID NO: 1554316 - DNA, 19 bp, Homo sapiens
gatcatcgccagaggtgct

SEQ ID NO: 1554317 - DNA, 12 bp, Homo sapiens
gatcatgaataa

SEQ ID NO: 1554318 - DNA, 17 bp, Homo sapiens
gatcatgaattatataa

SEQ ID NO: 1554319 - DNA, 13 bp, Homo sapiens
gatcatgtacttt

SEQ ID NO: 1554320 - DNA, 15 bp, Homo sapiens
gatcatgtacttttt

SEQ ID NO: 1554321 - DNA, 23 bp, Homo sapiens
gatcattttccccccactctccc

SEQ ID NO: 1554322 - DNA, 22 bp, Homo sapiens
gatccaaaagaagcccccagct

SEQ ID NO: 1554323 - DNA, 15 bp, Homo sapiens
gatccaagctaagca

SEQ ID NO: 1554324 - DNA, 17 bp, Homo sapiens
gatccaagctaagcact

SEQ ID NO: 1554325 - DNA, 16 bp, Homo sapiens
gatccacacacagagg

SEQ ID NO: 1554326 - DNA, 16 bp, Homo sapiens
gatccacccaacccta

SEQ ID NO: 1554327 - DNA, 17 bp, Homo sapiens
gatccacccaaccctat

SEQ ID NO: 1554328 - DNA, 12 bp, Homo sapiens
gatccacccgcc

SEQ ID NO: 1554329 - DNA, 18 bp, Homo sapiens
gatccacctgtctcagcc

SEQ ID NO: 1554330 - DNA, 13 bp, Homo sapiens
gatccagcactgg

SEQ ID NO: 1554331 - DNA, 12 bp, Homo sapiens
gatccagccact

SEQ ID NO: 1554332 - DNA, 22 bp, Homo sapiens
gatccagggacagaggccccag

SEQ ID NO: 1554333 - DNA, 18 bp, Homo sapiens
gatccagggatggagatg

SEQ ID NO: 1554334 - DNA, 13 bp, Homo sapiens
gatccatatttaa

SEQ ID NO: 1554335 - DNA, 23 bp, Homo sapiens
gatccatttccattgcttattat

SEQ ID NO: 1554336 - DNA, 15 bp, Homo sapiens
gatcccaaagcaagg

SEQ ID NO: 1554337 - DNA, 11 bp, Homo sapiens
gatcccacccc

SEQ ID NO: 1554338 - DNA, 13 bp, Homo sapiens
gatcccaccccct

SEQ ID NO: 1554339 - DNA, 15 bp, Homo sapiens
gatcccaccccctcc

SEQ ID NO: 1554340 - DNA, 17 bp, Homo sapiens
gatcccaccccctcctc

SEQ ID NO: 1554341 - DNA, 13 bp, Homo sapiens
gatcccactggcg

SEQ ID NO: 1554342 - DNA, 15 bp, Homo sapiens
gatcccagtcactcc

SEQ ID NO: 1554343 - DNA, 17 bp, Homo sapiens
gatcccagtcactcctc

SEQ ID NO: 1554344 - DNA, 17 bp, Homo sapiens
gatcccatgtcacctca

SEQ ID NO: 1554345 - DNA, 14 bp, Homo sapiens
gatccccaagtgtg

SEQ ID NO: 1554346 - DNA, 18 bp, Homo sapiens
gatccccaagtgtgaaca

SEQ ID NO: 1554347 - DNA, 13 bp, Homo sapiens
gatccccgcctgg

SEQ ID NO: 1554348 - DNA, 14 bp, Homo sapiens
gatccccgcctggc

SEQ ID NO: 1554349 - DNA, 19 bp, Homo sapiens
gatccccgcctggccagga

SEQ ID NO: 1554350 - DNA, 20 bp, Homo sapiens
gatcccgaggtatggcagag

SEQ ID NO: 1554351 - DNA, 23 bp, Homo sapiens
gatccctcccccccatgcactgt

SEQ ID NO: 1554352 - DNA, 13 bp, Homo sapiens
gatccctcctgag

SEQ ID NO: 1554353 - DNA, 16 bp, Homo sapiens
gatccctcctgagctc

SEQ ID NO: 1554354 - DNA, 17 bp, Homo sapiens
gatccctgaacccctgg

SEQ ID NO: 1554355 - DNA, 14 bp, Homo sapiens
gatccctgctctct

SEQ ID NO: 1554356 - DNA, 14 bp, Homo sapiens
gatccctgtgttgt

SEQ ID NO: 1554357 - DNA, 20 bp, Homo sapiens
gatccctgtgttgtctctag

SEQ ID NO: 1554358 - DNA, 21 bp, Homo sapiens
gatccctgtgttgtctctaga

SEQ ID NO: 1554359 - DNA, 14 bp, Homo sapiens
gatccgactgcttt

SEQ ID NO: 1554360 - DNA, 17 bp, Homo sapiens
gatccgactgctttgga

SEQ ID NO: 1554361 - DNA, 18 bp, Homo sapiens
gatccgactgctttggac

SEQ ID NO: 1554362 - DNA, 23 bp, Homo sapiens
gatccgagtgtgatttgaattct

SEQ ID NO: 1554363 - DNA, 18 bp, Homo sapiens
gatccgcaatgtggagca

SEQ ID NO: 1554364 - DNA, 18 bp, Homo sapiens
gatccgcctgcctctgcc

SEQ ID NO: 1554365 - DNA, 14 bp, Homo sapiens
gatccgctgccacc

SEQ ID NO: 1554366 - DNA, 16 bp, Homo sapiens
gatccgctgccaccac

SEQ ID NO: 1554367 - DNA, 15 bp, Homo sapiens
gatcctcccacctca

SEQ ID NO: 1554368 - DNA, 22 bp, Homo sapiens
gatcctcccacctcagcctcct

SEQ ID NO: 1554369 - DNA, 16 bp, Homo sapiens
gatcctccctcatggc

SEQ ID NO: 1554370 - DNA, 12 bp, Homo sapiens
gatcctgaagca

SEQ ID NO: 1554371 - DNA, 11 bp, Homo sapiens
gatcctgcagg

SEQ ID NO: 1554372 - DNA, 18 bp, Homo sapiens
gatcctgcgggtggggct

SEQ ID NO: 1554373 - DNA, 15 bp, Homo sapiens
gatcctgctccagca

SEQ ID NO: 1554374 - DNA, 17 bp, Homo sapiens
gatcctgctccagcagc

SEQ ID NO: 1554375 - DNA, 11 bp, Homo sapiens
gatcctgctgg

SEQ ID NO: 1554376 - DNA, 19 bp, Homo sapiens
gatcctgctggggccgcca

SEQ ID NO: 1554377 - DNA, 18 bp, Homo sapiens
gatcctggggccctcagc

SEQ ID NO: 1554378 - DNA, 19 bp, Homo sapiens
gatcctggggccctcagct

SEQ ID NO: 1554379 - DNA, 16 bp, Homo sapiens
gatcctgtccttttaa

SEQ ID NO: 1554380 - DNA, 15 bp, Homo sapiens
gatcctgttctgcgc

SEQ ID NO: 1554381 - DNA, 16 bp, Homo sapiens
gatcctgttctgcgct

SEQ ID NO: 1554382 - DNA, 15 bp, Homo sapiens
gatccttcacaggca

SEQ ID NO: 1554383 - DNA, 16 bp, Homo sapiens
gatccttccacctcag

SEQ ID NO: 1554384 - DNA, 13 bp, Homo sapiens
gatccttccatct

SEQ ID NO: 1554385 - DNA, 21 bp, Homo sapiens
gatccttccatcttgtggggc

SEQ ID NO: 1554386 - DNA, 21 bp, Homo sapiens
gatccttctgagctccacctc

SEQ ID NO: 1554387 - DNA, 22 bp, Homo sapiens
gatccttctgagctccacctct

SEQ ID NO: 1554388 - DNA, 15 bp, Homo sapiens
gatccttggtgctgt

SEQ ID NO: 1554389 - DNA, 18 bp, Homo sapiens
gatccttggtgctgtgtg

SEQ ID NO: 1554390 - DNA, 19 bp, Homo sapiens
gatccttggtgctgtgtgc

SEQ ID NO: 1554391 - DNA, 18 bp, Homo sapiens
gatcgagaccatcctggc

SEQ ID NO: 1554392 - DNA, 20 bp, Homo sapiens
gatcgagaccatcctggcca

SEQ ID NO: 1554393 - DNA, 23 bp, Homo sapiens
gatcgaggcatggggcatgtcct

SEQ ID NO: 1554394 - DNA, 22 bp, Homo sapiens
gatcgagtgtagctgtgaaatc

SEQ ID NO: 1554395 - DNA, 23 bp, Homo sapiens
gatcgcaccactgcactccagcc

SEQ ID NO: 1554396 - DNA, 18 bp, Homo sapiens
gatcgcagtttgcctggt

SEQ ID NO: 1554397 - DNA, 16 bp, Homo sapiens
gatcgctaagctggct

SEQ ID NO: 1554398 - DNA, 15 bp, Homo sapiens
gatcgcttgagccca

SEQ ID NO: 1554399 - DNA, 20 bp, Homo sapiens
gaatcctcccttcccaggag

SEQ ID NO: 1554400 - DNA, 16 bp, Homo sapiens
gaatcctggcagccca

SEQ ID NO: 1554401 - DNA, 17 bp, Homo sapiens
gaatcctggcagcccag

SEQ ID NO: 1554402 - DNA, 19 bp, Homo sapiens
gaatcctttggtgccaact

SEQ ID NO: 1554403 - DNA, 20 bp, Homo sapiens
gaatcgaagtgtttatgtaa

SEQ ID NO: 1554404 - DNA, 22 bp, Homo sapiens
gaatcggagcgaagcagagagg

SEQ ID NO: 1554405 - DNA, 13 bp, Homo sapiens
gaatctacatttg

SEQ ID NO: 1554406 - DNA, 15 bp, Homo sapiens
gaatctacatttgtt

SEQ ID NO: 1554407 - DNA, 20 bp, Homo sapiens
gaatctacatttgtttgtat

SEQ ID NO: 1554408 - DNA, 21 bp, Homo sapiens
gaatctacatttgtttgtatt

SEQ ID NO: 1554409 - DNA, 22 bp, Homo sapiens
gaatctacatttgtttgtattc

SEQ ID NO: 1554410 - DNA, 17 bp, Homo sapiens
gaatctagaaaatcaga

SEQ ID NO: 1554411 - DNA, 15 bp, Homo sapiens
gaatctagaagatgt

SEQ ID NO: 1554412 - DNA, 20 bp, Homo sapiens
gaatctataagtagtaaatc

SEQ ID NO: 1554413 - DNA, 14 bp, Homo sapiens
gaatctcagagaca

SEQ ID NO: 1554414 - DNA, 18 bp, Homo sapiens
gaatctcataattggaat

SEQ ID NO: 1554415 - DNA, 19 bp, Homo sapiens
gaatctcataatttataca

SEQ ID NO: 1554416 - DNA, 13 bp, Homo sapiens
gaatctcatccct

SEQ ID NO: 1554417 - DNA, 19 bp, Homo sapiens
gaatctcccctcctcacag

SEQ ID NO: 1554418 - DNA, 13 bp, Homo sapiens
gaatctctgtgcc

SEQ ID NO: 1554419 - DNA, 14 bp, Homo sapiens
gaatctctgtgcct

SEQ ID NO: 1554420 - DNA, 21 bp, Homo sapiens
gaatctcttcatgcttgacat

SEQ ID NO: 1554421 - DNA, 15 bp, Homo sapiens
gaatctgaatcagcc

SEQ ID NO: 1554422 - DNA, 22 bp, Homo sapiens
gaatctgcaattcaaaagttcc

SEQ ID NO: 1554423 - DNA, 21 bp, Homo sapiens
gaatctgcctgtggccttgcc

SEQ ID NO: 1554424 - DNA, 16 bp, Homo sapiens
gaatctgctcacttta

SEQ ID NO: 1554425 - DNA, 20 bp, Homo sapiens
gaatctgctgcatagctcta

SEQ ID NO: 1554426 - DNA, 16 bp, Homo sapiens
gaatctggagaccagg

SEQ ID NO: 1554427 - DNA, 13 bp, Homo sapiens
gaatctgtgcctg

SEQ ID NO: 1554428 - DNA, 14 bp, Homo sapiens
gaatctgtttctct

SEQ ID NO: 1554429 - DNA, 15 bp, Homo sapiens
gaatcttcactagaa

SEQ ID NO: 1554430 - DNA, 16 bp, Homo sapiens
gaatcttgttttgaaa

SEQ ID NO: 1554431 - DNA, 16 bp, Homo sapiens
gaatgaaattaacaca

SEQ ID NO: 1554432 - DNA, 17 bp, Homo sapiens
gaatgaagcagtatttt

SEQ ID NO: 1554433 - DNA, 16 bp, Homo sapiens
gaatgaagctgccatc

SEQ ID NO: 1554434 - DNA, 14 bp, Homo sapiens
gaatgaaggttttt

SEQ ID NO: 1554435 - DNA, 20 bp, Homo sapiens
gaatgacggtaagtgttctc

SEQ ID NO: 1554436 - DNA, 11 bp, Homo sapiens
gaatgactttt

SEQ ID NO: 1554437 - DNA, 16 bp, Homo sapiens
gaatgagactggcttg

SEQ ID NO: 1554438 - DNA, 20 bp, Homo sapiens
gaatgagagcgacacagacg

SEQ ID NO: 1554439 - DNA, 22 bp, Homo sapiens
gaatgaggaagcaaagagtgag

SEQ ID NO: 1554440 - DNA, 16 bp, Homo sapiens
gaatgaggtcccaggc

SEQ ID NO: 1554441 - DNA, 18 bp, Homo sapiens
gaatgaggtcccaggcag

SEQ ID NO: 1554442 - DNA, 14 bp, Homo sapiens
gaatgaggtgggag

SEQ ID NO: 1554443 - DNA, 15 bp, Homo sapiens
gaatgaggtgggagg

SEQ ID NO: 1554444 - DNA, 13 bp, Homo sapiens
gaatgagtgggaa

SEQ ID NO: 1554445 - DNA, 19 bp, Homo sapiens
gaatgagtgggctgtagtt

SEQ ID NO: 1554446 - DNA, 16 bp, Homo sapiens
gaatgattaatcaaag

SEQ ID NO: 1554447 - DNA, 22 bp, Homo sapiens
gaatgcaaaattgttttcactt

SEQ ID NO: 1554448 - DNA, 21 bp, Homo sapiens
gaatgcacaagaatggatcac

SEQ ID NO: 1554449 - DNA, 22 bp, Homo sapiens
gaatgcacactagcctctccag

SEQ ID NO: 1554450 - DNA, 14 bp, Homo sapiens
gaatgcagaaaaca

SEQ ID NO: 1554451 - DNA, 19 bp, Homo sapiens
gaatgcagacttttcagac

SEQ ID NO: 1554452 - DNA, 16 bp, Homo sapiens
gaatgcagattcctgg

SEQ ID NO: 1554453 - DNA, 21 bp, Homo sapiens
gaatgcagattcctgggcctg

SEQ ID NO: 1554454 - DNA, 22 bp, Homo sapiens
gaatgccactgccttcgcttct

SEQ ID NO: 1554455 - DNA, 19 bp, Homo sapiens
gaatgccatctatctagtt

SEQ ID NO: 1554456 - DNA, 16 bp, Homo sapiens
gaatgccatttagaat

SEQ ID NO: 1554457 - DNA, 23 bp, Homo sapiens
gaatgccatttagaatctagaaa

SEQ ID NO: 1554458 - DNA, 21 bp, Homo sapiens
gaatgccgcgaactgggttct

SEQ ID NO: 1554459 - DNA, 17 bp, Homo sapiens
gaatgccgctgtctctg

SEQ ID NO: 1554460 - DNA, 20 bp, Homo sapiens
gaatgccggttaaattccat

SEQ ID NO: 1554461 - DNA, 14 bp, Homo sapiens
gaatgccgtggatt

SEQ ID NO: 1554462 - DNA, 13 bp, Homo sapiens
gaatgcctcctcc

SEQ ID NO: 1554463 - DNA, 12 bp, Homo sapiens
gaatgcctcgct

SEQ ID NO: 1554464 - DNA, 19 bp, Homo sapiens
gaatgcctcgctcccttca

SEQ ID NO: 1554465 - DNA, 14 bp, Homo sapiens
gaatgctagacaga

SEQ ID NO: 1554466 - DNA, 16 bp, Homo sapiens
gaatgctatttcactt

SEQ ID NO: 1554467 - DNA, 23 bp, Homo sapiens
gaatgctcagggtcactgaacca

SEQ ID NO: 1554468 - DNA, 19 bp, Homo sapiens
gaatgctgaactccttgtt

SEQ ID NO: 1554469 - DNA, 10 bp, Homo sapiens
gaatgctgcc

SEQ ID NO: 1554470 - DNA, 12 bp, Homo sapiens
gaatgctgccag

SEQ ID NO: 1554471 - DNA, 23 bp, Homo sapiens
gaatgctggactggaggcccctg

SEQ ID NO: 1554472 - DNA, 19 bp, Homo sapiens
gaatgctgggtttatagat

SEQ ID NO: 1554473 - DNA, 16 bp, Homo sapiens
gaatgcttcctagaag

SEQ ID NO: 1554474 - DNA, 16 bp, Homo sapiens
gaatgcttctgagagc

SEQ ID NO: 1554475 - DNA, 14 bp, Homo sapiens
gaatgctttgccat

SEQ ID NO: 1554476 - DNA, 16 bp, Homo sapiens
gaatggaactactgta

SEQ ID NO: 1554477 - DNA, 17 bp, Homo sapiens
gaatggaactactgtac

SEQ ID NO: 1554478 - DNA, 20 bp, Homo sapiens
gaatggaactactgtacttt

SEQ ID NO: 1554479 - DNA, 14 bp, Homo sapiens
gaatggatcacaag

SEQ ID NO: 1554480 - DNA, 14 bp, Homo sapiens
gaatggatggggag

SEQ ID NO: 1554481 - DNA, 21 bp, Homo sapiens
gaatggcaatagggtagaatg

SEQ ID NO: 1554482 - DNA, 19 bp, Homo sapiens
gaatggcagtcctggaggc

SEQ ID NO: 1554483 - DNA, 21 bp, Homo sapiens
gaatggcagtcctggaggcag

SEQ ID NO: 1554484 - DNA, 13 bp, Homo sapiens
gaatggctttcaa

SEQ ID NO: 1554485 - DNA, 19 bp, Homo sapiens
gaatggggggcgggccagg

SEQ ID NO: 1554486 - DNA, 21 bp, Homo sapiens
gaatggggggcgggccagggt

SEQ ID NO: 1554487 - DNA, 23 bp, Homo sapiens
gaatggggggcgggccagggtgg

SEQ ID NO: 1554488 - DNA, 14 bp, Homo sapiens
gaatggtgatttta

SEQ ID NO: 1554489 - DNA, 16 bp, Homo sapiens
gaatggtgattttaaa

SEQ ID NO: 1554490 - DNA, 21 bp, Homo sapiens
gaatggtgattttaaatgtgt

SEQ ID NO: 1554491 - DNA, 22 bp, Homo sapiens
gaatggtgtgaacccgggaagc

SEQ ID NO: 1554492 - DNA, 19 bp, Homo sapiens
gaatggttccatgcctgag

SEQ ID NO: 1554493 - DNA, 22 bp, Homo sapiens
gaatggttccatgcctgagggt

SEQ ID NO: 1554494 - DNA, 22 bp, Homo sapiens
gaatgtaaaagaacttactgat

SEQ ID NO: 1554495 - DNA, 19 bp, Homo sapiens
gaatgtaaagttatgtatt

SEQ ID NO: 1554496 - DNA, 18 bp, Homo sapiens
gaatgtaactccagatag

SEQ ID NO: 1554497 - DNA, 13 bp, Homo sapiens
gaatgtaattgga

SEQ ID NO: 1554498 - DNA, 14 bp, Homo sapiens
gaatgtaattggaa

SEQ ID NO: 1554499 - DNA, 20 bp, Homo sapiens
gaatgtactatgtctgaaca

SEQ ID NO: 1554500 - DNA, 18 bp, Homo sapiens
gaatgtagcatctgagaa

SEQ ID NO: 1554501 - DNA, 13 bp, Homo sapiens
gaatgtagggcct

SEQ ID NO: 1554502 - DNA, 16 bp, Homo sapiens
gaatgtagtttgagga

SEQ ID NO: 1554503 - DNA, 17 bp, Homo sapiens
gaatgtatcaggaaata

SEQ ID NO: 1554504 - DNA, 16 bp, Homo sapiens
gaatgtattattctgc

SEQ ID NO: 1554505 - DNA, 18 bp, Homo sapiens
gaatgtattattctgcag

SEQ ID NO: 1554506 - DNA, 19 bp, Homo sapiens
gaatgtattattctgcagc

SEQ ID NO: 1554507 - DNA, 13 bp, Homo sapiens
gaatgtattctgt

SEQ ID NO: 1554508 - DNA, 22 bp, Homo sapiens
gaatgtattctgtatccgtgaa

SEQ ID NO: 1554509 - DNA, 19 bp, Homo sapiens
gatacagggagccggcggc

SEQ ID NO: 1554510 - DNA, 11 bp, Homo sapiens
gatacataaaa

SEQ ID NO: 1554511 - DNA, 14 bp, Homo sapiens
gatacatttaataa

SEQ ID NO: 1554512 - DNA, 18 bp, Homo sapiens
gataccacaaaccctgct

SEQ ID NO: 1554513 - DNA, 22 bp, Homo sapiens
gataccacaaaccctgctgaac

SEQ ID NO: 1554514 - DNA, 17 bp, Homo sapiens
gataccacctttactgt

SEQ ID NO: 1554515 - DNA, 17 bp, Homo sapiens
gataccaggttgaaaga

SEQ ID NO: 1554516 - DNA, 20 bp, Homo sapiens
gataccaggttgaaagacct

SEQ ID NO: 1554517 - DNA, 13 bp, Homo sapiens
gatacccccctct

SEQ ID NO: 1554518 - DNA, 21 bp, Homo sapiens
gatacccccctctgtcttgtg

SEQ ID NO: 1554519 - DNA, 20 bp, Homo sapiens
gatacctataaagaggatcg

SEQ ID NO: 1554520 - DNA, 15 bp, Homo sapiens
gatacctcagccctg

SEQ ID NO: 1554521 - DNA, 22 bp, Homo sapiens
gatacctcagccctggccctgc

SEQ ID NO: 1554522 - DNA, 20 bp, Homo sapiens
gacacccatgccagagaggt

SEQ ID NO: 1554523 - DNA, 21 bp, Homo sapiens
gacaccccctccccgcccctg

SEQ ID NO: 1554524 - DNA, 12 bp, Homo sapiens
gacaccctggcc

SEQ ID NO: 1554525 - DNA, 19 bp, Homo sapiens
gacaccgggccagtatcta

SEQ ID NO: 1554526 - DNA, 22 bp, Homo sapiens
gacaccgggccagtatctatat

SEQ ID NO: 1554527 - DNA, 15 bp, Homo sapiens
gacaccgtccctcag

SEQ ID NO: 1554528 - DNA, 17 bp, Homo sapiens
gacaccgtccctcagtg

SEQ ID NO: 1554529 - DNA, 15 bp, Homo sapiens
gacacctaccatgct

SEQ ID NO: 1554530 - DNA, 22 bp, Homo sapiens
gacacctccccctttcacactg

SEQ ID NO: 1554531 - DNA, 21 bp, Homo sapiens
gacacctcgcccttcagccca

SEQ ID NO: 1554532 - DNA, 16 bp, Homo sapiens
gacacctgcacctccc

SEQ ID NO: 1554533 - DNA, 18 bp, Homo sapiens
gacacctggtgcgggcct

SEQ ID NO: 1554534 - DNA, 19 bp, Homo sapiens
gacacctggtgcgggcctg

SEQ ID NO: 1554535 - DNA, 22 bp, Homo sapiens
gacacctggtgcgggcctggcc

SEQ ID NO: 1554536 - DNA, 21 bp, Homo sapiens
gacaccttctgagtattctca

SEQ ID NO: 1554537 - DNA, 14 bp, Homo sapiens
gacacctttaggtt

SEQ ID NO: 1554538 - DNA, 16 bp, Homo sapiens
gacacgacagcacaca

SEQ ID NO: 1554539 - DNA, 13 bp, Homo sapiens
gacacgagccaca

SEQ ID NO: 1554540 - DNA, 19 bp, Homo sapiens
gacacgagccacaagctgc

SEQ ID NO: 1554541 - DNA, 18 bp, Homo sapiens
gacacgcagcctgctctg

SEQ ID NO: 1554542 - DNA, 21 bp, Homo sapiens
gacacgccttcccctcagcca

SEQ ID NO: 1554543 - DNA, 16 bp, Homo sapiens
gacacgctcgcgggca

SEQ ID NO: 1554544 - DNA, 17 bp, Homo sapiens
gacacgctcgcgggcag

SEQ ID NO: 1554545 - DNA, 20 bp, Homo sapiens
gacacgggcagcctggctcc

SEQ ID NO: 1554546 - DNA, 14 bp, Homo sapiens
gacactaactttgt

SEQ ID NO: 1554547 - DNA, 18 bp, Homo sapiens
gacactaagttatagtat

SEQ ID NO: 1554548 - DNA, 22 bp, Homo sapiens
gacactaccctgagatctgcac

SEQ ID NO: 1554549 - DNA, 16 bp, Homo sapiens
gacactattcactaaa

SEQ ID NO: 1554550 - DNA, 23 bp, Homo sapiens
gacactcctcctcggaagagccc

SEQ ID NO: 1554551 - DNA, 21 bp, Homo sapiens
gacactcgcttgccgggcctg

SEQ ID NO: 1554552 - DNA, 17 bp, Homo sapiens
gacactctatatgtagt

SEQ ID NO: 1554553 - DNA, 13 bp, Homo sapiens
gacactctgctct

SEQ ID NO: 1554554 - DNA, 16 bp, Homo sapiens
gacactctgctctgcc

SEQ ID NO: 1554555 - DNA, 17 bp, Homo sapiens
gacactctgctctgccc

SEQ ID NO: 1554556 - DNA, 19 bp, Homo sapiens
gacactgaaagttttgtaa

SEQ ID NO: 1554557 - DNA, 20 bp, Homo sapiens
gacactgaagaagtcactga

SEQ ID NO: 1554558 - DNA, 16 bp, Homo sapiens
gacactgccacacagg

SEQ ID NO: 1554559 - DNA, 15 bp, Homo sapiens
gacactgctgcacca

SEQ ID NO: 1554560 - DNA, 19 bp, Homo sapiens
gacactgctgcaccagagt

SEQ ID NO: 1554561 - DNA, 20 bp, Homo sapiens
gacactgctgcaccagagtg

SEQ ID NO: 1554562 - DNA, 21 bp, Homo sapiens
gacactgctgcaccagagtga

SEQ ID NO: 1554563 - DNA, 18 bp, Homo sapiens
gacactggaccaggtcct

SEQ ID NO: 1554564 - DNA, 12 bp, Homo sapiens
gacactggcatg

SEQ ID NO: 1554565 - DNA, 13 bp, Homo sapiens
gacactgtacaag

SEQ ID NO: 1554566 - DNA, 18 bp, Homo sapiens
gacacttcagatctgagg

SEQ ID NO: 1554567 - DNA, 21 bp, Homo sapiens
gacacttcatggaccaagaat

SEQ ID NO: 1554568 - DNA, 17 bp, Homo sapiens
gacacttccctctgttt

SEQ ID NO: 1554569 - DNA, 20 bp, Homo sapiens
gacacttccctctgtttctc

SEQ ID NO: 1554570 - DNA, 13 bp, Homo sapiens
gacacttcctgcc

SEQ ID NO: 1554571 - DNA, 23 bp, Homo sapiens
gacacttgccttcttcacccagc

SEQ ID NO: 1554572 - DNA, 20 bp, Homo sapiens
gacactttgaaatgtgtttc

SEQ ID NO: 1554573 - DNA, 19 bp, Homo sapiens
gacacttttttgagtggat

SEQ ID NO: 1554574 - DNA, 18 bp, Homo sapiens
gacagaaaagtgcctgag

SEQ ID NO: 1554575 - DNA, 19 bp, Homo sapiens
gacagaaaagtgcctgagc

SEQ ID NO: 1554576 - DNA, 16 bp, Homo sapiens
gacagaaaccaagcca

SEQ ID NO: 1554577 - DNA, 13 bp, Homo sapiens
gacagaaggactg

SEQ ID NO: 1554578 - DNA, 14 bp, Homo sapiens
gacagaaggtgcca

SEQ ID NO: 1554579 - DNA, 23 bp, Homo sapiens
gacagaaggtgccactttaccca

SEQ ID NO: 1554580 - DNA, 16 bp, Homo sapiens
gacagaatgtgttctt

SEQ ID NO: 1554581 - DNA, 15 bp, Homo sapiens
gacagacctggacac

SEQ ID NO: 1554582 - DNA, 14 bp, Homo sapiens
gacagactatttgc

SEQ ID NO: 1554583 - DNA, 16 bp, Homo sapiens
gacagacttcacagcg

SEQ ID NO: 1554584 - DNA, 17 bp, Homo sapiens
gacagagaaggcagcag

SEQ ID NO: 1554585 - DNA, 19 bp, Homo sapiens
gacagagaggactgtaggg

SEQ ID NO: 1554586 - DNA, 16 bp, Homo sapiens
gacagagcccagcatc

SEQ ID NO: 1554587 - DNA, 18 bp, Homo sapiens
gacagaggccccagcctc

SEQ ID NO: 1554588 - DNA, 19 bp, Homo sapiens
gacagataaatccttaaca

SEQ ID NO: 1554589 - DNA, 20 bp, Homo sapiens
gacagataaatccttaacat

SEQ ID NO: 1554590 - DNA, 20 bp, Homo sapiens
gacagatgaatgccgtggat

SEQ ID NO: 1554591 - DNA, 22 bp, Homo sapiens
gacagcaacaaaatcatggctt

SEQ ID NO: 1554592 - DNA, 16 bp, Homo sapiens
gacagcagcctgtatg

SEQ ID NO: 1554593 - DNA, 18 bp, Homo sapiens
gacagcagcctgtatgtg

SEQ ID NO: 1554594 - DNA, 21 bp, Homo sapiens
gacagcagcctgtatgtggtg

SEQ ID NO: 1554595 - DNA, 16 bp, Homo sapiens
gacagcagctcaggca

SEQ ID NO: 1554596 - DNA, 22 bp, Homo sapiens
gacagcattttaaggttctcag

SEQ ID NO: 1554597 - DNA, 11 bp, Homo sapiens
gacagccaggt

SEQ ID NO: 1554598 - DNA, 11 bp, Homo sapiens
gacagcccaga

SEQ ID NO: 1554599 - DNA, 22 bp, Homo sapiens
gacagcccaggatactggcaca

SEQ ID NO: 1554600 - DNA, 15 bp, Homo sapiens
gacagccccaccctg

SEQ ID NO: 1554601 - DNA, 11 bp, Homo sapiens
gacagccttca

SEQ ID NO: 1554602 - DNA, 17 bp, Homo sapiens
gacagctccctctgcct

SEQ ID NO: 1554603 - DNA, 12 bp, Homo sapiens
gacagctgccca

SEQ ID NO: 1554604 - DNA, 19 bp, Homo sapiens
gacagctgcccagacacat

SEQ ID NO: 1554605 - DNA, 16 bp, Homo sapiens
gacagctgctgggacc

SEQ ID NO: 1554606 - DNA, 19 bp, Homo sapiens
gacagctgctgggacccac

SEQ ID NO: 1554607 - DNA, 22 bp, Homo sapiens
gacagctgctgggacccacctc

SEQ ID NO: 1554608 - DNA, 17 bp, Homo sapiens
gacagctgtccctgtca

SEQ ID NO: 1554609 - DNA, 20 bp, Homo sapiens
gacagcttcctcacacccct

SEQ ID NO: 1554610 - DNA, 15 bp, Homo sapiens
gacagcttgagccgg

SEQ ID NO: 1554611 - DNA, 16 bp, Homo sapiens
gacagcttggaaaggg

SEQ ID NO: 1554612 - DNA, 17 bp, Homo sapiens
gacagctttctgggatg

SEQ ID NO: 1554613 - DNA, 18 bp, Homo sapiens
gacagctttctgggatgt

SEQ ID NO: 1554614 - DNA, 20 bp, Homo sapiens
gacagctttctgggatgtca

SEQ ID NO: 1554615 - DNA, 14 bp, Homo sapiens
gacagctttgctcc

SEQ ID NO: 1554616 - DNA, 23 bp, Homo sapiens
gacagctttgctccgctcccacc

SEQ ID NO: 1554617 - DNA, 18 bp, Homo sapiens
gacaggaaaatcctctgg

SEQ ID NO: 1554618 - DNA, 16 bp, Homo sapiens
gacaggacagaatgtg

SEQ ID NO: 1554619 - DNA, 23 bp, Homo sapiens
gacaggacagtgcttcagcctga

SEQ ID NO: 1554620 - DNA, 12 bp, Homo sapiens
gacaggaccctc

SEQ ID NO: 1554621 - DNA, 15 bp, Homo sapiens
gacaggaccctcagg

SEQ ID NO: 1554622 - DNA, 22 bp, Homo sapiens
gacaggaccctcaggaattcag

SEQ ID NO: 1554623 - DNA, 14 bp, Homo sapiens
gacccaaggaggaa

SEQ ID NO: 1554624 - DNA, 19 bp, Homo sapiens
gacccaagtggggcctcct

SEQ ID NO: 1554625 - DNA, 12 bp, Homo sapiens
gacccaccagtg

SEQ ID NO: 1554626 - DNA, 18 bp, Homo sapiens
gacccacccatcttcctg

SEQ ID NO: 1554627 - DNA, 21 bp, Homo sapiens
gacccacccatcttcctgctg

SEQ ID NO: 1554628 - DNA, 16 bp, Homo sapiens
gacccaccccaactct

SEQ ID NO: 1554629 - DNA, 21 bp, Homo sapiens
gacccaccccaactctcccca

SEQ ID NO: 1554630 - DNA, 23 bp, Homo sapiens
gacccaccccaactctccccagt

SEQ ID NO: 1554631 - DNA, 18 bp, Homo sapiens
gacccacccctgtgctcc

SEQ ID NO: 1554632 - DNA, 16 bp, Homo sapiens
gacccacctccccctc

SEQ ID NO: 1554633 - DNA, 18 bp, Homo sapiens
gacccacgtgctagggga

SEQ ID NO: 1554634 - DNA, 16 bp, Homo sapiens
gacccagaatggagcc

SEQ ID NO: 1554635 - DNA, 20 bp, Homo sapiens
gacccagaatggagcctgct

SEQ ID NO: 1554636 - DNA, 22 bp, Homo sapiens
gacccagagtggagtctgagtc

SEQ ID NO: 1554637 - DNA, 15 bp, Homo sapiens
gacccagcaggaagc

SEQ ID NO: 1554638 - DNA, 16 bp, Homo sapiens
gacccagcaggaagcc

SEQ ID NO: 1554639 - DNA, 21 bp, Homo sapiens
gacccagcaggaagccaggct

SEQ ID NO: 1554640 - DNA, 15 bp, Homo sapiens
gacccagcatctccc

SEQ ID NO: 1554641 - DNA, 18 bp, Homo sapiens
gacccagcatctcccagc

SEQ ID NO: 1554642 - DNA, 13 bp, Homo sapiens
gacttatttctgc

SEQ ID NO: 1554643 - DNA, 15 bp, Homo sapiens
gacttatttctgctc

SEQ ID NO: 1554644 - DNA, 18 bp, Homo sapiens
gacttatttctgctctgg

SEQ ID NO: 1554645 - DNA, 14 bp, Homo sapiens
gacttcacactgca

SEQ ID NO: 1554646 - DNA, 13 bp, Homo sapiens
gacttcactgtat

SEQ ID NO: 1554647 - DNA, 21 bp, Homo sapiens
gacttcaggaacaagtaatgt

SEQ ID NO: 1554648 - DNA, 18 bp, Homo sapiens
gacttcagggcagggctc

SEQ ID NO: 1554649 - DNA, 19 bp, Homo sapiens
gacttccaaatcctggaag

SEQ ID NO: 1554650 - DNA, 15 bp, Homo sapiens
gacttccatgcctta

SEQ ID NO: 1554651 - DNA, 17 bp, Homo sapiens
gacttcccactgttctg

SEQ ID NO: 1554652 - DNA, 12 bp, Homo sapiens
gacttcccagct

SEQ ID NO: 1554653 - DNA, 18 bp, Homo sapiens
gacttcccagctaggaag

SEQ ID NO: 1554654 - DNA, 17 bp, Homo sapiens
gacttccccaatatctt

SEQ ID NO: 1554655 - DNA, 11 bp, Homo sapiens
gacttccccat

SEQ ID NO: 1554656 - DNA, 12 bp, Homo sapiens
gacttccccatc

SEQ ID NO: 1554657 - DNA, 15 bp, Homo sapiens
gacttccccatcccg

SEQ ID NO: 1554658 - DNA, 17 bp, Homo sapiens
gacttccccatcccgaa

SEQ ID NO: 1554659 - DNA, 16 bp, Homo sapiens
gacttcccctgggcaa

SEQ ID NO: 1554660 - DNA, 20 bp, Homo sapiens
gacttccctggaggagaagt

SEQ ID NO: 1554661 - DNA, 21 bp, Homo sapiens
gacttcctagggatctgaaat

SEQ ID NO: 1554662 - DNA, 13 bp, Homo sapiens
gacttcctggggc

SEQ ID NO: 1554663 - DNA, 20 bp, Homo sapiens
gacttcctgtccagctccaa

SEQ ID NO: 1554664 - DNA, 18 bp, Homo sapiens
gacttctaagtaaaacca

SEQ ID NO: 1554665 - DNA, 24 bp, Homo sapiens
gacttctaagtaaaaccacagcag

SEQ ID NO: 1554666 - DNA, 15 bp, Homo sapiens
gacttctcccctgcc

SEQ ID NO: 1554667 - DNA, 22 bp, Homo sapiens
gacttctcccctgcccttcctc

SEQ ID NO: 1554668 - DNA, 22 bp, Homo sapiens
gacttctgacaaaggtggtaaa

SEQ ID NO: 1554669 - DNA, 14 bp, Homo sapiens
gacttctgcctgga

SEQ ID NO: 1554670 - DNA, 13 bp, Homo sapiens
gacttctggaagg

SEQ ID NO: 1554671 - DNA, 14 bp, Homo sapiens
gacttctggaaggc

SEQ ID NO: 1554672 - DNA, 17 bp, Homo sapiens
gacttgaaaagaaagaa

SEQ ID NO: 1554673 - DNA, 20 bp, Homo sapiens
gacttgaatattcctggact

SEQ ID NO: 1554674 - DNA, 13 bp, Homo sapiens
gacttgaccccga

SEQ ID NO: 1554675 - DNA, 20 bp, Homo sapiens
gacttgatgttccttccaga

SEQ ID NO: 1554676 - DNA, 21 bp, Homo sapiens
gacttgccagagccgggcaca

SEQ ID NO: 1554677 - DNA, 22 bp, Homo sapiens
gacttgctgtccaggcagctcc

SEQ ID NO: 1554678 - DNA, 21 bp, Homo sapiens
gacttgctgtgtgaccctggg

SEQ ID NO: 1554679 - DNA, 20 bp, Homo sapiens
gacttgctgttttgttctgt

SEQ ID NO: 1554680 - DNA, 12 bp, Homo sapiens
gacttgcttcct

SEQ ID NO: 1554681 - DNA, 18 bp, Homo sapiens
gacttggagactcctggt

SEQ ID NO: 1554682 - DNA, 21 bp, Homo sapiens
gacttggagactcctggtctg

SEQ ID NO: 1554683 - DNA, 16 bp, Homo sapiens
gacttggagctgtcct

SEQ ID NO: 1554684 - DNA, 14 bp, Homo sapiens
gacttggcaggtgc

SEQ ID NO: 1554685 - DNA, 16 bp, Homo sapiens
gacttggccccagacg

SEQ ID NO: 1554686 - DNA, 20 bp, Homo sapiens
gacttggggagatggagttc

SEQ ID NO: 1554687 - DNA, 20 bp, Homo sapiens
gacttgggtctcatttagaa

SEQ ID NO: 1554688 - DNA, 20 bp, Homo sapiens
gacttggttggtagggtggg

SEQ ID NO: 1554689 - DNA, 19 bp, Homo sapiens
gacttgtacaaacagtatt

SEQ ID NO: 1554690 - DNA, 18 bp, Homo sapiens
gacttgtatatttgtaca

SEQ ID NO: 1554691 - DNA, 19 bp, Homo sapiens
gacttgtatatttgtacaa

SEQ ID NO: 1554692 - DNA, 17 bp, Homo sapiens
gacttgtatgctgccca

SEQ ID NO: 1554693 - DNA, 18 bp, Homo sapiens
gacttgtttgtcttccat

SEQ ID NO: 1554694 - DNA, 21 bp, Homo sapiens
gactttaaactttcccttggc

SEQ ID NO: 1554695 - DNA, 23 bp, Homo sapiens
gactttacaggaggttgtggatg

SEQ ID NO: 1554696 - DNA, 17 bp, Homo sapiens
gactttagcttttcctt

SEQ ID NO: 1554697 - DNA, 22 bp, Homo sapiens
gactttatctaatacctctgtg

SEQ ID NO: 1554698 - DNA, 15 bp, Homo sapiens
gactttatttatttc

SEQ ID NO: 1554699 - DNA, 16 bp, Homo sapiens
gactttcacaccatta

SEQ ID NO: 1554700 - DNA, 16 bp, Homo sapiens
gactttctgcctggag

SEQ ID NO: 1554701 - DNA, 18 bp, Homo sapiens
gactttcttgcatgaatc

SEQ ID NO: 1554702 - DNA, 20 bp, Homo sapiens
gactttgattgcacattgtt

SEQ ID NO: 1554703 - DNA, 12 bp, Homo sapiens
gactttgcttgc

SEQ ID NO: 1554704 - DNA, 14 bp, Homo sapiens
gactttgcttgctt

SEQ ID NO: 1554705 - DNA, 17 bp, Homo sapiens
gactttgcttgctttga

SEQ ID NO: 1554706 - DNA, 15 bp, Homo sapiens
gactttgtagatcct

SEQ ID NO: 1554707 - DNA, 20 bp, Homo sapiens
gacttttattaataaaacaa

SEQ ID NO: 1554708 - DNA, 22 bp, Homo sapiens
gacttttcaagtatttaagcct

SEQ ID NO: 1554709 - DNA, 22 bp, Homo sapiens
gacttttccaatatgtgatttt

SEQ ID NO: 1554710 - DNA, 22 bp, Homo sapiens
gacttttccattgaccagctct

SEQ ID NO: 1554711 - DNA, 22 bp, Homo sapiens
gacttttcgaccaattcaaccc

SEQ ID NO: 1554712 - DNA, 19 bp, Homo sapiens
gacttttcgttaacattga

SEQ ID NO: 1554713 - DNA, 13 bp, Homo sapiens
gacttttctgtaa

SEQ ID NO: 1554714 - DNA, 13 bp, Homo sapiens
gacttttctttct

SEQ ID NO: 1554715 - DNA, 13 bp, Homo sapiens
gacttttgaaaaa

SEQ ID NO: 1554716 - DNA, 13 bp, Homo sapiens
gacttttgcttta

SEQ ID NO: 1554717 - DNA, 17 bp, Homo sapiens
gacctcatcctgctctt

SEQ ID NO: 1554718 - DNA, 19 bp, Homo sapiens
gacctcatctgtggagctg

SEQ ID NO: 1554719 - DNA, 20 bp, Homo sapiens
gacctcatctgtggagctgc

SEQ ID NO: 1554720 - DNA, 14 bp, Homo sapiens
gacctcatgcccag

SEQ ID NO: 1554721 - DNA, 17 bp, Homo sapiens
gacctccatactgggct

SEQ ID NO: 1554722 - DNA, 14 bp, Homo sapiens
gacctccatttccc

SEQ ID NO: 1554723 - DNA, 14 bp, Homo sapiens
gacctccccacccg

SEQ ID NO: 1554724 - DNA, 17 bp, Homo sapiens
gacctcctaacaagtag

SEQ ID NO: 1554725 - DNA, 19 bp, Homo sapiens
gacctccttagccctgtct

SEQ ID NO: 1554726 - DNA, 18 bp, Homo sapiens
gacctcggatgaccatac

SEQ ID NO: 1554727 - DNA, 18 bp, Homo sapiens
gacctcgtcctccccctg

SEQ ID NO: 1554728 - DNA, 19 bp, Homo sapiens
gacctcgtcctccccctgc

SEQ ID NO: 1554729 - DNA, 22 bp, Homo sapiens
gacctcgtcctccccctgccag

SEQ ID NO: 1554730 - DNA, 22 bp, Homo sapiens
gacctcgtgatccgcctgcctc

SEQ ID NO: 1554731 - DNA, 20 bp, Homo sapiens
gacctctgcttttgcacacc

SEQ ID NO: 1554732 - DNA, 22 bp, Homo sapiens
gacctctgtaggcagcagagag

SEQ ID NO: 1554733 - DNA, 14 bp, Homo sapiens
gacctctgttgtcc

SEQ ID NO: 1554734 - DNA, 16 bp, Homo sapiens
gacctctgttgtcctc

SEQ ID NO: 1554735 - DNA, 19 bp, Homo sapiens
gacctcttccctctgggcc

SEQ ID NO: 1554736 - DNA, 15 bp, Homo sapiens
gacctgaaattccaa

SEQ ID NO: 1554737 - DNA, 21 bp, Homo sapiens
gacctgacaccgtccctcagt

SEQ ID NO: 1554738 - DNA, 22 bp, Homo sapiens
gacctgacaccgtccctcagtg

SEQ ID NO: 1554739 - DNA, 19 bp, Homo sapiens
gacctgaccccattcctga

SEQ ID NO: 1554740 - DNA, 15 bp, Homo sapiens
gacctgaggctgtgg

SEQ ID NO: 1554741 - DNA, 17 bp, Homo sapiens
gacctgaggctgtggtc

SEQ ID NO: 1554742 - DNA, 21 bp, Homo sapiens
gacctgagtcggccccacatg

SEQ ID NO: 1554743 - DNA, 14 bp, Homo sapiens
gacctgatcctgga

SEQ ID NO: 1554744 - DNA, 15 bp, Homo sapiens
gacctgatttattga

SEQ ID NO: 1554745 - DNA, 21 bp, Homo sapiens
gacctgatttattgaaatttt

SEQ ID NO: 1554746 - DNA, 20 bp, Homo sapiens
gacctgcactggggagcccg

SEQ ID NO: 1554747 - DNA, 17 bp, Homo sapiens
gacctgccaggcagggg

SEQ ID NO: 1554748 - DNA, 13 bp, Homo sapiens
gacctgccctctc

SEQ ID NO: 1554749 - DNA, 16 bp, Homo sapiens
gacctgccctctctgc

SEQ ID NO: 1554750 - DNA, 23 bp, Homo sapiens
gacctgccctctctgcgctgagg

SEQ ID NO: 1554751 - DNA, 19 bp, Homo sapiens
gacctgcctcctgcctgcc

SEQ ID NO: 1554752 - DNA, 18 bp, Homo sapiens
gacctggagcccctgggt

SEQ ID NO: 1554753 - DNA, 17 bp, Homo sapiens
gacctggtaccctcctg

SEQ ID NO: 1554754 - DNA, 15 bp, Homo sapiens
gacctggtgggagca

SEQ ID NO: 1554755 - DNA, 22 bp, Homo sapiens
gacctggttggccgtggtccag

SEQ ID NO: 1554756 - DNA, 12 bp, Homo sapiens
gacctgtaatca

SEQ ID NO: 1554757 - DNA, 19 bp, Homo sapiens
gacctgtcaccctgcagga

SEQ ID NO: 1554758 - DNA, 16 bp, Homo sapiens
gacctgtcgtctctcc

SEQ ID NO: 1554759 - DNA, 22 bp, Homo sapiens
gacctgtcgtctctcccacccc

SEQ ID NO: 1554760 - DNA, 17 bp, Homo sapiens
gacctgtgaccagcact

SEQ ID NO: 1554761 - DNA, 19 bp, Homo sapiens
gacctgtgtcactacgtga

SEQ ID NO: 1554762 - DNA, 18 bp, Homo sapiens
gacctgttgccagcagat

SEQ ID NO: 1554763 - DNA, 19 bp, Homo sapiens
gaccttagaaatcattgta

SEQ ID NO: 1554764 - DNA, 17 bp, Homo sapiens
gaccttagcgttctgga

SEQ ID NO: 1554765 - DNA, 15 bp, Homo sapiens
gaccttaggccttcc

SEQ ID NO: 1554766 - DNA, 18 bp, Homo sapiens
gaccttaggccttcctct

SEQ ID NO: 1554767 - DNA, 16 bp, Homo sapiens
gaccttcgggctgtgc

SEQ ID NO: 1554768 - DNA, 19 bp, Homo sapiens
gaccttctgatcttggaaa

SEQ ID NO: 1554769 - DNA, 15 bp, Homo sapiens
gaccttggagagctc

SEQ ID NO: 1554770 - DNA, 16 bp, Homo sapiens
gaccttgttacttctg

SEQ ID NO: 1554771 - DNA, 17 bp, Homo sapiens
gacctttccaccacagc

SEQ ID NO: 1554772 - DNA, 21 bp, Homo sapiens
gacctttccaccacagccagc

SEQ ID NO: 1554773 - DNA, 19 bp, Homo sapiens
gacctttgggttctttctg

SEQ ID NO: 1554774 - DNA, 20 bp, Homo sapiens
gacctttgggttctttctgg

SEQ ID NO: 1554775 - DNA, 21 bp, Homo sapiens
gacgaacatccaaccttccca

SEQ ID NO: 1554776 - DNA, 22 bp, Homo sapiens
gacgaagcggagagagccaaga

SEQ ID NO: 1554777 - DNA, 11 bp, Homo sapiens
gacgagacccc

SEQ ID NO: 1554778 - DNA, 14 bp, Homo sapiens
gacgagacccccat

SEQ ID NO: 1554779 - DNA, 22 bp, Homo sapiens
gacgagacccccatccagcctc

SEQ ID NO: 1554780 - DNA, 14 bp, Homo sapiens
gacgaggggcaggg

SEQ ID NO: 1554781 - DNA, 19 bp, Homo sapiens
gacgcacacagctgagcac

SEQ ID NO: 1554782 - DNA, 20 bp, Homo sapiens
gacgcagacagaggggatgg

SEQ ID NO: 1554783 - DNA, 14 bp, Homo sapiens
gacgcagcagctgg

SEQ ID NO: 1554784 - DNA, 13 bp, Homo sapiens
gacgcaggaatgg

SEQ ID NO: 1554785 - DNA, 16 bp, Homo sapiens
gacgcatagactgagg

SEQ ID NO: 1554786 - DNA, 14 bp, Homo sapiens
gacgccacagccca

SEQ ID NO: 1554787 - DNA, 22 bp, Homo sapiens
gacgccacagcccagccacgga

SEQ ID NO: 1554788 - DNA, 11 bp, Homo sapiens
gacgcccaccc

SEQ ID NO: 1554789 - DNA, 13 bp, Homo sapiens
gacgcccagctcc

SEQ ID NO: 1554790 - DNA, 22 bp, Homo sapiens
gacgcccagctccgcctgctgg

SEQ ID NO: 1554791 - DNA, 11 bp, Homo sapiens
gacgccctgcg

SEQ ID NO: 1554792 - DNA, 18 bp, Homo sapiens
gacgccttccaggtcagg

SEQ ID NO: 1554793 - DNA, 21 bp, Homo sapiens
gacgctgatccataaagacaa

SEQ ID NO: 1554794 - DNA, 18 bp, Homo sapiens
gacgcttgtgacagtgcc

SEQ ID NO: 1554795 - DNA, 19 bp, Homo sapiens
gacggaaaatgcttaaaaa

SEQ ID NO: 1554796 - DNA, 19 bp, Homo sapiens
gacggacatccaggcgtgg

SEQ ID NO: 1554797 - DNA, 15 bp, Homo sapiens
gacggagagaaaaaa

SEQ ID NO: 1554798 - DNA, 12 bp, Homo sapiens
gacggaggaggg

SEQ ID NO: 1554799 - DNA, 20 bp, Homo sapiens
gacggaggaggggaaggggc

SEQ ID NO: 1554800 - DNA, 12 bp, Homo sapiens
gacggaggggag

SEQ ID NO: 1554801 - DNA, 21 bp, Homo sapiens
gacggaggggagtagagaagt

SEQ ID NO: 1554802 - DNA, 11 bp, Homo sapiens
gacggcaggct

SEQ ID NO: 1554803 - DNA, 15 bp, Homo sapiens
gacggcggccaggca

SEQ ID NO: 1554804 - DNA, 23 bp, Homo sapiens
gacggctgggtgtttcagtttga

SEQ ID NO: 1554805 - DNA, 17 bp, Homo sapiens
gactcctcaggagagac

SEQ ID NO: 1554806 - DNA, 13 bp, Homo sapiens
gactcctgaccat

SEQ ID NO: 1554807 - DNA, 13 bp, Homo sapiens
gactcctgccctg

SEQ ID NO: 1554808 - DNA, 17 bp, Homo sapiens
gactcctgctggtacct

SEQ ID NO: 1554809 - DNA, 14 bp, Homo sapiens
gactcctggtctgt

SEQ ID NO: 1554810 - DNA, 16 bp, Homo sapiens
gactcgactctgtgcc

SEQ ID NO: 1554811 - DNA, 17 bp, Homo sapiens
gactcgactctgtgcct

SEQ ID NO: 1554812 - DNA, 16 bp, Homo sapiens
gactcgagaactttca

SEQ ID NO: 1554813 - DNA, 15 bp, Homo sapiens
gactcggtgagccgg

SEQ ID NO: 1554814 - DNA, 16 bp, Homo sapiens
gactcgttacctgccg

SEQ ID NO: 1554815 - DNA, 22 bp, Homo sapiens
gactctaaatgcagttttaaga

SEQ ID NO: 1554816 - DNA, 23 bp, Homo sapiens
gactctaaatgcagttttaagaa

SEQ ID NO: 1554817 - DNA, 23 bp, Homo sapiens
gactctacctcatatcagtttgc

SEQ ID NO: 1554818 - DNA, 18 bp, Homo sapiens
gactctagagtccaaggt

SEQ ID NO: 1554819 - DNA, 15 bp, Homo sapiens
gactctagcaaggct

SEQ ID NO: 1554820 - DNA, 14 bp, Homo sapiens
gactctcctcctcc

SEQ ID NO: 1554821 - DNA, 17 bp, Homo sapiens
gactctcctcctcccct

SEQ ID NO: 1554822 - DNA, 21 bp, Homo sapiens
gactctcgtgcatttcaactt

SEQ ID NO: 1554823 - DNA, 15 bp, Homo sapiens
gactctgaaatctga

SEQ ID NO: 1554824 - DNA, 20 bp, Homo sapiens
gactctgattctacagtgat

SEQ ID NO: 1554825 - DNA, 15 bp, Homo sapiens
gactctgcacccgcc

SEQ ID NO: 1554826 - DNA, 14 bp, Homo sapiens
gactctgctagact

SEQ ID NO: 1554827 - DNA, 20 bp, Homo sapiens
gactctggaggtcatctggc

SEQ ID NO: 1554828 - DNA, 23 bp, Homo sapiens
gactctggaggtcatctggcgga

SEQ ID NO: 1554829 - DNA, 17 bp, Homo sapiens
gactctggccctggccc

SEQ ID NO: 1554830 - DNA, 18 bp, Homo sapiens
gactctggccctggccct

SEQ ID NO: 1554831 - DNA, 13 bp, Homo sapiens
gactctgggcagg

SEQ ID NO: 1554832 - DNA, 18 bp, Homo sapiens
gactctgtggggccttgg

SEQ ID NO: 1554833 - DNA, 18 bp, Homo sapiens
gactcttgactcttgcct

SEQ ID NO: 1554834 - DNA, 21 bp, Homo sapiens
gactcttgcctgtttcccagg

SEQ ID NO: 1554835 - DNA, 14 bp, Homo sapiens
gactgaaagcagca

SEQ ID NO: 1554836 - DNA, 17 bp, Homo sapiens
gactgaaagcagcagct

SEQ ID NO: 1554837 - DNA, 19 bp, Homo sapiens
gaattttttttaacattcc

SEQ ID NO: 1554838 - DNA, 21 bp, Homo sapiens
gaattttttttaacattcctc

SEQ ID NO: 1554839 - DNA, 16 bp, Homo sapiens
gacaaaaacagcctca

SEQ ID NO: 1554840 - DNA, 18 bp, Homo sapiens
gacaaaaagtatattaaa

SEQ ID NO: 1554841 - DNA, 22 bp, Homo sapiens
gacaaaaagtatattaaacaaa

SEQ ID NO: 1554842 - DNA, 22 bp, Homo sapiens
gacaaaaatcaaagaacagatg

SEQ ID NO: 1554843 - DNA, 12 bp, Homo sapiens
gacaaaacattt

SEQ ID NO: 1554844 - DNA, 18 bp, Homo sapiens
gacaaaacctaacttgcg

SEQ ID NO: 1554845 - DNA, 21 bp, Homo sapiens
gacaaaatggggcagaagaga

SEQ ID NO: 1554846 - DNA, 15 bp, Homo sapiens
gacaaaatttgagaa

SEQ ID NO: 1554847 - DNA, 19 bp, Homo sapiens
gacaaacacctcccaggag

SEQ ID NO: 1554848 - DNA, 22 bp, Homo sapiens
gacaaacacctcccaggagaca

SEQ ID NO: 1554849 - DNA, 20 bp, Homo sapiens
gacaaacccggaagatcaga

SEQ ID NO: 1554850 - DNA, 20 bp, Homo sapiens
gacaaagccaaactctgcca

SEQ ID NO: 1554851 - DNA, 23 bp, Homo sapiens
gacaaaggaggaatttactttct

SEQ ID NO: 1554852 - DNA, 16 bp, Homo sapiens
gacaaagtcccagaat

SEQ ID NO: 1554853 - DNA, 11 bp, Homo sapiens
gacaaagtgcc

SEQ ID NO: 1554854 - DNA, 14 bp, Homo sapiens
gacaaagtgcctca

SEQ ID NO: 1554855 - DNA, 18 bp, Homo sapiens
gacaaagtgtgtaattat

SEQ ID NO: 1554856 - DNA, 18 bp, Homo sapiens
gacaaagttccaaaatgc

SEQ ID NO: 1554857 - DNA, 20 bp, Homo sapiens
gacaaatgggactgatgtca

SEQ ID NO: 1554858 - DNA, 12 bp, Homo sapiens
gacaaattctgt

SEQ ID NO: 1554859 - DNA, 14 bp, Homo sapiens
gacaaattctgttt

SEQ ID NO: 1554860 - DNA, 14 bp, Homo sapiens
gacaacaaaagaaa

SEQ ID NO: 1554861 - DNA, 13 bp, Homo sapiens
gacaacagaaaaa

SEQ ID NO: 1554862 - DNA, 12 bp, Homo sapiens
gacaacagttct

SEQ ID NO: 1554863 - DNA, 14 bp, Homo sapiens
gacaacagttctga

SEQ ID NO: 1554864 - DNA, 20 bp, Homo sapiens
gacaacagttctgagctgta

SEQ ID NO: 1554865 - DNA, 17 bp, Homo sapiens
gacaacatcccacagtg

SEQ ID NO: 1554866 - DNA, 15 bp, Homo sapiens
gacaacattatgatc

SEQ ID NO: 1554867 - DNA, 20 bp, Homo sapiens
gacaacattatgatctaata

SEQ ID NO: 1554868 - DNA, 17 bp, Homo sapiens
gacaaccactggtctgt

SEQ ID NO: 1554869 - DNA, 18 bp, Homo sapiens
gacaaccattaaagtcag

SEQ ID NO: 1554870 - DNA, 15 bp, Homo sapiens
gacaacctagaatgt

SEQ ID NO: 1554871 - DNA, 16 bp, Homo sapiens
gacaacctagaatgtc

SEQ ID NO: 1554872 - DNA, 15 bp, Homo sapiens
gacaactagatttgt

SEQ ID NO: 1554873 - DNA, 21 bp, Homo sapiens
gacaactgttttaataaaaga

SEQ ID NO: 1554874 - DNA, 23 bp, Homo sapiens
gacaactgttttaataaaagatt

SEQ ID NO: 1554875 - DNA, 16 bp, Homo sapiens
gacaacttagctcagg

SEQ ID NO: 1554876 - DNA, 17 bp, Homo sapiens
gacaacttatttaaaaa

SEQ ID NO: 1554877 - DNA, 15 bp, Homo sapiens
gacaagaaaggcaga

SEQ ID NO: 1554878 - DNA, 23 bp, Homo sapiens
gacaagaaaggcagacacaccgc

SEQ ID NO: 1554879 - DNA, 13 bp, Homo sapiens
gacaagaagcaaa

SEQ ID NO: 1554880 - DNA, 14 bp, Homo sapiens
gacaagagatggga

SEQ ID NO: 1554881 - DNA, 18 bp, Homo sapiens
gacaagagatgggaatga

SEQ ID NO: 1554882 - DNA, 15 bp, Homo sapiens
gacaagagctgctgt

SEQ ID NO: 1554883 - DNA, 19 bp, Homo sapiens
gacaagagctgctgtcctt

SEQ ID NO: 1554884 - DNA, 14 bp, Homo sapiens
gacaagatattgta

SEQ ID NO: 1554885 - DNA, 19 bp, Homo sapiens
gacaagccaacttgtaaat

SEQ ID NO: 1554886 - DNA, 17 bp, Homo sapiens
gacaagggaggcagtgg

SEQ ID NO: 1554887 - DNA, 13 bp, Homo sapiens
gacaagggattct

SEQ ID NO: 1554888 - DNA, 16 bp, Homo sapiens
gacaagggattctggg

SEQ ID NO: 1554889 - DNA, 13 bp, Homo sapiens
gacaagggctgac

SEQ ID NO: 1554890 - DNA, 13 bp, Homo sapiens
gacaaggtgctaa

SEQ ID NO: 1554891 - DNA, 15 bp, Homo sapiens
gacaagtaatttcag

SEQ ID NO: 1554892 - DNA, 16 bp, Homo sapiens
gacaagtgaagaacac

SEQ ID NO: 1554893 - DNA, 20 bp, Homo sapiens
gacaagtgactgtatctgtg

SEQ ID NO: 1554894 - DNA, 15 bp, Homo sapiens
gacaagtgggatttg

SEQ ID NO: 1554895 - DNA, 22 bp, Homo sapiens
gacaataaagatatttccaaga

SEQ ID NO: 1554896 - DNA, 12 bp, Homo sapiens
gacaatcactgc

SEQ ID NO: 1554897 - DNA, 16 bp, Homo sapiens
gacaatcagtcccctc

SEQ ID NO: 1554898 - DNA, 17 bp, Homo sapiens
gacaatcagtcccctcc

SEQ ID NO: 1554899 - DNA, 20 bp, Homo sapiens
gacaatcagtcccctcccat

SEQ ID NO: 1554900 - DNA, 19 bp, Homo sapiens
gacaatcatgaaatatgca

SEQ ID NO: 1554901 - DNA, 20 bp, Homo sapiens
gacaatcatgaaatatgcat

SEQ ID NO: 1554902 - DNA, 20 bp, Homo sapiens
gacaatctaccaactgtccc

SEQ ID NO: 1554903 - DNA, 20 bp, Homo sapiens
gacaatgatgatgataatga

SEQ ID NO: 1554904 - DNA, 21 bp, Homo sapiens
gacaatggcagctagactgga

SEQ ID NO: 1554905 - DNA, 21 bp, Homo sapiens
gacaattcctagataaaaaga

SEQ ID NO: 1554906 - DNA, 13 bp, Homo sapiens
gacaattctgttt

SEQ ID NO: 1554907 - DNA, 15 bp, Homo sapiens
gacaattgtcttttt

SEQ ID NO: 1554908 - DNA, 20 bp, Homo sapiens
gacaatttcaaaaaaataaa

SEQ ID NO: 1554909 - DNA, 20 bp, Homo sapiens
gacaatttctggcagatgta

SEQ ID NO: 1554910 - DNA, 17 bp, Homo sapiens
gacaatttgatacataa

SEQ ID NO: 1554911 - DNA, 18 bp, Homo sapiens
gacaatttgatacataat

SEQ ID NO: 1554912 - DNA, 19 bp, Homo sapiens
gacaatttgatacataata

SEQ ID NO: 1554913 - DNA, 14 bp, Homo sapiens
gacaattttgtctt

SEQ ID NO: 1554914 - DNA, 13 bp, Homo sapiens
gacacaaaaaaag

SEQ ID NO: 1554915 - DNA, 13 bp, Homo sapiens
gacacaactattt

SEQ ID NO: 1554916 - DNA, 22 bp, Homo sapiens
gacacaactgtgtgattaaaag

SEQ ID NO: 1554917 - DNA, 19 bp, Homo sapiens
gacacaatttcatttccag

SEQ ID NO: 1554918 - DNA, 12 bp, Homo sapiens
gacacacacacg

SEQ ID NO: 1554919 - DNA, 13 bp, Homo sapiens
gacacacacacgc

SEQ ID NO: 1554920 - DNA, 14 bp, Homo sapiens
gacacacacacgca

SEQ ID NO: 1554921 - DNA, 22 bp, Homo sapiens
gacacacacacgcacgcacaca

SEQ ID NO: 1554922 - DNA, 17 bp, Homo sapiens
gacacacacagactatt

SEQ ID NO: 1554923 - DNA, 19 bp, Homo sapiens
gacacacagcactctctaa

SEQ ID NO: 1554924 - DNA, 18 bp, Homo sapiens
gacacaccaggcgctaat

SEQ ID NO: 1554925 - DNA, 21 bp, Homo sapiens
gacacaccgcggccaggcacc

SEQ ID NO: 1554926 - DNA, 18 bp, Homo sapiens
gacacactaaccaagctg

SEQ ID NO: 1554927 - DNA, 19 bp, Homo sapiens
gacacactaaccaagctga

SEQ ID NO: 1554928 - DNA, 15 bp, Homo sapiens
gacacagaacacaga

SEQ ID NO: 1554929 - DNA, 13 bp, Homo sapiens
gacacagacattt

SEQ ID NO: 1554930 - DNA, 23 bp, Homo sapiens
gacacagacattttgtgtgagac

SEQ ID NO: 1554931 - DNA, 21 bp, Homo sapiens
gacacagattatgttcctgct

SEQ ID NO: 1554932 - DNA, 16 bp, Homo sapiens
gacacagcacaagggc

SEQ ID NO: 1554933 - DNA, 15 bp, Homo sapiens
gacacagcagcttca

SEQ ID NO: 1554934 - DNA, 20 bp, Homo sapiens
gacacagcagcttcaccaga

SEQ ID NO: 1554935 - DNA, 23 bp, Homo sapiens
gacacagctcttcattccattga

SEQ ID NO: 1554936 - DNA, 18 bp, Homo sapiens
gacacaggaaaccaacac

SEQ ID NO: 1554937 - DNA, 17 bp, Homo sapiens
gacacaggccctccctg

SEQ ID NO: 1554938 - DNA, 13 bp, Homo sapiens
gacacatcccggc

SEQ ID NO: 1554939 - DNA, 16 bp, Homo sapiens
gacacatcccggcctc

SEQ ID NO: 1554940 - DNA, 20 bp, Homo sapiens
gacacatgaaggtaaataaa

SEQ ID NO: 1554941 - DNA, 21 bp, Homo sapiens
gacacatgaaggtaaataaaa

SEQ ID NO: 1554942 - DNA, 12 bp, Homo sapiens
gaagccacagaa

SEQ ID NO: 1554943 - DNA, 16 bp, Homo sapiens
gaagccacaggcctga

SEQ ID NO: 1554944 - DNA, 15 bp, Homo sapiens
gaagccaccttccca

SEQ ID NO: 1554945 - DNA, 10 bp, Homo sapiens
gaagccagcc

SEQ ID NO: 1554946 - DNA, 13 bp, Homo sapiens
gaagccagccaca

SEQ ID NO: 1554947 - DNA, 24 bp, Homo sapiens
gaagccaggaatttcccaggaccc

SEQ ID NO: 1554948 - DNA, 20 bp, Homo sapiens
gaagccaggtacaggagagg

SEQ ID NO: 1554949 - DNA, 17 bp, Homo sapiens
gaagccatcacttctcc

SEQ ID NO: 1554950 - DNA, 19 bp, Homo sapiens
gaagccatcacttctcccc

SEQ ID NO: 1554951 - DNA, 22 bp, Homo sapiens
gaagccatcacttctccccgca

SEQ ID NO: 1554952 - DNA, 16 bp, Homo sapiens
gaagcccaagtgaaat

SEQ ID NO: 1554953 - DNA, 14 bp, Homo sapiens
gaagcccaataaac

SEQ ID NO: 1554954 - DNA, 22 bp, Homo sapiens
gaagcccagcccctactgctgt

SEQ ID NO: 1554955 - DNA, 12 bp, Homo sapiens
gaagcccagctc

SEQ ID NO: 1554956 - DNA, 16 bp, Homo sapiens
gaagcccagctccagg

SEQ ID NO: 1554957 - DNA, 17 bp, Homo sapiens
gaagcccagctccaggg

SEQ ID NO: 1554958 - DNA, 19 bp, Homo sapiens
gaagcccatcctgaccagc

SEQ ID NO: 1554959 - DNA, 18 bp, Homo sapiens
gaagccccacatgtccag

SEQ ID NO: 1554960 - DNA, 23 bp, Homo sapiens
gaagccccacatgtccagcacct

SEQ ID NO: 1554961 - DNA, 17 bp, Homo sapiens
gaagcccccagctaaga

SEQ ID NO: 1554962 - DNA, 21 bp, Homo sapiens
gaagcccccagctaagaacct

SEQ ID NO: 1554963 - DNA, 22 bp, Homo sapiens
gaagcccccagctaagaacctg

SEQ ID NO: 1554964 - DNA, 18 bp, Homo sapiens
gaagcccctgggcccagt

SEQ ID NO: 1554965 - DNA, 14 bp, Homo sapiens
gaagccccttggag

SEQ ID NO: 1554966 - DNA, 14 bp, Homo sapiens
gaagccctccttcc

SEQ ID NO: 1554967 - DNA, 15 bp, Homo sapiens
gaagccctccttcca

SEQ ID NO: 1554968 - DNA, 16 bp, Homo sapiens
gaagccctccttccac

SEQ ID NO: 1554969 - DNA, 18 bp, Homo sapiens
gaagccctggatttcaga

SEQ ID NO: 1554970 - DNA, 16 bp, Homo sapiens
gaagccgactctggcc

SEQ ID NO: 1554971 - DNA, 15 bp, Homo sapiens
gaagccggacagctg

SEQ ID NO: 1554972 - DNA, 20 bp, Homo sapiens
gaagccggcggcccaagccc

SEQ ID NO: 1554973 - DNA, 22 bp, Homo sapiens
gaagcctccacaccagctgctg

SEQ ID NO: 1554974 - DNA, 19 bp, Homo sapiens
gaagcctctctccttggcc

SEQ ID NO: 1554975 - DNA, 17 bp, Homo sapiens
gaagcctctggctagag

SEQ ID NO: 1554976 - DNA, 12 bp, Homo sapiens
gaagcctgaggc

SEQ ID NO: 1554977 - DNA, 13 bp, Homo sapiens
gaagcctgaggct

SEQ ID NO: 1554978 - DNA, 20 bp, Homo sapiens
gaagcctggattccagcagt

SEQ ID NO: 1554979 - DNA, 14 bp, Homo sapiens
gaagccttagccag

SEQ ID NO: 1554980 - DNA, 17 bp, Homo sapiens
gaagccttcagctccag

SEQ ID NO: 1554981 - DNA, 22 bp, Homo sapiens
gaagccttgcctaaatttaatg

SEQ ID NO: 1554982 - DNA, 16 bp, Homo sapiens
gaagcgagcactgacc

SEQ ID NO: 1554983 - DNA, 16 bp, Homo sapiens
gaagcgcttctgcacc

SEQ ID NO: 1554984 - DNA, 17 bp, Homo sapiens
gaagcggagagagccaa

SEQ ID NO: 1554985 - DNA, 20 bp, Homo sapiens
gaagcggagagagccaagac

SEQ ID NO: 1554986 - DNA, 21 bp, Homo sapiens
gaagcggagagagccaagacg

SEQ ID NO: 1554987 - DNA, 20 bp, Homo sapiens
gaagcggccctaagggagtg

SEQ ID NO: 1554988 - DNA, 19 bp, Homo sapiens
gaagcgtgtttctttccca

SEQ ID NO: 1554989 - DNA, 18 bp, Homo sapiens
gaagctagacacatgaag

SEQ ID NO: 1554990 - DNA, 17 bp, Homo sapiens
gaagctagatgcccctg

SEQ ID NO: 1554991 - DNA, 21 bp, Homo sapiens
gaagctatattagctgaaaca

SEQ ID NO: 1554992 - DNA, 21 bp, Homo sapiens
gaagctcagctgcattccgca

SEQ ID NO: 1554993 - DNA, 19 bp, Homo sapiens
gaagctcctctccccagcc

SEQ ID NO: 1554994 - DNA, 23 bp, Homo sapiens
gaagctcctctccccagcccaga

SEQ ID NO: 1554995 - DNA, 14 bp, Homo sapiens
gaagctcctgctac

SEQ ID NO: 1554996 - DNA, 24 bp, Homo sapiens
gaagctcctgctacttccccagct

SEQ ID NO: 1554997 - DNA, 20 bp, Homo sapiens
gaagctctccgagctctggt

SEQ ID NO: 1554998 - DNA, 16 bp, Homo sapiens
gaagctctgaagtcac

SEQ ID NO: 1554999 - DNA, 20 bp, Homo sapiens
gaagctctggctgaaccctg

SEQ ID NO: 1555000 - DNA, 23 bp, Homo sapiens
gaagctctggctgaaccctgtgc

SEQ ID NO: 1555001 - DNA, 20 bp, Homo sapiens
gaagctcttactctttccta

SEQ ID NO: 1555002 - DNA, 20 bp, Homo sapiens
gaagctcttttctcctgcag

SEQ ID NO: 1555003 - DNA, 16 bp, Homo sapiens
gaagctgagcttttga

SEQ ID NO: 1555004 - DNA, 13 bp, Homo sapiens
gaagctgcatcca

SEQ ID NO: 1555005 - DNA, 16 bp, Homo sapiens
gaagctgccctgccca

SEQ ID NO: 1555006 - DNA, 10 bp, Homo sapiens
gaagctgctg

SEQ ID NO: 1555007 - DNA, 11 bp, Homo sapiens
gaagctgctga

SEQ ID NO: 1555008 - DNA, 19 bp, Homo sapiens
gaagctgctgcagccctgc

SEQ ID NO: 1555009 - DNA, 14 bp, Homo sapiens
gaagctgctggagc

SEQ ID NO: 1555010 - DNA, 16 bp, Homo sapiens
gaagctggaagcctgc

SEQ ID NO: 1555011 - DNA, 22 bp, Homo sapiens
gaagctggctgggctggctgaa

SEQ ID NO: 1555012 - DNA, 16 bp, Homo sapiens
gaagctgggtgagcca

SEQ ID NO: 1555013 - DNA, 18 bp, Homo sapiens
gaagctgggtgagccaag

SEQ ID NO: 1555014 - DNA, 19 bp, Homo sapiens
gaagctgggtgagccaagg

SEQ ID NO: 1555015 - DNA, 20 bp, Homo sapiens
gaagctgggtgagccaagga

SEQ ID NO: 1555016 - DNA, 23 bp, Homo sapiens
gaagctgggtgagccaaggacag

SEQ ID NO: 1555017 - DNA, 20 bp, Homo sapiens
gaagctgtactcagagcaga

SEQ ID NO: 1555018 - DNA, 21 bp, Homo sapiens
gaagctgtactcagagcagag

SEQ ID NO: 1555019 - DNA, 22 bp, Homo sapiens
gaagctgtactcagagcagagc

SEQ ID NO: 1555020 - DNA, 22 bp, Homo sapiens
gaagctgtgtccttgcacctgc

SEQ ID NO: 1555021 - DNA, 24 bp, Homo sapiens
gaagctgtgtccttgcacctgcat

SEQ ID NO: 1555022 - DNA, 15 bp, Homo sapiens
gaagctgtttggaaa

SEQ ID NO: 1555023 - DNA, 18 bp, Homo sapiens
gaagctgtttggaaaaga

SEQ ID NO: 1555024 - DNA, 16 bp, Homo sapiens
gaagcttccacaaaat

SEQ ID NO: 1555025 - DNA, 14 bp, Homo sapiens
gaagcttgagcctc

SEQ ID NO: 1555026 - DNA, 15 bp, Homo sapiens
gaagcttgagcctcc

SEQ ID NO: 1555027 - DNA, 18 bp, Homo sapiens
gaagcttgagcctccccc

SEQ ID NO: 1555028 - DNA, 21 bp, Homo sapiens
gaagctttgagttgacttctg

SEQ ID NO: 1555029 - DNA, 11 bp, Homo sapiens
gaaggaaaaat

SEQ ID NO: 1555030 - DNA, 18 bp, Homo sapiens
gaaggaaaagaaagaaga

SEQ ID NO: 1555031 - DNA, 17 bp, Homo sapiens
gaaggaaaatgttcatg

SEQ ID NO: 1555032 - DNA, 12 bp, Homo sapiens
gaaggaagaggg

SEQ ID NO: 1555033 - DNA, 23 bp, Homo sapiens
gaaggaagatcttgagagctgct

SEQ ID NO: 1555034 - DNA, 16 bp, Homo sapiens
gaaggaaggagggcac

SEQ ID NO: 1555035 - DNA, 14 bp, Homo sapiens
gaaggaataagcat

SEQ ID NO: 1555036 - DNA, 15 bp, Homo sapiens
gaaggaatagccaga

SEQ ID NO: 1555037 - DNA, 13 bp, Homo sapiens
gaaggacacagtg

SEQ ID NO: 1555038 - DNA, 14 bp, Homo sapiens
gaaggacacagtga

SEQ ID NO: 1555039 - DNA, 17 bp, Homo sapiens
gaaggacacttcctgcc

SEQ ID NO: 1555040 - DNA, 19 bp, Homo sapiens
gaaggacaggaccctcagg

SEQ ID NO: 1555041 - DNA, 16 bp, Homo sapiens
gaaggaccacatttta

SEQ ID NO: 1555042 - DNA, 20 bp, Homo sapiens
gaaggaccacattttatatt

SEQ ID NO: 1555043 - DNA, 22 bp, Homo sapiens
gaaggaccacattttatattta

SEQ ID NO: 1555044 - DNA, 23 bp, Homo sapiens
gaaggacccggaggggcctggca

SEQ ID NO: 1555045 - DNA, 15 bp, Homo sapiens
gaaggactgacgaga

SEQ ID NO: 1555046 - DNA, 12 bp, Homo sapiens
gaaggacttgac

SEQ ID NO: 1555047 - DNA, 17 bp, Homo sapiens
gaaggagaaggaaggag

SEQ ID NO: 1555048 - DNA, 23 bp, Homo sapiens
gaaggagataattactgccttga

SEQ ID NO: 1555049 - DNA, 14 bp, Homo sapiens
gaaggagcagaaag

SEQ ID NO: 1555050 - DNA, 20 bp, Homo sapiens
gaaggaggaatgctggactg

SEQ ID NO: 1555051 - DNA, 22 bp, Homo sapiens
gaaggaggaatgctggactgga

SEQ ID NO: 1555052 - DNA, 13 bp, Homo sapiens
gaaggaggcagac

SEQ ID NO: 1555053 - DNA, 17 bp, Homo sapiens
gaaggaggcagactgat

SEQ ID NO: 1555054 - DNA, 21 bp, Homo sapiens
gaaggaggccaaccagcccga

SEQ ID NO: 1555055 - DNA, 14 bp, Homo sapiens
gaaggagggagctg

SEQ ID NO: 1555056 - DNA, 19 bp, Homo sapiens
gaaggagggagctgctcag

SEQ ID NO: 1555057 - DNA, 15 bp, Homo sapiens
gaaggagggcagagc

SEQ ID NO: 1555058 - DNA, 17 bp, Homo sapiens
gaagtgtataatataaa

SEQ ID NO: 1555059 - DNA, 21 bp, Homo sapiens
gaagtgtataatataaaaaat

SEQ ID NO: 1555060 - DNA, 15 bp, Homo sapiens
gaagtgtatttattt

SEQ ID NO: 1555061 - DNA, 19 bp, Homo sapiens
gaagtgtgggtctgtgtgt

SEQ ID NO: 1555062 - DNA, 19 bp, Homo sapiens
gaagtgttcaagaaataaa

SEQ ID NO: 1555063 - DNA, 15 bp, Homo sapiens
gaagttactgaatgc

SEQ ID NO: 1555064 - DNA, 16 bp, Homo sapiens
gaagttatgtgtatgt

SEQ ID NO: 1555065 - DNA, 21 bp, Homo sapiens
gaagttattttctacagtggt

SEQ ID NO: 1555066 - DNA, 20 bp, Homo sapiens
gaagttgcattcctttgtct

SEQ ID NO: 1555067 - DNA, 22 bp, Homo sapiens
gaagttggtttagctttggaaa

SEQ ID NO: 1555068 - DNA, 14 bp, Homo sapiens
gaagttgtttatca

SEQ ID NO: 1555069 - DNA, 17 bp, Homo sapiens
gaagtttgtagccaggt

SEQ ID NO: 1555070 - DNA, 17 bp, Homo sapiens
gaagttttacagcaagg

SEQ ID NO: 1555071 - DNA, 14 bp, Homo sapiens
gaataaaaaccctg

SEQ ID NO: 1555072 - DNA, 14 bp, Homo sapiens
gaataaacattaat

SEQ ID NO: 1555073 - DNA, 21 bp, Homo sapiens
gaataaactctcccctttctt

SEQ ID NO: 1555074 - DNA, 16 bp, Homo sapiens
gaataaaggcagtttt

SEQ ID NO: 1555075 - DNA, 20 bp, Homo sapiens
gaataaaggcagttttctaa

SEQ ID NO: 1555076 - DNA, 15 bp, Homo sapiens
gaataaagtattcta

SEQ ID NO: 1555077 - DNA, 16 bp, Homo sapiens
gaataaataaagaaga

SEQ ID NO: 1555078 - DNA, 17 bp, Homo sapiens
gaataaataaagaagaa

SEQ ID NO: 1555079 - DNA, 22 bp, Homo sapiens
gaataaataaatgtatcttatt

SEQ ID NO: 1555080 - DNA, 20 bp, Homo sapiens
gaataaattatggcatttct

SEQ ID NO: 1555081 - DNA, 22 bp, Homo sapiens
gaataaattatggcatttctat

SEQ ID NO: 1555082 - DNA, 19 bp, Homo sapiens
gaataaattggattatttt

SEQ ID NO: 1555083 - DNA, 19 bp, Homo sapiens
gaataacatgtaattaagt

SEQ ID NO: 1555084 - DNA, 15 bp, Homo sapiens
gaataacattttcta

SEQ ID NO: 1555085 - DNA, 23 bp, Homo sapiens
gaataaccacttaaaaaatgtcc

SEQ ID NO: 1555086 - DNA, 15 bp, Homo sapiens
gaataacctttctgg

SEQ ID NO: 1555087 - DNA, 12 bp, Homo sapiens
gaataaggagga

SEQ ID NO: 1555088 - DNA, 14 bp, Homo sapiens
gaataaggaggagg

SEQ ID NO: 1555089 - DNA, 21 bp, Homo sapiens
gaataaggaggaggagggaga

SEQ ID NO: 1555090 - DNA, 12 bp, Homo sapiens
gaataaggcctt

SEQ ID NO: 1555091 - DNA, 19 bp, Homo sapiens
gaataatatcaaataaaat

SEQ ID NO: 1555092 - DNA, 18 bp, Homo sapiens
gaataatcacgctttcct

SEQ ID NO: 1555093 - DNA, 19 bp, Homo sapiens
gaataatcacgctttcctg

SEQ ID NO: 1555094 - DNA, 13 bp, Homo sapiens
gaataatctatta

SEQ ID NO: 1555095 - DNA, 20 bp, Homo sapiens
gaataatctattatttggag

SEQ ID NO: 1555096 - DNA, 22 bp, Homo sapiens
gaataatctttgggtaacttca

SEQ ID NO: 1555097 - DNA, 18 bp, Homo sapiens
gaataatgaaaataaaac

SEQ ID NO: 1555098 - DNA, 17 bp, Homo sapiens
gaataatggaattatgt

SEQ ID NO: 1555099 - DNA, 13 bp, Homo sapiens
gaataatgtgtta

SEQ ID NO: 1555100 - DNA, 14 bp, Homo sapiens
gaataatttcactt

SEQ ID NO: 1555101 - DNA, 16 bp, Homo sapiens
gaataattttggaata

SEQ ID NO: 1555102 - DNA, 14 bp, Homo sapiens
gaatacagaaagat

SEQ ID NO: 1555103 - DNA, 13 bp, Homo sapiens
gaatacagtgtta

SEQ ID NO: 1555104 - DNA, 14 bp, Homo sapiens
gaatacataaacaa

SEQ ID NO: 1555105 - DNA, 21 bp, Homo sapiens
gaatacattctttgctagttg

SEQ ID NO: 1555106 - DNA, 22 bp, Homo sapiens
gaataccacatcaaataagaaa

SEQ ID NO: 1555107 - DNA, 19 bp, Homo sapiens
gaataccattaaaactgct

SEQ ID NO: 1555108 - DNA, 20 bp, Homo sapiens
gaataccattaaaactgctt

SEQ ID NO: 1555109 - DNA, 15 bp, Homo sapiens
gaatacggaagagca

SEQ ID NO: 1555110 - DNA, 13 bp, Homo sapiens
gaatactcttgaa

SEQ ID NO: 1555111 - DNA, 13 bp, Homo sapiens
gaatactgctaca

SEQ ID NO: 1555112 - DNA, 18 bp, Homo sapiens
gaatactgggttcttagt

SEQ ID NO: 1555113 - DNA, 17 bp, Homo sapiens
gaatagagctgccactg

SEQ ID NO: 1555114 - DNA, 16 bp, Homo sapiens
gaatagaggtcctcat

SEQ ID NO: 1555115 - DNA, 15 bp, Homo sapiens
gaatagatgctgact

SEQ ID NO: 1555116 - DNA, 19 bp, Homo sapiens
gaatagatggaatttggaa

SEQ ID NO: 1555117 - DNA, 21 bp, Homo sapiens
gaatagcaaaattcctgtgtt

SEQ ID NO: 1555118 - DNA, 19 bp, Homo sapiens
gaatagcagagagccaaat

SEQ ID NO: 1555119 - DNA, 12 bp, Homo sapiens
gaataggaaaac

SEQ ID NO: 1555120 - DNA, 14 bp, Homo sapiens
gaataggaaaacat

SEQ ID NO: 1555121 - DNA, 15 bp, Homo sapiens
gaataggtagtatca

SEQ ID NO: 1555122 - DNA, 14 bp, Homo sapiens
gaatagtgcttgct

SEQ ID NO: 1555123 - DNA, 19 bp, Homo sapiens
gaatagtgcttgctggcca

SEQ ID NO: 1555124 - DNA, 13 bp, Homo sapiens
gaatataattatc

SEQ ID NO: 1555125 - DNA, 22 bp, Homo sapiens
gaatatacagcaggtgctcaat

SEQ ID NO: 1555126 - DNA, 16 bp, Homo sapiens
gaatataccttattta

SEQ ID NO: 1555127 - DNA, 16 bp, Homo sapiens
gaatatatgcttttgg

SEQ ID NO: 1555128 - DNA, 15 bp, Homo sapiens
gaatatatgtgtgcc

SEQ ID NO: 1555129 - DNA, 13 bp, Homo sapiens
gaatatcatcttt

SEQ ID NO: 1555130 - DNA, 15 bp, Homo sapiens
gaatatcatctttta

SEQ ID NO: 1555131 - DNA, 19 bp, Homo sapiens
gaatatccatgtacttgtt

SEQ ID NO: 1555132 - DNA, 19 bp, Homo sapiens
gaatatgacggaagaacat

SEQ ID NO: 1555133 - DNA, 15 bp, Homo sapiens
gaatatgtttcaaac

SEQ ID NO: 1555134 - DNA, 12 bp, Homo sapiens
gaatattagctt

SEQ ID NO: 1555135 - DNA, 12 bp, Homo sapiens
gaatattcagga

SEQ ID NO: 1555136 - DNA, 24 bp, Homo sapiens
gaatattcctggacttacaaaatg

SEQ ID NO: 1555137 - DNA, 13 bp, Homo sapiens
gaatattctagaa

SEQ ID NO: 1555138 - DNA, 14 bp, Homo sapiens
gaatattctagaac

SEQ ID NO: 1555139 - DNA, 22 bp, Homo sapiens
gaatattgctttggtcatatga

SEQ ID NO: 1555140 - DNA, 15 bp, Homo sapiens
gaatattgtgattct

SEQ ID NO: 1555141 - DNA, 20 bp, Homo sapiens
gaatatttatatttcactat

SEQ ID NO: 1555142 - DNA, 18 bp, Homo sapiens
gaatatttattacctctg

SEQ ID NO: 1555143 - DNA, 16 bp, Homo sapiens
gaatattttaacttcc

SEQ ID NO: 1555144 - DNA, 12 bp, Homo sapiens
gaatattttatc

SEQ ID NO: 1555145 - DNA, 21 bp, Homo sapiens
gaatatttttagactatttct

SEQ ID NO: 1555146 - DNA, 21 bp, Homo sapiens
gaatatttttatatttccttt

SEQ ID NO: 1555147 - DNA, 22 bp, Homo sapiens
gaatatttttatatttccttta

SEQ ID NO: 1555148 - DNA, 16 bp, Homo sapiens
gaatatttttgtattt

SEQ ID NO: 1555149 - DNA, 14 bp, Homo sapiens
gaatcaaaactctc

SEQ ID NO: 1555150 - DNA, 15 bp, Homo sapiens
gaatcaaaactctcc

SEQ ID NO: 1555151 - DNA, 15 bp, Homo sapiens
gaatcaacagggcag

SEQ ID NO: 1555152 - DNA, 17 bp, Homo sapiens
gaatcaacagggcagca

SEQ ID NO: 1555153 - DNA, 20 bp, Homo sapiens
gaatcacctgaaccccagag

SEQ ID NO: 1555154 - DNA, 21 bp, Homo sapiens
gaatcacggtggtaaagaaag

SEQ ID NO: 1555155 - DNA, 22 bp, Homo sapiens
gaatcacggtggtaaagaaagt

SEQ ID NO: 1555156 - DNA, 20 bp, Homo sapiens
gaatcacttgaacccgggag

SEQ ID NO: 1555157 - DNA, 12 bp, Homo sapiens
gaatcagaagaa

SEQ ID NO: 1555158 - DNA, 22 bp, Homo sapiens
gaatcagaccctaccccaccac

SEQ ID NO: 1555159 - DNA, 19 bp, Homo sapiens
gaatcagacttcacactgc

SEQ ID NO: 1555160 - DNA, 16 bp, Homo sapiens
gaatcatgagcctgct

SEQ ID NO: 1555161 - DNA, 19 bp, Homo sapiens
gaatcatgtcgatcctggg

SEQ ID NO: 1555162 - DNA, 13 bp, Homo sapiens
gaatcatgtttct

SEQ ID NO: 1555163 - DNA, 15 bp, Homo sapiens
gaatccaagattggt

SEQ ID NO: 1555164 - DNA, 20 bp, Homo sapiens
gaatccaagcctccacagcg

SEQ ID NO: 1555165 - DNA, 20 bp, Homo sapiens
gaatccaatactgcccaagg

SEQ ID NO: 1555166 - DNA, 17 bp, Homo sapiens
gaatccagcaggtcaca

SEQ ID NO: 1555167 - DNA, 17 bp, Homo sapiens
gaatccagtttctttcc

SEQ ID NO: 1555168 - DNA, 14 bp, Homo sapiens
gaatccatgcttgg

SEQ ID NO: 1555169 - DNA, 15 bp, Homo sapiens
gaatccattggagaa

SEQ ID NO: 1555170 - DNA, 22 bp, Homo sapiens
gaatcccacccacatgtgacac

SEQ ID NO: 1555171 - DNA, 14 bp, Homo sapiens
gaatcccagcagca

SEQ ID NO: 1555172 - DNA, 22 bp, Homo sapiens
gaaatgatgttggtccaaagtg

SEQ ID NO: 1555173 - DNA, 21 bp, Homo sapiens
gaaatgattcaaattgctgct

SEQ ID NO: 1555174 - DNA, 22 bp, Homo sapiens
gaaatgccactgggacagctgg

SEQ ID NO: 1555175 - DNA, 16 bp, Homo sapiens
gaaatgctcttttgca

SEQ ID NO: 1555176 - DNA, 14 bp, Homo sapiens
gaaatgctgcctgc

SEQ ID NO: 1555177 - DNA, 16 bp, Homo sapiens
gaaatgctgcctgcct

SEQ ID NO: 1555178 - DNA, 17 bp, Homo sapiens
gaaatgctgcctgcctg

SEQ ID NO: 1555179 - DNA, 13 bp, Homo sapiens
gaaatgcttaaaa

SEQ ID NO: 1555180 - DNA, 22 bp, Homo sapiens
gaaatgcttgtggattgagggt

SEQ ID NO: 1555181 - DNA, 16 bp, Homo sapiens
gaaatggaaagcagag

SEQ ID NO: 1555182 - DNA, 16 bp, Homo sapiens
gaaatggctttgtgat

SEQ ID NO: 1555183 - DNA, 23 bp, Homo sapiens
gaaatggcttttcttacccagat

SEQ ID NO: 1555184 - DNA, 19 bp, Homo sapiens
gaaatggtttcctctggat

SEQ ID NO: 1555185 - DNA, 16 bp, Homo sapiens
gaaatgtacactacca

SEQ ID NO: 1555186 - DNA, 20 bp, Homo sapiens
gaaatgtacactaccaaaca

SEQ ID NO: 1555187 - DNA, 14 bp, Homo sapiens
gaaatgtgaagagg

SEQ ID NO: 1555188 - DNA, 18 bp, Homo sapiens
gaaatgtgaagaggtctg

SEQ ID NO: 1555189 - DNA, 21 bp, Homo sapiens
gaaatgtgaatttttattgtt

SEQ ID NO: 1555190 - DNA, 22 bp, Homo sapiens
gaaatgttattttttaattatt

SEQ ID NO: 1555191 - DNA, 12 bp, Homo sapiens
gaaattaacaca

SEQ ID NO: 1555192 - DNA, 21 bp, Homo sapiens
gaaattaacttttaaatgttt

SEQ ID NO: 1555193 - DNA, 22 bp, Homo sapiens
gaaattaagcattttgaaacaa

SEQ ID NO: 1555194 - DNA, 16 bp, Homo sapiens
gaaattaatgctgaga

SEQ ID NO: 1555195 - DNA, 16 bp, Homo sapiens
gaaattacctgtggat

SEQ ID NO: 1555196 - DNA, 17 bp, Homo sapiens
gaaattacctgtggata

SEQ ID NO: 1555197 - DNA, 19 bp, Homo sapiens
gaaattacctgtggatatt

SEQ ID NO: 1555198 - DNA, 19 bp, Homo sapiens
gaaattactacaaaatttg

SEQ ID NO: 1555199 - DNA, 21 bp, Homo sapiens
gaaattacttatcatccacat

SEQ ID NO: 1555200 - DNA, 16 bp, Homo sapiens
gaaattagctgtgtga

SEQ ID NO: 1555201 - DNA, 19 bp, Homo sapiens
gaaattagctgtgtgaaat

SEQ ID NO: 1555202 - DNA, 15 bp, Homo sapiens
gaaattcaaagcata

SEQ ID NO: 1555203 - DNA, 23 bp, Homo sapiens
gaaattcaaagcataaaactttg

SEQ ID NO: 1555204 - DNA, 18 bp, Homo sapiens
gaaattcaggtacagaaa

SEQ ID NO: 1555205 - DNA, 17 bp, Homo sapiens
gaaattcatttgtggca

SEQ ID NO: 1555206 - DNA, 12 bp, Homo sapiens
gaaattccaaag

SEQ ID NO: 1555207 - DNA, 17 bp, Homo sapiens
gaaattctggcccagcc

SEQ ID NO: 1555208 - DNA, 16 bp, Homo sapiens
gaaattctgtttttaa

SEQ ID NO: 1555209 - DNA, 18 bp, Homo sapiens
gaaattctgtttttaaaa

SEQ ID NO: 1555210 - DNA, 20 bp, Homo sapiens
gaaattcttatgttgaatat

SEQ ID NO: 1555211 - DNA, 13 bp, Homo sapiens
gaaattcttccta

SEQ ID NO: 1555212 - DNA, 15 bp, Homo sapiens
gaaattgaaaagtta

SEQ ID NO: 1555213 - DNA, 17 bp, Homo sapiens
gaaattgaaaagttatt

SEQ ID NO: 1555214 - DNA, 22 bp, Homo sapiens
gaaattgactgatgattttcct

SEQ ID NO: 1555215 - DNA, 22 bp, Homo sapiens
gaaattggaacagaatgtttta

SEQ ID NO: 1555216 - DNA, 12 bp, Homo sapiens
gaaattggtttt

SEQ ID NO: 1555217 - DNA, 13 bp, Homo sapiens
gaaattgtatatt

SEQ ID NO: 1555218 - DNA, 19 bp, Homo sapiens
gaaattgtatattgtaatt

SEQ ID NO: 1555219 - DNA, 21 bp, Homo sapiens
gaaattgtctagcagagcagg

SEQ ID NO: 1555220 - DNA, 19 bp, Homo sapiens
gaaattgttacaatagaat

SEQ ID NO: 1555221 - DNA, 20 bp, Homo sapiens
gaaattgttttaccagctcc

SEQ ID NO: 1555222 - DNA, 20 bp, Homo sapiens
gaaatttaattcatgtttct

SEQ ID NO: 1555223 - DNA, 18 bp, Homo sapiens
gaaatttacagttactgc

SEQ ID NO: 1555224 - DNA, 16 bp, Homo sapiens
gaaatttagagttcta

SEQ ID NO: 1555225 - DNA, 11 bp, Homo sapiens
gaaatttcaga

SEQ ID NO: 1555226 - DNA, 17 bp, Homo sapiens
gaaatttgttgtttgtt

SEQ ID NO: 1555227 - DNA, 15 bp, Homo sapiens
gaaatttgtttgtat

SEQ ID NO: 1555228 - DNA, 22 bp, Homo sapiens
gaaattttaacctatgatattt

SEQ ID NO: 1555229 - DNA, 15 bp, Homo sapiens
gaaattttacaatag

SEQ ID NO: 1555230 - DNA, 13 bp, Homo sapiens
gaaattttgctat

SEQ ID NO: 1555231 - DNA, 15 bp, Homo sapiens
gaaattttgtaagaa

SEQ ID NO: 1555232 - DNA, 17 bp, Homo sapiens
gaaatttttcagatgct

SEQ ID NO: 1555233 - DNA, 15 bp, Homo sapiens
gaacaaaataaattg

SEQ ID NO: 1555234 - DNA, 16 bp, Homo sapiens
gaacaaaataaattgg

SEQ ID NO: 1555235 - DNA, 15 bp, Homo sapiens
gaacaaatgtgtttt

SEQ ID NO: 1555236 - DNA, 22 bp, Homo sapiens
gaacaaatgtgtttttctatat

SEQ ID NO: 1555237 - DNA, 14 bp, Homo sapiens
gaacaaattatttt

SEQ ID NO: 1555238 - DNA, 21 bp, Homo sapiens
gaacaaattctttagtactca

SEQ ID NO: 1555239 - DNA, 15 bp, Homo sapiens
gaacaacaaagacat

SEQ ID NO: 1555240 - DNA, 15 bp, Homo sapiens
gaacaacatatacaa

SEQ ID NO: 1555241 - DNA, 14 bp, Homo sapiens
gaacaacttgtagc

SEQ ID NO: 1555242 - DNA, 13 bp, Homo sapiens
gaacaagaaatgg

SEQ ID NO: 1555243 - DNA, 18 bp, Homo sapiens
gaacaagacagccttcac

SEQ ID NO: 1555244 - DNA, 23 bp, Homo sapiens
gaacaagcaatgatgacccacta

SEQ ID NO: 1555245 - DNA, 16 bp, Homo sapiens
gaacaagcatgtctct

SEQ ID NO: 1555246 - DNA, 18 bp, Homo sapiens
gaacaagctcatctattt

SEQ ID NO: 1555247 - DNA, 15 bp, Homo sapiens
gaacaagtaatgtat

SEQ ID NO: 1555248 - DNA, 18 bp, Homo sapiens
gaacaagtaatgtattag

SEQ ID NO: 1555249 - DNA, 20 bp, Homo sapiens
gaacaagtcacagctgcagc

SEQ ID NO: 1555250 - DNA, 20 bp, Homo sapiens
gaacaagttgttaaaacatt

SEQ ID NO: 1555251 - DNA, 19 bp, Homo sapiens
gaacaataatgagagcaaa

SEQ ID NO: 1555252 - DNA, 21 bp, Homo sapiens
gaacaataatgagagcaaatg

SEQ ID NO: 1555253 - DNA, 18 bp, Homo sapiens
gaacaatagaataatcta

SEQ ID NO: 1555254 - DNA, 13 bp, Homo sapiens
gaacaattgaagt

SEQ ID NO: 1555255 - DNA, 17 bp, Homo sapiens
gaacaattgaagtaaac

SEQ ID NO: 1555256 - DNA, 22 bp, Homo sapiens
gaacacaaagcggggggagggt

SEQ ID NO: 1555257 - DNA, 21 bp, Homo sapiens
gaacacaagggatataaaatg

SEQ ID NO: 1555258 - DNA, 22 bp, Homo sapiens
gaacacaagggatataaaatga

SEQ ID NO: 1555259 - DNA, 14 bp, Homo sapiens
gaacacacatccca

SEQ ID NO: 1555260 - DNA, 17 bp, Homo sapiens
gaacacacatcccagga

SEQ ID NO: 1555261 - DNA, 11 bp, Homo sapiens
gaacacagcta

SEQ ID NO: 1555262 - DNA, 23 bp, Homo sapiens
gaacacatttctttttaaaaaaa

SEQ ID NO: 1555263 - DNA, 18 bp, Homo sapiens
gaacaccagcagcactgg

SEQ ID NO: 1555264 - DNA, 19 bp, Homo sapiens
gaacaccagcagcactgga

SEQ ID NO: 1555265 - DNA, 16 bp, Homo sapiens
gaacaccattgaaggc

SEQ ID NO: 1555266 - DNA, 19 bp, Homo sapiens
gaacaccattgaaggctta

SEQ ID NO: 1555267 - DNA, 13 bp, Homo sapiens
gaacacccttaga

SEQ ID NO: 1555268 - DNA, 22 bp, Homo sapiens
gaacactggacaacattttact

SEQ ID NO: 1555269 - DNA, 22 bp, Homo sapiens
gaacactggcttgaaggactgc

SEQ ID NO: 1555270 - DNA, 20 bp, Homo sapiens
gaacactgtgaccaggcttt

SEQ ID NO: 1555271 - DNA, 14 bp, Homo sapiens
gaacagaatgtttt

SEQ ID NO: 1555272 - DNA, 15 bp, Homo sapiens
gaacagaatgtttta

SEQ ID NO: 1555273 - DNA, 17 bp, Homo sapiens
gaacagacaggagaaat

SEQ ID NO: 1555274 - DNA, 15 bp, Homo sapiens
gaacagccacaaaat

SEQ ID NO: 1555275 - DNA, 24 bp, Homo sapiens
gaacagccctcggcctccgaggct

SEQ ID NO: 1555276 - DNA, 18 bp, Homo sapiens
gaacagccgctcctgtct

SEQ ID NO: 1555277 - DNA, 18 bp, Homo sapiens
gaacagctcctcctcttg

SEQ ID NO: 1555278 - DNA, 11 bp, Homo sapiens
gaacagctgtg

SEQ ID NO: 1555279 - DNA, 18 bp, Homo sapiens
gaacaggaatccttactg

SEQ ID NO: 1555280 - DNA, 14 bp, Homo sapiens
gaacaggcttggag

SEQ ID NO: 1555281 - DNA, 20 bp, Homo sapiens
gaacagggaaaataggcagg

SEQ ID NO: 1555282 - DNA, 15 bp, Homo sapiens
gaacagggacttgtt

SEQ ID NO: 1555283 - DNA, 18 bp, Homo sapiens
gaacagtggttgcctggg

SEQ ID NO: 1555284 - DNA, 17 bp, Homo sapiens
gaacagtgtttcccata

SEQ ID NO: 1555285 - DNA, 18 bp, Homo sapiens
gaactctgggctgccatg

SEQ ID NO: 1555286 - DNA, 16 bp, Homo sapiens
gaactctgttccccca

SEQ ID NO: 1555287 - DNA, 13 bp, Homo sapiens
gaactcttaatca

SEQ ID NO: 1555288 - DNA, 23 bp, Homo sapiens
gaactcttcagaacacacagact

SEQ ID NO: 1555289 - DNA, 22 bp, Homo sapiens
gaactgaacaccattgaaggct

SEQ ID NO: 1555290 - DNA, 18 bp, Homo sapiens
gaactgaattttgggact

SEQ ID NO: 1555291 - DNA, 19 bp, Homo sapiens
gaactgagcctagctacct

SEQ ID NO: 1555292 - DNA, 22 bp, Homo sapiens
gaactgaggagatgaccaggga

SEQ ID NO: 1555293 - DNA, 24 bp, Homo sapiens
gaactgaggagcggactcacttga

SEQ ID NO: 1555294 - DNA, 13 bp, Homo sapiens
gaactgaggcctt

SEQ ID NO: 1555295 - DNA, 16 bp, Homo sapiens
gaactgcaggccctgg

SEQ ID NO: 1555296 - DNA, 18 bp, Homo sapiens
gaactgcaggccctggcc

SEQ ID NO: 1555297 - DNA, 19 bp, Homo sapiens
gaactgcaggccctggcct

SEQ ID NO: 1555298 - DNA, 14 bp, Homo sapiens
gaactgcatggacc

SEQ ID NO: 1555299 - DNA, 20 bp, Homo sapiens
gaactgctgggcttggcagc

SEQ ID NO: 1555300 - DNA, 14 bp, Homo sapiens
gaactggaagaaag

SEQ ID NO: 1555301 - DNA, 20 bp, Homo sapiens
gaactggggttcaagcccag

SEQ ID NO: 1555302 - DNA, 21 bp, Homo sapiens
gaactggggttcaagcccagg

SEQ ID NO: 1555303 - DNA, 18 bp, Homo sapiens
gaactgggtgactggagg

SEQ ID NO: 1555304 - DNA, 14 bp, Homo sapiens
gaactgtacattgt

SEQ ID NO: 1555305 - DNA, 14 bp, Homo sapiens
gaactgtactgttt

SEQ ID NO: 1555306 - DNA, 15 bp, Homo sapiens
gaactgtactgtttt

SEQ ID NO: 1555307 - DNA, 22 bp, Homo sapiens
gaactgtactgttttctgggcc

SEQ ID NO: 1555308 - DNA, 18 bp, Homo sapiens
gaactgtagatgatgtat

SEQ ID NO: 1555309 - DNA, 20 bp, Homo sapiens
gaactgtcccacaaaatatt

SEQ ID NO: 1555310 - DNA, 12 bp, Homo sapiens
gaactgtcccag

SEQ ID NO: 1555311 - DNA, 22 bp, Homo sapiens
gaactgtctgaatattctagaa

SEQ ID NO: 1555312 - DNA, 16 bp, Homo sapiens
gaactgtgataaaaag

SEQ ID NO: 1555313 - DNA, 23 bp, Homo sapiens
gaactgtgcatcaaccaggaaga

SEQ ID NO: 1555314 - DNA, 14 bp, Homo sapiens
gaactgtgccacaa

SEQ ID NO: 1555315 - DNA, 14 bp, Homo sapiens
gaactgtgcctagt

SEQ ID NO: 1555316 - DNA, 21 bp, Homo sapiens
gaactgttacaacttgtattt

SEQ ID NO: 1555317 - DNA, 15 bp, Homo sapiens
gaactgttagaatgt

SEQ ID NO: 1555318 - DNA, 16 bp, Homo sapiens
gaacttaaatgccccc

SEQ ID NO: 1555319 - DNA, 19 bp, Homo sapiens
gaacttaaatgcccccctc

SEQ ID NO: 1555320 - DNA, 17 bp, Homo sapiens
gaacttacacttggagc

SEQ ID NO: 1555321 - DNA, 19 bp, Homo sapiens
gaacttacacttggagccc

SEQ ID NO: 1555322 - DNA, 23 bp, Homo sapiens
gaacttacatactaggtgccttt

SEQ ID NO: 1555323 - DNA, 17 bp, Homo sapiens
gaacttcacataggaag

SEQ ID NO: 1555324 - DNA, 16 bp, Homo sapiens
gaacttctgactactt

SEQ ID NO: 1555325 - DNA, 14 bp, Homo sapiens
gaacttgaatgtgt

SEQ ID NO: 1555326 - DNA, 15 bp, Homo sapiens
gaacttgcattgtga

SEQ ID NO: 1555327 - DNA, 17 bp, Homo sapiens
gaacttgctgctgcctt

SEQ ID NO: 1555328 - DNA, 14 bp, Homo sapiens
gaacttgctgctgt

SEQ ID NO: 1555329 - DNA, 19 bp, Homo sapiens
gaacttggaaagaaatgcc

SEQ ID NO: 1555330 - DNA, 12 bp, Homo sapiens
gaactttcattt

SEQ ID NO: 1555331 - DNA, 15 bp, Homo sapiens
gaactttctggtccc

SEQ ID NO: 1555332 - DNA, 22 bp, Homo sapiens
gaacttttttttttaatgtttt

SEQ ID NO: 1555333 - DNA, 10 bp, Homo sapiens
gaagaaaaaa

SEQ ID NO: 1555334 - DNA, 18 bp, Homo sapiens
gaagaaaaaaaataacac

SEQ ID NO: 1555335 - DNA, 15 bp, Homo sapiens
gaagaaaacttttgt

SEQ ID NO: 1555336 - DNA, 12 bp, Homo sapiens
gaagaaaatact

SEQ ID NO: 1555337 - DNA, 12 bp, Homo sapiens
gaagaaaggcca

SEQ ID NO: 1555338 - DNA, 22 bp, Homo sapiens
gaagaaaggccaaggtgctgga

SEQ ID NO: 1555339 - DNA, 17 bp, Homo sapiens
gaagaaagtcaaaaaat

SEQ ID NO: 1555340 - DNA, 22 bp, Homo sapiens
gaagaaagtcaaaaaattattt

SEQ ID NO: 1555341 - DNA, 16 bp, Homo sapiens
gaagaaatagcagagc

SEQ ID NO: 1555342 - DNA, 20 bp, Homo sapiens
gaagaaatctttctccctca

SEQ ID NO: 1555343 - DNA, 21 bp, Homo sapiens
gaagaacacagcatgtgccaa

SEQ ID NO: 1555344 - DNA, 22 bp, Homo sapiens
gaagaacacagcatgtgccaag

SEQ ID NO: 1555345 - DNA, 13 bp, Homo sapiens
gaagaacaggcct

SEQ ID NO: 1555346 - DNA, 13 bp, Homo sapiens
gaagaacatagaa

SEQ ID NO: 1555347 - DNA, 19 bp, Homo sapiens
gaagaaccagtccccccac

SEQ ID NO: 1555348 - DNA, 22 bp, Homo sapiens
gaagaaccagtccccccaccct

SEQ ID NO: 1555349 - DNA, 20 bp, Homo sapiens
gaagaacggggctcttctca

SEQ ID NO: 1555350 - DNA, 17 bp, Homo sapiens
gaagaagaaatctttct

SEQ ID NO: 1555351 - DNA, 17 bp, Homo sapiens
gaagaagagaagctgct

SEQ ID NO: 1555352 - DNA, 12 bp, Homo sapiens
gaagaagcctgt

SEQ ID NO: 1555353 - DNA, 15 bp, Homo sapiens
gaagaagggagaaga

SEQ ID NO: 1555354 - DNA, 16 bp, Homo sapiens
gaagaagggagaagaa

SEQ ID NO: 1555355 - DNA, 19 bp, Homo sapiens
gaagaagggagaagaaagg

SEQ ID NO: 1555356 - DNA, 19 bp, Homo sapiens
gaagaagtgagcagtgttg

SEQ ID NO: 1555357 - DNA, 13 bp, Homo sapiens
gaagaagtgtgtc

SEQ ID NO: 1555358 - DNA, 14 bp, Homo sapiens
gaagaatacatcag

SEQ ID NO: 1555359 - DNA, 17 bp, Homo sapiens
gaagaatattcaggact

SEQ ID NO: 1555360 - DNA, 20 bp, Homo sapiens
gaagaatccacaaggacctc

SEQ ID NO: 1555361 - DNA, 16 bp, Homo sapiens
gaagaatgaaagctgt

SEQ ID NO: 1555362 - DNA, 23 bp, Homo sapiens
gaagaatgaagaccactggactc

SEQ ID NO: 1555363 - DNA, 13 bp, Homo sapiens
gaagaattatgta

SEQ ID NO: 1555364 - DNA, 23 bp, Homo sapiens
gaagaattatgtaatatattgta

SEQ ID NO: 1555365 - DNA, 21 bp, Homo sapiens
gaagaattgaaaagtttttgt

SEQ ID NO: 1555366 - DNA, 19 bp, Homo sapiens
gaagaattgaacccaggag

SEQ ID NO: 1555367 - DNA, 23 bp, Homo sapiens
gaagaattgaacccaggaggtgg

SEQ ID NO: 1555368 - DNA, 20 bp, Homo sapiens
gaagaattttcagaccccag

SEQ ID NO: 1555369 - DNA, 19 bp, Homo sapiens
gaagacaaagtcccagaat

SEQ ID NO: 1555370 - DNA, 18 bp, Homo sapiens
gaagacaagcatttttaa

SEQ ID NO: 1555371 - DNA, 18 bp, Homo sapiens
gaagacaatttgatacat

SEQ ID NO: 1555372 - DNA, 18 bp, Homo sapiens
gaagacacagcctccccc

SEQ ID NO: 1555373 - DNA, 10 bp, Homo sapiens
gaagacagtg

SEQ ID NO: 1555374 - DNA, 12 bp, Homo sapiens
gaagacagtggc

SEQ ID NO: 1555375 - DNA, 13 bp, Homo sapiens
gaagacagtggcc

SEQ ID NO: 1555376 - DNA, 18 bp, Homo sapiens
gaagacatgaaccaagtg

SEQ ID NO: 1555377 - DNA, 18 bp, Homo sapiens
cttgacctagctctttgg

SEQ ID NO: 1555378 - DNA, 15 bp, Homo sapiens
cttgacctctataaa

SEQ ID NO: 1555379 - DNA, 17 bp, Homo sapiens
cttgacctgaggctgtg

SEQ ID NO: 1555380 - DNA, 22 bp, Homo sapiens
cttgacgggagcattggcccct

SEQ ID NO: 1555381 - DNA, 16 bp, Homo sapiens
cttgactcaggattta

SEQ ID NO: 1555382 - DNA, 17 bp, Homo sapiens
cttgactcatggcagct

SEQ ID NO: 1555383 - DNA, 17 bp, Homo sapiens
cttgacttgattagtgc

SEQ ID NO: 1555384 - DNA, 11 bp, Homo sapiens
cttgagaaacc

SEQ ID NO: 1555385 - DNA, 11 bp, Homo sapiens
cttgagaactt

SEQ ID NO: 1555386 - DNA, 21 bp, Homo sapiens
cttgagaatcctctcctttct

SEQ ID NO: 1555387 - DNA, 22 bp, Homo sapiens
cttgagacacggagcccagccc

SEQ ID NO: 1555388 - DNA, 14 bp, Homo sapiens
cttgagacctcagc

SEQ ID NO: 1555389 - DNA, 15 bp, Homo sapiens
cttgagacctcagcc

SEQ ID NO: 1555390 - DNA, 20 bp, Homo sapiens
cttgagagaaaaagtgcccc

SEQ ID NO: 1555391 - DNA, 17 bp, Homo sapiens
cttgagagacccagctg

SEQ ID NO: 1555392 - DNA, 15 bp, Homo sapiens
cttgagagctcaggc

SEQ ID NO: 1555393 - DNA, 17 bp, Homo sapiens
cttgagagctcaggcag

SEQ ID NO: 1555394 - DNA, 18 bp, Homo sapiens
cttgagagctcaggcagc

SEQ ID NO: 1555395 - DNA, 14 bp, Homo sapiens
cttgagagctgctg

SEQ ID NO: 1555396 - DNA, 18 bp, Homo sapiens
cttgagaggagaaatgca

SEQ ID NO: 1555397 - DNA, 18 bp, Homo sapiens
cttgagatggtgaggctg

SEQ ID NO: 1555398 - DNA, 22 bp, Homo sapiens
cttgagatgtatgaaggctttt

SEQ ID NO: 1555399 - DNA, 16 bp, Homo sapiens
cttgagcatcaatctt

SEQ ID NO: 1555400 - DNA, 16 bp, Homo sapiens
cttgagccagtaattg

SEQ ID NO: 1555401 - DNA, 13 bp, Homo sapiens
cttgagccatcca

SEQ ID NO: 1555402 - DNA, 19 bp, Homo sapiens
cttgagcctcccccaaagc

SEQ ID NO: 1555403 - DNA, 21 bp, Homo sapiens
cttgagcggagcccgatattc

SEQ ID NO: 1555404 - DNA, 19 bp, Homo sapiens
cttgagctcccctggagcc

SEQ ID NO: 1555405 - DNA, 23 bp, Homo sapiens
cttgagctcttcatttattttga

SEQ ID NO: 1555406 - DNA, 12 bp, Homo sapiens
cttgagctggcc

SEQ ID NO: 1555407 - DNA, 17 bp, Homo sapiens
cttgagctggcctctct

SEQ ID NO: 1555408 - DNA, 23 bp, Homo sapiens
cttgagctggcctctctagcaca

SEQ ID NO: 1555409 - DNA, 17 bp, Homo sapiens
cttgaggccaagatggc

SEQ ID NO: 1555410 - DNA, 23 bp, Homo sapiens
cttgaggccaagatggctgctgc

SEQ ID NO: 1555411 - DNA, 14 bp, Homo sapiens
cttgaggccaggag

SEQ ID NO: 1555412 - DNA, 23 bp, Homo sapiens
cttgaggccccgatggactcctg

SEQ ID NO: 1555413 - DNA, 19 bp, Homo sapiens
cttgagggtttgagagccc

SEQ ID NO: 1555414 - DNA, 21 bp, Homo sapiens
cttgagtaaaatactcttttt

SEQ ID NO: 1555415 - DNA, 22 bp, Homo sapiens
cttgagtaaaatactcttttta

SEQ ID NO: 1555416 - DNA, 21 bp, Homo sapiens
cttgagtggggttatctctgt

SEQ ID NO: 1555417 - DNA, 22 bp, Homo sapiens
cttgagtggggttatctctgtg

SEQ ID NO: 1555418 - DNA, 21 bp, Homo sapiens
cttgagtgttcctttttaaat

SEQ ID NO: 1555419 - DNA, 23 bp, Homo sapiens
cttgagtgttcctttttaaatgt

SEQ ID NO: 1555420 - DNA, 12 bp, Homo sapiens
cttgataatata

SEQ ID NO: 1555421 - DNA, 17 bp, Homo sapiens
cttgatacccccctctg

SEQ ID NO: 1555422 - DNA, 16 bp, Homo sapiens
cttgatatttgtattt

SEQ ID NO: 1555423 - DNA, 18 bp, Homo sapiens
cttgatatttgtatttat

SEQ ID NO: 1555424 - DNA, 17 bp, Homo sapiens
cttgatctctcttgtcc

SEQ ID NO: 1555425 - DNA, 20 bp, Homo sapiens
cttgatctgtatatacaata

SEQ ID NO: 1555426 - DNA, 13 bp, Homo sapiens
cttgatgccagag

SEQ ID NO: 1555427 - DNA, 14 bp, Homo sapiens
cttgatgccagagg

SEQ ID NO: 1555428 - DNA, 16 bp, Homo sapiens
cttgatgccagagggc

SEQ ID NO: 1555429 - DNA, 23 bp, Homo sapiens
cttgatgccagagggccagcagg

SEQ ID NO: 1555430 - DNA, 18 bp, Homo sapiens
cttgatgtaaaatcttgt

SEQ ID NO: 1555431 - DNA, 21 bp, Homo sapiens
cttgatgtaaaatcttgtcat

SEQ ID NO: 1555432 - DNA, 22 bp, Homo sapiens
cttgatgtaaaatcttgtcatg

SEQ ID NO: 1555433 - DNA, 23 bp, Homo sapiens
cttgatgtaaaatcttgtcatgt

SEQ ID NO: 1555434 - DNA, 22 bp, Homo sapiens
cttgatgtacataactcctgtc

SEQ ID NO: 1555435 - DNA, 17 bp, Homo sapiens
cttgatgtcatgtactt

SEQ ID NO: 1555436 - DNA, 15 bp, Homo sapiens
cttgatgtgttatct

SEQ ID NO: 1555437 - DNA, 18 bp, Homo sapiens
cttgatgtgttatctctt

SEQ ID NO: 1555438 - DNA, 18 bp, Homo sapiens
cttgatgttccttccaga

SEQ ID NO: 1555439 - DNA, 20 bp, Homo sapiens
cttgatgttccttccagatt

SEQ ID NO: 1555440 - DNA, 14 bp, Homo sapiens
cttgatgttgctta

SEQ ID NO: 1555441 - DNA, 18 bp, Homo sapiens
cttgatgtttcctggaag

SEQ ID NO: 1555442 - DNA, 17 bp, Homo sapiens
cttgatgtttggggtct

SEQ ID NO: 1555443 - DNA, 22 bp, Homo sapiens
cttgatgttttttctgtaatgt

SEQ ID NO: 1555444 - DNA, 16 bp, Homo sapiens
cttgattatattgttt

SEQ ID NO: 1555445 - DNA, 13 bp, Homo sapiens
cttgattcctggt

SEQ ID NO: 1555446 - DNA, 17 bp, Homo sapiens
cttgattgagaaagatg

SEQ ID NO: 1555447 - DNA, 19 bp, Homo sapiens
cttgatttaaacacacaga

SEQ ID NO: 1555448 - DNA, 23 bp, Homo sapiens
cttgatttcaaagttttgttgta

SEQ ID NO: 1555449 - DNA, 21 bp, Homo sapiens
cttgatttgggtggaaaacag

SEQ ID NO: 1555450 - DNA, 21 bp, Homo sapiens
cttgattttcaagctttcaaa

SEQ ID NO: 1555451 - DNA, 14 bp, Homo sapiens
cttgattttccatc

SEQ ID NO: 1555452 - DNA, 17 bp, Homo sapiens
cttgcaatcttctactt

SEQ ID NO: 1555453 - DNA, 14 bp, Homo sapiens
cttgcacacttccc

SEQ ID NO: 1555454 - DNA, 19 bp, Homo sapiens
cttgcacagtcactgctct

SEQ ID NO: 1555455 - DNA, 23 bp, Homo sapiens
cttgcaccccaaagctttcctgc

SEQ ID NO: 1555456 - DNA, 16 bp, Homo sapiens
cttgcacccgcctctc

SEQ ID NO: 1555457 - DNA, 13 bp, Homo sapiens
cttgcactgaagc

SEQ ID NO: 1555458 - DNA, 14 bp, Homo sapiens
cttgcactgaagcc

SEQ ID NO: 1555459 - DNA, 22 bp, Homo sapiens
cttgcactgaagccggacagct

SEQ ID NO: 1555460 - DNA, 14 bp, Homo sapiens
cttgcagaactgta

SEQ ID NO: 1555461 - DNA, 13 bp, Homo sapiens
cttgcagctggcc

SEQ ID NO: 1555462 - DNA, 20 bp, Homo sapiens
cttgcataataagctaaaga

SEQ ID NO: 1555463 - DNA, 21 bp, Homo sapiens
cttgcataggctcttaagcag

SEQ ID NO: 1555464 - DNA, 17 bp, Homo sapiens
cttgcatccattgttgt

SEQ ID NO: 1555465 - DNA, 16 bp, Homo sapiens
cttgcatctgggccag

SEQ ID NO: 1555466 - DNA, 13 bp, Homo sapiens
cttgcatgcttgc

SEQ ID NO: 1555467 - DNA, 16 bp, Homo sapiens
cttgcattccagagtt

SEQ ID NO: 1555468 - DNA, 14 bp, Homo sapiens
cttgcattgtgaca

SEQ ID NO: 1555469 - DNA, 19 bp, Homo sapiens
cttgccaagggtccctgtg

SEQ ID NO: 1555470 - DNA, 20 bp, Homo sapiens
cttgccaagggtccctgtgt

SEQ ID NO: 1555471 - DNA, 17 bp, Homo sapiens
cttgccactgcactcca

SEQ ID NO: 1555472 - DNA, 16 bp, Homo sapiens
cttgccagacatgtgg

SEQ ID NO: 1555473 - DNA, 16 bp, Homo sapiens
cttgccagagatccaa

SEQ ID NO: 1555474 - DNA, 23 bp, Homo sapiens
cttgccagagatccaaaagaagc

SEQ ID NO: 1555475 - DNA, 20 bp, Homo sapiens
cttgccagagccgggcacat

SEQ ID NO: 1555476 - DNA, 14 bp, Homo sapiens
cttgccatcactgg

SEQ ID NO: 1555477 - DNA, 15 bp, Homo sapiens
cttgccatgtgctgg

SEQ ID NO: 1555478 - DNA, 19 bp, Homo sapiens
cttgccattctcttgcatt

SEQ ID NO: 1555479 - DNA, 15 bp, Homo sapiens
cttgcccaagtccca

SEQ ID NO: 1555480 - DNA, 21 bp, Homo sapiens
cttgcccactgcctgcctccc

SEQ ID NO: 1555481 - DNA, 21 bp, Homo sapiens
cttgcccagagatgcctccac

SEQ ID NO: 1555482 - DNA, 22 bp, Homo sapiens
cttgcccagagatgcctccacc

SEQ ID NO: 1555483 - DNA, 19 bp, Homo sapiens
cttgcccagggctcagcct

SEQ ID NO: 1555484 - DNA, 12 bp, Homo sapiens
cttgcccatcct

SEQ ID NO: 1555485 - DNA, 16 bp, Homo sapiens
cttgcccccatccctc

SEQ ID NO: 1555486 - DNA, 23 bp, Homo sapiens
cttgcccccatttcacccatggg

SEQ ID NO: 1555487 - DNA, 16 bp, Homo sapiens
cttgcccgccagcctc

SEQ ID NO: 1555488 - DNA, 23 bp, Homo sapiens
cttgcccgccagcctcagtgcca

SEQ ID NO: 1555489 - DNA, 17 bp, Homo sapiens
cttgcccggattctggg

SEQ ID NO: 1555490 - DNA, 18 bp, Homo sapiens
cttgcccggattctggga

SEQ ID NO: 1555491 - DNA, 23 bp, Homo sapiens
cttgccctcccaaagtgctggga

SEQ ID NO: 1555492 - DNA, 14 bp, Homo sapiens
cttgcccttccctg

SEQ ID NO: 1555493 - DNA, 16 bp, Homo sapiens
cttgcccttccctgtc

SEQ ID NO: 1555494 - DNA, 23 bp, Homo sapiens
cttgcccttccctgtccctctaa

SEQ ID NO: 1555495 - DNA, 14 bp, Homo sapiens
cttgcccttggagc

SEQ ID NO: 1555496 - DNA, 15 bp, Homo sapiens
cttgcccttggagct

SEQ ID NO: 1555497 - DNA, 17 bp, Homo sapiens
cttgccctttcccccca

SEQ ID NO: 1555498 - DNA, 17 bp, Homo sapiens
cttgccgcgcctggctt

SEQ ID NO: 1555499 - DNA, 21 bp, Homo sapiens
cttgccgggcctgggcctcct

SEQ ID NO: 1555500 - DNA, 17 bp, Homo sapiens
cttgcctaaatttaatg

SEQ ID NO: 1555501 - DNA, 14 bp, Homo sapiens
cttgcctaggccaa

SEQ ID NO: 1555502 - DNA, 17 bp, Homo sapiens
cttgcctcaatgccagt

SEQ ID NO: 1555503 - DNA, 15 bp, Homo sapiens
cttgcctccaggtgc

SEQ ID NO: 1555504 - DNA, 21 bp, Homo sapiens
cttgcctccaggtgcagaggt

SEQ ID NO: 1555505 - DNA, 16 bp, Homo sapiens
cttgcctccttttttc

SEQ ID NO: 1555506 - DNA, 19 bp, Homo sapiens
cttgcctccttttttctta

SEQ ID NO: 1555507 - DNA, 19 bp, Homo sapiens
cttgcctctgccctggatt

SEQ ID NO: 1555508 - DNA, 22 bp, Homo sapiens
cttgcctgaacatccttccttc

SEQ ID NO: 1555509 - DNA, 14 bp, Homo sapiens
cttgcctgatataa

SEQ ID NO: 1555510 - DNA, 18 bp, Homo sapiens
cttgcctggggtctgagc

SEQ ID NO: 1555511 - DNA, 20 bp, Homo sapiens
cttgcctgttggctgctgcg

SEQ ID NO: 1555512 - DNA, 23 bp, Homo sapiens
cttgccttaaacactcaccttct

SEQ ID NO: 1555513 - DNA, 13 bp, Homo sapiens
cttgcgtcctgca

SEQ ID NO: 1555514 - DNA, 14 bp, Homo sapiens
cttgcgtcctgcag

SEQ ID NO: 1555515 - DNA, 15 bp, Homo sapiens
cttgcgtcctgcaga

SEQ ID NO: 1555516 - DNA, 19 bp, Homo sapiens
cttgcgtcctgcagaggac

SEQ ID NO: 1555517 - DNA, 14 bp, Homo sapiens
cttgctaaagcact

SEQ ID NO: 1555518 - DNA, 16 bp, Homo sapiens
cttgctaaagcacttt

SEQ ID NO: 1555519 - DNA, 23 bp, Homo sapiens
cttgctaaagcactttgcactta

SEQ ID NO: 1555520 - DNA, 17 bp, Homo sapiens
cttgctaccagtattta

SEQ ID NO: 1555521 - DNA, 20 bp, Homo sapiens
cttgctaccagtatttagaa

SEQ ID NO: 1555522 - DNA, 16 bp, Homo sapiens
cttgctacctcaaggg

SEQ ID NO: 1555523 - DNA, 16 bp, Homo sapiens
cttgctacctgtgagc

SEQ ID NO: 1555524 - DNA, 15 bp, Homo sapiens
cttgctagccctggg

SEQ ID NO: 1555525 - DNA, 19 bp, Homo sapiens
cttgctagtgatacactgt

SEQ ID NO: 1555526 - DNA, 23 bp, Homo sapiens
cttgctagtgatacactgtatct

SEQ ID NO: 1555527 - DNA, 18 bp, Homo sapiens
cttgctatatgatttagc

SEQ ID NO: 1555528 - DNA, 19 bp, Homo sapiens
cttgctccagattctgatg

SEQ ID NO: 1555529 - DNA, 15 bp, Homo sapiens
cttgctccagggtct

SEQ ID NO: 1555530 - DNA, 15 bp, Homo sapiens
cttgctctcttgtga

SEQ ID NO: 1555531 - DNA, 12 bp, Homo sapiens
cttgctcttctt

SEQ ID NO: 1555532 - DNA, 17 bp, Homo sapiens
cttgctgacaataaaga

SEQ ID NO: 1555533 - DNA, 15 bp, Homo sapiens
cttgctgatggctgc

SEQ ID NO: 1555534 - DNA, 14 bp, Homo sapiens
cttgctgctctgcg

SEQ ID NO: 1555535 - DNA, 12 bp, Homo sapiens
cttgctgctgcc

SEQ ID NO: 1555536 - DNA, 13 bp, Homo sapiens
cttgctgctgcct

SEQ ID NO: 1555537 - DNA, 13 bp, Homo sapiens
cttgctgctgtct

SEQ ID NO: 1555538 - DNA, 11 bp, Homo sapiens
cttgctgcttt

SEQ ID NO: 1555539 - DNA, 19 bp, Homo sapiens
cttgctgctttagtcccga

SEQ ID NO: 1555540 - DNA, 14 bp, Homo sapiens
cttgctggccccag

SEQ ID NO: 1555541 - DNA, 22 bp, Homo sapiens
cttgctggctacgcctcttctg

SEQ ID NO: 1555542 - DNA, 12 bp, Homo sapiens
cttgctggctct

SEQ ID NO: 1555543 - DNA, 18 bp, Homo sapiens
cttgctggctctgagaat

SEQ ID NO: 1555544 - DNA, 15 bp, Homo sapiens
cttgctgggccaggg

SEQ ID NO: 1555545 - DNA, 23 bp, Homo sapiens
cttgctgtcaatgttttgagtca

SEQ ID NO: 1555546 - DNA, 14 bp, Homo sapiens
cttgctgtccaggc

SEQ ID NO: 1555547 - DNA, 17 bp, Homo sapiens
cttgctgtccaggcagc

SEQ ID NO: 1555548 - DNA, 15 bp, Homo sapiens
cttgctgtcctaggc

SEQ ID NO: 1555549 - DNA, 20 bp, Homo sapiens
cttgctgtcctaggccacac

SEQ ID NO: 1555550 - DNA, 18 bp, Homo sapiens
cttgctgttttgttctgt

SEQ ID NO: 1555551 - DNA, 16 bp, Homo sapiens
cttgctgttttttgga

SEQ ID NO: 1555552 - DNA, 22 bp, Homo sapiens
cttgcttaaatttcttatgtga

SEQ ID NO: 1555553 - DNA, 15 bp, Homo sapiens
cttgcttatttgaca

SEQ ID NO: 1555554 - DNA, 14 bp, Homo sapiens
cttgcttcagtgga

SEQ ID NO: 1555555 - DNA, 13 bp, Homo sapiens
cttgcttccctaa

SEQ ID NO: 1555556 - DNA, 12 bp, Homo sapiens
cttgcttcctga

SEQ ID NO: 1555557 - DNA, 13 bp, Homo sapiens
cttgcttcctgat

SEQ ID NO: 1555558 - DNA, 15 bp, Homo sapiens
cttgcttcttactga

SEQ ID NO: 1555559 - DNA, 20 bp, Homo sapiens
cttgcttcttactgataatt

SEQ ID NO: 1555560 - DNA, 15 bp, Homo sapiens
cttgcttctttctag

SEQ ID NO: 1555561 - DNA, 15 bp, Homo sapiens
cttgcttggaagcca

SEQ ID NO: 1555562 - DNA, 17 bp, Homo sapiens
cttgcttggaagccagg

SEQ ID NO: 1555563 - DNA, 12 bp, Homo sapiens
cttgctttcctg

SEQ ID NO: 1555564 - DNA, 15 bp, Homo sapiens
cttgctttcctgcat

SEQ ID NO: 1555565 - DNA, 15 bp, Homo sapiens
cttgctttcctgggc

SEQ ID NO: 1555566 - DNA, 17 bp, Homo sapiens
cttgctttcctgggcct

SEQ ID NO: 1555567 - DNA, 17 bp, Homo sapiens
cttgctttctttagaat

SEQ ID NO: 1555568 - DNA, 18 bp, Homo sapiens
cttgctttcttttttaaa

SEQ ID NO: 1555569 - DNA, 23 bp, Homo sapiens
cttgctttcttttttaaaatcaa

SEQ ID NO: 1555570 - DNA, 19 bp, Homo sapiens
cttgggggctcccagggca

SEQ ID NO: 1555571 - DNA, 14 bp, Homo sapiens
cttgggggggtggc

SEQ ID NO: 1555572 - DNA, 19 bp, Homo sapiens
cttgggggggtggccgctg

SEQ ID NO: 1555573 - DNA, 17 bp, Homo sapiens
cttggggtaagccagag

SEQ ID NO: 1555574 - DNA, 19 bp, Homo sapiens
cttggggtaagccagagcc

SEQ ID NO: 1555575 - DNA, 18 bp, Homo sapiens
cttggggtccctccaccc

SEQ ID NO: 1555576 - DNA, 22 bp, Homo sapiens
cttggggttaagtctcctgtct

SEQ ID NO: 1555577 - DNA, 20 bp, Homo sapiens
cttggggttttcagtatgaa

SEQ ID NO: 1555578 - DNA, 14 bp, Homo sapiens
cttgggtcagagaa

SEQ ID NO: 1555579 - DNA, 22 bp, Homo sapiens
cttgggtgtaacaggtctcctc

SEQ ID NO: 1555580 - DNA, 15 bp, Homo sapiens
cttggtaagaagccg

SEQ ID NO: 1555581 - DNA, 23 bp, Homo sapiens
cttggtactactagatgtcttta

SEQ ID NO: 1555582 - DNA, 14 bp, Homo sapiens
cttggtactgaaaa

SEQ ID NO: 1555583 - DNA, 21 bp, Homo sapiens
cttggtagttctgtgcctccc

SEQ ID NO: 1555584 - DNA, 19 bp, Homo sapiens
cttggtattattctgtttt

SEQ ID NO: 1555585 - DNA, 21 bp, Homo sapiens
cttggtattattctgttttgc

SEQ ID NO: 1555586 - DNA, 14 bp, Homo sapiens
cttggtcagagcca

SEQ ID NO: 1555587 - DNA, 16 bp, Homo sapiens
cttggtccctggtccc

SEQ ID NO: 1555588 - DNA, 15 bp, Homo sapiens
cttggtctatgtgct

SEQ ID NO: 1555589 - DNA, 20 bp, Homo sapiens
cttggtctatgtgctctgta

SEQ ID NO: 1555590 - DNA, 14 bp, Homo sapiens
cttggtctctcctt

SEQ ID NO: 1555591 - DNA, 21 bp, Homo sapiens
cttggtctctccttcctcttg

SEQ ID NO: 1555592 - DNA, 22 bp, Homo sapiens
cttggtgaatttttttttccta

SEQ ID NO: 1555593 - DNA, 17 bp, Homo sapiens
cttggtgactctgtcct

SEQ ID NO: 1555594 - DNA, 14 bp, Homo sapiens
cttggtgagtcttg

SEQ ID NO: 1555595 - DNA, 17 bp, Homo sapiens
cttggtgcctctgcagt

SEQ ID NO: 1555596 - DNA, 18 bp, Homo sapiens
cttggtggagcagccaga

SEQ ID NO: 1555597 - DNA, 21 bp, Homo sapiens
cttggtggagcagccagagct

SEQ ID NO: 1555598 - DNA, 21 bp, Homo sapiens
cttggtgggtgtggccagcac

SEQ ID NO: 1555599 - DNA, 22 bp, Homo sapiens
cttggtggttctatcaggggtg

SEQ ID NO: 1555600 - DNA, 18 bp, Homo sapiens
cttggtgtaatttgaaga

SEQ ID NO: 1555601 - DNA, 23 bp, Homo sapiens
cttggttcaataaagcactgagc

SEQ ID NO: 1555602 - DNA, 17 bp, Homo sapiens
cttggttcccttgtgtg

SEQ ID NO: 1555603 - DNA, 13 bp, Homo sapiens
cttggttggctgg

SEQ ID NO: 1555604 - DNA, 16 bp, Homo sapiens
cttggttggctggcag

SEQ ID NO: 1555605 - DNA, 22 bp, Homo sapiens
cttggttggctggcagctgaga

SEQ ID NO: 1555606 - DNA, 13 bp, Homo sapiens
cttggtttgctag

SEQ ID NO: 1555607 - DNA, 14 bp, Homo sapiens
cttggtttgctagt

SEQ ID NO: 1555608 - DNA, 21 bp, Homo sapiens
cttggtttgttatatcaggga

SEQ ID NO: 1555609 - DNA, 14 bp, Homo sapiens
cttggttttatggt

SEQ ID NO: 1555610 - DNA, 21 bp, Homo sapiens
cttggtttttactgctctgag

SEQ ID NO: 1555611 - DNA, 21 bp, Homo sapiens
cttctagatcttagttctaga

SEQ ID NO: 1555612 - DNA, 16 bp, Homo sapiens
cttctagattcactgt

SEQ ID NO: 1555613 - DNA, 17 bp, Homo sapiens
cttctataattttgcct

SEQ ID NO: 1555614 - DNA, 15 bp, Homo sapiens
cttctatacccaccc

SEQ ID NO: 1555615 - DNA, 23 bp, Homo sapiens
cttctatcattccaattctaaat

SEQ ID NO: 1555616 - DNA, 17 bp, Homo sapiens
cttctatgctgcttcca

SEQ ID NO: 1555617 - DNA, 15 bp, Homo sapiens
cttctatgtccaaca

SEQ ID NO: 1555618 - DNA, 19 bp, Homo sapiens
cttctattaatcaagagaa

SEQ ID NO: 1555619 - DNA, 20 bp, Homo sapiens
cttctattctagcctgcatt

SEQ ID NO: 1555620 - DNA, 13 bp, Homo sapiens
cttctattttatt

SEQ ID NO: 1555621 - DNA, 14 bp, Homo sapiens
cttctattttgtaa

SEQ ID NO: 1555622 - DNA, 15 bp, Homo sapiens
cttctattttgtaaa

SEQ ID NO: 1555623 - DNA, 20 bp, Homo sapiens
cttctatttttatcatgaat

SEQ ID NO: 1555624 - DNA, 19 bp, Homo sapiens
cttctcaaacctgtttaaa

SEQ ID NO: 1555625 - DNA, 21 bp, Homo sapiens
cttctcaagttctaagattct

SEQ ID NO: 1555626 - DNA, 23 bp, Homo sapiens
cttctcaagttctaagattctaa

SEQ ID NO: 1555627 - DNA, 16 bp, Homo sapiens
cttctcaccccaggat

SEQ ID NO: 1555628 - DNA, 15 bp, Homo sapiens
cttctcactcaccac

SEQ ID NO: 1555629 - DNA, 14 bp, Homo sapiens
cttctcagaagcac

SEQ ID NO: 1555630 - DNA, 17 bp, Homo sapiens
cttctcagaagcacaga

SEQ ID NO: 1555631 - DNA, 22 bp, Homo sapiens
cttctcagaagcacagaatatt

SEQ ID NO: 1555632 - DNA, 20 bp, Homo sapiens
cttctcaggccccgggcttc

SEQ ID NO: 1555633 - DNA, 22 bp, Homo sapiens
cttctcaggccccgggcttccc

SEQ ID NO: 1555634 - DNA, 13 bp, Homo sapiens
cttctcaggctct

SEQ ID NO: 1555635 - DNA, 12 bp, Homo sapiens
cttctcatctgt

SEQ ID NO: 1555636 - DNA, 22 bp, Homo sapiens
cttctccaagaatggaagcctg

SEQ ID NO: 1555637 - DNA, 13 bp, Homo sapiens
gaaaaatggaaaa

SEQ ID NO: 1555638 - DNA, 17 bp, Homo sapiens
gaaaaatgggagccagg

SEQ ID NO: 1555639 - DNA, 18 bp, Homo sapiens
gaaaaatgggagccagga

SEQ ID NO: 1555640 - DNA, 16 bp, Homo sapiens
gaaaaatggttgatgg

SEQ ID NO: 1555641 - DNA, 18 bp, Homo sapiens
gaaaaatggttgatggaa

SEQ ID NO: 1555642 - DNA, 20 bp, Homo sapiens
gaaaaatggttgatggaaaa

SEQ ID NO: 1555643 - DNA, 14 bp, Homo sapiens
gaaaaatgttagga

SEQ ID NO: 1555644 - DNA, 11 bp, Homo sapiens
gaaaaattaac

SEQ ID NO: 1555645 - DNA, 16 bp, Homo sapiens
gaaaaattaacttttt

SEQ ID NO: 1555646 - DNA, 16 bp, Homo sapiens
gaaaaattacagcttc

SEQ ID NO: 1555647 - DNA, 20 bp, Homo sapiens
gaaaaattcaatagtaatat

SEQ ID NO: 1555648 - DNA, 14 bp, Homo sapiens
gaaaacaaagttct

SEQ ID NO: 1555649 - DNA, 18 bp, Homo sapiens
gaaaacactatttccaaa

SEQ ID NO: 1555650 - DNA, 12 bp, Homo sapiens
gaaaacagaaac

SEQ ID NO: 1555651 - DNA, 17 bp, Homo sapiens
gaaaacagtacagaagg

SEQ ID NO: 1555652 - DNA, 12 bp, Homo sapiens
gaaaacatgtac

SEQ ID NO: 1555653 - DNA, 16 bp, Homo sapiens
gaaaacatgtactaca

SEQ ID NO: 1555654 - DNA, 19 bp, Homo sapiens
gaaaacatgtactacagct

SEQ ID NO: 1555655 - DNA, 16 bp, Homo sapiens
gaaaacatgtttaaat

SEQ ID NO: 1555656 - DNA, 11 bp, Homo sapiens
gaaaacatttc

SEQ ID NO: 1555657 - DNA, 18 bp, Homo sapiens
gaaaaccaaccctgtggg

SEQ ID NO: 1555658 - DNA, 19 bp, Homo sapiens
gaaaaccacagtcagtgga

SEQ ID NO: 1555659 - DNA, 20 bp, Homo sapiens
gaaaaccaggaaaagggagc

SEQ ID NO: 1555660 - DNA, 12 bp, Homo sapiens
gaaaacccagag

SEQ ID NO: 1555661 - DNA, 18 bp, Homo sapiens
gaaaactaaggatttttc

SEQ ID NO: 1555662 - DNA, 18 bp, Homo sapiens
gaaaactccaccttccca

SEQ ID NO: 1555663 - DNA, 16 bp, Homo sapiens
gaaaactgacagagga

SEQ ID NO: 1555664 - DNA, 18 bp, Homo sapiens
gaaaactgtaaatatttt

SEQ ID NO: 1555665 - DNA, 16 bp, Homo sapiens
gaaaacttcttttaaa

SEQ ID NO: 1555666 - DNA, 15 bp, Homo sapiens
gaaaacttttctcag

SEQ ID NO: 1555667 - DNA, 12 bp, Homo sapiens
gaaaagaaagaa

SEQ ID NO: 1555668 - DNA, 15 bp, Homo sapiens
gaaaagaaggaaaga

SEQ ID NO: 1555669 - DNA, 14 bp, Homo sapiens
gaaaagacatttta

SEQ ID NO: 1555670 - DNA, 15 bp, Homo sapiens
gaaaagaccagggct

SEQ ID NO: 1555671 - DNA, 14 bp, Homo sapiens
gaaaagaccctgag

SEQ ID NO: 1555672 - DNA, 17 bp, Homo sapiens
gaaaagactccaaagaa

SEQ ID NO: 1555673 - DNA, 13 bp, Homo sapiens
gaaaagagagaaa

SEQ ID NO: 1555674 - DNA, 13 bp, Homo sapiens
gaaaagataaacc

SEQ ID NO: 1555675 - DNA, 19 bp, Homo sapiens
gaaaagataaagaccagaa

SEQ ID NO: 1555676 - DNA, 22 bp, Homo sapiens
gaaaagataaagaccagaaatt

SEQ ID NO: 1555677 - DNA, 15 bp, Homo sapiens
gaaaagatccccaag

SEQ ID NO: 1555678 - DNA, 15 bp, Homo sapiens
gaaaagattcttctg

SEQ ID NO: 1555679 - DNA, 23 bp, Homo sapiens
gaaaagattcttctgtgtttata

SEQ ID NO: 1555680 - DNA, 19 bp, Homo sapiens
gaaaagcaattgccctgta

SEQ ID NO: 1555681 - DNA, 16 bp, Homo sapiens
gaaaagcagttcatgt

SEQ ID NO: 1555682 - DNA, 16 bp, Homo sapiens
gaaaagcattttcagt

SEQ ID NO: 1555683 - DNA, 17 bp, Homo sapiens
ctttggccattccaaca

SEQ ID NO: 1555684 - DNA, 17 bp, Homo sapiens
ctttggccccactttga

SEQ ID NO: 1555685 - DNA, 20 bp, Homo sapiens
ctttggcctggggtgcatct

SEQ ID NO: 1555686 - DNA, 22 bp, Homo sapiens
ctttggctgagacctgggattt

SEQ ID NO: 1555687 - DNA, 11 bp, Homo sapiens
ctttggctgca

SEQ ID NO: 1555688 - DNA, 14 bp, Homo sapiens
ctttggctgcaggt

SEQ ID NO: 1555689 - DNA, 15 bp, Homo sapiens
ctttggctggtagca

SEQ ID NO: 1555690 - DNA, 20 bp, Homo sapiens
ctttggctggtagcagcagg

SEQ ID NO: 1555691 - DNA, 15 bp, Homo sapiens
ctttggcttctcctg

SEQ ID NO: 1555692 - DNA, 17 bp, Homo sapiens
ctttggcttctcctgtg

SEQ ID NO: 1555693 - DNA, 21 bp, Homo sapiens
ctttgggaaaacatgttaatg

SEQ ID NO: 1555694 - DNA, 16 bp, Homo sapiens
ctttgggaacactggc

SEQ ID NO: 1555695 - DNA, 13 bp, Homo sapiens
ctttgggaggcag

SEQ ID NO: 1555696 - DNA, 15 bp, Homo sapiens
ctttgggaggccaag

SEQ ID NO: 1555697 - DNA, 23 bp, Homo sapiens
ctttgggaggccaaggcaggtag

SEQ ID NO: 1555698 - DNA, 14 bp, Homo sapiens
ctttgggaggctga

SEQ ID NO: 1555699 - DNA, 14 bp, Homo sapiens
ctttgggcagtgcc

SEQ ID NO: 1555700 - DNA, 21 bp, Homo sapiens
ctttgggccagacatgccaca

SEQ ID NO: 1555701 - DNA, 15 bp, Homo sapiens
ctttgggctgccctg

SEQ ID NO: 1555702 - DNA, 21 bp, Homo sapiens
ctttgggctttgcaggctctg

SEQ ID NO: 1555703 - DNA, 20 bp, Homo sapiens
ctttggggacagttggcaga

SEQ ID NO: 1555704 - DNA, 21 bp, Homo sapiens
ctttggggacagttggcagag

SEQ ID NO: 1555705 - DNA, 18 bp, Homo sapiens
ctttgggggagtgggcgc

SEQ ID NO: 1555706 - DNA, 22 bp, Homo sapiens
ctttgggtacttatactaaatt

SEQ ID NO: 1555707 - DNA, 18 bp, Homo sapiens
ctttgggtccattcagat

SEQ ID NO: 1555708 - DNA, 18 bp, Homo sapiens
ctttgggtcctgggcagg

SEQ ID NO: 1555709 - DNA, 21 bp, Homo sapiens
ctttgggtggctcactactga

SEQ ID NO: 1555710 - DNA, 22 bp, Homo sapiens
ctttggtaattttttttgtttt

SEQ ID NO: 1555711 - DNA, 15 bp, Homo sapiens
ctttggtacacagtt

SEQ ID NO: 1555712 - DNA, 18 bp, Homo sapiens
ctttggtgaacagttttg

SEQ ID NO: 1555713 - DNA, 19 bp, Homo sapiens
ctttggtgttacacagccc

SEQ ID NO: 1555714 - DNA, 14 bp, Homo sapiens
ctttggttcagcta

SEQ ID NO: 1555715 - DNA, 17 bp, Homo sapiens
ctttggttctctccagg

SEQ ID NO: 1555716 - DNA, 19 bp, Homo sapiens
ctttggttctctccaggaa

SEQ ID NO: 1555717 - DNA, 20 bp, Homo sapiens
ctttggttctctccaggaag

SEQ ID NO: 1555718 - DNA, 19 bp, Homo sapiens
ctttggttctggccagaat

SEQ ID NO: 1555719 - DNA, 20 bp, Homo sapiens
ctttggtttaatttaaagcc

SEQ ID NO: 1555720 - DNA, 19 bp, Homo sapiens
ctttggtttttttcttctg

SEQ ID NO: 1555721 - DNA, 16 bp, Homo sapiens
ctttgtaaaaatcttt

SEQ ID NO: 1555722 - DNA, 21 bp, Homo sapiens
ctttgtaaatgcatattaaat

SEQ ID NO: 1555723 - DNA, 16 bp, Homo sapiens
ctttgtaagacatttg

SEQ ID NO: 1555724 - DNA, 17 bp, Homo sapiens
ctttgtaagacatttgt

SEQ ID NO: 1555725 - DNA, 18 bp, Homo sapiens
ctttgtaagacatttgta

SEQ ID NO: 1555726 - DNA, 13 bp, Homo sapiens
ctttgtaatggga

SEQ ID NO: 1555727 - DNA, 15 bp, Homo sapiens
ctttgtacagagtgc

SEQ ID NO: 1555728 - DNA, 19 bp, Homo sapiens
ctttgtacagagtgctttt

SEQ ID NO: 1555729 - DNA, 15 bp, Homo sapiens
ctttgtaccaaaatt

SEQ ID NO: 1555730 - DNA, 20 bp, Homo sapiens
ctttgtaccttttgtagttt

SEQ ID NO: 1555731 - DNA, 21 bp, Homo sapiens
ctttgtagatccttagaggtc

SEQ ID NO: 1555732 - DNA, 23 bp, Homo sapiens
ctttgtataatcccacccacctc

SEQ ID NO: 1555733 - DNA, 21 bp, Homo sapiens
ctttgtatataggcttctcac

SEQ ID NO: 1555734 - DNA, 14 bp, Homo sapiens
ctttgtatattaca

SEQ ID NO: 1555735 - DNA, 13 bp, Homo sapiens
ctttgtatctttc

SEQ ID NO: 1555736 - DNA, 12 bp, Homo sapiens
ctttgtatgcac

SEQ ID NO: 1555737 - DNA, 20 bp, Homo sapiens
ctttgtatgtcatttccttc

SEQ ID NO: 1555738 - DNA, 17 bp, Homo sapiens
ctttgtattttgattat

SEQ ID NO: 1555739 - DNA, 18 bp, Homo sapiens
ctttgtcatctttcttct

SEQ ID NO: 1555740 - DNA, 15 bp, Homo sapiens
ctttgtcccggggct

SEQ ID NO: 1555741 - DNA, 23 bp, Homo sapiens
ctttgtcgctgggtcagtgctgg

SEQ ID NO: 1555742 - DNA, 17 bp, Homo sapiens
cttttattcatttgagt

SEQ ID NO: 1555743 - DNA, 22 bp, Homo sapiens
cttttattcctgccctgctgtt

SEQ ID NO: 1555744 - DNA, 20 bp, Homo sapiens
cttttatttagggccttttc

SEQ ID NO: 1555745 - DNA, 21 bp, Homo sapiens
cttttattttacacagaaaca

SEQ ID NO: 1555746 - DNA, 15 bp, Homo sapiens
cttttattttttctt

SEQ ID NO: 1555747 - DNA, 21 bp, Homo sapiens
cttttattttttcttttgtaa

SEQ ID NO: 1555748 - DNA, 13 bp, Homo sapiens
cttttcaaatgtt

SEQ ID NO: 1555749 - DNA, 17 bp, Homo sapiens
cttttcaagtatttaag

SEQ ID NO: 1555750 - DNA, 22 bp, Homo sapiens
cttttcaatcttctacttttaa

SEQ ID NO: 1555751 - DNA, 15 bp, Homo sapiens
cttttcacactgtct

SEQ ID NO: 1555752 - DNA, 20 bp, Homo sapiens
cttttcacactgtcttcccg

SEQ ID NO: 1555753 - DNA, 17 bp, Homo sapiens
cttttcacattagataa

SEQ ID NO: 1555754 - DNA, 19 bp, Homo sapiens
cttttcacattaggctgtt

SEQ ID NO: 1555755 - DNA, 15 bp, Homo sapiens
cttttcacattttta

SEQ ID NO: 1555756 - DNA, 21 bp, Homo sapiens
cttttcaccaaaatttctaca

SEQ ID NO: 1555757 - DNA, 16 bp, Homo sapiens
cttttcactgcctgta

SEQ ID NO: 1555758 - DNA, 20 bp, Homo sapiens
cttttcactgctggctgcct

SEQ ID NO: 1555759 - DNA, 23 bp, Homo sapiens
cttttcactttctacttttttca

SEQ ID NO: 1555760 - DNA, 20 bp, Homo sapiens
cttttcagcttgtttctata

SEQ ID NO: 1555761 - DNA, 14 bp, Homo sapiens
cttttcaggaaaat

SEQ ID NO: 1555762 - DNA, 18 bp, Homo sapiens
cttttcatcaaaaagcct

SEQ ID NO: 1555763 - DNA, 18 bp, Homo sapiens
cttttccaaataaacatt

SEQ ID NO: 1555764 - DNA, 20 bp, Homo sapiens
cttttccaggatcctgcagg

SEQ ID NO: 1555765 - DNA, 21 bp, Homo sapiens
cttttccaggatcctgcagga

SEQ ID NO: 1555766 - DNA, 16 bp, Homo sapiens
cttttccatctaaaat

SEQ ID NO: 1555767 - DNA, 20 bp, Homo sapiens
cttttccattgaccagctct

SEQ ID NO: 1555768 - DNA, 15 bp, Homo sapiens
cttttcccaccagct

SEQ ID NO: 1555769 - DNA, 14 bp, Homo sapiens
cttttcccaggaat

SEQ ID NO: 1555770 - DNA, 19 bp, Homo sapiens
cttttcccatttgtaattt

SEQ ID NO: 1555771 - DNA, 13 bp, Homo sapiens
cttttccccagga

SEQ ID NO: 1555772 - DNA, 15 bp, Homo sapiens
cttttccccaggagc

SEQ ID NO: 1555773 - DNA, 19 bp, Homo sapiens
cttttcccccattaatcag

SEQ ID NO: 1555774 - DNA, 16 bp, Homo sapiens
cttttcccccttccca

SEQ ID NO: 1555775 - DNA, 14 bp, Homo sapiens
cttttccccggtcc

SEQ ID NO: 1555776 - DNA, 17 bp, Homo sapiens
cttttcccctttcctgt

SEQ ID NO: 1555777 - DNA, 14 bp, Homo sapiens
cttttccctgcttc

SEQ ID NO: 1555778 - DNA, 18 bp, Homo sapiens
cttttccctgtacttttc

SEQ ID NO: 1555779 - DNA, 22 bp, Homo sapiens
cttttcccttacaaggtgggga

SEQ ID NO: 1555780 - DNA, 13 bp, Homo sapiens
cttttcccttgct

SEQ ID NO: 1555781 - DNA, 15 bp, Homo sapiens
cttttcctcaagcaa

SEQ ID NO: 1555782 - DNA, 22 bp, Homo sapiens
cttttcctcaagcaataattgt

SEQ ID NO: 1555783 - DNA, 16 bp, Homo sapiens
cttttcctctctcccg

SEQ ID NO: 1555784 - DNA, 18 bp, Homo sapiens
cttttcctctctcccgga

SEQ ID NO: 1555785 - DNA, 21 bp, Homo sapiens
cttttcctgatggctggcagg

SEQ ID NO: 1555786 - DNA, 16 bp, Homo sapiens
cttttcctggtgctct

SEQ ID NO: 1555787 - DNA, 19 bp, Homo sapiens
cttttcgccccctgcctgc

SEQ ID NO: 1555788 - DNA, 22 bp, Homo sapiens
cttttcgccccctgcctgccat

SEQ ID NO: 1555789 - DNA, 23 bp, Homo sapiens
cttttcgccccctgcctgccata

SEQ ID NO: 1555790 - DNA, 21 bp, Homo sapiens
cttttctaatcacagtgttgc

SEQ ID NO: 1555791 - DNA, 22 bp, Homo sapiens
cttttctaattcctgttgctct

SEQ ID NO: 1555792 - DNA, 22 bp, Homo sapiens
cttttctaccctagccattcct

SEQ ID NO: 1555793 - DNA, 18 bp, Homo sapiens
cttttctagagacacatt

SEQ ID NO: 1555794 - DNA, 21 bp, Homo sapiens
cttttctatttataagtgact

SEQ ID NO: 1555795 - DNA, 11 bp, Homo sapiens
cttttctcagg

SEQ ID NO: 1555796 - DNA, 13 bp, Homo sapiens
cttttctcaggac

SEQ ID NO: 1555797 - DNA, 16 bp, Homo sapiens
tggaactactgtactt

SEQ ID NO: 1555798 - DNA, 19 bp, Homo sapiens
tggaactctactcaaccca

SEQ ID NO: 1555799 - DNA, 14 bp, Homo sapiens
tggaactctgtgca

SEQ ID NO: 1555800 - DNA, 18 bp, Homo sapiens
tggaactctgtgcaggtg

SEQ ID NO: 1555801 - DNA, 16 bp, Homo sapiens
tggaactgtcccagct

SEQ ID NO: 1555802 - DNA, 21 bp, Homo sapiens
tggaactttttagattattcc

SEQ ID NO: 1555803 - DNA, 14 bp, Homo sapiens
tggaagaaagtaag

SEQ ID NO: 1555804 - DNA, 12 bp, Homo sapiens
tggaagaaccac

SEQ ID NO: 1555805 - DNA, 12 bp, Homo sapiens
tggaagaaggga

SEQ ID NO: 1555806 - DNA, 15 bp, Homo sapiens
tggaagaagggagaa

SEQ ID NO: 1555807 - DNA, 13 bp, Homo sapiens
tggaagacacttc

SEQ ID NO: 1555808 - DNA, 17 bp, Homo sapiens
tggaagagcagcctgat

SEQ ID NO: 1555809 - DNA, 18 bp, Homo sapiens
tggaagatattcctgagt

SEQ ID NO: 1555810 - DNA, 23 bp, Homo sapiens
tggaagatggtccgtgcccaggc

SEQ ID NO: 1555811 - DNA, 18 bp, Homo sapiens
tggaagattattgagagc

SEQ ID NO: 1555812 - DNA, 14 bp, Homo sapiens
tggaagattcagct

SEQ ID NO: 1555813 - DNA, 14 bp, Homo sapiens
tggaagattttaaa

SEQ ID NO: 1555814 - DNA, 13 bp, Homo sapiens
tggaagcagagca

SEQ ID NO: 1555815 - DNA, 17 bp, Homo sapiens
tggaagcatgtaggaga

SEQ ID NO: 1555816 - DNA, 15 bp, Homo sapiens
tggaagccagctttc

SEQ ID NO: 1555817 - DNA, 18 bp, Homo sapiens
tggaagccagctttccct

SEQ ID NO: 1555818 - DNA, 22 bp, Homo sapiens
tggaagccaggtacaggagagg

SEQ ID NO: 1555819 - DNA, 20 bp, Homo sapiens
tggaagccctcaaagaagtc

SEQ ID NO: 1555820 - DNA, 17 bp, Homo sapiens
tggaagcctgaactgag

SEQ ID NO: 1555821 - DNA, 17 bp, Homo sapiens
tggaagctaccagagct

SEQ ID NO: 1555822 - DNA, 21 bp, Homo sapiens
tggaagctctccgagctctgg

SEQ ID NO: 1555823 - DNA, 16 bp, Homo sapiens
tggaagctggaagact

SEQ ID NO: 1555824 - DNA, 16 bp, Homo sapiens
tggaaggacacagtga

SEQ ID NO: 1555825 - DNA, 17 bp, Homo sapiens
tggaaggacacagtgat

SEQ ID NO: 1555826 - DNA, 19 bp, Homo sapiens
tggaaggaccacattttat

SEQ ID NO: 1555827 - DNA, 18 bp, Homo sapiens
tggaaggagcacatacta

SEQ ID NO: 1555828 - DNA, 23 bp, Homo sapiens
tggaaggcacccgccctttcctt

SEQ ID NO: 1555829 - DNA, 15 bp, Homo sapiens
tggaaggcagagaaa

SEQ ID NO: 1555830 - DNA, 18 bp, Homo sapiens
tggaaggcagagaaatct

SEQ ID NO: 1555831 - DNA, 20 bp, Homo sapiens
tggaaggcagagaaatctaa

SEQ ID NO: 1555832 - DNA, 16 bp, Homo sapiens
tggaaggcagggcaga

SEQ ID NO: 1555833 - DNA, 17 bp, Homo sapiens
tggaaggccttccactg

SEQ ID NO: 1555834 - DNA, 22 bp, Homo sapiens
tggaagggaaaaaaaatgtagc

SEQ ID NO: 1555835 - DNA, 22 bp, Homo sapiens
tggaagggccggcttctgcctg

SEQ ID NO: 1555836 - DNA, 14 bp, Homo sapiens
tggaaggggcagca

SEQ ID NO: 1555837 - DNA, 19 bp, Homo sapiens
tggaagggtctctctccag

SEQ ID NO: 1555838 - DNA, 18 bp, Homo sapiens
tggaagggttctggctgc

SEQ ID NO: 1555839 - DNA, 19 bp, Homo sapiens
tggaagggttctggctgcc

SEQ ID NO: 1555840 - DNA, 21 bp, Homo sapiens
tggaaggtttgtatattgtca

SEQ ID NO: 1555841 - DNA, 22 bp, Homo sapiens
tggaagtcagtacgatcaagtt

SEQ ID NO: 1555842 - DNA, 21 bp, Homo sapiens
tggaagtctccatgaagagct

SEQ ID NO: 1555843 - DNA, 14 bp, Homo sapiens
tggaagtctgcgcc

SEQ ID NO: 1555844 - DNA, 17 bp, Homo sapiens
tggaagtgtctgccagc

SEQ ID NO: 1555845 - DNA, 18 bp, Homo sapiens
tggaagtgtctgccagct

SEQ ID NO: 1555846 - DNA, 14 bp, Homo sapiens
tggaagtgtgggtc

SEQ ID NO: 1555847 - DNA, 15 bp, Homo sapiens
tggaataaaaggctt

SEQ ID NO: 1555848 - DNA, 18 bp, Homo sapiens
tggaataaaaggcttgaa

SEQ ID NO: 1555849 - DNA, 22 bp, Homo sapiens
tggaataaaaggcttgaagctg

SEQ ID NO: 1555850 - DNA, 17 bp, Homo sapiens
tggaataaacattaatt

SEQ ID NO: 1555851 - DNA, 20 bp, Homo sapiens
tggaataaacattaattttg

SEQ ID NO: 1555852 - DNA, 17 bp, Homo sapiens
tggaataaagttgcaga

SEQ ID NO: 1555853 - DNA, 23 bp, Homo sapiens
tggaataaattatggcatttcta

SEQ ID NO: 1555854 - DNA, 14 bp, Homo sapiens
tggaatacatgaaa

SEQ ID NO: 1555855 - DNA, 15 bp, Homo sapiens
tggaatacatgaaat

SEQ ID NO: 1555856 - DNA, 14 bp, Homo sapiens
tggaatacatttct

SEQ ID NO: 1555857 - DNA, 13 bp, Homo sapiens
tggaatagatgtc

SEQ ID NO: 1555858 - DNA, 15 bp, Homo sapiens
tggaatagatgtctc

SEQ ID NO: 1555859 - DNA, 15 bp, Homo sapiens
tggaatataaaacag

SEQ ID NO: 1555860 - DNA, 12 bp, Homo sapiens
tggaatattaaa

SEQ ID NO: 1555861 - DNA, 14 bp, Homo sapiens
tggaatattgtttc

SEQ ID NO: 1555862 - DNA, 18 bp, Homo sapiens
tggaatcgatttcctccc

SEQ ID NO: 1555863 - DNA, 16 bp, Homo sapiens
tggaatctagccgatg

SEQ ID NO: 1555864 - DNA, 18 bp, Homo sapiens
tggaatctagccgatgga

SEQ ID NO: 1555865 - DNA, 22 bp, Homo sapiens
tggaatctagccgatggaaaat

SEQ ID NO: 1555866 - DNA, 18 bp, Homo sapiens
tggaatctggagaccagg

SEQ ID NO: 1555867 - DNA, 18 bp, Homo sapiens
tggaatgcagggaagagg

SEQ ID NO: 1555868 - DNA, 22 bp, Homo sapiens
tggaatgcatatcgctgggctc

SEQ ID NO: 1555869 - DNA, 17 bp, Homo sapiens
tggaatgcccttcactg

SEQ ID NO: 1555870 - DNA, 19 bp, Homo sapiens
tggaatgccgctgtctctg

SEQ ID NO: 1555871 - DNA, 20 bp, Homo sapiens
tggaatgccgctgtctctga

SEQ ID NO: 1555872 - DNA, 16 bp, Homo sapiens
tggaatgctgtgttaa

SEQ ID NO: 1555873 - DNA, 24 bp, Homo sapiens
tggaatgcttcctagaagttactg

SEQ ID NO: 1555874 - DNA, 12 bp, Homo sapiens
cttgtgactgaa

SEQ ID NO: 1555875 - DNA, 21 bp, Homo sapiens
cttgtgacttttgctttaatt

SEQ ID NO: 1555876 - DNA, 15 bp, Homo sapiens
cttgtgagcatcaga

SEQ ID NO: 1555877 - DNA, 21 bp, Homo sapiens
cttgtgagcatcagagggctg

SEQ ID NO: 1555878 - DNA, 22 bp, Homo sapiens
cttgtgagcatcagagggctga

SEQ ID NO: 1555879 - DNA, 17 bp, Homo sapiens
cttgtgagtggataatc

SEQ ID NO: 1555880 - DNA, 14 bp, Homo sapiens
cttgtgatcctaaa

SEQ ID NO: 1555881 - DNA, 17 bp, Homo sapiens
cttgtgattgctgccat

SEQ ID NO: 1555882 - DNA, 12 bp, Homo sapiens
cttgtgattggc

SEQ ID NO: 1555883 - DNA, 16 bp, Homo sapiens
cttgtgcaattgtctt

SEQ ID NO: 1555884 - DNA, 20 bp, Homo sapiens
cttgtgcaccctctatccca

SEQ ID NO: 1555885 - DNA, 23 bp, Homo sapiens
cttgtgcaccctctatcccaata

SEQ ID NO: 1555886 - DNA, 15 bp, Homo sapiens
cttgtgcagtgttga

SEQ ID NO: 1555887 - DNA, 19 bp, Homo sapiens
cttgtgccatagtcacatg

SEQ ID NO: 1555888 - DNA, 21 bp, Homo sapiens
cttgtgccctgcccccatctc

SEQ ID NO: 1555889 - DNA, 23 bp, Homo sapiens
cttgtgccctgcccccatctccc

SEQ ID NO: 1555890 - DNA, 14 bp, Homo sapiens
cttgtgcctggggt

SEQ ID NO: 1555891 - DNA, 16 bp, Homo sapiens
cttgtgctcacgctcc

SEQ ID NO: 1555892 - DNA, 12 bp, Homo sapiens
cttgtgcttctt

SEQ ID NO: 1555893 - DNA, 22 bp, Homo sapiens
cttgtgcttggtggggctcgtg

SEQ ID NO: 1555894 - DNA, 24 bp, Homo sapiens
cttgtgcttggtggggctcgtggc

SEQ ID NO: 1555895 - DNA, 18 bp, Homo sapiens
cttgtggaattgggagct

SEQ ID NO: 1555896 - DNA, 13 bp, Homo sapiens
cttgtggactggc

SEQ ID NO: 1555897 - DNA, 24 bp, Homo sapiens
cttgtggactggctgtgcccctga

SEQ ID NO: 1555898 - DNA, 22 bp, Homo sapiens
cttgtggaggatgaatagatgt

SEQ ID NO: 1555899 - DNA, 17 bp, Homo sapiens
cttgtgggaccagtccc

SEQ ID NO: 1555900 - DNA, 15 bp, Homo sapiens
cttgtgggagacagc

SEQ ID NO: 1555901 - DNA, 16 bp, Homo sapiens
cttgtgggagacagca

SEQ ID NO: 1555902 - DNA, 18 bp, Homo sapiens
cttgtgggagacagcagc

SEQ ID NO: 1555903 - DNA, 19 bp, Homo sapiens
cttgtgggagacagcagcc

SEQ ID NO: 1555904 - DNA, 14 bp, Homo sapiens
cttgtggtgtgacc

SEQ ID NO: 1555905 - DNA, 23 bp, Homo sapiens
cttgtggtgtgaccatgttcatt

SEQ ID NO: 1555906 - DNA, 12 bp, Homo sapiens
cttgtggttaaa

SEQ ID NO: 1555907 - DNA, 15 bp, Homo sapiens
cttgtgtaactaatt

SEQ ID NO: 1555908 - DNA, 19 bp, Homo sapiens
cttgtgtcaagacatttct

SEQ ID NO: 1555909 - DNA, 14 bp, Homo sapiens
cttgtgtcccatga

SEQ ID NO: 1555910 - DNA, 15 bp, Homo sapiens
cttgtgtctctgtgc

SEQ ID NO: 1555911 - DNA, 17 bp, Homo sapiens
cttgtgtctctgtgctt

SEQ ID NO: 1555912 - DNA, 14 bp, Homo sapiens
cttgtgtgtcaggc

SEQ ID NO: 1555913 - DNA, 15 bp, Homo sapiens
cttgtgtgtcaggcc

SEQ ID NO: 1555914 - DNA, 21 bp, Homo sapiens
cttgtgtgtcaggccctctgc

SEQ ID NO: 1555915 - DNA, 19 bp, Homo sapiens
cttgtgtgtgggctgtgag

SEQ ID NO: 1555916 - DNA, 21 bp, Homo sapiens
cttgtgtgtgggctgtgagtg

SEQ ID NO: 1555917 - DNA, 14 bp, Homo sapiens
cttgtgttctgctc

SEQ ID NO: 1555918 - DNA, 16 bp, Homo sapiens
tccattctcccaggta

SEQ ID NO: 1555919 - DNA, 15 bp, Homo sapiens
tccattgaaagtgct

SEQ ID NO: 1555920 - DNA, 21 bp, Homo sapiens
tccattgaagccgactctggc

SEQ ID NO: 1555921 - DNA, 16 bp, Homo sapiens
tccattgaccagctct

SEQ ID NO: 1555922 - DNA, 17 bp, Homo sapiens
tccattgaccagctctc

SEQ ID NO: 1555923 - DNA, 19 bp, Homo sapiens
tccattggatctgcaagaa

SEQ ID NO: 1555924 - DNA, 15 bp, Homo sapiens
tccattggtccaaga

SEQ ID NO: 1555925 - DNA, 14 bp, Homo sapiens
tccatttagttctt

SEQ ID NO: 1555926 - DNA, 19 bp, Homo sapiens
tccatttatttatgaaaaa

SEQ ID NO: 1555927 - DNA, 19 bp, Homo sapiens
tccatttccattgcttatt

SEQ ID NO: 1555928 - DNA, 12 bp, Homo sapiens
tccatttctcaa

SEQ ID NO: 1555929 - DNA, 20 bp, Homo sapiens
tccatttctcaatcagtgca

SEQ ID NO: 1555930 - DNA, 12 bp, Homo sapiens
tccatttctgtc

SEQ ID NO: 1555931 - DNA, 14 bp, Homo sapiens
tccatttgctcttc

SEQ ID NO: 1555932 - DNA, 14 bp, Homo sapiens
tccatttgttcctg

SEQ ID NO: 1555933 - DNA, 21 bp, Homo sapiens
tccattttaacaactgctctt

SEQ ID NO: 1555934 - DNA, 13 bp, Homo sapiens
tccattttatgca

SEQ ID NO: 1555935 - DNA, 15 bp, Homo sapiens
tccattttatgcaga

SEQ ID NO: 1555936 - DNA, 17 bp, Homo sapiens
tccattttcccccacta

SEQ ID NO: 1555937 - DNA, 14 bp, Homo sapiens
tccattttctaaac

SEQ ID NO: 1555938 - DNA, 19 bp, Homo sapiens
tccattttctaaactgttt

SEQ ID NO: 1555939 - DNA, 14 bp, Homo sapiens
tccatttttcctct

SEQ ID NO: 1555940 - DNA, 15 bp, Homo sapiens
tccatttttcctctg

SEQ ID NO: 1555941 - DNA, 14 bp, Homo sapiens
tcccaaaaaactac

SEQ ID NO: 1555942 - DNA, 16 bp, Homo sapiens
tcccaaaatgtgcctc

SEQ ID NO: 1555943 - DNA, 22 bp, Homo sapiens
tcccaaaattgttttgagcttt

SEQ ID NO: 1555944 - DNA, 22 bp, Homo sapiens
tcccaaacgccctttcctcctc

SEQ ID NO: 1555945 - DNA, 21 bp, Homo sapiens
tcccaaacgcctcccctgccc

SEQ ID NO: 1555946 - DNA, 17 bp, Homo sapiens
tcccaaacttcggaaac

SEQ ID NO: 1555947 - DNA, 13 bp, Homo sapiens
tcccaaagcaagg

SEQ ID NO: 1555948 - DNA, 18 bp, Homo sapiens
tcccaaagcacttttaaa

SEQ ID NO: 1555949 - DNA, 19 bp, Homo sapiens
tcccaaagcacttttaaaa

SEQ ID NO: 1555950 - DNA, 15 bp, Homo sapiens
tcccaaagtgctggg

SEQ ID NO: 1555951 - DNA, 16 bp, Homo sapiens
tcccaacagaggcctc

SEQ ID NO: 1555952 - DNA, 13 bp, Homo sapiens
tcccaaccccagg

SEQ ID NO: 1555953 - DNA, 21 bp, Homo sapiens
tcccaacccccctcctgctcc

SEQ ID NO: 1555954 - DNA, 22 bp, Homo sapiens
tcccaacccccctcctgctcct

SEQ ID NO: 1555955 - DNA, 14 bp, Homo sapiens
tcccaacttgcctt

SEQ ID NO: 1555956 - DNA, 14 bp, Homo sapiens
tcccaagatgttga

SEQ ID NO: 1555957 - DNA, 18 bp, Homo sapiens
tcccaagccgggagccaa

SEQ ID NO: 1555958 - DNA, 13 bp, Homo sapiens
tcccaagcctcct

SEQ ID NO: 1555959 - DNA, 14 bp, Homo sapiens
tcccaagccttcgg

SEQ ID NO: 1555960 - DNA, 22 bp, Homo sapiens
tcccaaggagccattctgtgtg

SEQ ID NO: 1555961 - DNA, 20 bp, Homo sapiens
tcccaagggtgccctttggg

SEQ ID NO: 1555962 - DNA, 16 bp, Homo sapiens
tcccaaggtcctctca

SEQ ID NO: 1555963 - DNA, 17 bp, Homo sapiens
tcatccttttggataag

SEQ ID NO: 1555964 - DNA, 15 bp, Homo sapiens
tcatcgaatgctaaa

SEQ ID NO: 1555965 - DNA, 20 bp, Homo sapiens
tcatcgacttagcctgagtc

SEQ ID NO: 1555966 - DNA, 17 bp, Homo sapiens
tcatcgccagacaactg

SEQ ID NO: 1555967 - DNA, 22 bp, Homo sapiens
tcatcggagtcagccaggagct

SEQ ID NO: 1555968 - DNA, 19 bp, Homo sapiens
tcatctaagtcagtaccca

SEQ ID NO: 1555969 - DNA, 22 bp, Homo sapiens
tcatctaatgtattatgagcca

SEQ ID NO: 1555970 - DNA, 13 bp, Homo sapiens
tcatctataaaga

SEQ ID NO: 1555971 - DNA, 17 bp, Homo sapiens
tcatctatggcagtcca

SEQ ID NO: 1555972 - DNA, 22 bp, Homo sapiens
tcatctatggcagtccagccag

SEQ ID NO: 1555973 - DNA, 15 bp, Homo sapiens
tcatctattcaagca

SEQ ID NO: 1555974 - DNA, 11 bp, Homo sapiens
tcatctatttc

SEQ ID NO: 1555975 - DNA, 14 bp, Homo sapiens
tcatctatttctga

SEQ ID NO: 1555976 - DNA, 16 bp, Homo sapiens
tcatctatttctgaga

SEQ ID NO: 1555977 - DNA, 17 bp, Homo sapiens
tcatctatttctgagaa

SEQ ID NO: 1555978 - DNA, 18 bp, Homo sapiens
tcatctcagctcactgca

SEQ ID NO: 1555979 - DNA, 19 bp, Homo sapiens
tcatctcagctcactgcaa

SEQ ID NO: 1555980 - DNA, 11 bp, Homo sapiens
tcatctcaggg

SEQ ID NO: 1555981 - DNA, 16 bp, Homo sapiens
tcatctcattcaaacc

SEQ ID NO: 1555982 - DNA, 22 bp, Homo sapiens
tcatctccagggagtcccctcc

SEQ ID NO: 1555983 - DNA, 13 bp, Homo sapiens
tcatctcccctcc

SEQ ID NO: 1555984 - DNA, 16 bp, Homo sapiens
tcatctctctacctcc

SEQ ID NO: 1555985 - DNA, 17 bp, Homo sapiens
tcatctctctacctcca

SEQ ID NO: 1555986 - DNA, 18 bp, Homo sapiens
tcatctctctacctccac

SEQ ID NO: 1555987 - DNA, 23 bp, Homo sapiens
tcatctctgttcttttcccgcct

SEQ ID NO: 1555988 - DNA, 20 bp, Homo sapiens
tcatctcttagctcccctcc

SEQ ID NO: 1555989 - DNA, 12 bp, Homo sapiens
tcatctcttcag

SEQ ID NO: 1555990 - DNA, 16 bp, Homo sapiens
tcatctcttcaggttc

SEQ ID NO: 1555991 - DNA, 19 bp, Homo sapiens
tcatctcttcaggttctca

SEQ ID NO: 1555992 - DNA, 11 bp, Homo sapiens
tcatctgagga

SEQ ID NO: 1555993 - DNA, 20 bp, Homo sapiens
tccagtgacaaaccatccag

SEQ ID NO: 1555994 - DNA, 12 bp, Homo sapiens
tccagtgctcag

SEQ ID NO: 1555995 - DNA, 14 bp, Homo sapiens
tccagtgctcagct

SEQ ID NO: 1555996 - DNA, 17 bp, Homo sapiens
tccagtgctcagctgtg

SEQ ID NO: 1555997 - DNA, 13 bp, Homo sapiens
tccagtgctggat

SEQ ID NO: 1555998 - DNA, 22 bp, Homo sapiens
tccagtggaggtttgtcgggca

SEQ ID NO: 1555999 - DNA, 17 bp, Homo sapiens
tccagtggatcataaga

SEQ ID NO: 1556000 - DNA, 22 bp, Homo sapiens
tccagtgggcccggagaaacct

SEQ ID NO: 1556001 - DNA, 18 bp, Homo sapiens
tccagtggtcatgctcag

SEQ ID NO: 1556002 - DNA, 20 bp, Homo sapiens
tccagtggtcatgctcagcc

SEQ ID NO: 1556003 - DNA, 21 bp, Homo sapiens
tccagtggtcatgctcagcct

SEQ ID NO: 1556004 - DNA, 17 bp, Homo sapiens
tccagtggtgggtaatt

SEQ ID NO: 1556005 - DNA, 19 bp, Homo sapiens
tccagtggtgggtaattgt

SEQ ID NO: 1556006 - DNA, 13 bp, Homo sapiens
tccagtggttctg

SEQ ID NO: 1556007 - DNA, 19 bp, Homo sapiens
tccagtgtgggcttgacca

SEQ ID NO: 1556008 - DNA, 15 bp, Homo sapiens
tccagttataagaag

SEQ ID NO: 1556009 - DNA, 17 bp, Homo sapiens
tccagttcctttagaaa

SEQ ID NO: 1556010 - DNA, 12 bp, Homo sapiens
tccagttgcagg

SEQ ID NO: 1556011 - DNA, 18 bp, Homo sapiens
tccagttgggactcagga

SEQ ID NO: 1556012 - DNA, 17 bp, Homo sapiens
tccagtttgcacctgtc

SEQ ID NO: 1556013 - DNA, 19 bp, Homo sapiens
tccagtttgcacctgtccc

SEQ ID NO: 1556014 - DNA, 13 bp, Homo sapiens
tccagttttctct

SEQ ID NO: 1556015 - DNA, 22 bp, Homo sapiens
tccagtttttgtttttgcatga

SEQ ID NO: 1556016 - DNA, 19 bp, Homo sapiens
tccataaactaagagaaac

SEQ ID NO: 1556017 - DNA, 21 bp, Homo sapiens
tccataaactaagagaaactg

SEQ ID NO: 1556018 - DNA, 13 bp, Homo sapiens
tccataaagtaca

SEQ ID NO: 1556019 - DNA, 18 bp, Homo sapiens
tccataaagtacaaatga

SEQ ID NO: 1556020 - DNA, 17 bp, Homo sapiens
tccataagatttgcaaa

SEQ ID NO: 1556021 - DNA, 17 bp, Homo sapiens
tccataatgttctgcta

SEQ ID NO: 1556022 - DNA, 19 bp, Homo sapiens
tccataattatgacagtta

SEQ ID NO: 1556023 - DNA, 22 bp, Homo sapiens
tccatacactttgttgcaagat

SEQ ID NO: 1556024 - DNA, 16 bp, Homo sapiens
tccatacagcctctac

SEQ ID NO: 1556025 - DNA, 21 bp, Homo sapiens
tccatagcgacaccctttctg

SEQ ID NO: 1556026 - DNA, 18 bp, Homo sapiens
tccatagtagtatgatga

SEQ ID NO: 1556027 - DNA, 13 bp, Homo sapiens
tccatatcctggt

SEQ ID NO: 1556028 - DNA, 24 bp, Homo sapiens
tccatatctccttcccctacacct

SEQ ID NO: 1556029 - DNA, 14 bp, Homo sapiens
tccatatttattca

SEQ ID NO: 1556030 - DNA, 16 bp, Homo sapiens
tccatatttgatttct

SEQ ID NO: 1556031 - DNA, 19 bp, Homo sapiens
tccatatttgatttctaat

SEQ ID NO: 1556032 - DNA, 16 bp, Homo sapiens
tccatcactataataa

SEQ ID NO: 1556033 - DNA, 17 bp, Homo sapiens
tccatcagcaccccagt

SEQ ID NO: 1556034 - DNA, 21 bp, Homo sapiens
tccatcagcgggtctcctccc

SEQ ID NO: 1556035 - DNA, 23 bp, Homo sapiens
tccatcagcgggtctcctcccag

SEQ ID NO: 1556036 - DNA, 16 bp, Homo sapiens
tccatcatcactgtaa

SEQ ID NO: 1556037 - DNA, 13 bp, Homo sapiens
tccatccaaggcc

SEQ ID NO: 1556038 - DNA, 13 bp, Homo sapiens
tccatccaccacc

SEQ ID NO: 1556039 - DNA, 13 bp, Homo sapiens
tccatccatcctt

SEQ ID NO: 1556040 - DNA, 17 bp, Homo sapiens
tccatccatccttccaa

SEQ ID NO: 1556041 - DNA, 20 bp, Homo sapiens
tccatcccgaaaatctctcg

SEQ ID NO: 1556042 - DNA, 18 bp, Homo sapiens
tccatccctccattcatc

SEQ ID NO: 1556043 - DNA, 18 bp, Homo sapiens
tccatccttccaacatat

SEQ ID NO: 1556044 - DNA, 22 bp, Homo sapiens
tccatctaaaatactcaccaaa

SEQ ID NO: 1556045 - DNA, 12 bp, Homo sapiens
tccatctctgcc

SEQ ID NO: 1556046 - DNA, 14 bp, Homo sapiens
tccatctctgcctg

SEQ ID NO: 1556047 - DNA, 14 bp, Homo sapiens
tccatctgacaaaa

SEQ ID NO: 1556048 - DNA, 23 bp, Homo sapiens
tccatctgtccacatccccagag

SEQ ID NO: 1556049 - DNA, 17 bp, Homo sapiens
tccatcttaatgttact

SEQ ID NO: 1556050 - DNA, 18 bp, Homo sapiens
tccatcttgagccacagt

SEQ ID NO: 1556051 - DNA, 21 bp, Homo sapiens
tccatcttggtagttctgtgc

SEQ ID NO: 1556052 - DNA, 20 bp, Homo sapiens
tccatcttgtggggccagga

SEQ ID NO: 1556053 - DNA, 21 bp, Homo sapiens
tccatcttgtggggccaggac

SEQ ID NO: 1556054 - DNA, 15 bp, Homo sapiens
tccatctttctacag

SEQ ID NO: 1556055 - DNA, 14 bp, Homo sapiens
tccatgaatgtatc

SEQ ID NO: 1556056 - DNA, 16 bp, Homo sapiens
tccatgaatgtatcag

SEQ ID NO: 1556057 - DNA, 19 bp, Homo sapiens
tccatgactggctgtctgc

SEQ ID NO: 1556058 - DNA, 13 bp, Homo sapiens
tccatgagctgct

SEQ ID NO: 1556059 - DNA, 15 bp, Homo sapiens
tccatgaggtactgg

SEQ ID NO: 1556060 - DNA, 22 bp, Homo sapiens
tccatgagttatcatgaatttt

SEQ ID NO: 1556061 - DNA, 19 bp, Homo sapiens
tccatgcacctcccttccc

SEQ ID NO: 1556062 - DNA, 21 bp, Homo sapiens
tccatgcagactgttagcttt

SEQ ID NO: 1556063 - DNA, 15 bp, Homo sapiens
tccatgccccagctc

SEQ ID NO: 1556064 - DNA, 12 bp, Homo sapiens
tccatgcctgag

SEQ ID NO: 1556065 - DNA, 20 bp, Homo sapiens
tccatgcgtgtttctgactc

SEQ ID NO: 1556066 - DNA, 19 bp, Homo sapiens
tccatgctgcaaaggagaa

SEQ ID NO: 1556067 - DNA, 22 bp, Homo sapiens
tccatgctgtgcgcccagggct

SEQ ID NO: 1556068 - DNA, 20 bp, Homo sapiens
tccatgcttagtcactgcct

SEQ ID NO: 1556069 - DNA, 22 bp, Homo sapiens
tccatgcttagtcactgcctgc

SEQ ID NO: 1556070 - DNA, 23 bp, Homo sapiens
tccatgcttagtcactgcctgca

SEQ ID NO: 1556071 - DNA, 16 bp, Homo sapiens
tccatggaatttctag

SEQ ID NO: 1556072 - DNA, 15 bp, Homo sapiens
tccatggattgattc

SEQ ID NO: 1556073 - DNA, 24 bp, Homo sapiens
tccatggattgattcagtcttctg

SEQ ID NO: 1556074 - DNA, 13 bp, Homo sapiens
tccatggcagcag

SEQ ID NO: 1556075 - DNA, 17 bp, Homo sapiens
tccatggcagcagccag

SEQ ID NO: 1556076 - DNA, 21 bp, Homo sapiens
tccatggcagcagccagggac

SEQ ID NO: 1556077 - DNA, 12 bp, Homo sapiens
tccatggccacc

SEQ ID NO: 1556078 - DNA, 13 bp, Homo sapiens
tccatggccaccc

SEQ ID NO: 1556079 - DNA, 20 bp, Homo sapiens
tccatggctaagaccacaga

SEQ ID NO: 1556080 - DNA, 17 bp, Homo sapiens
tccatgggaaagatggt

SEQ ID NO: 1556081 - DNA, 22 bp, Homo sapiens
tccatgggagccagctgctttt

SEQ ID NO: 1556082 - DNA, 22 bp, Homo sapiens
tccatgggccccaccatttatg

SEQ ID NO: 1556083 - DNA, 20 bp, Homo sapiens
tccatgggctagtgtgagtg

SEQ ID NO: 1556084 - DNA, 15 bp, Homo sapiens
tccatggggggagaa

SEQ ID NO: 1556085 - DNA, 14 bp, Homo sapiens
tccatgtacttgtt

SEQ ID NO: 1556086 - DNA, 23 bp, Homo sapiens
tccatgtattcacacacccctca

SEQ ID NO: 1556087 - DNA, 16 bp, Homo sapiens
tccatgtgaaatttac

SEQ ID NO: 1556088 - DNA, 14 bp, Homo sapiens
tccatgtgcctttc

SEQ ID NO: 1556089 - DNA, 19 bp, Homo sapiens
tccatgtgcctttctttgc

SEQ ID NO: 1556090 - DNA, 21 bp, Homo sapiens
tccatgtgcctttctttgcct

SEQ ID NO: 1556091 - DNA, 22 bp, Homo sapiens
tccatgtgcctttctttgcctc

SEQ ID NO: 1556092 - DNA, 13 bp, Homo sapiens
tccatgtggagaa

SEQ ID NO: 1556093 - DNA, 18 bp, Homo sapiens
tccatgttagtttttact

SEQ ID NO: 1556094 - DNA, 12 bp, Homo sapiens
tccatgttgctg

SEQ ID NO: 1556095 - DNA, 14 bp, Homo sapiens
tccatgttgctgcc

SEQ ID NO: 1556096 - DNA, 17 bp, Homo sapiens
tccatgttgctgccaac

SEQ ID NO: 1556097 - DNA, 21 bp, Homo sapiens
tccatgtttctcacattgctg

SEQ ID NO: 1556098 - DNA, 14 bp, Homo sapiens
tccattaaatggtc

SEQ ID NO: 1556099 - DNA, 20 bp, Homo sapiens
tccattaatacccatgcttt

SEQ ID NO: 1556100 - DNA, 14 bp, Homo sapiens
tccattactgtgat

SEQ ID NO: 1556101 - DNA, 24 bp, Homo sapiens
tccattagaaaattttgtaaaaca

SEQ ID NO: 1556102 - DNA, 23 bp, Homo sapiens
tccattagcgacagtaggatttt

SEQ ID NO: 1556103 - DNA, 15 bp, Homo sapiens
tccattatgattctt

SEQ ID NO: 1556104 - DNA, 15 bp, Homo sapiens
tccattattttgtat

SEQ ID NO: 1556105 - DNA, 20 bp, Homo sapiens
tccattcatccttccatcca

SEQ ID NO: 1556106 - DNA, 23 bp, Homo sapiens
tccattcattaattagttccagt

SEQ ID NO: 1556107 - DNA, 12 bp, Homo sapiens
tccattcctcag

SEQ ID NO: 1556108 - DNA, 14 bp, Homo sapiens
tccattctcccagg

SEQ ID NO: 1556109 - DNA, 16 bp, Homo sapiens
tccagcctggggaccc

SEQ ID NO: 1556110 - DNA, 18 bp, Homo sapiens
tccagcctggggacccca

SEQ ID NO: 1556111 - DNA, 19 bp, Homo sapiens
tccagcctggggaccccac

SEQ ID NO: 1556112 - DNA, 20 bp, Homo sapiens
tccagcctggggaccccact

SEQ ID NO: 1556113 - DNA, 12 bp, Homo sapiens
tccagcctgggt

SEQ ID NO: 1556114 - DNA, 24 bp, Homo sapiens
tccagcctgggtcacagagtgaga

SEQ ID NO: 1556115 - DNA, 22 bp, Homo sapiens
tccagcgagagagtttcaaaag

SEQ ID NO: 1556116 - DNA, 19 bp, Homo sapiens
tccagcgatggtgctgccc

SEQ ID NO: 1556117 - DNA, 14 bp, Homo sapiens
tccagcggccctgt

SEQ ID NO: 1556118 - DNA, 17 bp, Homo sapiens
tccagcgtcactccagt

SEQ ID NO: 1556119 - DNA, 21 bp, Homo sapiens
tccagcgtcactccagtgctc

SEQ ID NO: 1556120 - DNA, 14 bp, Homo sapiens
tccagcgtctctcc

SEQ ID NO: 1556121 - DNA, 21 bp, Homo sapiens
tccagctaaacaccaacccct

SEQ ID NO: 1556122 - DNA, 17 bp, Homo sapiens
tccagctatacaggaag

SEQ ID NO: 1556123 - DNA, 16 bp, Homo sapiens
tccagctccaacctgc

SEQ ID NO: 1556124 - DNA, 22 bp, Homo sapiens
tccagctcccactccctttcca

SEQ ID NO: 1556125 - DNA, 18 bp, Homo sapiens
tccagctcccgctgtggc

SEQ ID NO: 1556126 - DNA, 13 bp, Homo sapiens
tccagctctgccc

SEQ ID NO: 1556127 - DNA, 16 bp, Homo sapiens
tccagctctgcccccg

SEQ ID NO: 1556128 - DNA, 12 bp, Homo sapiens
tccagctctgga

SEQ ID NO: 1556129 - DNA, 13 bp, Homo sapiens
tccagctctggag

SEQ ID NO: 1556130 - DNA, 20 bp, Homo sapiens
tccagctcttggcccctgtg

SEQ ID NO: 1556131 - DNA, 11 bp, Homo sapiens
tccagctgcca

SEQ ID NO: 1556132 - DNA, 13 bp, Homo sapiens
tccagctgcctgg

SEQ ID NO: 1556133 - DNA, 14 bp, Homo sapiens
tccagctgcctggg

SEQ ID NO: 1556134 - DNA, 16 bp, Homo sapiens
tccagctgcctgggcc

SEQ ID NO: 1556135 - DNA, 17 bp, Homo sapiens
tccagctgcctgggccc

SEQ ID NO: 1556136 - DNA, 13 bp, Homo sapiens
tccagctgggcct

SEQ ID NO: 1556137 - DNA, 15 bp, Homo sapiens
tccagctgggcctcc

SEQ ID NO: 1556138 - DNA, 20 bp, Homo sapiens
tccagctgggcctcctgcct

SEQ ID NO: 1556139 - DNA, 23 bp, Homo sapiens
tccagcttcggagggcccctgcg

SEQ ID NO: 1556140 - DNA, 17 bp, Homo sapiens
tccagcttgctcttcag

SEQ ID NO: 1556141 - DNA, 19 bp, Homo sapiens
tccagcttgctcttcagtg

SEQ ID NO: 1556142 - DNA, 16 bp, Homo sapiens
tccagctttctgccat

SEQ ID NO: 1556143 - DNA, 12 bp, Homo sapiens
tccaggaaaaaa

SEQ ID NO: 1556144 - DNA, 23 bp, Homo sapiens
tccaggaaactccacatctgcct

SEQ ID NO: 1556145 - DNA, 22 bp, Homo sapiens
tccaggaaagtggccaagaagc

SEQ ID NO: 1556146 - DNA, 14 bp, Homo sapiens
tccaggaaggcagc

SEQ ID NO: 1556147 - DNA, 15 bp, Homo sapiens
tccaggaaggcagct

SEQ ID NO: 1556148 - DNA, 17 bp, Homo sapiens
tccaggaaggcagctgc

SEQ ID NO: 1556149 - DNA, 18 bp, Homo sapiens
tccaggaaggcagctgct

SEQ ID NO: 1556150 - DNA, 19 bp, Homo sapiens
tccaggaaggcagctgctc

SEQ ID NO: 1556151 - DNA, 21 bp, Homo sapiens
tccaggaaggcagctgctctt

SEQ ID NO: 1556152 - DNA, 22 bp, Homo sapiens
tccaggaatgcctcctccctgg

SEQ ID NO: 1556153 - DNA, 21 bp, Homo sapiens
tccaggaattcctcttttgct

SEQ ID NO: 1556154 - DNA, 23 bp, Homo sapiens
tccaggactatatttgggcctgc

SEQ ID NO: 1556155 - DNA, 20 bp, Homo sapiens
tccaggactgggtctgacct

SEQ ID NO: 1556156 - DNA, 22 bp, Homo sapiens
tccaggactgggtctgacctgg

SEQ ID NO: 1556157 - DNA, 16 bp, Homo sapiens
tccaggagaagtgctc

SEQ ID NO: 1556158 - DNA, 20 bp, Homo sapiens
tccaggagaagtgctccctg

SEQ ID NO: 1556159 - DNA, 17 bp, Homo sapiens
tccaggagagagccagg

SEQ ID NO: 1556160 - DNA, 17 bp, Homo sapiens
tccaggagctaatctga

SEQ ID NO: 1556161 - DNA, 15 bp, Homo sapiens
tccaggatcctgcag

SEQ ID NO: 1556162 - DNA, 17 bp, Homo sapiens
tccaggatttaggcctt

SEQ ID NO: 1556163 - DNA, 16 bp, Homo sapiens
tccaggattttaattt

SEQ ID NO: 1556164 - DNA, 23 bp, Homo sapiens
tccaggattttaatttcaggaaa

SEQ ID NO: 1556165 - DNA, 15 bp, Homo sapiens
tccaggcagctccct

SEQ ID NO: 1556166 - DNA, 12 bp, Homo sapiens
tccaggcaggcc

SEQ ID NO: 1556167 - DNA, 16 bp, Homo sapiens
tccaggcaggccaggc

SEQ ID NO: 1556168 - DNA, 17 bp, Homo sapiens
tccaggccactgtggcc

SEQ ID NO: 1556169 - DNA, 20 bp, Homo sapiens
tccaggccactgtggccaga

SEQ ID NO: 1556170 - DNA, 15 bp, Homo sapiens
tccaggccaggtggg

SEQ ID NO: 1556171 - DNA, 16 bp, Homo sapiens
tccaggccatgatggc

SEQ ID NO: 1556172 - DNA, 11 bp, Homo sapiens
tccaggcccaa

SEQ ID NO: 1556173 - DNA, 18 bp, Homo sapiens
tccaggcccaaggctccc

SEQ ID NO: 1556174 - DNA, 19 bp, Homo sapiens
tccaggccccaccggccag

SEQ ID NO: 1556175 - DNA, 17 bp, Homo sapiens
tccaggcccctgaggac

SEQ ID NO: 1556176 - DNA, 18 bp, Homo sapiens
tccaggcccctgaggact

SEQ ID NO: 1556177 - DNA, 18 bp, Homo sapiens
tccaggccgcgccctttc

SEQ ID NO: 1556178 - DNA, 13 bp, Homo sapiens
tccaggcctgacc

SEQ ID NO: 1556179 - DNA, 15 bp, Homo sapiens
tccaggcctgcctcc

SEQ ID NO: 1556180 - DNA, 15 bp, Homo sapiens
tccaggctcttcctg

SEQ ID NO: 1556181 - DNA, 14 bp, Homo sapiens
tccaggctgagcca

SEQ ID NO: 1556182 - DNA, 21 bp, Homo sapiens
tccaggctgagccatgaggag

SEQ ID NO: 1556183 - DNA, 15 bp, Homo sapiens
tccaggctgggcagc

SEQ ID NO: 1556184 - DNA, 17 bp, Homo sapiens
tccaggcttggatgtaa

SEQ ID NO: 1556185 - DNA, 18 bp, Homo sapiens
tccaggctttcccacttc

SEQ ID NO: 1556186 - DNA, 12 bp, Homo sapiens
tccagggaagct

SEQ ID NO: 1556187 - DNA, 14 bp, Homo sapiens
tccagggaagctgg

SEQ ID NO: 1556188 - DNA, 19 bp, Homo sapiens
tccagggacagaggcccca

SEQ ID NO: 1556189 - DNA, 15 bp, Homo sapiens
tccagggaggcgatg

SEQ ID NO: 1556190 - DNA, 16 bp, Homo sapiens
tccagggcagcagccg

SEQ ID NO: 1556191 - DNA, 14 bp, Homo sapiens
tccagggcagcctc

SEQ ID NO: 1556192 - DNA, 18 bp, Homo sapiens
tccagggcattgctcagc

SEQ ID NO: 1556193 - DNA, 22 bp, Homo sapiens
tccagggcattgctcagcccgc

SEQ ID NO: 1556194 - DNA, 23 bp, Homo sapiens
tccagggccacgtgccaggcccg

SEQ ID NO: 1556195 - DNA, 14 bp, Homo sapiens
tccagggccagatg

SEQ ID NO: 1556196 - DNA, 16 bp, Homo sapiens
tccagggccctgagct

SEQ ID NO: 1556197 - DNA, 17 bp, Homo sapiens
tccagggccctgagctc

SEQ ID NO: 1556198 - DNA, 14 bp, Homo sapiens
tccagggcctgaca

SEQ ID NO: 1556199 - DNA, 16 bp, Homo sapiens
tccagggcctgacacc

SEQ ID NO: 1556200 - DNA, 22 bp, Homo sapiens
tccagggcctgacaccccctcc

SEQ ID NO: 1556201 - DNA, 17 bp, Homo sapiens
tccagggctggactgag

SEQ ID NO: 1556202 - DNA, 14 bp, Homo sapiens
tccaggggaacctg

SEQ ID NO: 1556203 - DNA, 18 bp, Homo sapiens
tccaggggagatggggag

SEQ ID NO: 1556204 - DNA, 22 bp, Homo sapiens
tccaggggctgcttcctcctgg

SEQ ID NO: 1556205 - DNA, 23 bp, Homo sapiens
tccaggggctgcttcctcctgga

SEQ ID NO: 1556206 - DNA, 17 bp, Homo sapiens
tccagggtccctctgtg

SEQ ID NO: 1556207 - DNA, 15 bp, Homo sapiens
tccagggtcctctag

SEQ ID NO: 1556208 - DNA, 13 bp, Homo sapiens
tccagggtcttgg

SEQ ID NO: 1556209 - DNA, 16 bp, Homo sapiens
tccagggtcttgggct

SEQ ID NO: 1556210 - DNA, 15 bp, Homo sapiens
tccaggtaaatggta

SEQ ID NO: 1556211 - DNA, 19 bp, Homo sapiens
tccaggtcggagtgcctgg

SEQ ID NO: 1556212 - DNA, 22 bp, Homo sapiens
tccaggtcggagtgcctggagt

SEQ ID NO: 1556213 - DNA, 16 bp, Homo sapiens
tccaggtctcactgct

SEQ ID NO: 1556214 - DNA, 16 bp, Homo sapiens
tccaggtcttgactca

SEQ ID NO: 1556215 - DNA, 21 bp, Homo sapiens
tccaggtggcgtgagaggcaa

SEQ ID NO: 1556216 - DNA, 18 bp, Homo sapiens
tccaggttccatccacca

SEQ ID NO: 1556217 - DNA, 19 bp, Homo sapiens
tccagtaacttttttgtgt

SEQ ID NO: 1556218 - DNA, 15 bp, Homo sapiens
tccagtaccttgctt

SEQ ID NO: 1556219 - DNA, 16 bp, Homo sapiens
tccagtaggatccagt

SEQ ID NO: 1556220 - DNA, 20 bp, Homo sapiens
tccagtcaaatctgggctca

SEQ ID NO: 1556221 - DNA, 18 bp, Homo sapiens
tccagtcatctgtaagag

SEQ ID NO: 1556222 - DNA, 14 bp, Homo sapiens
tccagtctggaaaa

SEQ ID NO: 1556223 - DNA, 21 bp, Homo sapiens
tccagtctggaaaacagaaac

SEQ ID NO: 1556224 - DNA, 20 bp, Homo sapiens
tccagtctgggtaacaggga

SEQ ID NO: 1556225 - DNA, 18 bp, Homo sapiens
tccagtgaacattcccag

SEQ ID NO: 1556226 - DNA, 12 bp, Homo sapiens
tcagcctgcaca

SEQ ID NO: 1556227 - DNA, 12 bp, Homo sapiens
tcagcctggcca

SEQ ID NO: 1556228 - DNA, 16 bp, Homo sapiens
tcagcctggccagaca

SEQ ID NO: 1556229 - DNA, 20 bp, Homo sapiens
tcagcctggccagacacagg

SEQ ID NO: 1556230 - DNA, 18 bp, Homo sapiens
tcagcctggtgggcctcc

SEQ ID NO: 1556231 - DNA, 19 bp, Homo sapiens
tcagcctggtgggcctcct

SEQ ID NO: 1556232 - DNA, 17 bp, Homo sapiens
tcagcctgtgctgcccg

SEQ ID NO: 1556233 - DNA, 17 bp, Homo sapiens
tcagccttctcctccca

SEQ ID NO: 1556234 - DNA, 15 bp, Homo sapiens
tcagccttgaaaaac

SEQ ID NO: 1556235 - DNA, 14 bp, Homo sapiens
tcagccttgccaga

SEQ ID NO: 1556236 - DNA, 15 bp, Homo sapiens
tcagccttgccagag

SEQ ID NO: 1556237 - DNA, 17 bp, Homo sapiens
tcagccttgccagagat

SEQ ID NO: 1556238 - DNA, 22 bp, Homo sapiens
tcagccttggataatgctgttg

SEQ ID NO: 1556239 - DNA, 19 bp, Homo sapiens
tcagcgactccgttggcca

SEQ ID NO: 1556240 - DNA, 18 bp, Homo sapiens
tcagtctcacagagaagc

SEQ ID NO: 1556241 - DNA, 19 bp, Homo sapiens
tcagtctcacagagaagct

SEQ ID NO: 1556242 - DNA, 21 bp, Homo sapiens
tcagtctctataccaataaag

SEQ ID NO: 1556243 - DNA, 22 bp, Homo sapiens
tcagtctctataccaataaagt

SEQ ID NO: 1556244 - DNA, 20 bp, Homo sapiens
tcagtctctcttctctccag

SEQ ID NO: 1556245 - DNA, 14 bp, Homo sapiens
tcagtctttgctca

SEQ ID NO: 1556246 - DNA, 15 bp, Homo sapiens
tcagtctttgctcag

SEQ ID NO: 1556247 - DNA, 18 bp, Homo sapiens
tcagtctttgctcagtgt

SEQ ID NO: 1556248 - DNA, 16 bp, Homo sapiens
tcagtgaatatttttg

SEQ ID NO: 1556249 - DNA, 18 bp, Homo sapiens
tcagtgactcctgctggt

SEQ ID NO: 1556250 - DNA, 22 bp, Homo sapiens
tcagtgactcctgctggtacct

SEQ ID NO: 1556251 - DNA, 12 bp, Homo sapiens
tcagtgactgaa

SEQ ID NO: 1556252 - DNA, 19 bp, Homo sapiens
tcagtgactgaaaccattt

SEQ ID NO: 1556253 - DNA, 24 bp, Homo sapiens
tcagtgaggagggatgtgggtaag

SEQ ID NO: 1556254 - DNA, 14 bp, Homo sapiens
tcagtgatctatgt

SEQ ID NO: 1556255 - DNA, 16 bp, Homo sapiens
tcagtgatctatgttt

SEQ ID NO: 1556256 - DNA, 17 bp, Homo sapiens
tcagtgatctatgtttg

SEQ ID NO: 1556257 - DNA, 23 bp, Homo sapiens
tcagtgatgccctcagagctctt

SEQ ID NO: 1556258 - DNA, 19 bp, Homo sapiens
tcagtgatgtaccatgaaa

SEQ ID NO: 1556259 - DNA, 14 bp, Homo sapiens
tcagtgcagtttct

SEQ ID NO: 1556260 - DNA, 14 bp, Homo sapiens
tcagtgcatttgtg

SEQ ID NO: 1556261 - DNA, 16 bp, Homo sapiens
tcagtgcatttgtgct

SEQ ID NO: 1556262 - DNA, 21 bp, Homo sapiens
tcagtgccacttgacattcct

SEQ ID NO: 1556263 - DNA, 22 bp, Homo sapiens
tcagtgccacttgacattcctt

SEQ ID NO: 1556264 - DNA, 20 bp, Homo sapiens
tcataccgcctcgtgccagc

SEQ ID NO: 1556265 - DNA, 13 bp, Homo sapiens
tcatactctgtgt

SEQ ID NO: 1556266 - DNA, 16 bp, Homo sapiens
tcatactctgtgtaat

SEQ ID NO: 1556267 - DNA, 13 bp, Homo sapiens
tcatactcttcta

SEQ ID NO: 1556268 - DNA, 15 bp, Homo sapiens
tcatagaaattgtgt

SEQ ID NO: 1556269 - DNA, 14 bp, Homo sapiens
tcatagaattttga

SEQ ID NO: 1556270 - DNA, 17 bp, Homo sapiens
tcatagaggtgagaaaa

SEQ ID NO: 1556271 - DNA, 20 bp, Homo sapiens
tcatagaggtgagaaaactc

SEQ ID NO: 1556272 - DNA, 19 bp, Homo sapiens
tcatagattattataaact

SEQ ID NO: 1556273 - DNA, 20 bp, Homo sapiens
tcatagattattataaacta

SEQ ID NO: 1556274 - DNA, 21 bp, Homo sapiens
tcatagattattataaactat

SEQ ID NO: 1556275 - DNA, 22 bp, Homo sapiens
tcatagattattataaactata

SEQ ID NO: 1556276 - DNA, 20 bp, Homo sapiens
tcatagcaagcttttgctca

SEQ ID NO: 1556277 - DNA, 16 bp, Homo sapiens
tcatagccaaagccag

SEQ ID NO: 1556278 - DNA, 17 bp, Homo sapiens
tcatagccaaagccagg

SEQ ID NO: 1556279 - DNA, 14 bp, Homo sapiens
tcatagcccagtag

SEQ ID NO: 1556280 - DNA, 17 bp, Homo sapiens
tcatagctgagattcct

SEQ ID NO: 1556281 - DNA, 15 bp, Homo sapiens
tcatagcttcacaat

SEQ ID NO: 1556282 - DNA, 20 bp, Homo sapiens
tcataggaaaagtacattta

SEQ ID NO: 1556283 - DNA, 21 bp, Homo sapiens
tcataggaattggtaaggcct

SEQ ID NO: 1556284 - DNA, 16 bp, Homo sapiens
tcataggacctgcatc

SEQ ID NO: 1556285 - DNA, 13 bp, Homo sapiens
tcataggagactg

SEQ ID NO: 1556286 - DNA, 19 bp, Homo sapiens
tcatagggaagacctgctg

SEQ ID NO: 1556287 - DNA, 18 bp, Homo sapiens
tcataggtcactggctct

SEQ ID NO: 1556288 - DNA, 21 bp, Homo sapiens
tcataggttaaaaaaaaaagt

SEQ ID NO: 1556289 - DNA, 23 bp, Homo sapiens
tcataggttaaaaaaaaaagtca

SEQ ID NO: 1556290 - DNA, 17 bp, Homo sapiens
tcataggttactaccta

SEQ ID NO: 1556291 - DNA, 16 bp, Homo sapiens
tcactgcagcctcagc

SEQ ID NO: 1556292 - DNA, 21 bp, Homo sapiens
tcactgcatggcttctgaaag

SEQ ID NO: 1556293 - DNA, 19 bp, Homo sapiens
tcactgccacactctccat

SEQ ID NO: 1556294 - DNA, 15 bp, Homo sapiens
tcactgccaggccag

SEQ ID NO: 1556295 - DNA, 18 bp, Homo sapiens
tcactgccaggccagcct

SEQ ID NO: 1556296 - DNA, 13 bp, Homo sapiens
tcactgccatgat

SEQ ID NO: 1556297 - DNA, 23 bp, Homo sapiens
tcactgcctaggaggctggccaa

SEQ ID NO: 1556298 - DNA, 12 bp, Homo sapiens
tcactgcctctc

SEQ ID NO: 1556299 - DNA, 14 bp, Homo sapiens
tcactgcctgcaga

SEQ ID NO: 1556300 - DNA, 19 bp, Homo sapiens
tcactgctgagtttctgtt

SEQ ID NO: 1556301 - DNA, 14 bp, Homo sapiens
tcactgctgcaagg

SEQ ID NO: 1556302 - DNA, 18 bp, Homo sapiens
tcactgctggctgcctta

SEQ ID NO: 1556303 - DNA, 18 bp, Homo sapiens
tcactgctggggagtccc

SEQ ID NO: 1556304 - DNA, 13 bp, Homo sapiens
tcactgcttgagg

SEQ ID NO: 1556305 - DNA, 18 bp, Homo sapiens
tcactgctttgcaccgtg

SEQ ID NO: 1556306 - DNA, 18 bp, Homo sapiens
tcactggaaaggggagag

SEQ ID NO: 1556307 - DNA, 23 bp, Homo sapiens
tcactggaaaggggagagcctgc

SEQ ID NO: 1556308 - DNA, 22 bp, Homo sapiens
tcactggaagatttatgaacag

SEQ ID NO: 1556309 - DNA, 18 bp, Homo sapiens
tcactggaccactgggca

SEQ ID NO: 1556310 - DNA, 13 bp, Homo sapiens
tcactggactgca

SEQ ID NO: 1556311 - DNA, 18 bp, Homo sapiens
tcactggagcaccaggca

SEQ ID NO: 1556312 - DNA, 22 bp, Homo sapiens
tcactggagcaccaggcacgaa

SEQ ID NO: 1556313 - DNA, 14 bp, Homo sapiens
tcactggagcccag

SEQ ID NO: 1556314 - DNA, 21 bp, Homo sapiens
tcactggaggagcagcttcct

SEQ ID NO: 1556315 - DNA, 14 bp, Homo sapiens
tcactggatgaaga

SEQ ID NO: 1556316 - DNA, 19 bp, Homo sapiens
tcactggatgaagattctc

SEQ ID NO: 1556317 - DNA, 14 bp, Homo sapiens
tcactggcagcctg

SEQ ID NO: 1556318 - DNA, 19 bp, Homo sapiens
tcactggcgccttctcgga

SEQ ID NO: 1556319 - DNA, 19 bp, Homo sapiens
tcactggctggcctgagca

SEQ ID NO: 1556320 - DNA, 19 bp, Homo sapiens
tcactggctggggcagagg

SEQ ID NO: 1556321 - DNA, 19 bp, Homo sapiens
tcactgggaagaagcaagg

SEQ ID NO: 1556322 - DNA, 22 bp, Homo sapiens
tcactgggaagaagcaagggca

SEQ ID NO: 1556323 - DNA, 19 bp, Homo sapiens
tcactggggtcctggggcc

SEQ ID NO: 1556324 - DNA, 20 bp, Homo sapiens
tcactgggtggggtgaggac

SEQ ID NO: 1556325 - DNA, 18 bp, Homo sapiens
tcactggtagaccaaaat

SEQ ID NO: 1556326 - DNA, 19 bp, Homo sapiens
tcactggtagaccaaaata

SEQ ID NO: 1556327 - DNA, 19 bp, Homo sapiens
tcactggtccaggtcttca

SEQ ID NO: 1556328 - DNA, 23 bp, Homo sapiens
tcactggtggatctaagaagggc

SEQ ID NO: 1556329 - DNA, 23 bp, Homo sapiens
tcactgtaaagacaaataaatga

SEQ ID NO: 1556330 - DNA, 12 bp, Homo sapiens
tcactgtactgc

SEQ ID NO: 1556331 - DNA, 16 bp, Homo sapiens
tcactgtactgcatgt

SEQ ID NO: 1556332 - DNA, 17 bp, Homo sapiens
tcactgtactgcatgtg

SEQ ID NO: 1556333 - DNA, 21 bp, Homo sapiens
tcactgtagaatgatttcatg

SEQ ID NO: 1556334 - DNA, 14 bp, Homo sapiens
tcactgtatataaa

SEQ ID NO: 1556335 - DNA, 18 bp, Homo sapiens
tcactgtatataaacata

SEQ ID NO: 1556336 - DNA, 18 bp, Homo sapiens
tcactgtatcattttctt

SEQ ID NO: 1556337 - DNA, 20 bp, Homo sapiens
tcactgtattagagcgccag

SEQ ID NO: 1556338 - DNA, 17 bp, Homo sapiens
tcactgtcgcccaggct

SEQ ID NO: 1556339 - DNA, 20 bp, Homo sapiens
tcactgtcgcccaggctgga

SEQ ID NO: 1556340 - DNA, 21 bp, Homo sapiens
tcactgtcttttgattcttga

SEQ ID NO: 1556341 - DNA, 17 bp, Homo sapiens
tcactgtggccacagcc

SEQ ID NO: 1556342 - DNA, 20 bp, Homo sapiens
tcactgtggccacagccccc

SEQ ID NO: 1556343 - DNA, 19 bp, Homo sapiens
tcactgtgtcacccagact

SEQ ID NO: 1556344 - DNA, 14 bp, Homo sapiens
tcactgtgttactg

SEQ ID NO: 1556345 - DNA, 17 bp, Homo sapiens
tcactgttccctctggc

SEQ ID NO: 1556346 - DNA, 18 bp, Homo sapiens
tcactgttccctctggct

SEQ ID NO: 1556347 - DNA, 20 bp, Homo sapiens
tcactgttcgtcactcaaat

SEQ ID NO: 1556348 - DNA, 16 bp, Homo sapiens
tcactgtttgttttta

SEQ ID NO: 1556349 - DNA, 22 bp, Homo sapiens
tcacttaactataaggtgcctc

SEQ ID NO: 1556350 - DNA, 23 bp, Homo sapiens
tcacttaactataaggtgcctca

SEQ ID NO: 1556351 - DNA, 20 bp, Homo sapiens
tcacttacccattagccagg

SEQ ID NO: 1556352 - DNA, 16 bp, Homo sapiens
tcacttacctgaaaag

SEQ ID NO: 1556353 - DNA, 18 bp, Homo sapiens
tcacttacgtttgtcctt

SEQ ID NO: 1556354 - DNA, 22 bp, Homo sapiens
tcacttactatccatttcttca

SEQ ID NO: 1556355 - DNA, 12 bp, Homo sapiens
tcacttagtcct

SEQ ID NO: 1556356 - DNA, 15 bp, Homo sapiens
tcacttcaaagctaa

SEQ ID NO: 1556357 - DNA, 16 bp, Homo sapiens
tcacttcataatccag

SEQ ID NO: 1556358 - DNA, 13 bp, Homo sapiens
tcacttctccccg

SEQ ID NO: 1556359 - DNA, 12 bp, Homo sapiens
tcacttcttcct

SEQ ID NO: 1556360 - DNA, 23 bp, Homo sapiens
tcacttgaaagattttattgtat

SEQ ID NO: 1556361 - DNA, 14 bp, Homo sapiens
tcacttgatgatac

SEQ ID NO: 1556362 - DNA, 20 bp, Homo sapiens
tcacttgatgatacaatgaa

SEQ ID NO: 1556363 - DNA, 18 bp, Homo sapiens
tcacttggctgtctgacc

SEQ ID NO: 1556364 - DNA, 12 bp, Homo sapiens
tcacttgtattg

SEQ ID NO: 1556365 - DNA, 17 bp, Homo sapiens
tcacttgtattgacttt

SEQ ID NO: 1556366 - DNA, 18 bp, Homo sapiens
tcacttgtattgacttta

SEQ ID NO: 1556367 - DNA, 17 bp, Homo sapiens
tcacttgtgcagtgttg

SEQ ID NO: 1556368 - DNA, 15 bp, Homo sapiens
tcacttgttgtttta

SEQ ID NO: 1556369 - DNA, 13 bp, Homo sapiens
tcactttaaacct

SEQ ID NO: 1556370 - DNA, 15 bp, Homo sapiens
tcactttagatgctg

SEQ ID NO: 1556371 - DNA, 19 bp, Homo sapiens
tcactttcacatagatgtc

SEQ ID NO: 1556372 - DNA, 14 bp, Homo sapiens
tcactttgaaaagt

SEQ ID NO: 1556373 - DNA, 21 bp, Homo sapiens
tcactttgaaaagttggaagg

SEQ ID NO: 1556374 - DNA, 22 bp, Homo sapiens
tcacttttcatccttccccaac

SEQ ID NO: 1556375 - DNA, 18 bp, Homo sapiens
tcacttttcctccctcag

SEQ ID NO: 1556376 - DNA, 13 bp, Homo sapiens
tcactttttctga

SEQ ID NO: 1556377 - DNA, 19 bp, Homo sapiens
tcactttttttctttttct

SEQ ID NO: 1556378 - DNA, 23 bp, Homo sapiens
tcagaaaacaacttggcatttct

SEQ ID NO: 1556379 - DNA, 23 bp, Homo sapiens
tcagaaaataaaatattcactct

SEQ ID NO: 1556380 - DNA, 17 bp, Homo sapiens
tcagaaaatattatgtg

SEQ ID NO: 1556381 - DNA, 20 bp, Homo sapiens
tcagaaaatattatgtgttt

SEQ ID NO: 1556382 - DNA, 22 bp, Homo sapiens
tcagaaacatcagttactctga

SEQ ID NO: 1556383 - DNA, 20 bp, Homo sapiens
tcagaaaccctcattgtgtt

SEQ ID NO: 1556384 - DNA, 15 bp, Homo sapiens
tcagaaacttgtgaa

SEQ ID NO: 1556385 - DNA, 16 bp, Homo sapiens
tcagaaacttgtgaag

SEQ ID NO: 1556386 - DNA, 14 bp, Homo sapiens
tcagaaagagcaag

SEQ ID NO: 1556387 - DNA, 23 bp, Homo sapiens
tcagaaagagcaagtctggatct

SEQ ID NO: 1556388 - DNA, 17 bp, Homo sapiens
tcagaaagcctttcatt

SEQ ID NO: 1556389 - DNA, 12 bp, Homo sapiens
tcagaaaggaat

SEQ ID NO: 1556390 - DNA, 15 bp, Homo sapiens
tcagaaaggatttta

SEQ ID NO: 1556391 - DNA, 18 bp, Homo sapiens
tcagaaagtaacaatcta

SEQ ID NO: 1556392 - DNA, 12 bp, Homo sapiens
tcagaaagtgta

SEQ ID NO: 1556393 - DNA, 22 bp, Homo sapiens
tcagaaataataaaaaatttca

SEQ ID NO: 1556394 - DNA, 17 bp, Homo sapiens
tcagaaatacagataaa

SEQ ID NO: 1556395 - DNA, 20 bp, Homo sapiens
tcagaaatataacacatttt

SEQ ID NO: 1556396 - DNA, 15 bp, Homo sapiens
tcagaaatgctgcct

SEQ ID NO: 1556397 - DNA, 21 bp, Homo sapiens
tcagaacacacagactttctg

SEQ ID NO: 1556398 - DNA, 15 bp, Homo sapiens
tcagaacaccccgct

SEQ ID NO: 1556399 - DNA, 21 bp, Homo sapiens
tcagaacattcagctctggag

SEQ ID NO: 1556400 - DNA, 20 bp, Homo sapiens
tcagaaccagagggcatgct

SEQ ID NO: 1556401 - DNA, 21 bp, Homo sapiens
tcagaaccagagggcatgctg

SEQ ID NO: 1556402 - DNA, 23 bp, Homo sapiens
tcagaaccagagggcatgctgaa

SEQ ID NO: 1556403 - DNA, 15 bp, Homo sapiens
tcagaacctcttccc

SEQ ID NO: 1556404 - DNA, 18 bp, Homo sapiens
tcagaacctcttccccag

SEQ ID NO: 1556405 - DNA, 14 bp, Homo sapiens
tcagaactcctgtg

SEQ ID NO: 1556406 - DNA, 15 bp, Homo sapiens
tcagaactgtgccac

SEQ ID NO: 1556407 - DNA, 15 bp, Homo sapiens
tcagaactgttggct

SEQ ID NO: 1556408 - DNA, 16 bp, Homo sapiens
tcagaacttgctgctg

SEQ ID NO: 1556409 - DNA, 23 bp, Homo sapiens
tcagaagaaaggccaaggtgctg

SEQ ID NO: 1556410 - DNA, 13 bp, Homo sapiens
tcagaagacttga

SEQ ID NO: 1556411 - DNA, 12 bp, Homo sapiens
tcagaagataac

SEQ ID NO: 1556412 - DNA, 19 bp, Homo sapiens
tcacagttcctcgccctgg

SEQ ID NO: 1556413 - DNA, 19 bp, Homo sapiens
tcacagttctttgggccag

SEQ ID NO: 1556414 - DNA, 20 bp, Homo sapiens
tcacagttctttgggccaga

SEQ ID NO: 1556415 - DNA, 17 bp, Homo sapiens
tcacatagagtgatctt

SEQ ID NO: 1556416 - DNA, 20 bp, Homo sapiens
tcacataggaagggatctga

SEQ ID NO: 1556417 - DNA, 21 bp, Homo sapiens
tcacataggaagggatctgag

SEQ ID NO: 1556418 - DNA, 22 bp, Homo sapiens
tcacataggaagggatctgaga

SEQ ID NO: 1556419 - DNA, 16 bp, Homo sapiens
tcacatataacatgca

SEQ ID NO: 1556420 - DNA, 17 bp, Homo sapiens
tcacatatctagtatga

SEQ ID NO: 1556421 - DNA, 22 bp, Homo sapiens
tcacatattttaaaatttgttc

SEQ ID NO: 1556422 - DNA, 13 bp, Homo sapiens
tcacatccatccc

SEQ ID NO: 1556423 - DNA, 16 bp, Homo sapiens
tcacatcccctgtcta

SEQ ID NO: 1556424 - DNA, 19 bp, Homo sapiens
tcacatgagtcaaaacaaa

SEQ ID NO: 1556425 - DNA, 13 bp, Homo sapiens
tcacatgccttgc

SEQ ID NO: 1556426 - DNA, 23 bp, Homo sapiens
tcacatgtatggacgtgtgtgaa

SEQ ID NO: 1556427 - DNA, 19 bp, Homo sapiens
tcacattaatatttgctga

SEQ ID NO: 1556428 - DNA, 15 bp, Homo sapiens
tcacattagaattag

SEQ ID NO: 1556429 - DNA, 19 bp, Homo sapiens
tcacattagataaattact

SEQ ID NO: 1556430 - DNA, 15 bp, Homo sapiens
tcacattatttgcat

SEQ ID NO: 1556431 - DNA, 16 bp, Homo sapiens
tcacattatttgcatg

SEQ ID NO: 1556432 - DNA, 17 bp, Homo sapiens
tcacattccacatctgt

SEQ ID NO: 1556433 - DNA, 18 bp, Homo sapiens
tcacattccacatctgtt

SEQ ID NO: 1556434 - DNA, 21 bp, Homo sapiens
tcacattgctgtattttagaa

SEQ ID NO: 1556435 - DNA, 20 bp, Homo sapiens
tcacattggagtcactgcca

SEQ ID NO: 1556436 - DNA, 13 bp, Homo sapiens
tcacatttaaatg

SEQ ID NO: 1556437 - DNA, 19 bp, Homo sapiens
tcacatttccagggcagca

SEQ ID NO: 1556438 - DNA, 15 bp, Homo sapiens
tcacatttgatgtac

SEQ ID NO: 1556439 - DNA, 13 bp, Homo sapiens
tcacattttgtat

SEQ ID NO: 1556440 - DNA, 20 bp, Homo sapiens
tcacatttttaaaagaacaa

SEQ ID NO: 1556441 - DNA, 20 bp, Homo sapiens
tcacatttttatacctgttt

SEQ ID NO: 1556442 - DNA, 15 bp, Homo sapiens
tcacatttttttatg

SEQ ID NO: 1556443 - DNA, 21 bp, Homo sapiens
tcaccaaatcagctgctacta

SEQ ID NO: 1556444 - DNA, 16 bp, Homo sapiens
tcaccaacttgccaca

SEQ ID NO: 1556445 - DNA, 19 bp, Homo sapiens
tcaccaacttgccacatgt

SEQ ID NO: 1556446 - DNA, 12 bp, Homo sapiens
tcaccaagctca

SEQ ID NO: 1556447 - DNA, 21 bp, Homo sapiens
tcaccaagctcacagttcctc

SEQ ID NO: 1556448 - DNA, 12 bp, Homo sapiens
tcaccaaggaaa

SEQ ID NO: 1556449 - DNA, 15 bp, Homo sapiens
tcaccaatgagcctt

SEQ ID NO: 1556450 - DNA, 18 bp, Homo sapiens
tcaccaccccctgtccca

SEQ ID NO: 1556451 - DNA, 21 bp, Homo sapiens
tcaccaccccctgtcccattc

SEQ ID NO: 1556452 - DNA, 14 bp, Homo sapiens
tcaccaccttccca

SEQ ID NO: 1556453 - DNA, 21 bp, Homo sapiens
tcaccacgtggggctcacttt

SEQ ID NO: 1556454 - DNA, 11 bp, Homo sapiens
tcaccagagct

SEQ ID NO: 1556455 - DNA, 21 bp, Homo sapiens
tcaccagagcttctctgggct

SEQ ID NO: 1556456 - DNA, 23 bp, Homo sapiens
tcaccagagcttctctgggctga

SEQ ID NO: 1556457 - DNA, 15 bp, Homo sapiens
tcaccagccccactg

SEQ ID NO: 1556458 - DNA, 19 bp, Homo sapiens
tcaccagcccggcctgctc

SEQ ID NO: 1556459 - DNA, 16 bp, Homo sapiens
tcaccagccctggcaa

SEQ ID NO: 1556460 - DNA, 15 bp, Homo sapiens
tcaccagctgctgtg

SEQ ID NO: 1556461 - DNA, 20 bp, Homo sapiens
tcaccagctgctgtgcccca

SEQ ID NO: 1556462 - DNA, 13 bp, Homo sapiens
tcaccaggcctgg

SEQ ID NO: 1556463 - DNA, 16 bp, Homo sapiens
tcaccaggcctggcct

SEQ ID NO: 1556464 - DNA, 19 bp, Homo sapiens
tcaccaggggaggagcctg

SEQ ID NO: 1556465 - DNA, 22 bp, Homo sapiens
tcaccagggtccgcaccagctg

SEQ ID NO: 1556466 - DNA, 15 bp, Homo sapiens
tcaccatacccagct

SEQ ID NO: 1556467 - DNA, 15 bp, Homo sapiens
tcaccatccagtggg

SEQ ID NO: 1556468 - DNA, 16 bp, Homo sapiens
tcacccaagccacaag

SEQ ID NO: 1556469 - DNA, 17 bp, Homo sapiens
tcacccaccctgtggct

SEQ ID NO: 1556470 - DNA, 14 bp, Homo sapiens
tcacccagactgga

SEQ ID NO: 1556471 - DNA, 17 bp, Homo sapiens
tcacccagctaatctgt

SEQ ID NO: 1556472 - DNA, 18 bp, Homo sapiens
tcacccagtccccacccg

SEQ ID NO: 1556473 - DNA, 19 bp, Homo sapiens
tcacccagtccccacccgc

SEQ ID NO: 1556474 - DNA, 20 bp, Homo sapiens
tcacccatgcaagcagagga

SEQ ID NO: 1556475 - DNA, 21 bp, Homo sapiens
tcacccatgcaagcagaggac

SEQ ID NO: 1556476 - DNA, 12 bp, Homo sapiens
tcaccccaccct

SEQ ID NO: 1556477 - DNA, 22 bp, Homo sapiens
tcacccccaacttcaccacccc

SEQ ID NO: 1556478 - DNA, 18 bp, Homo sapiens
tcacccccctctgctgcc

SEQ ID NO: 1556479 - DNA, 17 bp, Homo sapiens
tcacccctccctttctc

SEQ ID NO: 1556480 - DNA, 15 bp, Homo sapiens
tcacccctggttctc

SEQ ID NO: 1556481 - DNA, 18 bp, Homo sapiens
tcacccctggttctcatc

SEQ ID NO: 1556482 - DNA, 22 bp, Homo sapiens
tcacccctggttctcatctttc

SEQ ID NO: 1556483 - DNA, 15 bp, Homo sapiens
tcaccctacctgtgc

SEQ ID NO: 1556484 - DNA, 17 bp, Homo sapiens
tcaccctacctgtgcct

SEQ ID NO: 1556485 - DNA, 20 bp, Homo sapiens
tcaccctcataccatctgct

SEQ ID NO: 1556486 - DNA, 15 bp, Homo sapiens
tcaccctccacttcc

SEQ ID NO: 1556487 - DNA, 23 bp, Homo sapiens
tcaccctgatttaggagaagcca

SEQ ID NO: 1556488 - DNA, 17 bp, Homo sapiens
tcaccctgcaggacttg

SEQ ID NO: 1556489 - DNA, 20 bp, Homo sapiens
tcaccctgcccgctcccaac

SEQ ID NO: 1556490 - DNA, 21 bp, Homo sapiens
tcaccctgggagtttcctgag

SEQ ID NO: 1556491 - DNA, 13 bp, Homo sapiens
tcaccctgtcaag

SEQ ID NO: 1556492 - DNA, 13 bp, Homo sapiens
tcaccctgtgaaa

SEQ ID NO: 1556493 - DNA, 21 bp, Homo sapiens
tcacccttaaaattctcctgt

SEQ ID NO: 1556494 - DNA, 13 bp, Homo sapiens
tcacccttgtcct

SEQ ID NO: 1556495 - DNA, 20 bp, Homo sapiens
tcaccgagagtagccgagag

SEQ ID NO: 1556496 - DNA, 14 bp, Homo sapiens
tcaccggagctttc

SEQ ID NO: 1556497 - DNA, 22 bp, Homo sapiens
tcaccggctctcacctggccct

SEQ ID NO: 1556498 - DNA, 16 bp, Homo sapiens
tcaccgggatgaacct

SEQ ID NO: 1556499 - DNA, 18 bp, Homo sapiens
tcaccggggtggtttagt

SEQ ID NO: 1556500 - DNA, 15 bp, Homo sapiens
tcacctactttgtaa

SEQ ID NO: 1556501 - DNA, 20 bp, Homo sapiens
tcacctagaacgtgcatcct

SEQ ID NO: 1556502 - DNA, 16 bp, Homo sapiens
tcacctagcagcctca

SEQ ID NO: 1556503 - DNA, 16 bp, Homo sapiens
tcacctcagagtggag

SEQ ID NO: 1556504 - DNA, 17 bp, Homo sapiens
tcacctcagtagaaaag

SEQ ID NO: 1556505 - DNA, 20 bp, Homo sapiens
tcacctccaagcatttcatg

SEQ ID NO: 1556506 - DNA, 18 bp, Homo sapiens
tcacctcccgaagccacc

SEQ ID NO: 1556507 - DNA, 17 bp, Homo sapiens
tcacctcctccactcac

SEQ ID NO: 1556508 - DNA, 20 bp, Homo sapiens
tcacctcctccactcactcc

SEQ ID NO: 1556509 - DNA, 22 bp, Homo sapiens
tcacctcctctaaggttgggca

SEQ ID NO: 1556510 - DNA, 22 bp, Homo sapiens
tcacctctcttcagcccctagt

SEQ ID NO: 1556511 - DNA, 14 bp, Homo sapiens
tcacctctgaggac

SEQ ID NO: 1556512 - DNA, 12 bp, Homo sapiens
tcacctctgcct

SEQ ID NO: 1556513 - DNA, 13 bp, Homo sapiens
tcacctctgcctc

SEQ ID NO: 1556514 - DNA, 14 bp, Homo sapiens
tcacctctgcctca

SEQ ID NO: 1556515 - DNA, 15 bp, Homo sapiens
tcacctctgcctcaa

SEQ ID NO: 1556516 - DNA, 23 bp, Homo sapiens
tcacctcttatgcacacctccca

SEQ ID NO: 1556517 - DNA, 16 bp, Homo sapiens
tcacctcttcctctgg

SEQ ID NO: 1556518 - DNA, 17 bp, Homo sapiens
tcacctcttcctctggt

SEQ ID NO: 1556519 - DNA, 17 bp, Homo sapiens
tcacctgaaccccagag

SEQ ID NO: 1556520 - DNA, 23 bp, Homo sapiens
tcacctgaaccccagaggcagag

SEQ ID NO: 1556521 - DNA, 16 bp, Homo sapiens
tcacctgagacctcca

SEQ ID NO: 1556522 - DNA, 12 bp, Homo sapiens
tcacctgaggtc

SEQ ID NO: 1556523 - DNA, 23 bp, Homo sapiens
tcacctgaggtcaggagttcaag

SEQ ID NO: 1556524 - DNA, 15 bp, Homo sapiens
tcacctgcaagcccc

SEQ ID NO: 1556525 - DNA, 18 bp, Homo sapiens
tcacctgcaagccccagg

SEQ ID NO: 1556526 - DNA, 13 bp, Homo sapiens
tcacctgcactaa

SEQ ID NO: 1556527 - DNA, 12 bp, Homo sapiens
tcacctgcctgt

SEQ ID NO: 1556528 - DNA, 23 bp, Homo sapiens
tatgtacttagctgtactataag

SEQ ID NO: 1556529 - DNA, 14 bp, Homo sapiens
tatgtacttgtttg

SEQ ID NO: 1556530 - DNA, 16 bp, Homo sapiens
tatgtacttgtttgct

SEQ ID NO: 1556531 - DNA, 14 bp, Homo sapiens
tatgtagataacaa

SEQ ID NO: 1556532 - DNA, 21 bp, Homo sapiens
tatgtagcaggaaataaagta

SEQ ID NO: 1556533 - DNA, 21 bp, Homo sapiens
tatgtatacatgtgccatgct

SEQ ID NO: 1556534 - DNA, 19 bp, Homo sapiens
tatgtataggggaaagaag

SEQ ID NO: 1556535 - DNA, 14 bp, Homo sapiens
tatgtatatatata

SEQ ID NO: 1556536 - DNA, 17 bp, Homo sapiens
tatgtatatgtatatat

SEQ ID NO: 1556537 - DNA, 23 bp, Homo sapiens
tatgtatatttttttaatttaac

SEQ ID NO: 1556538 - DNA, 20 bp, Homo sapiens
tatgtatcagtgtcctttcc

SEQ ID NO: 1556539 - DNA, 22 bp, Homo sapiens
tatgtatggatatatttgaaat

SEQ ID NO: 1556540 - DNA, 17 bp, Homo sapiens
tatgtatggtatccaag

SEQ ID NO: 1556541 - DNA, 13 bp, Homo sapiens
tatgtatgttaat

SEQ ID NO: 1556542 - DNA, 15 bp, Homo sapiens
tatgtattcccttgt

SEQ ID NO: 1556543 - DNA, 20 bp, Homo sapiens
tatgtattcccttgtatttt

SEQ ID NO: 1556544 - DNA, 12 bp, Homo sapiens
tatgtatttata

SEQ ID NO: 1556545 - DNA, 14 bp, Homo sapiens
tatgtattttccta

SEQ ID NO: 1556546 - DNA, 13 bp, Homo sapiens
tatgtcagcagct

SEQ ID NO: 1556547 - DNA, 16 bp, Homo sapiens
tatgtcagcagctctg

SEQ ID NO: 1556548 - DNA, 14 bp, Homo sapiens
tatgtcatagaaat

SEQ ID NO: 1556549 - DNA, 17 bp, Homo sapiens
tatgtcatttttaatgt

SEQ ID NO: 1556550 - DNA, 18 bp, Homo sapiens
tatgtcatttttaatgta

SEQ ID NO: 1556551 - DNA, 19 bp, Homo sapiens
tatgtcatttttaatgtat

SEQ ID NO: 1556552 - DNA, 20 bp, Homo sapiens
tatgtcatttttaatgtatc

SEQ ID NO: 1556553 - DNA, 22 bp, Homo sapiens
tatgtccccataagacaaacac

SEQ ID NO: 1556554 - DNA, 13 bp, Homo sapiens
tatgtcctaagga

SEQ ID NO: 1556555 - DNA, 22 bp, Homo sapiens
tatgtcgagagctggccaaaga

SEQ ID NO: 1556556 - DNA, 19 bp, Homo sapiens
tatgtcgtagaattccttc

SEQ ID NO: 1556557 - DNA, 17 bp, Homo sapiens
tatgtctgaacatagaa

SEQ ID NO: 1556558 - DNA, 12 bp, Homo sapiens
tatgtctgcctt

SEQ ID NO: 1556559 - DNA, 14 bp, Homo sapiens
tatgtctgccttcg

SEQ ID NO: 1556560 - DNA, 12 bp, Homo sapiens
tatgtctgtgta

SEQ ID NO: 1556561 - DNA, 13 bp, Homo sapiens
tatgtctgtgtat

SEQ ID NO: 1556562 - DNA, 14 bp, Homo sapiens
tatgtctgtgtatg

SEQ ID NO: 1556563 - DNA, 15 bp, Homo sapiens
tatgtctgtttttgt

SEQ ID NO: 1556564 - DNA, 15 bp, Homo sapiens
tatgtcttcttttgt

SEQ ID NO: 1556565 - DNA, 14 bp, Homo sapiens
tatgtcttggacac

SEQ ID NO: 1556566 - DNA, 21 bp, Homo sapiens
tatgtcttggacactgtacaa

SEQ ID NO: 1556567 - DNA, 15 bp, Homo sapiens
tatgtgaaaaattaa

SEQ ID NO: 1556568 - DNA, 16 bp, Homo sapiens
tatgtgaaaaattaac

SEQ ID NO: 1556569 - DNA, 23 bp, Homo sapiens
tatgtgaaactacagatctttgg

SEQ ID NO: 1556570 - DNA, 14 bp, Homo sapiens
tatgtgacattaac

SEQ ID NO: 1556571 - DNA, 14 bp, Homo sapiens
tatgtgagtattct

SEQ ID NO: 1556572 - DNA, 23 bp, Homo sapiens
tatgtgagtgccttttgcagaag

SEQ ID NO: 1556573 - DNA, 13 bp, Homo sapiens
tatgtgattacaa

SEQ ID NO: 1556574 - DNA, 21 bp, Homo sapiens
tatgtgattttttttcccatt

SEQ ID NO: 1556575 - DNA, 22 bp, Homo sapiens
tatgtgattttttttcccattt

SEQ ID NO: 1556576 - DNA, 17 bp, Homo sapiens
tatgtgccagttcctgt

SEQ ID NO: 1556577 - DNA, 17 bp, Homo sapiens
tatgtgcctcccattca

SEQ ID NO: 1556578 - DNA, 13 bp, Homo sapiens
tatgtgccttaag

SEQ ID NO: 1556579 - DNA, 21 bp, Homo sapiens
tatgtgctatgcaaaatagac

SEQ ID NO: 1556580 - DNA, 17 bp, Homo sapiens
tatgtgctgtgaagtga

SEQ ID NO: 1556581 - DNA, 17 bp, Homo sapiens
tatgtggcagctgggga

SEQ ID NO: 1556582 - DNA, 22 bp, Homo sapiens
tatgtggctgtaatgacaaaag

SEQ ID NO: 1556583 - DNA, 18 bp, Homo sapiens
tatgtgggggtctgtgtg

SEQ ID NO: 1556584 - DNA, 14 bp, Homo sapiens
tatgtgtgaaacaa

SEQ ID NO: 1556585 - DNA, 17 bp, Homo sapiens
tatgtgtgaaacaatgt

SEQ ID NO: 1556586 - DNA, 18 bp, Homo sapiens
tatgtgtgagatatgtgt

SEQ ID NO: 1556587 - DNA, 13 bp, Homo sapiens
tatgtgtggctgt

SEQ ID NO: 1556588 - DNA, 23 bp, Homo sapiens
tatgtgtgtgtgttgtgtgtggg

SEQ ID NO: 1556589 - DNA, 15 bp, Homo sapiens
tatgtgttatgaaca

SEQ ID NO: 1556590 - DNA, 15 bp, Homo sapiens
tatgttaaaaagaaa

SEQ ID NO: 1556591 - DNA, 14 bp, Homo sapiens
tatgttaagctctt

SEQ ID NO: 1556592 - DNA, 19 bp, Homo sapiens
tatgttaagggaagaattc

SEQ ID NO: 1556593 - DNA, 12 bp, Homo sapiens
tatgttactatt

SEQ ID NO: 1556594 - DNA, 13 bp, Homo sapiens
tatgttagaatca

SEQ ID NO: 1556595 - DNA, 14 bp, Homo sapiens
tatgttcatttgtt

SEQ ID NO: 1556596 - DNA, 17 bp, Homo sapiens
tatgttcatttgtttgt

SEQ ID NO: 1556597 - DNA, 16 bp, Homo sapiens
tatgttcctgctgtat

SEQ ID NO: 1556598 - DNA, 12 bp, Homo sapiens
tatgttctaaaa

SEQ ID NO: 1556599 - DNA, 22 bp, Homo sapiens
tcaaaagaaaattgatattttt

SEQ ID NO: 1556600 - DNA, 18 bp, Homo sapiens
tcaaaagaggttacttta

SEQ ID NO: 1556601 - DNA, 18 bp, Homo sapiens
tcaaaagcaaatgagatc

SEQ ID NO: 1556602 - DNA, 15 bp, Homo sapiens
tcaaaagcattgtct

SEQ ID NO: 1556603 - DNA, 17 bp, Homo sapiens
tcaaaagctatttaaag

SEQ ID NO: 1556604 - DNA, 22 bp, Homo sapiens
tcaaaagctatttaaagcatct

SEQ ID NO: 1556605 - DNA, 15 bp, Homo sapiens
tcaaaaggaaaccaa

SEQ ID NO: 1556606 - DNA, 21 bp, Homo sapiens
tcaaaaggtattatacatgtg

SEQ ID NO: 1556607 - DNA, 15 bp, Homo sapiens
tcaaaagttccaaga

SEQ ID NO: 1556608 - DNA, 17 bp, Homo sapiens
tcaaaagttccaagagt

SEQ ID NO: 1556609 - DNA, 12 bp, Homo sapiens
tcaaaataaaaa

SEQ ID NO: 1556610 - DNA, 18 bp, Homo sapiens
tcaaaatacatttgtaag

SEQ ID NO: 1556611 - DNA, 16 bp, Homo sapiens
tcaaaatagttctatt

SEQ ID NO: 1556612 - DNA, 19 bp, Homo sapiens
tcaaaatatttgtacatag

SEQ ID NO: 1556613 - DNA, 17 bp, Homo sapiens
tcaaaatctttgtataa

SEQ ID NO: 1556614 - DNA, 19 bp, Homo sapiens
tcaaaatgtccagatgtag

SEQ ID NO: 1556615 - DNA, 16 bp, Homo sapiens
tcaaaatgttctattt

SEQ ID NO: 1556616 - DNA, 19 bp, Homo sapiens
tcaaaattctagctgtatg

SEQ ID NO: 1556617 - DNA, 11 bp, Homo sapiens
tcaaacacagt

SEQ ID NO: 1556618 - DNA, 17 bp, Homo sapiens
tcaaacacagttacact

SEQ ID NO: 1556619 - DNA, 15 bp, Homo sapiens
tcaaacaggctgtaa

SEQ ID NO: 1556620 - DNA, 17 bp, Homo sapiens
tcaaacaggctgtaatt

SEQ ID NO: 1556621 - DNA, 13 bp, Homo sapiens
tcaaacagtctca

SEQ ID NO: 1556622 - DNA, 17 bp, Homo sapiens
tcaaacatgagatgtgt

SEQ ID NO: 1556623 - DNA, 20 bp, Homo sapiens
tcaaaccatattttttatga

SEQ ID NO: 1556624 - DNA, 16 bp, Homo sapiens
tcaaaccctagccttg

SEQ ID NO: 1556625 - DNA, 16 bp, Homo sapiens
tcaaactaaattcaaa

SEQ ID NO: 1556626 - DNA, 21 bp, Homo sapiens
tcaaactgaaaagctgagacc

SEQ ID NO: 1556627 - DNA, 16 bp, Homo sapiens
tcaaactggggcctcc

SEQ ID NO: 1556628 - DNA, 19 bp, Homo sapiens
tcaaactggggcctccaga

SEQ ID NO: 1556629 - DNA, 19 bp, Homo sapiens
tcaaactggggcctccctg

SEQ ID NO: 1556630 - DNA, 18 bp, Homo sapiens
tcaaactgtgaagcattt

SEQ ID NO: 1556631 - DNA, 15 bp, Homo sapiens
tcaaacttaaacaaa

SEQ ID NO: 1556632 - DNA, 15 bp, Homo sapiens
tcaaacttactattt

SEQ ID NO: 1556633 - DNA, 14 bp, Homo sapiens
tcaaagaaaataga

SEQ ID NO: 1556634 - DNA, 15 bp, Homo sapiens
tcaaagaaagtgtat

SEQ ID NO: 1556635 - DNA, 22 bp, Homo sapiens
tcaaagaaggtgctgatcctaa

SEQ ID NO: 1556636 - DNA, 17 bp, Homo sapiens
tcaaagaagtaaaacat

SEQ ID NO: 1556637 - DNA, 21 bp, Homo sapiens
tcaaagaagtcatggcccaaa

SEQ ID NO: 1556638 - DNA, 16 bp, Homo sapiens
tcaaagaagtcggaat

SEQ ID NO: 1556639 - DNA, 18 bp, Homo sapiens
tcaaagaagtcggaatgt

SEQ ID NO: 1556640 - DNA, 12 bp, Homo sapiens
tcaaagaattac

SEQ ID NO: 1556641 - DNA, 15 bp, Homo sapiens
tcaaagagagaaaat

SEQ ID NO: 1556642 - DNA, 20 bp, Homo sapiens
tcaaagagagaaaataaaga

SEQ ID NO: 1556643 - DNA, 15 bp, Homo sapiens
tcaaagagattcgaa

SEQ ID NO: 1556644 - DNA, 16 bp, Homo sapiens
tcaaagcaaaagtgct

SEQ ID NO: 1556645 - DNA, 13 bp, Homo sapiens
tcaaagcaagggc

SEQ ID NO: 1556646 - DNA, 16 bp, Homo sapiens
tcaaagcagaagtctg

SEQ ID NO: 1556647 - DNA, 13 bp, Homo sapiens
tcaaagccctgcc

SEQ ID NO: 1556648 - DNA, 14 bp, Homo sapiens
tcaaagccctgcct

SEQ ID NO: 1556649 - DNA, 15 bp, Homo sapiens
tcaaagccctgcctc

SEQ ID NO: 1556650 - DNA, 16 bp, Homo sapiens
tcaaagccctgcctct

SEQ ID NO: 1556651 - DNA, 21 bp, Homo sapiens
tcaaagccctgcctctgtgta

SEQ ID NO: 1556652 - DNA, 15 bp, Homo sapiens
tcaaagctaaaaaat

SEQ ID NO: 1556653 - DNA, 11 bp, Homo sapiens
tcaaagctgcc

SEQ ID NO: 1556654 - DNA, 15 bp, Homo sapiens
tcaaaggacaaagtg

SEQ ID NO: 1556655 - DNA, 15 bp, Homo sapiens
tcaaaggagaaaaaa

SEQ ID NO: 1556656 - DNA, 18 bp, Homo sapiens
tcaaaggagctttctcaa

SEQ ID NO: 1556657 - DNA, 13 bp, Homo sapiens
tcaaagggcagtt

SEQ ID NO: 1556658 - DNA, 18 bp, Homo sapiens
tcaaagggcccacagtga

SEQ ID NO: 1556659 - DNA, 21 bp, Homo sapiens
tcaaaggttctaggtttcaaa

SEQ ID NO: 1556660 - DNA, 19 bp, Homo sapiens
tcaaagtaaaacttgctgc

SEQ ID NO: 1556661 - DNA, 14 bp, Homo sapiens
tcaaagtatgcaat

SEQ ID NO: 1556662 - DNA, 18 bp, Homo sapiens
tcaaagtggtaaatactg

SEQ ID NO: 1556663 - DNA, 21 bp, Homo sapiens
tcaaagtggtaaatactgtga

SEQ ID NO: 1556664 - DNA, 19 bp, Homo sapiens
tcaaagtgtatatttattc

SEQ ID NO: 1556665 - DNA, 18 bp, Homo sapiens
tcaaagtgttgtgttcct

SEQ ID NO: 1556666 - DNA, 19 bp, Homo sapiens
tcaaagtgttgtgttcctg

SEQ ID NO: 1556667 - DNA, 13 bp, Homo sapiens
tcaaagttttgtt

SEQ ID NO: 1556668 - DNA, 23 bp, Homo sapiens
tcaaataaaactagtgacagctt

SEQ ID NO: 1556669 - DNA, 17 bp, Homo sapiens
tcaaataagtatttata

SEQ ID NO: 1556670 - DNA, 16 bp, Homo sapiens
tcaaatacacatttgc

SEQ ID NO: 1556671 - DNA, 15 bp, Homo sapiens
tcaaatagttgcata

SEQ ID NO: 1556672 - DNA, 15 bp, Homo sapiens
tcaacagcatgtcta

SEQ ID NO: 1556673 - DNA, 16 bp, Homo sapiens
tcaacagcatgtctac

SEQ ID NO: 1556674 - DNA, 13 bp, Homo sapiens
tcaacagtaaacc

SEQ ID NO: 1556675 - DNA, 14 bp, Homo sapiens
tcaacagtaaacca

SEQ ID NO: 1556676 - DNA, 18 bp, Homo sapiens
tcaacagtaaaccactga

SEQ ID NO: 1556677 - DNA, 23 bp, Homo sapiens
tcaacatgttattcaatgtgaca

SEQ ID NO: 1556678 - DNA, 14 bp, Homo sapiens
tcaacatttacatg

SEQ ID NO: 1556679 - DNA, 16 bp, Homo sapiens
tcaacatttacatgta

SEQ ID NO: 1556680 - DNA, 17 bp, Homo sapiens
tcaacatttattttgag

SEQ ID NO: 1556681 - DNA, 18 bp, Homo sapiens
tcaacatttattttgaga

SEQ ID NO: 1556682 - DNA, 20 bp, Homo sapiens
tcaacatttttttttctcca

SEQ ID NO: 1556683 - DNA, 15 bp, Homo sapiens
tcaaccaatgtagaa

SEQ ID NO: 1556684 - DNA, 23 bp, Homo sapiens
tcaaccactgtggcgttctgctg

SEQ ID NO: 1556685 - DNA, 22 bp, Homo sapiens
tcaaccattagataaacacagg

SEQ ID NO: 1556686 - DNA, 23 bp, Homo sapiens
tcaaccattagataaacacaggc

SEQ ID NO: 1556687 - DNA, 22 bp, Homo sapiens
tcaacccattgttgtcaaggaa

SEQ ID NO: 1556688 - DNA, 23 bp, Homo sapiens
tcaacccccagctaataaaccag

SEQ ID NO: 1556689 - DNA, 18 bp, Homo sapiens
tcaacccccatttctatt

SEQ ID NO: 1556690 - DNA, 14 bp, Homo sapiens
tcaacccctctcag

SEQ ID NO: 1556691 - DNA, 17 bp, Homo sapiens
tcaaccctcagccttga

SEQ ID NO: 1556692 - DNA, 15 bp, Homo sapiens
tcaaccctctcctgt

SEQ ID NO: 1556693 - DNA, 19 bp, Homo sapiens
tcaacctaagcaacagaaa

SEQ ID NO: 1556694 - DNA, 13 bp, Homo sapiens
tcaacctaccctg

SEQ ID NO: 1556695 - DNA, 19 bp, Homo sapiens
tcaacctcttctggctcaa

SEQ ID NO: 1556696 - DNA, 13 bp, Homo sapiens
tcaaccttctggg

SEQ ID NO: 1556697 - DNA, 14 bp, Homo sapiens
tcaacgcagccctg

SEQ ID NO: 1556698 - DNA, 19 bp, Homo sapiens
tcaacgcctcactgaaaca

SEQ ID NO: 1556699 - DNA, 23 bp, Homo sapiens
tcaacgcctcactgaaacatggc

SEQ ID NO: 1556700 - DNA, 15 bp, Homo sapiens
tcaacgcctccccct

SEQ ID NO: 1556701 - DNA, 20 bp, Homo sapiens
tcaactaaagttgtacttta

SEQ ID NO: 1556702 - DNA, 15 bp, Homo sapiens
tcaactaatttttgt

SEQ ID NO: 1556703 - DNA, 15 bp, Homo sapiens
tcaactcctgggctc

SEQ ID NO: 1556704 - DNA, 14 bp, Homo sapiens
tcaactctacccct

SEQ ID NO: 1556705 - DNA, 18 bp, Homo sapiens
tcaactctacccctgctc

SEQ ID NO: 1556706 - DNA, 14 bp, Homo sapiens
tcaactctgagccc

SEQ ID NO: 1556707 - DNA, 12 bp, Homo sapiens
tcaactgaaggg

SEQ ID NO: 1556708 - DNA, 16 bp, Homo sapiens
tcaactgtcttcctca

SEQ ID NO: 1556709 - DNA, 14 bp, Homo sapiens
tcaactttactgta

SEQ ID NO: 1556710 - DNA, 18 bp, Homo sapiens
tcaactttactgtaatat

SEQ ID NO: 1556711 - DNA, 20 bp, Homo sapiens
tcaactttactgtaatataa

SEQ ID NO: 1556712 - DNA, 14 bp, Homo sapiens
tcaactttgtaaaa

SEQ ID NO: 1556713 - DNA, 16 bp, Homo sapiens
tcaagaaaaaaaggga

SEQ ID NO: 1556714 - DNA, 12 bp, Homo sapiens
tcaagaaacagc

SEQ ID NO: 1556715 - DNA, 16 bp, Homo sapiens
tcaagaaacagccagc

SEQ ID NO: 1556716 - DNA, 13 bp, Homo sapiens
tcaagaaactgag

SEQ ID NO: 1556717 - DNA, 17 bp, Homo sapiens
tcaagaaactgaggaat

SEQ ID NO: 1556718 - DNA, 21 bp, Homo sapiens
tcaagaaagcttcaaactgca

SEQ ID NO: 1556719 - DNA, 14 bp, Homo sapiens
tcaagaacaaacac

SEQ ID NO: 1556720 - DNA, 16 bp, Homo sapiens
tcaagaacaaacagaa

SEQ ID NO: 1556721 - DNA, 12 bp, Homo sapiens
tcaagaagacat

SEQ ID NO: 1556722 - DNA, 18 bp, Homo sapiens
tcaagaagggctgcatga

SEQ ID NO: 1556723 - DNA, 20 bp, Homo sapiens
tcaagaagggctgcatgatg

SEQ ID NO: 1556724 - DNA, 22 bp, Homo sapiens
tcaagaagttctttgattctgt

SEQ ID NO: 1556725 - DNA, 17 bp, Homo sapiens
tcaagaatctagaagat

SEQ ID NO: 1556726 - DNA, 23 bp, Homo sapiens
tcaagaatctagaagatgtgtaa

SEQ ID NO: 1556727 - DNA, 15 bp, Homo sapiens
tcaagaatgcaatat

SEQ ID NO: 1556728 - DNA, 16 bp, Homo sapiens
tcaagacagattgtga

SEQ ID NO: 1556729 - DNA, 11 bp, Homo sapiens
tcaagacattt

SEQ ID NO: 1556730 - DNA, 13 bp, Homo sapiens
tcaagacatttct

SEQ ID NO: 1556731 - DNA, 14 bp, Homo sapiens
tcaagaccagcctg

SEQ ID NO: 1556732 - DNA, 22 bp, Homo sapiens
tcaagaccaggctgcagcctcc

SEQ ID NO: 1556733 - DNA, 23 bp, Homo sapiens
tcaagaccaggctgcagcctcca

SEQ ID NO: 1556734 - DNA, 20 bp, Homo sapiens
tcaagactttagcttttcct

SEQ ID NO: 1556735 - DNA, 15 bp, Homo sapiens
tcaagagaaacttca

SEQ ID NO: 1556736 - DNA, 20 bp, Homo sapiens
tcaagagctagaaaaataaa

SEQ ID NO: 1556737 - DNA, 15 bp, Homo sapiens
tcaagaggaatctgt

SEQ ID NO: 1556738 - DNA, 23 bp, Homo sapiens
tcaagagtgagatgtagaaagtt

SEQ ID NO: 1556739 - DNA, 18 bp, Homo sapiens
tcaagagttcagtgctca

SEQ ID NO: 1556740 - DNA, 15 bp, Homo sapiens
tcaagatattaaaat

SEQ ID NO: 1556741 - DNA, 15 bp, Homo sapiens
tcaagatattcaggt

SEQ ID NO: 1556742 - DNA, 17 bp, Homo sapiens
tcaagatgacagctctt

SEQ ID NO: 1556743 - DNA, 22 bp, Homo sapiens
tcaagatgatgatgatctttaa

SEQ ID NO: 1556744 - DNA, 19 bp, Homo sapiens
tcaagattctaaagctcaa

SEQ ID NO: 1556745 - DNA, 15 bp, Homo sapiens
tcaagattttagggc

SEQ ID NO: 1556746 - DNA, 22 bp, Homo sapiens
tcaagattttagggcttttatt

SEQ ID NO: 1556747 - DNA, 18 bp, Homo sapiens
tcaagattttgaatgctt

SEQ ID NO: 1556748 - DNA, 18 bp, Homo sapiens
tcaagatttttttcctga

SEQ ID NO: 1556749 - DNA, 14 bp, Homo sapiens
tcaagcacatgtaa

SEQ ID NO: 1556750 - DNA, 14 bp, Homo sapiens
tcaagcacttccca

SEQ ID NO: 1556751 - DNA, 22 bp, Homo sapiens
tcaagcagcgaccgccccctcc

SEQ ID NO: 1556752 - DNA, 16 bp, Homo sapiens
tcaagcagtcgtgcct

SEQ ID NO: 1556753 - DNA, 20 bp, Homo sapiens
tcaagcagtcgtgcctgtgt

SEQ ID NO: 1556754 - DNA, 18 bp, Homo sapiens
tcaagccaatcccctcct

SEQ ID NO: 1556755 - DNA, 21 bp, Homo sapiens
tcaagccagccccctccagct

SEQ ID NO: 1556756 - DNA, 23 bp, Homo sapiens
tcaagccagccccctccagctca

SEQ ID NO: 1556757 - DNA, 15 bp, Homo sapiens
tcaagcccagaaagt

SEQ ID NO: 1556758 - DNA, 13 bp, Homo sapiens
tcaagccctgcag

SEQ ID NO: 1556759 - DNA, 20 bp, Homo sapiens
tcaagccgcaagctctcagc

SEQ ID NO: 1556760 - DNA, 13 bp, Homo sapiens
tcaagcctgtggg

SEQ ID NO: 1556761 - DNA, 20 bp, Homo sapiens
tcaagcctgtgggagtagaa

SEQ ID NO: 1556762 - DNA, 17 bp, Homo sapiens
tcaagcgattctcctgt

SEQ ID NO: 1556763 - DNA, 20 bp, Homo sapiens
tcaagctactttatgtaaat

SEQ ID NO: 1556764 - DNA, 14 bp, Homo sapiens
tcaagctgctctga

SEQ ID NO: 1556765 - DNA, 13 bp, Homo sapiens
tcaagctgtcccc

SEQ ID NO: 1556766 - DNA, 20 bp, Homo sapiens
tcaagctgttatttcttccc

SEQ ID NO: 1556767 - DNA, 22 bp, Homo sapiens
tcaagctgttatttcttccctg

SEQ ID NO: 1556768 - DNA, 21 bp, Homo sapiens
tcaaggaaaggctcatttaaa

SEQ ID NO: 1556769 - DNA, 16 bp, Homo sapiens
tcaaggaacagccaca

SEQ ID NO: 1556770 - DNA, 19 bp, Homo sapiens
tcaaggaacagccacaaaa

SEQ ID NO: 1556771 - DNA, 23 bp, Homo sapiens
tcaaggaatttcttaacttcttg

SEQ ID NO: 1556772 - DNA, 19 bp, Homo sapiens
tcaaggacaaagtctccag

SEQ ID NO: 1556773 - DNA, 20 bp, Homo sapiens
tcaaggacaaagtctccagc

SEQ ID NO: 1556774 - DNA, 22 bp, Homo sapiens
tcaaggacaaagtctccagccc

SEQ ID NO: 1556775 - DNA, 23 bp, Homo sapiens
tcaaggagcccagaaaacctcca

SEQ ID NO: 1556776 - DNA, 18 bp, Homo sapiens
tcaaggatacagggagcc

SEQ ID NO: 1556777 - DNA, 22 bp, Homo sapiens
tcaaggatggttttgggactag

SEQ ID NO: 1556778 - DNA, 16 bp, Homo sapiens
tcaaggcactctagat

SEQ ID NO: 1556779 - DNA, 18 bp, Homo sapiens
tcaaggcactctagattc

SEQ ID NO: 1556780 - DNA, 21 bp, Homo sapiens
tcaaggcactctagattccat

SEQ ID NO: 1556781 - DNA, 17 bp, Homo sapiens
tcaaggccacctctgcc

SEQ ID NO: 1556782 - DNA, 14 bp, Homo sapiens
tcaaggccttcagt

SEQ ID NO: 1556783 - DNA, 15 bp, Homo sapiens
tcaatcttgttactg

SEQ ID NO: 1556784 - DNA, 15 bp, Homo sapiens
tcaatgaagccagct

SEQ ID NO: 1556785 - DNA, 21 bp, Homo sapiens
tcaatgatgttagcctgattt

SEQ ID NO: 1556786 - DNA, 20 bp, Homo sapiens
tcaatgcaagagtgattgca

SEQ ID NO: 1556787 - DNA, 12 bp, Homo sapiens
tcaatgccctgc

SEQ ID NO: 1556788 - DNA, 14 bp, Homo sapiens
tcaatgggaaatac

SEQ ID NO: 1556789 - DNA, 17 bp, Homo sapiens
tcaatgggctcttccaa

SEQ ID NO: 1556790 - DNA, 14 bp, Homo sapiens
tcaatggggccagt

SEQ ID NO: 1556791 - DNA, 20 bp, Homo sapiens
tcaatggtagattcgctgtc

SEQ ID NO: 1556792 - DNA, 17 bp, Homo sapiens
tcaatgtacatagaccc

SEQ ID NO: 1556793 - DNA, 15 bp, Homo sapiens
tcaatgtcaagtacc

SEQ ID NO: 1556794 - DNA, 15 bp, Homo sapiens
tcaatgtgaatcaga

SEQ ID NO: 1556795 - DNA, 22 bp, Homo sapiens
tcaatgtttatgcaaggaagga

SEQ ID NO: 1556796 - DNA, 23 bp, Homo sapiens
tcaatgtttatgcaaggaaggaa

SEQ ID NO: 1556797 - DNA, 14 bp, Homo sapiens
tcaatgtttctgga

SEQ ID NO: 1556798 - DNA, 12 bp, Homo sapiens
tcaattaaatgt

SEQ ID NO: 1556799 - DNA, 16 bp, Homo sapiens
tcaattactggtccaa

SEQ ID NO: 1556800 - DNA, 20 bp, Homo sapiens
tcaattactggtccaaaaga

SEQ ID NO: 1556801 - DNA, 22 bp, Homo sapiens
tcaattacttattttaggaaat

SEQ ID NO: 1556802 - DNA, 23 bp, Homo sapiens
tcaattacttattttaggaaatt

SEQ ID NO: 1556803 - DNA, 21 bp, Homo sapiens
tcaattagtggtcataaaata

SEQ ID NO: 1556804 - DNA, 14 bp, Homo sapiens
tcaattatagtttc

SEQ ID NO: 1556805 - DNA, 17 bp, Homo sapiens
tcaattatagtttctga

SEQ ID NO: 1556806 - DNA, 15 bp, Homo sapiens
tcaattcctctggga

SEQ ID NO: 1556807 - DNA, 13 bp, Homo sapiens
tcaattcctgggc

SEQ ID NO: 1556808 - DNA, 17 bp, Homo sapiens
tcaattcctgggcccca

SEQ ID NO: 1556809 - DNA, 22 bp, Homo sapiens
tcaattcttcatgcgtgccctt

SEQ ID NO: 1556810 - DNA, 17 bp, Homo sapiens
tcaattgtcacttttta

SEQ ID NO: 1556811 - DNA, 15 bp, Homo sapiens
tcaatttaaataacc

SEQ ID NO: 1556812 - DNA, 23 bp, Homo sapiens
tcaatttctgtgttgccaagctc

SEQ ID NO: 1556813 - DNA, 21 bp, Homo sapiens
tcaatttttgtttttgagtac

SEQ ID NO: 1556814 - DNA, 14 bp, Homo sapiens
tcacaaaaaagaag

SEQ ID NO: 1556815 - DNA, 20 bp, Homo sapiens
tcacaaaatatattttgttt

SEQ ID NO: 1556816 - DNA, 17 bp, Homo sapiens
tcacaaactacctctgg

SEQ ID NO: 1556817 - DNA, 21 bp, Homo sapiens
tcacaaactacctctggacag

SEQ ID NO: 1556818 - DNA, 12 bp, Homo sapiens
tcacaaactgtg

SEQ ID NO: 1556819 - DNA, 19 bp, Homo sapiens
tcacaaactgtgaaaatag

SEQ ID NO: 1556820 - DNA, 23 bp, Homo sapiens
tcacaaactgtgaaaatagtgta

SEQ ID NO: 1556821 - DNA, 21 bp, Homo sapiens
tcacaaatgtcattgtctact

SEQ ID NO: 1556822 - DNA, 22 bp, Homo sapiens
tcacaactttgacgtaattaaa

SEQ ID NO: 1556823 - DNA, 20 bp, Homo sapiens
tcacaaggcccaggagacct

SEQ ID NO: 1556824 - DNA, 19 bp, Homo sapiens
tcacaaggtacaaaatctt

SEQ ID NO: 1556825 - DNA, 16 bp, Homo sapiens
tcacaagtgaaaaaca

SEQ ID NO: 1556826 - DNA, 16 bp, Homo sapiens
tcacaatagaaactca

SEQ ID NO: 1556827 - DNA, 23 bp, Homo sapiens
tcacaatcttggggctgatgaag

SEQ ID NO: 1556828 - DNA, 19 bp, Homo sapiens
tcacaattccatttccagt

SEQ ID NO: 1556829 - DNA, 19 bp, Homo sapiens
tcacaatttaaaatatttc

SEQ ID NO: 1556830 - DNA, 23 bp, Homo sapiens
tcacacaaagactccttgtggac

SEQ ID NO: 1556831 - DNA, 18 bp, Homo sapiens
tcacacaacactgatgtg

SEQ ID NO: 1556832 - DNA, 21 bp, Homo sapiens
tcacacaacactgatgtgact

SEQ ID NO: 1556833 - DNA, 15 bp, Homo sapiens
tcacacaatatagtt

SEQ ID NO: 1556834 - DNA, 21 bp, Homo sapiens
tcacacaatatagttttttct

SEQ ID NO: 1556835 - DNA, 13 bp, Homo sapiens
tcacacacccctc

SEQ ID NO: 1556836 - DNA, 21 bp, Homo sapiens
tcacacactcacaatttaaaa

SEQ ID NO: 1556837 - DNA, 18 bp, Homo sapiens
tcacaccctaccttcccc

SEQ ID NO: 1556838 - DNA, 20 bp, Homo sapiens
tcacaccctaccttccccag

SEQ ID NO: 1556839 - DNA, 18 bp, Homo sapiens
tcacacctgactctgaaa

SEQ ID NO: 1556840 - DNA, 18 bp, Homo sapiens
tcacactaagagggcaga

SEQ ID NO: 1556841 - DNA, 21 bp, Homo sapiens
tcacactaagagggcagactg

SEQ ID NO: 1556842 - DNA, 22 bp, Homo sapiens
tcacactccagtggcagacaaa

SEQ ID NO: 1556843 - DNA, 20 bp, Homo sapiens
tcacactgaatcagctgctg

SEQ ID NO: 1556844 - DNA, 23 bp, Homo sapiens
tcacactgagaatgtaagaacta

SEQ ID NO: 1556845 - DNA, 18 bp, Homo sapiens
tcacactgcaagagcctt

SEQ ID NO: 1556846 - DNA, 21 bp, Homo sapiens
tcacactgcaagagccttggt

SEQ ID NO: 1556847 - DNA, 13 bp, Homo sapiens
tcacactggccac

SEQ ID NO: 1556848 - DNA, 22 bp, Homo sapiens
tcacactgggtggtggcctggt

SEQ ID NO: 1556849 - DNA, 11 bp, Homo sapiens
tcacactgtct

SEQ ID NO: 1556850 - DNA, 14 bp, Homo sapiens
tcacactgtcttcc

SEQ ID NO: 1556851 - DNA, 18 bp, Homo sapiens
tcacactgttactccaca

SEQ ID NO: 1556852 - DNA, 20 bp, Homo sapiens
tcacacttatattttatgaa

SEQ ID NO: 1556853 - DNA, 17 bp, Homo sapiens
tcacacttcattgtaaa

SEQ ID NO: 1556854 - DNA, 21 bp, Homo sapiens
tcacacttcattgtaaatcac

SEQ ID NO: 1556855 - DNA, 21 bp, Homo sapiens
tcacagaaatcagaggagaga

SEQ ID NO: 1556856 - DNA, 21 bp, Homo sapiens
tcacagaacccttggagccaa

SEQ ID NO: 1556857 - DNA, 22 bp, Homo sapiens
tcacagaatcatatgattctgc

SEQ ID NO: 1556858 - DNA, 17 bp, Homo sapiens
tcacagacctggagccc

SEQ ID NO: 1556859 - DNA, 22 bp, Homo sapiens
tcacagacctggagcccctggg

SEQ ID NO: 1556860 - DNA, 23 bp, Homo sapiens
tcacagacctggagcccctgggt

SEQ ID NO: 1556861 - DNA, 12 bp, Homo sapiens
tcacagagaagc

SEQ ID NO: 1556862 - DNA, 13 bp, Homo sapiens
tcacagagaagct

SEQ ID NO: 1556863 - DNA, 16 bp, Homo sapiens
tcacagagcacgcctg

SEQ ID NO: 1556864 - DNA, 20 bp, Homo sapiens
tcacagagcacgcctgccat

SEQ ID NO: 1556865 - DNA, 22 bp, Homo sapiens
tcacagagcacgcctgccatct

SEQ ID NO: 1556866 - DNA, 18 bp, Homo sapiens
tcacagagtcaaggcctg

SEQ ID NO: 1556867 - DNA, 19 bp, Homo sapiens
tcacagagtcaaggcctgc

SEQ ID NO: 1556868 - DNA, 21 bp, Homo sapiens
tcacagatgggtattaaactt

SEQ ID NO: 1556869 - DNA, 14 bp, Homo sapiens
tcacagcacagtac

SEQ ID NO: 1556870 - DNA, 17 bp, Homo sapiens
tcacagccagactggca

SEQ ID NO: 1556871 - DNA, 19 bp, Homo sapiens
tcacagcccaaaatttgat

SEQ ID NO: 1556872 - DNA, 13 bp, Homo sapiens
tcacagcccagcc

SEQ ID NO: 1556873 - DNA, 14 bp, Homo sapiens
tcacagctcctccc

SEQ ID NO: 1556874 - DNA, 11 bp, Homo sapiens
tcacagctgca

SEQ ID NO: 1556875 - DNA, 20 bp, Homo sapiens
tcacagctgcagctgggccc

SEQ ID NO: 1556876 - DNA, 19 bp, Homo sapiens
tcacagcttcagccaggag

SEQ ID NO: 1556877 - DNA, 16 bp, Homo sapiens
tcacaggcatcaggaa

SEQ ID NO: 1556878 - DNA, 19 bp, Homo sapiens
tcacaggccccaggaaagg

SEQ ID NO: 1556879 - DNA, 22 bp, Homo sapiens
tcacaggcttctgagcacagct

SEQ ID NO: 1556880 - DNA, 18 bp, Homo sapiens
tcacagggcagagccggg

SEQ ID NO: 1556881 - DNA, 16 bp, Homo sapiens
tcacagggccccagaa

SEQ ID NO: 1556882 - DNA, 12 bp, Homo sapiens
tcacagggtggg

SEQ ID NO: 1556883 - DNA, 17 bp, Homo sapiens
tcacagggtgggcctcg

SEQ ID NO: 1556884 - DNA, 16 bp, Homo sapiens
tcacagggttgggccc

SEQ ID NO: 1556885 - DNA, 17 bp, Homo sapiens
tcacagggttgggccca

SEQ ID NO: 1556886 - DNA, 19 bp, Homo sapiens
tcacagggttgggcccaga

SEQ ID NO: 1556887 - DNA, 24 bp, Homo sapiens
tcacagggttgggcccagatctgg

SEQ ID NO: 1556888 - DNA, 17 bp, Homo sapiens
tcacagtactttccagc

SEQ ID NO: 1556889 - DNA, 19 bp, Homo sapiens
tcacagtagagccagcttg

SEQ ID NO: 1556890 - DNA, 21 bp, Homo sapiens
tcacagtagagccagcttggg

SEQ ID NO: 1556891 - DNA, 14 bp, Homo sapiens
tcacagtcctgagt

SEQ ID NO: 1556892 - DNA, 16 bp, Homo sapiens
tcacagtctctggaaa

SEQ ID NO: 1556893 - DNA, 21 bp, Homo sapiens
tcacagtctctttaatcttca

SEQ ID NO: 1556894 - DNA, 17 bp, Homo sapiens
tcacagtgctcttttct

SEQ ID NO: 1556895 - DNA, 14 bp, Homo sapiens
tcacagtgctgtgt

SEQ ID NO: 1556896 - DNA, 14 bp, Homo sapiens
tcacagtgtttcga

SEQ ID NO: 1556897 - DNA, 13 bp, Homo sapiens
tcacagttcctcg

SEQ ID NO: 1556898 - DNA, 19 bp, Homo sapiens
tagaattctagtgctgctg

SEQ ID NO: 1556899 - DNA, 16 bp, Homo sapiens
tagaattttaagtgct

SEQ ID NO: 1556900 - DNA, 19 bp, Homo sapiens
tagaattttgagtattcca

SEQ ID NO: 1556901 - DNA, 18 bp, Homo sapiens
tagaattttgggtattgt

SEQ ID NO: 1556902 - DNA, 13 bp, Homo sapiens
tagacaaaaagta

SEQ ID NO: 1556903 - DNA, 12 bp, Homo sapiens
tagacaaagtac

SEQ ID NO: 1556904 - DNA, 13 bp, Homo sapiens
tagacaaccatag

SEQ ID NO: 1556905 - DNA, 19 bp, Homo sapiens
tagacaaccatagaactgt

SEQ ID NO: 1556906 - DNA, 19 bp, Homo sapiens
tagacaacctgaaatttat

SEQ ID NO: 1556907 - DNA, 14 bp, Homo sapiens
tagacaacctttct

SEQ ID NO: 1556908 - DNA, 20 bp, Homo sapiens
tagacaagatattgtacata

SEQ ID NO: 1556909 - DNA, 22 bp, Homo sapiens
tagacacaatttcatttccagc

SEQ ID NO: 1556910 - DNA, 19 bp, Homo sapiens
tagacacatgaaggtaaat

SEQ ID NO: 1556911 - DNA, 20 bp, Homo sapiens
tagacacatgaaggtaaata

SEQ ID NO: 1556912 - DNA, 14 bp, Homo sapiens
tagacaccaaagtt

SEQ ID NO: 1556913 - DNA, 19 bp, Homo sapiens
tagacagaaaccaagccat

SEQ ID NO: 1556914 - DNA, 15 bp, Homo sapiens
tagacagaacaccta

SEQ ID NO: 1556915 - DNA, 23 bp, Homo sapiens
tagacagcttttctcaactgggt

SEQ ID NO: 1556916 - DNA, 21 bp, Homo sapiens
tagacatcaatcctggtaacc

SEQ ID NO: 1556917 - DNA, 16 bp, Homo sapiens
tagacatctttaacat

SEQ ID NO: 1556918 - DNA, 17 bp, Homo sapiens
tagacatggaggttcta

SEQ ID NO: 1556919 - DNA, 18 bp, Homo sapiens
tagacatggaggttctaa

SEQ ID NO: 1556920 - DNA, 19 bp, Homo sapiens
tagacatggaggttctaag

SEQ ID NO: 1556921 - DNA, 18 bp, Homo sapiens
tagacattcagactaaaa

SEQ ID NO: 1556922 - DNA, 15 bp, Homo sapiens
tagacattctcacat

SEQ ID NO: 1556923 - DNA, 19 bp, Homo sapiens
tagacatttgtaaatgtaa

SEQ ID NO: 1556924 - DNA, 16 bp, Homo sapiens
tagaccaaagcaaaga

SEQ ID NO: 1556925 - DNA, 17 bp, Homo sapiens
tagaccaaagcaaagaa

SEQ ID NO: 1556926 - DNA, 19 bp, Homo sapiens
tagacccatagcagctttg

SEQ ID NO: 1556927 - DNA, 16 bp, Homo sapiens
tagaccctcgggcccc

SEQ ID NO: 1556928 - DNA, 18 bp, Homo sapiens
tagacctacagacctggc

SEQ ID NO: 1556929 - DNA, 14 bp, Homo sapiens
tagacctcagcctg

SEQ ID NO: 1556930 - DNA, 15 bp, Homo sapiens
tagacctcagcctgt

SEQ ID NO: 1556931 - DNA, 16 bp, Homo sapiens
tagacctcagcctgtg

SEQ ID NO: 1556932 - DNA, 20 bp, Homo sapiens
tagacctcagcctgtgctgc

SEQ ID NO: 1556933 - DNA, 21 bp, Homo sapiens
tagacgccttccaggtcagga

SEQ ID NO: 1556934 - DNA, 14 bp, Homo sapiens
tagactaattgtgt

SEQ ID NO: 1556935 - DNA, 21 bp, Homo sapiens
tagactattccttttctgtat

SEQ ID NO: 1556936 - DNA, 18 bp, Homo sapiens
tagactcatcttactgta

SEQ ID NO: 1556937 - DNA, 17 bp, Homo sapiens
tagactctgtctacctg

SEQ ID NO: 1556938 - DNA, 21 bp, Homo sapiens
tagactggagtgaggcttcca

SEQ ID NO: 1556939 - DNA, 22 bp, Homo sapiens
tagactggagtgaggcttccag

SEQ ID NO: 1556940 - DNA, 21 bp, Homo sapiens
tagactggatggaaagacaaa

SEQ ID NO: 1556941 - DNA, 19 bp, Homo sapiens
tagactgttactttggcaa

SEQ ID NO: 1556942 - DNA, 14 bp, Homo sapiens
tagacttaggcatt

SEQ ID NO: 1556943 - DNA, 15 bp, Homo sapiens
tagacttccccatcc

SEQ ID NO: 1556944 - DNA, 17 bp, Homo sapiens
tagacttcctttataat

SEQ ID NO: 1556945 - DNA, 13 bp, Homo sapiens
tagacttctggtt

SEQ ID NO: 1556946 - DNA, 13 bp, Homo sapiens
tagagaaaaggct

SEQ ID NO: 1556947 - DNA, 14 bp, Homo sapiens
tagagaagctgaaa

SEQ ID NO: 1556948 - DNA, 22 bp, Homo sapiens
tagagaattcctatttaaaaaa

SEQ ID NO: 1556949 - DNA, 12 bp, Homo sapiens
tagagacacatt

SEQ ID NO: 1556950 - DNA, 14 bp, Homo sapiens
tagagactgtagat

SEQ ID NO: 1556951 - DNA, 15 bp, Homo sapiens
tagagactgtagatt

SEQ ID NO: 1556952 - DNA, 19 bp, Homo sapiens
tagagactgtagattgctt

SEQ ID NO: 1556953 - DNA, 13 bp, Homo sapiens
tagagagaataaa

SEQ ID NO: 1556954 - DNA, 15 bp, Homo sapiens
tagagagaataaatt

SEQ ID NO: 1556955 - DNA, 13 bp, Homo sapiens
tagagagcctgtc

SEQ ID NO: 1556956 - DNA, 13 bp, Homo sapiens
tagagagggggct

SEQ ID NO: 1556957 - DNA, 13 bp, Homo sapiens
tagagattttaca

SEQ ID NO: 1556958 - DNA, 16 bp, Homo sapiens
tagagattttctcttc

SEQ ID NO: 1556959 - DNA, 21 bp, Homo sapiens
tagagcaaaattgatgtgttt

SEQ ID NO: 1556960 - DNA, 19 bp, Homo sapiens
tagagcaatgttggttttt

SEQ ID NO: 1556961 - DNA, 16 bp, Homo sapiens
tagagcacactgtagc

SEQ ID NO: 1556962 - DNA, 13 bp, Homo sapiens
tagagcagaaatt

SEQ ID NO: 1556963 - DNA, 15 bp, Homo sapiens
tagagcagaaattct

SEQ ID NO: 1556964 - DNA, 19 bp, Homo sapiens
tagagcattgaattggaga

SEQ ID NO: 1556965 - DNA, 14 bp, Homo sapiens
tagagccgagggga

SEQ ID NO: 1556966 - DNA, 17 bp, Homo sapiens
tagagcctgtaaacttt

SEQ ID NO: 1556967 - DNA, 15 bp, Homo sapiens
tagagcgccagctcc

SEQ ID NO: 1556968 - DNA, 14 bp, Homo sapiens
tagagctagctgcc

SEQ ID NO: 1556969 - DNA, 17 bp, Homo sapiens
tagagctagctgccact

SEQ ID NO: 1556970 - DNA, 15 bp, Homo sapiens
tagagctgatccaga

SEQ ID NO: 1556971 - DNA, 17 bp, Homo sapiens
tagagctgcataatgtc

SEQ ID NO: 1556972 - DNA, 15 bp, Homo sapiens
tagagctgccactgg

SEQ ID NO: 1556973 - DNA, 23 bp, Homo sapiens
tagagcttccaaatgtgtcagaa

SEQ ID NO: 1556974 - DNA, 22 bp, Homo sapiens
tagaggaaaaaaatgactaaaa

SEQ ID NO: 1556975 - DNA, 20 bp, Homo sapiens
tagaggaaataagaaaaatc

SEQ ID NO: 1556976 - DNA, 13 bp, Homo sapiens
tagaggagctgct

SEQ ID NO: 1556977 - DNA, 16 bp, Homo sapiens
tagaggcaacaggatt

SEQ ID NO: 1556978 - DNA, 20 bp, Homo sapiens
tagaggccagccccacccag

SEQ ID NO: 1556979 - DNA, 17 bp, Homo sapiens
tagaggcccaggcacca

SEQ ID NO: 1556980 - DNA, 15 bp, Homo sapiens
tagaggcctgaggat

SEQ ID NO: 1556981 - DNA, 14 bp, Homo sapiens
tagaggcttctccg

SEQ ID NO: 1556982 - DNA, 20 bp, Homo sapiens
tagaggcttctccgccagcc

SEQ ID NO: 1556983 - DNA, 21 bp, Homo sapiens
tagaggcttctccgccagcct

SEQ ID NO: 1556984 - DNA, 22 bp, Homo sapiens
tagaggcttctccgccagcctc

SEQ ID NO: 1556985 - DNA, 21 bp, Homo sapiens
tagagggacggccaagaatgt

SEQ ID NO: 1556986 - DNA, 14 bp, Homo sapiens
tagagggcccatca

SEQ ID NO: 1556987 - DNA, 16 bp, Homo sapiens
tagaggggaaggaaat

SEQ ID NO: 1556988 - DNA, 14 bp, Homo sapiens
tagaggtgagaaaa

SEQ ID NO: 1556989 - DNA, 16 bp, Homo sapiens
tagaggtgggcagctg

SEQ ID NO: 1556990 - DNA, 15 bp, Homo sapiens
tagaggttttaaagt

SEQ ID NO: 1556991 - DNA, 17 bp, Homo sapiens
tagagtaaaaagaaaac

SEQ ID NO: 1556992 - DNA, 17 bp, Homo sapiens
taccttatagttactgt

SEQ ID NO: 1556993 - DNA, 16 bp, Homo sapiens
taccttatttattttt

SEQ ID NO: 1556994 - DNA, 18 bp, Homo sapiens
taccttatttatttttgt

SEQ ID NO: 1556995 - DNA, 15 bp, Homo sapiens
taccttcaatactta

SEQ ID NO: 1556996 - DNA, 18 bp, Homo sapiens
taccttccactctggaac

SEQ ID NO: 1556997 - DNA, 17 bp, Homo sapiens
taccttctggttgcttc

SEQ ID NO: 1556998 - DNA, 13 bp, Homo sapiens
taccttgcagtgt

SEQ ID NO: 1556999 - DNA, 22 bp, Homo sapiens
taccttgcctccttttttctta

SEQ ID NO: 1557000 - DNA, 22 bp, Homo sapiens
taccttgttatttaacccattt

SEQ ID NO: 1557001 - DNA, 14 bp, Homo sapiens
tacctttatggttt

SEQ ID NO: 1557002 - DNA, 17 bp, Homo sapiens
taccttttctcttttct

SEQ ID NO: 1557003 - DNA, 12 bp, Homo sapiens
taccttttgtag

SEQ ID NO: 1557004 - DNA, 20 bp, Homo sapiens
tacctttttatttgcatgtg

SEQ ID NO: 1557005 - DNA, 19 bp, Homo sapiens
tacctttttttttcttttt

SEQ ID NO: 1557006 - DNA, 16 bp, Homo sapiens
taccttttttttttct

SEQ ID NO: 1557007 - DNA, 18 bp, Homo sapiens
taccttttttttttcttg

SEQ ID NO: 1557008 - DNA, 13 bp, Homo sapiens
tacgaagaggggt

SEQ ID NO: 1557009 - DNA, 20 bp, Homo sapiens
tacgaagagtatttttgaca

SEQ ID NO: 1557010 - DNA, 19 bp, Homo sapiens
tacgacgtgggaatttcaa

SEQ ID NO: 1557011 - DNA, 19 bp, Homo sapiens
tacgagagcagaggtctcc

SEQ ID NO: 1557012 - DNA, 14 bp, Homo sapiens
tacgagttttccct

SEQ ID NO: 1557013 - DNA, 14 bp, Homo sapiens
tacgatacgctact

SEQ ID NO: 1557014 - DNA, 19 bp, Homo sapiens
tacgatcaagttgttgact

SEQ ID NO: 1557015 - DNA, 13 bp, Homo sapiens
tacgatttcacta

SEQ ID NO: 1557016 - DNA, 16 bp, Homo sapiens
tacgcccatctcagga

SEQ ID NO: 1557017 - DNA, 13 bp, Homo sapiens
tacgcctcttctg

SEQ ID NO: 1557018 - DNA, 20 bp, Homo sapiens
tacgctttgtcacacaaaaa

SEQ ID NO: 1557019 - DNA, 17 bp, Homo sapiens
tacgcttttctttgtta

SEQ ID NO: 1557020 - DNA, 12 bp, Homo sapiens
tacggagaagaa

SEQ ID NO: 1557021 - DNA, 22 bp, Homo sapiens
tacggatttgtccaaataaatt

SEQ ID NO: 1557022 - DNA, 21 bp, Homo sapiens
tacggcatcacacttatattt

SEQ ID NO: 1557023 - DNA, 16 bp, Homo sapiens
tacgggcgctgcagcc

SEQ ID NO: 1557024 - DNA, 18 bp, Homo sapiens
tacgggcgctgcagcctc

SEQ ID NO: 1557025 - DNA, 21 bp, Homo sapiens
tacgggggcacttggaggacc

SEQ ID NO: 1557026 - DNA, 16 bp, Homo sapiens
tacgggggctgtgact

SEQ ID NO: 1557027 - DNA, 16 bp, Homo sapiens
tacgtataaatatcag

SEQ ID NO: 1557028 - DNA, 20 bp, Homo sapiens
tacgtataaatatcagtatt

SEQ ID NO: 1557029 - DNA, 19 bp, Homo sapiens
tacgtcccgctgctgtgct

SEQ ID NO: 1557030 - DNA, 17 bp, Homo sapiens
tacgtgagggggagctg

SEQ ID NO: 1557031 - DNA, 23 bp, Homo sapiens
tacgtgatctctgttacaaaaga

SEQ ID NO: 1557032 - DNA, 20 bp, Homo sapiens
tacgtgccagatataactgt

SEQ ID NO: 1557033 - DNA, 18 bp, Homo sapiens
tacgtgggtgccctctcc

SEQ ID NO: 1557034 - DNA, 22 bp, Homo sapiens
tacgtgttaggaggctgcatgc

SEQ ID NO: 1557035 - DNA, 13 bp, Homo sapiens
tacgtttgtatgt

SEQ ID NO: 1557036 - DNA, 14 bp, Homo sapiens
tacgtttgtgcaga

SEQ ID NO: 1557037 - DNA, 20 bp, Homo sapiens
tacgtttgtgcagaatctct

SEQ ID NO: 1557038 - DNA, 18 bp, Homo sapiens
tactaaaaaaaagatgaa

SEQ ID NO: 1557039 - DNA, 14 bp, Homo sapiens
tactaaagaaagat

SEQ ID NO: 1557040 - DNA, 16 bp, Homo sapiens
tactaactaaatacca

SEQ ID NO: 1557041 - DNA, 21 bp, Homo sapiens
tactaagaatgtccttattct

SEQ ID NO: 1557042 - DNA, 16 bp, Homo sapiens
tactaaggacgttgtt

SEQ ID NO: 1557043 - DNA, 14 bp, Homo sapiens
tactaagttcacat

SEQ ID NO: 1557044 - DNA, 20 bp, Homo sapiens
tactaatagaataaaggcag

SEQ ID NO: 1557045 - DNA, 23 bp, Homo sapiens
tactaatagaataaaggcagttt

SEQ ID NO: 1557046 - DNA, 12 bp, Homo sapiens
tactaatctgag

SEQ ID NO: 1557047 - DNA, 13 bp, Homo sapiens
tactaatctgaga

SEQ ID NO: 1557048 - DNA, 14 bp, Homo sapiens
tactaatctgagat

SEQ ID NO: 1557049 - DNA, 16 bp, Homo sapiens
tactaatctgagattg

SEQ ID NO: 1557050 - DNA, 17 bp, Homo sapiens
tactaatgatgctttta

SEQ ID NO: 1557051 - DNA, 13 bp, Homo sapiens
tactaatgatgtt

SEQ ID NO: 1557052 - DNA, 14 bp, Homo sapiens
tactaatgatgttt

SEQ ID NO: 1557053 - DNA, 16 bp, Homo sapiens
tactaatgatgttttc

SEQ ID NO: 1557054 - DNA, 13 bp, Homo sapiens
tactaatttcagt

SEQ ID NO: 1557055 - DNA, 17 bp, Homo sapiens
tactaattttacacatt

SEQ ID NO: 1557056 - DNA, 16 bp, Homo sapiens
tactaattttctagat

SEQ ID NO: 1557057 - DNA, 16 bp, Homo sapiens
tactacagaaattctg

SEQ ID NO: 1557058 - DNA, 13 bp, Homo sapiens
tactcagccctgg

SEQ ID NO: 1557059 - DNA, 14 bp, Homo sapiens
tactcagccctggg

SEQ ID NO: 1557060 - DNA, 14 bp, Homo sapiens
tactcaggaagaac

SEQ ID NO: 1557061 - DNA, 21 bp, Homo sapiens
tactcaggaggctgaggcagg

SEQ ID NO: 1557062 - DNA, 19 bp, Homo sapiens
tactcagtgttagagaaat

SEQ ID NO: 1557063 - DNA, 18 bp, Homo sapiens
tactcattccttgtgtgt

SEQ ID NO: 1557064 - DNA, 15 bp, Homo sapiens
tactcatttttcatt

SEQ ID NO: 1557065 - DNA, 17 bp, Homo sapiens
tactccacaccttttat

SEQ ID NO: 1557066 - DNA, 22 bp, Homo sapiens
tactccacagcggaggagacca

SEQ ID NO: 1557067 - DNA, 21 bp, Homo sapiens
tactccactcccagcagctca

SEQ ID NO: 1557068 - DNA, 21 bp, Homo sapiens
tactccactgccctggcagca

SEQ ID NO: 1557069 - DNA, 18 bp, Homo sapiens
tactccatacataacttg

SEQ ID NO: 1557070 - DNA, 22 bp, Homo sapiens
tactccctcaaagcacacgtca

SEQ ID NO: 1557071 - DNA, 13 bp, Homo sapiens
tactccctgcaga

SEQ ID NO: 1557072 - DNA, 13 bp, Homo sapiens
tactcccttcctg

SEQ ID NO: 1557073 - DNA, 17 bp, Homo sapiens
tactcccttcctggcct

SEQ ID NO: 1557074 - DNA, 20 bp, Homo sapiens
tactccgtgaggctgctgcc

SEQ ID NO: 1557075 - DNA, 15 bp, Homo sapiens
tactcctacctcagc

SEQ ID NO: 1557076 - DNA, 16 bp, Homo sapiens
tactcctacctcagcc

SEQ ID NO: 1557077 - DNA, 14 bp, Homo sapiens
tactcctagaagaa

SEQ ID NO: 1557078 - DNA, 17 bp, Homo sapiens
tactcctagaagaacca

SEQ ID NO: 1557079 - DNA, 21 bp, Homo sapiens
tactcctagaagaaccaaata

SEQ ID NO: 1557080 - DNA, 22 bp, Homo sapiens
tactcctctgcagtgccttggg

SEQ ID NO: 1557081 - DNA, 17 bp, Homo sapiens
tactcctgtgctctgga

SEQ ID NO: 1557082 - DNA, 14 bp, Homo sapiens
tactccttaagaac

SEQ ID NO: 1557083 - DNA, 22 bp, Homo sapiens
tactcgggaggctgaggcagga

SEQ ID NO: 1557084 - DNA, 16 bp, Homo sapiens
tactctaaagaaaaat

SEQ ID NO: 1557085 - DNA, 13 bp, Homo sapiens
tactctaagatct

SEQ ID NO: 1557086 - DNA, 20 bp, Homo sapiens
tactctaagatcttagattc

SEQ ID NO: 1557087 - DNA, 22 bp, Homo sapiens
tactctagcctgggccagagaa

SEQ ID NO: 1557088 - DNA, 14 bp, Homo sapiens
tactctcagcacca

SEQ ID NO: 1557089 - DNA, 14 bp, Homo sapiens
tactctcattcttt

SEQ ID NO: 1557090 - DNA, 16 bp, Homo sapiens
tactctccaacctgga

SEQ ID NO: 1557091 - DNA, 18 bp, Homo sapiens
tactctccaacctggaca

SEQ ID NO: 1557092 - DNA, 20 bp, Homo sapiens
tactctccccacgagggctg

SEQ ID NO: 1557093 - DNA, 22 bp, Homo sapiens
tactctccccacgagggctggc

SEQ ID NO: 1557094 - DNA, 19 bp, Homo sapiens
tactctcctcggccccctc

SEQ ID NO: 1557095 - DNA, 21 bp, Homo sapiens
tactctccttgagtgtatgag

SEQ ID NO: 1557096 - DNA, 14 bp, Homo sapiens
tactctctgctcta

SEQ ID NO: 1557097 - DNA, 14 bp, Homo sapiens
tactctgaaaagca

SEQ ID NO: 1557098 - DNA, 12 bp, Homo sapiens
tactctgagccc

SEQ ID NO: 1557099 - DNA, 13 bp, Homo sapiens
tactctgagccca

SEQ ID NO: 1557100 - DNA, 15 bp, Homo sapiens
tactctgagcccagg

SEQ ID NO: 1557101 - DNA, 16 bp, Homo sapiens
tactctgagcccaggc

SEQ ID NO: 1557102 - DNA, 13 bp, Homo sapiens
tactctgtccagg

SEQ ID NO: 1557103 - DNA, 16 bp, Homo sapiens
tactctgtccaggcca

SEQ ID NO: 1557104 - DNA, 19 bp, Homo sapiens
tactcttacagagccttga

SEQ ID NO: 1557105 - DNA, 21 bp, Homo sapiens
tactcttaggaagagaaacca

SEQ ID NO: 1557106 - DNA, 17 bp, Homo sapiens
tactcttgctgatggct

SEQ ID NO: 1557107 - DNA, 14 bp, Homo sapiens
tactcttgtcattt

SEQ ID NO: 1557108 - DNA, 19 bp, Homo sapiens
tactctttttcaataaatt

SEQ ID NO: 1557109 - DNA, 21 bp, Homo sapiens
tactgaacacatgtgtatgat

SEQ ID NO: 1557110 - DNA, 12 bp, Homo sapiens
tactgaaggaaa

SEQ ID NO: 1557111 - DNA, 14 bp, Homo sapiens
tactgaaggaaaaa

SEQ ID NO: 1557112 - DNA, 20 bp, Homo sapiens
tactgaaggaaaaacacaag

SEQ ID NO: 1557113 - DNA, 19 bp, Homo sapiens
tactgaagtcttttctgtc

SEQ ID NO: 1557114 - DNA, 18 bp, Homo sapiens
tactgaataatgctacca

SEQ ID NO: 1557115 - DNA, 22 bp, Homo sapiens
tactgaattggcttccagattt

SEQ ID NO: 1557116 - DNA, 12 bp, Homo sapiens
tactgaattttt

SEQ ID NO: 1557117 - DNA, 21 bp, Homo sapiens
tactgacagggagcagccccc

SEQ ID NO: 1557118 - DNA, 11 bp, Homo sapiens
tactgacctac

SEQ ID NO: 1557119 - DNA, 23 bp, Homo sapiens
tactgtgtacagaattctgctac

SEQ ID NO: 1557120 - DNA, 22 bp, Homo sapiens
tactgtgtgttttcccaaagca

SEQ ID NO: 1557121 - DNA, 13 bp, Homo sapiens
tactgttactggg

SEQ ID NO: 1557122 - DNA, 15 bp, Homo sapiens
tactgttattctttg

SEQ ID NO: 1557123 - DNA, 15 bp, Homo sapiens
tactgttctaaagct

SEQ ID NO: 1557124 - DNA, 17 bp, Homo sapiens
tactgttctaaagctct

SEQ ID NO: 1557125 - DNA, 18 bp, Homo sapiens
tactgttctaaagctctg

SEQ ID NO: 1557126 - DNA, 19 bp, Homo sapiens
tactgttctaaagctctga

SEQ ID NO: 1557127 - DNA, 21 bp, Homo sapiens
tactgttctaaagctctgaca

SEQ ID NO: 1557128 - DNA, 18 bp, Homo sapiens
tactgttgctttaatatg

SEQ ID NO: 1557129 - DNA, 19 bp, Homo sapiens
tactgtttgtaatatacag

SEQ ID NO: 1557130 - DNA, 15 bp, Homo sapiens
tactgttttaattgt

SEQ ID NO: 1557131 - DNA, 19 bp, Homo sapiens
tactgttttatctggcccc

SEQ ID NO: 1557132 - DNA, 19 bp, Homo sapiens
tactgttttgaagctgggc

SEQ ID NO: 1557133 - DNA, 16 bp, Homo sapiens
tacttaaaaattaata

SEQ ID NO: 1557134 - DNA, 12 bp, Homo sapiens
tacttaaagatt

SEQ ID NO: 1557135 - DNA, 19 bp, Homo sapiens
tacttaaagatttatcaaa

SEQ ID NO: 1557136 - DNA, 17 bp, Homo sapiens
tacttaaatgaaagcat

SEQ ID NO: 1557137 - DNA, 23 bp, Homo sapiens
tacttaaatggtaataagcactg

SEQ ID NO: 1557138 - DNA, 24 bp, Homo sapiens
tacttaaatggtaataagcactgt

SEQ ID NO: 1557139 - DNA, 17 bp, Homo sapiens
tacttaaatgttatgta

SEQ ID NO: 1557140 - DNA, 19 bp, Homo sapiens
tacttaaatgttatgtata

SEQ ID NO: 1557141 - DNA, 13 bp, Homo sapiens
tacttaataaatt

SEQ ID NO: 1557142 - DNA, 19 bp, Homo sapiens
tacttaataaattcagata

SEQ ID NO: 1557143 - DNA, 16 bp, Homo sapiens
tacttacctaaacaga

SEQ ID NO: 1557144 - DNA, 15 bp, Homo sapiens
tacttactataattt

SEQ ID NO: 1557145 - DNA, 15 bp, Homo sapiens
tacttagcagctatc

SEQ ID NO: 1557146 - DNA, 14 bp, Homo sapiens
tacttagctgtact

SEQ ID NO: 1557147 - DNA, 16 bp, Homo sapiens
tacttaggttattttg

SEQ ID NO: 1557148 - DNA, 13 bp, Homo sapiens
tacttagtggtat

SEQ ID NO: 1557149 - DNA, 15 bp, Homo sapiens
tacttatcacatttt

SEQ ID NO: 1557150 - DNA, 18 bp, Homo sapiens
tacttattttaggaaatt

SEQ ID NO: 1557151 - DNA, 17 bp, Homo sapiens
tacttatttttgacagt

SEQ ID NO: 1557152 - DNA, 18 bp, Homo sapiens
tacttcaagttaaagtga

SEQ ID NO: 1557153 - DNA, 23 bp, Homo sapiens
tacttcaagttaaagtgaataac

SEQ ID NO: 1557154 - DNA, 22 bp, Homo sapiens
tacttcaggggcacttcattga

SEQ ID NO: 1557155 - DNA, 14 bp, Homo sapiens
tacttcaggtgctt

SEQ ID NO: 1557156 - DNA, 23 bp, Homo sapiens
tacttcaggtgcttttgatgtga

SEQ ID NO: 1557157 - DNA, 21 bp, Homo sapiens
tacttccataggacatactgc

SEQ ID NO: 1557158 - DNA, 14 bp, Homo sapiens
tacttcccaaagcc

SEQ ID NO: 1557159 - DNA, 19 bp, Homo sapiens
tacttccccagctctcagt

SEQ ID NO: 1557160 - DNA, 20 bp, Homo sapiens
tacttcccgggccagggctg

SEQ ID NO: 1557161 - DNA, 13 bp, Homo sapiens
tacttcccttcct

SEQ ID NO: 1557162 - DNA, 15 bp, Homo sapiens
tacttcccttcctcc

SEQ ID NO: 1557163 - DNA, 16 bp, Homo sapiens
tacttcctcctcccca

SEQ ID NO: 1557164 - DNA, 13 bp, Homo sapiens
tacttcctcctga

SEQ ID NO: 1557165 - DNA, 17 bp, Homo sapiens
tacttcctggattttct

SEQ ID NO: 1557166 - DNA, 13 bp, Homo sapiens
tacttcctgtgta

SEQ ID NO: 1557167 - DNA, 12 bp, Homo sapiens
tacttccttatg

SEQ ID NO: 1557168 - DNA, 18 bp, Homo sapiens
tacttcgtcttctaattt

SEQ ID NO: 1557169 - DNA, 20 bp, Homo sapiens
tacttctgaaataaatgttc

SEQ ID NO: 1557170 - DNA, 21 bp, Homo sapiens
tacttctggcataactaaaat

SEQ ID NO: 1557171 - DNA, 22 bp, Homo sapiens
tacttctggcataactaaaatt

SEQ ID NO: 1557172 - DNA, 20 bp, Homo sapiens
tacttctgtaattgtgtgga

SEQ ID NO: 1557173 - DNA, 22 bp, Homo sapiens
tacttctgtaattgtgtggatt

SEQ ID NO: 1557174 - DNA, 19 bp, Homo sapiens
tacttttatgatgtatatt

SEQ ID NO: 1557175 - DNA, 15 bp, Homo sapiens
tacttttcacactgt

SEQ ID NO: 1557176 - DNA, 17 bp, Homo sapiens
tacttttcacactgtct

SEQ ID NO: 1557177 - DNA, 21 bp, Homo sapiens
tacttttcacactgtcttccc

SEQ ID NO: 1557178 - DNA, 19 bp, Homo sapiens
tacttttcccatttgtaat

SEQ ID NO: 1557179 - DNA, 14 bp, Homo sapiens
tacttttgagtgtg

SEQ ID NO: 1557180 - DNA, 19 bp, Homo sapiens
tactttttagtaatttctt

SEQ ID NO: 1557181 - DNA, 16 bp, Homo sapiens
tactttttatactcca

SEQ ID NO: 1557182 - DNA, 20 bp, Homo sapiens
tactttttcccatctggctt

SEQ ID NO: 1557183 - DNA, 21 bp, Homo sapiens
tactttttcccatctggcttt

SEQ ID NO: 1557184 - DNA, 13 bp, Homo sapiens
tactttttcctgg

SEQ ID NO: 1557185 - DNA, 13 bp, Homo sapiens
tacttttttaaat

SEQ ID NO: 1557186 - DNA, 18 bp, Homo sapiens
tacttttttaaatatttt

SEQ ID NO: 1557187 - DNA, 13 bp, Homo sapiens
tacttttttatag

SEQ ID NO: 1557188 - DNA, 13 bp, Homo sapiens
tagaaaaaacaat

SEQ ID NO: 1557189 - DNA, 13 bp, Homo sapiens
tagaaaaagcagt

SEQ ID NO: 1557190 - DNA, 18 bp, Homo sapiens
tagaaaaaggggcctgag

SEQ ID NO: 1557191 - DNA, 15 bp, Homo sapiens
tagaaaaataaaatg

SEQ ID NO: 1557192 - DNA, 21 bp, Homo sapiens
tagaaaagcagtcccattcat

SEQ ID NO: 1557193 - DNA, 12 bp, Homo sapiens
tagaaaaggtga

SEQ ID NO: 1557194 - DNA, 22 bp, Homo sapiens
tagaaaaggtgataaaatcata

SEQ ID NO: 1557195 - DNA, 18 bp, Homo sapiens
tagaaaagtgaattgaag

SEQ ID NO: 1557196 - DNA, 15 bp, Homo sapiens
tagaaaataggggtt

SEQ ID NO: 1557197 - DNA, 18 bp, Homo sapiens
tagaaaatccttcagcta

SEQ ID NO: 1557198 - DNA, 22 bp, Homo sapiens
tagaaaatgacttatttctgct

SEQ ID NO: 1557199 - DNA, 24 bp, Homo sapiens
tagaaaatgtgtcctatctatctt

SEQ ID NO: 1557200 - DNA, 14 bp, Homo sapiens
tagaaaattatttg

SEQ ID NO: 1557201 - DNA, 14 bp, Homo sapiens
tagaaaattttgta

SEQ ID NO: 1557202 - DNA, 21 bp, Homo sapiens
tagaaacacataattaacact

SEQ ID NO: 1557203 - DNA, 14 bp, Homo sapiens
tagaaacagaaata

SEQ ID NO: 1557204 - DNA, 16 bp, Homo sapiens
tagaaacatgacactg

SEQ ID NO: 1557205 - DNA, 23 bp, Homo sapiens
tagaaacatggttttgaaatgct

SEQ ID NO: 1557206 - DNA, 16 bp, Homo sapiens
tagaaacgtaaactat

SEQ ID NO: 1557207 - DNA, 22 bp, Homo sapiens
tagaaacgtaaactatgaccta

SEQ ID NO: 1557208 - DNA, 17 bp, Homo sapiens
tagaaactggaaatact

SEQ ID NO: 1557209 - DNA, 15 bp, Homo sapiens
tagaaacttaaacac

SEQ ID NO: 1557210 - DNA, 19 bp, Homo sapiens
tagaaagaaaagaccctga

SEQ ID NO: 1557211 - DNA, 22 bp, Homo sapiens
tagaaagaaaagaccctgagac

SEQ ID NO: 1557212 - DNA, 23 bp, Homo sapiens
tagaaagaagcccaatattataa

SEQ ID NO: 1557213 - DNA, 17 bp, Homo sapiens
tagaaagatcgtttaaa

SEQ ID NO: 1557214 - DNA, 15 bp, Homo sapiens
tagaaagcattacat

SEQ ID NO: 1557215 - DNA, 11 bp, Homo sapiens
tagaaagctat

SEQ ID NO: 1557216 - DNA, 12 bp, Homo sapiens
tagaaagctgga

SEQ ID NO: 1557217 - DNA, 14 bp, Homo sapiens
tagaaagctggact

SEQ ID NO: 1557218 - DNA, 18 bp, Homo sapiens
tagaaagctggactgacc

SEQ ID NO: 1557219 - DNA, 20 bp, Homo sapiens
tagaaagctggactgaccaa

SEQ ID NO: 1557220 - DNA, 17 bp, Homo sapiens
tagaaaggcaaagtaca

SEQ ID NO: 1557221 - DNA, 12 bp, Homo sapiens
tagaaaggcagc

SEQ ID NO: 1557222 - DNA, 18 bp, Homo sapiens
tagaaagtgccagaaagt

SEQ ID NO: 1557223 - DNA, 11 bp, Homo sapiens
tagaaatactt

SEQ ID NO: 1557224 - DNA, 19 bp, Homo sapiens
tagagtaaaaagaaaacaa

SEQ ID NO: 1557225 - DNA, 19 bp, Homo sapiens
tagagtagaggtataattg

SEQ ID NO: 1557226 - DNA, 14 bp, Homo sapiens
tagagtatatgcac

SEQ ID NO: 1557227 - DNA, 17 bp, Homo sapiens
tagagtatttcccttcc

SEQ ID NO: 1557228 - DNA, 18 bp, Homo sapiens
tagagtcaactacacaaa

SEQ ID NO: 1557229 - DNA, 23 bp, Homo sapiens
tagagtcatctccatcagctgta

SEQ ID NO: 1557230 - DNA, 15 bp, Homo sapiens
tagagtcattgtaat

SEQ ID NO: 1557231 - DNA, 19 bp, Homo sapiens
tagagtcattgtaatgttg

SEQ ID NO: 1557232 - DNA, 16 bp, Homo sapiens
tagagtccaaggttta

SEQ ID NO: 1557233 - DNA, 17 bp, Homo sapiens
tagagtgtagactgtgg

SEQ ID NO: 1557234 - DNA, 20 bp, Homo sapiens
tagagtgtagctgtaagggc

SEQ ID NO: 1557235 - DNA, 22 bp, Homo sapiens
tagagtgtagctgtaagggcag

SEQ ID NO: 1557236 - DNA, 17 bp, Homo sapiens
tagagttaacaatgata

SEQ ID NO: 1557237 - DNA, 12 bp, Homo sapiens
tagagttcggtc

SEQ ID NO: 1557238 - DNA, 15 bp, Homo sapiens
tagagtttatacagt

SEQ ID NO: 1557239 - DNA, 18 bp, Homo sapiens
tagagtttatacagtgta

SEQ ID NO: 1557240 - DNA, 23 bp, Homo sapiens
tagagtttatacagtgtacatgt

SEQ ID NO: 1557241 - DNA, 17 bp, Homo sapiens
tagagtttgctattaga

SEQ ID NO: 1557242 - DNA, 23 bp, Homo sapiens
tagctccctgtggggcaggagtg

SEQ ID NO: 1557243 - DNA, 16 bp, Homo sapiens
tagctcctgtggcccc

SEQ ID NO: 1557244 - DNA, 21 bp, Homo sapiens
tagctctaggagggctggcaa

SEQ ID NO: 1557245 - DNA, 17 bp, Homo sapiens
tagctctattttaaagt

SEQ ID NO: 1557246 - DNA, 14 bp, Homo sapiens
tagctctgcctccc

SEQ ID NO: 1557247 - DNA, 23 bp, Homo sapiens
tagctctggggtgggcagttttt

SEQ ID NO: 1557248 - DNA, 17 bp, Homo sapiens
taggcatttcctgctga

SEQ ID NO: 1557249 - DNA, 20 bp, Homo sapiens
tagttaacacatcaaatatt

SEQ ID NO: 1557250 - DNA, 13 bp, Homo sapiens
tagttaatttatt

SEQ ID NO: 1557251 - DNA, 20 bp, Homo sapiens
tagttactgtaaaatgcaaa

SEQ ID NO: 1557252 - DNA, 16 bp, Homo sapiens
tataacagtgtttaaa

SEQ ID NO: 1557253 - DNA, 14 bp, Homo sapiens
tataacagttatat

SEQ ID NO: 1557254 - DNA, 17 bp, Homo sapiens
tataacagttatatttt

SEQ ID NO: 1557255 - DNA, 20 bp, Homo sapiens
tataaccctaggaatttaga

SEQ ID NO: 1557256 - DNA, 17 bp, Homo sapiens
tataacctagttaaaga

SEQ ID NO: 1557257 - DNA, 22 bp, Homo sapiens
tataacctagttaaagaaagga

SEQ ID NO: 1557258 - DNA, 15 bp, Homo sapiens
tataacctggcaaaa

SEQ ID NO: 1557259 - DNA, 20 bp, Homo sapiens
tataacctggcaaaatcttg

SEQ ID NO: 1557260 - DNA, 16 bp, Homo sapiens
tataactagctagaag

SEQ ID NO: 1557261 - DNA, 15 bp, Homo sapiens
tatactttacaggaa

SEQ ID NO: 1557262 - DNA, 13 bp, Homo sapiens
tatactttattga

SEQ ID NO: 1557263 - DNA, 19 bp, Homo sapiens
tatactttgttctgttgtc

SEQ ID NO: 1557264 - DNA, 22 bp, Homo sapiens
tatactttgttctgttgtctgc

SEQ ID NO: 1557265 - DNA, 15 bp, Homo sapiens
tatacttttgcttgt

SEQ ID NO: 1557266 - DNA, 23 bp, Homo sapiens
tatagaaaaataaaaatctcttt

SEQ ID NO: 1557267 - DNA, 15 bp, Homo sapiens
tatagaatatttatt

SEQ ID NO: 1557268 - DNA, 13 bp, Homo sapiens
tatagaattcaga

SEQ ID NO: 1557269 - DNA, 16 bp, Homo sapiens
tatagacaaataataa

SEQ ID NO: 1557270 - DNA, 13 bp, Homo sapiens
tatagacgctctt

SEQ ID NO: 1557271 - DNA, 18 bp, Homo sapiens
tatagagcagaaattctg

SEQ ID NO: 1557272 - DNA, 21 bp, Homo sapiens
tatagaggaccctaacacagt

SEQ ID NO: 1557273 - DNA, 19 bp, Homo sapiens
tatagatgggcaactggct

SEQ ID NO: 1557274 - DNA, 12 bp, Homo sapiens
tatagattctaa

SEQ ID NO: 1557275 - DNA, 17 bp, Homo sapiens
tatagattctaaagatt

SEQ ID NO: 1557276 - DNA, 23 bp, Homo sapiens
tatagcaatccatgttagttttt

SEQ ID NO: 1557277 - DNA, 22 bp, Homo sapiens
tatagccctgccctcccaagtc

SEQ ID NO: 1557278 - DNA, 18 bp, Homo sapiens
tatagctacatgttcttt

SEQ ID NO: 1557279 - DNA, 20 bp, Homo sapiens
tatagcttacctgaacagga

SEQ ID NO: 1557280 - DNA, 19 bp, Homo sapiens
tataggaacatatgaaaat

SEQ ID NO: 1557281 - DNA, 18 bp, Homo sapiens
tataggagccttaatttt

SEQ ID NO: 1557282 - DNA, 19 bp, Homo sapiens
tataggatattgctaattg

SEQ ID NO: 1557283 - DNA, 15 bp, Homo sapiens
tataggatcatttgt

SEQ ID NO: 1557284 - DNA, 22 bp, Homo sapiens
tataggcctgtcccttgcctct

SEQ ID NO: 1557285 - DNA, 20 bp, Homo sapiens
tataggtgatgtttgctctt

SEQ ID NO: 1557286 - DNA, 18 bp, Homo sapiens
tatagtagcttataagag

SEQ ID NO: 1557287 - DNA, 18 bp, Homo sapiens
tatagtagttacttgtga

SEQ ID NO: 1557288 - DNA, 12 bp, Homo sapiens
tatagtatatta

SEQ ID NO: 1557289 - DNA, 15 bp, Homo sapiens
tatagtatatttata

SEQ ID NO: 1557290 - DNA, 15 bp, Homo sapiens
tatagtatctgtata

SEQ ID NO: 1557291 - DNA, 20 bp, Homo sapiens
tatagtcccagctactcaga

SEQ ID NO: 1557292 - DNA, 21 bp, Homo sapiens
tatagtgcaatagtgcaacat

SEQ ID NO: 1557293 - DNA, 19 bp, Homo sapiens
tatagtgcctaaaattgta

SEQ ID NO: 1557294 - DNA, 21 bp, Homo sapiens
tatagtgttcacaaactgtga

SEQ ID NO: 1557295 - DNA, 13 bp, Homo sapiens
tatagttctagac

SEQ ID NO: 1557296 - DNA, 15 bp, Homo sapiens
tatagttctagacat

SEQ ID NO: 1557297 - DNA, 15 bp, Homo sapiens
tatagttgatatgta

SEQ ID NO: 1557298 - DNA, 14 bp, Homo sapiens
tatagttgcttgcc

SEQ ID NO: 1557299 - DNA, 18 bp, Homo sapiens
tatagttgttttatatgt

SEQ ID NO: 1557300 - DNA, 17 bp, Homo sapiens
tatagttttacttttaa

SEQ ID NO: 1557301 - DNA, 13 bp, Homo sapiens
tatagttttttct

SEQ ID NO: 1557302 - DNA, 18 bp, Homo sapiens
tatataaaaagaaaagat

SEQ ID NO: 1557303 - DNA, 19 bp, Homo sapiens
tatataaaaagaaaagata

SEQ ID NO: 1557304 - DNA, 21 bp, Homo sapiens
tatataaaacttaaaaacaag

SEQ ID NO: 1557305 - DNA, 14 bp, Homo sapiens
tatataaacaataa

SEQ ID NO: 1557306 - DNA, 13 bp, Homo sapiens
tatataaacatat

SEQ ID NO: 1557307 - DNA, 19 bp, Homo sapiens
tatataaagacaacaaaag

SEQ ID NO: 1557308 - DNA, 18 bp, Homo sapiens
tatataaagcacagattt

SEQ ID NO: 1557309 - DNA, 13 bp, Homo sapiens
tatataaatcatt

SEQ ID NO: 1557310 - DNA, 13 bp, Homo sapiens
tatataaatgtat

SEQ ID NO: 1557311 - DNA, 14 bp, Homo sapiens
tatataactttttt

SEQ ID NO: 1557312 - DNA, 22 bp, Homo sapiens
tatataatttttttatgttttg

SEQ ID NO: 1557313 - DNA, 14 bp, Homo sapiens
tatatacagtaact

SEQ ID NO: 1557314 - DNA, 17 bp, Homo sapiens
tatatacagtaacttta

SEQ ID NO: 1557315 - DNA, 19 bp, Homo sapiens
tatatacctggcttttact

SEQ ID NO: 1557316 - DNA, 22 bp, Homo sapiens
tatatacctggcttttacttta

SEQ ID NO: 1557317 - DNA, 18 bp, Homo sapiens
tatatactgctatttaca

SEQ ID NO: 1557318 - DNA, 20 bp, Homo sapiens
tatatactgctatttacact

SEQ ID NO: 1557319 - DNA, 19 bp, Homo sapiens
tatatacttagctatattt

SEQ ID NO: 1557320 - DNA, 14 bp, Homo sapiens
tatatagaacacaa

SEQ ID NO: 1557321 - DNA, 16 bp, Homo sapiens
tatatagaacacaagg

SEQ ID NO: 1557322 - DNA, 23 bp, Homo sapiens
tatatagaacacaagggatataa

SEQ ID NO: 1557323 - DNA, 17 bp, Homo sapiens
tatataggcagttgcat

SEQ ID NO: 1557324 - DNA, 13 bp, Homo sapiens
tatatagttcctt

SEQ ID NO: 1557325 - DNA, 18 bp, Homo sapiens
tatatagttccttgcctt

SEQ ID NO: 1557326 - DNA, 13 bp, Homo sapiens
tatatataaaacg

SEQ ID NO: 1557327 - DNA, 15 bp, Homo sapiens
tatatataaatgtat

SEQ ID NO: 1557328 - DNA, 17 bp, Homo sapiens
tatatataataaatact

SEQ ID NO: 1557329 - DNA, 23 bp, Homo sapiens
tatatataataaatactcagtga

SEQ ID NO: 1557330 - DNA, 13 bp, Homo sapiens
tatatatacagta

SEQ ID NO: 1557331 - DNA, 16 bp, Homo sapiens
tatatatacatatgta

SEQ ID NO: 1557332 - DNA, 13 bp, Homo sapiens
tatatatagaatc

SEQ ID NO: 1557333 - DNA, 15 bp, Homo sapiens
tatatatatatagta

SEQ ID NO: 1557334 - DNA, 13 bp, Homo sapiens
tatatatatatgt

SEQ ID NO: 1557335 - DNA, 14 bp, Homo sapiens
tatatatatatgta

SEQ ID NO: 1557336 - DNA, 13 bp, Homo sapiens
tatatatatgtat

SEQ ID NO: 1557337 - DNA, 14 bp, Homo sapiens
tatatatatgtata

SEQ ID NO: 1557338 - DNA, 15 bp, Homo sapiens
tatatatatgtatat

SEQ ID NO: 1557339 - DNA, 12 bp, Homo sapiens
tatatatctttt

SEQ ID NO: 1557340 - DNA, 19 bp, Homo sapiens
tatatatgcacacatatat

SEQ ID NO: 1557341 - DNA, 20 bp, Homo sapiens
tatatatgcacacatatata

SEQ ID NO: 1557342 - DNA, 18 bp, Homo sapiens
tatatatggtcatataca

SEQ ID NO: 1557343 - DNA, 17 bp, Homo sapiens
tatatattcttataaaa

SEQ ID NO: 1557344 - DNA, 20 bp, Homo sapiens
tatatatttattttattcta

SEQ ID NO: 1557345 - DNA, 23 bp, Homo sapiens
tatatattttaaggttgcacaca

SEQ ID NO: 1557346 - DNA, 18 bp, Homo sapiens
tatatattttgttgttcc

SEQ ID NO: 1557347 - DNA, 12 bp, Homo sapiens
tatatcatattt

SEQ ID NO: 1557348 - DNA, 14 bp, Homo sapiens
tatatcatatttct

SEQ ID NO: 1557349 - DNA, 19 bp, Homo sapiens
tatatcatatttctgtgga

SEQ ID NO: 1557350 - DNA, 17 bp, Homo sapiens
tatatcatgaaacactt

SEQ ID NO: 1557351 - DNA, 16 bp, Homo sapiens
tatatcattctaaaga

SEQ ID NO: 1557352 - DNA, 16 bp, Homo sapiens
tatatccctgataaat

SEQ ID NO: 1557353 - DNA, 19 bp, Homo sapiens
tatatccctgataaatatt

SEQ ID NO: 1557354 - DNA, 17 bp, Homo sapiens
tatatcctttctaacaa

SEQ ID NO: 1557355 - DNA, 20 bp, Homo sapiens
tatatcctttctaacaaaaa

SEQ ID NO: 1557356 - DNA, 19 bp, Homo sapiens
tatatctcttttggtccca

SEQ ID NO: 1557357 - DNA, 14 bp, Homo sapiens
tatatctgagcaag

SEQ ID NO: 1557358 - DNA, 16 bp, Homo sapiens
tatatctgagcaagga

SEQ ID NO: 1557359 - DNA, 21 bp, Homo sapiens
tatatctgtaaatttaactgc

SEQ ID NO: 1557360 - DNA, 14 bp, Homo sapiens
tatatctgtatata

SEQ ID NO: 1557361 - DNA, 14 bp, Homo sapiens
tatatcttaagcag

SEQ ID NO: 1557362 - DNA, 21 bp, Homo sapiens
tatatgaccatatttactctt

SEQ ID NO: 1557363 - DNA, 18 bp, Homo sapiens
tatatgagactttatgtg

SEQ ID NO: 1557364 - DNA, 19 bp, Homo sapiens
tatatgaggacttgtgtct

SEQ ID NO: 1557365 - DNA, 14 bp, Homo sapiens
tatatgatttagca

SEQ ID NO: 1557366 - DNA, 22 bp, Homo sapiens
tatatgcatatatatatgtgtg

SEQ ID NO: 1557367 - DNA, 16 bp, Homo sapiens
tatatgcctgattcat

SEQ ID NO: 1557368 - DNA, 21 bp, Homo sapiens
tatatgcttactgatatattt

SEQ ID NO: 1557369 - DNA, 13 bp, Homo sapiens
tatatggataatg

SEQ ID NO: 1557370 - DNA, 14 bp, Homo sapiens
tatatggcaaatag

SEQ ID NO: 1557371 - DNA, 16 bp, Homo sapiens
tatatggcaaatagcc

SEQ ID NO: 1557372 - DNA, 15 bp, Homo sapiens
tatatggtatatata

SEQ ID NO: 1557373 - DNA, 22 bp, Homo sapiens
tatatggtatatatacatatat

SEQ ID NO: 1557374 - DNA, 22 bp, Homo sapiens
tatatggtggtaataagggaaa

SEQ ID NO: 1557375 - DNA, 19 bp, Homo sapiens
tatatgtagtgcattttta

SEQ ID NO: 1557376 - DNA, 14 bp, Homo sapiens
tatatgtataatat

SEQ ID NO: 1557377 - DNA, 21 bp, Homo sapiens
tatatgtatatatatatagta

SEQ ID NO: 1557378 - DNA, 11 bp, Homo sapiens
tatcacagtgt

SEQ ID NO: 1557379 - DNA, 13 bp, Homo sapiens
tatcacagtgttt

SEQ ID NO: 1557380 - DNA, 18 bp, Homo sapiens
tatcacattaatctcaaa

SEQ ID NO: 1557381 - DNA, 13 bp, Homo sapiens
tatcacattattt

SEQ ID NO: 1557382 - DNA, 23 bp, Homo sapiens
tatcacattttattaaacacagg

SEQ ID NO: 1557383 - DNA, 17 bp, Homo sapiens
tatcacctcattctgaa

SEQ ID NO: 1557384 - DNA, 18 bp, Homo sapiens
tatcacctctcttcagcc

SEQ ID NO: 1557385 - DNA, 16 bp, Homo sapiens
tatcacgatttgcagg

SEQ ID NO: 1557386 - DNA, 14 bp, Homo sapiens
tatcagaaatacaa

SEQ ID NO: 1557387 - DNA, 13 bp, Homo sapiens
tatcagacaagca

SEQ ID NO: 1557388 - DNA, 15 bp, Homo sapiens
tatcagacaagcact

SEQ ID NO: 1557389 - DNA, 20 bp, Homo sapiens
tatcagacaagcactatttt

SEQ ID NO: 1557390 - DNA, 22 bp, Homo sapiens
tatcagaggtctatttttacct

SEQ ID NO: 1557391 - DNA, 18 bp, Homo sapiens
tatcagctttgataattg

SEQ ID NO: 1557392 - DNA, 15 bp, Homo sapiens
tatcagtaaataact

SEQ ID NO: 1557393 - DNA, 16 bp, Homo sapiens
tatcagtattctgaca

SEQ ID NO: 1557394 - DNA, 18 bp, Homo sapiens
tatcagtcgttttagtgt

SEQ ID NO: 1557395 - DNA, 15 bp, Homo sapiens
tatcagtgacagagt

SEQ ID NO: 1557396 - DNA, 17 bp, Homo sapiens
tatcagtgacagagttc

SEQ ID NO: 1557397 - DNA, 20 bp, Homo sapiens
tatcagtgacagagttcact

SEQ ID NO: 1557398 - DNA, 23 bp, Homo sapiens
tatcagtgctcgagacacagtga

SEQ ID NO: 1557399 - DNA, 17 bp, Homo sapiens
tatcagtgtcctttcca

SEQ ID NO: 1557400 - DNA, 14 bp, Homo sapiens
tatcagttaccaaa

SEQ ID NO: 1557401 - DNA, 16 bp, Homo sapiens
tatcagttacccactc

SEQ ID NO: 1557402 - DNA, 15 bp, Homo sapiens
tatcagttgcaataa

SEQ ID NO: 1557403 - DNA, 18 bp, Homo sapiens
tacccacatgtacagaca

SEQ ID NO: 1557404 - DNA, 17 bp, Homo sapiens
tacccactcggtcccag

SEQ ID NO: 1557405 - DNA, 14 bp, Homo sapiens
tacccagccatctg

SEQ ID NO: 1557406 - DNA, 19 bp, Homo sapiens
tacccagccatctgcccag

SEQ ID NO: 1557407 - DNA, 23 bp, Homo sapiens
tacccagccatctgcccaggggt

SEQ ID NO: 1557408 - DNA, 16 bp, Homo sapiens
tacccagggctctgca

SEQ ID NO: 1557409 - DNA, 22 bp, Homo sapiens
tacccataaacagcacacctgt

SEQ ID NO: 1557410 - DNA, 23 bp, Homo sapiens
tacccataaacagcacacctgtg

SEQ ID NO: 1557411 - DNA, 16 bp, Homo sapiens
tacccatagacatgaa

SEQ ID NO: 1557412 - DNA, 21 bp, Homo sapiens
tacccatctagtacttgaaaa

SEQ ID NO: 1557413 - DNA, 24 bp, Homo sapiens
tacccatctctctactgctggact

SEQ ID NO: 1557414 - DNA, 13 bp, Homo sapiens
tacccatgcacag

SEQ ID NO: 1557415 - DNA, 15 bp, Homo sapiens
tacccattctgtttt

SEQ ID NO: 1557416 - DNA, 22 bp, Homo sapiens
tacccattctgttttcccccag

SEQ ID NO: 1557417 - DNA, 19 bp, Homo sapiens
tacccattgccccagacct

SEQ ID NO: 1557418 - DNA, 22 bp, Homo sapiens
taccccaccacgatgtggccct

SEQ ID NO: 1557419 - DNA, 14 bp, Homo sapiens
taccccaccctcag

SEQ ID NO: 1557420 - DNA, 22 bp, Homo sapiens
taccccaccctcagcacccctt

SEQ ID NO: 1557421 - DNA, 17 bp, Homo sapiens
taccccagccaggctcc

SEQ ID NO: 1557422 - DNA, 15 bp, Homo sapiens
tacccccctctgtct

SEQ ID NO: 1557423 - DNA, 16 bp, Homo sapiens
taccccctccttcaga

SEQ ID NO: 1557424 - DNA, 20 bp, Homo sapiens
tacccctctcagtctgcagt

SEQ ID NO: 1557425 - DNA, 20 bp, Homo sapiens
tacccctgctcccattcctc

SEQ ID NO: 1557426 - DNA, 22 bp, Homo sapiens
tacccctgctcccattcctccc

SEQ ID NO: 1557427 - DNA, 15 bp, Homo sapiens
taccccttggaaatg

SEQ ID NO: 1557428 - DNA, 22 bp, Homo sapiens
taccccttggaaatgtctgctg

SEQ ID NO: 1557429 - DNA, 23 bp, Homo sapiens
taccccttggaaatgtctgctgg

SEQ ID NO: 1557430 - DNA, 19 bp, Homo sapiens
tacccgagcccagctacat

SEQ ID NO: 1557431 - DNA, 21 bp, Homo sapiens
tacccgagcccagctacattc

SEQ ID NO: 1557432 - DNA, 23 bp, Homo sapiens
taccctattctatccatctcctg

SEQ ID NO: 1557433 - DNA, 14 bp, Homo sapiens
taccctcagcctcc

SEQ ID NO: 1557434 - DNA, 13 bp, Homo sapiens
taccctcccaccc

SEQ ID NO: 1557435 - DNA, 14 bp, Homo sapiens
taccctcccacccc

SEQ ID NO: 1557436 - DNA, 23 bp, Homo sapiens
taccctcgggcccacctggccac

SEQ ID NO: 1557437 - DNA, 13 bp, Homo sapiens
taccctctcagct

SEQ ID NO: 1557438 - DNA, 16 bp, Homo sapiens
taccctctcagctcca

SEQ ID NO: 1557439 - DNA, 14 bp, Homo sapiens
taccctctggaggg

SEQ ID NO: 1557440 - DNA, 22 bp, Homo sapiens
taccctctggaggggtgtggct

SEQ ID NO: 1557441 - DNA, 22 bp, Homo sapiens
taccctcttcatggatggggga

SEQ ID NO: 1557442 - DNA, 15 bp, Homo sapiens
taccctctttgctgc

SEQ ID NO: 1557443 - DNA, 18 bp, Homo sapiens
taccctgagatctgcaca

SEQ ID NO: 1557444 - DNA, 17 bp, Homo sapiens
taccctgagttcatcca

SEQ ID NO: 1557445 - DNA, 20 bp, Homo sapiens
taccctggcagggacctgag

SEQ ID NO: 1557446 - DNA, 21 bp, Homo sapiens
taccctgggtgtccccgctgc

SEQ ID NO: 1557447 - DNA, 22 bp, Homo sapiens
taccctgtctgtcccttttctt

SEQ ID NO: 1557448 - DNA, 14 bp, Homo sapiens
tacccttaagctag

SEQ ID NO: 1557449 - DNA, 20 bp, Homo sapiens
tacccttccacctcctagag

SEQ ID NO: 1557450 - DNA, 22 bp, Homo sapiens
tacccttcccgcctccctctca

SEQ ID NO: 1557451 - DNA, 15 bp, Homo sapiens
tacccttctcctttc

SEQ ID NO: 1557452 - DNA, 16 bp, Homo sapiens
tacccttctcctttcc

SEQ ID NO: 1557453 - DNA, 17 bp, Homo sapiens
tacccttctcctttcct

SEQ ID NO: 1557454 - DNA, 21 bp, Homo sapiens
tacccttctcctttccttccc

SEQ ID NO: 1557455 - DNA, 20 bp, Homo sapiens
tacccttggctcaatcctct

SEQ ID NO: 1557456 - DNA, 23 bp, Homo sapiens
taccctttaagatatccatcttt

SEQ ID NO: 1557457 - DNA, 15 bp, Homo sapiens
tacccttttctgggg

SEQ ID NO: 1557458 - DNA, 18 bp, Homo sapiens
taccctttttctccagct

SEQ ID NO: 1557459 - DNA, 16 bp, Homo sapiens
taccgaagtaaactga

SEQ ID NO: 1557460 - DNA, 23 bp, Homo sapiens
taccgagagcttggactacacaa

SEQ ID NO: 1557461 - DNA, 15 bp, Homo sapiens
taccgatttctgcta

SEQ ID NO: 1557462 - DNA, 16 bp, Homo sapiens
taccgctcagtatttt

SEQ ID NO: 1557463 - DNA, 18 bp, Homo sapiens
taccgctggccctgccgt

SEQ ID NO: 1557464 - DNA, 18 bp, Homo sapiens
taccggattctctcttta

SEQ ID NO: 1557465 - DNA, 17 bp, Homo sapiens
taccggttgtttagaaa

SEQ ID NO: 1557466 - DNA, 23 bp, Homo sapiens
taccgtgagtgacatagcctcat

SEQ ID NO: 1557467 - DNA, 18 bp, Homo sapiens
taccgtggatttgtactt

SEQ ID NO: 1557468 - DNA, 21 bp, Homo sapiens
tacctaaaagagatttcaaga

SEQ ID NO: 1557469 - DNA, 22 bp, Homo sapiens
tacctaaaaggaaatctcaccc

SEQ ID NO: 1557470 - DNA, 23 bp, Homo sapiens
tacctaaaaggaaatctcacccc

SEQ ID NO: 1557471 - DNA, 13 bp, Homo sapiens
tacctaacatctg

SEQ ID NO: 1557472 - DNA, 22 bp, Homo sapiens
tacctaagattacaaatcagaa

SEQ ID NO: 1557473 - DNA, 17 bp, Homo sapiens
tatgatttaggcttcta

SEQ ID NO: 1557474 - DNA, 16 bp, Homo sapiens
tatgatttgttttgaa

SEQ ID NO: 1557475 - DNA, 13 bp, Homo sapiens
tatgcaaagcact

SEQ ID NO: 1557476 - DNA, 11 bp, Homo sapiens
tatgcaaatac

SEQ ID NO: 1557477 - DNA, 12 bp, Homo sapiens
tatgcaaataca

SEQ ID NO: 1557478 - DNA, 20 bp, Homo sapiens
tatgcaaatggagataaaag

SEQ ID NO: 1557479 - DNA, 17 bp, Homo sapiens
tatgcaaggaaggaaag

SEQ ID NO: 1557480 - DNA, 18 bp, Homo sapiens
tatgcaatcaaatctgct

SEQ ID NO: 1557481 - DNA, 22 bp, Homo sapiens
tatgcaatgctatcactgtctt

SEQ ID NO: 1557482 - DNA, 13 bp, Homo sapiens
tatgcacaacaga

SEQ ID NO: 1557483 - DNA, 21 bp, Homo sapiens
tatgcactgtggtttcagatg

SEQ ID NO: 1557484 - DNA, 14 bp, Homo sapiens
tatgcacttggcct

SEQ ID NO: 1557485 - DNA, 23 bp, Homo sapiens
tatgcacttttagaaatgcatat

SEQ ID NO: 1557486 - DNA, 20 bp, Homo sapiens
tatgcagaaatagacaaaaa

SEQ ID NO: 1557487 - DNA, 21 bp, Homo sapiens
tatgcagaaatagacaaaaag

SEQ ID NO: 1557488 - DNA, 23 bp, Homo sapiens
tatgcagaagcatattttgctgg

SEQ ID NO: 1557489 - DNA, 17 bp, Homo sapiens
tatgcagacagtctgtt

SEQ ID NO: 1557490 - DNA, 19 bp, Homo sapiens
tatgcagacagtctgttat

SEQ ID NO: 1557491 - DNA, 22 bp, Homo sapiens
tatgcagacagtctgttatgca

SEQ ID NO: 1557492 - DNA, 23 bp, Homo sapiens
tatgcagttgataagaggaattt

SEQ ID NO: 1557493 - DNA, 14 bp, Homo sapiens
tatgcataaagtca

SEQ ID NO: 1557494 - DNA, 17 bp, Homo sapiens
tatgcatatatatatgt

SEQ ID NO: 1557495 - DNA, 20 bp, Homo sapiens
tatgcatggtgccccaggac

SEQ ID NO: 1557496 - DNA, 21 bp, Homo sapiens
tatgcatggtgccccaggacc

SEQ ID NO: 1557497 - DNA, 17 bp, Homo sapiens
tatgcattattaaattg

SEQ ID NO: 1557498 - DNA, 12 bp, Homo sapiens
tatgcattcaca

SEQ ID NO: 1557499 - DNA, 15 bp, Homo sapiens
tatgcattcacaagg

SEQ ID NO: 1557500 - DNA, 23 bp, Homo sapiens
tatgcattcacatttagaaaagt

SEQ ID NO: 1557501 - DNA, 17 bp, Homo sapiens
tatgccaaagatcactt

SEQ ID NO: 1557502 - DNA, 22 bp, Homo sapiens
tatgccacgggaagtttagaga

SEQ ID NO: 1557503 - DNA, 14 bp, Homo sapiens
tatgccacttcctt

SEQ ID NO: 1557504 - DNA, 19 bp, Homo sapiens
tatgcccggcgccgggcac

SEQ ID NO: 1557505 - DNA, 23 bp, Homo sapiens
tatgccggatgtgcttttctcca

SEQ ID NO: 1557506 - DNA, 16 bp, Homo sapiens
tatgcctctgtattta

SEQ ID NO: 1557507 - DNA, 20 bp, Homo sapiens
tatgcctgagttataaatat

SEQ ID NO: 1557508 - DNA, 23 bp, Homo sapiens
tatgcctgagttataaatatttt

SEQ ID NO: 1557509 - DNA, 14 bp, Homo sapiens
tatgccttaagcag

SEQ ID NO: 1557510 - DNA, 16 bp, Homo sapiens
tatgccttaagcagaa

SEQ ID NO: 1557511 - DNA, 19 bp, Homo sapiens
tatgccttcttattgcttt

SEQ ID NO: 1557512 - DNA, 21 bp, Homo sapiens
tatgctagtttattggaagtg

SEQ ID NO: 1557513 - DNA, 21 bp, Homo sapiens
tatgctcttgaaatattcaga

SEQ ID NO: 1557514 - DNA, 20 bp, Homo sapiens
tatgctgatcatcgccagag

SEQ ID NO: 1557515 - DNA, 11 bp, Homo sapiens
tatgctgccca

SEQ ID NO: 1557516 - DNA, 20 bp, Homo sapiens
tatgctgctttaaacttgga

SEQ ID NO: 1557517 - DNA, 14 bp, Homo sapiens
tatgctggtagatg

SEQ ID NO: 1557518 - DNA, 12 bp, Homo sapiens
tatgctggtggt

SEQ ID NO: 1557519 - DNA, 13 bp, Homo sapiens
tatgctgtatttt

SEQ ID NO: 1557520 - DNA, 15 bp, Homo sapiens
tatgctgtcatggtc

SEQ ID NO: 1557521 - DNA, 19 bp, Homo sapiens
tatgcttaaaataagcagg

SEQ ID NO: 1557522 - DNA, 15 bp, Homo sapiens
tatgcttactcttgc

SEQ ID NO: 1557523 - DNA, 19 bp, Homo sapiens
tatgcttaggccagtcagt

SEQ ID NO: 1557524 - DNA, 18 bp, Homo sapiens
tatgcttccacaggcaaa

SEQ ID NO: 1557525 - DNA, 16 bp, Homo sapiens
tatgcttgggccctgc

SEQ ID NO: 1557526 - DNA, 13 bp, Homo sapiens
tatgctttattaa

SEQ ID NO: 1557527 - DNA, 21 bp, Homo sapiens
tatgctttccctgaggaatga

SEQ ID NO: 1557528 - DNA, 21 bp, Homo sapiens
tatgctttttctcagatctgg

SEQ ID NO: 1557529 - DNA, 17 bp, Homo sapiens
tatggaaataaatgtat

SEQ ID NO: 1557530 - DNA, 16 bp, Homo sapiens
tatggaaatgcaaact

SEQ ID NO: 1557531 - DNA, 13 bp, Homo sapiens
tatggaactctct

SEQ ID NO: 1557532 - DNA, 14 bp, Homo sapiens
tatggaagaaagta

SEQ ID NO: 1557533 - DNA, 19 bp, Homo sapiens
tatggaagggtttgtggct

SEQ ID NO: 1557534 - DNA, 14 bp, Homo sapiens
tatggaattacatg

SEQ ID NO: 1557535 - DNA, 22 bp, Homo sapiens
tatggacactggtgccatgtca

SEQ ID NO: 1557536 - DNA, 15 bp, Homo sapiens
tatggacgtgtgtga

SEQ ID NO: 1557537 - DNA, 17 bp, Homo sapiens
tatggactatctgtctg

SEQ ID NO: 1557538 - DNA, 15 bp, Homo sapiens
tatggatatatttga

SEQ ID NO: 1557539 - DNA, 19 bp, Homo sapiens
tatggatgattcagaaatt

SEQ ID NO: 1557540 - DNA, 20 bp, Homo sapiens
tatggatgattcagaaattg

SEQ ID NO: 1557541 - DNA, 16 bp, Homo sapiens
tatggatgatttaagt

SEQ ID NO: 1557542 - DNA, 14 bp, Homo sapiens
tatggcagcgaaag

SEQ ID NO: 1557543 - DNA, 14 bp, Homo sapiens
tatggcatttctat

SEQ ID NO: 1557544 - DNA, 12 bp, Homo sapiens
tatggcccagaa

SEQ ID NO: 1557545 - DNA, 23 bp, Homo sapiens
tatggcctcagctgcctcacttc

SEQ ID NO: 1557546 - DNA, 17 bp, Homo sapiens
tatggctcactatgaat

SEQ ID NO: 1557547 - DNA, 13 bp, Homo sapiens
tatggctgcccag

SEQ ID NO: 1557548 - DNA, 14 bp, Homo sapiens
tatggctgcccagg

SEQ ID NO: 1557549 - DNA, 15 bp, Homo sapiens
taacaggccaaagag

SEQ ID NO: 1557550 - DNA, 18 bp, Homo sapiens
taacagggagaagtagct

SEQ ID NO: 1557551 - DNA, 17 bp, Homo sapiens
taacagggattgatttt

SEQ ID NO: 1557552 - DNA, 13 bp, Homo sapiens
taacagtcattta

SEQ ID NO: 1557553 - DNA, 18 bp, Homo sapiens
taacagtcatttaaaaaa

SEQ ID NO: 1557554 - DNA, 18 bp, Homo sapiens
taacagtggctgcttctc

SEQ ID NO: 1557555 - DNA, 22 bp, Homo sapiens
taacagttatatttttgtgttt

SEQ ID NO: 1557556 - DNA, 16 bp, Homo sapiens
taacataaaatctgtg

SEQ ID NO: 1557557 - DNA, 19 bp, Homo sapiens
taacatagtgtctgctgct

SEQ ID NO: 1557558 - DNA, 23 bp, Homo sapiens
taacatataatgttgttatttaa

SEQ ID NO: 1557559 - DNA, 15 bp, Homo sapiens
taacatatctaaagt

SEQ ID NO: 1557560 - DNA, 16 bp, Homo sapiens
taacatatctaaagtc

SEQ ID NO: 1557561 - DNA, 17 bp, Homo sapiens
taacatatctaaagtca

SEQ ID NO: 1557562 - DNA, 17 bp, Homo sapiens
taacatattcttgcttt

SEQ ID NO: 1557563 - DNA, 19 bp, Homo sapiens
taacatattcttgctttca

SEQ ID NO: 1557564 - DNA, 17 bp, Homo sapiens
taacatcataattacat

SEQ ID NO: 1557565 - DNA, 13 bp, Homo sapiens
taacatccaagcc

SEQ ID NO: 1557566 - DNA, 16 bp, Homo sapiens
taacatccaagccaga

SEQ ID NO: 1557567 - DNA, 18 bp, Homo sapiens
taacatccaagccagagt

SEQ ID NO: 1557568 - DNA, 16 bp, Homo sapiens
taacatcgtgggtcac

SEQ ID NO: 1557569 - DNA, 16 bp, Homo sapiens
taacatctgaaaagaa

SEQ ID NO: 1557570 - DNA, 18 bp, Homo sapiens
taacatctgaaaagaaat

SEQ ID NO: 1557571 - DNA, 22 bp, Homo sapiens
taacatctttattgaaattcta

SEQ ID NO: 1557572 - DNA, 21 bp, Homo sapiens
taacatgaacacccttagaaa

SEQ ID NO: 1557573 - DNA, 23 bp, Homo sapiens
taacatggacatgatcttcttta

SEQ ID NO: 1557574 - DNA, 11 bp, Homo sapiens
taacatgggct

SEQ ID NO: 1557575 - DNA, 21 bp, Homo sapiens
taacatgggctcttcactagt

SEQ ID NO: 1557576 - DNA, 22 bp, Homo sapiens
taacattaggaccttagaattt

SEQ ID NO: 1557577 - DNA, 12 bp, Homo sapiens
taacattattta

SEQ ID NO: 1557578 - DNA, 16 bp, Homo sapiens
taacattatttatatg

SEQ ID NO: 1557579 - DNA, 11 bp, Homo sapiens
taacattcctc

SEQ ID NO: 1557580 - DNA, 22 bp, Homo sapiens
taacattcctcatgaatgtaaa

SEQ ID NO: 1557581 - DNA, 15 bp, Homo sapiens
taacattctttttct

SEQ ID NO: 1557582 - DNA, 15 bp, Homo sapiens
taacattgaccaaga

SEQ ID NO: 1557583 - DNA, 18 bp, Homo sapiens
taacattgaccaagaact

SEQ ID NO: 1557584 - DNA, 19 bp, Homo sapiens
taactgattacctgccaat

SEQ ID NO: 1557585 - DNA, 20 bp, Homo sapiens
taactgcaattttaattgat

SEQ ID NO: 1557586 - DNA, 11 bp, Homo sapiens
taactgccagc

SEQ ID NO: 1557587 - DNA, 13 bp, Homo sapiens
taactgctgagcc

SEQ ID NO: 1557588 - DNA, 15 bp, Homo sapiens
taactgctgagccac

SEQ ID NO: 1557589 - DNA, 16 bp, Homo sapiens
taactgctgagccact

SEQ ID NO: 1557590 - DNA, 11 bp, Homo sapiens
taactgctgca

SEQ ID NO: 1557591 - DNA, 13 bp, Homo sapiens
taactgctttgca

SEQ ID NO: 1557592 - DNA, 19 bp, Homo sapiens
taactggaacaaattattt

SEQ ID NO: 1557593 - DNA, 22 bp, Homo sapiens
taactggaagcatgtaggagaa

SEQ ID NO: 1557594 - DNA, 18 bp, Homo sapiens
taactggagccccatcag

SEQ ID NO: 1557595 - DNA, 22 bp, Homo sapiens
taactggcttctgcttgtcatc

SEQ ID NO: 1557596 - DNA, 15 bp, Homo sapiens
taactgtaaagatgt

SEQ ID NO: 1557597 - DNA, 16 bp, Homo sapiens
taactgtaattatttg

SEQ ID NO: 1557598 - DNA, 19 bp, Homo sapiens
taactgtaattatttgaat

SEQ ID NO: 1557599 - DNA, 11 bp, Homo sapiens
taactgtcctg

SEQ ID NO: 1557600 - DNA, 17 bp, Homo sapiens
taactgtcctgtcctgc

SEQ ID NO: 1557601 - DNA, 13 bp, Homo sapiens
taactgtcttgtt

SEQ ID NO: 1557602 - DNA, 14 bp, Homo sapiens
taactgtgaaatac

SEQ ID NO: 1557603 - DNA, 13 bp, Homo sapiens
taactgtgaagtt

SEQ ID NO: 1557604 - DNA, 19 bp, Homo sapiens
taactgtgtatgtacatat

SEQ ID NO: 1557605 - DNA, 22 bp, Homo sapiens
taactgttcccttatctgtttt

SEQ ID NO: 1557606 - DNA, 23 bp, Homo sapiens
taacttaaaaatgtaaatattct

SEQ ID NO: 1557607 - DNA, 21 bp, Homo sapiens
taacttagactctagtattta

SEQ ID NO: 1557608 - DNA, 22 bp, Homo sapiens
taacttatctagaaagaaaaga

SEQ ID NO: 1557609 - DNA, 14 bp, Homo sapiens
taacttattccaag

SEQ ID NO: 1557610 - DNA, 19 bp, Homo sapiens
taacttcctgctgcaccct

SEQ ID NO: 1557611 - DNA, 22 bp, Homo sapiens
taacttcctgctgcaccctgcg

SEQ ID NO: 1557612 - DNA, 20 bp, Homo sapiens
taacttgaagaaaccgattt

SEQ ID NO: 1557613 - DNA, 22 bp, Homo sapiens
taaggtctgtttgctgttgctg

SEQ ID NO: 1557614 - DNA, 18 bp, Homo sapiens
taaggtctttcagtactt

SEQ ID NO: 1557615 - DNA, 21 bp, Homo sapiens
taaggtgcctcagttttcctt

SEQ ID NO: 1557616 - DNA, 13 bp, Homo sapiens
taaggtgccttct

SEQ ID NO: 1557617 - DNA, 16 bp, Homo sapiens
taaggtgggtccagga

SEQ ID NO: 1557618 - DNA, 22 bp, Homo sapiens
taaggtgggtccaggaaggcag

SEQ ID NO: 1557619 - DNA, 14 bp, Homo sapiens
taaggttgtgcagg

SEQ ID NO: 1557620 - DNA, 15 bp, Homo sapiens
taagtaaaaccacag

SEQ ID NO: 1557621 - DNA, 13 bp, Homo sapiens
taagtaaatgctg

SEQ ID NO: 1557622 - DNA, 18 bp, Homo sapiens
taagtaattgcatttctg

SEQ ID NO: 1557623 - DNA, 23 bp, Homo sapiens
taagtaattgcctacaataaaaa

SEQ ID NO: 1557624 - DNA, 19 bp, Homo sapiens
taagtactatgtatcaatg

SEQ ID NO: 1557625 - DNA, 14 bp, Homo sapiens
taagtactgtgtac

SEQ ID NO: 1557626 - DNA, 16 bp, Homo sapiens
taagtagaacaaaaaa

SEQ ID NO: 1557627 - DNA, 16 bp, Homo sapiens
taagtagtaaatcaga

SEQ ID NO: 1557628 - DNA, 20 bp, Homo sapiens
taagtatgtgtaaaatgtga

SEQ ID NO: 1557629 - DNA, 16 bp, Homo sapiens
taagtattctaaattt

SEQ ID NO: 1557630 - DNA, 21 bp, Homo sapiens
taagtattcttatttaatgaa

SEQ ID NO: 1557631 - DNA, 14 bp, Homo sapiens
taagtatttcccag

SEQ ID NO: 1557632 - DNA, 13 bp, Homo sapiens
taagtatttggaa

SEQ ID NO: 1557633 - DNA, 14 bp, Homo sapiens
taagtcaagcacat

SEQ ID NO: 1557634 - DNA, 16 bp, Homo sapiens
taagtcaagcacatgt

SEQ ID NO: 1557635 - DNA, 17 bp, Homo sapiens
taagtcaagcacatgta

SEQ ID NO: 1557636 - DNA, 18 bp, Homo sapiens
taagtcagatttttattt

SEQ ID NO: 1557637 - DNA, 21 bp, Homo sapiens
taagtcaggagtgtagttgga

SEQ ID NO: 1557638 - DNA, 20 bp, Homo sapiens
taagtcaggtaatatacctg

SEQ ID NO: 1557639 - DNA, 12 bp, Homo sapiens
taagtccagtgt

SEQ ID NO: 1557640 - DNA, 17 bp, Homo sapiens
taagtccttccacctgc

SEQ ID NO: 1557641 - DNA, 15 bp, Homo sapiens
taagtcctttatgtg

SEQ ID NO: 1557642 - DNA, 17 bp, Homo sapiens
taagtcctttatgtgga

SEQ ID NO: 1557643 - DNA, 18 bp, Homo sapiens
taagtctaaatatttcct

SEQ ID NO: 1557644 - DNA, 21 bp, Homo sapiens
taagtctcctgtcttatggtc

SEQ ID NO: 1557645 - DNA, 19 bp, Homo sapiens
taagtctcgaatgtaattg

SEQ ID NO: 1557646 - DNA, 19 bp, Homo sapiens
taagtcttccttaaatgac

SEQ ID NO: 1557647 - DNA, 14 bp, Homo sapiens
taagtctttcatgg

SEQ ID NO: 1557648 - DNA, 18 bp, Homo sapiens
taagtgaacacccatgaa

SEQ ID NO: 1557649 - DNA, 15 bp, Homo sapiens
taagtgacacagaca

SEQ ID NO: 1557650 - DNA, 16 bp, Homo sapiens
taagtgagcagaacag

SEQ ID NO: 1557651 - DNA, 22 bp, Homo sapiens
taagtgatgtgctgaattttat

SEQ ID NO: 1557652 - DNA, 12 bp, Homo sapiens
taagtgcacttt

SEQ ID NO: 1557653 - DNA, 10 bp, Homo sapiens
taagtgccca

SEQ ID NO: 1557654 - DNA, 12 bp, Homo sapiens
taagtgcccaaa

SEQ ID NO: 1557655 - DNA, 17 bp, Homo sapiens
taagtgcccacatttga

SEQ ID NO: 1557656 - DNA, 23 bp, Homo sapiens
taagtgccttggatgagaagtgt

SEQ ID NO: 1557657 - DNA, 16 bp, Homo sapiens
taagtggctgccttct

SEQ ID NO: 1557658 - DNA, 15 bp, Homo sapiens
taagtgggcccaccc

SEQ ID NO: 1557659 - DNA, 19 bp, Homo sapiens
taagtgtaaaaaatgtctc

SEQ ID NO: 1557660 - DNA, 19 bp, Homo sapiens
taagtgtgagtaagagctg

SEQ ID NO: 1557661 - DNA, 14 bp, Homo sapiens
taagtgtgtgtgtg

SEQ ID NO: 1557662 - DNA, 23 bp, Homo sapiens
taagtgttcgtctttagttttga

SEQ ID NO: 1557663 - DNA, 14 bp, Homo sapiens
taagtgttctcatg

SEQ ID NO: 1557664 - DNA, 14 bp, Homo sapiens
taagttataagact

SEQ ID NO: 1557665 - DNA, 18 bp, Homo sapiens
taagttatagtgaatact

SEQ ID NO: 1557666 - DNA, 15 bp, Homo sapiens
taagttatcaacttt

SEQ ID NO: 1557667 - DNA, 17 bp, Homo sapiens
taagttatttcttgttt

SEQ ID NO: 1557668 - DNA, 19 bp, Homo sapiens
taagttcaaattcttctga

SEQ ID NO: 1557669 - DNA, 17 bp, Homo sapiens
taagttcacattagaat

SEQ ID NO: 1557670 - DNA, 14 bp, Homo sapiens
taagttcatacaat

SEQ ID NO: 1557671 - DNA, 14 bp, Homo sapiens
taagttcatacatt

SEQ ID NO: 1557672 - DNA, 13 bp, Homo sapiens
taagttgaaggaa

SEQ ID NO: 1557673 - DNA, 23 bp, Homo sapiens
taagttgctgtgtgtctgtcctg

SEQ ID NO: 1557674 - DNA, 15 bp, Homo sapiens
taagttggagcaggg

SEQ ID NO: 1557675 - DNA, 17 bp, Homo sapiens
taagttgtcaaagaagc

SEQ ID NO: 1557676 - DNA, 16 bp, Homo sapiens
taagttgttatttcag

SEQ ID NO: 1557677 - DNA, 16 bp, Homo sapiens
taagtttacaccttta

SEQ ID NO: 1557678 - DNA, 17 bp, Homo sapiens
taagtttattttttcta

SEQ ID NO: 1557679 - DNA, 23 bp, Homo sapiens
taagtttcaaacttactattttg

SEQ ID NO: 1557680 - DNA, 12 bp, Homo sapiens
taagtttctaag

SEQ ID NO: 1557681 - DNA, 13 bp, Homo sapiens
taagtttctaaga

SEQ ID NO: 1557682 - DNA, 17 bp, Homo sapiens
taagtttctaagattct

SEQ ID NO: 1557683 - DNA, 18 bp, Homo sapiens
taagtttctaagattcta

SEQ ID NO: 1557684 - DNA, 17 bp, Homo sapiens
taagtttctctgcagaa

SEQ ID NO: 1557685 - DNA, 16 bp, Homo sapiens
taagtttctcttcacc

SEQ ID NO: 1557686 - DNA, 13 bp, Homo sapiens
taagtttgaagag

SEQ ID NO: 1557687 - DNA, 16 bp, Homo sapiens
taagtttgatttcatt

SEQ ID NO: 1557688 - DNA, 17 bp, Homo sapiens
taagtttgcactcaaat

SEQ ID NO: 1557689 - DNA, 20 bp, Homo sapiens
taagtttgcactcaaatctt

SEQ ID NO: 1557690 - DNA, 20 bp, Homo sapiens
taagtttggagcactagttt

SEQ ID NO: 1557691 - DNA, 18 bp, Homo sapiens
taagtttttccaaaacct

SEQ ID NO: 1557692 - DNA, 15 bp, Homo sapiens
taataaaaaatggaa

SEQ ID NO: 1557693 - DNA, 14 bp, Homo sapiens
taataaaaagcctc

SEQ ID NO: 1557694 - DNA, 16 bp, Homo sapiens
taataaaaagcctctt

SEQ ID NO: 1557695 - DNA, 15 bp, Homo sapiens
taataaaaatacaca

SEQ ID NO: 1557696 - DNA, 13 bp, Homo sapiens
taataaaagattt

SEQ ID NO: 1557697 - DNA, 18 bp, Homo sapiens
taataaaagatttacatt

SEQ ID NO: 1557698 - DNA, 21 bp, Homo sapiens
taataaaagatttacattcca

SEQ ID NO: 1557699 - DNA, 13 bp, Homo sapiens
taataaaagtgaa

SEQ ID NO: 1557700 - DNA, 18 bp, Homo sapiens
taataaacactgttttat

SEQ ID NO: 1557701 - DNA, 13 bp, Homo sapiens
taataaactgtat

SEQ ID NO: 1557702 - DNA, 17 bp, Homo sapiens
taataaactgtattaaa

SEQ ID NO: 1557703 - DNA, 21 bp, Homo sapiens
taataaactgtattaaatctt

SEQ ID NO: 1557704 - DNA, 11 bp, Homo sapiens
taataaacttt

SEQ ID NO: 1557705 - DNA, 21 bp, Homo sapiens
taataaacttttttttgagaa

SEQ ID NO: 1557706 - DNA, 14 bp, Homo sapiens
taataaagatgctc

SEQ ID NO: 1557707 - DNA, 15 bp, Homo sapiens
taataaatatactat

SEQ ID NO: 1557708 - DNA, 19 bp, Homo sapiens
taataaatatactatgaaa

SEQ ID NO: 1557709 - DNA, 23 bp, Homo sapiens
taaaggcattgtccaaagtttat

SEQ ID NO: 1557710 - DNA, 19 bp, Homo sapiens
taaaggcctcatctccttt

SEQ ID NO: 1557711 - DNA, 20 bp, Homo sapiens
taaaggcctcatctccttta

SEQ ID NO: 1557712 - DNA, 23 bp, Homo sapiens
taaaggcctggaaccagggagga

SEQ ID NO: 1557713 - DNA, 17 bp, Homo sapiens
taaaggcttaggcatgt

SEQ ID NO: 1557714 - DNA, 19 bp, Homo sapiens
taaagggcccaatgaatta

SEQ ID NO: 1557715 - DNA, 16 bp, Homo sapiens
taaaggggttccaaat

SEQ ID NO: 1557716 - DNA, 20 bp, Homo sapiens
taaaggtaccaaacaaggaa

SEQ ID NO: 1557717 - DNA, 21 bp, Homo sapiens
taaaggtaccaaacaaggaag

SEQ ID NO: 1557718 - DNA, 22 bp, Homo sapiens
taaaggtaccaaacaaggaagc

SEQ ID NO: 1557719 - DNA, 19 bp, Homo sapiens
taaaggtccacaggtctag

SEQ ID NO: 1557720 - DNA, 20 bp, Homo sapiens
taaaggtcccatgctccacc

SEQ ID NO: 1557721 - DNA, 21 bp, Homo sapiens
taaaggtgacatcggaaaaat

SEQ ID NO: 1557722 - DNA, 18 bp, Homo sapiens
taaagtacaaatgaagaa

SEQ ID NO: 1557723 - DNA, 18 bp, Homo sapiens
taaagtagaagagggttt

SEQ ID NO: 1557724 - DNA, 17 bp, Homo sapiens
taaagtatatgtgcagt

SEQ ID NO: 1557725 - DNA, 21 bp, Homo sapiens
taaagtcacatccctgtaaat

SEQ ID NO: 1557726 - DNA, 15 bp, Homo sapiens
taaagtcagatggaa

SEQ ID NO: 1557727 - DNA, 17 bp, Homo sapiens
taaagtcagatggaaaa

SEQ ID NO: 1557728 - DNA, 17 bp, Homo sapiens
taaagtcaggtccaatt

SEQ ID NO: 1557729 - DNA, 18 bp, Homo sapiens
taaagtcatcatgaactg

SEQ ID NO: 1557730 - DNA, 22 bp, Homo sapiens
taaagtcatcatgaactggctt

SEQ ID NO: 1557731 - DNA, 18 bp, Homo sapiens
taaagtctaagcaagatg

SEQ ID NO: 1557732 - DNA, 22 bp, Homo sapiens
taaagtgattaaacgtgcagac

SEQ ID NO: 1557733 - DNA, 19 bp, Homo sapiens
taaagtgctaaggttctaa

SEQ ID NO: 1557734 - DNA, 21 bp, Homo sapiens
taaagtgctaaggttctaagg

SEQ ID NO: 1557735 - DNA, 22 bp, Homo sapiens
taaagtgtaaatcctttttctt

SEQ ID NO: 1557736 - DNA, 13 bp, Homo sapiens
taaagtgttagat

SEQ ID NO: 1557737 - DNA, 12 bp, Homo sapiens
taaagttctaag

SEQ ID NO: 1557738 - DNA, 14 bp, Homo sapiens
taaagttctaagat

SEQ ID NO: 1557739 - DNA, 19 bp, Homo sapiens
taaagttgagcttagtttt

SEQ ID NO: 1557740 - DNA, 14 bp, Homo sapiens
taaagtttacaagc

SEQ ID NO: 1557741 - DNA, 17 bp, Homo sapiens
taaagttttgcaacaat

SEQ ID NO: 1557742 - DNA, 17 bp, Homo sapiens
taaataaaaagaaaggc

SEQ ID NO: 1557743 - DNA, 17 bp, Homo sapiens
taaataaaaatatgtaa

SEQ ID NO: 1557744 - DNA, 13 bp, Homo sapiens
taaataaaagcac

SEQ ID NO: 1557745 - DNA, 14 bp, Homo sapiens
taaataaaagcagc

SEQ ID NO: 1557746 - DNA, 15 bp, Homo sapiens
taaataaaagcagca

SEQ ID NO: 1557747 - DNA, 19 bp, Homo sapiens
taaataaaagcagcatctg

SEQ ID NO: 1557748 - DNA, 20 bp, Homo sapiens
taaataaaagcagcatctgc

SEQ ID NO: 1557749 - DNA, 22 bp, Homo sapiens
taaataaaagctagatactgga

SEQ ID NO: 1557750 - DNA, 16 bp, Homo sapiens
taaataaaatgtgtac

SEQ ID NO: 1557751 - DNA, 18 bp, Homo sapiens
taaataaaatgtgtacag

SEQ ID NO: 1557752 - DNA, 17 bp, Homo sapiens
taaataaaattcatttc

SEQ ID NO: 1557753 - DNA, 14 bp, Homo sapiens
taaataaagaagaa

SEQ ID NO: 1557754 - DNA, 15 bp, Homo sapiens
taaataaatttccca

SEQ ID NO: 1557755 - DNA, 13 bp, Homo sapiens
taaataaatttga

SEQ ID NO: 1557756 - DNA, 14 bp, Homo sapiens
taaataaatttgac

SEQ ID NO: 1557757 - DNA, 13 bp, Homo sapiens
taaataagattct

SEQ ID NO: 1557758 - DNA, 20 bp, Homo sapiens
taaattgcagaattcaaaag

SEQ ID NO: 1557759 - DNA, 16 bp, Homo sapiens
taaattgcatcactgt

SEQ ID NO: 1557760 - DNA, 19 bp, Homo sapiens
taaattgctcacagttatt

SEQ ID NO: 1557761 - DNA, 19 bp, Homo sapiens
taaattgtatacattttgt

SEQ ID NO: 1557762 - DNA, 23 bp, Homo sapiens
taaattgtccgtgttcatacatt

SEQ ID NO: 1557763 - DNA, 13 bp, Homo sapiens
taaatttaagcaa

SEQ ID NO: 1557764 - DNA, 15 bp, Homo sapiens
taaatttatttcaaa

SEQ ID NO: 1557765 - DNA, 17 bp, Homo sapiens
taaatttatttgaaaat

SEQ ID NO: 1557766 - DNA, 21 bp, Homo sapiens
taaatttcactactagattga

SEQ ID NO: 1557767 - DNA, 22 bp, Homo sapiens
taaatttcccagttaaagatta

SEQ ID NO: 1557768 - DNA, 15 bp, Homo sapiens
taaatttcttatgtg

SEQ ID NO: 1557769 - DNA, 19 bp, Homo sapiens
taaatttcttggcaaattt

SEQ ID NO: 1557770 - DNA, 18 bp, Homo sapiens
taaatttgacttttctgt

SEQ ID NO: 1557771 - DNA, 14 bp, Homo sapiens
taaatttgatttcc

SEQ ID NO: 1557772 - DNA, 13 bp, Homo sapiens
taaatttgctagc

SEQ ID NO: 1557773 - DNA, 14 bp, Homo sapiens
taaatttgctagca

SEQ ID NO: 1557774 - DNA, 22 bp, Homo sapiens
taaatttgtactatttaactga

SEQ ID NO: 1557775 - DNA, 17 bp, Homo sapiens
taaattttaatgtaaaa

SEQ ID NO: 1557776 - DNA, 18 bp, Homo sapiens
taaattttcatgaatgtg

SEQ ID NO: 1557777 - DNA, 18 bp, Homo sapiens
taaattttgagttctaca

SEQ ID NO: 1557778 - DNA, 19 bp, Homo sapiens
taaattttgagttctacat

SEQ ID NO: 1557779 - DNA, 17 bp, Homo sapiens
taaattttgtatgaaaa

SEQ ID NO: 1557780 - DNA, 17 bp, Homo sapiens
taaattttgtttcagaa

SEQ ID NO: 1557781 - DNA, 13 bp, Homo sapiens
taaatttttaaga

SEQ ID NO: 1557782 - DNA, 23 bp, Homo sapiens
taacaaaaaaatatatttaatga

SEQ ID NO: 1557783 - DNA, 13 bp, Homo sapiens
taacaaaagaact

SEQ ID NO: 1557784 - DNA, 13 bp, Homo sapiens
taacaaaagattt

SEQ ID NO: 1557785 - DNA, 24 bp, Homo sapiens
taacaaaataaggttatatgagta

SEQ ID NO: 1557786 - DNA, 20 bp, Homo sapiens
taacaaaccaacatctttgc

SEQ ID NO: 1557787 - DNA, 18 bp, Homo sapiens
taacaaatctaatctctt

SEQ ID NO: 1557788 - DNA, 15 bp, Homo sapiens
taacaactaacttgt

SEQ ID NO: 1557789 - DNA, 15 bp, Homo sapiens
taacaagaaaacata

SEQ ID NO: 1557790 - DNA, 12 bp, Homo sapiens
taacaagagttt

SEQ ID NO: 1557791 - DNA, 21 bp, Homo sapiens
taacaagccaaacattcttat

SEQ ID NO: 1557792 - DNA, 12 bp, Homo sapiens
taacaaggaatg

SEQ ID NO: 1557793 - DNA, 18 bp, Homo sapiens
taacaaggaatgcctgtg

SEQ ID NO: 1557794 - DNA, 19 bp, Homo sapiens
taacaaggaatgcctgtgc

SEQ ID NO: 1557795 - DNA, 15 bp, Homo sapiens
taacaaggagatttc

SEQ ID NO: 1557796 - DNA, 23 bp, Homo sapiens
taacaaggagatttcttagttca

SEQ ID NO: 1557797 - DNA, 16 bp, Homo sapiens
taacaaggtccaagat

SEQ ID NO: 1557798 - DNA, 19 bp, Homo sapiens
taacaaggtgtcttttcca

SEQ ID NO: 1557799 - DNA, 21 bp, Homo sapiens
taacaagtataaaaaattctc

SEQ ID NO: 1557800 - DNA, 19 bp, Homo sapiens
taacaataatatttcaagt

SEQ ID NO: 1557801 - DNA, 20 bp, Homo sapiens
taacaataatatttcaagtg

SEQ ID NO: 1557802 - DNA, 18 bp, Homo sapiens
taacaatacaaatggatt

SEQ ID NO: 1557803 - DNA, 19 bp, Homo sapiens
taacaatacaaatggattt

SEQ ID NO: 1557804 - DNA, 23 bp, Homo sapiens
taacaatctatggcttatttcta

SEQ ID NO: 1557805 - DNA, 21 bp, Homo sapiens
taacaatgacactagaaaact

SEQ ID NO: 1557806 - DNA, 22 bp, Homo sapiens
taacaatgatgaccccggcctg

SEQ ID NO: 1557807 - DNA, 14 bp, Homo sapiens
taacaatgtatttt

SEQ ID NO: 1557808 - DNA, 16 bp, Homo sapiens
taacaatgtattttaa

SEQ ID NO: 1557809 - DNA, 14 bp, Homo sapiens
taacaattgtgtag

SEQ ID NO: 1557810 - DNA, 20 bp, Homo sapiens
taacaattgtgtagcctttt

SEQ ID NO: 1557811 - DNA, 13 bp, Homo sapiens
taacacaaaggaa

SEQ ID NO: 1557812 - DNA, 21 bp, Homo sapiens
taacacagcattgtatatgtg

SEQ ID NO: 1557813 - DNA, 15 bp, Homo sapiens
taacacagtattatg

SEQ ID NO: 1557814 - DNA, 20 bp, Homo sapiens
taacacagtgccttcaataa

SEQ ID NO: 1557815 - DNA, 21 bp, Homo sapiens
taacacagtgccttcaataaa

SEQ ID NO: 1557816 - DNA, 22 bp, Homo sapiens
taacacattatcgggagcagtg

SEQ ID NO: 1557817 - DNA, 12 bp, Homo sapiens
taacacatttgg

SEQ ID NO: 1557818 - DNA, 13 bp, Homo sapiens
taacaccagtggg

SEQ ID NO: 1557819 - DNA, 23 bp, Homo sapiens
taacacgctgcctggtctgtctg

SEQ ID NO: 1557820 - DNA, 16 bp, Homo sapiens
taacactaatatattt

SEQ ID NO: 1557821 - DNA, 20 bp, Homo sapiens
taacactaatatatttaaaa

SEQ ID NO: 1557822 - DNA, 23 bp, Homo sapiens
taacactaatatatttaaaaata

SEQ ID NO: 1557823 - DNA, 19 bp, Homo sapiens
taacactactcaaagcaaa

SEQ ID NO: 1557824 - DNA, 22 bp, Homo sapiens
taacactttgtattacttaggt

SEQ ID NO: 1557825 - DNA, 14 bp, Homo sapiens
taacagaaattgta

SEQ ID NO: 1557826 - DNA, 22 bp, Homo sapiens
taacagcattcttgtcacaata

SEQ ID NO: 1557827 - DNA, 11 bp, Homo sapiens
taacagccctc

SEQ ID NO: 1557828 - DNA, 17 bp, Homo sapiens
taacagcgtttattata

SEQ ID NO: 1557829 - DNA, 15 bp, Homo sapiens
taacaggcaaacatt

SEQ ID NO: 1557830 - DNA, 20 bp, Homo sapiens
taacaggcaaacattttctc

SEQ ID NO: 1557831 - DNA, 22 bp, Homo sapiens
taacaggcaaacattttctctt

SEQ ID NO: 1557832 - DNA, 20 bp, Homo sapiens
taacaggcatttgttcactg

SEQ ID NO: 1557833 - DNA, 16 bp, Homo sapiens
taaatctagagtttat

SEQ ID NO: 1557834 - DNA, 21 bp, Homo sapiens
taaatctagagtttatacagt

SEQ ID NO: 1557835 - DNA, 15 bp, Homo sapiens
taaatctgacccagt

SEQ ID NO: 1557836 - DNA, 16 bp, Homo sapiens
taaatctgacccagtg

SEQ ID NO: 1557837 - DNA, 15 bp, Homo sapiens
taaatctgtctgatt

SEQ ID NO: 1557838 - DNA, 19 bp, Homo sapiens
taaatctgtctgattctat

SEQ ID NO: 1557839 - DNA, 13 bp, Homo sapiens
taaatcttaaaca

SEQ ID NO: 1557840 - DNA, 17 bp, Homo sapiens
taaatcttaaacaatgt

SEQ ID NO: 1557841 - DNA, 11 bp, Homo sapiens
taaatcttaag

SEQ ID NO: 1557842 - DNA, 12 bp, Homo sapiens
taaatcttcctt

SEQ ID NO: 1557843 - DNA, 16 bp, Homo sapiens
taaatcttccttgtga

SEQ ID NO: 1557844 - DNA, 15 bp, Homo sapiens
taaatcttttcttca

SEQ ID NO: 1557845 - DNA, 17 bp, Homo sapiens
taaatctttttgcttct

SEQ ID NO: 1557846 - DNA, 20 bp, Homo sapiens
taaatctttttgcttctact

SEQ ID NO: 1557847 - DNA, 14 bp, Homo sapiens
taaatgaaagaaaa

SEQ ID NO: 1557848 - DNA, 16 bp, Homo sapiens
taaatgaagcagcttt

SEQ ID NO: 1557849 - DNA, 14 bp, Homo sapiens
taaatgaccaaaga

SEQ ID NO: 1557850 - DNA, 16 bp, Homo sapiens
taaatgacttttctta

SEQ ID NO: 1557851 - DNA, 16 bp, Homo sapiens
taaatgagctatgtat

SEQ ID NO: 1557852 - DNA, 15 bp, Homo sapiens
taaatgattatattc

SEQ ID NO: 1557853 - DNA, 20 bp, Homo sapiens
taaatgattcaaaaagtcac

SEQ ID NO: 1557854 - DNA, 21 bp, Homo sapiens
taaatgcaccaagaaagcttc

SEQ ID NO: 1557855 - DNA, 14 bp, Homo sapiens
taaatgcattatag

SEQ ID NO: 1557856 - DNA, 13 bp, Homo sapiens
taaatgccagagc

SEQ ID NO: 1557857 - DNA, 15 bp, Homo sapiens
taaatgccagagcca

SEQ ID NO: 1557858 - DNA, 20 bp, Homo sapiens
taaatgccagagccaacctg

SEQ ID NO: 1557859 - DNA, 15 bp, Homo sapiens
taaatgcctcttaaa

SEQ ID NO: 1557860 - DNA, 15 bp, Homo sapiens
taaatgccttgtata

SEQ ID NO: 1557861 - DNA, 18 bp, Homo sapiens
taaatgccttgtataaaa

SEQ ID NO: 1557862 - DNA, 17 bp, Homo sapiens
taaatgctcattttctg

SEQ ID NO: 1557863 - DNA, 20 bp, Homo sapiens
taaatgctcattttctggtt

SEQ ID NO: 1557864 - DNA, 17 bp, Homo sapiens
taaatgctcgtgtgatt

SEQ ID NO: 1557865 - DNA, 21 bp, Homo sapiens
taaatgctttgtgtgattgaa

SEQ ID NO: 1557866 - DNA, 17 bp, Homo sapiens
taaatggaattattttg

SEQ ID NO: 1557867 - DNA, 23 bp, Homo sapiens
taaatggcctcatgtggctggaa

SEQ ID NO: 1557868 - DNA, 15 bp, Homo sapiens
taaatggtgtacata

SEQ ID NO: 1557869 - DNA, 21 bp, Homo sapiens
taaatggtgtacataatgtat

SEQ ID NO: 1557870 - DNA, 13 bp, Homo sapiens
taaatgtaaagat

SEQ ID NO: 1557871 - DNA, 17 bp, Homo sapiens
taaatgtaaagatattt

SEQ ID NO: 1557872 - DNA, 15 bp, Homo sapiens
taaatgtaacttatt

SEQ ID NO: 1557873 - DNA, 21 bp, Homo sapiens
taaatgtacccctctcagtct

SEQ ID NO: 1557874 - DNA, 14 bp, Homo sapiens
taaatgtccctaat

SEQ ID NO: 1557875 - DNA, 12 bp, Homo sapiens
taaatgtctgtt

SEQ ID NO: 1557876 - DNA, 11 bp, Homo sapiens
taaatgtgaat

SEQ ID NO: 1557877 - DNA, 21 bp, Homo sapiens
taaatgtgaatttttatttct

SEQ ID NO: 1557878 - DNA, 19 bp, Homo sapiens
taaatgtgattcacctctt

SEQ ID NO: 1557879 - DNA, 12 bp, Homo sapiens
taaatgtgttcc

SEQ ID NO: 1557880 - DNA, 19 bp, Homo sapiens
taaatgttacctaattatt

SEQ ID NO: 1557881 - DNA, 17 bp, Homo sapiens
taaatgttacctctgaa

SEQ ID NO: 1557882 - DNA, 16 bp, Homo sapiens
taaatgttatgtatat

SEQ ID NO: 1557883 - DNA, 19 bp, Homo sapiens
taaatgttattacttgtaa

SEQ ID NO: 1557884 - DNA, 20 bp, Homo sapiens
taaatgttattacttgtaaa

SEQ ID NO: 1557885 - DNA, 19 bp, Homo sapiens
taaatgttgctttaacctg

SEQ ID NO: 1557886 - DNA, 17 bp, Homo sapiens
taaatgttggaatgtta

SEQ ID NO: 1557887 - DNA, 12 bp, Homo sapiens
taaatgtttaaa

SEQ ID NO: 1557888 - DNA, 18 bp, Homo sapiens
taaatgtttaacatcatt

SEQ ID NO: 1557889 - DNA, 22 bp, Homo sapiens
taaaatctgtaaaccataggta

SEQ ID NO: 1557890 - DNA, 19 bp, Homo sapiens
taaaatcttggcacagaaa

SEQ ID NO: 1557891 - DNA, 12 bp, Homo sapiens
taaaatcttgtc

SEQ ID NO: 1557892 - DNA, 16 bp, Homo sapiens
taaaatcttgtcatgt

SEQ ID NO: 1557893 - DNA, 20 bp, Homo sapiens
taaaatcttgtcatgtgtat

SEQ ID NO: 1557894 - DNA, 12 bp, Homo sapiens
taaaatgaacat

SEQ ID NO: 1557895 - DNA, 17 bp, Homo sapiens
taaaatgaacatctctt

SEQ ID NO: 1557896 - DNA, 19 bp, Homo sapiens
taaaatgaacctgctactt

SEQ ID NO: 1557897 - DNA, 20 bp, Homo sapiens
taaaatgaggttcaactgtt

SEQ ID NO: 1557898 - DNA, 19 bp, Homo sapiens
taaaatgccatagtttgtg

SEQ ID NO: 1557899 - DNA, 10 bp, Homo sapiens
taaaatgtaa

SEQ ID NO: 1557900 - DNA, 14 bp, Homo sapiens
taaaatgtaagatt

SEQ ID NO: 1557901 - DNA, 15 bp, Homo sapiens
taaaatgtaatttaa

SEQ ID NO: 1557902 - DNA, 17 bp, Homo sapiens
taaaatgtacatgtatt

SEQ ID NO: 1557903 - DNA, 11 bp, Homo sapiens
taaaatgtgaa

SEQ ID NO: 1557904 - DNA, 13 bp, Homo sapiens
taaaatgtgaagt

SEQ ID NO: 1557905 - DNA, 19 bp, Homo sapiens
taaaatgtgatgttctaag

SEQ ID NO: 1557906 - DNA, 18 bp, Homo sapiens
taaaatgtgatttttctg

SEQ ID NO: 1557907 - DNA, 19 bp, Homo sapiens
taaaatgtgtacagtgaat

SEQ ID NO: 1557908 - DNA, 15 bp, Homo sapiens
taaaatgtttactgt

SEQ ID NO: 1557909 - DNA, 18 bp, Homo sapiens
taaaatgtttactgtaaa

SEQ ID NO: 1557910 - DNA, 20 bp, Homo sapiens
taaaatgtttactgtaaatt

SEQ ID NO: 1557911 - DNA, 21 bp, Homo sapiens
taaaatgtttactgtaaattt

SEQ ID NO: 1557912 - DNA, 17 bp, Homo sapiens
taaaatgtttcattatg

SEQ ID NO: 1557913 - DNA, 14 bp, Homo sapiens
taaaattaaatgcc

SEQ ID NO: 1557914 - DNA, 15 bp, Homo sapiens
taaaattaagatttc

SEQ ID NO: 1557915 - DNA, 15 bp, Homo sapiens
taaaattaagtagaa

SEQ ID NO: 1557916 - DNA, 18 bp, Homo sapiens
taaaattaagtagaacaa

SEQ ID NO: 1557917 - DNA, 18 bp, Homo sapiens
taaaattaagtatatata

SEQ ID NO: 1557918 - DNA, 15 bp, Homo sapiens
taaaattaagttgaa

SEQ ID NO: 1557919 - DNA, 16 bp, Homo sapiens
taaaattaagttgaaa

SEQ ID NO: 1557920 - DNA, 17 bp, Homo sapiens
taaaattaatgcagatt

SEQ ID NO: 1557921 - DNA, 20 bp, Homo sapiens
taaaattaatgcagatttct

SEQ ID NO: 1557922 - DNA, 22 bp, Homo sapiens
taaaattatcaatatctaatat

SEQ ID NO: 1557923 - DNA, 13 bp, Homo sapiens
gtttttaatttga

SEQ ID NO: 1557924 - DNA, 14 bp, Homo sapiens
gtttttaatttgat

SEQ ID NO: 1557925 - DNA, 17 bp, Homo sapiens
gtttttacaagatgtat

SEQ ID NO: 1557926 - DNA, 17 bp, Homo sapiens
gtttttacagctgtgtt

SEQ ID NO: 1557927 - DNA, 21 bp, Homo sapiens
gtttttacctaccacagtgtc

SEQ ID NO: 1557928 - DNA, 16 bp, Homo sapiens
gtttttactacagttg

SEQ ID NO: 1557929 - DNA, 18 bp, Homo sapiens
gtttttactgctctgaga

SEQ ID NO: 1557930 - DNA, 17 bp, Homo sapiens
gtttttatattaatgta

SEQ ID NO: 1557931 - DNA, 15 bp, Homo sapiens
gtttttatgagaaac

SEQ ID NO: 1557932 - DNA, 17 bp, Homo sapiens
gtttttatgagaaactt

SEQ ID NO: 1557933 - DNA, 16 bp, Homo sapiens
gtttttatggggctga

SEQ ID NO: 1557934 - DNA, 18 bp, Homo sapiens
gtttttatggggctgaac

SEQ ID NO: 1557935 - DNA, 14 bp, Homo sapiens
gtttttatttttgt

SEQ ID NO: 1557936 - DNA, 16 bp, Homo sapiens
gtttttcacattttcc

SEQ ID NO: 1557937 - DNA, 15 bp, Homo sapiens
gtttttccactactg

SEQ ID NO: 1557938 - DNA, 16 bp, Homo sapiens
gtttttccactactgc

SEQ ID NO: 1557939 - DNA, 18 bp, Homo sapiens
gtttttccactactgcta

SEQ ID NO: 1557940 - DNA, 12 bp, Homo sapiens
gtttttctacta

SEQ ID NO: 1557941 - DNA, 12 bp, Homo sapiens
gtttttctatat

SEQ ID NO: 1557942 - DNA, 20 bp, Homo sapiens
gtttttctatatagttcctt

SEQ ID NO: 1557943 - DNA, 14 bp, Homo sapiens
gtttttctgccagg

SEQ ID NO: 1557944 - DNA, 18 bp, Homo sapiens
gtttttgatagctttatt

SEQ ID NO: 1557945 - DNA, 15 bp, Homo sapiens
gtttttgcacatgtt

SEQ ID NO: 1557946 - DNA, 15 bp, Homo sapiens
gtgtcaggccctctg

SEQ ID NO: 1557947 - DNA, 22 bp, Homo sapiens
gtgtcaggccctctgcctgcac

SEQ ID NO: 1557948 - DNA, 16 bp, Homo sapiens
gtgtcatcagaagata

SEQ ID NO: 1557949 - DNA, 17 bp, Homo sapiens
gtgtcatttcttcactt

SEQ ID NO: 1557950 - DNA, 13 bp, Homo sapiens
gtgtccagcagct

SEQ ID NO: 1557951 - DNA, 14 bp, Homo sapiens
gtgtccagcagctg

SEQ ID NO: 1557952 - DNA, 16 bp, Homo sapiens
gtgtccagcttccaaa

SEQ ID NO: 1557953 - DNA, 17 bp, Homo sapiens
gtgtccagcttccaaag

SEQ ID NO: 1557954 - DNA, 22 bp, Homo sapiens
gtgtccagttttggaggctgag

SEQ ID NO: 1557955 - DNA, 21 bp, Homo sapiens
gtgtccatgcgctcagggcca

SEQ ID NO: 1557956 - DNA, 17 bp, Homo sapiens
gtgtcccaaggagctga

SEQ ID NO: 1557957 - DNA, 15 bp, Homo sapiens
gtgtcccagatgctg

SEQ ID NO: 1557958 - DNA, 23 bp, Homo sapiens
gtgtcccatgacccacccctgtg

SEQ ID NO: 1557959 - DNA, 21 bp, Homo sapiens
gtgtccccaacgtcccctccg

SEQ ID NO: 1557960 - DNA, 19 bp, Homo sapiens
gtgtccccgctgctgtgca

SEQ ID NO: 1557961 - DNA, 21 bp, Homo sapiens
gtgtcccctgccccagaggtc

SEQ ID NO: 1557962 - DNA, 13 bp, Homo sapiens
gtgtccctggaca

SEQ ID NO: 1557963 - DNA, 15 bp, Homo sapiens
gtgtccgatgctgga

SEQ ID NO: 1557964 - DNA, 16 bp, Homo sapiens
gtgtccgtccaccctt

SEQ ID NO: 1557965 - DNA, 18 bp, Homo sapiens
gtgtccgtccacccttcc

SEQ ID NO: 1557966 - DNA, 19 bp, Homo sapiens
gtgtcctccaccatgcact

SEQ ID NO: 1557967 - DNA, 18 bp, Homo sapiens
gtgtcctcccctcaagga

SEQ ID NO: 1557968 - DNA, 16 bp, Homo sapiens
gtgtcctctccctgcc

SEQ ID NO: 1557969 - DNA, 17 bp, Homo sapiens
gtgtcctctccctgcca

SEQ ID NO: 1557970 - DNA, 19 bp, Homo sapiens
gtgtcctctccctgccaag

SEQ ID NO: 1557971 - DNA, 18 bp, Homo sapiens
gtgtcctcttccctctct

SEQ ID NO: 1557972 - DNA, 19 bp, Homo sapiens
gtgtcctgaagctgctgga

SEQ ID NO: 1557973 - DNA, 16 bp, Homo sapiens
gtgtcctgaccaccct

SEQ ID NO: 1557974 - DNA, 13 bp, Homo sapiens
gtgtcctgcctgt

SEQ ID NO: 1557975 - DNA, 18 bp, Homo sapiens
gtgtccttgcacctgcat

SEQ ID NO: 1557976 - DNA, 22 bp, Homo sapiens
gtgtcgaggccacattgctggc

SEQ ID NO: 1557977 - DNA, 16 bp, Homo sapiens
gtgtcggatcctgtga

SEQ ID NO: 1557978 - DNA, 18 bp, Homo sapiens
gtgtcgtcttgaacgagc

SEQ ID NO: 1557979 - DNA, 23 bp, Homo sapiens
gtgtcgtcttgaacgagcagccc

SEQ ID NO: 1557980 - DNA, 17 bp, Homo sapiens
gtgtctaaaaacaccaa

SEQ ID NO: 1557981 - DNA, 14 bp, Homo sapiens
gtgtctaagattct

SEQ ID NO: 1557982 - DNA, 16 bp, Homo sapiens
gtgtctaagattctag

SEQ ID NO: 1557983 - DNA, 19 bp, Homo sapiens
gtgtctcaaaggagctttc

SEQ ID NO: 1557984 - DNA, 18 bp, Homo sapiens
gtgtctcagcctctgcca

SEQ ID NO: 1557985 - DNA, 21 bp, Homo sapiens
gtgtctcggagggattcccct

SEQ ID NO: 1557986 - DNA, 20 bp, Homo sapiens
gtgtctgcattgttattgtg

SEQ ID NO: 1557987 - DNA, 16 bp, Homo sapiens
gtgtctgccaaacaca

SEQ ID NO: 1557988 - DNA, 15 bp, Homo sapiens
gtgtctgctcagtaa

SEQ ID NO: 1557989 - DNA, 18 bp, Homo sapiens
gtgtctggggtgagggag

SEQ ID NO: 1557990 - DNA, 16 bp, Homo sapiens
gtgtctggtgcagaat

SEQ ID NO: 1557991 - DNA, 12 bp, Homo sapiens
gtgtctgtacac

SEQ ID NO: 1557992 - DNA, 22 bp, Homo sapiens
gtgtctgtacacgtgtcctgta

SEQ ID NO: 1557993 - DNA, 13 bp, Homo sapiens
gtgtctgtattta

SEQ ID NO: 1557994 - DNA, 13 bp, Homo sapiens
gtgtctgtctttg

SEQ ID NO: 1557995 - DNA, 15 bp, Homo sapiens
gtgtctgtctttgtg

SEQ ID NO: 1557996 - DNA, 15 bp, Homo sapiens
gtgtctgtggggagg

SEQ ID NO: 1557997 - DNA, 12 bp, Homo sapiens
gtgtctgttgct

SEQ ID NO: 1557998 - DNA, 15 bp, Homo sapiens
gtgtcttaattatta

SEQ ID NO: 1557999 - DNA, 13 bp, Homo sapiens
gtgtcttccataa

SEQ ID NO: 1558000 - DNA, 16 bp, Homo sapiens
gtgtcttgggcagagc

SEQ ID NO: 1558001 - DNA, 17 bp, Homo sapiens
gtgtcttgggcagagct

SEQ ID NO: 1558002 - DNA, 18 bp, Homo sapiens
gtgtctttcacagctcct

SEQ ID NO: 1558003 - DNA, 15 bp, Homo sapiens
gtgtcttttgacatt

SEQ ID NO: 1558004 - DNA, 13 bp, Homo sapiens
gtgtgaaacaatg

SEQ ID NO: 1558005 - DNA, 22 bp, Homo sapiens
gtgtgaactcaccctgggagcc

SEQ ID NO: 1558006 - DNA, 23 bp, Homo sapiens
gtgtgaactcaccctgggagcca

SEQ ID NO: 1558007 - DNA, 17 bp, Homo sapiens
gtgtgaattctgcaact

SEQ ID NO: 1558008 - DNA, 18 bp, Homo sapiens
gtgtgacagtttccaaat

SEQ ID NO: 1558009 - DNA, 13 bp, Homo sapiens
gtgtgaccctggg

SEQ ID NO: 1558010 - DNA, 18 bp, Homo sapiens
gtgtgagacttaaaacat

SEQ ID NO: 1558011 - DNA, 18 bp, Homo sapiens
gtgtgaggagctgctggc

SEQ ID NO: 1558012 - DNA, 16 bp, Homo sapiens
gtgtgagtggcagcca

SEQ ID NO: 1558013 - DNA, 15 bp, Homo sapiens
gtgtgatatttcaga

SEQ ID NO: 1558014 - DNA, 17 bp, Homo sapiens
gtgtgatatttcagaaa

SEQ ID NO: 1558015 - DNA, 22 bp, Homo sapiens
gtgtgcaaagatctctagagtt

SEQ ID NO: 1558016 - DNA, 15 bp, Homo sapiens
taaaaatcacactgt

SEQ ID NO: 1558017 - DNA, 16 bp, Homo sapiens
taaaaatcacactgta

SEQ ID NO: 1558018 - DNA, 17 bp, Homo sapiens
taaaaatcattgattgt

SEQ ID NO: 1558019 - DNA, 19 bp, Homo sapiens
taaaaatcctaaaatatgt

SEQ ID NO: 1558020 - DNA, 23 bp, Homo sapiens
taaaaatctgagaaactctacat

SEQ ID NO: 1558021 - DNA, 15 bp, Homo sapiens
taaaaatgaggtact

SEQ ID NO: 1558022 - DNA, 17 bp, Homo sapiens
taaaaatgatactgatg

SEQ ID NO: 1558023 - DNA, 11 bp, Homo sapiens
taaaaatgcaa

SEQ ID NO: 1558024 - DNA, 20 bp, Homo sapiens
taaaaatgggtgttattttt

SEQ ID NO: 1558025 - DNA, 18 bp, Homo sapiens
taaaaattaaaaaatgaa

SEQ ID NO: 1558026 - DNA, 22 bp, Homo sapiens
taaaaattacctttaattttaa

SEQ ID NO: 1558027 - DNA, 18 bp, Homo sapiens
taaaaattagcctaagat

SEQ ID NO: 1558028 - DNA, 12 bp, Homo sapiens
taaaaattgttt

SEQ ID NO: 1558029 - DNA, 15 bp, Homo sapiens
taaaacaaaaccaag

SEQ ID NO: 1558030 - DNA, 16 bp, Homo sapiens
taaaacaaaaccaagc

SEQ ID NO: 1558031 - DNA, 14 bp, Homo sapiens
taaaacaaaatttg

SEQ ID NO: 1558032 - DNA, 22 bp, Homo sapiens
taaaacaaccagttaaagccac

SEQ ID NO: 1558033 - DNA, 20 bp, Homo sapiens
taaaacaagggaaaaatttt

SEQ ID NO: 1558034 - DNA, 18 bp, Homo sapiens
taaaacaatgccatgaac

SEQ ID NO: 1558035 - DNA, 21 bp, Homo sapiens
taaaacaatgccatgaacaaa

SEQ ID NO: 1558036 - DNA, 14 bp, Homo sapiens
taaaacacaaagtc

SEQ ID NO: 1558037 - DNA, 18 bp, Homo sapiens
taaaacagaatcttctgg

SEQ ID NO: 1558038 - DNA, 13 bp, Homo sapiens
taaaacagacact

SEQ ID NO: 1558039 - DNA, 17 bp, Homo sapiens
taaaacagacactggca

SEQ ID NO: 1558040 - DNA, 21 bp, Homo sapiens
taaaacaggcaaagttttaca

SEQ ID NO: 1558041 - DNA, 23 bp, Homo sapiens
taaaacaggcaaagttttacaga

SEQ ID NO: 1558042 - DNA, 21 bp, Homo sapiens
taaaacaggttataacagtgt

SEQ ID NO: 1558043 - DNA, 22 bp, Homo sapiens
taaaacatggtgcctatatctg

SEQ ID NO: 1558044 - DNA, 15 bp, Homo sapiens
gttccaacctcctgc

SEQ ID NO: 1558045 - DNA, 18 bp, Homo sapiens
gttccaagtctttgctat

SEQ ID NO: 1558046 - DNA, 15 bp, Homo sapiens
gttccaccccaagag

SEQ ID NO: 1558047 - DNA, 15 bp, Homo sapiens
gttccacctgccaca

SEQ ID NO: 1558048 - DNA, 18 bp, Homo sapiens
gttccacttgtttgcact

SEQ ID NO: 1558049 - DNA, 23 bp, Homo sapiens
gttccagaccccctgagccacag

SEQ ID NO: 1558050 - DNA, 18 bp, Homo sapiens
gttccagactcaggttcc

SEQ ID NO: 1558051 - DNA, 22 bp, Homo sapiens
gttccagactcaggttccagaa

SEQ ID NO: 1558052 - DNA, 18 bp, Homo sapiens
gttccagaggtattcctc

SEQ ID NO: 1558053 - DNA, 22 bp, Homo sapiens
gttccaggcctgatcttgcctg

SEQ ID NO: 1558054 - DNA, 23 bp, Homo sapiens
gttccaggcctgatcttgcctgt

SEQ ID NO: 1558055 - DNA, 17 bp, Homo sapiens
gttccagggtccctctg

SEQ ID NO: 1558056 - DNA, 21 bp, Homo sapiens
gttccagggtccctctgtgta

SEQ ID NO: 1558057 - DNA, 15 bp, Homo sapiens
gttccagtttctcct

SEQ ID NO: 1558058 - DNA, 15 bp, Homo sapiens
gttccatccaccacc

SEQ ID NO: 1558059 - DNA, 16 bp, Homo sapiens
gttccatccaccacct

SEQ ID NO: 1558060 - DNA, 17 bp, Homo sapiens
gttccatccaccacctt

SEQ ID NO: 1558061 - DNA, 19 bp, Homo sapiens
gttccatgcagccttgggg

SEQ ID NO: 1558062 - DNA, 14 bp, Homo sapiens
gttccatgcctgag

SEQ ID NO: 1558063 - DNA, 12 bp, Homo sapiens
gttcccaactga

SEQ ID NO: 1558064 - DNA, 14 bp, Homo sapiens
gttcccaataaaag

SEQ ID NO: 1558065 - DNA, 14 bp, Homo sapiens
gttcccacttggag

SEQ ID NO: 1558066 - DNA, 21 bp, Homo sapiens
gttcccagctccccccgccca

SEQ ID NO: 1558067 - DNA, 20 bp, Homo sapiens
gttccccacacagggcactg

SEQ ID NO: 1558068 - DNA, 14 bp, Homo sapiens
gttccccagagaaa

SEQ ID NO: 1558069 - DNA, 16 bp, Homo sapiens
gttcccccagcctgcc

SEQ ID NO: 1558070 - DNA, 20 bp, Homo sapiens
gttccccgcaacccacagct

SEQ ID NO: 1558071 - DNA, 12 bp, Homo sapiens
gttcccctggcc

SEQ ID NO: 1558072 - DNA, 13 bp, Homo sapiens
gttccccttggct

SEQ ID NO: 1558073 - DNA, 17 bp, Homo sapiens
gttccccttggcttcct

SEQ ID NO: 1558074 - DNA, 15 bp, Homo sapiens
gttcccggagcacag

SEQ ID NO: 1558075 - DNA, 17 bp, Homo sapiens
gttcccggagcacagcc

SEQ ID NO: 1558076 - DNA, 21 bp, Homo sapiens
gttcccggagcacagccctgg

SEQ ID NO: 1558077 - DNA, 17 bp, Homo sapiens
gttccctagagagaata

SEQ ID NO: 1558078 - DNA, 13 bp, Homo sapiens
gttccctcccaga

SEQ ID NO: 1558079 - DNA, 17 bp, Homo sapiens
gttccctgaaaacccag

SEQ ID NO: 1558080 - DNA, 12 bp, Homo sapiens
gttccctgcacc

SEQ ID NO: 1558081 - DNA, 14 bp, Homo sapiens
gttccctgcaccct

SEQ ID NO: 1558082 - DNA, 16 bp, Homo sapiens
gttccctgcaccctgg

SEQ ID NO: 1558083 - DNA, 13 bp, Homo sapiens
gttcccttcctct

SEQ ID NO: 1558084 - DNA, 19 bp, Homo sapiens
gttcccttcctcttcctgc

SEQ ID NO: 1558085 - DNA, 20 bp, Homo sapiens
gttcccttcctcttcctgcc

SEQ ID NO: 1558086 - DNA, 18 bp, Homo sapiens
gttcccttggcctcagaa

SEQ ID NO: 1558087 - DNA, 17 bp, Homo sapiens
gttcctactcacacttc

SEQ ID NO: 1558088 - DNA, 19 bp, Homo sapiens
gttcctccttttcttcacc

SEQ ID NO: 1558089 - DNA, 18 bp, Homo sapiens
gttcctctatactttgtt

SEQ ID NO: 1558090 - DNA, 13 bp, Homo sapiens
gttcctctgctca

SEQ ID NO: 1558091 - DNA, 23 bp, Homo sapiens
gttcctctgctcaccgcccatca

SEQ ID NO: 1558092 - DNA, 22 bp, Homo sapiens
gttcctctttggtgtacagact

SEQ ID NO: 1558093 - DNA, 21 bp, Homo sapiens
gttcctgagtgcgtggatctg

SEQ ID NO: 1558094 - DNA, 20 bp, Homo sapiens
gttcctgatgacccaggctg

SEQ ID NO: 1558095 - DNA, 23 bp, Homo sapiens
gttcctgctccatgactggctgt

SEQ ID NO: 1558096 - DNA, 18 bp, Homo sapiens
gttcctgctgtcctggtg

SEQ ID NO: 1558097 - DNA, 23 bp, Homo sapiens
gttcctggaagcaggtgctacaa

SEQ ID NO: 1558098 - DNA, 16 bp, Homo sapiens
gttcctggagttttga

SEQ ID NO: 1558099 - DNA, 21 bp, Homo sapiens
gttcctggttgttcctgcatc

SEQ ID NO: 1558100 - DNA, 20 bp, Homo sapiens
gttcctgtatggtggaagct

SEQ ID NO: 1558101 - DNA, 19 bp, Homo sapiens
gttccttatccctctcttc

SEQ ID NO: 1558102 - DNA, 14 bp, Homo sapiens
gttccttccctggg

SEQ ID NO: 1558103 - DNA, 17 bp, Homo sapiens
gttccttccctgggaag

SEQ ID NO: 1558104 - DNA, 15 bp, Homo sapiens
gttccttctctgggt

SEQ ID NO: 1558105 - DNA, 20 bp, Homo sapiens
gttccttgccttaataaata

SEQ ID NO: 1558106 - DNA, 18 bp, Homo sapiens
gttccttggccatgcaga

SEQ ID NO: 1558107 - DNA, 18 bp, Homo sapiens
gttcctttttaaatgtga

SEQ ID NO: 1558108 - DNA, 19 bp, Homo sapiens
gttcgagaccagcctggcc

SEQ ID NO: 1558109 - DNA, 22 bp, Homo sapiens
gttcgaggactacaaccaattt

SEQ ID NO: 1558110 - DNA, 14 bp, Homo sapiens
gttctaaagttcta

SEQ ID NO: 1558111 - DNA, 13 bp, Homo sapiens
gttctaagattct

SEQ ID NO: 1558112 - DNA, 17 bp, Homo sapiens
gttctaagattctaatg

SEQ ID NO: 1558113 - DNA, 14 bp, Homo sapiens
gttctaagattctg

SEQ ID NO: 1558114 - DNA, 21 bp, Homo sapiens
gttctaaggcctaggattcta

SEQ ID NO: 1558115 - DNA, 11 bp, Homo sapiens
gttctaaggct

SEQ ID NO: 1558116 - DNA, 14 bp, Homo sapiens
gttctaaggctctg

SEQ ID NO: 1558117 - DNA, 14 bp, Homo sapiens
gttctaagtttcta

SEQ ID NO: 1558118 - DNA, 16 bp, Homo sapiens
gttctaagtttctaag

SEQ ID NO: 1558119 - DNA, 18 bp, Homo sapiens
gttctaagtttctaagat

SEQ ID NO: 1558120 - DNA, 19 bp, Homo sapiens
gttctaataatttctaatg

SEQ ID NO: 1558121 - DNA, 16 bp, Homo sapiens
gttctacactcatctt

SEQ ID NO: 1558122 - DNA, 20 bp, Homo sapiens
gttctagacatggaggttct

SEQ ID NO: 1558123 - DNA, 15 bp, Homo sapiens
gttctagacttcccc

SEQ ID NO: 1558124 - DNA, 16 bp, Homo sapiens
gttctagacttcccca

SEQ ID NO: 1558125 - DNA, 22 bp, Homo sapiens
gttctagcatggcatatttttc

SEQ ID NO: 1558126 - DNA, 23 bp, Homo sapiens
gttctagtctcctttgcactgag

SEQ ID NO: 1558127 - DNA, 14 bp, Homo sapiens
gttctagtttgcat

SEQ ID NO: 1558128 - DNA, 18 bp, Homo sapiens
gttctataagtgaggaag

SEQ ID NO: 1558129 - DNA, 23 bp, Homo sapiens
gttctatcaggggtgcattctgg

SEQ ID NO: 1558130 - DNA, 15 bp, Homo sapiens
gttctatgcctttag

SEQ ID NO: 1558131 - DNA, 15 bp, Homo sapiens
gttctatttaatgga

SEQ ID NO: 1558132 - DNA, 14 bp, Homo sapiens
gttctatttctatc

SEQ ID NO: 1558133 - DNA, 17 bp, Homo sapiens
gttctatttctatctgc

SEQ ID NO: 1558134 - DNA, 14 bp, Homo sapiens
gttctattttactg

SEQ ID NO: 1558135 - DNA, 15 bp, Homo sapiens
gttctattttactgt

SEQ ID NO: 1558136 - DNA, 17 bp, Homo sapiens
gttctattttactgtct

SEQ ID NO: 1558137 - DNA, 21 bp, Homo sapiens
gttctcaagaatctagaagat

SEQ ID NO: 1558138 - DNA, 17 bp, Homo sapiens
gttctcacacccaccgt

SEQ ID NO: 1558139 - DNA, 18 bp, Homo sapiens
gttctcagatcttgacag

SEQ ID NO: 1558140 - DNA, 17 bp, Homo sapiens
gttctcaggtgttgcca

SEQ ID NO: 1558141 - DNA, 11 bp, Homo sapiens
gttctcatctt

SEQ ID NO: 1558142 - DNA, 12 bp, Homo sapiens
gttctcatgaag

SEQ ID NO: 1558143 - DNA, 23 bp, Homo sapiens
gttctcatttggtctgccagaat

SEQ ID NO: 1558144 - DNA, 17 bp, Homo sapiens
gttctccacccaccagt

SEQ ID NO: 1558145 - DNA, 22 bp, Homo sapiens
gttctccacccaccagtcaggg

SEQ ID NO: 1558146 - DNA, 13 bp, Homo sapiens
gttctccccaggg

SEQ ID NO: 1558147 - DNA, 18 bp, Homo sapiens
gttctccgttagctcctg

SEQ ID NO: 1558148 - DNA, 22 bp, Homo sapiens
gttctccgttagctcctgtggc

SEQ ID NO: 1558149 - DNA, 20 bp, Homo sapiens
gttctcctgaatattttttg

SEQ ID NO: 1558150 - DNA, 18 bp, Homo sapiens
gttctcctgtccctccat

SEQ ID NO: 1558151 - DNA, 13 bp, Homo sapiens
gttctctctgcct

SEQ ID NO: 1558152 - DNA, 22 bp, Homo sapiens
gttctctctgcctgtgagccag

SEQ ID NO: 1558153 - DNA, 15 bp, Homo sapiens
gttctcttctctctt

SEQ ID NO: 1558154 - DNA, 14 bp, Homo sapiens
gttctctttggaaa

SEQ ID NO: 1558155 - DNA, 15 bp, Homo sapiens
gttctctttggaaat

SEQ ID NO: 1558156 - DNA, 16 bp, Homo sapiens
gttctgacacacgtat

SEQ ID NO: 1558157 - DNA, 20 bp, Homo sapiens
gttctgagctgtaatttcgc

SEQ ID NO: 1558158 - DNA, 20 bp, Homo sapiens
gttctgcagacacgccttcc

SEQ ID NO: 1558159 - DNA, 20 bp, Homo sapiens
gttctgcagcggcagagcaa

SEQ ID NO: 1558160 - DNA, 15 bp, Homo sapiens
gttctgccagatctt

SEQ ID NO: 1558161 - DNA, 21 bp, Homo sapiens
gtttaaagaaagtgtatttgg

SEQ ID NO: 1558162 - DNA, 23 bp, Homo sapiens
gtttaaagaagctctccaggccc

SEQ ID NO: 1558163 - DNA, 16 bp, Homo sapiens
gtttaaagaataaagt

SEQ ID NO: 1558164 - DNA, 20 bp, Homo sapiens
gtttaaataaaatttaattt

SEQ ID NO: 1558165 - DNA, 17 bp, Homo sapiens
gtttctcttgagctggc

SEQ ID NO: 1558166 - DNA, 20 bp, Homo sapiens
gtttctcttgagctggcctc

SEQ ID NO: 1558167 - DNA, 18 bp, Homo sapiens
gtttctgaactctgacag

SEQ ID NO: 1558168 - DNA, 19 bp, Homo sapiens
gtttctgaagtacttaaac

SEQ ID NO: 1558169 - DNA, 13 bp, Homo sapiens
gtttctgactctg

SEQ ID NO: 1558170 - DNA, 17 bp, Homo sapiens
gtttctgactctgagct

SEQ ID NO: 1558171 - DNA, 22 bp, Homo sapiens
gtttctgcatgaatatcataca

SEQ ID NO: 1558172 - DNA, 21 bp, Homo sapiens
gtttctgcccacattggaccc

SEQ ID NO: 1558173 - DNA, 10 bp, Homo sapiens
gtttctggaa

SEQ ID NO: 1558174 - DNA, 13 bp, Homo sapiens
gtttctggacatt

SEQ ID NO: 1558175 - DNA, 19 bp, Homo sapiens
gtttgtgtgatttcctaaa

SEQ ID NO: 1558176 - DNA, 21 bp, Homo sapiens
gtttgtgtgtatttgtattaa

SEQ ID NO: 1558177 - DNA, 14 bp, Homo sapiens
gtttgtgtgtctta

SEQ ID NO: 1558178 - DNA, 15 bp, Homo sapiens
gtttgtgtgtcttaa

SEQ ID NO: 1558179 - DNA, 21 bp, Homo sapiens
gtttgtgtgttgtcttgaaag

SEQ ID NO: 1558180 - DNA, 17 bp, Homo sapiens
gtttgtgtttgattggc

SEQ ID NO: 1558181 - DNA, 22 bp, Homo sapiens
gtttgttatttacactggtcta

SEQ ID NO: 1558182 - DNA, 23 bp, Homo sapiens
gtttgtttcatatatacaggcat

SEQ ID NO: 1558183 - DNA, 19 bp, Homo sapiens
gtttgtttctccccctggg

SEQ ID NO: 1558184 - DNA, 20 bp, Homo sapiens
gtttgtttctccccctgggc

SEQ ID NO: 1558185 - DNA, 15 bp, Homo sapiens
gtttgtttgtctgtt

SEQ ID NO: 1558186 - DNA, 13 bp, Homo sapiens
gtttgtttttgct

SEQ ID NO: 1558187 - DNA, 16 bp, Homo sapiens
gtttgtttttgcttgt

SEQ ID NO: 1558188 - DNA, 17 bp, Homo sapiens
gtttgtttttttgccac

SEQ ID NO: 1558189 - DNA, 18 bp, Homo sapiens
gttttaaaactggacctg

SEQ ID NO: 1558190 - DNA, 12 bp, Homo sapiens
gttttaaaatta

SEQ ID NO: 1558191 - DNA, 13 bp, Homo sapiens
gttaacaaggaat

SEQ ID NO: 1558192 - DNA, 18 bp, Homo sapiens
gttaacacaatgtgaatt

SEQ ID NO: 1558193 - DNA, 23 bp, Homo sapiens
gttaacagagacagataactctc

SEQ ID NO: 1558194 - DNA, 19 bp, Homo sapiens
gttaacaggatattagaca

SEQ ID NO: 1558195 - DNA, 14 bp, Homo sapiens
gttaacatctttta

SEQ ID NO: 1558196 - DNA, 23 bp, Homo sapiens
gttaacattccaagactctagag

SEQ ID NO: 1558197 - DNA, 23 bp, Homo sapiens
gttaacattgaccaagaactgca

SEQ ID NO: 1558198 - DNA, 20 bp, Homo sapiens
gttaaccagaataaagttct

SEQ ID NO: 1558199 - DNA, 23 bp, Homo sapiens
gttaacccatttttgagccaagc

SEQ ID NO: 1558200 - DNA, 17 bp, Homo sapiens
gttaacctcagtgtcat

SEQ ID NO: 1558201 - DNA, 14 bp, Homo sapiens
gttaacgtcatctc

SEQ ID NO: 1558202 - DNA, 19 bp, Homo sapiens
gttaacgtgatgtgccact

SEQ ID NO: 1558203 - DNA, 18 bp, Homo sapiens
gttaactgtgaaatacca

SEQ ID NO: 1558204 - DNA, 19 bp, Homo sapiens
gttaacttggtcagagcca

SEQ ID NO: 1558205 - DNA, 16 bp, Homo sapiens
gttaagaaagcactta

SEQ ID NO: 1558206 - DNA, 13 bp, Homo sapiens
gttaagacctggc

SEQ ID NO: 1558207 - DNA, 14 bp, Homo sapiens
gttaagacctggca

SEQ ID NO: 1558208 - DNA, 21 bp, Homo sapiens
gttaaggaagatcctgaagca

SEQ ID NO: 1558209 - DNA, 14 bp, Homo sapiens
gttaaggccagggc

SEQ ID NO: 1558210 - DNA, 16 bp, Homo sapiens
gttaaggcctgaatca

SEQ ID NO: 1558211 - DNA, 18 bp, Homo sapiens
gttaagtcaattctgtta

SEQ ID NO: 1558212 - DNA, 14 bp, Homo sapiens
gttaatacaaggta

SEQ ID NO: 1558213 - DNA, 19 bp, Homo sapiens
gttaatacacagtacttta

SEQ ID NO: 1558214 - DNA, 23 bp, Homo sapiens
gttaatccacatctttactcagg

SEQ ID NO: 1558215 - DNA, 15 bp, Homo sapiens
gttaatgtcattgct

SEQ ID NO: 1558216 - DNA, 15 bp, Homo sapiens
gttaatgttatatca

SEQ ID NO: 1558217 - DNA, 14 bp, Homo sapiens
gttaattttgctaa

SEQ ID NO: 1558218 - DNA, 20 bp, Homo sapiens
gttaatttttccaactacta

SEQ ID NO: 1558219 - DNA, 21 bp, Homo sapiens
gttaatttttcctgcatgttc

SEQ ID NO: 1558220 - DNA, 13 bp, Homo sapiens
gttacaaactgca

SEQ ID NO: 1558221 - DNA, 16 bp, Homo sapiens
gttacaagtgttctta

SEQ ID NO: 1558222 - DNA, 21 bp, Homo sapiens
gttacacactttttaagaaat

SEQ ID NO: 1558223 - DNA, 19 bp, Homo sapiens
gttacacattaaacaggat

SEQ ID NO: 1558224 - DNA, 15 bp, Homo sapiens
gttacactaaaaggt

SEQ ID NO: 1558225 - DNA, 17 bp, Homo sapiens
gttacagagacctatgt

SEQ ID NO: 1558226 - DNA, 15 bp, Homo sapiens
gttacagcttcgctg

SEQ ID NO: 1558227 - DNA, 15 bp, Homo sapiens
gttacagtgcagaca

SEQ ID NO: 1558228 - DNA, 18 bp, Homo sapiens
gttacataagataaatgt

SEQ ID NO: 1558229 - DNA, 21 bp, Homo sapiens
gttaccactcttttgctgtgc

SEQ ID NO: 1558230 - DNA, 21 bp, Homo sapiens
gttaccatttttctggattta

SEQ ID NO: 1558231 - DNA, 20 bp, Homo sapiens
gttacccagggctctgcagc

SEQ ID NO: 1558232 - DNA, 13 bp, Homo sapiens
gttacctaattat

SEQ ID NO: 1558233 - DNA, 13 bp, Homo sapiens
gttacctactttg

SEQ ID NO: 1558234 - DNA, 16 bp, Homo sapiens
gttacctactttgact

SEQ ID NO: 1558235 - DNA, 17 bp, Homo sapiens
gttacctcctataaact

SEQ ID NO: 1558236 - DNA, 23 bp, Homo sapiens
gttacctctattttaattactgc

SEQ ID NO: 1558237 - DNA, 20 bp, Homo sapiens
gttacctgtcattttgcact

SEQ ID NO: 1558238 - DNA, 21 bp, Homo sapiens
gttacctgtcattttgcactg

SEQ ID NO: 1558239 - DNA, 15 bp, Homo sapiens
gttaccttatagtta

SEQ ID NO: 1558240 - DNA, 19 bp, Homo sapiens
gttactatggtaacacttt

SEQ ID NO: 1558241 - DNA, 12 bp, Homo sapiens
gttactcagccc

SEQ ID NO: 1558242 - DNA, 14 bp, Homo sapiens
gttactcagccctg

SEQ ID NO: 1558243 - DNA, 17 bp, Homo sapiens
gttactcagccctgggc

SEQ ID NO: 1558244 - DNA, 20 bp, Homo sapiens
gttactcagtgttagagaaa

SEQ ID NO: 1558245 - DNA, 18 bp, Homo sapiens
gttactctccaacctgga

SEQ ID NO: 1558246 - DNA, 11 bp, Homo sapiens
gttactctgaa

SEQ ID NO: 1558247 - DNA, 12 bp, Homo sapiens
gttactctgtcc

SEQ ID NO: 1558248 - DNA, 12 bp, Homo sapiens
gttactgagtga

SEQ ID NO: 1558249 - DNA, 20 bp, Homo sapiens
gttactgctgattcttgtaa

SEQ ID NO: 1558250 - DNA, 22 bp, Homo sapiens
gttactgctgattcttgtaaat

SEQ ID NO: 1558251 - DNA, 14 bp, Homo sapiens
gttactgctttgca

SEQ ID NO: 1558252 - DNA, 17 bp, Homo sapiens
gttactgggccctgagt

SEQ ID NO: 1558253 - DNA, 13 bp, Homo sapiens
gttactgtaaatg

SEQ ID NO: 1558254 - DNA, 12 bp, Homo sapiens
gttactgtattt

SEQ ID NO: 1558255 - DNA, 13 bp, Homo sapiens
gttactgtgtaat

SEQ ID NO: 1558256 - DNA, 15 bp, Homo sapiens
gttactgttgcactg

SEQ ID NO: 1558257 - DNA, 13 bp, Homo sapiens
gttacttccttat

SEQ ID NO: 1558258 - DNA, 18 bp, Homo sapiens
gttacttctcccctgggt

SEQ ID NO: 1558259 - DNA, 14 bp, Homo sapiens
gttacttcttctct

SEQ ID NO: 1558260 - DNA, 15 bp, Homo sapiens
gttacttcttctctt

SEQ ID NO: 1558261 - DNA, 16 bp, Homo sapiens
gttacttcttctctta

SEQ ID NO: 1558262 - DNA, 12 bp, Homo sapiens
gttactttggca

SEQ ID NO: 1558263 - DNA, 22 bp, Homo sapiens
gttagaaaatgacttatttctg

SEQ ID NO: 1558264 - DNA, 13 bp, Homo sapiens
gttagaaagtgct

SEQ ID NO: 1558265 - DNA, 14 bp, Homo sapiens
gttagaatgtctgc

SEQ ID NO: 1558266 - DNA, 18 bp, Homo sapiens
gttagacgccttccaggt

SEQ ID NO: 1558267 - DNA, 23 bp, Homo sapiens
gttagacgccttccaggtcagga

SEQ ID NO: 1558268 - DNA, 15 bp, Homo sapiens
gttagattttgcatt

SEQ ID NO: 1558269 - DNA, 21 bp, Homo sapiens
gttagcatgcgcgctgtgggc

SEQ ID NO: 1558270 - DNA, 20 bp, Homo sapiens
gttagccctcagtcagttcc

SEQ ID NO: 1558271 - DNA, 18 bp, Homo sapiens
gttaggaataacactgca

SEQ ID NO: 1558272 - DNA, 20 bp, Homo sapiens
gttaggaggctgcatgctct

SEQ ID NO: 1558273 - DNA, 22 bp, Homo sapiens
gttaggaggctgcatgctctgg

SEQ ID NO: 1558274 - DNA, 21 bp, Homo sapiens
gttaggagtggttctcatttg

SEQ ID NO: 1558275 - DNA, 15 bp, Homo sapiens
gttaggagttcgaga

SEQ ID NO: 1558276 - DNA, 17 bp, Homo sapiens
gttagggagagagaagc

SEQ ID NO: 1558277 - DNA, 21 bp, Homo sapiens
gttagggagagagaagcaggc

SEQ ID NO: 1558278 - DNA, 11 bp, Homo sapiens
gttagggaggg

SEQ ID NO: 1558279 - DNA, 22 bp, Homo sapiens
gttaggggccttagggcactgg

SEQ ID NO: 1558280 - DNA, 22 bp, Homo sapiens
gttaggtgctgaatgaagctgc

SEQ ID NO: 1558281 - DNA, 17 bp, Homo sapiens
gttaggttgtctccagg

SEQ ID NO: 1558282 - DNA, 17 bp, Homo sapiens
gttagtatctaacatgt

SEQ ID NO: 1558283 - DNA, 15 bp, Homo sapiens
gttagtattaaaatc

SEQ ID NO: 1558284 - DNA, 19 bp, Homo sapiens
gttagtgtgtgtgcatgtg

SEQ ID NO: 1558285 - DNA, 22 bp, Homo sapiens
gttagttaccttatagttactg

SEQ ID NO: 1558286 - DNA, 13 bp, Homo sapiens
gttagttcccaac

SEQ ID NO: 1558287 - DNA, 16 bp, Homo sapiens
gttagtttgtatatat

SEQ ID NO: 1558288 - DNA, 17 bp, Homo sapiens
gttagtttgtatatatt

SEQ ID NO: 1558289 - DNA, 14 bp, Homo sapiens
gttagtttttactt

SEQ ID NO: 1558290 - DNA, 22 bp, Homo sapiens
gttataaaaaatggttcagaat

SEQ ID NO: 1558291 - DNA, 14 bp, Homo sapiens
gttataaatatttt

SEQ ID NO: 1558292 - DNA, 17 bp, Homo sapiens
gttataatgaatgactt

SEQ ID NO: 1558293 - DNA, 23 bp, Homo sapiens
gttataattttttttaaaataga

SEQ ID NO: 1558294 - DNA, 14 bp, Homo sapiens
gttatacaaggcaa

SEQ ID NO: 1558295 - DNA, 20 bp, Homo sapiens
gttatagacagtcgttccca

SEQ ID NO: 1558296 - DNA, 16 bp, Homo sapiens
gttatagatttagcta

SEQ ID NO: 1558297 - DNA, 18 bp, Homo sapiens
gttatagatttagctatt

SEQ ID NO: 1558298 - DNA, 20 bp, Homo sapiens
gttatagatttagctattta

SEQ ID NO: 1558299 - DNA, 21 bp, Homo sapiens
gttatagccctgccctcccaa

SEQ ID NO: 1558300 - DNA, 20 bp, Homo sapiens
gttataggtaaaatctctga

SEQ ID NO: 1558301 - DNA, 15 bp, Homo sapiens
gttatagtatatctg

SEQ ID NO: 1558302 - DNA, 17 bp, Homo sapiens
gttatatataataaata

SEQ ID NO: 1558303 - DNA, 14 bp, Homo sapiens
gttatatcaacaga

SEQ ID NO: 1558304 - DNA, 18 bp, Homo sapiens
gttatatcatcaatactt

SEQ ID NO: 1558305 - DNA, 17 bp, Homo sapiens
gttatattatttacatt

SEQ ID NO: 1558306 - DNA, 16 bp, Homo sapiens
gttatcacttatatat

SEQ ID NO: 1558307 - DNA, 18 bp, Homo sapiens
gttatcatgaattttaaa

SEQ ID NO: 1558308 - DNA, 20 bp, Homo sapiens
gttatcattttttcctgttt

SEQ ID NO: 1558309 - DNA, 13 bp, Homo sapiens
gttatgaacagct

SEQ ID NO: 1558310 - DNA, 15 bp, Homo sapiens
gttatgaacagctgt

SEQ ID NO: 1558311 - DNA, 13 bp, Homo sapiens
gttatgaacatcc

SEQ ID NO: 1558312 - DNA, 15 bp, Homo sapiens
gttatgcactgcctg

SEQ ID NO: 1558313 - DNA, 19 bp, Homo sapiens
gttatgcactgcctgccat

SEQ ID NO: 1558314 - DNA, 22 bp, Homo sapiens
gttatgtactagtgttctgttt

SEQ ID NO: 1558315 - DNA, 22 bp, Homo sapiens
gttatgtcagcagctctgagac

SEQ ID NO: 1558316 - DNA, 23 bp, Homo sapiens
gttatgtcagcagctctgagaca

SEQ ID NO: 1558317 - DNA, 20 bp, Homo sapiens
gttatgttcccagcagtggg

SEQ ID NO: 1558318 - DNA, 13 bp, Homo sapiens
gttattaaaattg

SEQ ID NO: 1558319 - DNA, 15 bp, Homo sapiens
gttattacttcctca

SEQ ID NO: 1558320 - DNA, 21 bp, Homo sapiens
gttattagggtggtatttagt

SEQ ID NO: 1558321 - DNA, 17 bp, Homo sapiens
gttattatctgggctta

SEQ ID NO: 1558322 - DNA, 16 bp, Homo sapiens
gttattattgctgttt

SEQ ID NO: 1558323 - DNA, 19 bp, Homo sapiens
gttattcaaatttgtacag

SEQ ID NO: 1558324 - DNA, 21 bp, Homo sapiens
gttattgataagttcatacat

SEQ ID NO: 1558325 - DNA, 22 bp, Homo sapiens
gttattgataagttcatacatt

SEQ ID NO: 1558326 - DNA, 22 bp, Homo sapiens
gttattgggagtcttaataaaa

SEQ ID NO: 1558327 - DNA, 21 bp, Homo sapiens
gttattgggcaagtgattgaa

SEQ ID NO: 1558328 - DNA, 10 bp, Homo sapiens
gttatttaaa

SEQ ID NO: 1558329 - DNA, 18 bp, Homo sapiens
gttatttaatatggtatt

SEQ ID NO: 1558330 - DNA, 15 bp, Homo sapiens
gttatttaattgaaa

SEQ ID NO: 1558331 - DNA, 14 bp, Homo sapiens
gttatttacactgg

SEQ ID NO: 1558332 - DNA, 16 bp, Homo sapiens
gttatttacactggtc

SEQ ID NO: 1558333 - DNA, 19 bp, Homo sapiens
gttatttccccagccacag

SEQ ID NO: 1558334 - DNA, 17 bp, Homo sapiens
gttattttctacagtgg

SEQ ID NO: 1558335 - DNA, 13 bp, Homo sapiens
gttattttgcttt

SEQ ID NO: 1558336 - DNA, 19 bp, Homo sapiens
gttatttttattaaatgta

SEQ ID NO: 1558337 - DNA, 21 bp, Homo sapiens
gttatttttctcttgtaccat

SEQ ID NO: 1558338 - DNA, 14 bp, Homo sapiens
gttatttttgtaca

SEQ ID NO: 1558339 - DNA, 13 bp, Homo sapiens
gttcaaagactgt

SEQ ID NO: 1558340 - DNA, 16 bp, Homo sapiens
gttcaaagactgtgaa

SEQ ID NO: 1558341 - DNA, 22 bp, Homo sapiens
gttcaaagaggtgaacattaaa

SEQ ID NO: 1558342 - DNA, 21 bp, Homo sapiens
gttcaaagatgcattttgagt

SEQ ID NO: 1558343 - DNA, 20 bp, Homo sapiens
gttcaaagtgtatatttatt

SEQ ID NO: 1558344 - DNA, 14 bp, Homo sapiens
gttcaaatcctcac

SEQ ID NO: 1558345 - DNA, 22 bp, Homo sapiens
gttcaacaaagaaacaaagatg

SEQ ID NO: 1558346 - DNA, 15 bp, Homo sapiens
gttcaacccacagct

SEQ ID NO: 1558347 - DNA, 18 bp, Homo sapiens
gttcaagcacactggaat

SEQ ID NO: 1558348 - DNA, 14 bp, Homo sapiens
gttcaagcccaggc

SEQ ID NO: 1558349 - DNA, 19 bp, Homo sapiens
gttcaagcgattctcctgt

SEQ ID NO: 1558350 - DNA, 20 bp, Homo sapiens
gttcaagctattctcatgcc

SEQ ID NO: 1558351 - DNA, 14 bp, Homo sapiens
gttcaataagcatt

SEQ ID NO: 1558352 - DNA, 18 bp, Homo sapiens
gttcaataataaatattt

SEQ ID NO: 1558353 - DNA, 21 bp, Homo sapiens
gttcaatactcttgaaatgta

SEQ ID NO: 1558354 - DNA, 15 bp, Homo sapiens
gttcaatgttccatt

SEQ ID NO: 1558355 - DNA, 23 bp, Homo sapiens
gttcacaaactacctctggacag

SEQ ID NO: 1558356 - DNA, 20 bp, Homo sapiens
gttcacaaactgtgaaaata

SEQ ID NO: 1558357 - DNA, 17 bp, Homo sapiens
gttcacagaaaaagcat

SEQ ID NO: 1558358 - DNA, 16 bp, Homo sapiens
gttcacccacagggct

SEQ ID NO: 1558359 - DNA, 21 bp, Homo sapiens
gttcaccttcaaaatgttcta

SEQ ID NO: 1558360 - DNA, 22 bp, Homo sapiens
gttcaccttggaagggcgttct

SEQ ID NO: 1558361 - DNA, 22 bp, Homo sapiens
gttcagaaatttggcattgatc

SEQ ID NO: 1558362 - DNA, 14 bp, Homo sapiens
gttcagaagaaatt

SEQ ID NO: 1558363 - DNA, 16 bp, Homo sapiens
gttcagaatggcagtc

SEQ ID NO: 1558364 - DNA, 22 bp, Homo sapiens
gttcagaatggcagtcctggag

SEQ ID NO: 1558365 - DNA, 23 bp, Homo sapiens
gttcagaatggcagtcctggagg

SEQ ID NO: 1558366 - DNA, 15 bp, Homo sapiens
gttcagacccctgcc

SEQ ID NO: 1558367 - DNA, 22 bp, Homo sapiens
gttcagagactcagggccccag

SEQ ID NO: 1558368 - DNA, 17 bp, Homo sapiens
gttcagatgtgcatttc

SEQ ID NO: 1558369 - DNA, 16 bp, Homo sapiens
gttcagattttactgt

SEQ ID NO: 1558370 - DNA, 21 bp, Homo sapiens
gttcagattttactgtctatg

SEQ ID NO: 1558371 - DNA, 22 bp, Homo sapiens
gttcagcaaactaaccagcatt

SEQ ID NO: 1558372 - DNA, 16 bp, Homo sapiens
gttcagcactgtccct

SEQ ID NO: 1558373 - DNA, 12 bp, Homo sapiens
gttcagcagaac

SEQ ID NO: 1558374 - DNA, 22 bp, Homo sapiens
gttcagcagaacctgcacacag

SEQ ID NO: 1558375 - DNA, 14 bp, Homo sapiens
gttcagcccctcct

SEQ ID NO: 1558376 - DNA, 17 bp, Homo sapiens
gttcagcccctcctctg

SEQ ID NO: 1558377 - DNA, 19 bp, Homo sapiens
gttcagctaagctaggaat

SEQ ID NO: 1558378 - DNA, 17 bp, Homo sapiens
gttcagctctttccaaa

SEQ ID NO: 1558379 - DNA, 21 bp, Homo sapiens
gttcagctctttccaaattaa

SEQ ID NO: 1558380 - DNA, 23 bp, Homo sapiens
gttcagcttggtgggagaaagtc

SEQ ID NO: 1558381 - DNA, 19 bp, Homo sapiens
gttcagctttaaaggccag

SEQ ID NO: 1558382 - DNA, 18 bp, Homo sapiens
gttcaggagtcccaagga

SEQ ID NO: 1558383 - DNA, 19 bp, Homo sapiens
gttcaggcccggcagggcg

SEQ ID NO: 1558384 - DNA, 23 bp, Homo sapiens
gttcagtgagatatcatagagac

SEQ ID NO: 1558385 - DNA, 16 bp, Homo sapiens
gttcagtgccttcctc

SEQ ID NO: 1558386 - DNA, 17 bp, Homo sapiens
gttcagtgttaagtgat

SEQ ID NO: 1558387 - DNA, 17 bp, Homo sapiens
gttcataataaaagtga

SEQ ID NO: 1558388 - DNA, 14 bp, Homo sapiens
gttcatacatattt

SEQ ID NO: 1558389 - DNA, 11 bp, Homo sapiens
gttcatacatt

SEQ ID NO: 1558390 - DNA, 14 bp, Homo sapiens
gttcatacatttga

SEQ ID NO: 1558391 - DNA, 14 bp, Homo sapiens
gttcatagcccagt

SEQ ID NO: 1558392 - DNA, 17 bp, Homo sapiens
gttcatagggtctcttc

SEQ ID NO: 1558393 - DNA, 18 bp, Homo sapiens
gttcatagggtctcttca

SEQ ID NO: 1558394 - DNA, 18 bp, Homo sapiens
gttcatcaccatttcctc

SEQ ID NO: 1558395 - DNA, 17 bp, Homo sapiens
gttcatcacctgctaga

SEQ ID NO: 1558396 - DNA, 13 bp, Homo sapiens
gttcatcagtgtt

SEQ ID NO: 1558397 - DNA, 21 bp, Homo sapiens
gttcatcagtgttaaaaaatt

SEQ ID NO: 1558398 - DNA, 17 bp, Homo sapiens
gttcatcatcctaagct

SEQ ID NO: 1558399 - DNA, 19 bp, Homo sapiens
gttcatccgcactgtaaat

SEQ ID NO: 1558400 - DNA, 22 bp, Homo sapiens
gttcatcctcattgcctcctgt

SEQ ID NO: 1558401 - DNA, 20 bp, Homo sapiens
gttcatctatggcagtccag

SEQ ID NO: 1558402 - DNA, 13 bp, Homo sapiens
gttcatcttgcag

SEQ ID NO: 1558403 - DNA, 14 bp, Homo sapiens
gttcatgagaatct

SEQ ID NO: 1558404 - DNA, 16 bp, Homo sapiens
gttcatgccaccatgg

SEQ ID NO: 1558405 - DNA, 21 bp, Homo sapiens
gttcatgtctgaaacagagaa

SEQ ID NO: 1558406 - DNA, 15 bp, Homo sapiens
gttcatgtttgtaaa

SEQ ID NO: 1558407 - DNA, 19 bp, Homo sapiens
gttcattataatctcaaag

SEQ ID NO: 1558408 - DNA, 23 bp, Homo sapiens
gttcattctcccgcttcctggcc

SEQ ID NO: 1558409 - DNA, 14 bp, Homo sapiens
gttcattctgatgt

SEQ ID NO: 1558410 - DNA, 16 bp, Homo sapiens
gttcattctgatgtcc

SEQ ID NO: 1558411 - DNA, 21 bp, Homo sapiens
gttcattgatgggatttttgt

SEQ ID NO: 1558412 - DNA, 20 bp, Homo sapiens
gttcatttggtgttcctgga

SEQ ID NO: 1558413 - DNA, 22 bp, Homo sapiens
gttcatttggtgttcctggaag

SEQ ID NO: 1558414 - DNA, 23 bp, Homo sapiens
gttcatttggtgttcctggaagc

SEQ ID NO: 1558415 - DNA, 13 bp, Homo sapiens
gttcattttagtg

SEQ ID NO: 1558416 - DNA, 13 bp, Homo sapiens
gttcattttgagt

SEQ ID NO: 1558417 - DNA, 19 bp, Homo sapiens
gttccaaaatattgacatt

SEQ ID NO: 1558418 - DNA, 16 bp, Homo sapiens
gttccaaaccctcctg

SEQ ID NO: 1558419 - DNA, 18 bp, Homo sapiens
gttccaaaccctcctggg

SEQ ID NO: 1558420 - DNA, 17 bp, Homo sapiens
gttccaaagtcacagga

SEQ ID NO: 1558421 - DNA, 18 bp, Homo sapiens
gttccaacatgcaatact

SEQ ID NO: 1558422 - DNA, 19 bp, Homo sapiens
gttccaacatgcaatactg

SEQ ID NO: 1558423 - DNA, 23 bp, Homo sapiens
gttccaacatgcaatactggtca

SEQ ID NO: 1558424 - DNA, 21 bp, Homo sapiens
gtggtaggcctataaaattaa

SEQ ID NO: 1558425 - DNA, 17 bp, Homo sapiens
gtggtatgagggggtgg

SEQ ID NO: 1558426 - DNA, 21 bp, Homo sapiens
gtggtatgtaatttatgcaag

SEQ ID NO: 1558427 - DNA, 14 bp, Homo sapiens
gtggtatgtctgcc

SEQ ID NO: 1558428 - DNA, 22 bp, Homo sapiens
gtggtcacaacttgatggctgc

SEQ ID NO: 1558429 - DNA, 15 bp, Homo sapiens
gtggtcacagcggag

SEQ ID NO: 1558430 - DNA, 17 bp, Homo sapiens
gtggtcaccttcgagta

SEQ ID NO: 1558431 - DNA, 15 bp, Homo sapiens
gtggtcagggcaggg

SEQ ID NO: 1558432 - DNA, 18 bp, Homo sapiens
gtggtcagggcagggctc

SEQ ID NO: 1558433 - DNA, 12 bp, Homo sapiens
gtggtccagctc

SEQ ID NO: 1558434 - DNA, 14 bp, Homo sapiens
gtggtccagctctt

SEQ ID NO: 1558435 - DNA, 23 bp, Homo sapiens
gtggtctgttggcaggctggcca

SEQ ID NO: 1558436 - DNA, 17 bp, Homo sapiens
gtggtgaggggctttct

SEQ ID NO: 1558437 - DNA, 19 bp, Homo sapiens
gtggtgatcaattaaatgt

SEQ ID NO: 1558438 - DNA, 21 bp, Homo sapiens
gtggtgatttgaaaaatataa

SEQ ID NO: 1558439 - DNA, 16 bp, Homo sapiens
gtggtgccatccccag

SEQ ID NO: 1558440 - DNA, 13 bp, Homo sapiens
gtggtggcctggt

SEQ ID NO: 1558441 - DNA, 18 bp, Homo sapiens
gtggtggcctggtccctg

SEQ ID NO: 1558442 - DNA, 19 bp, Homo sapiens
gtggtggctccccctctgc

SEQ ID NO: 1558443 - DNA, 15 bp, Homo sapiens
gtggtgggccctgag

SEQ ID NO: 1558444 - DNA, 15 bp, Homo sapiens
gtggtgtcagaccct

SEQ ID NO: 1558445 - DNA, 13 bp, Homo sapiens
gtggtgtgactct

SEQ ID NO: 1558446 - DNA, 18 bp, Homo sapiens
gtggtgtgtccctggaca

SEQ ID NO: 1558447 - DNA, 22 bp, Homo sapiens
gtggtgtgtccctggacacagc

SEQ ID NO: 1558448 - DNA, 23 bp, Homo sapiens
gtggttattggactccaggcctg

SEQ ID NO: 1558449 - DNA, 13 bp, Homo sapiens
gtggttcctgtgg

SEQ ID NO: 1558450 - DNA, 15 bp, Homo sapiens
gtggttctcatttgg

SEQ ID NO: 1558451 - DNA, 20 bp, Homo sapiens
gtggttggggccctgccctg

SEQ ID NO: 1558452 - DNA, 18 bp, Homo sapiens
gtggtttaggctatttgt

SEQ ID NO: 1558453 - DNA, 18 bp, Homo sapiens
gtggtttcagatgtgcaa

SEQ ID NO: 1558454 - DNA, 14 bp, Homo sapiens
gtggtttcatgtta

SEQ ID NO: 1558455 - DNA, 12 bp, Homo sapiens
gtggtttggaat

SEQ ID NO: 1558456 - DNA, 23 bp, Homo sapiens
gtggttttagattttctggttct

SEQ ID NO: 1558457 - DNA, 24 bp, Homo sapiens
gtggttttcccctccctgggttca

SEQ ID NO: 1558458 - DNA, 17 bp, Homo sapiens
gtgtaaaaaatggaaaa

SEQ ID NO: 1558459 - DNA, 18 bp, Homo sapiens
gtgtaaaaaatggaaaaa

SEQ ID NO: 1558460 - DNA, 19 bp, Homo sapiens
gtgtaaaaaatggaaaaaa

SEQ ID NO: 1558461 - DNA, 21 bp, Homo sapiens
gtgtaaaaaatggaaaaaaac

SEQ ID NO: 1558462 - DNA, 14 bp, Homo sapiens
gtgtaaaaaatgtc

SEQ ID NO: 1558463 - DNA, 18 bp, Homo sapiens
gtgtaaaaagcctccttg

SEQ ID NO: 1558464 - DNA, 19 bp, Homo sapiens
gtgtaacaattgtgtagcc

SEQ ID NO: 1558465 - DNA, 23 bp, Homo sapiens
gtgtaacactgcaagaagtcttg

SEQ ID NO: 1558466 - DNA, 17 bp, Homo sapiens
gtgtaacaggtctcctc

SEQ ID NO: 1558467 - DNA, 22 bp, Homo sapiens
gtgtaaccgtaacccaccccca

SEQ ID NO: 1558468 - DNA, 16 bp, Homo sapiens
gtgtaactcccagtga

SEQ ID NO: 1558469 - DNA, 13 bp, Homo sapiens
gtgtaacttcctg

SEQ ID NO: 1558470 - DNA, 14 bp, Homo sapiens
gtgtaacttcctgc

SEQ ID NO: 1558471 - DNA, 16 bp, Homo sapiens
gtgtaacttcctgctg

SEQ ID NO: 1558472 - DNA, 18 bp, Homo sapiens
gtgtaacttcctgctgca

SEQ ID NO: 1558473 - DNA, 19 bp, Homo sapiens
gtgtaagaagctgtgaata

SEQ ID NO: 1558474 - DNA, 22 bp, Homo sapiens
gtgtaagtgtgagtaagagctg

SEQ ID NO: 1558475 - DNA, 14 bp, Homo sapiens
gtgtaatatgaaat

SEQ ID NO: 1558476 - DNA, 14 bp, Homo sapiens
gtgtaattatcatg

SEQ ID NO: 1558477 - DNA, 22 bp, Homo sapiens
gtgtaatttaaaattgtgatgt

SEQ ID NO: 1558478 - DNA, 14 bp, Homo sapiens
gtgtaatttaagtg

SEQ ID NO: 1558479 - DNA, 14 bp, Homo sapiens
gtgtaatttgaaga

SEQ ID NO: 1558480 - DNA, 16 bp, Homo sapiens
gtgtacaaaactgtaa

SEQ ID NO: 1558481 - DNA, 15 bp, Homo sapiens
gtgtacacgggactg

SEQ ID NO: 1558482 - DNA, 21 bp, Homo sapiens
gtgtacagtgaattgtctttt

SEQ ID NO: 1558483 - DNA, 16 bp, Homo sapiens
gtgtacataactgaaa

SEQ ID NO: 1558484 - DNA, 14 bp, Homo sapiens
gtgtacatgtacat

SEQ ID NO: 1558485 - DNA, 21 bp, Homo sapiens
gtgtaccacttcctgaggcct

SEQ ID NO: 1558486 - DNA, 22 bp, Homo sapiens
gtgtaccacttcctgaggcctc

SEQ ID NO: 1558487 - DNA, 22 bp, Homo sapiens
gtgtaccctggggcaatagggt

SEQ ID NO: 1558488 - DNA, 19 bp, Homo sapiens
gtgtacctctagaatccca

SEQ ID NO: 1558489 - DNA, 22 bp, Homo sapiens
gtgtacctctagaatcccagca

SEQ ID NO: 1558490 - DNA, 20 bp, Homo sapiens
gtgtactctataagaggtgt

SEQ ID NO: 1558491 - DNA, 15 bp, Homo sapiens
gtgtacttaactatt

SEQ ID NO: 1558492 - DNA, 19 bp, Homo sapiens
gtgtacttcccgggccagg

SEQ ID NO: 1558493 - DNA, 20 bp, Homo sapiens
gtgtagccagccaggtgcat

SEQ ID NO: 1558494 - DNA, 11 bp, Homo sapiens
gtgtagccttt

SEQ ID NO: 1558495 - DNA, 12 bp, Homo sapiens
gtgtagcctttt

SEQ ID NO: 1558496 - DNA, 13 bp, Homo sapiens
gtgtagccttttt

SEQ ID NO: 1558497 - DNA, 20 bp, Homo sapiens
gtgtagcctttttgtataaa

SEQ ID NO: 1558498 - DNA, 12 bp, Homo sapiens
gtgtagctgtaa

SEQ ID NO: 1558499 - DNA, 13 bp, Homo sapiens
gtgtagctgtcct

SEQ ID NO: 1558500 - DNA, 15 bp, Homo sapiens
gtgtagctgtgtggc

SEQ ID NO: 1558501 - DNA, 16 bp, Homo sapiens
gtgtaggggccacctc

SEQ ID NO: 1558502 - DNA, 18 bp, Homo sapiens
gtgtaggggccacctcct

SEQ ID NO: 1558503 - DNA, 20 bp, Homo sapiens
gtgtagtatcttgaaatcct

SEQ ID NO: 1558504 - DNA, 20 bp, Homo sapiens
gtgtagtggaagagcagcct

SEQ ID NO: 1558505 - DNA, 21 bp, Homo sapiens
gtgtagtggaagagcagcctg

SEQ ID NO: 1558506 - DNA, 12 bp, Homo sapiens
gtgtataaaaat

SEQ ID NO: 1558507 - DNA, 14 bp, Homo sapiens
gtgtataatataaa

SEQ ID NO: 1558508 - DNA, 22 bp, Homo sapiens
gtgtatagtgttcacaaactgt

SEQ ID NO: 1558509 - DNA, 23 bp, Homo sapiens
gtgtatagtgttcacaaactgtg

SEQ ID NO: 1558510 - DNA, 17 bp, Homo sapiens
gtgtatatttattcata

SEQ ID NO: 1558511 - DNA, 19 bp, Homo sapiens
gtgtatgccacacctggcc

SEQ ID NO: 1558512 - DNA, 19 bp, Homo sapiens
gtgtatggaaataaatgta

SEQ ID NO: 1558513 - DNA, 19 bp, Homo sapiens
gtgtatggcgttggtttgt

SEQ ID NO: 1558514 - DNA, 17 bp, Homo sapiens
gtgtatgtacatatata

SEQ ID NO: 1558515 - DNA, 21 bp, Homo sapiens
gtgtatgtgggggtctgtgtg

SEQ ID NO: 1558516 - DNA, 12 bp, Homo sapiens
gtgtatgtgtgt

SEQ ID NO: 1558517 - DNA, 22 bp, Homo sapiens
gtgtatgtttgcacacttgtgt

SEQ ID NO: 1558518 - DNA, 16 bp, Homo sapiens
gtgtattcagaggcag

SEQ ID NO: 1558519 - DNA, 13 bp, Homo sapiens
gtgtattccaaga

SEQ ID NO: 1558520 - DNA, 20 bp, Homo sapiens
gtgtattccaagacatgtct

SEQ ID NO: 1558521 - DNA, 14 bp, Homo sapiens
gtgtattctctgta

SEQ ID NO: 1558522 - DNA, 12 bp, Homo sapiens
gtgtattctgtg

SEQ ID NO: 1558523 - DNA, 20 bp, Homo sapiens
gtgtattgatgcaatataag

SEQ ID NO: 1558524 - DNA, 19 bp, Homo sapiens
gtgtatttcttatacgctt

SEQ ID NO: 1558525 - DNA, 19 bp, Homo sapiens
gtgtatttggaaataaagt

SEQ ID NO: 1558526 - DNA, 21 bp, Homo sapiens
gtgtatttggaaataaagtca

SEQ ID NO: 1558527 - DNA, 13 bp, Homo sapiens
gtgtatttgtatt

SEQ ID NO: 1558528 - DNA, 19 bp, Homo sapiens
gtgtatttgtattaataaa

SEQ ID NO: 1558529 - DNA, 23 bp, Homo sapiens
gtgtatttgtattaataaagcat

SEQ ID NO: 1558530 - DNA, 15 bp, Homo sapiens
gtgtcaacttcaaca

SEQ ID NO: 1558531 - DNA, 16 bp, Homo sapiens
gtgtcaagttgtgctt

SEQ ID NO: 1558532 - DNA, 18 bp, Homo sapiens
gtgtcaagttgtgcttgt

SEQ ID NO: 1558533 - DNA, 20 bp, Homo sapiens
gtgtcacacaacactgatgt

SEQ ID NO: 1558534 - DNA, 19 bp, Homo sapiens
gtgtcacccaaaccggcag

SEQ ID NO: 1558535 - DNA, 23 bp, Homo sapiens
gtgtcactactcacagtctcttt

SEQ ID NO: 1558536 - DNA, 20 bp, Homo sapiens
gtgtcagaccctggaggccc

SEQ ID NO: 1558537 - DNA, 17 bp, Homo sapiens
gtgtcagagcccagccc

SEQ ID NO: 1558538 - DNA, 21 bp, Homo sapiens
gtgtcaggcaggtttgccagt

SEQ ID NO: 1558539 - DNA, 20 bp, Homo sapiens
gtgtcaggcccgtcggagct

SEQ ID NO: 1558540 - DNA, 16 bp, Homo sapiens
gtggcctggccaggag

SEQ ID NO: 1558541 - DNA, 13 bp, Homo sapiens
gtggcctggccgt

SEQ ID NO: 1558542 - DNA, 21 bp, Homo sapiens
gtggcctggccgttcagcctg

SEQ ID NO: 1558543 - DNA, 22 bp, Homo sapiens
gtggcctggccgttcagcctgt

SEQ ID NO: 1558544 - DNA, 15 bp, Homo sapiens
gtggcctgtggcctg

SEQ ID NO: 1558545 - DNA, 21 bp, Homo sapiens
gtggcctgtgtccagcagctg

SEQ ID NO: 1558546 - DNA, 19 bp, Homo sapiens
gtggcctgtgtcccatgac

SEQ ID NO: 1558547 - DNA, 18 bp, Homo sapiens
gtggcctgttccctagag

SEQ ID NO: 1558548 - DNA, 21 bp, Homo sapiens
gtggcctgttccctagagaga

SEQ ID NO: 1558549 - DNA, 15 bp, Homo sapiens
gtggccttccccagc

SEQ ID NO: 1558550 - DNA, 17 bp, Homo sapiens
gtggccttccccagcct

SEQ ID NO: 1558551 - DNA, 22 bp, Homo sapiens
gtggccttccccttttgcctgg

SEQ ID NO: 1558552 - DNA, 15 bp, Homo sapiens
gtggccttgcccgcc

SEQ ID NO: 1558553 - DNA, 14 bp, Homo sapiens
gtggccttgggcct

SEQ ID NO: 1558554 - DNA, 16 bp, Homo sapiens
gtggccttgggccttg

SEQ ID NO: 1558555 - DNA, 16 bp, Homo sapiens
gtggcgactctgcaga

SEQ ID NO: 1558556 - DNA, 23 bp, Homo sapiens
gtggcgcaggtgccatgcctgct

SEQ ID NO: 1558557 - DNA, 15 bp, Homo sapiens
gtggcggcacgtcct

SEQ ID NO: 1558558 - DNA, 13 bp, Homo sapiens
gtggcggtgcctg

SEQ ID NO: 1558559 - DNA, 17 bp, Homo sapiens
gtggcggtgcctgggtg

SEQ ID NO: 1558560 - DNA, 22 bp, Homo sapiens
gtggcgtgtgcatagcgtcctg

SEQ ID NO: 1558561 - DNA, 22 bp, Homo sapiens
gtggctcatggcgtaatgggcc

SEQ ID NO: 1558562 - DNA, 15 bp, Homo sapiens
gtggctcattctttt

SEQ ID NO: 1558563 - DNA, 16 bp, Homo sapiens
gtggctccccctctgc

SEQ ID NO: 1558564 - DNA, 20 bp, Homo sapiens
gtggctcctcccggtgccca

SEQ ID NO: 1558565 - DNA, 12 bp, Homo sapiens
gtggctcctggg

SEQ ID NO: 1558566 - DNA, 14 bp, Homo sapiens
gtggctcctgggcc

SEQ ID NO: 1558567 - DNA, 21 bp, Homo sapiens
gtggctcctgggccggctgag

SEQ ID NO: 1558568 - DNA, 17 bp, Homo sapiens
gtggctgacccagtccc

SEQ ID NO: 1558569 - DNA, 19 bp, Homo sapiens
gtggctgacccagtccctg

SEQ ID NO: 1558570 - DNA, 17 bp, Homo sapiens
gtggctgaggccaccca

SEQ ID NO: 1558571 - DNA, 20 bp, Homo sapiens
gtggctgcctcatttagaga

SEQ ID NO: 1558572 - DNA, 20 bp, Homo sapiens
gtggctggaagatcctgcgg

SEQ ID NO: 1558573 - DNA, 16 bp, Homo sapiens
gtggctggaggagctg

SEQ ID NO: 1558574 - DNA, 16 bp, Homo sapiens
gtggagactgcttccc

SEQ ID NO: 1558575 - DNA, 17 bp, Homo sapiens
gtggagactttctgtta

SEQ ID NO: 1558576 - DNA, 15 bp, Homo sapiens
gtggagcagcagcca

SEQ ID NO: 1558577 - DNA, 19 bp, Homo sapiens
gtggagcagcagccactgc

SEQ ID NO: 1558578 - DNA, 15 bp, Homo sapiens
gtggagcagccagag

SEQ ID NO: 1558579 - DNA, 19 bp, Homo sapiens
gtggagccaagtggtccag

SEQ ID NO: 1558580 - DNA, 15 bp, Homo sapiens
gtggagccagggagc

SEQ ID NO: 1558581 - DNA, 14 bp, Homo sapiens
gtggagccagggcc

SEQ ID NO: 1558582 - DNA, 12 bp, Homo sapiens
gtggagccaggt

SEQ ID NO: 1558583 - DNA, 21 bp, Homo sapiens
gtggagccaggttgtcgggcc

SEQ ID NO: 1558584 - DNA, 23 bp, Homo sapiens
gtggagcctgccgcccccgcctg

SEQ ID NO: 1558585 - DNA, 14 bp, Homo sapiens
gtggagcctgggtg

SEQ ID NO: 1558586 - DNA, 15 bp, Homo sapiens
gtggaggaagagcca

SEQ ID NO: 1558587 - DNA, 12 bp, Homo sapiens
gtggaggaaggt

SEQ ID NO: 1558588 - DNA, 19 bp, Homo sapiens
gtggaggaaggtgctgagc

SEQ ID NO: 1558589 - DNA, 17 bp, Homo sapiens
gtggaggaggaaggcaa

SEQ ID NO: 1558590 - DNA, 19 bp, Homo sapiens
gtggaggaggaaggcaaga

SEQ ID NO: 1558591 - DNA, 17 bp, Homo sapiens
gtggaggaggagggagg

SEQ ID NO: 1558592 - DNA, 15 bp, Homo sapiens
gtggaggcagccagg

SEQ ID NO: 1558593 - DNA, 12 bp, Homo sapiens
gtggaggcctga

SEQ ID NO: 1558594 - DNA, 15 bp, Homo sapiens
gtggaggcctgatgc

SEQ ID NO: 1558595 - DNA, 17 bp, Homo sapiens
gtggaggcctgatgctg

SEQ ID NO: 1558596 - DNA, 18 bp, Homo sapiens
gtggaggcctgatgctgc

SEQ ID NO: 1558597 - DNA, 13 bp, Homo sapiens
gtggaggctgctg

SEQ ID NO: 1558598 - DNA, 14 bp, Homo sapiens
gtggaggctgctgt

SEQ ID NO: 1558599 - DNA, 15 bp, Homo sapiens
gtggaggcttcctgc

SEQ ID NO: 1558600 - DNA, 18 bp, Homo sapiens
gtgcagagtgcccagaac

SEQ ID NO: 1558601 - DNA, 23 bp, Homo sapiens
gtgcagatgagcagtcacactgt

SEQ ID NO: 1558602 - DNA, 19 bp, Homo sapiens
gtgcagatgcaattgtttg

SEQ ID NO: 1558603 - DNA, 15 bp, Homo sapiens
gtgcagatggagaga

SEQ ID NO: 1558604 - DNA, 15 bp, Homo sapiens
gtgcagatgggctgt

SEQ ID NO: 1558605 - DNA, 14 bp, Homo sapiens
gtgcagcaaaagca

SEQ ID NO: 1558606 - DNA, 19 bp, Homo sapiens
gtgcagcagcccagcttcc

SEQ ID NO: 1558607 - DNA, 15 bp, Homo sapiens
gtgcaggacagctct

SEQ ID NO: 1558608 - DNA, 16 bp, Homo sapiens
gtgcaggtgctgcctt

SEQ ID NO: 1558609 - DNA, 24 bp, Homo sapiens
gtgcagtggcatcatctcagctca

SEQ ID NO: 1558610 - DNA, 19 bp, Homo sapiens
gtgcagtttcttttcacat

SEQ ID NO: 1558611 - DNA, 18 bp, Homo sapiens
gtgcatagcgtcctgccc

SEQ ID NO: 1558612 - DNA, 22 bp, Homo sapiens
gtgcatagttgtagacaaagta

SEQ ID NO: 1558613 - DNA, 14 bp, Homo sapiens
gtgcatccttgtaa

SEQ ID NO: 1558614 - DNA, 12 bp, Homo sapiens
gtgcatctcctc

SEQ ID NO: 1558615 - DNA, 13 bp, Homo sapiens
gtgcatctggtgt

SEQ ID NO: 1558616 - DNA, 23 bp, Homo sapiens
gtgcatggcactgactgaatgct

SEQ ID NO: 1558617 - DNA, 13 bp, Homo sapiens
gtgcatggctcct

SEQ ID NO: 1558618 - DNA, 13 bp, Homo sapiens
gtgcatgggtgaa

SEQ ID NO: 1558619 - DNA, 18 bp, Homo sapiens
gtgcatgggtgaagggag

SEQ ID NO: 1558620 - DNA, 16 bp, Homo sapiens
gtgcatggtggccaga

SEQ ID NO: 1558621 - DNA, 16 bp, Homo sapiens
gtgcatgtatgtcttg

SEQ ID NO: 1558622 - DNA, 14 bp, Homo sapiens
gtgcatgtgaagca

SEQ ID NO: 1558623 - DNA, 17 bp, Homo sapiens
gtgcatgtgctgtgtga

SEQ ID NO: 1558624 - DNA, 18 bp, Homo sapiens
gtgcatgtgctgtgtgag

SEQ ID NO: 1558625 - DNA, 17 bp, Homo sapiens
gtgcattgctgtgtgaa

SEQ ID NO: 1558626 - DNA, 21 bp, Homo sapiens
gtgcattggaagaccccaccc

SEQ ID NO: 1558627 - DNA, 14 bp, Homo sapiens
gtgcattgttattt

SEQ ID NO: 1558628 - DNA, 18 bp, Homo sapiens
gtgcattgttatttaata

SEQ ID NO: 1558629 - DNA, 23 bp, Homo sapiens
gtgcatttgtgctagaaattttc

SEQ ID NO: 1558630 - DNA, 20 bp, Homo sapiens
gtgcatttttggatcatttt

SEQ ID NO: 1558631 - DNA, 17 bp, Homo sapiens
gtgccaaatagccccag

SEQ ID NO: 1558632 - DNA, 20 bp, Homo sapiens
gtgccaaatagccccagact

SEQ ID NO: 1558633 - DNA, 13 bp, Homo sapiens
gtgccaacctgtt

SEQ ID NO: 1558634 - DNA, 14 bp, Homo sapiens
gtgccaagcacagt

SEQ ID NO: 1558635 - DNA, 18 bp, Homo sapiens
gtgccaagcacagtgcct

SEQ ID NO: 1558636 - DNA, 21 bp, Homo sapiens
gtgccaagggccccaggggca

SEQ ID NO: 1558637 - DNA, 22 bp, Homo sapiens
gtgccaagggccccaggggcag

SEQ ID NO: 1558638 - DNA, 14 bp, Homo sapiens
gtgccaatttcaag

SEQ ID NO: 1558639 - DNA, 21 bp, Homo sapiens
gtgccaatttcaagttccaag

SEQ ID NO: 1558640 - DNA, 22 bp, Homo sapiens
gtgccacacagtgacttggccc

SEQ ID NO: 1558641 - DNA, 16 bp, Homo sapiens
gtgccaccaccctgcc

SEQ ID NO: 1558642 - DNA, 22 bp, Homo sapiens
gtgccacccacctttgccacaa

SEQ ID NO: 1558643 - DNA, 15 bp, Homo sapiens
gtgccactccctgag

SEQ ID NO: 1558644 - DNA, 15 bp, Homo sapiens
gtgccacttaatgta

SEQ ID NO: 1558645 - DNA, 23 bp, Homo sapiens
gtgccacttcttaaaggcctgga

SEQ ID NO: 1558646 - DNA, 18 bp, Homo sapiens
gtgccacttgacattcct

SEQ ID NO: 1558647 - DNA, 19 bp, Homo sapiens
gtgccacttgacattcctt

SEQ ID NO: 1558648 - DNA, 15 bp, Homo sapiens
gtgccagagaggggc

SEQ ID NO: 1558649 - DNA, 20 bp, Homo sapiens
gtgccagaggaatcctggca

SEQ ID NO: 1558650 - DNA, 22 bp, Homo sapiens
gtgccagaggaatcctggcagc

SEQ ID NO: 1558651 - DNA, 14 bp, Homo sapiens
gtgccagaggtggg

SEQ ID NO: 1558652 - DNA, 15 bp, Homo sapiens
gtgccagcagcctcg

SEQ ID NO: 1558653 - DNA, 20 bp, Homo sapiens
gtgccagcaggggggctgtg

SEQ ID NO: 1558654 - DNA, 15 bp, Homo sapiens
gtgccagctctagtt

SEQ ID NO: 1558655 - DNA, 15 bp, Homo sapiens
gtgccaggaccagcc

SEQ ID NO: 1558656 - DNA, 14 bp, Homo sapiens
gtgccagttcctgt

SEQ ID NO: 1558657 - DNA, 24 bp, Homo sapiens
gtgccatcaccacggctcactgca

SEQ ID NO: 1558658 - DNA, 15 bp, Homo sapiens
gtgccatgcctgctc

SEQ ID NO: 1558659 - DNA, 19 bp, Homo sapiens
gtgccatgcctgctccctg

SEQ ID NO: 1558660 - DNA, 19 bp, Homo sapiens
gtgccatggatttccactg

SEQ ID NO: 1558661 - DNA, 22 bp, Homo sapiens
gtgccatgtaaatccccactgg

SEQ ID NO: 1558662 - DNA, 14 bp, Homo sapiens
gtgccattcccagc

SEQ ID NO: 1558663 - DNA, 21 bp, Homo sapiens
gtgccatttctgaactgttac

SEQ ID NO: 1558664 - DNA, 16 bp, Homo sapiens
gtgcccaaagtgggga

SEQ ID NO: 1558665 - DNA, 21 bp, Homo sapiens
gtgcccacaccggggacaggc

SEQ ID NO: 1558666 - DNA, 15 bp, Homo sapiens
gtgcccacatcccag

SEQ ID NO: 1558667 - DNA, 23 bp, Homo sapiens
gtgcccacatgtgtccatcccag

SEQ ID NO: 1558668 - DNA, 16 bp, Homo sapiens
gtgcccacccagggaa

SEQ ID NO: 1558669 - DNA, 15 bp, Homo sapiens
gtgcccagcaggccc

SEQ ID NO: 1558670 - DNA, 17 bp, Homo sapiens
gtgcccagcaggcccag

SEQ ID NO: 1558671 - DNA, 19 bp, Homo sapiens
gtgcccagcaggcccagca

SEQ ID NO: 1558672 - DNA, 13 bp, Homo sapiens
gtgcccagcccct

SEQ ID NO: 1558673 - DNA, 15 bp, Homo sapiens
gtgcccagcccctgc

SEQ ID NO: 1558674 - DNA, 17 bp, Homo sapiens
gtgcccagcccctgccc

SEQ ID NO: 1558675 - DNA, 20 bp, Homo sapiens
gtgcccagcccctgccccta

SEQ ID NO: 1558676 - DNA, 16 bp, Homo sapiens
gtgcccatgcaatggc

SEQ ID NO: 1558677 - DNA, 11 bp, Homo sapiens
gtgccccacca

SEQ ID NO: 1558678 - DNA, 18 bp, Homo sapiens
gtgccccacctgcctggt

SEQ ID NO: 1558679 - DNA, 19 bp, Homo sapiens
gtgccccacctgcctggtg

SEQ ID NO: 1558680 - DNA, 13 bp, Homo sapiens
gtgccccactcca

SEQ ID NO: 1558681 - DNA, 18 bp, Homo sapiens
gtgccccactccagcctg

SEQ ID NO: 1558682 - DNA, 21 bp, Homo sapiens
gtgccccagactgagctctcc

SEQ ID NO: 1558683 - DNA, 22 bp, Homo sapiens
gtgccccaggatgccacgcctg

SEQ ID NO: 1558684 - DNA, 16 bp, Homo sapiens
gtgccccatgcctgtc

SEQ ID NO: 1558685 - DNA, 21 bp, Homo sapiens
gtgccccatgcctgtccagcc

SEQ ID NO: 1558686 - DNA, 18 bp, Homo sapiens
gtgcccccactgaccaga

SEQ ID NO: 1558687 - DNA, 17 bp, Homo sapiens
gtgcccccagcccagag

SEQ ID NO: 1558688 - DNA, 21 bp, Homo sapiens
gtgccccccacccctggaaga

SEQ ID NO: 1558689 - DNA, 13 bp, Homo sapiens
gtgcccccctcct

SEQ ID NO: 1558690 - DNA, 14 bp, Homo sapiens
gtgcccccctcctc

SEQ ID NO: 1558691 - DNA, 20 bp, Homo sapiens
gtgccccccttgccagacat

SEQ ID NO: 1558692 - DNA, 18 bp, Homo sapiens
gtgcccccgcctgccacc

SEQ ID NO: 1558693 - DNA, 17 bp, Homo sapiens
gtgccccctcctctccc

SEQ ID NO: 1558694 - DNA, 20 bp, Homo sapiens
gtgccccctcctctcccatc

SEQ ID NO: 1558695 - DNA, 19 bp, Homo sapiens
gtgcccctgatgcagcctg

SEQ ID NO: 1558696 - DNA, 17 bp, Homo sapiens
gtgccccttaagggttg

SEQ ID NO: 1558697 - DNA, 15 bp, Homo sapiens
gtgcccgtaatccca

SEQ ID NO: 1558698 - DNA, 17 bp, Homo sapiens
gtgccctcaccacccac

SEQ ID NO: 1558699 - DNA, 15 bp, Homo sapiens
gtgccctcgctgctt

SEQ ID NO: 1558700 - DNA, 17 bp, Homo sapiens
gtgcccttgcccttgga

SEQ ID NO: 1558701 - DNA, 19 bp, Homo sapiens
gtgcccttttccagcctca

SEQ ID NO: 1558702 - DNA, 15 bp, Homo sapiens
gtgccgccagctgcc

SEQ ID NO: 1558703 - DNA, 16 bp, Homo sapiens
gtgccgcctgctcctc

SEQ ID NO: 1558704 - DNA, 23 bp, Homo sapiens
gtgccggcatctcccctagctca

SEQ ID NO: 1558705 - DNA, 20 bp, Homo sapiens
gtgccgtaattatgtaccat

SEQ ID NO: 1558706 - DNA, 21 bp, Homo sapiens
gtgccgtaattatgtaccatg

SEQ ID NO: 1558707 - DNA, 14 bp, Homo sapiens
gtgccgtgagcagg

SEQ ID NO: 1558708 - DNA, 20 bp, Homo sapiens
gtgccgtgtgttgcatgcag

SEQ ID NO: 1558709 - DNA, 22 bp, Homo sapiens
gtgccgttactctccaacctgg

SEQ ID NO: 1558710 - DNA, 17 bp, Homo sapiens
gtgcctaatggagaaga

SEQ ID NO: 1558711 - DNA, 17 bp, Homo sapiens
gtgcctagactgttact

SEQ ID NO: 1558712 - DNA, 18 bp, Homo sapiens
gggctgaactgagcctag

SEQ ID NO: 1558713 - DNA, 21 bp, Homo sapiens
gggctgacccagcatctccca

SEQ ID NO: 1558714 - DNA, 20 bp, Homo sapiens
gggctgactagaagggccag

SEQ ID NO: 1558715 - DNA, 23 bp, Homo sapiens
gggctgagcccctaccccacacc

SEQ ID NO: 1558716 - DNA, 16 bp, Homo sapiens
gggctgagccctggca

SEQ ID NO: 1558717 - DNA, 13 bp, Homo sapiens
gggctgagctggg

SEQ ID NO: 1558718 - DNA, 23 bp, Homo sapiens
gggctgagctggggacctggtac

SEQ ID NO: 1558719 - DNA, 10 bp, Homo sapiens
gggctgagga

SEQ ID NO: 1558720 - DNA, 18 bp, Homo sapiens
gggctgagggcctgctgg

SEQ ID NO: 1558721 - DNA, 11 bp, Homo sapiens
gggctgagggg

SEQ ID NO: 1558722 - DNA, 12 bp, Homo sapiens
gggctgaggggc

SEQ ID NO: 1558723 - DNA, 16 bp, Homo sapiens
gggctgagggtgccct

SEQ ID NO: 1558724 - DNA, 18 bp, Homo sapiens
gggctgatctcagggaag

SEQ ID NO: 1558725 - DNA, 14 bp, Homo sapiens
gggctgatgaagaa

SEQ ID NO: 1558726 - DNA, 11 bp, Homo sapiens
gggctgcagca

SEQ ID NO: 1558727 - DNA, 19 bp, Homo sapiens
gggctgcagcatgttgctg

SEQ ID NO: 1558728 - DNA, 20 bp, Homo sapiens
gggctgcatgatgtttgccc

SEQ ID NO: 1558729 - DNA, 21 bp, Homo sapiens
gggctgccctggtgctgccac

SEQ ID NO: 1558730 - DNA, 12 bp, Homo sapiens
gggctgcctggg

SEQ ID NO: 1558731 - DNA, 13 bp, Homo sapiens
gggctgcctgggc

SEQ ID NO: 1558732 - DNA, 14 bp, Homo sapiens
gggctgcctgggct

SEQ ID NO: 1558733 - DNA, 19 bp, Homo sapiens
gggctgcctgggctgttgg

SEQ ID NO: 1558734 - DNA, 21 bp, Homo sapiens
gggctgcctgggctgttggca

SEQ ID NO: 1558735 - DNA, 18 bp, Homo sapiens
gggctgctcctccagggc

SEQ ID NO: 1558736 - DNA, 19 bp, Homo sapiens
gggctgctcctccagggcc

SEQ ID NO: 1558737 - DNA, 17 bp, Homo sapiens
gggctgcttctccacct

SEQ ID NO: 1558738 - DNA, 19 bp, Homo sapiens
gggctggactgaggcctga

SEQ ID NO: 1558739 - DNA, 18 bp, Homo sapiens
gggctggacttctacctg

SEQ ID NO: 1558740 - DNA, 24 bp, Homo sapiens
gggctggagaaagagctgcctgga

SEQ ID NO: 1558741 - DNA, 19 bp, Homo sapiens
gggctggaggcccaggctg

SEQ ID NO: 1558742 - DNA, 21 bp, Homo sapiens
gggctggagtgcgctcttggt

SEQ ID NO: 1558743 - DNA, 16 bp, Homo sapiens
gggctggcaagcaggg

SEQ ID NO: 1558744 - DNA, 17 bp, Homo sapiens
gggctggcaagcaggga

SEQ ID NO: 1558745 - DNA, 15 bp, Homo sapiens
gggctggctgaagaa

SEQ ID NO: 1558746 - DNA, 23 bp, Homo sapiens
gggctggggaaagggctggctgc

SEQ ID NO: 1558747 - DNA, 19 bp, Homo sapiens
gggctggggacagagggtg

SEQ ID NO: 1558748 - DNA, 14 bp, Homo sapiens
gggctggggtcctc

SEQ ID NO: 1558749 - DNA, 22 bp, Homo sapiens
gggctggggtcctcctgtgcta

SEQ ID NO: 1558750 - DNA, 18 bp, Homo sapiens
gggctggttgctgtagaa

SEQ ID NO: 1558751 - DNA, 18 bp, Homo sapiens
gggctgtagatcaggttt

SEQ ID NO: 1558752 - DNA, 14 bp, Homo sapiens
gggctgtcctgctc

SEQ ID NO: 1558753 - DNA, 22 bp, Homo sapiens
gggctgtgagcatcctggcagg

SEQ ID NO: 1558754 - DNA, 14 bp, Homo sapiens
gggctgtgccaacc

SEQ ID NO: 1558755 - DNA, 16 bp, Homo sapiens
gggctgtgccaacctg

SEQ ID NO: 1558756 - DNA, 20 bp, Homo sapiens
gggcttaatggagttcttgt

SEQ ID NO: 1558757 - DNA, 15 bp, Homo sapiens
gggcttatgtctctg

SEQ ID NO: 1558758 - DNA, 20 bp, Homo sapiens
gggcttcattccggactggc

SEQ ID NO: 1558759 - DNA, 19 bp, Homo sapiens
gggcttcctctagaagcca

SEQ ID NO: 1558760 - DNA, 13 bp, Homo sapiens
gggcttctcctga

SEQ ID NO: 1558761 - DNA, 18 bp, Homo sapiens
gggcttggacttcctggg

SEQ ID NO: 1558762 - DNA, 16 bp, Homo sapiens
gggcttggcctgctgt

SEQ ID NO: 1558763 - DNA, 17 bp, Homo sapiens
gggcttggcctgctgtg

SEQ ID NO: 1558764 - DNA, 16 bp, Homo sapiens
gggcttgggccctgca

SEQ ID NO: 1558765 - DNA, 13 bp, Homo sapiens
gggctttaaaatt

SEQ ID NO: 1558766 - DNA, 14 bp, Homo sapiens
gggctttctcttcc

SEQ ID NO: 1558767 - DNA, 14 bp, Homo sapiens
gggctttctggaga

SEQ ID NO: 1558768 - DNA, 16 bp, Homo sapiens
gggctttgagggtgga

SEQ ID NO: 1558769 - DNA, 17 bp, Homo sapiens
gggctttgcaggctctg

SEQ ID NO: 1558770 - DNA, 17 bp, Homo sapiens
gggctttggttccttct

SEQ ID NO: 1558771 - DNA, 21 bp, Homo sapiens
gggctttggttccttctctgg

SEQ ID NO: 1558772 - DNA, 22 bp, Homo sapiens
gggctttggttccttctctggg

SEQ ID NO: 1558773 - DNA, 21 bp, Homo sapiens
ggggaaaggcctgtggggagc

SEQ ID NO: 1558774 - DNA, 22 bp, Homo sapiens
ggggaacctgccatgccaggaa

SEQ ID NO: 1558775 - DNA, 21 bp, Homo sapiens
ggggaactcagatccagggac

SEQ ID NO: 1558776 - DNA, 13 bp, Homo sapiens
ggggaactcctgg

SEQ ID NO: 1558777 - DNA, 17 bp, Homo sapiens
ggggaagacagtggccc

SEQ ID NO: 1558778 - DNA, 13 bp, Homo sapiens
ggggaaggaagga

SEQ ID NO: 1558779 - DNA, 13 bp, Homo sapiens
ggggaaggagcca

SEQ ID NO: 1558780 - DNA, 14 bp, Homo sapiens
ggggaaggggcggt

SEQ ID NO: 1558781 - DNA, 17 bp, Homo sapiens
ggggaatccgtgtgtgt

SEQ ID NO: 1558782 - DNA, 13 bp, Homo sapiens
ggggacagctgtg

SEQ ID NO: 1558783 - DNA, 13 bp, Homo sapiens
ggggaccaggagc

SEQ ID NO: 1558784 - DNA, 13 bp, Homo sapiens
ggggacccagtgc

SEQ ID NO: 1558785 - DNA, 21 bp, Homo sapiens
ggggacccctggctctgggcc

SEQ ID NO: 1558786 - DNA, 11 bp, Homo sapiens
ggggaccctgt

SEQ ID NO: 1558787 - DNA, 13 bp, Homo sapiens
ggggactcagccc

SEQ ID NO: 1558788 - DNA, 15 bp, Homo sapiens
ggggactcagccctg

SEQ ID NO: 1558789 - DNA, 11 bp, Homo sapiens
ggggagaaagg

SEQ ID NO: 1558790 - DNA, 19 bp, Homo sapiens
ggggagaaataaattttgt

SEQ ID NO: 1558791 - DNA, 16 bp, Homo sapiens
ggggagacagttgaga

SEQ ID NO: 1558792 - DNA, 12 bp, Homo sapiens
ggggagacctgg

SEQ ID NO: 1558793 - DNA, 21 bp, Homo sapiens
ggggagcaaatcatctgcatt

SEQ ID NO: 1558794 - DNA, 14 bp, Homo sapiens
ggggagcagagaca

SEQ ID NO: 1558795 - DNA, 11 bp, Homo sapiens
ggggagcccac

SEQ ID NO: 1558796 - DNA, 11 bp, Homo sapiens
ggggaggaagg

SEQ ID NO: 1558797 - DNA, 14 bp, Homo sapiens
ggggaggagggggc

SEQ ID NO: 1558798 - DNA, 19 bp, Homo sapiens
ggggaggatcactggagcc

SEQ ID NO: 1558799 - DNA, 14 bp, Homo sapiens
ggggagggattctg

SEQ ID NO: 1558800 - DNA, 15 bp, Homo sapiens
ggggagggattctgg

SEQ ID NO: 1558801 - DNA, 12 bp, Homo sapiens
ggggagggctgc

SEQ ID NO: 1558802 - DNA, 15 bp, Homo sapiens
ggggagtccctgcca

SEQ ID NO: 1558803 - DNA, 21 bp, Homo sapiens
ggggagttaagacctggcagc

SEQ ID NO: 1558804 - DNA, 14 bp, Homo sapiens
ggggatatttccta

SEQ ID NO: 1558805 - DNA, 23 bp, Homo sapiens
ggggatccctcccccccatgcac

SEQ ID NO: 1558806 - DNA, 22 bp, Homo sapiens
ggggatcttcccacaggagggc

SEQ ID NO: 1558807 - DNA, 17 bp, Homo sapiens
ggggtgatcctgttctg

SEQ ID NO: 1558808 - DNA, 15 bp, Homo sapiens
ggggtgcactcgcca

SEQ ID NO: 1558809 - DNA, 15 bp, Homo sapiens
ggggtgcattctggc

SEQ ID NO: 1558810 - DNA, 13 bp, Homo sapiens
ggggtgccccctc

SEQ ID NO: 1558811 - DNA, 18 bp, Homo sapiens
ggggtgccgctgtctctg

SEQ ID NO: 1558812 - DNA, 18 bp, Homo sapiens
ggggtgccggcatctccc

SEQ ID NO: 1558813 - DNA, 13 bp, Homo sapiens
ggggtgctctctc

SEQ ID NO: 1558814 - DNA, 20 bp, Homo sapiens
ggggtgcttttatagaggct

SEQ ID NO: 1558815 - DNA, 23 bp, Homo sapiens
ggggtggaatgccgctgtctctg

SEQ ID NO: 1558816 - DNA, 13 bp, Homo sapiens
ggggtgggctggt

SEQ ID NO: 1558817 - DNA, 22 bp, Homo sapiens
ggggtgtaacttcctgctgcac

SEQ ID NO: 1558818 - DNA, 18 bp, Homo sapiens
ggggtgttagtggcaccg

SEQ ID NO: 1558819 - DNA, 17 bp, Homo sapiens
ggggttcagcccctcct

SEQ ID NO: 1558820 - DNA, 22 bp, Homo sapiens
ggggttcagcccctcctctgcc

SEQ ID NO: 1558821 - DNA, 14 bp, Homo sapiens
gtgcctcaggccag

SEQ ID NO: 1558822 - DNA, 20 bp, Homo sapiens
gtgcctccaccaccactggc

SEQ ID NO: 1558823 - DNA, 22 bp, Homo sapiens
gtgcctccaccaccactggcca

SEQ ID NO: 1558824 - DNA, 15 bp, Homo sapiens
gtgcctccaggtgtg

SEQ ID NO: 1558825 - DNA, 12 bp, Homo sapiens
gtgcctcccccc

SEQ ID NO: 1558826 - DNA, 20 bp, Homo sapiens
gtgcctccctccccagtgca

SEQ ID NO: 1558827 - DNA, 20 bp, Homo sapiens
gtgcctcctcagaggacagt

SEQ ID NO: 1558828 - DNA, 21 bp, Homo sapiens
gtgcctccttggtaaatacaa

SEQ ID NO: 1558829 - DNA, 16 bp, Homo sapiens
gtgcctctgcagtact

SEQ ID NO: 1558830 - DNA, 12 bp, Homo sapiens
gtgcctctggga

SEQ ID NO: 1558831 - DNA, 14 bp, Homo sapiens
gtgcctctgtgcac

SEQ ID NO: 1558832 - DNA, 21 bp, Homo sapiens
gtgcctctgtgcacagtggct

SEQ ID NO: 1558833 - DNA, 15 bp, Homo sapiens
gtgcctcttccagtg

SEQ ID NO: 1558834 - DNA, 18 bp, Homo sapiens
gtgcctgagaggcaggca

SEQ ID NO: 1558835 - DNA, 21 bp, Homo sapiens
gtgcctgcaccaggagacaga

SEQ ID NO: 1558836 - DNA, 15 bp, Homo sapiens
gtgcctgccactctc

SEQ ID NO: 1558837 - DNA, 19 bp, Homo sapiens
gtgcctgctcagcagccag

SEQ ID NO: 1558838 - DNA, 12 bp, Homo sapiens
gtgcctggcctg

SEQ ID NO: 1558839 - DNA, 19 bp, Homo sapiens
gtgcctggcctggcacaca

SEQ ID NO: 1558840 - DNA, 18 bp, Homo sapiens
gtgcctggcgcccctgcc

SEQ ID NO: 1558841 - DNA, 16 bp, Homo sapiens
gtgcctgggaatgtat

SEQ ID NO: 1558842 - DNA, 18 bp, Homo sapiens
gtgcctgggccctgggct

SEQ ID NO: 1558843 - DNA, 20 bp, Homo sapiens
gtgcctgggtggggctgctc

SEQ ID NO: 1558844 - DNA, 23 bp, Homo sapiens
gtgcctgggtggggctgctcctc

SEQ ID NO: 1558845 - DNA, 22 bp, Homo sapiens
gtgcctgtccttgaaaaacaaa

SEQ ID NO: 1558846 - DNA, 17 bp, Homo sapiens
gtgcctgtgaggcaggg

SEQ ID NO: 1558847 - DNA, 15 bp, Homo sapiens
gtgcctgtgctcctg

SEQ ID NO: 1558848 - DNA, 17 bp, Homo sapiens
gtgcctgtgctcctgcc

SEQ ID NO: 1558849 - DNA, 21 bp, Homo sapiens
gtgcctgtgctcctgcccagg

SEQ ID NO: 1558850 - DNA, 22 bp, Homo sapiens
gtgcctgtgtccatgcgctcag

SEQ ID NO: 1558851 - DNA, 14 bp, Homo sapiens
gtgcctgtgtgcgt

SEQ ID NO: 1558852 - DNA, 19 bp, Homo sapiens
gtgccttaaaaggagagaa

SEQ ID NO: 1558853 - DNA, 22 bp, Homo sapiens
gtgccttcctctctctaccagt

SEQ ID NO: 1558854 - DNA, 11 bp, Homo sapiens
gtgccttctct

SEQ ID NO: 1558855 - DNA, 16 bp, Homo sapiens
gtgccttctctcagct

SEQ ID NO: 1558856 - DNA, 23 bp, Homo sapiens
gtgccttctctcagctcccaggc

SEQ ID NO: 1558857 - DNA, 15 bp, Homo sapiens
gtgccttctgggaag

SEQ ID NO: 1558858 - DNA, 23 bp, Homo sapiens
gtgccttcttattctcactccac

SEQ ID NO: 1558859 - DNA, 19 bp, Homo sapiens
gtgccttggggaatttcct

SEQ ID NO: 1558860 - DNA, 18 bp, Homo sapiens
gtgccttggtctctcctt

SEQ ID NO: 1558861 - DNA, 23 bp, Homo sapiens
gtgccttggtctctccttcctct

SEQ ID NO: 1558862 - DNA, 18 bp, Homo sapiens
gtgcctttccctcctaaa

SEQ ID NO: 1558863 - DNA, 16 bp, Homo sapiens
gtgcctttctttgcct

SEQ ID NO: 1558864 - DNA, 17 bp, Homo sapiens
gtgcctttctttgcctc

SEQ ID NO: 1558865 - DNA, 19 bp, Homo sapiens
gtgcctttctttgcctctg

SEQ ID NO: 1558866 - DNA, 17 bp, Homo sapiens
gtgccttttgcacccct

SEQ ID NO: 1558867 - DNA, 18 bp, Homo sapiens
gtgccttttgcagaagag

SEQ ID NO: 1558868 - DNA, 14 bp, Homo sapiens
gtgccttttgccat

SEQ ID NO: 1558869 - DNA, 20 bp, Homo sapiens
gtgcgaccccccacccccgc

SEQ ID NO: 1558870 - DNA, 12 bp, Homo sapiens
gtgcgagcacac

SEQ ID NO: 1558871 - DNA, 14 bp, Homo sapiens
gtgcgagcacacac

SEQ ID NO: 1558872 - DNA, 15 bp, Homo sapiens
gtgcgcccagggctg

SEQ ID NO: 1558873 - DNA, 17 bp, Homo sapiens
gtgcgctcacctcagag

SEQ ID NO: 1558874 - DNA, 17 bp, Homo sapiens
gtgcgctcacctgcagc

SEQ ID NO: 1558875 - DNA, 21 bp, Homo sapiens
gtgcgctcacctgcagcccct

SEQ ID NO: 1558876 - DNA, 14 bp, Homo sapiens
gtgcgctgcctggc

SEQ ID NO: 1558877 - DNA, 13 bp, Homo sapiens
gtgcgggcctggc

SEQ ID NO: 1558878 - DNA, 13 bp, Homo sapiens
gtgcggttcctca

SEQ ID NO: 1558879 - DNA, 21 bp, Homo sapiens
gtgcgtggaatgcccttcact

SEQ ID NO: 1558880 - DNA, 16 bp, Homo sapiens
gtgcgtggctgtggca

SEQ ID NO: 1558881 - DNA, 22 bp, Homo sapiens
gtgcgtggtatacatgtgtaca

SEQ ID NO: 1558882 - DNA, 22 bp, Homo sapiens
gtgcgtgttagtgtgtgtgcat

SEQ ID NO: 1558883 - DNA, 19 bp, Homo sapiens
gtgcgtttataattggctt

SEQ ID NO: 1558884 - DNA, 16 bp, Homo sapiens
gtgctaaaaatgaaaa

SEQ ID NO: 1558885 - DNA, 21 bp, Homo sapiens
gtgctacaaaaacacagcaag

SEQ ID NO: 1558886 - DNA, 22 bp, Homo sapiens
gtgctacaaaaacacagcaagg

SEQ ID NO: 1558887 - DNA, 12 bp, Homo sapiens
gtgctacatttt

SEQ ID NO: 1558888 - DNA, 20 bp, Homo sapiens
gtgctactccatgcaggggt

SEQ ID NO: 1558889 - DNA, 17 bp, Homo sapiens
gtgctagaacaatggga

SEQ ID NO: 1558890 - DNA, 16 bp, Homo sapiens
gtgctaggggatgagg

SEQ ID NO: 1558891 - DNA, 17 bp, Homo sapiens
gtgctagtcactggcag

SEQ ID NO: 1558892 - DNA, 20 bp, Homo sapiens
gtgctataaatgccagagcc

SEQ ID NO: 1558893 - DNA, 21 bp, Homo sapiens
gtgctatactgcatacttttt

SEQ ID NO: 1558894 - DNA, 22 bp, Homo sapiens
gtgctatgcggaggaaagcaag

SEQ ID NO: 1558895 - DNA, 19 bp, Homo sapiens
gtgctatggatggcttcta

SEQ ID NO: 1558896 - DNA, 17 bp, Homo sapiens
gtgctattctgtgttga

SEQ ID NO: 1558897 - DNA, 20 bp, Homo sapiens
gtgctatttgtacaaataaa

SEQ ID NO: 1558898 - DNA, 21 bp, Homo sapiens
gtgctattttgtttgttttgt

SEQ ID NO: 1558899 - DNA, 22 bp, Homo sapiens
gtgctcaaggttactgggagtg

SEQ ID NO: 1558900 - DNA, 16 bp, Homo sapiens
gtgctcaatagcttga

SEQ ID NO: 1558901 - DNA, 15 bp, Homo sapiens
gtgctcagctgtggc

SEQ ID NO: 1558902 - DNA, 13 bp, Homo sapiens
gtgctccaacctg

SEQ ID NO: 1558903 - DNA, 22 bp, Homo sapiens
gtgctccatatttgatttctaa

SEQ ID NO: 1558904 - DNA, 23 bp, Homo sapiens
gtgctccatatttgatttctaat

SEQ ID NO: 1558905 - DNA, 13 bp, Homo sapiens
gtgctccatctcc

SEQ ID NO: 1558906 - DNA, 16 bp, Homo sapiens
gtgctcccctgccaca

SEQ ID NO: 1558907 - DNA, 15 bp, Homo sapiens
gtgctccctggaggc

SEQ ID NO: 1558908 - DNA, 14 bp, Homo sapiens
gtgctcctctcctt

SEQ ID NO: 1558909 - DNA, 15 bp, Homo sapiens
gtgctcctgcccagg

SEQ ID NO: 1558910 - DNA, 18 bp, Homo sapiens
gtgctcctgcccaggagc

SEQ ID NO: 1558911 - DNA, 18 bp, Homo sapiens
gtgctccttttctctttg

SEQ ID NO: 1558912 - DNA, 21 bp, Homo sapiens
gtgctcgagacacagtgaagc

SEQ ID NO: 1558913 - DNA, 17 bp, Homo sapiens
gtgctctaggctgcccc

SEQ ID NO: 1558914 - DNA, 19 bp, Homo sapiens
gtgctctgaggcctcacta

SEQ ID NO: 1558915 - DNA, 11 bp, Homo sapiens
gtgctctggcg

SEQ ID NO: 1558916 - DNA, 23 bp, Homo sapiens
gtgctctggcggcttcctgtcca

SEQ ID NO: 1558917 - DNA, 21 bp, Homo sapiens
gtgctctggggatttctggga

SEQ ID NO: 1558918 - DNA, 14 bp, Homo sapiens
gtgctctgtgtcaa

SEQ ID NO: 1558919 - DNA, 21 bp, Homo sapiens
gtgctcttggctgacccctct

SEQ ID NO: 1558920 - DNA, 14 bp, Homo sapiens
gtgctcttttctcc

SEQ ID NO: 1558921 - DNA, 16 bp, Homo sapiens
gtgctcttttctcctc

SEQ ID NO: 1558922 - DNA, 23 bp, Homo sapiens
gtgctgaatggttttcaaaataa

SEQ ID NO: 1558923 - DNA, 17 bp, Homo sapiens
gtgctgacaacttagct

SEQ ID NO: 1558924 - DNA, 20 bp, Homo sapiens
gtgctgacaacttagctcag

SEQ ID NO: 1558925 - DNA, 21 bp, Homo sapiens
gtgctgacaacttagctcagg

SEQ ID NO: 1558926 - DNA, 21 bp, Homo sapiens
gtgctgacggccagggagaag

SEQ ID NO: 1558927 - DNA, 23 bp, Homo sapiens
gtgctgacggccagggagaagct

SEQ ID NO: 1558928 - DNA, 15 bp, Homo sapiens
gtgctgactgaacat

SEQ ID NO: 1558929 - DNA, 17 bp, Homo sapiens
gtgctgactgaggcctg

SEQ ID NO: 1558930 - DNA, 20 bp, Homo sapiens
gtgctgactgaggcctgctt

SEQ ID NO: 1558931 - DNA, 22 bp, Homo sapiens
gtgctgactgaggcctgcttcc

SEQ ID NO: 1558932 - DNA, 11 bp, Homo sapiens
gtgctgagctt

SEQ ID NO: 1558933 - DNA, 18 bp, Homo sapiens
gtgctgagcttagccttg

SEQ ID NO: 1558934 - DNA, 14 bp, Homo sapiens
gtgctgaggccagg

SEQ ID NO: 1558935 - DNA, 23 bp, Homo sapiens
gtgctgatagggtaaggggaggc

SEQ ID NO: 1558936 - DNA, 17 bp, Homo sapiens
gtgctgatcctgctgac

SEQ ID NO: 1558937 - DNA, 20 bp, Homo sapiens
aaagtgctgcagggctttaa

SEQ ID NO: 1558938 - DNA, 12 bp, Homo sapiens
aaagtgcttaag

SEQ ID NO: 1558939 - DNA, 15 bp, Homo sapiens
aaagtggagctggga

SEQ ID NO: 1558940 - DNA, 17 bp, Homo sapiens
aaagtgggcttaatgga

SEQ ID NO: 1558941 - DNA, 23 bp, Homo sapiens
aaagtggggagggacaagggatt

SEQ ID NO: 1558942 - DNA, 17 bp, Homo sapiens
aaagtgggttttttagt

SEQ ID NO: 1558943 - DNA, 13 bp, Homo sapiens
aaagtggtaaata

SEQ ID NO: 1558944 - DNA, 17 bp, Homo sapiens
aaagtggtctctgctgg

SEQ ID NO: 1558945 - DNA, 18 bp, Homo sapiens
aaagtggtctctgctggg

SEQ ID NO: 1558946 - DNA, 15 bp, Homo sapiens
aaagtgtatttggaa

SEQ ID NO: 1558947 - DNA, 20 bp, Homo sapiens
aaagtgtcttttgacatttt

SEQ ID NO: 1558948 - DNA, 19 bp, Homo sapiens
aaagtgtgagctcttccct

SEQ ID NO: 1558949 - DNA, 16 bp, Homo sapiens
aaagtgtgtatatatt

SEQ ID NO: 1558950 - DNA, 23 bp, Homo sapiens
aaagtgtgtatatattttgtgtg

SEQ ID NO: 1558951 - DNA, 13 bp, Homo sapiens
aaagtgttacttt

SEQ ID NO: 1558952 - DNA, 14 bp, Homo sapiens
aaagtgttctgtgc

SEQ ID NO: 1558953 - DNA, 13 bp, Homo sapiens
aaagtgttgtatc

SEQ ID NO: 1558954 - DNA, 22 bp, Homo sapiens
aaagttaaacattgaagtaatg

SEQ ID NO: 1558955 - DNA, 12 bp, Homo sapiens
aaagttaacatt

SEQ ID NO: 1558956 - DNA, 18 bp, Homo sapiens
aaagttaatgggatggtc

SEQ ID NO: 1558957 - DNA, 19 bp, Homo sapiens
aaagttactacctgtcaag

SEQ ID NO: 1558958 - DNA, 22 bp, Homo sapiens
aaagttactgattcactgcatg

SEQ ID NO: 1558959 - DNA, 20 bp, Homo sapiens
aaagttactttgtcagaggc

SEQ ID NO: 1558960 - DNA, 16 bp, Homo sapiens
aaagttagggggttct

SEQ ID NO: 1558961 - DNA, 19 bp, Homo sapiens
aaagttagtattaaaatct

SEQ ID NO: 1558962 - DNA, 20 bp, Homo sapiens
aaagttattgataagttcat

SEQ ID NO: 1558963 - DNA, 18 bp, Homo sapiens
aaagttcacaatgtggcc

SEQ ID NO: 1558964 - DNA, 21 bp, Homo sapiens
aaagttccaagagtctaaaga

SEQ ID NO: 1558965 - DNA, 18 bp, Homo sapiens
aaagttctaataatttct

SEQ ID NO: 1558966 - DNA, 16 bp, Homo sapiens
aaagttcttattttag

SEQ ID NO: 1558967 - DNA, 17 bp, Homo sapiens
aaagttgaaaagccaaa

SEQ ID NO: 1558968 - DNA, 13 bp, Homo sapiens
aaagttgcagatg

SEQ ID NO: 1558969 - DNA, 13 bp, Homo sapiens
aaagttgcatttg

SEQ ID NO: 1558970 - DNA, 18 bp, Homo sapiens
aaagttgggcccctgagg

SEQ ID NO: 1558971 - DNA, 16 bp, Homo sapiens
aaagttggtgacagat

SEQ ID NO: 1558972 - DNA, 22 bp, Homo sapiens
aaagttgtaaaatagaaaaagt

SEQ ID NO: 1558973 - DNA, 14 bp, Homo sapiens
aaagttgtacttta

SEQ ID NO: 1558974 - DNA, 17 bp, Homo sapiens
aaagttgtatccattaa

SEQ ID NO: 1558975 - DNA, 13 bp, Homo sapiens
aaagtttaagctg

SEQ ID NO: 1558976 - DNA, 19 bp, Homo sapiens
aaagtttacattgtcctgt

SEQ ID NO: 1558977 - DNA, 23 bp, Homo sapiens
aaagtttcacaggtcaataaact

SEQ ID NO: 1558978 - DNA, 13 bp, Homo sapiens
aaagtttccatat

SEQ ID NO: 1558979 - DNA, 18 bp, Homo sapiens
aaagtttctagaatttta

SEQ ID NO: 1558980 - DNA, 12 bp, Homo sapiens
aaagtttctcag

SEQ ID NO: 1558981 - DNA, 17 bp, Homo sapiens
aaagtttctcagatcct

SEQ ID NO: 1558982 - DNA, 15 bp, Homo sapiens
aaagtttgccagaag

SEQ ID NO: 1558983 - DNA, 15 bp, Homo sapiens
aaagtttgcttagaa

SEQ ID NO: 1558984 - DNA, 16 bp, Homo sapiens
aaagtttgcttagaaa

SEQ ID NO: 1558985 - DNA, 16 bp, Homo sapiens
aaagttttgtaaaaga

SEQ ID NO: 1558986 - DNA, 14 bp, Homo sapiens
aaagttttgttgta

SEQ ID NO: 1558987 - DNA, 20 bp, Homo sapiens
aaataaaaagaaaggctgtt

SEQ ID NO: 1558988 - DNA, 14 bp, Homo sapiens
aaataaaaagagaa

SEQ ID NO: 1558989 - DNA, 20 bp, Homo sapiens
aaataaaaatattgtgttgt

SEQ ID NO: 1558990 - DNA, 22 bp, Homo sapiens
aaataaaaatcaacttgtgtac

SEQ ID NO: 1558991 - DNA, 14 bp, Homo sapiens
aaataaaaccagct

SEQ ID NO: 1558992 - DNA, 12 bp, Homo sapiens
aaataaaagcac

SEQ ID NO: 1558993 - DNA, 14 bp, Homo sapiens
aaataaaagcacaa

SEQ ID NO: 1558994 - DNA, 16 bp, Homo sapiens
aaataaaagcacaagt

SEQ ID NO: 1558995 - DNA, 13 bp, Homo sapiens
aaataaaagcagc

SEQ ID NO: 1558996 - DNA, 19 bp, Homo sapiens
aaataaaaggactgtgatt

SEQ ID NO: 1558997 - DNA, 16 bp, Homo sapiens
aaataaaagtgatcaa

SEQ ID NO: 1558998 - DNA, 11 bp, Homo sapiens
aaataaaatat

SEQ ID NO: 1558999 - DNA, 14 bp, Homo sapiens
aaataaaatatttt

SEQ ID NO: 1559000 - DNA, 20 bp, Homo sapiens
aaataaaatgaacatctctt

SEQ ID NO: 1559001 - DNA, 15 bp, Homo sapiens
aaataaaatgcattt

SEQ ID NO: 1559002 - DNA, 23 bp, Homo sapiens
aaataaaatgccatagtttgtga

SEQ ID NO: 1559003 - DNA, 20 bp, Homo sapiens
aaataaaatgtttcattatg

SEQ ID NO: 1559004 - DNA, 12 bp, Homo sapiens
aaataaacattt

SEQ ID NO: 1559005 - DNA, 14 bp, Homo sapiens
aaataaaccactgt

SEQ ID NO: 1559006 - DNA, 19 bp, Homo sapiens
aaataaacctataatattt

SEQ ID NO: 1559007 - DNA, 11 bp, Homo sapiens
aaataaactag

SEQ ID NO: 1559008 - DNA, 17 bp, Homo sapiens
aaataaactagtttcca

SEQ ID NO: 1559009 - DNA, 21 bp, Homo sapiens
aaataaactatttatatcaca

SEQ ID NO: 1559010 - DNA, 22 bp, Homo sapiens
aaataaagaacaattgttagat

SEQ ID NO: 1559011 - DNA, 16 bp, Homo sapiens
aaataaagaagaaaat

SEQ ID NO: 1559012 - DNA, 20 bp, Homo sapiens
aaataaagtatatatagaat

SEQ ID NO: 1559013 - DNA, 13 bp, Homo sapiens
aaataaatatttt

SEQ ID NO: 1559014 - DNA, 17 bp, Homo sapiens
aaataaatcatcctcat

SEQ ID NO: 1559015 - DNA, 23 bp, Homo sapiens
aaataaatgattatattcacaga

SEQ ID NO: 1559016 - DNA, 14 bp, Homo sapiens
aaataaattcctaa

SEQ ID NO: 1559017 - DNA, 15 bp, Homo sapiens
aaataaattcctaca

SEQ ID NO: 1559018 - DNA, 16 bp, Homo sapiens
aaataaatttcccagt

SEQ ID NO: 1559019 - DNA, 14 bp, Homo sapiens
aaataaattttgtt

SEQ ID NO: 1559020 - DNA, 19 bp, Homo sapiens
aaataacaactaacttgtt

SEQ ID NO: 1559021 - DNA, 20 bp, Homo sapiens
aaataacaagagttttaaca

SEQ ID NO: 1559022 - DNA, 14 bp, Homo sapiens
aaataacctatttt

SEQ ID NO: 1559023 - DNA, 15 bp, Homo sapiens
aaataactgaatttg

SEQ ID NO: 1559024 - DNA, 19 bp, Homo sapiens
aaataactggaaaacagaa

SEQ ID NO: 1559025 - DNA, 13 bp, Homo sapiens
aaataactgtaat

SEQ ID NO: 1559026 - DNA, 22 bp, Homo sapiens
aaataactgtgtggcagttaat

SEQ ID NO: 1559027 - DNA, 15 bp, Homo sapiens
aaataacttcaagca

SEQ ID NO: 1559028 - DNA, 16 bp, Homo sapiens
aaataacttcaagcaa

SEQ ID NO: 1559029 - DNA, 14 bp, Homo sapiens
aaataagagatttg

SEQ ID NO: 1559030 - DNA, 15 bp, Homo sapiens
aaataagagttgctt

SEQ ID NO: 1559031 - DNA, 14 bp, Homo sapiens
aaataagattctaa

SEQ ID NO: 1559032 - DNA, 22 bp, Homo sapiens
aaataagtatttataatagcaa

SEQ ID NO: 1559033 - DNA, 17 bp, Homo sapiens
aaataagtatttctgat

SEQ ID NO: 1559034 - DNA, 18 bp, Homo sapiens
aaataagtatttctgatt

SEQ ID NO: 1559035 - DNA, 19 bp, Homo sapiens
aaataataaagatgctctt

SEQ ID NO: 1559036 - DNA, 17 bp, Homo sapiens
aaataatatatttcttc

SEQ ID NO: 1559037 - DNA, 15 bp, Homo sapiens
aaataatcaaaagct

SEQ ID NO: 1559038 - DNA, 16 bp, Homo sapiens
aaataatcacacacac

SEQ ID NO: 1559039 - DNA, 23 bp, Homo sapiens
aaataatctatttctatgagaaa

SEQ ID NO: 1559040 - DNA, 19 bp, Homo sapiens
aaataatgaatacatttcc

SEQ ID NO: 1559041 - DNA, 19 bp, Homo sapiens
aaataatgctacaatttta

SEQ ID NO: 1559042 - DNA, 17 bp, Homo sapiens
aaataatgcttcagata

SEQ ID NO: 1559043 - DNA, 20 bp, Homo sapiens
aaataatggaaaaatagtaa

SEQ ID NO: 1559044 - DNA, 20 bp, Homo sapiens
aaataatttgaatgtatttg

SEQ ID NO: 1559045 - DNA, 13 bp, Homo sapiens
aaataattttcca

SEQ ID NO: 1559046 - DNA, 20 bp, Homo sapiens
aaataattttccaagtaaag

SEQ ID NO: 1559047 - DNA, 16 bp, Homo sapiens
aaatacaaaaatgaat

SEQ ID NO: 1559048 - DNA, 12 bp, Homo sapiens
aaatacaataaa

SEQ ID NO: 1559049 - DNA, 15 bp, Homo sapiens
aaatacacactcaaa

SEQ ID NO: 1559050 - DNA, 14 bp, Homo sapiens
aaatacacatttgc

SEQ ID NO: 1559051 - DNA, 15 bp, Homo sapiens
aaatacacatttgct

SEQ ID NO: 1559052 - DNA, 21 bp, Homo sapiens
aaatacaccacctcactcctg

SEQ ID NO: 1559053 - DNA, 23 bp, Homo sapiens
aaatacaccacctcactcctgtt

SEQ ID NO: 1559054 - DNA, 16 bp, Homo sapiens
aaatcaagcctgattc

SEQ ID NO: 1559055 - DNA, 17 bp, Homo sapiens
aaatcaaggaaaggctc

SEQ ID NO: 1559056 - DNA, 13 bp, Homo sapiens
aaatcaatgtcac

SEQ ID NO: 1559057 - DNA, 23 bp, Homo sapiens
aaatcaattactggtccaaaaga

SEQ ID NO: 1559058 - DNA, 19 bp, Homo sapiens
aaatcacaaggatttctct

SEQ ID NO: 1559059 - DNA, 23 bp, Homo sapiens
aaatcacagatgggtattaaact

SEQ ID NO: 1559060 - DNA, 19 bp, Homo sapiens
aaatcacatattttaaaat

SEQ ID NO: 1559061 - DNA, 12 bp, Homo sapiens
aaatcacatcct

SEQ ID NO: 1559062 - DNA, 15 bp, Homo sapiens
aaatcacctggtatt

SEQ ID NO: 1559063 - DNA, 16 bp, Homo sapiens
aaatcacttcattgtt

SEQ ID NO: 1559064 - DNA, 18 bp, Homo sapiens
aaatcagaaagtaacaat

SEQ ID NO: 1559065 - DNA, 12 bp, Homo sapiens
aaatcagaagtc

SEQ ID NO: 1559066 - DNA, 13 bp, Homo sapiens
aaatcagatgaat

SEQ ID NO: 1559067 - DNA, 18 bp, Homo sapiens
aaatcagctattttgtga

SEQ ID NO: 1559068 - DNA, 23 bp, Homo sapiens
aaatcaggcttttgtttcctttt

SEQ ID NO: 1559069 - DNA, 21 bp, Homo sapiens
aaatcagtgatctatgtttgt

SEQ ID NO: 1559070 - DNA, 21 bp, Homo sapiens
aaatcagttactaagaagaaa

SEQ ID NO: 1559071 - DNA, 13 bp, Homo sapiens
aaatcataaagtc

SEQ ID NO: 1559072 - DNA, 23 bp, Homo sapiens
aaatcataataaagtttccatta

SEQ ID NO: 1559073 - DNA, 19 bp, Homo sapiens
aaatcataccagttgttca

SEQ ID NO: 1559074 - DNA, 22 bp, Homo sapiens
aaatcataggaaagtatttttt

SEQ ID NO: 1559075 - DNA, 12 bp, Homo sapiens
aaatcatcaaga

SEQ ID NO: 1559076 - DNA, 14 bp, Homo sapiens
aaatcatcaagaag

SEQ ID NO: 1559077 - DNA, 12 bp, Homo sapiens
aaatcatgtttg

SEQ ID NO: 1559078 - DNA, 14 bp, Homo sapiens
aaatcatgttttga

SEQ ID NO: 1559079 - DNA, 14 bp, Homo sapiens
aaatcattgtagaa

SEQ ID NO: 1559080 - DNA, 21 bp, Homo sapiens
aaatcatttctgcatcagctg

SEQ ID NO: 1559081 - DNA, 23 bp, Homo sapiens
aaatcatttctgcatcagctgct

SEQ ID NO: 1559082 - DNA, 15 bp, Homo sapiens
aaatccaaatattgt

SEQ ID NO: 1559083 - DNA, 11 bp, Homo sapiens
aaatccagtgg

SEQ ID NO: 1559084 - DNA, 14 bp, Homo sapiens
aaatccagtggtgg

SEQ ID NO: 1559085 - DNA, 16 bp, Homo sapiens
aaatccagtggtgggt

SEQ ID NO: 1559086 - DNA, 19 bp, Homo sapiens
aaatccagtgtgcacccct

SEQ ID NO: 1559087 - DNA, 22 bp, Homo sapiens
aaatccgacttgaatattcctg

SEQ ID NO: 1559088 - DNA, 11 bp, Homo sapiens
aaatcctctgg

SEQ ID NO: 1559089 - DNA, 16 bp, Homo sapiens
aaatcctgagctcaaa

SEQ ID NO: 1559090 - DNA, 18 bp, Homo sapiens
ctctgccggtcgggcagc

SEQ ID NO: 1559091 - DNA, 20 bp, Homo sapiens
ctctgccggtcgggcagcca

SEQ ID NO: 1559092 - DNA, 15 bp, Homo sapiens
ctctgcctcccaggt

SEQ ID NO: 1559093 - DNA, 14 bp, Homo sapiens
ctctgcctccctct

SEQ ID NO: 1559094 - DNA, 22 bp, Homo sapiens
ctctgcctctagtccccaaggc

SEQ ID NO: 1559095 - DNA, 10 bp, Homo sapiens
ctctgcctgc

SEQ ID NO: 1559096 - DNA, 12 bp, Homo sapiens
ctctgcctgccc

SEQ ID NO: 1559097 - DNA, 13 bp, Homo sapiens
ctctgcctgcccc

SEQ ID NO: 1559098 - DNA, 20 bp, Homo sapiens
ctctgcctgccccgccccca

SEQ ID NO: 1559099 - DNA, 15 bp, Homo sapiens
ctcttttctttctgt

SEQ ID NO: 1559100 - DNA, 14 bp, Homo sapiens
ctcttttgaaagta

SEQ ID NO: 1559101 - DNA, 20 bp, Homo sapiens
ctcttttgaaagtagagcta

SEQ ID NO: 1559102 - DNA, 20 bp, Homo sapiens
ctcttttgaatccatgcttg

SEQ ID NO: 1559103 - DNA, 21 bp, Homo sapiens
ctcttttgagactttgcccag

SEQ ID NO: 1559104 - DNA, 24 bp, Homo sapiens
ctcttttgtgatgaacatattcat

SEQ ID NO: 1559105 - DNA, 14 bp, Homo sapiens
ctctttttgttttt

SEQ ID NO: 1559106 - DNA, 18 bp, Homo sapiens
ctcttttttaaaaacaaa

SEQ ID NO: 1559107 - DNA, 14 bp, Homo sapiens
ctctttttttcttt

SEQ ID NO: 1559108 - DNA, 16 bp, Homo sapiens
ctctttttttcttttc

SEQ ID NO: 1559109 - DNA, 22 bp, Homo sapiens
ctctttttttgagtgacagctt

SEQ ID NO: 1559110 - DNA, 16 bp, Homo sapiens
ctctttttttggccca

SEQ ID NO: 1559111 - DNA, 19 bp, Homo sapiens
ctgaaaaaaaaaaagaaga

SEQ ID NO: 1559112 - DNA, 19 bp, Homo sapiens
ctgaaaaaaacatatccaa

SEQ ID NO: 1559113 - DNA, 21 bp, Homo sapiens
ctgaaaaaacacctagcttta

SEQ ID NO: 1559114 - DNA, 13 bp, Homo sapiens
ctgaaaaaatata

SEQ ID NO: 1559115 - DNA, 19 bp, Homo sapiens
ctgaaaaactgatcaaaaa

SEQ ID NO: 1559116 - DNA, 12 bp, Homo sapiens
ctgaaaaatcac

SEQ ID NO: 1559117 - DNA, 17 bp, Homo sapiens
ctgaaaaatcacatcct

SEQ ID NO: 1559118 - DNA, 23 bp, Homo sapiens
ctgaaaagaaatgctaatgtaat

SEQ ID NO: 1559119 - DNA, 19 bp, Homo sapiens
ctgaaaagggcggaagagt

SEQ ID NO: 1559120 - DNA, 18 bp, Homo sapiens
ctgaaaataccatcaggc

SEQ ID NO: 1559121 - DNA, 20 bp, Homo sapiens
ctgaaaatatttttttctag

SEQ ID NO: 1559122 - DNA, 23 bp, Homo sapiens
ctgaaaatatttttttctagcta

SEQ ID NO: 1559123 - DNA, 18 bp, Homo sapiens
ctgaaaatcaaagtaaaa

SEQ ID NO: 1559124 - DNA, 19 bp, Homo sapiens
ctgaaaatgcaaagctgaa

SEQ ID NO: 1559125 - DNA, 13 bp, Homo sapiens
ctgaaaatgtgct

SEQ ID NO: 1559126 - DNA, 22 bp, Homo sapiens
ctgaaaatgtttttctgccagg

SEQ ID NO: 1559127 - DNA, 18 bp, Homo sapiens
ctgaaaattcgaaccagg

SEQ ID NO: 1559128 - DNA, 15 bp, Homo sapiens
ctgaaaattgccttt

SEQ ID NO: 1559129 - DNA, 20 bp, Homo sapiens
ctgaaaattgcctttctgtg

SEQ ID NO: 1559130 - DNA, 21 bp, Homo sapiens
ctgaaaattggacagattgcc

SEQ ID NO: 1559131 - DNA, 15 bp, Homo sapiens
ctgaaacaacaaata

SEQ ID NO: 1559132 - DNA, 16 bp, Homo sapiens
ctgaaacaacttggaa

SEQ ID NO: 1559133 - DNA, 23 bp, Homo sapiens
ctgaaacacacgagcaaacccag

SEQ ID NO: 1559134 - DNA, 13 bp, Homo sapiens
ctgaaacagattt

SEQ ID NO: 1559135 - DNA, 20 bp, Homo sapiens
ctgaaacctagtactgcccc

SEQ ID NO: 1559136 - DNA, 20 bp, Homo sapiens
ctgaaacgctcctttgtgtg

SEQ ID NO: 1559137 - DNA, 14 bp, Homo sapiens
ctgaaactggcttc

SEQ ID NO: 1559138 - DNA, 20 bp, Homo sapiens
ctgaaagaaacagttaactt

SEQ ID NO: 1559139 - DNA, 17 bp, Homo sapiens
ctgaaagatacagggga

SEQ ID NO: 1559140 - DNA, 16 bp, Homo sapiens
ctgaaagcacatgaat

SEQ ID NO: 1559141 - DNA, 14 bp, Homo sapiens
ctgaaagcagcagc

SEQ ID NO: 1559142 - DNA, 19 bp, Homo sapiens
ctgaaagcagcagctagga

SEQ ID NO: 1559143 - DNA, 12 bp, Homo sapiens
ctgaaagccacg

SEQ ID NO: 1559144 - DNA, 23 bp, Homo sapiens
ctgaaagccagctgccgaccaga

SEQ ID NO: 1559145 - DNA, 16 bp, Homo sapiens
ctgaaaggaacactgg

SEQ ID NO: 1559146 - DNA, 19 bp, Homo sapiens
ctgaaaggatgtggaagag

SEQ ID NO: 1559147 - DNA, 15 bp, Homo sapiens
ctgaaagttttgtaa

SEQ ID NO: 1559148 - DNA, 17 bp, Homo sapiens
ctgaaataaaatgccat

SEQ ID NO: 1559149 - DNA, 15 bp, Homo sapiens
ctgaaataatatatt

SEQ ID NO: 1559150 - DNA, 19 bp, Homo sapiens
ctgaaataatatatttctt

SEQ ID NO: 1559151 - DNA, 18 bp, Homo sapiens
ctgaaataggaaacaagt

SEQ ID NO: 1559152 - DNA, 22 bp, Homo sapiens
ctgaaatcactttacctgcagg

SEQ ID NO: 1559153 - DNA, 17 bp, Homo sapiens
ctgaaatccataaacta

SEQ ID NO: 1559154 - DNA, 22 bp, Homo sapiens
ctgaaatccataaactaagaga

SEQ ID NO: 1559155 - DNA, 16 bp, Homo sapiens
ctgaaatctgaagacc

SEQ ID NO: 1559156 - DNA, 18 bp, Homo sapiens
ctgaaatgaaacaaataa

SEQ ID NO: 1559157 - DNA, 22 bp, Homo sapiens
ctgaaatgaaacaaataatcac

SEQ ID NO: 1559158 - DNA, 17 bp, Homo sapiens
ctgaaatgaccaagaca

SEQ ID NO: 1559159 - DNA, 12 bp, Homo sapiens
ctgaaattccaa

SEQ ID NO: 1559160 - DNA, 17 bp, Homo sapiens
ctgaaattccaaagtct

SEQ ID NO: 1559161 - DNA, 18 bp, Homo sapiens
ctgaaattccaaagtctc

SEQ ID NO: 1559162 - DNA, 20 bp, Homo sapiens
ctgaaattccaaagtctcta

SEQ ID NO: 1559163 - DNA, 14 bp, Homo sapiens
ctgaaattctcctg

SEQ ID NO: 1559164 - DNA, 15 bp, Homo sapiens
ctgaaattctcctgg

SEQ ID NO: 1559165 - DNA, 19 bp, Homo sapiens
ctgaaattctcctggaggt

SEQ ID NO: 1559166 - DNA, 21 bp, Homo sapiens
ctgaaattgaaaagttatttc

SEQ ID NO: 1559167 - DNA, 18 bp, Homo sapiens
ctgaaatttctcattagt

SEQ ID NO: 1559168 - DNA, 13 bp, Homo sapiens
ctgaaattttaga

SEQ ID NO: 1559169 - DNA, 18 bp, Homo sapiens
ctgaaattttagaaatat

SEQ ID NO: 1559170 - DNA, 13 bp, Homo sapiens
ctgaaattttata

SEQ ID NO: 1559171 - DNA, 18 bp, Homo sapiens
ctgaacaaaacctacgca

SEQ ID NO: 1559172 - DNA, 17 bp, Homo sapiens
ctgaacaaaagctcagg

SEQ ID NO: 1559173 - DNA, 12 bp, Homo sapiens
ctgaacaagaat

SEQ ID NO: 1559174 - DNA, 21 bp, Homo sapiens
ctgaacaataggctgttccca

SEQ ID NO: 1559175 - DNA, 15 bp, Homo sapiens
ctgaacaatctccaa

SEQ ID NO: 1559176 - DNA, 21 bp, Homo sapiens
ctgaacaatggggactttgtt

SEQ ID NO: 1559177 - DNA, 12 bp, Homo sapiens
ctgaacacatgt

SEQ ID NO: 1559178 - DNA, 19 bp, Homo sapiens
ctgaacacatgtgtatgat

SEQ ID NO: 1559179 - DNA, 14 bp, Homo sapiens
ctgaacacatttct

SEQ ID NO: 1559180 - DNA, 19 bp, Homo sapiens
ctgaacaccattgaaggct

SEQ ID NO: 1559181 - DNA, 13 bp, Homo sapiens
ctgaacagaagct

SEQ ID NO: 1559182 - DNA, 20 bp, Homo sapiens
ctgaacatccttccttccca

SEQ ID NO: 1559183 - DNA, 20 bp, Homo sapiens
ctgaaccactgcttctcttt

SEQ ID NO: 1559184 - DNA, 21 bp, Homo sapiens
ctgaaccactgcttctctttt

SEQ ID NO: 1559185 - DNA, 14 bp, Homo sapiens
ctgaaccatccctg

SEQ ID NO: 1559186 - DNA, 15 bp, Homo sapiens
ctgaaccccatgggc

SEQ ID NO: 1559187 - DNA, 16 bp, Homo sapiens
ctgaaccccatgggct

SEQ ID NO: 1559188 - DNA, 18 bp, Homo sapiens
ctgaaccccatgggcttg

SEQ ID NO: 1559189 - DNA, 16 bp, Homo sapiens
ctgaaccccctccaga

SEQ ID NO: 1559190 - DNA, 14 bp, Homo sapiens
ctgaaccctgtgct

SEQ ID NO: 1559191 - DNA, 18 bp, Homo sapiens
ctgaaccctgtgctggtg

SEQ ID NO: 1559192 - DNA, 20 bp, Homo sapiens
ctgaacccttgtgcttggtg

SEQ ID NO: 1559193 - DNA, 17 bp, Homo sapiens
ctgaaccggctttacca

SEQ ID NO: 1559194 - DNA, 14 bp, Homo sapiens
ctgaacctggaaat

SEQ ID NO: 1559195 - DNA, 23 bp, Homo sapiens
ctgaaccttaggctttgtatgac

SEQ ID NO: 1559196 - DNA, 14 bp, Homo sapiens
ctgaaccttccatc

SEQ ID NO: 1559197 - DNA, 14 bp, Homo sapiens
ctgaaccttgagca

SEQ ID NO: 1559198 - DNA, 18 bp, Homo sapiens
ctgaaccttgagcaaatt

SEQ ID NO: 1559199 - DNA, 13 bp, Homo sapiens
ctgaacggggaga

SEQ ID NO: 1559200 - DNA, 17 bp, Homo sapiens
ctgaacggggagaaaag

SEQ ID NO: 1559201 - DNA, 17 bp, Homo sapiens
ctgaacgttttcttctt

SEQ ID NO: 1559202 - DNA, 21 bp, Homo sapiens
ctgaacgttttcttctttccc

SEQ ID NO: 1559203 - DNA, 19 bp, Homo sapiens
ctgaactaaaataaaaatg

SEQ ID NO: 1559204 - DNA, 16 bp, Homo sapiens
ctgaactacaagtgta

SEQ ID NO: 1559205 - DNA, 18 bp, Homo sapiens
ctgaactcaaactgagga

SEQ ID NO: 1559206 - DNA, 11 bp, Homo sapiens
ctgaactcagc

SEQ ID NO: 1559207 - DNA, 19 bp, Homo sapiens
ctgaactccatacagcctc

SEQ ID NO: 1559208 - DNA, 20 bp, Homo sapiens
ctgaactccatacagcctct

SEQ ID NO: 1559209 - DNA, 13 bp, Homo sapiens
ctgaactccattt

SEQ ID NO: 1559210 - DNA, 20 bp, Homo sapiens
attgcttctaaaacaataaa

SEQ ID NO: 1559211 - DNA, 18 bp, Homo sapiens
attgcttgagctcaggag

SEQ ID NO: 1559212 - DNA, 23 bp, Homo sapiens
attgctttatgggggggagggag

SEQ ID NO: 1559213 - DNA, 11 bp, Homo sapiens
attgctttctg

SEQ ID NO: 1559214 - DNA, 20 bp, Homo sapiens
attgctttgccaaaatacca

SEQ ID NO: 1559215 - DNA, 18 bp, Homo sapiens
attgctttggtcatatga

SEQ ID NO: 1559216 - DNA, 21 bp, Homo sapiens
attgcttttttccaaaacaaa

SEQ ID NO: 1559217 - DNA, 16 bp, Homo sapiens
attggaacagaatgtt

SEQ ID NO: 1559218 - DNA, 23 bp, Homo sapiens
attggaactctactcaacccatt

SEQ ID NO: 1559219 - DNA, 23 bp, Homo sapiens
attggaaggtatttttttaaatt

SEQ ID NO: 1559220 - DNA, 15 bp, Homo sapiens
attggaataatcact

SEQ ID NO: 1559221 - DNA, 18 bp, Homo sapiens
attggaatctgatatact

SEQ ID NO: 1559222 - DNA, 17 bp, Homo sapiens
attggaatcttcacctc

SEQ ID NO: 1559223 - DNA, 18 bp, Homo sapiens
attggaatgcagaggtct

SEQ ID NO: 1559224 - DNA, 19 bp, Homo sapiens
attggaatggaactactgt

SEQ ID NO: 1559225 - DNA, 22 bp, Homo sapiens
attggaatggaactactgtact

SEQ ID NO: 1559226 - DNA, 14 bp, Homo sapiens
attggaattctttc

SEQ ID NO: 1559227 - DNA, 13 bp, Homo sapiens
attggactccagg

SEQ ID NO: 1559228 - DNA, 16 bp, Homo sapiens
attggactccaggcct

SEQ ID NO: 1559229 - DNA, 20 bp, Homo sapiens
attggagctgactgttcttg

SEQ ID NO: 1559230 - DNA, 22 bp, Homo sapiens
attggagctgactgttcttggt

SEQ ID NO: 1559231 - DNA, 18 bp, Homo sapiens
attggattattcatttaa

SEQ ID NO: 1559232 - DNA, 15 bp, Homo sapiens
attggatttcctaat

SEQ ID NO: 1559233 - DNA, 17 bp, Homo sapiens
attggcagctcaaagac

SEQ ID NO: 1559234 - DNA, 14 bp, Homo sapiens
attggcatggcttt

SEQ ID NO: 1559235 - DNA, 23 bp, Homo sapiens
attggcatggctttatttgtttt

SEQ ID NO: 1559236 - DNA, 16 bp, Homo sapiens
attggcccaacactgt

SEQ ID NO: 1559237 - DNA, 11 bp, Homo sapiens
attggcctgga

SEQ ID NO: 1559238 - DNA, 12 bp, Homo sapiens
attggcctggag

SEQ ID NO: 1559239 - DNA, 21 bp, Homo sapiens
attggcctggcctccagctcc

SEQ ID NO: 1559240 - DNA, 19 bp, Homo sapiens
attggctgcaggaagaaac

SEQ ID NO: 1559241 - DNA, 14 bp, Homo sapiens
attggctttgtgct

SEQ ID NO: 1559242 - DNA, 15 bp, Homo sapiens
attgggaaaacattt

SEQ ID NO: 1559243 - DNA, 15 bp, Homo sapiens
attgggaccctccag

SEQ ID NO: 1559244 - DNA, 21 bp, Homo sapiens
attgggagcttgggaatggat

SEQ ID NO: 1559245 - DNA, 15 bp, Homo sapiens
attgggctgcaggct

SEQ ID NO: 1559246 - DNA, 19 bp, Homo sapiens
attggggaagactgtggct

SEQ ID NO: 1559247 - DNA, 19 bp, Homo sapiens
attgggggctggtgccagc

SEQ ID NO: 1559248 - DNA, 22 bp, Homo sapiens
attgggtgaatatggtggaaaa

SEQ ID NO: 1559249 - DNA, 20 bp, Homo sapiens
attgggtgggattttttccc

SEQ ID NO: 1559250 - DNA, 17 bp, Homo sapiens
attggtatcaagaaagt

SEQ ID NO: 1559251 - DNA, 18 bp, Homo sapiens
attggtatcaagaaagtc

SEQ ID NO: 1559252 - DNA, 17 bp, Homo sapiens
attggtttaaagaaagt

SEQ ID NO: 1559253 - DNA, 15 bp, Homo sapiens
attgtaaaaatggca

SEQ ID NO: 1559254 - DNA, 13 bp, Homo sapiens
attgtaaaataat

SEQ ID NO: 1559255 - DNA, 12 bp, Homo sapiens
attgtaaagtaa

SEQ ID NO: 1559256 - DNA, 22 bp, Homo sapiens
attgtaaatactggactcagga

SEQ ID NO: 1559257 - DNA, 14 bp, Homo sapiens
attgtaaatgtgct

SEQ ID NO: 1559258 - DNA, 20 bp, Homo sapiens
attgtaagtgaaattaagca

SEQ ID NO: 1559259 - DNA, 18 bp, Homo sapiens
attgtaatcgtgtgccat

SEQ ID NO: 1559260 - DNA, 19 bp, Homo sapiens
attgtaatcgtgtgccatg

SEQ ID NO: 1559261 - DNA, 16 bp, Homo sapiens
attgtaatctgaataa

SEQ ID NO: 1559262 - DNA, 14 bp, Homo sapiens
atactttattgaaa

SEQ ID NO: 1559263 - DNA, 13 bp, Homo sapiens
atactttatttct

SEQ ID NO: 1559264 - DNA, 14 bp, Homo sapiens
atactttatttctg

SEQ ID NO: 1559265 - DNA, 16 bp, Homo sapiens
atactttccatgtttt

SEQ ID NO: 1559266 - DNA, 19 bp, Homo sapiens
atactttgacaaggaaaat

SEQ ID NO: 1559267 - DNA, 14 bp, Homo sapiens
atactttgtaaata

SEQ ID NO: 1559268 - DNA, 17 bp, Homo sapiens
atactttgtattttgat

SEQ ID NO: 1559269 - DNA, 14 bp, Homo sapiens
atactttgttctgt

SEQ ID NO: 1559270 - DNA, 15 bp, Homo sapiens
atactttgttctgtt

SEQ ID NO: 1559271 - DNA, 17 bp, Homo sapiens
atactttgttctgttgt

SEQ ID NO: 1559272 - DNA, 20 bp, Homo sapiens
atactttgttctgttgtctg

SEQ ID NO: 1559273 - DNA, 16 bp, Homo sapiens
atacttttgcattttt

SEQ ID NO: 1559274 - DNA, 20 bp, Homo sapiens
atacttttgcatttttcctt

SEQ ID NO: 1559275 - DNA, 13 bp, Homo sapiens
atacttttgtgta

SEQ ID NO: 1559276 - DNA, 20 bp, Homo sapiens
atacttttgtgtattctgtg

SEQ ID NO: 1559277 - DNA, 10 bp, Homo sapiens
atagaaaaat

SEQ ID NO: 1559278 - DNA, 12 bp, Homo sapiens
atagaaaaatgt

SEQ ID NO: 1559279 - DNA, 19 bp, Homo sapiens
atagaaaaatgtataaaaa

SEQ ID NO: 1559280 - DNA, 18 bp, Homo sapiens
atagaaaattatttgtat

SEQ ID NO: 1559281 - DNA, 11 bp, Homo sapiens
atagaaacatg

SEQ ID NO: 1559282 - DNA, 13 bp, Homo sapiens
atagaaacatgac

SEQ ID NO: 1559283 - DNA, 19 bp, Homo sapiens
atagaaacgtaaactatga

SEQ ID NO: 1559284 - DNA, 19 bp, Homo sapiens
atagaaagtgccagaaagt

SEQ ID NO: 1559285 - DNA, 17 bp, Homo sapiens
atagaaatgtttgctga

SEQ ID NO: 1559286 - DNA, 19 bp, Homo sapiens
atagaaattagatttgtgc

SEQ ID NO: 1559287 - DNA, 19 bp, Homo sapiens
atagaacacaaaacttgaa

SEQ ID NO: 1559288 - DNA, 23 bp, Homo sapiens
atagaacacaaaacttgaaagaa

SEQ ID NO: 1559289 - DNA, 22 bp, Homo sapiens
atagaactgtcccacaaaatat

SEQ ID NO: 1559290 - DNA, 20 bp, Homo sapiens
atagaaggaatttgtacttc

SEQ ID NO: 1559291 - DNA, 19 bp, Homo sapiens
atagaaggctatggggata

SEQ ID NO: 1559292 - DNA, 20 bp, Homo sapiens
atagaataaaggcagttttc

SEQ ID NO: 1559293 - DNA, 16 bp, Homo sapiens
atagaataatctatta

SEQ ID NO: 1559294 - DNA, 20 bp, Homo sapiens
atagaataattcttttctga

SEQ ID NO: 1559295 - DNA, 15 bp, Homo sapiens
atagaatacattttg

SEQ ID NO: 1559296 - DNA, 21 bp, Homo sapiens
atagaatacttttttctagtt

SEQ ID NO: 1559297 - DNA, 18 bp, Homo sapiens
atagaatgatgttttaaa

SEQ ID NO: 1559298 - DNA, 17 bp, Homo sapiens
atagacaaaagaataag

SEQ ID NO: 1559299 - DNA, 20 bp, Homo sapiens
atagacaaaagaataagaca

SEQ ID NO: 1559300 - DNA, 14 bp, Homo sapiens
atagacacatacat

SEQ ID NO: 1559301 - DNA, 12 bp, Homo sapiens
atagacatcttt

SEQ ID NO: 1559302 - DNA, 13 bp, Homo sapiens
atagacatgaaag

SEQ ID NO: 1559303 - DNA, 16 bp, Homo sapiens
atagaccctctttctt

SEQ ID NO: 1559304 - DNA, 19 bp, Homo sapiens
atagaccctctttcttgtt

SEQ ID NO: 1559305 - DNA, 16 bp, Homo sapiens
atagacctacagacct

SEQ ID NO: 1559306 - DNA, 21 bp, Homo sapiens
atagacctacagacctggctc

SEQ ID NO: 1559307 - DNA, 19 bp, Homo sapiens
atagacgggttgaaagaca

SEQ ID NO: 1559308 - DNA, 22 bp, Homo sapiens
atagacgtttggactgatttgt

SEQ ID NO: 1559309 - DNA, 14 bp, Homo sapiens
atagagaataaggc

SEQ ID NO: 1559310 - DNA, 15 bp, Homo sapiens
atagagcaaaattga

SEQ ID NO: 1559311 - DNA, 21 bp, Homo sapiens
atagagcaaaattgatgtgtt

SEQ ID NO: 1559312 - DNA, 13 bp, Homo sapiens
atagagcaatgtt

SEQ ID NO: 1559313 - DNA, 14 bp, Homo sapiens
atagagcagaaatt

SEQ ID NO: 1559314 - DNA, 23 bp, Homo sapiens
atagagcatatttgccaataaag

SEQ ID NO: 1559315 - DNA, 22 bp, Homo sapiens
atagagctgcagggtggattgt

SEQ ID NO: 1559316 - DNA, 14 bp, Homo sapiens
atagagctgccact

SEQ ID NO: 1559317 - DNA, 16 bp, Homo sapiens
atagagctgccactgg

SEQ ID NO: 1559318 - DNA, 16 bp, Homo sapiens
atagagcttttaaaaa

SEQ ID NO: 1559319 - DNA, 21 bp, Homo sapiens
caggcagcctctgtcaggcct

SEQ ID NO: 1559320 - DNA, 22 bp, Homo sapiens
caggcagcctctgtcaggcctt

SEQ ID NO: 1559321 - DNA, 17 bp, Homo sapiens
caggcagccttgaccac

SEQ ID NO: 1559322 - DNA, 16 bp, Homo sapiens
caggcagctccctcct

SEQ ID NO: 1559323 - DNA, 13 bp, Homo sapiens
caggcaggaacaa

SEQ ID NO: 1559324 - DNA, 12 bp, Homo sapiens
caggcaggagca

SEQ ID NO: 1559325 - DNA, 21 bp, Homo sapiens
caggcaggccaaggccttctc

SEQ ID NO: 1559326 - DNA, 13 bp, Homo sapiens
caggcaggccagg

SEQ ID NO: 1559327 - DNA, 20 bp, Homo sapiens
caggcagggagtgtctgcag

SEQ ID NO: 1559328 - DNA, 15 bp, Homo sapiens
caggcagggctgggc

SEQ ID NO: 1559329 - DNA, 23 bp, Homo sapiens
caggcagggctgggccaggtctc

SEQ ID NO: 1559330 - DNA, 13 bp, Homo sapiens
caggcaggggtgg

SEQ ID NO: 1559331 - DNA, 21 bp, Homo sapiens
caggcaggggtgggggtggag

SEQ ID NO: 1559332 - DNA, 16 bp, Homo sapiens
caggcaggtctgcaag

SEQ ID NO: 1559333 - DNA, 19 bp, Homo sapiens
caggcaggtctgcaagggc

SEQ ID NO: 1559334 - DNA, 20 bp, Homo sapiens
caggcaggtggactgactgt

SEQ ID NO: 1559335 - DNA, 16 bp, Homo sapiens
caggcagtcgggggct

SEQ ID NO: 1559336 - DNA, 21 bp, Homo sapiens
caggcagtcgggggctggcct

SEQ ID NO: 1559337 - DNA, 22 bp, Homo sapiens
caggcagtcgggggctggccta

SEQ ID NO: 1559338 - DNA, 23 bp, Homo sapiens
caggcagtcgggggctggcctag

SEQ ID NO: 1559339 - DNA, 15 bp, Homo sapiens
caggcagttctagaa

SEQ ID NO: 1559340 - DNA, 20 bp, Homo sapiens
caggcataaaatagagtaaa

SEQ ID NO: 1559341 - DNA, 23 bp, Homo sapiens
caggcatagaggcttctccgcca

SEQ ID NO: 1559342 - DNA, 15 bp, Homo sapiens
caggcataggcctgg

SEQ ID NO: 1559343 - DNA, 19 bp, Homo sapiens
caggcataggcctgggtgc

SEQ ID NO: 1559344 - DNA, 12 bp, Homo sapiens
caggcatcagga

SEQ ID NO: 1559345 - DNA, 16 bp, Homo sapiens
caggcatctacacagc

SEQ ID NO: 1559346 - DNA, 22 bp, Homo sapiens
caggcatgaggaatctgggagg

SEQ ID NO: 1559347 - DNA, 18 bp, Homo sapiens
caggcattcctgaaggga

SEQ ID NO: 1559348 - DNA, 23 bp, Homo sapiens
caggccaagagcagaggcagcga

SEQ ID NO: 1559349 - DNA, 18 bp, Homo sapiens
caggccaagcccaataca

SEQ ID NO: 1559350 - DNA, 21 bp, Homo sapiens
caggccaagcccaatacagcc

SEQ ID NO: 1559351 - DNA, 12 bp, Homo sapiens
caggccaaggct

SEQ ID NO: 1559352 - DNA, 20 bp, Homo sapiens
caggccaatgttgctgatgg

SEQ ID NO: 1559353 - DNA, 19 bp, Homo sapiens
caggccacctccccagcat

SEQ ID NO: 1559354 - DNA, 21 bp, Homo sapiens
caggccactgtggccagagct

SEQ ID NO: 1559355 - DNA, 22 bp, Homo sapiens
caggccactgtggccagagctg

SEQ ID NO: 1559356 - DNA, 20 bp, Homo sapiens
caggccagatgttgttcctg

SEQ ID NO: 1559357 - DNA, 13 bp, Homo sapiens
caggccagcccag

SEQ ID NO: 1559358 - DNA, 14 bp, Homo sapiens
caggccagcccagc

SEQ ID NO: 1559359 - DNA, 13 bp, Homo sapiens
caggccagcccgg

SEQ ID NO: 1559360 - DNA, 12 bp, Homo sapiens
caggccagcctc

SEQ ID NO: 1559361 - DNA, 13 bp, Homo sapiens
caggccagcctcc

SEQ ID NO: 1559362 - DNA, 21 bp, Homo sapiens
caggccaggggacccctgcca

SEQ ID NO: 1559363 - DNA, 12 bp, Homo sapiens
caggccaggtcc

SEQ ID NO: 1559364 - DNA, 12 bp, Homo sapiens
caggccaggtgg

SEQ ID NO: 1559365 - DNA, 16 bp, Homo sapiens
caggccatgtgagcca

SEQ ID NO: 1559366 - DNA, 17 bp, Homo sapiens
caggccatgtgagccac

SEQ ID NO: 1559367 - DNA, 16 bp, Homo sapiens
caggccattctgccgc

SEQ ID NO: 1559368 - DNA, 15 bp, Homo sapiens
caggccatttttggt

SEQ ID NO: 1559369 - DNA, 15 bp, Homo sapiens
caggcccaactgtga

SEQ ID NO: 1559370 - DNA, 21 bp, Homo sapiens
caggcccacagcgtgggaact

SEQ ID NO: 1559371 - DNA, 10 bp, Homo sapiens
caggcccacc

SEQ ID NO: 1559372 - DNA, 16 bp, Homo sapiens
caggcccactccccag

SEQ ID NO: 1559373 - DNA, 23 bp, Homo sapiens
caggcccactccccagccccagc

SEQ ID NO: 1559374 - DNA, 16 bp, Homo sapiens
caggcccactgtgcct

SEQ ID NO: 1559375 - DNA, 21 bp, Homo sapiens
caggcccagaggagccaagtc

SEQ ID NO: 1559376 - DNA, 20 bp, Homo sapiens
caggcccagcattgctggtt

SEQ ID NO: 1559377 - DNA, 13 bp, Homo sapiens
caggcccagcgcg

SEQ ID NO: 1559378 - DNA, 19 bp, Homo sapiens
caggcccagcgcggccagc

SEQ ID NO: 1559379 - DNA, 21 bp, Homo sapiens
caggcccagcgcggccagcgt

SEQ ID NO: 1559380 - DNA, 13 bp, Homo sapiens
caggcccatctca

SEQ ID NO: 1559381 - DNA, 21 bp, Homo sapiens
caggcccatctcaggtgccac

SEQ ID NO: 1559382 - DNA, 24 bp, Homo sapiens
caggcccatctcaggtgccactcc

SEQ ID NO: 1559383 - DNA, 19 bp, Homo sapiens
caggccccaccggccaggc

SEQ ID NO: 1559384 - DNA, 17 bp, Homo sapiens
caggccccactccttcc

SEQ ID NO: 1559385 - DNA, 20 bp, Homo sapiens
caggccccactccttcctga

SEQ ID NO: 1559386 - DNA, 15 bp, Homo sapiens
caggccccaggaaag

SEQ ID NO: 1559387 - DNA, 19 bp, Homo sapiens
caggccccccgcagcaccc

SEQ ID NO: 1559388 - DNA, 16 bp, Homo sapiens
caggccccctgcatct

SEQ ID NO: 1559389 - DNA, 17 bp, Homo sapiens
caggccccgcttgtcca

SEQ ID NO: 1559390 - DNA, 19 bp, Homo sapiens
caggccccgcttgtccagc

SEQ ID NO: 1559391 - DNA, 13 bp, Homo sapiens
caggcccctgagg

SEQ ID NO: 1559392 - DNA, 14 bp, Homo sapiens
caggcccctgagga

SEQ ID NO: 1559393 - DNA, 19 bp, Homo sapiens
caggcccctgaggactgga

SEQ ID NO: 1559394 - DNA, 20 bp, Homo sapiens
caggcccctgaggactggag

SEQ ID NO: 1559395 - DNA, 21 bp, Homo sapiens
caggcccgcaccccggcctca

SEQ ID NO: 1559396 - DNA, 17 bp, Homo sapiens
caggcccggactcacca

SEQ ID NO: 1559397 - DNA, 18 bp, Homo sapiens
caggcccggcgcggtggc

SEQ ID NO: 1559398 - DNA, 16 bp, Homo sapiens
caggcccggggctggc

SEQ ID NO: 1559399 - DNA, 23 bp, Homo sapiens
caggcccggggggaccaggatga

SEQ ID NO: 1559400 - DNA, 17 bp, Homo sapiens
caggcccgtcggagctg

SEQ ID NO: 1559401 - DNA, 19 bp, Homo sapiens
caggccgggcttgggccct

SEQ ID NO: 1559402 - DNA, 22 bp, Homo sapiens
caggccgggcttgggccctgca

SEQ ID NO: 1559403 - DNA, 22 bp, Homo sapiens
caggccgtcctcccgggccctc

SEQ ID NO: 1559404 - DNA, 19 bp, Homo sapiens
caggccgttccccttggct

SEQ ID NO: 1559405 - DNA, 20 bp, Homo sapiens
caggccgttccccttggctt

SEQ ID NO: 1559406 - DNA, 18 bp, Homo sapiens
caggcctaagacatgtga

SEQ ID NO: 1559407 - DNA, 23 bp, Homo sapiens
caggcctccaacgcccctgtggc

SEQ ID NO: 1559408 - DNA, 13 bp, Homo sapiens
caggcctccagcc

SEQ ID NO: 1559409 - DNA, 15 bp, Homo sapiens
caggcctccagcctc

SEQ ID NO: 1559410 - DNA, 16 bp, Homo sapiens
caggcctccagcctct

SEQ ID NO: 1559411 - DNA, 20 bp, Homo sapiens
caggcctccagcctctcccg

SEQ ID NO: 1559412 - DNA, 14 bp, Homo sapiens
caggcctccctctc

SEQ ID NO: 1559413 - DNA, 18 bp, Homo sapiens
caggcctccctctctctt

SEQ ID NO: 1559414 - DNA, 12 bp, Homo sapiens
caggcctctcca

SEQ ID NO: 1559415 - DNA, 20 bp, Homo sapiens
caggcctctcggtgctccat

SEQ ID NO: 1559416 - DNA, 14 bp, Homo sapiens
caggcctctgcaga

SEQ ID NO: 1559417 - DNA, 16 bp, Homo sapiens
caggcctctgcagaag

SEQ ID NO: 1559418 - DNA, 13 bp, Homo sapiens
caggcctctgcct

SEQ ID NO: 1559419 - DNA, 16 bp, Homo sapiens
caggcctctgcctgct

SEQ ID NO: 1559420 - DNA, 20 bp, Homo sapiens
caggcctgaaagaggctgag

SEQ ID NO: 1559421 - DNA, 23 bp, Homo sapiens
caggcctgaaagaggctgaggcc

SEQ ID NO: 1559422 - DNA, 18 bp, Homo sapiens
caggcctgaccagggggc

SEQ ID NO: 1559423 - DNA, 16 bp, Homo sapiens
caggcctgagaatgag

SEQ ID NO: 1559424 - DNA, 21 bp, Homo sapiens
caggcctgagaatgagtggga

SEQ ID NO: 1559425 - DNA, 14 bp, Homo sapiens
caggcctgagattt

SEQ ID NO: 1559426 - DNA, 19 bp, Homo sapiens
caggcctgagatttcatct

SEQ ID NO: 1559427 - DNA, 18 bp, Homo sapiens
caggcctgcaggggcaag

SEQ ID NO: 1559428 - DNA, 12 bp, Homo sapiens
caggcctgcctc

SEQ ID NO: 1559429 - DNA, 14 bp, Homo sapiens
caggcctgcctccc

SEQ ID NO: 1559430 - DNA, 16 bp, Homo sapiens
caggcctgcctcccac

SEQ ID NO: 1559431 - DNA, 17 bp, Homo sapiens
caggcctgcctcccact

SEQ ID NO: 1559432 - DNA, 17 bp, Homo sapiens
caggcctggcaagtggg

SEQ ID NO: 1559433 - DNA, 16 bp, Homo sapiens
caggcctggcctctgg

SEQ ID NO: 1559434 - DNA, 12 bp, Homo sapiens
caggcctgggac

SEQ ID NO: 1559435 - DNA, 16 bp, Homo sapiens
caggcctgggacccag

SEQ ID NO: 1559436 - DNA, 17 bp, Homo sapiens
caggcctgggacccagc

SEQ ID NO: 1559437 - DNA, 18 bp, Homo sapiens
caggcctgggacccagct

SEQ ID NO: 1559438 - DNA, 17 bp, Homo sapiens
caggcctgtatgaggct

SEQ ID NO: 1559439 - DNA, 19 bp, Homo sapiens
caggcctgtatgaggcttt

SEQ ID NO: 1559440 - DNA, 16 bp, Homo sapiens
caggcctgtccaccct

SEQ ID NO: 1559441 - DNA, 18 bp, Homo sapiens
caggccttcatcctcctc

SEQ ID NO: 1559442 - DNA, 23 bp, Homo sapiens
caggcgatggggcaagacagaaa

SEQ ID NO: 1559443 - DNA, 17 bp, Homo sapiens
caggcgccccttccccc

SEQ ID NO: 1559444 - DNA, 17 bp, Homo sapiens
caggcgccggcgggcgg

SEQ ID NO: 1559445 - DNA, 15 bp, Homo sapiens
caggcgcctgccatc

SEQ ID NO: 1559446 - DNA, 22 bp, Homo sapiens
caggcggagctgctgagtgaca

SEQ ID NO: 1559447 - DNA, 14 bp, Homo sapiens
caggcgggcgagcc

SEQ ID NO: 1559448 - DNA, 18 bp, Homo sapiens
caggcgggcgagccgcgg

SEQ ID NO: 1559449 - DNA, 15 bp, Homo sapiens
caggcgggctcaagg

SEQ ID NO: 1559450 - DNA, 15 bp, Homo sapiens
caggcggggtgctgt

SEQ ID NO: 1559451 - DNA, 19 bp, Homo sapiens
caggcggggtgctgtggtg

SEQ ID NO: 1559452 - DNA, 16 bp, Homo sapiens
caggcgttggtgccac

SEQ ID NO: 1559453 - DNA, 18 bp, Homo sapiens
caggcgttggtgccactt

SEQ ID NO: 1559454 - DNA, 17 bp, Homo sapiens
caggctaagaccctgtg

SEQ ID NO: 1559455 - DNA, 18 bp, Homo sapiens
caggctaagaccctgtgt

SEQ ID NO: 1559456 - DNA, 21 bp, Homo sapiens
caggctaagaccctgtgtcct

SEQ ID NO: 1559457 - DNA, 19 bp, Homo sapiens
caggctatatgcagtcctt

SEQ ID NO: 1559458 - DNA, 15 bp, Homo sapiens
caggctatttgttca

SEQ ID NO: 1559459 - DNA, 19 bp, Homo sapiens
caggctatttgttcagaga

SEQ ID NO: 1559460 - DNA, 20 bp, Homo sapiens
caggctatttgttcagagag

SEQ ID NO: 1559461 - DNA, 15 bp, Homo sapiens
caggctcactcacag

SEQ ID NO: 1559462 - DNA, 20 bp, Homo sapiens
caggctcactcacagagtca

SEQ ID NO: 1559463 - DNA, 14 bp, Homo sapiens
caggctcactgcca

SEQ ID NO: 1559464 - DNA, 18 bp, Homo sapiens
caggctcactgccaggcc

SEQ ID NO: 1559465 - DNA, 20 bp, Homo sapiens
caggctcactgccaggccag

SEQ ID NO: 1559466 - DNA, 14 bp, Homo sapiens
caggctccatgcac

SEQ ID NO: 1559467 - DNA, 16 bp, Homo sapiens
caggctccatgcacct

SEQ ID NO: 1559468 - DNA, 19 bp, Homo sapiens
caggctcctacctgtctgc

SEQ ID NO: 1559469 - DNA, 17 bp, Homo sapiens
caggctcctggctgtgc

SEQ ID NO: 1559470 - DNA, 24 bp, Homo sapiens
caggctcctggctgtgcccagcag

SEQ ID NO: 1559471 - DNA, 13 bp, Homo sapiens
caggctccttcct

SEQ ID NO: 1559472 - DNA, 17 bp, Homo sapiens
caggctccttcctgtct

SEQ ID NO: 1559473 - DNA, 20 bp, Homo sapiens
caggctccttcctgtcttcc

SEQ ID NO: 1559474 - DNA, 21 bp, Homo sapiens
caggctccttcctgtcttcct

SEQ ID NO: 1559475 - DNA, 14 bp, Homo sapiens
caggctctgccctg

SEQ ID NO: 1559476 - DNA, 15 bp, Homo sapiens
caggctctgccctgc

SEQ ID NO: 1559477 - DNA, 23 bp, Homo sapiens
caggctctgccctgccctagctc

SEQ ID NO: 1559478 - DNA, 15 bp, Homo sapiens
caggctctgggctca

SEQ ID NO: 1559479 - DNA, 17 bp, Homo sapiens
caggctctgggctcagg

SEQ ID NO: 1559480 - DNA, 19 bp, Homo sapiens
caggctctgggctcagggc

SEQ ID NO: 1559481 - DNA, 21 bp, Homo sapiens
caggctctgggctcagggctg

SEQ ID NO: 1559482 - DNA, 22 bp, Homo sapiens
caggctcttagcagcttccaga

SEQ ID NO: 1559483 - DNA, 13 bp, Homo sapiens
caggctcttcctg

SEQ ID NO: 1559484 - DNA, 14 bp, Homo sapiens
caggctcttcctgg

SEQ ID NO: 1559485 - DNA, 17 bp, Homo sapiens
caggctcttcctggacc

SEQ ID NO: 1559486 - DNA, 20 bp, Homo sapiens
caggctcttcctggacctga

SEQ ID NO: 1559487 - DNA, 22 bp, Homo sapiens
caggctcttcctggacctgagt

SEQ ID NO: 1559488 - DNA, 21 bp, Homo sapiens
caggctcttccttgaatcttc

SEQ ID NO: 1559489 - DNA, 14 bp, Homo sapiens
caggctgagagcca

SEQ ID NO: 1559490 - DNA, 15 bp, Homo sapiens
ccagcggctccaact

SEQ ID NO: 1559491 - DNA, 17 bp, Homo sapiens
ccagcggctccaactcc

SEQ ID NO: 1559492 - DNA, 15 bp, Homo sapiens
ccagcggctgctcaa

SEQ ID NO: 1559493 - DNA, 22 bp, Homo sapiens
ccagcggctggtgcagggcctc

SEQ ID NO: 1559494 - DNA, 22 bp, Homo sapiens
ccagcgggcacagggcaccaga

SEQ ID NO: 1559495 - DNA, 12 bp, Homo sapiens
ccagcgggcaga

SEQ ID NO: 1559496 - DNA, 13 bp, Homo sapiens
ccagcgggcagat

SEQ ID NO: 1559497 - DNA, 19 bp, Homo sapiens
ccagcgtcactccagtgct

SEQ ID NO: 1559498 - DNA, 21 bp, Homo sapiens
ccagcgtcactccagtgctca

SEQ ID NO: 1559499 - DNA, 14 bp, Homo sapiens
ccagcgtcccaggg

SEQ ID NO: 1559500 - DNA, 18 bp, Homo sapiens
ccagcgtcccagggtacc

SEQ ID NO: 1559501 - DNA, 15 bp, Homo sapiens
ccagcgtcccagtct

SEQ ID NO: 1559502 - DNA, 15 bp, Homo sapiens
ccagcgtcccttggt

SEQ ID NO: 1559503 - DNA, 17 bp, Homo sapiens
ccagcgtcccttggtga

SEQ ID NO: 1559504 - DNA, 16 bp, Homo sapiens
ccagcgtgtggagcag

SEQ ID NO: 1559505 - DNA, 18 bp, Homo sapiens
ccagcgtgtggagcagag

SEQ ID NO: 1559506 - DNA, 18 bp, Homo sapiens
ccagctaaacaccaaccc

SEQ ID NO: 1559507 - DNA, 14 bp, Homo sapiens
ccagctaagaacct

SEQ ID NO: 1559508 - DNA, 23 bp, Homo sapiens
ccagctaaggacatttcccaggg

SEQ ID NO: 1559509 - DNA, 20 bp, Homo sapiens
ccagctaatctgtagggctg

SEQ ID NO: 1559510 - DNA, 20 bp, Homo sapiens
ccagctaatttttgtatttt

SEQ ID NO: 1559511 - DNA, 17 bp, Homo sapiens
ccagctacattcctcag

SEQ ID NO: 1559512 - DNA, 23 bp, Homo sapiens
ccagctaccaagtcagacaccaa

SEQ ID NO: 1559513 - DNA, 15 bp, Homo sapiens
ccagctactcaggag

SEQ ID NO: 1559514 - DNA, 22 bp, Homo sapiens
ccagctactcaggaggctgaga

SEQ ID NO: 1559515 - DNA, 21 bp, Homo sapiens
ccagctactcgggaggctgag

SEQ ID NO: 1559516 - DNA, 15 bp, Homo sapiens
ccagctactctgtcc

SEQ ID NO: 1559517 - DNA, 19 bp, Homo sapiens
ccagctactctgtccaggc

SEQ ID NO: 1559518 - DNA, 20 bp, Homo sapiens
ccagctactctgtccaggcc

SEQ ID NO: 1559519 - DNA, 23 bp, Homo sapiens
ccagctactctgtccaggccact

SEQ ID NO: 1559520 - DNA, 17 bp, Homo sapiens
ccagcttggttccagga

SEQ ID NO: 1559521 - DNA, 18 bp, Homo sapiens
ccagctttccctgcctct

SEQ ID NO: 1559522 - DNA, 20 bp, Homo sapiens
ccaggaaactccacatctgc

SEQ ID NO: 1559523 - DNA, 21 bp, Homo sapiens
ccaggaaactccacatctgcc

SEQ ID NO: 1559524 - DNA, 23 bp, Homo sapiens
ccaggaaactccacatctgcctt

SEQ ID NO: 1559525 - DNA, 23 bp, Homo sapiens
ccaggaaactctgcattctagta

SEQ ID NO: 1559526 - DNA, 15 bp, Homo sapiens
ccaggaaaggcttgg

SEQ ID NO: 1559527 - DNA, 20 bp, Homo sapiens
ccaggaaaggcttggctggt

SEQ ID NO: 1559528 - DNA, 14 bp, Homo sapiens
ccaggaactgggcc

SEQ ID NO: 1559529 - DNA, 16 bp, Homo sapiens
ccaggaagccgtcctg

SEQ ID NO: 1559530 - DNA, 14 bp, Homo sapiens
ccaggaaggcagct

SEQ ID NO: 1559531 - DNA, 15 bp, Homo sapiens
ccaggaaggcagctg

SEQ ID NO: 1559532 - DNA, 18 bp, Homo sapiens
ccaggaaggcagctgctc

SEQ ID NO: 1559533 - DNA, 22 bp, Homo sapiens
ccaggaaggtagcccagcactg

SEQ ID NO: 1559534 - DNA, 23 bp, Homo sapiens
ccaggaaggtagcccagcactgt

SEQ ID NO: 1559535 - DNA, 23 bp, Homo sapiens
ccaggaatcggagcgaagcagag

SEQ ID NO: 1559536 - DNA, 18 bp, Homo sapiens
ccaggacaccgggcaggg

SEQ ID NO: 1559537 - DNA, 17 bp, Homo sapiens
ccaggacagctggttcg

SEQ ID NO: 1559538 - DNA, 17 bp, Homo sapiens
ccaggacaggcccggcg

SEQ ID NO: 1559539 - DNA, 12 bp, Homo sapiens
ccaggaccagcc

SEQ ID NO: 1559540 - DNA, 14 bp, Homo sapiens
ccaggaccagcctg

SEQ ID NO: 1559541 - DNA, 13 bp, Homo sapiens
ccaggaccagctc

SEQ ID NO: 1559542 - DNA, 15 bp, Homo sapiens
ccaggaccagctcag

SEQ ID NO: 1559543 - DNA, 16 bp, Homo sapiens
ccaggaccagctgggg

SEQ ID NO: 1559544 - DNA, 18 bp, Homo sapiens
ccaggaccagctggggcg

SEQ ID NO: 1559545 - DNA, 16 bp, Homo sapiens
ccaggacccgccagcc

SEQ ID NO: 1559546 - DNA, 19 bp, Homo sapiens
ccaggacccgccagccccg

SEQ ID NO: 1559547 - DNA, 20 bp, Homo sapiens
ccaggacccgccagccccgc

SEQ ID NO: 1559548 - DNA, 21 bp, Homo sapiens
ccaggacccgccagccccgct

SEQ ID NO: 1559549 - DNA, 16 bp, Homo sapiens
ccaggaccctgaaggg

SEQ ID NO: 1559550 - DNA, 23 bp, Homo sapiens
ccaggaccctgaaggggccatga

SEQ ID NO: 1559551 - DNA, 14 bp, Homo sapiens
ccaggactccctcc

SEQ ID NO: 1559552 - DNA, 17 bp, Homo sapiens
ccaggactccctcctca

SEQ ID NO: 1559553 - DNA, 18 bp, Homo sapiens
ccaggactccctcctcac

SEQ ID NO: 1559554 - DNA, 15 bp, Homo sapiens
ccaggactgggtctg

SEQ ID NO: 1559555 - DNA, 19 bp, Homo sapiens
ccaggactgggtctgacct

SEQ ID NO: 1559556 - DNA, 20 bp, Homo sapiens
aatatttaaacctttttctt

SEQ ID NO: 1559557 - DNA, 17 bp, Homo sapiens
aatatttaagtatatag

SEQ ID NO: 1559558 - DNA, 20 bp, Homo sapiens
aatatttaagtgaaggagaa

SEQ ID NO: 1559559 - DNA, 15 bp, Homo sapiens
aatatttagaaaatt

SEQ ID NO: 1559560 - DNA, 11 bp, Homo sapiens
aatatttataa

SEQ ID NO: 1559561 - DNA, 12 bp, Homo sapiens
aatatttataac

SEQ ID NO: 1559562 - DNA, 18 bp, Homo sapiens
aatatttatgaagaaaat

SEQ ID NO: 1559563 - DNA, 15 bp, Homo sapiens
aatatttatgtaaac

SEQ ID NO: 1559564 - DNA, 12 bp, Homo sapiens
aatatttattac

SEQ ID NO: 1559565 - DNA, 19 bp, Homo sapiens
aatatttattacacaaaga

SEQ ID NO: 1559566 - DNA, 13 bp, Homo sapiens
aatatttattacc

SEQ ID NO: 1559567 - DNA, 15 bp, Homo sapiens
aatatttattacctc

SEQ ID NO: 1559568 - DNA, 16 bp, Homo sapiens
aatatttattacctct

SEQ ID NO: 1559569 - DNA, 15 bp, Homo sapiens
aatatttcaagacat

SEQ ID NO: 1559570 - DNA, 23 bp, Homo sapiens
aatatttcaagtgcctagactgt

SEQ ID NO: 1559571 - DNA, 19 bp, Homo sapiens
aatatttccttaaactgtg

SEQ ID NO: 1559572 - DNA, 12 bp, Homo sapiens
aatatttgctga

SEQ ID NO: 1559573 - DNA, 21 bp, Homo sapiens
aatattttaatttttaaatgc

SEQ ID NO: 1559574 - DNA, 22 bp, Homo sapiens
aatattttctctgtacttttca

SEQ ID NO: 1559575 - DNA, 14 bp, Homo sapiens
aatattttgccttt

SEQ ID NO: 1559576 - DNA, 13 bp, Homo sapiens
aatattttgctaa

SEQ ID NO: 1559577 - DNA, 14 bp, Homo sapiens
aatattttgctaac

SEQ ID NO: 1559578 - DNA, 16 bp, Homo sapiens
aatattttgctaactg

SEQ ID NO: 1559579 - DNA, 21 bp, Homo sapiens
aatattttgctaactggttaa

SEQ ID NO: 1559580 - DNA, 18 bp, Homo sapiens
aatatttttagactattt

SEQ ID NO: 1559581 - DNA, 19 bp, Homo sapiens
aatatttttatatttcctt

SEQ ID NO: 1559582 - DNA, 20 bp, Homo sapiens
aatatttttatatttccttt

SEQ ID NO: 1559583 - DNA, 21 bp, Homo sapiens
aatatttttatatttccttta

SEQ ID NO: 1559584 - DNA, 20 bp, Homo sapiens
aatatttttcaattttgaaa

SEQ ID NO: 1559585 - DNA, 17 bp, Homo sapiens
aatatttttgtatttct

SEQ ID NO: 1559586 - DNA, 20 bp, Homo sapiens
aatatttttgtatttctcta

SEQ ID NO: 1559587 - DNA, 19 bp, Homo sapiens
aatatttttgtattttaca

SEQ ID NO: 1559588 - DNA, 20 bp, Homo sapiens
aatatttttgtattttacat

SEQ ID NO: 1559589 - DNA, 21 bp, Homo sapiens
aatattttttatatatacagt

SEQ ID NO: 1559590 - DNA, 18 bp, Homo sapiens
aatcaaaactctcctaca

SEQ ID NO: 1559591 - DNA, 14 bp, Homo sapiens
aatcaaacagtaat

SEQ ID NO: 1559592 - DNA, 16 bp, Homo sapiens
aatcaaataagtattt

SEQ ID NO: 1559593 - DNA, 18 bp, Homo sapiens
aatcaaataagtatttat

SEQ ID NO: 1559594 - DNA, 13 bp, Homo sapiens
aatcaaataatac

SEQ ID NO: 1559595 - DNA, 16 bp, Homo sapiens
aatcaaataatacctt

SEQ ID NO: 1559596 - DNA, 21 bp, Homo sapiens
aatcaaataataccttagaag

SEQ ID NO: 1559597 - DNA, 15 bp, Homo sapiens
aatcaaatgtatgta

SEQ ID NO: 1559598 - DNA, 20 bp, Homo sapiens
aatcaaccctctcctgtctg

SEQ ID NO: 1559599 - DNA, 21 bp, Homo sapiens
aatcaaccctctcctgtctgc

SEQ ID NO: 1559600 - DNA, 14 bp, Homo sapiens
aatcaactttactg

SEQ ID NO: 1559601 - DNA, 15 bp, Homo sapiens
aatcaactttactgt

SEQ ID NO: 1559602 - DNA, 16 bp, Homo sapiens
aatcaacttttatgca

SEQ ID NO: 1559603 - DNA, 14 bp, Homo sapiens
aatcaagagaaact

SEQ ID NO: 1559604 - DNA, 17 bp, Homo sapiens
aatcaagattatgatga

SEQ ID NO: 1559605 - DNA, 13 bp, Homo sapiens
aatcaagatttta

SEQ ID NO: 1559606 - DNA, 20 bp, Homo sapiens
aatcaagatttttttcctga

SEQ ID NO: 1559607 - DNA, 20 bp, Homo sapiens
aatcaagcctttatggctgc

SEQ ID NO: 1559608 - DNA, 23 bp, Homo sapiens
aatcaagcctttatggctgctgg

SEQ ID NO: 1559609 - DNA, 12 bp, Homo sapiens
aatcaaggaaag

SEQ ID NO: 1559610 - DNA, 19 bp, Homo sapiens
aatcaatacactagttgtt

SEQ ID NO: 1559611 - DNA, 17 bp, Homo sapiens
aatcaatgtcacttaaa

SEQ ID NO: 1559612 - DNA, 22 bp, Homo sapiens
aatcacagatgggtattaaact

SEQ ID NO: 1559613 - DNA, 22 bp, Homo sapiens
aatcacagcccaaaatttgatg

SEQ ID NO: 1559614 - DNA, 23 bp, Homo sapiens
aatcacagtactttccagcagtc

SEQ ID NO: 1559615 - DNA, 16 bp, Homo sapiens
aatcacagtgttgcat

SEQ ID NO: 1559616 - DNA, 15 bp, Homo sapiens
aatcacattttgtat

SEQ ID NO: 1559617 - DNA, 22 bp, Homo sapiens
aatcacatttttttatgctctt

SEQ ID NO: 1559618 - DNA, 15 bp, Homo sapiens
aatcaccatgtaagc

SEQ ID NO: 1559619 - DNA, 16 bp, Homo sapiens
aatcaccatgtaagca

SEQ ID NO: 1559620 - DNA, 20 bp, Homo sapiens
aatcacggtggtaaagaaag

SEQ ID NO: 1559621 - DNA, 18 bp, Homo sapiens
aatcactatgatttctga

SEQ ID NO: 1559622 - DNA, 17 bp, Homo sapiens
aatcactgtgctcagcc

SEQ ID NO: 1559623 - DNA, 16 bp, Homo sapiens
aatcacttaggaaatg

SEQ ID NO: 1559624 - DNA, 23 bp, Homo sapiens
aatcacttgaacccgggggacag

SEQ ID NO: 1559625 - DNA, 21 bp, Homo sapiens
aatcactttacctgcaggctc

SEQ ID NO: 1559626 - DNA, 13 bp, Homo sapiens
aatcagaaagtaa

SEQ ID NO: 1559627 - DNA, 23 bp, Homo sapiens
aatcagaactcaaatggggccag

SEQ ID NO: 1559628 - DNA, 14 bp, Homo sapiens
aatcagcactgaaa

SEQ ID NO: 1559629 - DNA, 15 bp, Homo sapiens
aatcagcactgaaaa

SEQ ID NO: 1559630 - DNA, 18 bp, Homo sapiens
aatcagcattctcactcc

SEQ ID NO: 1559631 - DNA, 23 bp, Homo sapiens
aatcagctatttactgccaaagg

SEQ ID NO: 1559632 - DNA, 16 bp, Homo sapiens
aatcagctattttgtg

SEQ ID NO: 1559633 - DNA, 19 bp, Homo sapiens
aatcagcttttgttctaga

SEQ ID NO: 1559634 - DNA, 18 bp, Homo sapiens
aatcagggaggtcatttt

SEQ ID NO: 1559635 - DNA, 21 bp, Homo sapiens
aatcagtaatatttatatatt

SEQ ID NO: 1559636 - DNA, 19 bp, Homo sapiens
aatcagtcagtgcaaatgt

SEQ ID NO: 1559637 - DNA, 21 bp, Homo sapiens
aatcagtcagtgcaaatgtca

SEQ ID NO: 1559638 - DNA, 17 bp, Homo sapiens
aatcagtgtttggtgta

SEQ ID NO: 1559639 - DNA, 17 bp, Homo sapiens
aatcagttcattagaaa

SEQ ID NO: 1559640 - DNA, 18 bp, Homo sapiens
aatcagttcattagaaat

SEQ ID NO: 1559641 - DNA, 20 bp, Homo sapiens
aatcagttcattagaaatat

SEQ ID NO: 1559642 - DNA, 16 bp, Homo sapiens
aatcagttgtgaatac

SEQ ID NO: 1559643 - DNA, 14 bp, Homo sapiens
aatcataaagtcag

SEQ ID NO: 1559644 - DNA, 12 bp, Homo sapiens
aatcataagtat

SEQ ID NO: 1559645 - DNA, 16 bp, Homo sapiens
aatcataagtatttgg

SEQ ID NO: 1559646 - DNA, 15 bp, Homo sapiens
aatcataatgtatta

SEQ ID NO: 1559647 - DNA, 17 bp, Homo sapiens
aatcataatgtattatt

SEQ ID NO: 1559648 - DNA, 21 bp, Homo sapiens
aatcataatgtattatttaaa

SEQ ID NO: 1559649 - DNA, 13 bp, Homo sapiens
aatcatacaaact

SEQ ID NO: 1559650 - DNA, 19 bp, Homo sapiens
aatcatacaaactctcacc

SEQ ID NO: 1559651 - DNA, 13 bp, Homo sapiens
aatcataccagtt

SEQ ID NO: 1559652 - DNA, 21 bp, Homo sapiens
aatcatataataaatgtacat

SEQ ID NO: 1559653 - DNA, 14 bp, Homo sapiens
aatcatatgattct

SEQ ID NO: 1559654 - DNA, 15 bp, Homo sapiens
aatcatatgattctg

SEQ ID NO: 1559655 - DNA, 12 bp, Homo sapiens
aatcatcaagaa

SEQ ID NO: 1559656 - DNA, 14 bp, Homo sapiens
aatcatcaagaagg

SEQ ID NO: 1559657 - DNA, 12 bp, Homo sapiens
aatcatcctcat

SEQ ID NO: 1559658 - DNA, 21 bp, Homo sapiens
aatcatgaaaagaggaacagg

SEQ ID NO: 1559659 - DNA, 19 bp, Homo sapiens
aatcatgtccatacacttt

SEQ ID NO: 1559660 - DNA, 15 bp, Homo sapiens
aatcatgttgaaaca

SEQ ID NO: 1559661 - DNA, 19 bp, Homo sapiens
aatcatgtttattttgagt

SEQ ID NO: 1559662 - DNA, 16 bp, Homo sapiens
aatcatgtttctttga

SEQ ID NO: 1559663 - DNA, 17 bp, Homo sapiens
aatcattaagacaactg

SEQ ID NO: 1559664 - DNA, 20 bp, Homo sapiens
aatcattagttttagaggca

SEQ ID NO: 1559665 - DNA, 15 bp, Homo sapiens
aatcattcagaaatg

SEQ ID NO: 1559666 - DNA, 16 bp, Homo sapiens
aatcattcagaaatgt

SEQ ID NO: 1559667 - DNA, 19 bp, Homo sapiens
aatcattcagaaatgttga

SEQ ID NO: 1559668 - DNA, 13 bp, Homo sapiens
aatcatttattca

SEQ ID NO: 1559669 - DNA, 15 bp, Homo sapiens
aatcatttgtttaaa

SEQ ID NO: 1559670 - DNA, 14 bp, Homo sapiens
aatcatttgtttac

SEQ ID NO: 1559671 - DNA, 12 bp, Homo sapiens
aatgctgcactt

SEQ ID NO: 1559672 - DNA, 14 bp, Homo sapiens
aatgctgcatttta

SEQ ID NO: 1559673 - DNA, 17 bp, Homo sapiens
aatgctggactggaggc

SEQ ID NO: 1559674 - DNA, 15 bp, Homo sapiens
aatgctggttttcct

SEQ ID NO: 1559675 - DNA, 20 bp, Homo sapiens
aatgctgttaatatttctaa

SEQ ID NO: 1559676 - DNA, 22 bp, Homo sapiens
aatgctgttaatatttctaaaa

SEQ ID NO: 1559677 - DNA, 16 bp, Homo sapiens
aatgctgttgcctcat

SEQ ID NO: 1559678 - DNA, 15 bp, Homo sapiens
aatgctgtttctaag

SEQ ID NO: 1559679 - DNA, 18 bp, Homo sapiens
aatgctgtttctaagaaa

SEQ ID NO: 1559680 - DNA, 19 bp, Homo sapiens
aatgctgtttctaagaaaa

SEQ ID NO: 1559681 - DNA, 20 bp, Homo sapiens
aatgcttatcatctaaagat

SEQ ID NO: 1559682 - DNA, 18 bp, Homo sapiens
aatgcttcagatattatt

SEQ ID NO: 1559683 - DNA, 14 bp, Homo sapiens
aatgcttcattatt

SEQ ID NO: 1559684 - DNA, 20 bp, Homo sapiens
aatgcttcattcaatattga

SEQ ID NO: 1559685 - DNA, 16 bp, Homo sapiens
aatgcttccaagcatg

SEQ ID NO: 1559686 - DNA, 15 bp, Homo sapiens
aatgcttgtagaagt

SEQ ID NO: 1559687 - DNA, 17 bp, Homo sapiens
aatgctttctgaagctt

SEQ ID NO: 1559688 - DNA, 17 bp, Homo sapiens
aatgctttgggaggcca

SEQ ID NO: 1559689 - DNA, 21 bp, Homo sapiens
aatgctttgggaggccaaggc

SEQ ID NO: 1559690 - DNA, 17 bp, Homo sapiens
aatgctttttagaaagc

SEQ ID NO: 1559691 - DNA, 16 bp, Homo sapiens
aatggaaacagactca

SEQ ID NO: 1559692 - DNA, 12 bp, Homo sapiens
aatggaaactga

SEQ ID NO: 1559693 - DNA, 15 bp, Homo sapiens
aatggaaattttgct

SEQ ID NO: 1559694 - DNA, 16 bp, Homo sapiens
aatggaaattttgcta

SEQ ID NO: 1559695 - DNA, 17 bp, Homo sapiens
aatggaactactgtact

SEQ ID NO: 1559696 - DNA, 17 bp, Homo sapiens
aatggaagcactgccat

SEQ ID NO: 1559697 - DNA, 18 bp, Homo sapiens
aatggaataaaaggcttg

SEQ ID NO: 1559698 - DNA, 16 bp, Homo sapiens
aatggaatcgatttcc

SEQ ID NO: 1559699 - DNA, 15 bp, Homo sapiens
aatggaattattttg

SEQ ID NO: 1559700 - DNA, 18 bp, Homo sapiens
aatggacaaaatccatga

SEQ ID NO: 1559701 - DNA, 14 bp, Homo sapiens
aatggacatttcta

SEQ ID NO: 1559702 - DNA, 23 bp, Homo sapiens
aatggactggaaggggaagggac

SEQ ID NO: 1559703 - DNA, 14 bp, Homo sapiens
aatggagaagctct

SEQ ID NO: 1559704 - DNA, 15 bp, Homo sapiens
aatggagaagctctg

SEQ ID NO: 1559705 - DNA, 12 bp, Homo sapiens
aatggaggcttt

SEQ ID NO: 1559706 - DNA, 14 bp, Homo sapiens
aatggaggcttttc

SEQ ID NO: 1559707 - DNA, 18 bp, Homo sapiens
aatggaggcttttcactg

SEQ ID NO: 1559708 - DNA, 13 bp, Homo sapiens
aatggatcacaag

SEQ ID NO: 1559709 - DNA, 13 bp, Homo sapiens
aatggatgaggtg

SEQ ID NO: 1559710 - DNA, 17 bp, Homo sapiens
aatggatttttctttaa

SEQ ID NO: 1559711 - DNA, 23 bp, Homo sapiens
aatggcaaggcagccctgtctga

SEQ ID NO: 1559712 - DNA, 18 bp, Homo sapiens
aatggcagctagtgcctt

SEQ ID NO: 1559713 - DNA, 18 bp, Homo sapiens
aatggcagtcctggaggc

SEQ ID NO: 1559714 - DNA, 12 bp, Homo sapiens
aatggccatgca

SEQ ID NO: 1559715 - DNA, 21 bp, Homo sapiens
aatggccatgcaggaggtgga

SEQ ID NO: 1559716 - DNA, 23 bp, Homo sapiens
aatggcgtctgctctggtggctt

SEQ ID NO: 1559717 - DNA, 14 bp, Homo sapiens
aatggctaataaac

SEQ ID NO: 1559718 - DNA, 15 bp, Homo sapiens
aatggctaataaact

SEQ ID NO: 1559719 - DNA, 16 bp, Homo sapiens
aatggctcaagtagaa

SEQ ID NO: 1559720 - DNA, 21 bp, Homo sapiens
aatggctgggtcagggccaga

SEQ ID NO: 1559721 - DNA, 17 bp, Homo sapiens
aatggcttttcttaccc

SEQ ID NO: 1559722 - DNA, 21 bp, Homo sapiens
aatgggaaaaaacttaaaaat

SEQ ID NO: 1559723 - DNA, 16 bp, Homo sapiens
aatgggaatattttat

SEQ ID NO: 1559724 - DNA, 18 bp, Homo sapiens
aatgggactgatgtcatc

SEQ ID NO: 1559725 - DNA, 22 bp, Homo sapiens
aatgggactgatgtcatcttga

SEQ ID NO: 1559726 - DNA, 13 bp, Homo sapiens
aatgggagccagg

SEQ ID NO: 1559727 - DNA, 15 bp, Homo sapiens
aatgggagccaggag

SEQ ID NO: 1559728 - DNA, 22 bp, Homo sapiens
aatgggatggtcggatctcaca

SEQ ID NO: 1559729 - DNA, 15 bp, Homo sapiens
aatgggcctgcccaa

SEQ ID NO: 1559730 - DNA, 20 bp, Homo sapiens
aatggggataataatactga

SEQ ID NO: 1559731 - DNA, 16 bp, Homo sapiens
aatggggcagacacaa

SEQ ID NO: 1559732 - DNA, 12 bp, Homo sapiens
aatggggccaga

SEQ ID NO: 1559733 - DNA, 20 bp, Homo sapiens
aatgggggcctcttcaaatt

SEQ ID NO: 1559734 - DNA, 18 bp, Homo sapiens
aatggggggcgggccagg

SEQ ID NO: 1559735 - DNA, 20 bp, Homo sapiens
aatggggggcgggccagggt

SEQ ID NO: 1559736 - DNA, 14 bp, Homo sapiens
aatggtaataagca

SEQ ID NO: 1559737 - DNA, 14 bp, Homo sapiens
aatggtaatagaat

SEQ ID NO: 1559738 - DNA, 21 bp, Homo sapiens
aatggtaatagaatagcacag

SEQ ID NO: 1559739 - DNA, 21 bp, Homo sapiens
aatggtagattcgctgtcccc

SEQ ID NO: 1559740 - DNA, 23 bp, Homo sapiens
aatggtataaaaggttgccaaat

SEQ ID NO: 1559741 - DNA, 17 bp, Homo sapiens
aatggtcccatccaggc

SEQ ID NO: 1559742 - DNA, 14 bp, Homo sapiens
aatggtctctgtca

SEQ ID NO: 1559743 - DNA, 23 bp, Homo sapiens
aatggtctttgctccagataact

SEQ ID NO: 1559744 - DNA, 12 bp, Homo sapiens
aatggtgatttt

SEQ ID NO: 1559745 - DNA, 13 bp, Homo sapiens
aatggtgcttccc

SEQ ID NO: 1559746 - DNA, 15 bp, Homo sapiens
aatggtgcttccccc

SEQ ID NO: 1559747 - DNA, 13 bp, Homo sapiens
aatggtgtacata

SEQ ID NO: 1559748 - DNA, 18 bp, Homo sapiens
aatggtgtagctgtcctc

SEQ ID NO: 1559749 - DNA, 20 bp, Homo sapiens
aatggtgtcagtatccaggc

SEQ ID NO: 1559750 - DNA, 19 bp, Homo sapiens
aatggtgttgtatgccttt

SEQ ID NO: 1559751 - DNA, 19 bp, Homo sapiens
aatggttccatgcctgagg

SEQ ID NO: 1559752 - DNA, 16 bp, Homo sapiens
aatggttgatggaaaa

SEQ ID NO: 1559753 - DNA, 17 bp, Homo sapiens
aatggttgatggaaaat

SEQ ID NO: 1559754 - DNA, 18 bp, Homo sapiens
aatggttgatggaaaata

SEQ ID NO: 1559755 - DNA, 23 bp, Homo sapiens
aatggttgatggaaaataaacat

SEQ ID NO: 1559756 - DNA, 14 bp, Homo sapiens
aatggttttcaaaa

SEQ ID NO: 1559757 - DNA, 12 bp, Homo sapiens
aatgtaaaaaag

SEQ ID NO: 1559758 - DNA, 15 bp, Homo sapiens
aatgtaaaattcata

SEQ ID NO: 1559759 - DNA, 23 bp, Homo sapiens
aatgtaaactaggattggagtat

SEQ ID NO: 1559760 - DNA, 17 bp, Homo sapiens
aatgtaaagttatgtat

SEQ ID NO: 1559761 - DNA, 22 bp, Homo sapiens
aatgtaaagttatgtatttaaa

SEQ ID NO: 1559762 - DNA, 16 bp, Homo sapiens
aatgtaaataaactat

SEQ ID NO: 1559763 - DNA, 21 bp, Homo sapiens
aatgtaaataaactatttata

SEQ ID NO: 1559764 - DNA, 12 bp, Homo sapiens
aatgtaaatatt

SEQ ID NO: 1559765 - DNA, 13 bp, Homo sapiens
aatgtaaatttgt

SEQ ID NO: 1559766 - DNA, 14 bp, Homo sapiens
aatgtaaatttgta

SEQ ID NO: 1559767 - DNA, 15 bp, Homo sapiens
aatgtaaatttgtac

SEQ ID NO: 1559768 - DNA, 17 bp, Homo sapiens
aatgtaaatttgtacta

SEQ ID NO: 1559769 - DNA, 16 bp, Homo sapiens
aatgtaacatcataat

SEQ ID NO: 1559770 - DNA, 17 bp, Homo sapiens
aatgtaacatcataatt

SEQ ID NO: 1559771 - DNA, 15 bp, Homo sapiens
aatgtaacttttgta

SEQ ID NO: 1559772 - DNA, 20 bp, Homo sapiens
aatgtaagattatagattct

SEQ ID NO: 1559773 - DNA, 23 bp, Homo sapiens
aatgtaagattatagattctaaa

SEQ ID NO: 1559774 - DNA, 22 bp, Homo sapiens
aatgtaagcaaaggctctgaaa

SEQ ID NO: 1559775 - DNA, 15 bp, Homo sapiens
aatgtaagctctact

SEQ ID NO: 1559776 - DNA, 15 bp, Homo sapiens
aatgtaagtgggccc

SEQ ID NO: 1559777 - DNA, 17 bp, Homo sapiens
aatgtaatataatgtat

SEQ ID NO: 1559778 - DNA, 13 bp, Homo sapiens
aatgtaattggaa

SEQ ID NO: 1559779 - DNA, 16 bp, Homo sapiens
aatgtaattggaatct

SEQ ID NO: 1559780 - DNA, 19 bp, Homo sapiens
aatgtaattggaatcttca

SEQ ID NO: 1559781 - DNA, 13 bp, Homo sapiens
aatgtaatttaaa

SEQ ID NO: 1559782 - DNA, 16 bp, Homo sapiens
aatgtaatttaaatga

SEQ ID NO: 1559783 - DNA, 19 bp, Homo sapiens
aatgtacaagttttgtata

SEQ ID NO: 1559784 - DNA, 14 bp, Homo sapiens
aatgtacaattatg

SEQ ID NO: 1559785 - DNA, 20 bp, Homo sapiens
aatgtacactaccaaacact

SEQ ID NO: 1559786 - DNA, 20 bp, Homo sapiens
gcctgggggacagaaagaga

SEQ ID NO: 1559787 - DNA, 22 bp, Homo sapiens
gcctgggggacccctggctctg

SEQ ID NO: 1559788 - DNA, 23 bp, Homo sapiens
gcctgggggcagtgactggcagg

SEQ ID NO: 1559789 - DNA, 19 bp, Homo sapiens
gcctggggtgcatctcctc

SEQ ID NO: 1559790 - DNA, 21 bp, Homo sapiens
gcctgggtcacacacggaggc

SEQ ID NO: 1559791 - DNA, 20 bp, Homo sapiens
gcctgggtctccctggtggg

SEQ ID NO: 1559792 - DNA, 23 bp, Homo sapiens
gcctgggtgacagagtgagaccc

SEQ ID NO: 1559793 - DNA, 20 bp, Homo sapiens
gcctgggtgctggctgccca

SEQ ID NO: 1559794 - DNA, 18 bp, Homo sapiens
gcctgggtggggctgctc

SEQ ID NO: 1559795 - DNA, 14 bp, Homo sapiens
gcctgggtggtacc

SEQ ID NO: 1559796 - DNA, 21 bp, Homo sapiens
gcctggtaagggggtccctgt

SEQ ID NO: 1559797 - DNA, 19 bp, Homo sapiens
gcctggtcccagagtggct

SEQ ID NO: 1559798 - DNA, 13 bp, Homo sapiens
gcctggtcctccc

SEQ ID NO: 1559799 - DNA, 10 bp, Homo sapiens
tatttgtaaa

SEQ ID NO: 1559800 - DNA, 13 bp, Homo sapiens
tatttgtaaatct

SEQ ID NO: 1559801 - DNA, 17 bp, Homo sapiens
tatttgtaaatctgcca

SEQ ID NO: 1559802 - DNA, 16 bp, Homo sapiens
tatttgtaaatttatg

SEQ ID NO: 1559803 - DNA, 12 bp, Homo sapiens
tatttgtaatta

SEQ ID NO: 1559804 - DNA, 14 bp, Homo sapiens
tatttgtacaaata

SEQ ID NO: 1559805 - DNA, 20 bp, Homo sapiens
tatttgtacaattttaaagt

SEQ ID NO: 1559806 - DNA, 15 bp, Homo sapiens
tatttgtactttctg

SEQ ID NO: 1559807 - DNA, 17 bp, Homo sapiens
tatttgtatagttgctt

SEQ ID NO: 1559808 - DNA, 15 bp, Homo sapiens
tatttgtattaataa

SEQ ID NO: 1559809 - DNA, 22 bp, Homo sapiens
tatttgtattaataaagcattc

SEQ ID NO: 1559810 - DNA, 19 bp, Homo sapiens
tatttgtatttatttccag

SEQ ID NO: 1559811 - DNA, 15 bp, Homo sapiens
tatttgtctgtaaaa

SEQ ID NO: 1559812 - DNA, 13 bp, Homo sapiens
tatttgtcttccg

SEQ ID NO: 1559813 - DNA, 12 bp, Homo sapiens
tatttgtgtttt

SEQ ID NO: 1559814 - DNA, 19 bp, Homo sapiens
tatttgtgttttaatttaa

SEQ ID NO: 1559815 - DNA, 19 bp, Homo sapiens
tatttgttaaaatatttgc

SEQ ID NO: 1559816 - DNA, 17 bp, Homo sapiens
tatttgttatatataat

SEQ ID NO: 1559817 - DNA, 20 bp, Homo sapiens
tatttgttatatataataaa

SEQ ID NO: 1559818 - DNA, 16 bp, Homo sapiens
tattttaaaataaatg

SEQ ID NO: 1559819 - DNA, 14 bp, Homo sapiens
tattttaaaatata

SEQ ID NO: 1559820 - DNA, 15 bp, Homo sapiens
tattttaaaatatat

SEQ ID NO: 1559821 - DNA, 14 bp, Homo sapiens
tattttaaaatatt

SEQ ID NO: 1559822 - DNA, 17 bp, Homo sapiens
tattttaaaatttgttc

SEQ ID NO: 1559823 - DNA, 20 bp, Homo sapiens
tattttaaagtaaaagtcta

SEQ ID NO: 1559824 - DNA, 17 bp, Homo sapiens
tattttaaatataaata

SEQ ID NO: 1559825 - DNA, 17 bp, Homo sapiens
tattttaacactttgta

SEQ ID NO: 1559826 - DNA, 15 bp, Homo sapiens
tattttaactatttt

SEQ ID NO: 1559827 - DNA, 18 bp, Homo sapiens
tattttaactatttttgt

SEQ ID NO: 1559828 - DNA, 16 bp, Homo sapiens
tattttaagaattgtt

SEQ ID NO: 1559829 - DNA, 19 bp, Homo sapiens
tattttaatattttgtatt

SEQ ID NO: 1559830 - DNA, 13 bp, Homo sapiens
tattttaatgtac

SEQ ID NO: 1559831 - DNA, 19 bp, Homo sapiens
tattttaatttatgagttt

SEQ ID NO: 1559832 - DNA, 18 bp, Homo sapiens
tattttacacagaaacac

SEQ ID NO: 1559833 - DNA, 21 bp, Homo sapiens
tattttacagctcattaaact

SEQ ID NO: 1559834 - DNA, 14 bp, Homo sapiens
tattttactgtctt

SEQ ID NO: 1559835 - DNA, 20 bp, Homo sapiens
tattttagacaaccatagaa

SEQ ID NO: 1559836 - DNA, 22 bp, Homo sapiens
tattttatatctgagcaaggag

SEQ ID NO: 1559837 - DNA, 16 bp, Homo sapiens
tcaaaaagcagagtgg

SEQ ID NO: 1559838 - DNA, 21 bp, Homo sapiens
tcaaaaagtattatcattgct

SEQ ID NO: 1559839 - DNA, 13 bp, Homo sapiens
tcaaaaataaact

SEQ ID NO: 1559840 - DNA, 21 bp, Homo sapiens
tcaaaaataaactagtttcca

SEQ ID NO: 1559841 - DNA, 15 bp, Homo sapiens
tcaaaaatataactt

SEQ ID NO: 1559842 - DNA, 14 bp, Homo sapiens
tcaaaacaaaacaa

SEQ ID NO: 1559843 - DNA, 15 bp, Homo sapiens
tcaaaacagagatgt

SEQ ID NO: 1559844 - DNA, 16 bp, Homo sapiens
tcaaaacctgcagtta

SEQ ID NO: 1559845 - DNA, 16 bp, Homo sapiens
tcaaaacctgtgccag

SEQ ID NO: 1559846 - DNA, 17 bp, Homo sapiens
tcaaaacctgtgccagg

SEQ ID NO: 1559847 - DNA, 16 bp, Homo sapiens
tcaaaacgggtcagta

SEQ ID NO: 1559848 - DNA, 12 bp, Homo sapiens
tcaaaactggtt

SEQ ID NO: 1559849 - DNA, 16 bp, Homo sapiens
tcaaaactgtttgtta

SEQ ID NO: 1559850 - DNA, 16 bp, Homo sapiens
tcaaaactttcgttgt

SEQ ID NO: 1559851 - DNA, 19 bp, Homo sapiens
tcaaaagaatcagaaacag

SEQ ID NO: 1559852 - DNA, 21 bp, Homo sapiens
tcaaaagaggttactttagtt

SEQ ID NO: 1559853 - DNA, 18 bp, Homo sapiens
tcaaaagggaagagtttt

SEQ ID NO: 1559854 - DNA, 20 bp, Homo sapiens
tcaaaaggtattatacatgt

SEQ ID NO: 1559855 - DNA, 14 bp, Homo sapiens
tcaaaagtattgaa

SEQ ID NO: 1559856 - DNA, 13 bp, Homo sapiens
tcaaaagttccaa

SEQ ID NO: 1559857 - DNA, 21 bp, Homo sapiens
tcaaaagttccaagagtctaa

SEQ ID NO: 1559858 - DNA, 22 bp, Homo sapiens
tcaaaagttccaagagtctaaa

SEQ ID NO: 1559859 - DNA, 16 bp, Homo sapiens
tcaaaagttgaaatta

SEQ ID NO: 1559860 - DNA, 20 bp, Homo sapiens
tcaaaataaaaagtgacaca

SEQ ID NO: 1559861 - DNA, 21 bp, Homo sapiens
tcaaaataaaaagtgacacag

SEQ ID NO: 1559862 - DNA, 17 bp, Homo sapiens
tcaaaataaagaagtat

SEQ ID NO: 1559863 - DNA, 14 bp, Homo sapiens
tcaaaataatttta

SEQ ID NO: 1559864 - DNA, 21 bp, Homo sapiens
tcaaaataccatgccatttaa

SEQ ID NO: 1559865 - DNA, 22 bp, Homo sapiens
tcaaaatatgtaagaacacatt

SEQ ID NO: 1559866 - DNA, 16 bp, Homo sapiens
tcaaaatatttgtaca

SEQ ID NO: 1559867 - DNA, 16 bp, Homo sapiens
tcaaaatccaaaaaga

SEQ ID NO: 1559868 - DNA, 23 bp, Homo sapiens
tcaaaatccaaaaagaaatgatg

SEQ ID NO: 1559869 - DNA, 15 bp, Homo sapiens
tcaaaatctgtcata

SEQ ID NO: 1559870 - DNA, 18 bp, Homo sapiens
tcaaaatctttgtataaa

SEQ ID NO: 1559871 - DNA, 24 bp, Homo sapiens
tcaaaatggggagggactagggca

SEQ ID NO: 1559872 - DNA, 14 bp, Homo sapiens
tcaaaatgtctgta

SEQ ID NO: 1559873 - DNA, 21 bp, Homo sapiens
tcaaaatgttatcttctcaag

SEQ ID NO: 1559874 - DNA, 17 bp, Homo sapiens
tcaaaattctagctgta

SEQ ID NO: 1559875 - DNA, 15 bp, Homo sapiens
tcaaaattgcttcta

SEQ ID NO: 1559876 - DNA, 21 bp, Homo sapiens
tcaaacagtctcaggaaatca

SEQ ID NO: 1559877 - DNA, 22 bp, Homo sapiens
tcaaacagtctcaggaaatcaa

SEQ ID NO: 1559878 - DNA, 18 bp, Homo sapiens
tcaaacatggaagatgaa

SEQ ID NO: 1559879 - DNA, 22 bp, Homo sapiens
tcaaacattcgtgagctgggga

SEQ ID NO: 1559880 - DNA, 13 bp, Homo sapiens
tcaaacattttct

SEQ ID NO: 1559881 - DNA, 15 bp, Homo sapiens
tcaaacattttctgg

SEQ ID NO: 1559882 - DNA, 17 bp, Homo sapiens
tcaaaccagtcactttt

SEQ ID NO: 1559883 - DNA, 21 bp, Homo sapiens
tcaaaccctagccttgcttgt

SEQ ID NO: 1559884 - DNA, 16 bp, Homo sapiens
tcaaacctcacatttg

SEQ ID NO: 1559885 - DNA, 19 bp, Homo sapiens
tcaaacctgtttaaatatt

SEQ ID NO: 1559886 - DNA, 18 bp, Homo sapiens
tcaaactacatattgtaa

SEQ ID NO: 1559887 - DNA, 20 bp, Homo sapiens
tcaaactcctgacctcaggt

SEQ ID NO: 1559888 - DNA, 12 bp, Homo sapiens
tcaaactgaaaa

SEQ ID NO: 1559889 - DNA, 17 bp, Homo sapiens
tcaaactgaaattcaga

SEQ ID NO: 1559890 - DNA, 19 bp, Homo sapiens
tcaaactgaatttgttctt

SEQ ID NO: 1559891 - DNA, 20 bp, Homo sapiens
tcaaactgaatttgttctta

SEQ ID NO: 1559892 - DNA, 15 bp, Homo sapiens
tcaaactgaggaatt

SEQ ID NO: 1559893 - DNA, 15 bp, Homo sapiens
tcaaactgctccaag

SEQ ID NO: 1559894 - DNA, 16 bp, Homo sapiens
tcaaactgctccaagt

SEQ ID NO: 1559895 - DNA, 17 bp, Homo sapiens
tcaaactgctgcatact

SEQ ID NO: 1559896 - DNA, 22 bp, Homo sapiens
tcaaactggggcctccagaact

SEQ ID NO: 1559897 - DNA, 16 bp, Homo sapiens
tcaaacttactatttt

SEQ ID NO: 1559898 - DNA, 14 bp, Homo sapiens
tcaaactttcactt

SEQ ID NO: 1559899 - DNA, 12 bp, Homo sapiens
tcaaagaaagtg

SEQ ID NO: 1559900 - DNA, 15 bp, Homo sapiens
tcaaagaaattcaga

SEQ ID NO: 1559901 - DNA, 20 bp, Homo sapiens
tcaaagaaattcagaacagc

SEQ ID NO: 1559902 - DNA, 16 bp, Homo sapiens
tcaaagaagactcagt

SEQ ID NO: 1559903 - DNA, 15 bp, Homo sapiens
tcaaagaagcttcca

SEQ ID NO: 1559904 - DNA, 15 bp, Homo sapiens
tcaaagaaggtgctg

SEQ ID NO: 1559905 - DNA, 15 bp, Homo sapiens
tcaaagaagtcggaa

SEQ ID NO: 1559906 - DNA, 14 bp, Homo sapiens
tcaaagaattacag

SEQ ID NO: 1559907 - DNA, 15 bp, Homo sapiens
tcaaagaattacagt

SEQ ID NO: 1559908 - DNA, 15 bp, Homo sapiens
tcaaagacagaatgg

SEQ ID NO: 1559909 - DNA, 16 bp, Homo sapiens
tcaaagagattcgaat

SEQ ID NO: 1559910 - DNA, 12 bp, Homo sapiens
tcaaagatgctg

SEQ ID NO: 1559911 - DNA, 19 bp, Homo sapiens
tcaaagcaagggctccagc

SEQ ID NO: 1559912 - DNA, 15 bp, Homo sapiens
tcaaagcacaataac

SEQ ID NO: 1559913 - DNA, 19 bp, Homo sapiens
tcaaagcactgttgagaag

SEQ ID NO: 1559914 - DNA, 21 bp, Homo sapiens
tcaaagcagaagtctggcttt

SEQ ID NO: 1559915 - DNA, 18 bp, Homo sapiens
tcaaagcataaaactttg

SEQ ID NO: 1559916 - DNA, 15 bp, Homo sapiens
tcaaagccacattat

SEQ ID NO: 1559917 - DNA, 17 bp, Homo sapiens
tcaaagccacattattt

SEQ ID NO: 1559918 - DNA, 20 bp, Homo sapiens
tcaaagccacattatttcta

SEQ ID NO: 1559919 - DNA, 18 bp, Homo sapiens
tcaaagccctgcctctgt

SEQ ID NO: 1559920 - DNA, 12 bp, Homo sapiens
tcaaagcctggc

SEQ ID NO: 1559921 - DNA, 11 bp, Homo sapiens
tcaaagccttc

SEQ ID NO: 1559922 - DNA, 13 bp, Homo sapiens
tcaaaggagaaaa

SEQ ID NO: 1559923 - DNA, 14 bp, Homo sapiens
tcaaaggagaaaaa

SEQ ID NO: 1559924 - DNA, 20 bp, Homo sapiens
tcaaaggagcgagcatgtcg

SEQ ID NO: 1559925 - DNA, 16 bp, Homo sapiens
tcaaagggagagaaaa

SEQ ID NO: 1559926 - DNA, 17 bp, Homo sapiens
tcaaagggagagaaaag

SEQ ID NO: 1559927 - DNA, 17 bp, Homo sapiens
tcaaaggtgatgtaatt

SEQ ID NO: 1559928 - DNA, 12 bp, Homo sapiens
tcaaaggttcta

SEQ ID NO: 1559929 - DNA, 16 bp, Homo sapiens
tcaaaggttctaggtt

SEQ ID NO: 1559930 - DNA, 20 bp, Homo sapiens
tcaaaggttctaggtttcaa

SEQ ID NO: 1559931 - DNA, 14 bp, Homo sapiens
tcaaagtaaaactt

SEQ ID NO: 1559932 - DNA, 23 bp, Homo sapiens
tcaaagtaaggctggtaagagaa

SEQ ID NO: 1559933 - DNA, 15 bp, Homo sapiens
tcaaagtatgtatgt

SEQ ID NO: 1559934 - DNA, 22 bp, Homo sapiens
tcaaagtgagaaaatgcctcaa

SEQ ID NO: 1559935 - DNA, 17 bp, Homo sapiens
tcaaagtggtaaatact

SEQ ID NO: 1559936 - DNA, 19 bp, Homo sapiens
tcaaagtggtaaatactgt

SEQ ID NO: 1559937 - DNA, 17 bp, Homo sapiens
tcaaagtggtacaggaa

SEQ ID NO: 1559938 - DNA, 18 bp, Homo sapiens
tcaaagtggtacaggaag

SEQ ID NO: 1559939 - DNA, 15 bp, Homo sapiens
tcaaagtgtatattt

SEQ ID NO: 1559940 - DNA, 22 bp, Homo sapiens
tcaaagtgtatatttattcata

SEQ ID NO: 1559941 - DNA, 18 bp, Homo sapiens
tcaaagttgaaaattcat

SEQ ID NO: 1559942 - DNA, 16 bp, Homo sapiens
tcaaataaaatatcat

SEQ ID NO: 1559943 - DNA, 19 bp, Homo sapiens
tcaaataaaatatcataaa

SEQ ID NO: 1559944 - DNA, 12 bp, Homo sapiens
tcaaataagaaa

SEQ ID NO: 1559945 - DNA, 13 bp, Homo sapiens
tcaaataagaaat

SEQ ID NO: 1559946 - DNA, 20 bp, Homo sapiens
tcaaataagtatttataata

SEQ ID NO: 1559947 - DNA, 16 bp, Homo sapiens
tcaaatatgcaaagca

SEQ ID NO: 1559948 - DNA, 19 bp, Homo sapiens
tcaaatatgcaaagcactg

SEQ ID NO: 1559949 - DNA, 14 bp, Homo sapiens
tcaaatattgtaaa

SEQ ID NO: 1559950 - DNA, 11 bp, Homo sapiens
tcaaatatttc

SEQ ID NO: 1559951 - DNA, 23 bp, Homo sapiens
tcaaatatttcttgctgcttcta

SEQ ID NO: 1559952 - DNA, 15 bp, Homo sapiens
tcaaatcagtcagtg

SEQ ID NO: 1559953 - DNA, 14 bp, Homo sapiens
tcaaatccagtggt

SEQ ID NO: 1559954 - DNA, 14 bp, Homo sapiens
tcaacaaagaaaca

SEQ ID NO: 1559955 - DNA, 18 bp, Homo sapiens
tcaacaaatattcactgg

SEQ ID NO: 1559956 - DNA, 21 bp, Homo sapiens
tcaacaacgtgagagaaagag

SEQ ID NO: 1559957 - DNA, 22 bp, Homo sapiens
tcaacaagatttccttgtgcaa

SEQ ID NO: 1559958 - DNA, 17 bp, Homo sapiens
tcaacaataaaattttt

SEQ ID NO: 1559959 - DNA, 18 bp, Homo sapiens
tcaacaatttcaataaaa

SEQ ID NO: 1559960 - DNA, 22 bp, Homo sapiens
tcaacacattggaattgatgtc

SEQ ID NO: 1559961 - DNA, 17 bp, Homo sapiens
tcaacacttattttctg

SEQ ID NO: 1559962 - DNA, 23 bp, Homo sapiens
tcaacagagaggaccaacatcca

SEQ ID NO: 1559963 - DNA, 17 bp, Homo sapiens
tcaacagcaaagcttgg

SEQ ID NO: 1559964 - DNA, 16 bp, Homo sapiens
tcaacagttcaaagaa

SEQ ID NO: 1559965 - DNA, 17 bp, Homo sapiens
tcaacagttcaaagaag

SEQ ID NO: 1559966 - DNA, 15 bp, Homo sapiens
tcaacatcttttaca

SEQ ID NO: 1559967 - DNA, 14 bp, Homo sapiens
tcaacatgtctcct

SEQ ID NO: 1559968 - DNA, 15 bp, Homo sapiens
tcaacatgttactga

SEQ ID NO: 1559969 - DNA, 19 bp, Homo sapiens
tcaacatgttattcaatgt

SEQ ID NO: 1559970 - DNA, 17 bp, Homo sapiens
tcaacatttacatgtat

SEQ ID NO: 1559971 - DNA, 14 bp, Homo sapiens
tcaacatttatgac

SEQ ID NO: 1559972 - DNA, 16 bp, Homo sapiens
tcaacatttatgacct

SEQ ID NO: 1559973 - DNA, 13 bp, Homo sapiens
tcaaccactgtgg

SEQ ID NO: 1559974 - DNA, 15 bp, Homo sapiens
tcaaccactgtggcg

SEQ ID NO: 1559975 - DNA, 22 bp, Homo sapiens
tcaaccaggtccagatgtgcta

SEQ ID NO: 1559976 - DNA, 15 bp, Homo sapiens
tcaaccataaaagaa

SEQ ID NO: 1559977 - DNA, 17 bp, Homo sapiens
tcaaccataaaagaagt

SEQ ID NO: 1559978 - DNA, 18 bp, Homo sapiens
tcaaccatgtcatctttt

SEQ ID NO: 1559979 - DNA, 20 bp, Homo sapiens
tcaaccccaccatatgaatt

SEQ ID NO: 1559980 - DNA, 22 bp, Homo sapiens
tcaaccccaccatatgaattgt

SEQ ID NO: 1559981 - DNA, 13 bp, Homo sapiens
tcaacccccagct

SEQ ID NO: 1559982 - DNA, 14 bp, Homo sapiens
tcaacccccagcta

SEQ ID NO: 1559983 - DNA, 22 bp, Homo sapiens
tcaacccccagctaataaacca

SEQ ID NO: 1559984 - DNA, 23 bp, Homo sapiens
tcaaccggaaggaggccaaccag

SEQ ID NO: 1559985 - DNA, 17 bp, Homo sapiens
tcaacctcttctggctc

SEQ ID NO: 1559986 - DNA, 18 bp, Homo sapiens
tcaacctcttctggctca

SEQ ID NO: 1559987 - DNA, 18 bp, Homo sapiens
tcaacgcagccctgcttt

SEQ ID NO: 1559988 - DNA, 16 bp, Homo sapiens
tcaacgtatgtgtgtt

SEQ ID NO: 1559989 - DNA, 16 bp, Homo sapiens
tcaactaatttttgta

SEQ ID NO: 1559990 - DNA, 16 bp, Homo sapiens
tcaactcacagcttct

SEQ ID NO: 1559991 - DNA, 16 bp, Homo sapiens
tcaactcacctaatgt

SEQ ID NO: 1559992 - DNA, 20 bp, Homo sapiens
tcaactcccaacttcttcct

SEQ ID NO: 1559993 - DNA, 17 bp, Homo sapiens
tcaactctacccctgct

SEQ ID NO: 1559994 - DNA, 16 bp, Homo sapiens
tcaactcttcgaagcc

SEQ ID NO: 1559995 - DNA, 21 bp, Homo sapiens
tcaactgaaggggtgcaccca

SEQ ID NO: 1559996 - DNA, 23 bp, Homo sapiens
tcaactgacctgaccccattcct

SEQ ID NO: 1559997 - DNA, 20 bp, Homo sapiens
tcaactgagggccagggacc

SEQ ID NO: 1559998 - DNA, 18 bp, Homo sapiens
tcaactgcctactccaaa

SEQ ID NO: 1559999 - DNA, 22 bp, Homo sapiens
tcaactgctgttttatgtcata

SEQ ID NO: 1560000 - DNA, 18 bp, Homo sapiens
tcaactgggtccagaaga

SEQ ID NO: 1560001 - DNA, 21 bp, Homo sapiens
tcaactgtaggttatttaaaa

SEQ ID NO: 1560002 - DNA, 22 bp, Homo sapiens
tcaactgtattgggccttttgg

SEQ ID NO: 1560003 - DNA, 15 bp, Homo sapiens
tcaacttaaaagtca

SEQ ID NO: 1560004 - DNA, 13 bp, Homo sapiens
tcaacttaacatg

SEQ ID NO: 1560005 - DNA, 20 bp, Homo sapiens
tcaacttagtcaataagaaa

SEQ ID NO: 1560006 - DNA, 16 bp, Homo sapiens
tcaacttattctttga

SEQ ID NO: 1560007 - DNA, 16 bp, Homo sapiens
tcaactttgtaaaaat

SEQ ID NO: 1560008 - DNA, 13 bp, Homo sapiens
tcaacttttatgc

SEQ ID NO: 1560009 - DNA, 13 bp, Homo sapiens
tcaacttttctaa

SEQ ID NO: 1560010 - DNA, 17 bp, Homo sapiens
tcaagaaaacaacttca

SEQ ID NO: 1560011 - DNA, 17 bp, Homo sapiens
tcaagaaacagccagca

SEQ ID NO: 1560012 - DNA, 22 bp, Homo sapiens
tcaagaaactgaggaattttct

SEQ ID NO: 1560013 - DNA, 11 bp, Homo sapiens
tcaagaaatga

SEQ ID NO: 1560014 - DNA, 20 bp, Homo sapiens
tcaagaacaaacactgcagt

SEQ ID NO: 1560015 - DNA, 14 bp, Homo sapiens
tcaagaagaaaaag

SEQ ID NO: 1560016 - DNA, 19 bp, Homo sapiens
tcaagaagacatggagact

SEQ ID NO: 1560017 - DNA, 14 bp, Homo sapiens
tcaagaagggctgc

SEQ ID NO: 1560018 - DNA, 15 bp, Homo sapiens
tcaagaagggctgca

SEQ ID NO: 1560019 - DNA, 17 bp, Homo sapiens
tcaagaagtaagagcta

SEQ ID NO: 1560020 - DNA, 16 bp, Homo sapiens
tcaagaatcagaagaa

SEQ ID NO: 1560021 - DNA, 18 bp, Homo sapiens
tcaagaatctagaagatg

SEQ ID NO: 1560022 - DNA, 13 bp, Homo sapiens
tcaagacatttgc

SEQ ID NO: 1560023 - DNA, 17 bp, Homo sapiens
tcaagacatttgctgaa

SEQ ID NO: 1560024 - DNA, 15 bp, Homo sapiens
tcaagaccaggctgc

SEQ ID NO: 1560025 - DNA, 12 bp, Homo sapiens
tcaagacctgag

SEQ ID NO: 1560026 - DNA, 16 bp, Homo sapiens
tcaagaccttctcccc

SEQ ID NO: 1560027 - DNA, 17 bp, Homo sapiens
tcaagactgaattccaa

SEQ ID NO: 1560028 - DNA, 21 bp, Homo sapiens
tcaagactttagcttttcctt

SEQ ID NO: 1560029 - DNA, 12 bp, Homo sapiens
tcaagagaaact

SEQ ID NO: 1560030 - DNA, 13 bp, Homo sapiens
tcaagagaaactt

SEQ ID NO: 1560031 - DNA, 16 bp, Homo sapiens
tcaagagatctttctt

SEQ ID NO: 1560032 - DNA, 14 bp, Homo sapiens
tcaagagcctcccc

SEQ ID NO: 1560033 - DNA, 12 bp, Homo sapiens
tcaagaggctga

SEQ ID NO: 1560034 - DNA, 20 bp, Homo sapiens
tcaagagggcactggtggcc

SEQ ID NO: 1560035 - DNA, 21 bp, Homo sapiens
tcaagagggcactggtggccc

SEQ ID NO: 1560036 - DNA, 19 bp, Homo sapiens
tcaagaggtgggagggccc

SEQ ID NO: 1560037 - DNA, 16 bp, Homo sapiens
tcaagatgacagctct

SEQ ID NO: 1560038 - DNA, 13 bp, Homo sapiens
tcaagattttgaa

SEQ ID NO: 1560039 - DNA, 16 bp, Homo sapiens
tcaagattttgaatgc

SEQ ID NO: 1560040 - DNA, 19 bp, Homo sapiens
tcaagattttgaatgcttc

SEQ ID NO: 1560041 - DNA, 12 bp, Homo sapiens
tcaagcaacaag

SEQ ID NO: 1560042 - DNA, 16 bp, Homo sapiens
tcaagcaataattgtt

SEQ ID NO: 1560043 - DNA, 15 bp, Homo sapiens
tgtcctacttctgac

SEQ ID NO: 1560044 - DNA, 17 bp, Homo sapiens
tgtcctacttctgactt

SEQ ID NO: 1560045 - DNA, 18 bp, Homo sapiens
tgtcctacttctgacttt

SEQ ID NO: 1560046 - DNA, 21 bp, Homo sapiens
tgtcctacttctgactttact

SEQ ID NO: 1560047 - DNA, 18 bp, Homo sapiens
tgtcctatggacaactta

SEQ ID NO: 1560048 - DNA, 14 bp, Homo sapiens
tgtcctatgtcaat

SEQ ID NO: 1560049 - DNA, 19 bp, Homo sapiens
tgtcctcagaggcgtgctg

SEQ ID NO: 1560050 - DNA, 12 bp, Homo sapiens
tgtcctcagcct

SEQ ID NO: 1560051 - DNA, 13 bp, Homo sapiens
tgtcctcagcctt

SEQ ID NO: 1560052 - DNA, 16 bp, Homo sapiens
tgtcctcagccttgcc

SEQ ID NO: 1560053 - DNA, 17 bp, Homo sapiens
tgtcctcagccttgcca

SEQ ID NO: 1560054 - DNA, 22 bp, Homo sapiens
tgtcctcagccttgccagagat

SEQ ID NO: 1560055 - DNA, 23 bp, Homo sapiens
tgtcctcagggagcagggaaggc

SEQ ID NO: 1560056 - DNA, 19 bp, Homo sapiens
tgtcctccagaagcctctg

SEQ ID NO: 1560057 - DNA, 22 bp, Homo sapiens
tgtcctccagaagcctctggct

SEQ ID NO: 1560058 - DNA, 23 bp, Homo sapiens
tgtcctccagaagcctctggcta

SEQ ID NO: 1560059 - DNA, 15 bp, Homo sapiens
tgtcctccaggagct

SEQ ID NO: 1560060 - DNA, 11 bp, Homo sapiens
tgtcctcctcg

SEQ ID NO: 1560061 - DNA, 14 bp, Homo sapiens
tgtcctccttttca

SEQ ID NO: 1560062 - DNA, 16 bp, Homo sapiens
tgtcctccttttcact

SEQ ID NO: 1560063 - DNA, 17 bp, Homo sapiens
tgtcctccttttcactt

SEQ ID NO: 1560064 - DNA, 16 bp, Homo sapiens
tgtcctctcagaactc

SEQ ID NO: 1560065 - DNA, 20 bp, Homo sapiens
tgtcctctcagaactcctgt

SEQ ID NO: 1560066 - DNA, 21 bp, Homo sapiens
tgtcctctcagaactcctgtg

SEQ ID NO: 1560067 - DNA, 14 bp, Homo sapiens
tgtcctcttctgct

SEQ ID NO: 1560068 - DNA, 13 bp, Homo sapiens
tgtcctgaagctg

SEQ ID NO: 1560069 - DNA, 16 bp, Homo sapiens
tgtcctgaccaccctc

SEQ ID NO: 1560070 - DNA, 17 bp, Homo sapiens
tgtcctgaccaccctcc

SEQ ID NO: 1560071 - DNA, 15 bp, Homo sapiens
tgtcctgccagctgc

SEQ ID NO: 1560072 - DNA, 16 bp, Homo sapiens
tgtcctgccagctgcc

SEQ ID NO: 1560073 - DNA, 22 bp, Homo sapiens
tgtcctgcctgcaatatttgaa

SEQ ID NO: 1560074 - DNA, 11 bp, Homo sapiens
tgtcctgctca

SEQ ID NO: 1560075 - DNA, 17 bp, Homo sapiens
tgtcctgctcacctgtg

SEQ ID NO: 1560076 - DNA, 14 bp, Homo sapiens
tgtcctgctgccct

SEQ ID NO: 1560077 - DNA, 20 bp, Homo sapiens
tgtcctgctgccctcccaca

SEQ ID NO: 1560078 - DNA, 16 bp, Homo sapiens
tgtcctggcccttcag

SEQ ID NO: 1560079 - DNA, 17 bp, Homo sapiens
tgtcctggcccttcagt

SEQ ID NO: 1560080 - DNA, 17 bp, Homo sapiens
tgtcctgggcctgcccc

SEQ ID NO: 1560081 - DNA, 20 bp, Homo sapiens
tgtcctggtgctctctgcca

SEQ ID NO: 1560082 - DNA, 18 bp, Homo sapiens
tgtcctggtggctgggcc

SEQ ID NO: 1560083 - DNA, 15 bp, Homo sapiens
tgtcctgtaaaggtt

SEQ ID NO: 1560084 - DNA, 11 bp, Homo sapiens
tgtcctgtcct

SEQ ID NO: 1560085 - DNA, 13 bp, Homo sapiens
tgtcctgtcctgg

SEQ ID NO: 1560086 - DNA, 15 bp, Homo sapiens
tgtcctgtcctggtc

SEQ ID NO: 1560087 - DNA, 18 bp, Homo sapiens
tgtcctgtcctggtcctg

SEQ ID NO: 1560088 - DNA, 18 bp, Homo sapiens
tgtccttaacccacctct

SEQ ID NO: 1560089 - DNA, 20 bp, Homo sapiens
tgtccttaacccacctctcc

SEQ ID NO: 1560090 - DNA, 23 bp, Homo sapiens
tgtccttaacccacctctcctgc

SEQ ID NO: 1560091 - DNA, 14 bp, Homo sapiens
tgtccttcagagct

SEQ ID NO: 1560092 - DNA, 16 bp, Homo sapiens
tgtccttccctgccac

SEQ ID NO: 1560093 - DNA, 17 bp, Homo sapiens
tgtccttccctgccact

SEQ ID NO: 1560094 - DNA, 15 bp, Homo sapiens
tgtccttgcaggggc

SEQ ID NO: 1560095 - DNA, 18 bp, Homo sapiens
tgtcctttaaaaaagaaa

SEQ ID NO: 1560096 - DNA, 13 bp, Homo sapiens
tgtcctttccctt

SEQ ID NO: 1560097 - DNA, 23 bp, Homo sapiens
tgtccttttatttctccatcttt

SEQ ID NO: 1560098 - DNA, 17 bp, Homo sapiens
tgtcgaaggggaggcac

SEQ ID NO: 1560099 - DNA, 20 bp, Homo sapiens
tgtcgaaggggaggcacact

SEQ ID NO: 1560100 - DNA, 17 bp, Homo sapiens
tgtcgagagctggccaa

SEQ ID NO: 1560101 - DNA, 23 bp, Homo sapiens
tgtcgaggccacattgctggctg

SEQ ID NO: 1560102 - DNA, 22 bp, Homo sapiens
tgtcgatgtaggcattctggag

SEQ ID NO: 1560103 - DNA, 17 bp, Homo sapiens
tgtcgcccagtgccctg

SEQ ID NO: 1560104 - DNA, 15 bp, Homo sapiens
tgtcgctcatgtgtg

SEQ ID NO: 1560105 - DNA, 18 bp, Homo sapiens
atcatttgttggaatgaa

SEQ ID NO: 1560106 - DNA, 15 bp, Homo sapiens
atcatttgtttaaaa

SEQ ID NO: 1560107 - DNA, 11 bp, Homo sapiens
atcattttcat

SEQ ID NO: 1560108 - DNA, 17 bp, Homo sapiens
atcattttccccccact

SEQ ID NO: 1560109 - DNA, 16 bp, Homo sapiens
atcattttttatatat

SEQ ID NO: 1560110 - DNA, 14 bp, Homo sapiens
atcattttttcctg

SEQ ID NO: 1560111 - DNA, 21 bp, Homo sapiens
atcattttttcctgtttggga

SEQ ID NO: 1560112 - DNA, 20 bp, Homo sapiens
atccaaaaaaagggaaggat

SEQ ID NO: 1560113 - DNA, 18 bp, Homo sapiens
atccaaaagaagccccca

SEQ ID NO: 1560114 - DNA, 16 bp, Homo sapiens
atccaaaatgaatgca

SEQ ID NO: 1560115 - DNA, 15 bp, Homo sapiens
atccaaatctgtcct

SEQ ID NO: 1560116 - DNA, 18 bp, Homo sapiens
atccaaccccccacctgc

SEQ ID NO: 1560117 - DNA, 16 bp, Homo sapiens
atccaactaatgcctt

SEQ ID NO: 1560118 - DNA, 18 bp, Homo sapiens
atccaactaatgccttac

SEQ ID NO: 1560119 - DNA, 20 bp, Homo sapiens
atccaactaatgccttactc

SEQ ID NO: 1560120 - DNA, 15 bp, Homo sapiens
atccaagattctgct

SEQ ID NO: 1560121 - DNA, 18 bp, Homo sapiens
atccaagcctccacagcg

SEQ ID NO: 1560122 - DNA, 21 bp, Homo sapiens
atccaagcctccacagcgagg

SEQ ID NO: 1560123 - DNA, 23 bp, Homo sapiens
atccaagcttttttaaagtaaaa

SEQ ID NO: 1560124 - DNA, 14 bp, Homo sapiens
atccaaggagaaac

SEQ ID NO: 1560125 - DNA, 22 bp, Homo sapiens
atccaaggagaaacagagacag

SEQ ID NO: 1560126 - DNA, 20 bp, Homo sapiens
atccaagtaccaatgctgtt

SEQ ID NO: 1560127 - DNA, 12 bp, Homo sapiens
atccaagtgaac

SEQ ID NO: 1560128 - DNA, 14 bp, Homo sapiens
atccaatattgtaa

SEQ ID NO: 1560129 - DNA, 20 bp, Homo sapiens
atccaatcctcactgggtgg

SEQ ID NO: 1560130 - DNA, 20 bp, Homo sapiens
atccaatgggtttttccctg

SEQ ID NO: 1560131 - DNA, 20 bp, Homo sapiens
atccaattgatgtatatgtt

SEQ ID NO: 1560132 - DNA, 17 bp, Homo sapiens
atccaattttgatcttt

SEQ ID NO: 1560133 - DNA, 20 bp, Homo sapiens
atccaattttgatcttttta

SEQ ID NO: 1560134 - DNA, 20 bp, Homo sapiens
atccacaactaatgagggaa

SEQ ID NO: 1560135 - DNA, 16 bp, Homo sapiens
atccacacacagagga

SEQ ID NO: 1560136 - DNA, 16 bp, Homo sapiens
atccacatgaaaataa

SEQ ID NO: 1560137 - DNA, 19 bp, Homo sapiens
atccacattgttttaaaaa

SEQ ID NO: 1560138 - DNA, 20 bp, Homo sapiens
atccacccaaccctatctcc

SEQ ID NO: 1560139 - DNA, 13 bp, Homo sapiens
atccacccagtgc

SEQ ID NO: 1560140 - DNA, 14 bp, Homo sapiens
atccacccagtgct

SEQ ID NO: 1560141 - DNA, 19 bp, Homo sapiens
atccacccagtgctgccat

SEQ ID NO: 1560142 - DNA, 22 bp, Homo sapiens
atccacccagtgctgccatgcc

SEQ ID NO: 1560143 - DNA, 21 bp, Homo sapiens
atccacctcatcactggactg

SEQ ID NO: 1560144 - DNA, 21 bp, Homo sapiens
atccacctgtctcagcctccc

SEQ ID NO: 1560145 - DNA, 21 bp, Homo sapiens
atccacctgtcttggcctccc

SEQ ID NO: 1560146 - DNA, 12 bp, Homo sapiens
atccagaaaact

SEQ ID NO: 1560147 - DNA, 15 bp, Homo sapiens
atccagaaaactgtg

SEQ ID NO: 1560148 - DNA, 17 bp, Homo sapiens
atccagaaaactgtgat

SEQ ID NO: 1560149 - DNA, 14 bp, Homo sapiens
atccagaaagaaaa

SEQ ID NO: 1560150 - DNA, 15 bp, Homo sapiens
atccagaaatactta

SEQ ID NO: 1560151 - DNA, 23 bp, Homo sapiens
atccagaatttattagtttaaaa

SEQ ID NO: 1560152 - DNA, 16 bp, Homo sapiens
atccagactcagagct

SEQ ID NO: 1560153 - DNA, 21 bp, Homo sapiens
atccagaggaacaagcatgtc

SEQ ID NO: 1560154 - DNA, 22 bp, Homo sapiens
atccagaggcaaacggaggcaa

SEQ ID NO: 1560155 - DNA, 20 bp, Homo sapiens
atccagatacacccaaagta

SEQ ID NO: 1560156 - DNA, 15 bp, Homo sapiens
atccagcaggtcaca

SEQ ID NO: 1560157 - DNA, 11 bp, Homo sapiens
atccagccact

SEQ ID NO: 1560158 - DNA, 14 bp, Homo sapiens
atccagccagaccc

SEQ ID NO: 1560159 - DNA, 13 bp, Homo sapiens
atccagcctccag

SEQ ID NO: 1560160 - DNA, 14 bp, Homo sapiens
atccagcctccagg

SEQ ID NO: 1560161 - DNA, 16 bp, Homo sapiens
atccagcctccagggc

SEQ ID NO: 1560162 - DNA, 20 bp, Homo sapiens
atccagcctgtgtgttctgt

SEQ ID NO: 1560163 - DNA, 13 bp, Homo sapiens
atccagccttgga

SEQ ID NO: 1560164 - DNA, 17 bp, Homo sapiens
atccagcctttccaagt

SEQ ID NO: 1560165 - DNA, 22 bp, Homo sapiens
atccagcgagagagtttcaaaa

SEQ ID NO: 1560166 - DNA, 22 bp, Homo sapiens
atccaggactatatttgggcct

SEQ ID NO: 1560167 - DNA, 23 bp, Homo sapiens
atccaggactatatttgggcctg

SEQ ID NO: 1560168 - DNA, 15 bp, Homo sapiens
atccaggcaccagga

SEQ ID NO: 1560169 - DNA, 16 bp, Homo sapiens
atccaggcaccaggac

SEQ ID NO: 1560170 - DNA, 14 bp, Homo sapiens
atccaggcagatcc

SEQ ID NO: 1560171 - DNA, 12 bp, Homo sapiens
atccaggccact

SEQ ID NO: 1560172 - DNA, 16 bp, Homo sapiens
atccagggacagaggc

SEQ ID NO: 1560173 - DNA, 19 bp, Homo sapiens
atccagggacagaggcccc

SEQ ID NO: 1560174 - DNA, 20 bp, Homo sapiens
atccagggacagaggcccca

SEQ ID NO: 1560175 - DNA, 18 bp, Homo sapiens
atccaggtcttgactcat

SEQ ID NO: 1560176 - DNA, 15 bp, Homo sapiens
atccaggttccctcc

SEQ ID NO: 1560177 - DNA, 17 bp, Homo sapiens
atccagtgacctctctc

SEQ ID NO: 1560178 - DNA, 22 bp, Homo sapiens
atccagtgacctctctctctgg

SEQ ID NO: 1560179 - DNA, 21 bp, Homo sapiens
atccagtgatccttacaagtt

SEQ ID NO: 1560180 - DNA, 12 bp, Homo sapiens
atccagtggtgg

SEQ ID NO: 1560181 - DNA, 17 bp, Homo sapiens
atccagtggtgggtaat

SEQ ID NO: 1560182 - DNA, 13 bp, Homo sapiens
atccagttgcagg

SEQ ID NO: 1560183 - DNA, 14 bp, Homo sapiens
atccagttgcaggt

SEQ ID NO: 1560184 - DNA, 14 bp, Homo sapiens
atccagtttctttc

SEQ ID NO: 1560185 - DNA, 20 bp, Homo sapiens
atccagtttgtgtttttcta

SEQ ID NO: 1560186 - DNA, 18 bp, Homo sapiens
atccataaactaagagaa

SEQ ID NO: 1560187 - DNA, 14 bp, Homo sapiens
atccataaagacaa

SEQ ID NO: 1560188 - DNA, 11 bp, Homo sapiens
atccatacaaa

SEQ ID NO: 1560189 - DNA, 19 bp, Homo sapiens
atccataggactaccgcag

SEQ ID NO: 1560190 - DNA, 16 bp, Homo sapiens
atccatagtgactttt

SEQ ID NO: 1560191 - DNA, 18 bp, Homo sapiens
atccatcttgagccacag

SEQ ID NO: 1560192 - DNA, 20 bp, Homo sapiens
atccatgacctagttttcca

SEQ ID NO: 1560193 - DNA, 20 bp, Homo sapiens
atccatggggctgattgtat

SEQ ID NO: 1560194 - DNA, 12 bp, Homo sapiens
ccacagcagttg

SEQ ID NO: 1560195 - DNA, 23 bp, Homo sapiens
ccacagcagttgaaaagactcca

SEQ ID NO: 1560196 - DNA, 22 bp, Homo sapiens
ccacagccagcacctggcatcg

SEQ ID NO: 1560197 - DNA, 13 bp, Homo sapiens
ccacagccataga

SEQ ID NO: 1560198 - DNA, 15 bp, Homo sapiens
ccacagcccagccac

SEQ ID NO: 1560199 - DNA, 18 bp, Homo sapiens
ccacagcccagccacgga

SEQ ID NO: 1560200 - DNA, 19 bp, Homo sapiens
ccacagccccaacctccca

SEQ ID NO: 1560201 - DNA, 12 bp, Homo sapiens
ccacagccgcag

SEQ ID NO: 1560202 - DNA, 15 bp, Homo sapiens
ccacagccgcagcct

SEQ ID NO: 1560203 - DNA, 13 bp, Homo sapiens
ccacagcctcctt

SEQ ID NO: 1560204 - DNA, 20 bp, Homo sapiens
ccacagcctccttctgtttg

SEQ ID NO: 1560205 - DNA, 15 bp, Homo sapiens
ccacagcggaggaga

SEQ ID NO: 1560206 - DNA, 19 bp, Homo sapiens
ccacagcggaggagaccag

SEQ ID NO: 1560207 - DNA, 15 bp, Homo sapiens
ccacagcgtccctgg

SEQ ID NO: 1560208 - DNA, 16 bp, Homo sapiens
ccacagcgtccctggc

SEQ ID NO: 1560209 - DNA, 21 bp, Homo sapiens
ccacagcgtccctggcgcagg

SEQ ID NO: 1560210 - DNA, 17 bp, Homo sapiens
ccacagcgtgggaactc

SEQ ID NO: 1560211 - DNA, 16 bp, Homo sapiens
ccacagctcagctgcc

SEQ ID NO: 1560212 - DNA, 13 bp, Homo sapiens
ccacagctcccac

SEQ ID NO: 1560213 - DNA, 17 bp, Homo sapiens
ccacagctcccacccca

SEQ ID NO: 1560214 - DNA, 20 bp, Homo sapiens
ccacagctgcagctgatcca

SEQ ID NO: 1560215 - DNA, 13 bp, Homo sapiens
ccacagctgctgg

SEQ ID NO: 1560216 - DNA, 14 bp, Homo sapiens
ccacagctgctggc

SEQ ID NO: 1560217 - DNA, 19 bp, Homo sapiens
ccacagctgctggccaggg

SEQ ID NO: 1560218 - DNA, 19 bp, Homo sapiens
ccacagctgggcagggtga

SEQ ID NO: 1560219 - DNA, 13 bp, Homo sapiens
ccacagcttttgc

SEQ ID NO: 1560220 - DNA, 18 bp, Homo sapiens
ccacaggaagctcagcct

SEQ ID NO: 1560221 - DNA, 22 bp, Homo sapiens
ccacaggaagctcagccttctc

SEQ ID NO: 1560222 - DNA, 18 bp, Homo sapiens
ccacaggagggccagcgc

SEQ ID NO: 1560223 - DNA, 15 bp, Homo sapiens
ccacaggcataagct

SEQ ID NO: 1560224 - DNA, 21 bp, Homo sapiens
ccacaggccccccgcagcacc

SEQ ID NO: 1560225 - DNA, 23 bp, Homo sapiens
ccacaggccccccgcagcaccct

SEQ ID NO: 1560226 - DNA, 11 bp, Homo sapiens
ccacaggcctg

SEQ ID NO: 1560227 - DNA, 14 bp, Homo sapiens
ccacagggaccagg

SEQ ID NO: 1560228 - DNA, 17 bp, Homo sapiens
ccacagggaccagggcc

SEQ ID NO: 1560229 - DNA, 23 bp, Homo sapiens
ccacagggaccagggccaccgca

SEQ ID NO: 1560230 - DNA, 17 bp, Homo sapiens
ccacagggctaagagct

SEQ ID NO: 1560231 - DNA, 15 bp, Homo sapiens
ccacaggggcaggcc

SEQ ID NO: 1560232 - DNA, 22 bp, Homo sapiens
ccacaggggcaggcctgggacc

SEQ ID NO: 1560233 - DNA, 21 bp, Homo sapiens
ccacaggtcatcagatgcctg

SEQ ID NO: 1560234 - DNA, 14 bp, Homo sapiens
ccacagtgctgctt

SEQ ID NO: 1560235 - DNA, 19 bp, Homo sapiens
ccacagtgtcactggtcag

SEQ ID NO: 1560236 - DNA, 23 bp, Homo sapiens
ccacagtgttgtgccccttcact

SEQ ID NO: 1560237 - DNA, 19 bp, Homo sapiens
ccacataaaagccccagct

SEQ ID NO: 1560238 - DNA, 21 bp, Homo sapiens
ccacataaaagccccagcttg

SEQ ID NO: 1560239 - DNA, 24 bp, Homo sapiens
ccacataaaagccccagcttggct

SEQ ID NO: 1560240 - DNA, 23 bp, Homo sapiens
ccacataccaggcaacctcccat

SEQ ID NO: 1560241 - DNA, 22 bp, Homo sapiens
ccacatagcatgcttcctttct

SEQ ID NO: 1560242 - DNA, 13 bp, Homo sapiens
ccacatcccaggc

SEQ ID NO: 1560243 - DNA, 15 bp, Homo sapiens
ccacatccccagagc

SEQ ID NO: 1560244 - DNA, 19 bp, Homo sapiens
ccacatctgcatcactcat

SEQ ID NO: 1560245 - DNA, 15 bp, Homo sapiens
ccacatgacctccat

SEQ ID NO: 1560246 - DNA, 22 bp, Homo sapiens
ccacatgaggccatctcaggag

SEQ ID NO: 1560247 - DNA, 13 bp, Homo sapiens
ccacatgccccag

SEQ ID NO: 1560248 - DNA, 15 bp, Homo sapiens
ccacatggagccccc

SEQ ID NO: 1560249 - DNA, 20 bp, Homo sapiens
ccacatgtacagacatacat

SEQ ID NO: 1560250 - DNA, 15 bp, Homo sapiens
ccacatgtgacacat

SEQ ID NO: 1560251 - DNA, 21 bp, Homo sapiens
ccacatgttctaggtttcagc

SEQ ID NO: 1560252 - DNA, 13 bp, Homo sapiens
ccacattgctggc

SEQ ID NO: 1560253 - DNA, 14 bp, Homo sapiens
ccacattgctggct

SEQ ID NO: 1560254 - DNA, 15 bp, Homo sapiens
ccacattgctggctg

SEQ ID NO: 1560255 - DNA, 14 bp, Homo sapiens
ccacatttctaaaa

SEQ ID NO: 1560256 - DNA, 16 bp, Homo sapiens
ccacatttgggctcag

SEQ ID NO: 1560257 - DNA, 16 bp, Homo sapiens
ccacatttgtcacaga

SEQ ID NO: 1560258 - DNA, 14 bp, Homo sapiens
ccaccaaagctgcc

SEQ ID NO: 1560259 - DNA, 19 bp, Homo sapiens
ccaccaaagctgcccactg

SEQ ID NO: 1560260 - DNA, 13 bp, Homo sapiens
ccaccaacactgc

SEQ ID NO: 1560261 - DNA, 19 bp, Homo sapiens
ccaccaacataaaacaaaa

SEQ ID NO: 1560262 - DNA, 15 bp, Homo sapiens
ccaccaacatcccat

SEQ ID NO: 1560263 - DNA, 12 bp, Homo sapiens
ccaccaactctg

SEQ ID NO: 1560264 - DNA, 17 bp, Homo sapiens
ccaccaactctgcactc

SEQ ID NO: 1560265 - DNA, 17 bp, Homo sapiens
ccaccaagacttgtttt

SEQ ID NO: 1560266 - DNA, 23 bp, Homo sapiens
ccaccaagggtatctgctgcctc

SEQ ID NO: 1560267 - DNA, 21 bp, Homo sapiens
ccaccacagccagcacctggc

SEQ ID NO: 1560268 - DNA, 14 bp, Homo sapiens
ccaccaccactggc

SEQ ID NO: 1560269 - DNA, 16 bp, Homo sapiens
ccaccaccactggcca

SEQ ID NO: 1560270 - DNA, 15 bp, Homo sapiens
ccaccaccagtgaga

SEQ ID NO: 1560271 - DNA, 11 bp, Homo sapiens
ccaccacccaa

SEQ ID NO: 1560272 - DNA, 13 bp, Homo sapiens
ccaccacccaacc

SEQ ID NO: 1560273 - DNA, 21 bp, Homo sapiens
ccaccaccctgccccccctaa

SEQ ID NO: 1560274 - DNA, 19 bp, Homo sapiens
ccaccacgatgtggccctg

SEQ ID NO: 1560275 - DNA, 15 bp, Homo sapiens
ccaccacgtctgcca

SEQ ID NO: 1560276 - DNA, 21 bp, Homo sapiens
ccaccacgtctgccaggccca

SEQ ID NO: 1560277 - DNA, 22 bp, Homo sapiens
ccaccacgtctggctccctgcc

SEQ ID NO: 1560278 - DNA, 17 bp, Homo sapiens
ccaccactgcctgactg

SEQ ID NO: 1560279 - DNA, 15 bp, Homo sapiens
ccaccactggccacc

SEQ ID NO: 1560280 - DNA, 19 bp, Homo sapiens
ccaccactggccaccaggc

SEQ ID NO: 1560281 - DNA, 20 bp, Homo sapiens
ccaccactggccaccaggct

SEQ ID NO: 1560282 - DNA, 15 bp, Homo sapiens
ccaccagagccggga

SEQ ID NO: 1560283 - DNA, 19 bp, Homo sapiens
ccaccagcaggcaggtgga

SEQ ID NO: 1560284 - DNA, 22 bp, Homo sapiens
ccaccagcaggcaggtggactg

SEQ ID NO: 1560285 - DNA, 23 bp, Homo sapiens
ccaccagcctgctgacagacact

SEQ ID NO: 1560286 - DNA, 14 bp, Homo sapiens
ccaccaggagaacc

SEQ ID NO: 1560287 - DNA, 12 bp, Homo sapiens
ccaccaggagca

SEQ ID NO: 1560288 - DNA, 17 bp, Homo sapiens
ccaccaggagcagcagc

SEQ ID NO: 1560289 - DNA, 15 bp, Homo sapiens
tcacgccctcttgtt

SEQ ID NO: 1560290 - DNA, 20 bp, Homo sapiens
tcacgccgtaattctttctg

SEQ ID NO: 1560291 - DNA, 21 bp, Homo sapiens
tcacgcctgtaatcccagcac

SEQ ID NO: 1560292 - DNA, 16 bp, Homo sapiens
tcacgctcatgtcctg

SEQ ID NO: 1560293 - DNA, 17 bp, Homo sapiens
tcacgctcatgtcctgt

SEQ ID NO: 1560294 - DNA, 21 bp, Homo sapiens
tcacgctcccccgcagtcccc

SEQ ID NO: 1560295 - DNA, 16 bp, Homo sapiens
tcacgctttcctgaat

SEQ ID NO: 1560296 - DNA, 19 bp, Homo sapiens
tcacggctgcgcactgtgt

SEQ ID NO: 1560297 - DNA, 17 bp, Homo sapiens
tcacgtaagatacaagt

SEQ ID NO: 1560298 - DNA, 21 bp, Homo sapiens
tcacgtacaaaactctgtata

SEQ ID NO: 1560299 - DNA, 13 bp, Homo sapiens
tcacgtaccccac

SEQ ID NO: 1560300 - DNA, 18 bp, Homo sapiens
tcacgtatttcacagagc

SEQ ID NO: 1560301 - DNA, 20 bp, Homo sapiens
tcacgtatttcacagagcac

SEQ ID NO: 1560302 - DNA, 13 bp, Homo sapiens
tcacgtcacactt

SEQ ID NO: 1560303 - DNA, 20 bp, Homo sapiens
tcacgtgcaggacagctctt

SEQ ID NO: 1560304 - DNA, 23 bp, Homo sapiens
tcacgtgcaggacagctcttgat

SEQ ID NO: 1560305 - DNA, 22 bp, Homo sapiens
tcactaaagcatgaaatgtgaa

SEQ ID NO: 1560306 - DNA, 14 bp, Homo sapiens
tcactaaatgtaaa

SEQ ID NO: 1560307 - DNA, 17 bp, Homo sapiens
tcactaacagggagaag

SEQ ID NO: 1560308 - DNA, 23 bp, Homo sapiens
tcactaattggtacttttaaaaa

SEQ ID NO: 1560309 - DNA, 18 bp, Homo sapiens
tcactacaagtcagctcc

SEQ ID NO: 1560310 - DNA, 13 bp, Homo sapiens
tcactaccctgat

SEQ ID NO: 1560311 - DNA, 17 bp, Homo sapiens
tcactaccttcatgcat

SEQ ID NO: 1560312 - DNA, 22 bp, Homo sapiens
tcactactcacagtctctttaa

SEQ ID NO: 1560313 - DNA, 17 bp, Homo sapiens
tcactactcgagcccac

SEQ ID NO: 1560314 - DNA, 20 bp, Homo sapiens
tcactactcgagcccaccca

SEQ ID NO: 1560315 - DNA, 21 bp, Homo sapiens
tcactacttgaccattctcac

SEQ ID NO: 1560316 - DNA, 16 bp, Homo sapiens
tcactagaaaatgaga

SEQ ID NO: 1560317 - DNA, 14 bp, Homo sapiens
tcactagcagctgc

SEQ ID NO: 1560318 - DNA, 16 bp, Homo sapiens
tcactagcagctgcag

SEQ ID NO: 1560319 - DNA, 16 bp, Homo sapiens
tcactatctttctgat

SEQ ID NO: 1560320 - DNA, 22 bp, Homo sapiens
tcactatgaatctattatactg

SEQ ID NO: 1560321 - DNA, 13 bp, Homo sapiens
tcactatttcctt

SEQ ID NO: 1560322 - DNA, 15 bp, Homo sapiens
tcactatttccttta

SEQ ID NO: 1560323 - DNA, 17 bp, Homo sapiens
tcactatttcctttata

SEQ ID NO: 1560324 - DNA, 18 bp, Homo sapiens
tcactatttcctttataa

SEQ ID NO: 1560325 - DNA, 20 bp, Homo sapiens
tcactatttttatttatatt

SEQ ID NO: 1560326 - DNA, 18 bp, Homo sapiens
tcactcaagaccaggctg

SEQ ID NO: 1560327 - DNA, 19 bp, Homo sapiens
tcactcaagaccaggctgc

SEQ ID NO: 1560328 - DNA, 18 bp, Homo sapiens
tcactcacactggccaca

SEQ ID NO: 1560329 - DNA, 14 bp, Homo sapiens
tcactcacagagtc

SEQ ID NO: 1560330 - DNA, 13 bp, Homo sapiens
tcactcacatagc

SEQ ID NO: 1560331 - DNA, 21 bp, Homo sapiens
tcactcaccactaccagccag

SEQ ID NO: 1560332 - DNA, 17 bp, Homo sapiens
tcactcactcactcatt

SEQ ID NO: 1560333 - DNA, 19 bp, Homo sapiens
tcactcagccaccctgagt

SEQ ID NO: 1560334 - DNA, 20 bp, Homo sapiens
tcactcagccaccctgagtt

SEQ ID NO: 1560335 - DNA, 22 bp, Homo sapiens
tcactcatggaacactcatgtc

SEQ ID NO: 1560336 - DNA, 13 bp, Homo sapiens
tcactccacagag

SEQ ID NO: 1560337 - DNA, 14 bp, Homo sapiens
tcactccacagagt

SEQ ID NO: 1560338 - DNA, 13 bp, Homo sapiens
tcactccaccacc

SEQ ID NO: 1560339 - DNA, 14 bp, Homo sapiens
tcactccaccaccc

SEQ ID NO: 1560340 - DNA, 17 bp, Homo sapiens
tcactccaccatcccca

SEQ ID NO: 1560341 - DNA, 12 bp, Homo sapiens
tcactccagtgc

SEQ ID NO: 1560342 - DNA, 17 bp, Homo sapiens
tcactccagtgctcagc

SEQ ID NO: 1560343 - DNA, 18 bp, Homo sapiens
tcactccagtgctcagct

SEQ ID NO: 1560344 - DNA, 11 bp, Homo sapiens
tcactccccag

SEQ ID NO: 1560345 - DNA, 17 bp, Homo sapiens
tcactccccagggagct

SEQ ID NO: 1560346 - DNA, 19 bp, Homo sapiens
tcactccccagggagctct

SEQ ID NO: 1560347 - DNA, 14 bp, Homo sapiens
tcactccctctgca

SEQ ID NO: 1560348 - DNA, 20 bp, Homo sapiens
tcactccctctgcagaatcc

SEQ ID NO: 1560349 - DNA, 17 bp, Homo sapiens
tcactccctctgccttc

SEQ ID NO: 1560350 - DNA, 14 bp, Homo sapiens
tcactccggtgtgc

SEQ ID NO: 1560351 - DNA, 20 bp, Homo sapiens
tcactctacttagcatgtcc

SEQ ID NO: 1560352 - DNA, 14 bp, Homo sapiens
tcactctccattag

SEQ ID NO: 1560353 - DNA, 14 bp, Homo sapiens
tcactctctattgt

SEQ ID NO: 1560354 - DNA, 14 bp, Homo sapiens
tcactctctgctgg

SEQ ID NO: 1560355 - DNA, 18 bp, Homo sapiens
tcactctctgctggcagg

SEQ ID NO: 1560356 - DNA, 20 bp, Homo sapiens
tcactctgccctctgctgct

SEQ ID NO: 1560357 - DNA, 12 bp, Homo sapiens
tcactctgggct

SEQ ID NO: 1560358 - DNA, 17 bp, Homo sapiens
tcactcttccagaatcc

SEQ ID NO: 1560359 - DNA, 13 bp, Homo sapiens
tcactgaacaaaa

SEQ ID NO: 1560360 - DNA, 16 bp, Homo sapiens
tcactgaaccactgct

SEQ ID NO: 1560361 - DNA, 21 bp, Homo sapiens
tcactgaaccactgcttctct

SEQ ID NO: 1560362 - DNA, 22 bp, Homo sapiens
tcactgaaccactgcttctctt

SEQ ID NO: 1560363 - DNA, 15 bp, Homo sapiens
tcactgaactccacc

SEQ ID NO: 1560364 - DNA, 17 bp, Homo sapiens
tcactgaactccaccga

SEQ ID NO: 1560365 - DNA, 19 bp, Homo sapiens
tcactgacacaaaaagtag

SEQ ID NO: 1560366 - DNA, 17 bp, Homo sapiens
tcactgagaggcctgga

SEQ ID NO: 1560367 - DNA, 22 bp, Homo sapiens
tcactgagcatcactagtgaca

SEQ ID NO: 1560368 - DNA, 14 bp, Homo sapiens
tcactgatgtacaa

SEQ ID NO: 1560369 - DNA, 18 bp, Homo sapiens
tcactgcaacctccacct

SEQ ID NO: 1560370 - DNA, 18 bp, Homo sapiens
tcactgcaacctctgcct

SEQ ID NO: 1560371 - DNA, 18 bp, Homo sapiens
tcactgcaattttgtgta

SEQ ID NO: 1560372 - DNA, 20 bp, Homo sapiens
tcactgcacagtgcatctca

SEQ ID NO: 1560373 - DNA, 11 bp, Homo sapiens
tcactgccagg

SEQ ID NO: 1560374 - DNA, 11 bp, Homo sapiens
tcactgccatg

SEQ ID NO: 1560375 - DNA, 19 bp, Homo sapiens
tcactgcctctccctggcc

SEQ ID NO: 1560376 - DNA, 21 bp, Homo sapiens
tcactgcctctccctggccct

SEQ ID NO: 1560377 - DNA, 22 bp, Homo sapiens
tcactgcctgcagaggtctgtg

SEQ ID NO: 1560378 - DNA, 17 bp, Homo sapiens
tcactgctagagacgct

SEQ ID NO: 1560379 - DNA, 14 bp, Homo sapiens
tcactgctgctgcc

SEQ ID NO: 1560380 - DNA, 13 bp, Homo sapiens
tcactgctggctg

SEQ ID NO: 1560381 - DNA, 14 bp, Homo sapiens
tcactgctggctgc

SEQ ID NO: 1560382 - DNA, 15 bp, Homo sapiens
tcactgctggctgcc

SEQ ID NO: 1560383 - DNA, 17 bp, Homo sapiens
tcactgctggctgcctt

SEQ ID NO: 1560384 - DNA, 16 bp, Homo sapiens
tcactggactgcatgg

SEQ ID NO: 1560385 - DNA, 17 bp, Homo sapiens
tcactggactgcatggg

SEQ ID NO: 1560386 - DNA, 17 bp, Homo sapiens
tcactggagcaccaggc

SEQ ID NO: 1560387 - DNA, 12 bp, Homo sapiens
tcactggagccc

SEQ ID NO: 1560388 - DNA, 19 bp, Homo sapiens
tcactggaggagcagcttc

SEQ ID NO: 1560389 - DNA, 21 bp, Homo sapiens
tcactggagttacattaatgt

SEQ ID NO: 1560390 - DNA, 21 bp, Homo sapiens
tcactggattataagttctat

SEQ ID NO: 1560391 - DNA, 18 bp, Homo sapiens
tcactggcaggtgtggga

SEQ ID NO: 1560392 - DNA, 14 bp, Homo sapiens
tcactggcgccttc

SEQ ID NO: 1560393 - DNA, 11 bp, Homo sapiens
tcactggctct

SEQ ID NO: 1560394 - DNA, 19 bp, Homo sapiens
tcactggctctccaagtgc

SEQ ID NO: 1560395 - DNA, 20 bp, Homo sapiens
tcactggctctccaagtgcc

SEQ ID NO: 1560396 - DNA, 14 bp, Homo sapiens
tcactgggaagaag

SEQ ID NO: 1560397 - DNA, 21 bp, Homo sapiens
tcactggggtcctggggcctc

SEQ ID NO: 1560398 - DNA, 18 bp, Homo sapiens
tcactgggtggggtgagg

SEQ ID NO: 1560399 - DNA, 20 bp, Homo sapiens
tcactggtagaccaaaataa

SEQ ID NO: 1560400 - DNA, 13 bp, Homo sapiens
tcactgtactgca

SEQ ID NO: 1560401 - DNA, 18 bp, Homo sapiens
tcactgtatagacatgct

SEQ ID NO: 1560402 - DNA, 12 bp, Homo sapiens
tcactgtatata

SEQ ID NO: 1560403 - DNA, 14 bp, Homo sapiens
tcactgtcactgcc

SEQ ID NO: 1560404 - DNA, 16 bp, Homo sapiens
tcactgtcactgccga

SEQ ID NO: 1560405 - DNA, 20 bp, Homo sapiens
tcactgtcaggaagaaatca

SEQ ID NO: 1560406 - DNA, 19 bp, Homo sapiens
ccaccaggagcagcagcca

SEQ ID NO: 1560407 - DNA, 23 bp, Homo sapiens
ccaccaggctggcgcagccaagg

SEQ ID NO: 1560408 - DNA, 16 bp, Homo sapiens
ccaccaggggaaggaa

SEQ ID NO: 1560409 - DNA, 19 bp, Homo sapiens
ccaccaggggaaggaagga

SEQ ID NO: 1560410 - DNA, 22 bp, Homo sapiens
ccaccagtcagggacagcagcc

SEQ ID NO: 1560411 - DNA, 13 bp, Homo sapiens
ccaccagtgcctt

SEQ ID NO: 1560412 - DNA, 17 bp, Homo sapiens
ccaccatatgaattgta

SEQ ID NO: 1560413 - DNA, 19 bp, Homo sapiens
ccaccatatgaattgtaca

SEQ ID NO: 1560414 - DNA, 20 bp, Homo sapiens
ccaccatatgaattgtacag

SEQ ID NO: 1560415 - DNA, 21 bp, Homo sapiens
ccaccatcaccaccgcctctg

SEQ ID NO: 1560416 - DNA, 14 bp, Homo sapiens
ccaccatcctgcag

SEQ ID NO: 1560417 - DNA, 16 bp, Homo sapiens
ccaccatgcctcacta

SEQ ID NO: 1560418 - DNA, 12 bp, Homo sapiens
ccaccattcctg

SEQ ID NO: 1560419 - DNA, 13 bp, Homo sapiens
ccacccaacccta

SEQ ID NO: 1560420 - DNA, 21 bp, Homo sapiens
ccacccaaccctatctcctga

SEQ ID NO: 1560421 - DNA, 15 bp, Homo sapiens
ccacccaagcctgct

SEQ ID NO: 1560422 - DNA, 15 bp, Homo sapiens
ccacccacacagctg

SEQ ID NO: 1560423 - DNA, 17 bp, Homo sapiens
ccacccacagccataga

SEQ ID NO: 1560424 - DNA, 15 bp, Homo sapiens
ccacccaccagggcg

SEQ ID NO: 1560425 - DNA, 13 bp, Homo sapiens
tcacttctgtctc

SEQ ID NO: 1560426 - DNA, 17 bp, Homo sapiens
tcacttctgtctcctgt

SEQ ID NO: 1560427 - DNA, 13 bp, Homo sapiens
tcacttgaatgtg

SEQ ID NO: 1560428 - DNA, 18 bp, Homo sapiens
tcacttgatgtttcctgg

SEQ ID NO: 1560429 - DNA, 16 bp, Homo sapiens
tcacttgccatgcagg

SEQ ID NO: 1560430 - DNA, 23 bp, Homo sapiens
tcacttggctgtctgaccagaga

SEQ ID NO: 1560431 - DNA, 11 bp, Homo sapiens
tcacttgtatt

SEQ ID NO: 1560432 - DNA, 23 bp, Homo sapiens
tcacttgttgttttactaaagaa

SEQ ID NO: 1560433 - DNA, 17 bp, Homo sapiens
tcactttacctgcaggc

SEQ ID NO: 1560434 - DNA, 17 bp, Homo sapiens
tcactttagatgctgat

SEQ ID NO: 1560435 - DNA, 21 bp, Homo sapiens
tcactttcccttgtgtcaaga

SEQ ID NO: 1560436 - DNA, 14 bp, Homo sapiens
tcactttctcagtt

SEQ ID NO: 1560437 - DNA, 11 bp, Homo sapiens
tcactttgaaa

SEQ ID NO: 1560438 - DNA, 18 bp, Homo sapiens
tcactttgacacccaggc

SEQ ID NO: 1560439 - DNA, 13 bp, Homo sapiens
tcactttgtctaa

SEQ ID NO: 1560440 - DNA, 19 bp, Homo sapiens
tcactttgtctaactcaga

SEQ ID NO: 1560441 - DNA, 14 bp, Homo sapiens
tcacttttcatcct

SEQ ID NO: 1560442 - DNA, 19 bp, Homo sapiens
tcacttttcatccttcccc

SEQ ID NO: 1560443 - DNA, 13 bp, Homo sapiens
tcacttttcctcc

SEQ ID NO: 1560444 - DNA, 13 bp, Homo sapiens
tcacttttctgag

SEQ ID NO: 1560445 - DNA, 18 bp, Homo sapiens
tcacttttctgagttctt

SEQ ID NO: 1560446 - DNA, 14 bp, Homo sapiens
tcactttttctgat

SEQ ID NO: 1560447 - DNA, 16 bp, Homo sapiens
tcactttttctgataa

SEQ ID NO: 1560448 - DNA, 13 bp, Homo sapiens
tcactttttttct

SEQ ID NO: 1560449 - DNA, 18 bp, Homo sapiens
tcagaaaagagccacttt

SEQ ID NO: 1560450 - DNA, 12 bp, Homo sapiens
tcagaaaataaa

SEQ ID NO: 1560451 - DNA, 18 bp, Homo sapiens
tcagaaaatgaaaaatct

SEQ ID NO: 1560452 - DNA, 22 bp, Homo sapiens
tcagaaaccagttatgtgaatg

SEQ ID NO: 1560453 - DNA, 21 bp, Homo sapiens
tcagaaaccctcattgtgttt

SEQ ID NO: 1560454 - DNA, 22 bp, Homo sapiens
tcagaaacgagatcgggaagca

SEQ ID NO: 1560455 - DNA, 24 bp, Homo sapiens
tcagaaacgagatcgggaagcaga

SEQ ID NO: 1560456 - DNA, 13 bp, Homo sapiens
tcagaaagacttg

SEQ ID NO: 1560457 - DNA, 13 bp, Homo sapiens
tcagaaagagctc

SEQ ID NO: 1560458 - DNA, 16 bp, Homo sapiens
tcagaaagctttattt

SEQ ID NO: 1560459 - DNA, 13 bp, Homo sapiens
tcagaaaggattt

SEQ ID NO: 1560460 - DNA, 20 bp, Homo sapiens
tcagaaataataacctgtta

SEQ ID NO: 1560461 - DNA, 22 bp, Homo sapiens
tcagaaatacagataaatgatt

SEQ ID NO: 1560462 - DNA, 15 bp, Homo sapiens
tcagaaatagatttc

SEQ ID NO: 1560463 - DNA, 12 bp, Homo sapiens
tcagaaatatgt

SEQ ID NO: 1560464 - DNA, 14 bp, Homo sapiens
tcagaaatgctgcc

SEQ ID NO: 1560465 - DNA, 16 bp, Homo sapiens
tcagaaatgctgcctg

SEQ ID NO: 1560466 - DNA, 19 bp, Homo sapiens
tcagaaatgctgcctgcct

SEQ ID NO: 1560467 - DNA, 21 bp, Homo sapiens
tcagaaattggaacagaatgt

SEQ ID NO: 1560468 - DNA, 10 bp, Homo sapiens
tcagaacata

SEQ ID NO: 1560469 - DNA, 20 bp, Homo sapiens
tcagaacatactgattggga

SEQ ID NO: 1560470 - DNA, 19 bp, Homo sapiens
tcagaacattcagctctgg

SEQ ID NO: 1560471 - DNA, 22 bp, Homo sapiens
tcagaacattcagctctggaga

SEQ ID NO: 1560472 - DNA, 23 bp, Homo sapiens
tcagaacattcagctctggagaa

SEQ ID NO: 1560473 - DNA, 21 bp, Homo sapiens
tcagaaccaaatctttcccct

SEQ ID NO: 1560474 - DNA, 16 bp, Homo sapiens
tcagaacctcttcccc

SEQ ID NO: 1560475 - DNA, 14 bp, Homo sapiens
tcagaactgtgcca

SEQ ID NO: 1560476 - DNA, 17 bp, Homo sapiens
tcagaacttcaggtgtg

SEQ ID NO: 1560477 - DNA, 13 bp, Homo sapiens
tcagaagaaaggc

SEQ ID NO: 1560478 - DNA, 20 bp, Homo sapiens
tcagaagcacagaatatttt

SEQ ID NO: 1560479 - DNA, 12 bp, Homo sapiens
tcagaagcaggt

SEQ ID NO: 1560480 - DNA, 15 bp, Homo sapiens
tcagaagcctgaggc

SEQ ID NO: 1560481 - DNA, 20 bp, Homo sapiens
tcagaagcctgaggctggga

SEQ ID NO: 1560482 - DNA, 13 bp, Homo sapiens
tcagaaggacggc

SEQ ID NO: 1560483 - DNA, 12 bp, Homo sapiens
tcagaaggagaa

SEQ ID NO: 1560484 - DNA, 23 bp, Homo sapiens
tcagaaggagaaggaaggagact

SEQ ID NO: 1560485 - DNA, 14 bp, Homo sapiens
tcagaaggccccag

SEQ ID NO: 1560486 - DNA, 15 bp, Homo sapiens
tcagaaggccccaga

SEQ ID NO: 1560487 - DNA, 19 bp, Homo sapiens
tcagaaggtctgttttgag

SEQ ID NO: 1560488 - DNA, 16 bp, Homo sapiens
tcagaagtatatctgt

SEQ ID NO: 1560489 - DNA, 17 bp, Homo sapiens
tcagaagtatatctgta

SEQ ID NO: 1560490 - DNA, 23 bp, Homo sapiens
tcagaagtttaaatattaagcat

SEQ ID NO: 1560491 - DNA, 18 bp, Homo sapiens
tcagaataactacctcct

SEQ ID NO: 1560492 - DNA, 18 bp, Homo sapiens
tcagaataataaatattg

SEQ ID NO: 1560493 - DNA, 19 bp, Homo sapiens
tcagaatataacatgtaaa

SEQ ID NO: 1560494 - DNA, 18 bp, Homo sapiens
tcagaatcccttaacagt

SEQ ID NO: 1560495 - DNA, 18 bp, Homo sapiens
tcagaatctaaacgtggt

SEQ ID NO: 1560496 - DNA, 19 bp, Homo sapiens
tcagaatctaaacgtggtc

SEQ ID NO: 1560497 - DNA, 18 bp, Homo sapiens
tcagaatgtgaaaaagga

SEQ ID NO: 1560498 - DNA, 23 bp, Homo sapiens
tcagaattaaacttttaattcat

SEQ ID NO: 1560499 - DNA, 21 bp, Homo sapiens
tcagaattaagcagaacactg

SEQ ID NO: 1560500 - DNA, 18 bp, Homo sapiens
tcagaattcggtgtgctg

SEQ ID NO: 1560501 - DNA, 23 bp, Homo sapiens
tcagaattcggtgtgctgccaac

SEQ ID NO: 1560502 - DNA, 10 bp, Homo sapiens
tcagaattct

SEQ ID NO: 1560503 - DNA, 14 bp, Homo sapiens
tcagacaacattat

SEQ ID NO: 1560504 - DNA, 15 bp, Homo sapiens
tcagacaacattatg

SEQ ID NO: 1560505 - DNA, 20 bp, Homo sapiens
tcagacaacattatgatcta

SEQ ID NO: 1560506 - DNA, 18 bp, Homo sapiens
tcagacaagcactatttt

SEQ ID NO: 1560507 - DNA, 22 bp, Homo sapiens
tcagacaccctcaacctcttct

SEQ ID NO: 1560508 - DNA, 22 bp, Homo sapiens
tcagacacctgttcacagaaaa

SEQ ID NO: 1560509 - DNA, 18 bp, Homo sapiens
tcagacagaacccctaca

SEQ ID NO: 1560510 - DNA, 16 bp, Homo sapiens
tcagacagaacttgaa

SEQ ID NO: 1560511 - DNA, 22 bp, Homo sapiens
tcagacagagaggactgtaggg

SEQ ID NO: 1560512 - DNA, 22 bp, Homo sapiens
tcagacagggtctgaaggactg

SEQ ID NO: 1560513 - DNA, 22 bp, Homo sapiens
tcagacatacagctgcctacct

SEQ ID NO: 1560514 - DNA, 22 bp, Homo sapiens
tcagacatctgaggttttattt

SEQ ID NO: 1560515 - DNA, 15 bp, Homo sapiens
tcagacatgttttcc

SEQ ID NO: 1560516 - DNA, 14 bp, Homo sapiens
tcagacattttcac

SEQ ID NO: 1560517 - DNA, 20 bp, Homo sapiens
tcagacattttcactggaag

SEQ ID NO: 1560518 - DNA, 15 bp, Homo sapiens
tcagaccataatgtt

SEQ ID NO: 1560519 - DNA, 23 bp, Homo sapiens
tcagaccataatgttacattatt

SEQ ID NO: 1560520 - DNA, 12 bp, Homo sapiens
tcagaccccagc

SEQ ID NO: 1560521 - DNA, 13 bp, Homo sapiens
tcagaccccagcg

SEQ ID NO: 1560522 - DNA, 13 bp, Homo sapiens
tcagaccctaccc

SEQ ID NO: 1560523 - DNA, 16 bp, Homo sapiens
tcagaccctaccccac

SEQ ID NO: 1560524 - DNA, 12 bp, Homo sapiens
tcagaccctgga

SEQ ID NO: 1560525 - DNA, 23 bp, Homo sapiens
ccacctcatcactggactgcatg

SEQ ID NO: 1560526 - DNA, 21 bp, Homo sapiens
ccacctccaggctttcccact

SEQ ID NO: 1560527 - DNA, 12 bp, Homo sapiens
ccacctcccacc

SEQ ID NO: 1560528 - DNA, 19 bp, Homo sapiens
ccacctcccaccccactcc

SEQ ID NO: 1560529 - DNA, 21 bp, Homo sapiens
ccacctcccaccccactccag

SEQ ID NO: 1560530 - DNA, 22 bp, Homo sapiens
ccacctcccaccccactccagc

SEQ ID NO: 1560531 - DNA, 23 bp, Homo sapiens
ccacctcccaccccactccagcc

SEQ ID NO: 1560532 - DNA, 20 bp, Homo sapiens
ccacctcccccaaaccctgc

SEQ ID NO: 1560533 - DNA, 17 bp, Homo sapiens
ccacctcccctatccac

SEQ ID NO: 1560534 - DNA, 19 bp, Homo sapiens
ccacctcccctatccaccc

SEQ ID NO: 1560535 - DNA, 15 bp, Homo sapiens
ccacctcccttccca

SEQ ID NO: 1560536 - DNA, 16 bp, Homo sapiens
ccacctcccttcccac

SEQ ID NO: 1560537 - DNA, 23 bp, Homo sapiens
ccacctcctagaggtgggcagct

SEQ ID NO: 1560538 - DNA, 20 bp, Homo sapiens
ccacctcgcaggttcaagca

SEQ ID NO: 1560539 - DNA, 21 bp, Homo sapiens
ccacctcgcaggttcaagcaa

SEQ ID NO: 1560540 - DNA, 21 bp, Homo sapiens
tcagactggctggctgcagtg

SEQ ID NO: 1560541 - DNA, 17 bp, Homo sapiens
tcagactttcacaccat

SEQ ID NO: 1560542 - DNA, 13 bp, Homo sapiens
tcagagaatttct

SEQ ID NO: 1560543 - DNA, 14 bp, Homo sapiens
tcagagacaaaata

SEQ ID NO: 1560544 - DNA, 21 bp, Homo sapiens
tcagagacaaaatatttccca

SEQ ID NO: 1560545 - DNA, 22 bp, Homo sapiens
tcagagacaaaatatttcccat

SEQ ID NO: 1560546 - DNA, 10 bp, Homo sapiens
tcagagacac

SEQ ID NO: 1560547 - DNA, 18 bp, Homo sapiens
tcagagaccagcactcag

SEQ ID NO: 1560548 - DNA, 12 bp, Homo sapiens
tcagagaccagg

SEQ ID NO: 1560549 - DNA, 15 bp, Homo sapiens
tcagagaccagggct

SEQ ID NO: 1560550 - DNA, 16 bp, Homo sapiens
tcagagaccagggctc

SEQ ID NO: 1560551 - DNA, 19 bp, Homo sapiens
tcagagagacccgggaagg

SEQ ID NO: 1560552 - DNA, 20 bp, Homo sapiens
tcagagagacccgggaagga

SEQ ID NO: 1560553 - DNA, 20 bp, Homo sapiens
tcagagagacctcatcctgc

SEQ ID NO: 1560554 - DNA, 14 bp, Homo sapiens
tcagagagagtgtt

SEQ ID NO: 1560555 - DNA, 22 bp, Homo sapiens
tcagagagcgagcgctacccac

SEQ ID NO: 1560556 - DNA, 21 bp, Homo sapiens
tcagagaggccttttggaatg

SEQ ID NO: 1560557 - DNA, 18 bp, Homo sapiens
tcagagatgaacatctaa

SEQ ID NO: 1560558 - DNA, 16 bp, Homo sapiens
tcagagatgcaccacc

SEQ ID NO: 1560559 - DNA, 15 bp, Homo sapiens
tcagagatgggctga

SEQ ID NO: 1560560 - DNA, 22 bp, Homo sapiens
tcagagatggtaatctacagct

SEQ ID NO: 1560561 - DNA, 23 bp, Homo sapiens
tcagagatggtaatctacagctc

SEQ ID NO: 1560562 - DNA, 23 bp, Homo sapiens
tcagagcaaaagacttgagccat

SEQ ID NO: 1560563 - DNA, 15 bp, Homo sapiens
tcagagcagagcaaa

SEQ ID NO: 1560564 - DNA, 13 bp, Homo sapiens
tcagagcagggcc

SEQ ID NO: 1560565 - DNA, 18 bp, Homo sapiens
tcagagccactctatgag

SEQ ID NO: 1560566 - DNA, 13 bp, Homo sapiens
tcagagccagcct

SEQ ID NO: 1560567 - DNA, 23 bp, Homo sapiens
tcagagccagcctggctctgccc

SEQ ID NO: 1560568 - DNA, 18 bp, Homo sapiens
tcagagccagtgaaggag

SEQ ID NO: 1560569 - DNA, 13 bp, Homo sapiens
tcagagcccagcc

SEQ ID NO: 1560570 - DNA, 17 bp, Homo sapiens
tcagagcccagcccagg

SEQ ID NO: 1560571 - DNA, 19 bp, Homo sapiens
tcagagcccagcccaggag

SEQ ID NO: 1560572 - DNA, 17 bp, Homo sapiens
tcagagcccccagccct

SEQ ID NO: 1560573 - DNA, 17 bp, Homo sapiens
tcagagctcttcaagct

SEQ ID NO: 1560574 - DNA, 23 bp, Homo sapiens
tcagagctcttcaagctgtcccc

SEQ ID NO: 1560575 - DNA, 23 bp, Homo sapiens
tcagaggaaaaatgggagccagg

SEQ ID NO: 1560576 - DNA, 18 bp, Homo sapiens
tcagaggcacaaaagggt

SEQ ID NO: 1560577 - DNA, 13 bp, Homo sapiens
tcagaggctgcag

SEQ ID NO: 1560578 - DNA, 14 bp, Homo sapiens
tcagaggctgcagg

SEQ ID NO: 1560579 - DNA, 18 bp, Homo sapiens
tcagagtccttaaaatgt

SEQ ID NO: 1560580 - DNA, 20 bp, Homo sapiens
tcagagtgactacacacagt

SEQ ID NO: 1560581 - DNA, 17 bp, Homo sapiens
tcagagtggaatgcttc

SEQ ID NO: 1560582 - DNA, 18 bp, Homo sapiens
tcagagtttgtgtgtatt

SEQ ID NO: 1560583 - DNA, 22 bp, Homo sapiens
tcagagtttgtgtgtatttgta

SEQ ID NO: 1560584 - DNA, 14 bp, Homo sapiens
tcagatacaatgta

SEQ ID NO: 1560585 - DNA, 15 bp, Homo sapiens
tcagataggtgcttc

SEQ ID NO: 1560586 - DNA, 23 bp, Homo sapiens
tcagatataagagaagtctcatt

SEQ ID NO: 1560587 - DNA, 18 bp, Homo sapiens
tcagatatatttttcaca

SEQ ID NO: 1560588 - DNA, 15 bp, Homo sapiens
tcagatatcaaaatt

SEQ ID NO: 1560589 - DNA, 15 bp, Homo sapiens
tcagatatttgcacc

SEQ ID NO: 1560590 - DNA, 21 bp, Homo sapiens
tcagatattttttcagaaata

SEQ ID NO: 1560591 - DNA, 23 bp, Homo sapiens
tcagatattttttcagaaatatg

SEQ ID NO: 1560592 - DNA, 21 bp, Homo sapiens
tcagatcatttcaaaactcat

SEQ ID NO: 1560593 - DNA, 16 bp, Homo sapiens
tcagatccagggacag

SEQ ID NO: 1560594 - DNA, 18 bp, Homo sapiens
tcagatcctgttacttgc

SEQ ID NO: 1560595 - DNA, 16 bp, Homo sapiens
tcagatccttgtttca

SEQ ID NO: 1560596 - DNA, 18 bp, Homo sapiens
tcagatcggccacagggc

SEQ ID NO: 1560597 - DNA, 13 bp, Homo sapiens
tcagatctgaggt

SEQ ID NO: 1560598 - DNA, 22 bp, Homo sapiens
tcagatctggtctagttaacct

SEQ ID NO: 1560599 - DNA, 16 bp, Homo sapiens
tcagatgaattgataa

SEQ ID NO: 1560600 - DNA, 19 bp, Homo sapiens
tcagatgccacttctaaga

SEQ ID NO: 1560601 - DNA, 15 bp, Homo sapiens
tcagatgcctgcttg

SEQ ID NO: 1560602 - DNA, 14 bp, Homo sapiens
tcagatgctccaag

SEQ ID NO: 1560603 - DNA, 22 bp, Homo sapiens
tcagatgctccaagattctaga

SEQ ID NO: 1560604 - DNA, 22 bp, Homo sapiens
tcagatgcttgcggcaaaagga

SEQ ID NO: 1560605 - DNA, 18 bp, Homo sapiens
tcagatgggaagacatga

SEQ ID NO: 1560606 - DNA, 17 bp, Homo sapiens
tcagatgggtctgatat

SEQ ID NO: 1560607 - DNA, 14 bp, Homo sapiens
tcagatgtcttctg

SEQ ID NO: 1560608 - DNA, 19 bp, Homo sapiens
tcagatgtcttctgcctgt

SEQ ID NO: 1560609 - DNA, 19 bp, Homo sapiens
tcagattcccagagcaaaa

SEQ ID NO: 1560610 - DNA, 22 bp, Homo sapiens
tcagatttaagccttacaaagg

SEQ ID NO: 1560611 - DNA, 12 bp, Homo sapiens
tcagatttctgg

SEQ ID NO: 1560612 - DNA, 14 bp, Homo sapiens
tcagatttctggtt

SEQ ID NO: 1560613 - DNA, 22 bp, Homo sapiens
tcagattttactgtctatggat

SEQ ID NO: 1560614 - DNA, 20 bp, Homo sapiens
tcagcaaaccatttttaaag

SEQ ID NO: 1560615 - DNA, 16 bp, Homo sapiens
tcagcaactcgcttta

SEQ ID NO: 1560616 - DNA, 19 bp, Homo sapiens
tcagcacaatctgtaaatt

SEQ ID NO: 1560617 - DNA, 14 bp, Homo sapiens
tcagcacaggaatt

SEQ ID NO: 1560618 - DNA, 19 bp, Homo sapiens
tcagcacaggaattctcaa

SEQ ID NO: 1560619 - DNA, 19 bp, Homo sapiens
tcagcaccaagagcagctg

SEQ ID NO: 1560620 - DNA, 15 bp, Homo sapiens
tcagcaccaccctag

SEQ ID NO: 1560621 - DNA, 13 bp, Homo sapiens
tcagcaccccttc

SEQ ID NO: 1560622 - DNA, 15 bp, Homo sapiens
tcagcaccccttcca

SEQ ID NO: 1560623 - DNA, 19 bp, Homo sapiens
tcagcaccctgggtgccat

SEQ ID NO: 1560624 - DNA, 14 bp, Homo sapiens
tcagcaccttggcc

SEQ ID NO: 1560625 - DNA, 11 bp, Homo sapiens
tcagcactgaa

SEQ ID NO: 1560626 - DNA, 13 bp, Homo sapiens
tcagcactgaaaa

SEQ ID NO: 1560627 - DNA, 14 bp, Homo sapiens
tcagcactgaaaat

SEQ ID NO: 1560628 - DNA, 15 bp, Homo sapiens
tcagcactgaaaata

SEQ ID NO: 1560629 - DNA, 12 bp, Homo sapiens
tcagcactgtcc

SEQ ID NO: 1560630 - DNA, 21 bp, Homo sapiens
tcagcactgtcccttgcctca

SEQ ID NO: 1560631 - DNA, 21 bp, Homo sapiens
tcagcagaacctgcacacagg

SEQ ID NO: 1560632 - DNA, 14 bp, Homo sapiens
tcagcagcagctca

SEQ ID NO: 1560633 - DNA, 18 bp, Homo sapiens
tcagcagcagctcacacc

SEQ ID NO: 1560634 - DNA, 16 bp, Homo sapiens
tcagcagccagtctca

SEQ ID NO: 1560635 - DNA, 23 bp, Homo sapiens
tcagcagccgccttaagctgatc

SEQ ID NO: 1560636 - DNA, 13 bp, Homo sapiens
tcagcagtgacca

SEQ ID NO: 1560637 - DNA, 14 bp, Homo sapiens
tcagcagttgacat

SEQ ID NO: 1560638 - DNA, 15 bp, Homo sapiens
tcagcagttgacatc

SEQ ID NO: 1560639 - DNA, 14 bp, Homo sapiens
tcagcatagcctgc

SEQ ID NO: 1560640 - DNA, 13 bp, Homo sapiens
tcagcatatttgt

SEQ ID NO: 1560641 - DNA, 22 bp, Homo sapiens
tcagcatatttgtatagttgct

SEQ ID NO: 1560642 - DNA, 23 bp, Homo sapiens
tcagcatatttgtatagttgctt

SEQ ID NO: 1560643 - DNA, 22 bp, Homo sapiens
ccactcacctttctccactggg

SEQ ID NO: 1560644 - DNA, 12 bp, Homo sapiens
ccactcactcca

SEQ ID NO: 1560645 - DNA, 15 bp, Homo sapiens
ccactcactccagcc

SEQ ID NO: 1560646 - DNA, 15 bp, Homo sapiens
ccactcagctgtcct

SEQ ID NO: 1560647 - DNA, 16 bp, Homo sapiens
ccactccacatctgca

SEQ ID NO: 1560648 - DNA, 18 bp, Homo sapiens
ccactccacatctgcatc

SEQ ID NO: 1560649 - DNA, 13 bp, Homo sapiens
ccactccagccct

SEQ ID NO: 1560650 - DNA, 15 bp, Homo sapiens
ccactccagccctgt

SEQ ID NO: 1560651 - DNA, 16 bp, Homo sapiens
ccactccagccctgtc

SEQ ID NO: 1560652 - DNA, 13 bp, Homo sapiens
ccactccagctct

SEQ ID NO: 1560653 - DNA, 14 bp, Homo sapiens
ccactccagctctg

SEQ ID NO: 1560654 - DNA, 16 bp, Homo sapiens
ccactccccaccttca

SEQ ID NO: 1560655 - DNA, 13 bp, Homo sapiens
ttcactgtaagtt

SEQ ID NO: 1560656 - DNA, 13 bp, Homo sapiens
ttcactgtatata

SEQ ID NO: 1560657 - DNA, 14 bp, Homo sapiens
ttcactgtatataa

SEQ ID NO: 1560658 - DNA, 19 bp, Homo sapiens
ttcactgtatataaacata

SEQ ID NO: 1560659 - DNA, 22 bp, Homo sapiens
ttcactgtatataaacatattt

SEQ ID NO: 1560660 - DNA, 22 bp, Homo sapiens
ttcactgtggccacagccccct

SEQ ID NO: 1560661 - DNA, 22 bp, Homo sapiens
ttcacttagaacctttctgtgt

SEQ ID NO: 1560662 - DNA, 21 bp, Homo sapiens
ttcacttcaaagctaaaaaat

SEQ ID NO: 1560663 - DNA, 15 bp, Homo sapiens
ttcacttcagcttaa

SEQ ID NO: 1560664 - DNA, 14 bp, Homo sapiens
ttcacttcttccta

SEQ ID NO: 1560665 - DNA, 21 bp, Homo sapiens
ttcacttgccatgcaggaaga

SEQ ID NO: 1560666 - DNA, 13 bp, Homo sapiens
ttcacttgtattg

SEQ ID NO: 1560667 - DNA, 16 bp, Homo sapiens
ttcactttagatgctg

SEQ ID NO: 1560668 - DNA, 17 bp, Homo sapiens
ttcactttagatgctga

SEQ ID NO: 1560669 - DNA, 16 bp, Homo sapiens
ttcactttattgctat

SEQ ID NO: 1560670 - DNA, 17 bp, Homo sapiens
ttcactttcaaaaacat

SEQ ID NO: 1560671 - DNA, 23 bp, Homo sapiens
ttcactttgaaaagttggaagga

SEQ ID NO: 1560672 - DNA, 20 bp, Homo sapiens
ttcagaaaatattatgtgtt

SEQ ID NO: 1560673 - DNA, 23 bp, Homo sapiens
ttcagaaaggggcattttgtact

SEQ ID NO: 1560674 - DNA, 22 bp, Homo sapiens
ttcagaaatataacacattttt

SEQ ID NO: 1560675 - DNA, 19 bp, Homo sapiens
ttcagaaatgctgcctgcc

SEQ ID NO: 1560676 - DNA, 12 bp, Homo sapiens
ttcagaaatgtt

SEQ ID NO: 1560677 - DNA, 12 bp, Homo sapiens
ttcagaacctct

SEQ ID NO: 1560678 - DNA, 19 bp, Homo sapiens
ttcagaacctcttccccag

SEQ ID NO: 1560679 - DNA, 12 bp, Homo sapiens
ttcagaagagat

SEQ ID NO: 1560680 - DNA, 19 bp, Homo sapiens
ttcagaaggttattttctt

SEQ ID NO: 1560681 - DNA, 23 bp, Homo sapiens
ttcagaaggttattttctttatc

SEQ ID NO: 1560682 - DNA, 23 bp, Homo sapiens
ttcagaagtgagctttgctgcta

SEQ ID NO: 1560683 - DNA, 17 bp, Homo sapiens
ttcagaatatcatcttt

SEQ ID NO: 1560684 - DNA, 19 bp, Homo sapiens
ttcagaatattttcaaaat

SEQ ID NO: 1560685 - DNA, 19 bp, Homo sapiens
ttcagaatggcagtcctgg

SEQ ID NO: 1560686 - DNA, 20 bp, Homo sapiens
ttcagaatggcagtcctgga

SEQ ID NO: 1560687 - DNA, 22 bp, Homo sapiens
ttcagaatggcagtcctggagg

SEQ ID NO: 1560688 - DNA, 23 bp, Homo sapiens
ttcagaatggcagtcctggaggc

SEQ ID NO: 1560689 - DNA, 17 bp, Homo sapiens
ttcagaattaaactttt

SEQ ID NO: 1560690 - DNA, 18 bp, Homo sapiens
ttcagaattttgtatatt

SEQ ID NO: 1560691 - DNA, 17 bp, Homo sapiens
ttcagacaacattatga

SEQ ID NO: 1560692 - DNA, 20 bp, Homo sapiens
ttcagacaacattatgatct

SEQ ID NO: 1560693 - DNA, 15 bp, Homo sapiens
ttcagacacatgcta

SEQ ID NO: 1560694 - DNA, 21 bp, Homo sapiens
ttcagacacatgctatgttct

SEQ ID NO: 1560695 - DNA, 13 bp, Homo sapiens
ttcagacccagag

SEQ ID NO: 1560696 - DNA, 13 bp, Homo sapiens
ttcagacctgaca

SEQ ID NO: 1560697 - DNA, 14 bp, Homo sapiens
ttcagactcagact

SEQ ID NO: 1560698 - DNA, 13 bp, Homo sapiens
ttcagactctctc

SEQ ID NO: 1560699 - DNA, 19 bp, Homo sapiens
ttcagactttgcttcccat

SEQ ID NO: 1560700 - DNA, 15 bp, Homo sapiens
ttcagagactcaggg

SEQ ID NO: 1560701 - DNA, 17 bp, Homo sapiens
ttcagagccagcctggc

SEQ ID NO: 1560702 - DNA, 18 bp, Homo sapiens
ttcagagcccccagccct

SEQ ID NO: 1560703 - DNA, 20 bp, Homo sapiens
ttcagagcccccagccctgg

SEQ ID NO: 1560704 - DNA, 13 bp, Homo sapiens
ttcagagccctcg

SEQ ID NO: 1560705 - DNA, 12 bp, Homo sapiens
ttcagagcctag

SEQ ID NO: 1560706 - DNA, 15 bp, Homo sapiens
ttcagagcctagcca

SEQ ID NO: 1560707 - DNA, 19 bp, Homo sapiens
ttcagagcctagccacctc

SEQ ID NO: 1560708 - DNA, 23 bp, Homo sapiens
ttcagagcctagccacctcccac

SEQ ID NO: 1560709 - DNA, 22 bp, Homo sapiens
ttcagaggataaatatcaatgg

SEQ ID NO: 1560710 - DNA, 19 bp, Homo sapiens
ttcagagtgaagaatctta

SEQ ID NO: 1560711 - DNA, 14 bp, Homo sapiens
ttcagagtttgtgt

SEQ ID NO: 1560712 - DNA, 22 bp, Homo sapiens
ttcagagtttgtgtgtatttgt

SEQ ID NO: 1560713 - DNA, 12 bp, Homo sapiens
ttcagatacatg

SEQ ID NO: 1560714 - DNA, 14 bp, Homo sapiens
ttcagatatcaaaa

SEQ ID NO: 1560715 - DNA, 17 bp, Homo sapiens
ttcagatatcaaaattc

SEQ ID NO: 1560716 - DNA, 21 bp, Homo sapiens
ttcagatcactgaatttataa

SEQ ID NO: 1560717 - DNA, 13 bp, Homo sapiens
ttcagatgccact

SEQ ID NO: 1560718 - DNA, 18 bp, Homo sapiens
ttcagatgccacttctaa

SEQ ID NO: 1560719 - DNA, 19 bp, Homo sapiens
ttcagatgcttctgggaga

SEQ ID NO: 1560720 - DNA, 19 bp, Homo sapiens
ttcagatgtcttctgcctg

SEQ ID NO: 1560721 - DNA, 14 bp, Homo sapiens
ttcagatgtgcaat

SEQ ID NO: 1560722 - DNA, 15 bp, Homo sapiens
ttcagatgtgcaata

SEQ ID NO: 1560723 - DNA, 16 bp, Homo sapiens
ttcagatgtgcaataa

SEQ ID NO: 1560724 - DNA, 22 bp, Homo sapiens
ttcagatgtgcaataatttgta

SEQ ID NO: 1560725 - DNA, 15 bp, Homo sapiens
ttcagatgtgcattt

SEQ ID NO: 1560726 - DNA, 23 bp, Homo sapiens
ttcagatgtgcatttcacctgtg

SEQ ID NO: 1560727 - DNA, 21 bp, Homo sapiens
ttcagattcccagagcaaaat

SEQ ID NO: 1560728 - DNA, 16 bp, Homo sapiens
ttcagatttgccttat

SEQ ID NO: 1560729 - DNA, 19 bp, Homo sapiens
ttcagcaaactaaccagca

SEQ ID NO: 1560730 - DNA, 20 bp, Homo sapiens
ttcagcaaactcttttccca

SEQ ID NO: 1560731 - DNA, 15 bp, Homo sapiens
ttcagcactgtccct

SEQ ID NO: 1560732 - DNA, 13 bp, Homo sapiens
ttcagcagaacct

SEQ ID NO: 1560733 - DNA, 16 bp, Homo sapiens
ttcagcagaacctgca

SEQ ID NO: 1560734 - DNA, 13 bp, Homo sapiens
ttcagcagactgg

SEQ ID NO: 1560735 - DNA, 16 bp, Homo sapiens
ttcagcagcagctcac

SEQ ID NO: 1560736 - DNA, 16 bp, Homo sapiens
ttcagcagtgcctaaa

SEQ ID NO: 1560737 - DNA, 23 bp, Homo sapiens
ttcagcatgggtccttgatgcca

SEQ ID NO: 1560738 - DNA, 17 bp, Homo sapiens
ttcagcattaagctgtt

SEQ ID NO: 1560739 - DNA, 16 bp, Homo sapiens
ttcagcattaggcttt

SEQ ID NO: 1560740 - DNA, 11 bp, Homo sapiens
ttcagccaagg

SEQ ID NO: 1560741 - DNA, 11 bp, Homo sapiens
ttcagccacat

SEQ ID NO: 1560742 - DNA, 17 bp, Homo sapiens
ttcagccacatgcccca

SEQ ID NO: 1560743 - DNA, 21 bp, Homo sapiens
ttcagccactgagggacaaaa

SEQ ID NO: 1560744 - DNA, 17 bp, Homo sapiens
ttcagccagcttaaacc

SEQ ID NO: 1560745 - DNA, 22 bp, Homo sapiens
ttcagcccccatcacccaagcc

SEQ ID NO: 1560746 - DNA, 16 bp, Homo sapiens
ttcagcccctcctctg

SEQ ID NO: 1560747 - DNA, 18 bp, Homo sapiens
ttcagcccctcctctgcc

SEQ ID NO: 1560748 - DNA, 19 bp, Homo sapiens
ttcagcccctcctctgcca

SEQ ID NO: 1560749 - DNA, 20 bp, Homo sapiens
ttcagcccctcctctgccac

SEQ ID NO: 1560750 - DNA, 16 bp, Homo sapiens
ttcagccctcacccct

SEQ ID NO: 1560751 - DNA, 13 bp, Homo sapiens
ttcagcctaagag

SEQ ID NO: 1560752 - DNA, 20 bp, Homo sapiens
ttcagcctagccgacctcag

SEQ ID NO: 1560753 - DNA, 20 bp, Homo sapiens
ttcagctaaagtaacagagc

SEQ ID NO: 1560754 - DNA, 11 bp, Homo sapiens
ttcagctctgg

SEQ ID NO: 1560755 - DNA, 14 bp, Homo sapiens
ttcagctctggaga

SEQ ID NO: 1560756 - DNA, 15 bp, Homo sapiens
ttcagctctggagaa

SEQ ID NO: 1560757 - DNA, 17 bp, Homo sapiens
ttcagctctttccaaat

SEQ ID NO: 1560758 - DNA, 19 bp, Homo sapiens
ttcagctgggtcacatcca

SEQ ID NO: 1560759 - DNA, 23 bp, Homo sapiens
ttcagctgggtcacatccatccc

SEQ ID NO: 1560760 - DNA, 22 bp, Homo sapiens
ttcagcttcctgctgctggggc

SEQ ID NO: 1560761 - DNA, 22 bp, Homo sapiens
ttcagcttcgtttattttcaag

SEQ ID NO: 1560762 - DNA, 19 bp, Homo sapiens
ttcagcttgtttctatact

SEQ ID NO: 1560763 - DNA, 13 bp, Homo sapiens
ttcaggaaaatgt

SEQ ID NO: 1560764 - DNA, 21 bp, Homo sapiens
ttcaggaacaagtaatgtatt

SEQ ID NO: 1560765 - DNA, 22 bp, Homo sapiens
ttcaggaacaagtaatgtatta

SEQ ID NO: 1560766 - DNA, 23 bp, Homo sapiens
ttcaggaacaagtaatgtattag

SEQ ID NO: 1560767 - DNA, 18 bp, Homo sapiens
ttcaggaatttaaaatta

SEQ ID NO: 1560768 - DNA, 16 bp, Homo sapiens
ttcaggactttgtgag

SEQ ID NO: 1560769 - DNA, 19 bp, Homo sapiens
ctcagccacacccaggcac

SEQ ID NO: 1560770 - DNA, 15 bp, Homo sapiens
ctcagccaccctgag

SEQ ID NO: 1560771 - DNA, 19 bp, Homo sapiens
ctcagccagtggcacagga

SEQ ID NO: 1560772 - DNA, 21 bp, Homo sapiens
ctcagccatgaggagttgctg

SEQ ID NO: 1560773 - DNA, 23 bp, Homo sapiens
ctcagccatttccccctcctcag

SEQ ID NO: 1560774 - DNA, 16 bp, Homo sapiens
ctcagcccagctggcc

SEQ ID NO: 1560775 - DNA, 15 bp, Homo sapiens
ctcagccccaactct

SEQ ID NO: 1560776 - DNA, 16 bp, Homo sapiens
ctcagccccaactctt

SEQ ID NO: 1560777 - DNA, 20 bp, Homo sapiens
ctcagccccaactctttatc

SEQ ID NO: 1560778 - DNA, 16 bp, Homo sapiens
ctcagcccgctgagtg

SEQ ID NO: 1560779 - DNA, 13 bp, Homo sapiens
ctcagcccgcttg

SEQ ID NO: 1560780 - DNA, 15 bp, Homo sapiens
ctcagccctagaggc

SEQ ID NO: 1560781 - DNA, 19 bp, Homo sapiens
ctcagccctccctgcccct

SEQ ID NO: 1560782 - DNA, 20 bp, Homo sapiens
ctcagccctccctgcccctc

SEQ ID NO: 1560783 - DNA, 13 bp, Homo sapiens
ctcagccctgagg

SEQ ID NO: 1560784 - DNA, 15 bp, Homo sapiens
ctcagccctgcacca

SEQ ID NO: 1560785 - DNA, 20 bp, Homo sapiens
ctcagccctgcaccatgctg

SEQ ID NO: 1560786 - DNA, 13 bp, Homo sapiens
ctcagccctggcc

SEQ ID NO: 1560787 - DNA, 12 bp, Homo sapiens
ctcagccctggg

SEQ ID NO: 1560788 - DNA, 14 bp, Homo sapiens
ctcagccctgggcc

SEQ ID NO: 1560789 - DNA, 11 bp, Homo sapiens
ctcagccctgt

SEQ ID NO: 1560790 - DNA, 23 bp, Homo sapiens
ttcaggtatttttattcatgtga

SEQ ID NO: 1560791 - DNA, 17 bp, Homo sapiens
ttcaggtggccagaaga

SEQ ID NO: 1560792 - DNA, 20 bp, Homo sapiens
ttcaggtgtttagttgcaga

SEQ ID NO: 1560793 - DNA, 15 bp, Homo sapiens
ttcaggttctcatga

SEQ ID NO: 1560794 - DNA, 19 bp, Homo sapiens
ttcaggttttgtaaagatg

SEQ ID NO: 1560795 - DNA, 21 bp, Homo sapiens
ttcagtaccctctcagctcca

SEQ ID NO: 1560796 - DNA, 22 bp, Homo sapiens
ttcagtaccctctcagctccag

SEQ ID NO: 1560797 - DNA, 17 bp, Homo sapiens
ttcagtatactgtgtgg

SEQ ID NO: 1560798 - DNA, 20 bp, Homo sapiens
ttcagtcccctctctctggg

SEQ ID NO: 1560799 - DNA, 15 bp, Homo sapiens
ttcagtcgttgtgct

SEQ ID NO: 1560800 - DNA, 18 bp, Homo sapiens
ttcagtctcacagagaag

SEQ ID NO: 1560801 - DNA, 18 bp, Homo sapiens
ttcagtctctataccaat

SEQ ID NO: 1560802 - DNA, 22 bp, Homo sapiens
ttcagtctctataccaataaag

SEQ ID NO: 1560803 - DNA, 24 bp, Homo sapiens
ttcagtctctataccaataaagtg

SEQ ID NO: 1560804 - DNA, 14 bp, Homo sapiens
ttcagtctgctcca

SEQ ID NO: 1560805 - DNA, 19 bp, Homo sapiens
ttcagtcttggtggttcta

SEQ ID NO: 1560806 - DNA, 13 bp, Homo sapiens
ttcagtgaagatg

SEQ ID NO: 1560807 - DNA, 21 bp, Homo sapiens
ttcagtggaccgaaatctgta

SEQ ID NO: 1560808 - DNA, 21 bp, Homo sapiens
ttcagtgtaatgtgacttcat

SEQ ID NO: 1560809 - DNA, 13 bp, Homo sapiens
ttcagtgtacatg

SEQ ID NO: 1560810 - DNA, 20 bp, Homo sapiens
ttcagtgtatggaaataaat

SEQ ID NO: 1560811 - DNA, 17 bp, Homo sapiens
ttcagtgtgagtcagaa

SEQ ID NO: 1560812 - DNA, 18 bp, Homo sapiens
ttcagttgatcactggca

SEQ ID NO: 1560813 - DNA, 16 bp, Homo sapiens
ttcagttgattttaca

SEQ ID NO: 1560814 - DNA, 17 bp, Homo sapiens
ttcagttgcttgtcttc

SEQ ID NO: 1560815 - DNA, 19 bp, Homo sapiens
ttcagttgcttgtcttctg

SEQ ID NO: 1560816 - DNA, 17 bp, Homo sapiens
ttcagtttaatgtctcc

SEQ ID NO: 1560817 - DNA, 21 bp, Homo sapiens
ttcagtttgaaaatattttgt

SEQ ID NO: 1560818 - DNA, 17 bp, Homo sapiens
ttcagtttgtaaagtcg

SEQ ID NO: 1560819 - DNA, 15 bp, Homo sapiens
ttcagtttttcattt

SEQ ID NO: 1560820 - DNA, 21 bp, Homo sapiens
ttcagtttttcatttgttttg

SEQ ID NO: 1560821 - DNA, 23 bp, Homo sapiens
ttcagtttttcatttgttttgct

SEQ ID NO: 1560822 - DNA, 11 bp, Homo sapiens
ttcataaacaa

SEQ ID NO: 1560823 - DNA, 19 bp, Homo sapiens
ttcataaacaacttaatgt

SEQ ID NO: 1560824 - DNA, 15 bp, Homo sapiens
ttcataaacaagttc

SEQ ID NO: 1560825 - DNA, 21 bp, Homo sapiens
ttcataaatacaaaaatgaat

SEQ ID NO: 1560826 - DNA, 12 bp, Homo sapiens
ttcataaatgaa

SEQ ID NO: 1560827 - DNA, 15 bp, Homo sapiens
ttcataatcactcta

SEQ ID NO: 1560828 - DNA, 14 bp, Homo sapiens
ttcataatcagtaa

SEQ ID NO: 1560829 - DNA, 14 bp, Homo sapiens
ttcataatgaatta

SEQ ID NO: 1560830 - DNA, 19 bp, Homo sapiens
ttcataatgaattataaca

SEQ ID NO: 1560831 - DNA, 22 bp, Homo sapiens
ttcataatgaattataacagtt

SEQ ID NO: 1560832 - DNA, 15 bp, Homo sapiens
ttcataatgcagaag

SEQ ID NO: 1560833 - DNA, 12 bp, Homo sapiens
ttcatacatatt

SEQ ID NO: 1560834 - DNA, 23 bp, Homo sapiens
ttcatacatatttttgtagcact

SEQ ID NO: 1560835 - DNA, 13 bp, Homo sapiens
ttcatacattgta

SEQ ID NO: 1560836 - DNA, 12 bp, Homo sapiens
ttcataccgcct

SEQ ID NO: 1560837 - DNA, 19 bp, Homo sapiens
ttcataccgcctcgtgcca

SEQ ID NO: 1560838 - DNA, 23 bp, Homo sapiens
ttcatactccttttaagcagtga

SEQ ID NO: 1560839 - DNA, 19 bp, Homo sapiens
ttcataggcggtcatgtgt

SEQ ID NO: 1560840 - DNA, 23 bp, Homo sapiens
ttcataggcggtcatgtgtgcat

SEQ ID NO: 1560841 - DNA, 19 bp, Homo sapiens
ttcataggtcactggctct

SEQ ID NO: 1560842 - DNA, 15 bp, Homo sapiens
ttcatagtaaaatac

SEQ ID NO: 1560843 - DNA, 17 bp, Homo sapiens
ttcatagtaagattgat

SEQ ID NO: 1560844 - DNA, 22 bp, Homo sapiens
ttcatatgtacttgtttgctat

SEQ ID NO: 1560845 - DNA, 15 bp, Homo sapiens
ttcatatgtcacctt

SEQ ID NO: 1560846 - DNA, 18 bp, Homo sapiens
ttcatatttatactttgc

SEQ ID NO: 1560847 - DNA, 13 bp, Homo sapiens
ttcatatttctac

SEQ ID NO: 1560848 - DNA, 15 bp, Homo sapiens
ttcatatttctttgg

SEQ ID NO: 1560849 - DNA, 15 bp, Homo sapiens
ttcatatttgtactt

SEQ ID NO: 1560850 - DNA, 16 bp, Homo sapiens
ttcatattttaaatct

SEQ ID NO: 1560851 - DNA, 13 bp, Homo sapiens
ttcatcagcattt

SEQ ID NO: 1560852 - DNA, 18 bp, Homo sapiens
ttcatcatcctaagctat

SEQ ID NO: 1560853 - DNA, 20 bp, Homo sapiens
ttcatcattccctctcatct

SEQ ID NO: 1560854 - DNA, 15 bp, Homo sapiens
ttcatcattgggctc

SEQ ID NO: 1560855 - DNA, 23 bp, Homo sapiens
ttcatcattgtttctgcatgaat

SEQ ID NO: 1560856 - DNA, 20 bp, Homo sapiens
ttcatccaacttatgttttt

SEQ ID NO: 1560857 - DNA, 18 bp, Homo sapiens
ttcatccaatcctcactg

SEQ ID NO: 1560858 - DNA, 22 bp, Homo sapiens
ttcatccaatcctcactgggtg

SEQ ID NO: 1560859 - DNA, 22 bp, Homo sapiens
ttcatccaggcccaactgtgag

SEQ ID NO: 1560860 - DNA, 19 bp, Homo sapiens
ttcatcccgtatcacagtg

SEQ ID NO: 1560861 - DNA, 14 bp, Homo sapiens
ttcatccgcactgt

SEQ ID NO: 1560862 - DNA, 20 bp, Homo sapiens
ttcatcctcattgcctcctg

SEQ ID NO: 1560863 - DNA, 21 bp, Homo sapiens
ttcatcctcattgcctcctgt

SEQ ID NO: 1560864 - DNA, 20 bp, Homo sapiens
ttcatcctcctccccagctc

SEQ ID NO: 1560865 - DNA, 16 bp, Homo sapiens
ttcatctaccttttct

SEQ ID NO: 1560866 - DNA, 17 bp, Homo sapiens
ttcatctatttctgaga

SEQ ID NO: 1560867 - DNA, 18 bp, Homo sapiens
ttcatctatttctgagaa

SEQ ID NO: 1560868 - DNA, 14 bp, Homo sapiens
ttcatctcatttgt

SEQ ID NO: 1560869 - DNA, 15 bp, Homo sapiens
ttcatctccagggag

SEQ ID NO: 1560870 - DNA, 20 bp, Homo sapiens
ttcatctccctcctccaggt

SEQ ID NO: 1560871 - DNA, 18 bp, Homo sapiens
ttcatctctctacctcca

SEQ ID NO: 1560872 - DNA, 19 bp, Homo sapiens
ttcatctctctacctccac

SEQ ID NO: 1560873 - DNA, 21 bp, Homo sapiens
ttcatctctctacctccaccc

SEQ ID NO: 1560874 - DNA, 23 bp, Homo sapiens
ttcatctctctacctccaccctg

SEQ ID NO: 1560875 - DNA, 21 bp, Homo sapiens
ttcatctgctctccttcctgg

SEQ ID NO: 1560876 - DNA, 18 bp, Homo sapiens
ttcatcttaaactaatac

SEQ ID NO: 1560877 - DNA, 17 bp, Homo sapiens
ttcatcttcctgtgtcc

SEQ ID NO: 1560878 - DNA, 20 bp, Homo sapiens
ttcatcttcctgtgtcctga

SEQ ID NO: 1560879 - DNA, 12 bp, Homo sapiens
ttcatcttctgg

SEQ ID NO: 1560880 - DNA, 13 bp, Homo sapiens
ttcatcttctgga

SEQ ID NO: 1560881 - DNA, 12 bp, Homo sapiens
ttcatcttgcag

SEQ ID NO: 1560882 - DNA, 20 bp, Homo sapiens
ttcatcttgcagcatttact

SEQ ID NO: 1560883 - DNA, 24 bp, Homo sapiens
ggctcacgcctgtaatcccagcag

SEQ ID NO: 1560884 - DNA, 16 bp, Homo sapiens
ggctcactactgaaca

SEQ ID NO: 1560885 - DNA, 19 bp, Homo sapiens
ggctcactgcagcctccgc

SEQ ID NO: 1560886 - DNA, 16 bp, Homo sapiens
ggctcactgccaggcc

SEQ ID NO: 1560887 - DNA, 19 bp, Homo sapiens
ggctcactgccaggccagc

SEQ ID NO: 1560888 - DNA, 14 bp, Homo sapiens
ggctcactggcagg

SEQ ID NO: 1560889 - DNA, 18 bp, Homo sapiens
ggctcactggcaggtgtg

SEQ ID NO: 1560890 - DNA, 13 bp, Homo sapiens
ggctcagatctca

SEQ ID NO: 1560891 - DNA, 17 bp, Homo sapiens
ggctcagatgaaatgca

SEQ ID NO: 1560892 - DNA, 12 bp, Homo sapiens
ggctcagcctgg

SEQ ID NO: 1560893 - DNA, 20 bp, Homo sapiens
ggctcagctcggggagcctt

SEQ ID NO: 1560894 - DNA, 15 bp, Homo sapiens
ggctcaggcaagccc

SEQ ID NO: 1560895 - DNA, 12 bp, Homo sapiens
ggctcaggcaga

SEQ ID NO: 1560896 - DNA, 14 bp, Homo sapiens
ggctcaggcccagc

SEQ ID NO: 1560897 - DNA, 14 bp, Homo sapiens
ggctcagggctgga

SEQ ID NO: 1560898 - DNA, 16 bp, Homo sapiens
ggctcagggctggagt

SEQ ID NO: 1560899 - DNA, 22 bp, Homo sapiens
ggctcagggttggccatttgct

SEQ ID NO: 1560900 - DNA, 21 bp, Homo sapiens
ggctcatgcctgtaatctcag

SEQ ID NO: 1560901 - DNA, 23 bp, Homo sapiens
ggctcatggcgtaatgggcctgc

SEQ ID NO: 1560902 - DNA, 15 bp, Homo sapiens
ggctccacacagcag

SEQ ID NO: 1560903 - DNA, 17 bp, Homo sapiens
ggctccacacagcagtg

SEQ ID NO: 1560904 - DNA, 19 bp, Homo sapiens
ggctccacacagcagtgtc

SEQ ID NO: 1560905 - DNA, 22 bp, Homo sapiens
ggctccacacagcagtgtcccc

SEQ ID NO: 1560906 - DNA, 15 bp, Homo sapiens
ggctccagcccctct

SEQ ID NO: 1560907 - DNA, 21 bp, Homo sapiens
ggctccagcccctcttggaga

SEQ ID NO: 1560908 - DNA, 22 bp, Homo sapiens
ggctccagcccctcttggagaa

SEQ ID NO: 1560909 - DNA, 18 bp, Homo sapiens
ggctccaggcagaaggag

SEQ ID NO: 1560910 - DNA, 22 bp, Homo sapiens
ggctccagtttccccatggggc

SEQ ID NO: 1560911 - DNA, 17 bp, Homo sapiens
ggctccatatcatttga

SEQ ID NO: 1560912 - DNA, 17 bp, Homo sapiens
ggctccatgcacctccc

SEQ ID NO: 1560913 - DNA, 17 bp, Homo sapiens
ggctcccacaggccctt

SEQ ID NO: 1560914 - DNA, 11 bp, Homo sapiens
ggctcccaccc

SEQ ID NO: 1560915 - DNA, 22 bp, Homo sapiens
ggctcccaggggtctccctggc

SEQ ID NO: 1560916 - DNA, 20 bp, Homo sapiens
ggctccccctctgcttctcg

SEQ ID NO: 1560917 - DNA, 16 bp, Homo sapiens
ggctccccgcctccac

SEQ ID NO: 1560918 - DNA, 15 bp, Homo sapiens
ggctccggcctctgc

SEQ ID NO: 1560919 - DNA, 17 bp, Homo sapiens
ggctccggcctctgcct

SEQ ID NO: 1560920 - DNA, 16 bp, Homo sapiens
ggctcctccttgccca

SEQ ID NO: 1560921 - DNA, 12 bp, Homo sapiens
ggctcctggctg

SEQ ID NO: 1560922 - DNA, 19 bp, Homo sapiens
ggctcctggctgccaggcg

SEQ ID NO: 1560923 - DNA, 17 bp, Homo sapiens
ggctcctggctgtgccc

SEQ ID NO: 1560924 - DNA, 13 bp, Homo sapiens
ggctcctgggccg

SEQ ID NO: 1560925 - DNA, 13 bp, Homo sapiens
ggctcctgtctgg

SEQ ID NO: 1560926 - DNA, 13 bp, Homo sapiens
ggctccttcccct

SEQ ID NO: 1560927 - DNA, 20 bp, Homo sapiens
ggctccttcccctgcacctg

SEQ ID NO: 1560928 - DNA, 23 bp, Homo sapiens
ggctccttcccctgcacctggcc

SEQ ID NO: 1560929 - DNA, 13 bp, Homo sapiens
ggctcctttctcc

SEQ ID NO: 1560930 - DNA, 19 bp, Homo sapiens
ggctcctttctccagccag

SEQ ID NO: 1560931 - DNA, 15 bp, Homo sapiens
ggctcgaatctctgt

SEQ ID NO: 1560932 - DNA, 13 bp, Homo sapiens
ggctcgcccatac

SEQ ID NO: 1560933 - DNA, 20 bp, Homo sapiens
ggctcgccgtgtctcagcct

SEQ ID NO: 1560934 - DNA, 16 bp, Homo sapiens
ggctcggacccacccc

SEQ ID NO: 1560935 - DNA, 16 bp, Homo sapiens
ggctcggagcaccctt

SEQ ID NO: 1560936 - DNA, 13 bp, Homo sapiens
ggctcgtggactg

SEQ ID NO: 1560937 - DNA, 14 bp, Homo sapiens
ggctcgtggccttc

SEQ ID NO: 1560938 - DNA, 20 bp, Homo sapiens
ggctctaccctgtctgtccc

SEQ ID NO: 1560939 - DNA, 18 bp, Homo sapiens
ggctctatgagtctagat

SEQ ID NO: 1560940 - DNA, 20 bp, Homo sapiens
ggctctcacccagtccccac

SEQ ID NO: 1560941 - DNA, 21 bp, Homo sapiens
ggctctcacccccatccctgg

SEQ ID NO: 1560942 - DNA, 18 bp, Homo sapiens
ggctctccaaaggggctg

SEQ ID NO: 1560943 - DNA, 15 bp, Homo sapiens
gagcctgtaaacttt

SEQ ID NO: 1560944 - DNA, 17 bp, Homo sapiens
gagcctgtcaccagagc

SEQ ID NO: 1560945 - DNA, 19 bp, Homo sapiens
gagcctgtgcctcctcacc

SEQ ID NO: 1560946 - DNA, 19 bp, Homo sapiens
gagccttagccgcccatgc

SEQ ID NO: 1560947 - DNA, 14 bp, Homo sapiens
gagccttcaagtgc

SEQ ID NO: 1560948 - DNA, 20 bp, Homo sapiens
gagccttcctttctcctgcc

SEQ ID NO: 1560949 - DNA, 20 bp, Homo sapiens
gagccttctcaccccaggat

SEQ ID NO: 1560950 - DNA, 21 bp, Homo sapiens
gagccttgcagatatctgcat

SEQ ID NO: 1560951 - DNA, 16 bp, Homo sapiens
gagccttgctgggcca

SEQ ID NO: 1560952 - DNA, 18 bp, Homo sapiens
gagccttgctgggccagg

SEQ ID NO: 1560953 - DNA, 19 bp, Homo sapiens
gagccttggtgtccacctg

SEQ ID NO: 1560954 - DNA, 20 bp, Homo sapiens
gagccttgtgagatccttca

SEQ ID NO: 1560955 - DNA, 21 bp, Homo sapiens
gagcctttggaagtctgcgcc

SEQ ID NO: 1560956 - DNA, 17 bp, Homo sapiens
gagcgagagatcaaaga

SEQ ID NO: 1560957 - DNA, 20 bp, Homo sapiens
gagcgagagatcaaagatga

SEQ ID NO: 1560958 - DNA, 16 bp, Homo sapiens
gagcgagcgctaccca

SEQ ID NO: 1560959 - DNA, 21 bp, Homo sapiens
gagcgcacagggagtgcacat

SEQ ID NO: 1560960 - DNA, 12 bp, Homo sapiens
gagcgccacctc

SEQ ID NO: 1560961 - DNA, 16 bp, Homo sapiens
gagcgcctgaccctgg

SEQ ID NO: 1560962 - DNA, 15 bp, Homo sapiens
gagcgctacccactt

SEQ ID NO: 1560963 - DNA, 23 bp, Homo sapiens
gagcgctcctgccgcagagctgg

SEQ ID NO: 1560964 - DNA, 19 bp, Homo sapiens
gagcggactcacttgatgt

SEQ ID NO: 1560965 - DNA, 15 bp, Homo sapiens
gagcggcgcagagcc

SEQ ID NO: 1560966 - DNA, 20 bp, Homo sapiens
gagcgttagactgacttgtt

SEQ ID NO: 1560967 - DNA, 22 bp, Homo sapiens
gagctaaactccttcctggcct

SEQ ID NO: 1560968 - DNA, 14 bp, Homo sapiens
gagctaataaatct

SEQ ID NO: 1560969 - DNA, 20 bp, Homo sapiens
gagctacaacaaaaggactt

SEQ ID NO: 1560970 - DNA, 14 bp, Homo sapiens
gagctactgatgaa

SEQ ID NO: 1560971 - DNA, 18 bp, Homo sapiens
gagctagcgctgccgcac

SEQ ID NO: 1560972 - DNA, 19 bp, Homo sapiens
gagctagttctcagcttgc

SEQ ID NO: 1560973 - DNA, 14 bp, Homo sapiens
gagctatgtattaa

SEQ ID NO: 1560974 - DNA, 15 bp, Homo sapiens
gagctcaccctgccc

SEQ ID NO: 1560975 - DNA, 21 bp, Homo sapiens
gagctcaccctgcccgctccc

SEQ ID NO: 1560976 - DNA, 23 bp, Homo sapiens
gagctcaccctgcccgctcccaa

SEQ ID NO: 1560977 - DNA, 20 bp, Homo sapiens
gagctcagacattttctttt

SEQ ID NO: 1560978 - DNA, 14 bp, Homo sapiens
gagctcagaccccc

SEQ ID NO: 1560979 - DNA, 15 bp, Homo sapiens
gagctcagaccccca

SEQ ID NO: 1560980 - DNA, 13 bp, Homo sapiens
gagctcaggcagc

SEQ ID NO: 1560981 - DNA, 14 bp, Homo sapiens
gagctcatcccccc

SEQ ID NO: 1560982 - DNA, 14 bp, Homo sapiens
gagctcatgagggc

SEQ ID NO: 1560983 - DNA, 14 bp, Homo sapiens
gagctcattctgtc

SEQ ID NO: 1560984 - DNA, 11 bp, Homo sapiens
gagctccacct

SEQ ID NO: 1560985 - DNA, 20 bp, Homo sapiens
gagctccacctctggtggct

SEQ ID NO: 1560986 - DNA, 22 bp, Homo sapiens
gagctccactctgcttctctga

SEQ ID NO: 1560987 - DNA, 21 bp, Homo sapiens
gagctcccacctcccttccca

SEQ ID NO: 1560988 - DNA, 19 bp, Homo sapiens
gagctcccctccacagctg

SEQ ID NO: 1560989 - DNA, 21 bp, Homo sapiens
gagctcccctggagccagcag

SEQ ID NO: 1560990 - DNA, 22 bp, Homo sapiens
gagctcccctggagccagcagg

SEQ ID NO: 1560991 - DNA, 20 bp, Homo sapiens
gaggagaagggggtctctgt

SEQ ID NO: 1560992 - DNA, 14 bp, Homo sapiens
gaggagaccagctc

SEQ ID NO: 1560993 - DNA, 13 bp, Homo sapiens
gaggagaccctgg

SEQ ID NO: 1560994 - DNA, 17 bp, Homo sapiens
gaggagagtcccagagc

SEQ ID NO: 1560995 - DNA, 20 bp, Homo sapiens
gaggagagtggttgttgcca

SEQ ID NO: 1560996 - DNA, 16 bp, Homo sapiens
gaggagcacctgaacc

SEQ ID NO: 1560997 - DNA, 19 bp, Homo sapiens
gaggagcagagggcagggg

SEQ ID NO: 1560998 - DNA, 14 bp, Homo sapiens
gaggagcagcttcc

SEQ ID NO: 1560999 - DNA, 19 bp, Homo sapiens
gaggagcagcttccttctg

SEQ ID NO: 1561000 - DNA, 13 bp, Homo sapiens
gaggagcagggtc

SEQ ID NO: 1561001 - DNA, 16 bp, Homo sapiens
gaggagccaccagttc

SEQ ID NO: 1561002 - DNA, 15 bp, Homo sapiens
gaggagccccagcta

SEQ ID NO: 1561003 - DNA, 21 bp, Homo sapiens
gaggagccctgaggacctctc

SEQ ID NO: 1561004 - DNA, 22 bp, Homo sapiens
gaggagccctgaggacctctca

SEQ ID NO: 1561005 - DNA, 14 bp, Homo sapiens
gaggagcctcagaa

SEQ ID NO: 1561006 - DNA, 23 bp, Homo sapiens
gaggagcctgtgcgtcccagctg

SEQ ID NO: 1561007 - DNA, 18 bp, Homo sapiens
gaggagccttgctgggcc

SEQ ID NO: 1561008 - DNA, 13 bp, Homo sapiens
gaggagccttttt

SEQ ID NO: 1561009 - DNA, 17 bp, Homo sapiens
gaggagctggcctgtgg

SEQ ID NO: 1561010 - DNA, 16 bp, Homo sapiens
gaggagctgggcccct

SEQ ID NO: 1561011 - DNA, 16 bp, Homo sapiens
gaggagcttctcccag

SEQ ID NO: 1561012 - DNA, 22 bp, Homo sapiens
gaggagcttctcccagtgtgag

SEQ ID NO: 1561013 - DNA, 13 bp, Homo sapiens
gaggaggaaggca

SEQ ID NO: 1561014 - DNA, 14 bp, Homo sapiens
gaggaggccacctc

SEQ ID NO: 1561015 - DNA, 11 bp, Homo sapiens
gaggagggaga

SEQ ID NO: 1561016 - DNA, 17 bp, Homo sapiens
gaggagggagaagagaa

SEQ ID NO: 1561017 - DNA, 17 bp, Homo sapiens
gaggagggagagggagg

SEQ ID NO: 1561018 - DNA, 16 bp, Homo sapiens
gaggagggaggccagg

SEQ ID NO: 1561019 - DNA, 14 bp, Homo sapiens
gaggagggaggccg

SEQ ID NO: 1561020 - DNA, 15 bp, Homo sapiens
gaggagggatgctgc

SEQ ID NO: 1561021 - DNA, 12 bp, Homo sapiens
gaggagggatgt

SEQ ID NO: 1561022 - DNA, 13 bp, Homo sapiens
gaggagggatgtg

SEQ ID NO: 1561023 - DNA, 15 bp, Homo sapiens
gaggagggatgtggg

SEQ ID NO: 1561024 - DNA, 16 bp, Homo sapiens
gaggaggggaaggggc

SEQ ID NO: 1561025 - DNA, 20 bp, Homo sapiens
gaggaggggaaggggctgag

SEQ ID NO: 1561026 - DNA, 12 bp, Homo sapiens
gaggagggtggg

SEQ ID NO: 1561027 - DNA, 19 bp, Homo sapiens
gaggaggtgtctggggtga

SEQ ID NO: 1561028 - DNA, 22 bp, Homo sapiens
gaggaggtgtctggggtgaggg

SEQ ID NO: 1561029 - DNA, 14 bp, Homo sapiens
gaggagtggaggtg

SEQ ID NO: 1561030 - DNA, 15 bp, Homo sapiens
gaggatacatttaat

SEQ ID NO: 1561031 - DNA, 16 bp, Homo sapiens
gaggatcactggagcc

SEQ ID NO: 1561032 - DNA, 17 bp, Homo sapiens
gaggatcactggagccc

SEQ ID NO: 1561033 - DNA, 16 bp, Homo sapiens
ggcctgcatggagaag

SEQ ID NO: 1561034 - DNA, 17 bp, Homo sapiens
ggcctgcatggagaagg

SEQ ID NO: 1561035 - DNA, 18 bp, Homo sapiens
ggcctgccctctgcccca

SEQ ID NO: 1561036 - DNA, 20 bp, Homo sapiens
ggcctgcctccagggctgga

SEQ ID NO: 1561037 - DNA, 18 bp, Homo sapiens
ggcctgccttgaagccac

SEQ ID NO: 1561038 - DNA, 14 bp, Homo sapiens
ggcctgctccagac

SEQ ID NO: 1561039 - DNA, 18 bp, Homo sapiens
ggcctgctccagacctga

SEQ ID NO: 1561040 - DNA, 13 bp, Homo sapiens
ggcctgctgccag

SEQ ID NO: 1561041 - DNA, 23 bp, Homo sapiens
ggcctgctgccagtgcagccact

SEQ ID NO: 1561042 - DNA, 20 bp, Homo sapiens
ggcctgctggaggcctcagg

SEQ ID NO: 1561043 - DNA, 21 bp, Homo sapiens
ggcctgctgggaaccccgcag

SEQ ID NO: 1561044 - DNA, 22 bp, Homo sapiens
ggcctgctgggaaccccgcagc

SEQ ID NO: 1561045 - DNA, 19 bp, Homo sapiens
ggcctgcttttccaggatc

SEQ ID NO: 1561046 - DNA, 24 bp, Homo sapiens
ggcctgcttttccaggatcctgca

SEQ ID NO: 1561047 - DNA, 24 bp, Homo sapiens
ggcctggaaccagggaggagagga

SEQ ID NO: 1561048 - DNA, 19 bp, Homo sapiens
ggcctggactgactgcagc

SEQ ID NO: 1561049 - DNA, 21 bp, Homo sapiens
ggcctggactgactgcagccc

SEQ ID NO: 1561050 - DNA, 14 bp, Homo sapiens
ggcctggagatcct

SEQ ID NO: 1561051 - DNA, 17 bp, Homo sapiens
ggcctggagatcctcct

SEQ ID NO: 1561052 - DNA, 19 bp, Homo sapiens
ggcctggagatcctcctgc

SEQ ID NO: 1561053 - DNA, 20 bp, Homo sapiens
ggcctggagatcctcctgca

SEQ ID NO: 1561054 - DNA, 13 bp, Homo sapiens
ggcctggagcatg

SEQ ID NO: 1561055 - DNA, 23 bp, Homo sapiens
ggcctggagccccatcggccaag

SEQ ID NO: 1561056 - DNA, 18 bp, Homo sapiens
ggcctggaggtctggctg

SEQ ID NO: 1561057 - DNA, 19 bp, Homo sapiens
ggcctggaggtctggctga

SEQ ID NO: 1561058 - DNA, 21 bp, Homo sapiens
ggcctggatctccccactcta

SEQ ID NO: 1561059 - DNA, 17 bp, Homo sapiens
ggcctggattcacgccc

SEQ ID NO: 1561060 - DNA, 17 bp, Homo sapiens
ggcctggattcatttcc

SEQ ID NO: 1561061 - DNA, 20 bp, Homo sapiens
ggcctggattcatttcctgc

SEQ ID NO: 1561062 - DNA, 22 bp, Homo sapiens
ggcctggattcatttcctgccc

SEQ ID NO: 1561063 - DNA, 17 bp, Homo sapiens
ggcctggccacctctct

SEQ ID NO: 1561064 - DNA, 15 bp, Homo sapiens
ggcctggccaggagc

SEQ ID NO: 1561065 - DNA, 17 bp, Homo sapiens
ggcctggccaggagctc

SEQ ID NO: 1561066 - DNA, 13 bp, Homo sapiens
ggcctggccagtc

SEQ ID NO: 1561067 - DNA, 21 bp, Homo sapiens
ggcctggccagtcctggtcct

SEQ ID NO: 1561068 - DNA, 15 bp, Homo sapiens
ggcctggccagtctt

SEQ ID NO: 1561069 - DNA, 15 bp, Homo sapiens
ggcctggccatttcc

SEQ ID NO: 1561070 - DNA, 11 bp, Homo sapiens
ggcctggcctc

SEQ ID NO: 1561071 - DNA, 12 bp, Homo sapiens
ggcctggcctcc

SEQ ID NO: 1561072 - DNA, 14 bp, Homo sapiens
ggcctggcctctgg

SEQ ID NO: 1561073 - DNA, 15 bp, Homo sapiens
ggcctggcctctggg

SEQ ID NO: 1561074 - DNA, 16 bp, Homo sapiens
ggcctggcctctgggc

SEQ ID NO: 1561075 - DNA, 15 bp, Homo sapiens
ggcctggcctgagct

SEQ ID NO: 1561076 - DNA, 16 bp, Homo sapiens
ggcctggcctgagctg

SEQ ID NO: 1561077 - DNA, 15 bp, Homo sapiens
ggcctggctccccac

SEQ ID NO: 1561078 - DNA, 21 bp, Homo sapiens
ggcctggcttgctccagggtc

SEQ ID NO: 1561079 - DNA, 11 bp, Homo sapiens
ggcctgggagg

SEQ ID NO: 1561080 - DNA, 20 bp, Homo sapiens
ggcctgggagggttcccctg

SEQ ID NO: 1561081 - DNA, 23 bp, Homo sapiens
ggcctgggagggttcccctggcc

SEQ ID NO: 1561082 - DNA, 22 bp, Homo sapiens
ggcctgggatctggcacactcc

SEQ ID NO: 1561083 - DNA, 15 bp, Homo sapiens
ggcctgggccgctgc

SEQ ID NO: 1561084 - DNA, 12 bp, Homo sapiens
ggcctgggcctc

SEQ ID NO: 1561085 - DNA, 13 bp, Homo sapiens
ggcctgggcctca

SEQ ID NO: 1561086 - DNA, 13 bp, Homo sapiens
ggcctgggcctgc

SEQ ID NO: 1561087 - DNA, 14 bp, Homo sapiens
ggcctggggctcct

SEQ ID NO: 1561088 - DNA, 16 bp, Homo sapiens
ggcctggggctccttt

SEQ ID NO: 1561089 - DNA, 23 bp, Homo sapiens
ggcctggggctcctttctccagc

SEQ ID NO: 1561090 - DNA, 17 bp, Homo sapiens
ggcctgggggcagtgac

SEQ ID NO: 1561091 - DNA, 18 bp, Homo sapiens
ggcctggggtgcatctcc

SEQ ID NO: 1561092 - DNA, 20 bp, Homo sapiens
ggcctggggtgcatctcctc

SEQ ID NO: 1561093 - DNA, 11 bp, Homo sapiens
ggcctggtccc

SEQ ID NO: 1561094 - DNA, 13 bp, Homo sapiens
ggcctggtccctg

SEQ ID NO: 1561095 - DNA, 17 bp, Homo sapiens
ggcctgtagagttgctg

SEQ ID NO: 1561096 - DNA, 15 bp, Homo sapiens
ggcctgtcgtgccag

SEQ ID NO: 1561097 - DNA, 19 bp, Homo sapiens
ggcctgtctcatccccagg

SEQ ID NO: 1561098 - DNA, 12 bp, Homo sapiens
ggcctgtgaatc

SEQ ID NO: 1561099 - DNA, 13 bp, Homo sapiens
ggcctgtgcagca

SEQ ID NO: 1561100 - DNA, 16 bp, Homo sapiens
ggcctgtgcagcagcc

SEQ ID NO: 1561101 - DNA, 17 bp, Homo sapiens
ggcctgtgcagcagccc

SEQ ID NO: 1561102 - DNA, 18 bp, Homo sapiens
ggcctgtgcagcagccca

SEQ ID NO: 1561103 - DNA, 21 bp, Homo sapiens
ggcctgtgcagcagcccagct

SEQ ID NO: 1561104 - DNA, 15 bp, Homo sapiens
ggcctgtggcacagc

SEQ ID NO: 1561105 - DNA, 16 bp, Homo sapiens
ggcctgtggcacagcc

SEQ ID NO: 1561106 - DNA, 17 bp, Homo sapiens
ggcctgtggcacagccc

SEQ ID NO: 1561107 - DNA, 20 bp, Homo sapiens
ggcctgtggcctgtgtccca

SEQ ID NO: 1561108 - DNA, 17 bp, Homo sapiens
ggcctgtgggagcctgc

SEQ ID NO: 1561109 - DNA, 14 bp, Homo sapiens
ggcctgtggggagc

SEQ ID NO: 1561110 - DNA, 16 bp, Homo sapiens
ggcctgtggggagccg

SEQ ID NO: 1561111 - DNA, 17 bp, Homo sapiens
ggcctgtggtggctccc

SEQ ID NO: 1561112 - DNA, 20 bp, Homo sapiens
ggcctgtggtggctccccct

SEQ ID NO: 1561113 - DNA, 17 bp, Homo sapiens
ggcctgtgtccagcagc

SEQ ID NO: 1561114 - DNA, 21 bp, Homo sapiens
ggcctgtgtccagcagctgcg

SEQ ID NO: 1561115 - DNA, 22 bp, Homo sapiens
ggcctgtgtccagcagctgcgg

SEQ ID NO: 1561116 - DNA, 15 bp, Homo sapiens
ggcctgttctcttgg

SEQ ID NO: 1561117 - DNA, 17 bp, Homo sapiens
ggcctgttctcttggct

SEQ ID NO: 1561118 - DNA, 24 bp, Homo sapiens
ggcctgttgctatagagcctacct

SEQ ID NO: 1561119 - DNA, 19 bp, Homo sapiens
ggcctgtttgatgtatgtg

SEQ ID NO: 1561120 - DNA, 18 bp, Homo sapiens
ggcctgtttggcctctct

SEQ ID NO: 1561121 - DNA, 15 bp, Homo sapiens
ggccttaactatttc

SEQ ID NO: 1561122 - DNA, 15 bp, Homo sapiens
ggccttagggcactg

SEQ ID NO: 1561123 - DNA, 20 bp, Homo sapiens
ggccttagggcactgggctg

SEQ ID NO: 1561124 - DNA, 22 bp, Homo sapiens
ggccttatcgggctccagccat

SEQ ID NO: 1561125 - DNA, 14 bp, Homo sapiens
ggccttcaccaagc

SEQ ID NO: 1561126 - DNA, 19 bp, Homo sapiens
ggccttcagtttatttcca

SEQ ID NO: 1561127 - DNA, 14 bp, Homo sapiens
ggccttccagctgc

SEQ ID NO: 1561128 - DNA, 17 bp, Homo sapiens
ggccttccagctgctgt

SEQ ID NO: 1561129 - DNA, 15 bp, Homo sapiens
ggccttccccagcct

SEQ ID NO: 1561130 - DNA, 17 bp, Homo sapiens
ggccttccccagcctct

SEQ ID NO: 1561131 - DNA, 22 bp, Homo sapiens
ggccttccccttttgcctggct

SEQ ID NO: 1561132 - DNA, 23 bp, Homo sapiens
ggccttccccttttgcctggctg

SEQ ID NO: 1561133 - DNA, 16 bp, Homo sapiens
ggccttgaagactccc

SEQ ID NO: 1561134 - DNA, 19 bp, Homo sapiens
ggccttgaagactccctga

SEQ ID NO: 1561135 - DNA, 15 bp, Homo sapiens
ggccttgcagctggc

SEQ ID NO: 1561136 - DNA, 19 bp, Homo sapiens
ggccttgcagctggcccac

SEQ ID NO: 1561137 - DNA, 14 bp, Homo sapiens
ggccttgcccagag

SEQ ID NO: 1561138 - DNA, 21 bp, Homo sapiens
ggccttggtggagcagccaga

SEQ ID NO: 1561139 - DNA, 17 bp, Homo sapiens
ggccttgtgtgtcaggc

SEQ ID NO: 1561140 - DNA, 20 bp, Homo sapiens
ggccttgtgtgtcaggccct

SEQ ID NO: 1561141 - DNA, 21 bp, Homo sapiens
ggcctttatctcaacggaagc

SEQ ID NO: 1561142 - DNA, 23 bp, Homo sapiens
ggcctttgcaagatgcttggttg

SEQ ID NO: 1561143 - DNA, 12 bp, Homo sapiens
ggccttttggat

SEQ ID NO: 1561144 - DNA, 20 bp, Homo sapiens
ggcgacagagcgagactccg

SEQ ID NO: 1561145 - DNA, 11 bp, Homo sapiens
ggcgacctcct

SEQ ID NO: 1561146 - DNA, 22 bp, Homo sapiens
ggcgagcatgggggctgccagc

SEQ ID NO: 1561147 - DNA, 13 bp, Homo sapiens
ggcgagccaggca

SEQ ID NO: 1561148 - DNA, 12 bp, Homo sapiens
ttcatgtttctt

SEQ ID NO: 1561149 - DNA, 20 bp, Homo sapiens
ttcatgttttagcatttgta

SEQ ID NO: 1561150 - DNA, 23 bp, Homo sapiens
ttcattaattagttccagtttct

SEQ ID NO: 1561151 - DNA, 22 bp, Homo sapiens
ttcattatggtagaatcatttt

SEQ ID NO: 1561152 - DNA, 17 bp, Homo sapiens
ttcattatgtaaaatgt

SEQ ID NO: 1561153 - DNA, 22 bp, Homo sapiens
ttcattattagtactgctcttg

SEQ ID NO: 1561154 - DNA, 15 bp, Homo sapiens
ttcattattctctgc

SEQ ID NO: 1561155 - DNA, 24 bp, Homo sapiens
ttcattcaagctatttaatatctg

SEQ ID NO: 1561156 - DNA, 17 bp, Homo sapiens
ttcattcaatattgaca

SEQ ID NO: 1561157 - DNA, 19 bp, Homo sapiens
ttcattcaatattgacatt

SEQ ID NO: 1561158 - DNA, 14 bp, Homo sapiens
ttcattcattcact

SEQ ID NO: 1561159 - DNA, 19 bp, Homo sapiens
ttcattccaaatgctttca

SEQ ID NO: 1561160 - DNA, 22 bp, Homo sapiens
ttcattccggactggcagaagc

SEQ ID NO: 1561161 - DNA, 12 bp, Homo sapiens
ttcattccgtta

SEQ ID NO: 1561162 - DNA, 16 bp, Homo sapiens
ttcattcctaaagaaa

SEQ ID NO: 1561163 - DNA, 18 bp, Homo sapiens
ttcattcctaacacagca

SEQ ID NO: 1561164 - DNA, 23 bp, Homo sapiens
ttcattcgtcttgttgttattga

SEQ ID NO: 1561165 - DNA, 16 bp, Homo sapiens
ttcattctaaaccaaa

SEQ ID NO: 1561166 - DNA, 13 bp, Homo sapiens
ttcattctgcaag

SEQ ID NO: 1561167 - DNA, 18 bp, Homo sapiens
ttcattctgcaagtatac

SEQ ID NO: 1561168 - DNA, 16 bp, Homo sapiens
ttcattctttactgca

SEQ ID NO: 1561169 - DNA, 20 bp, Homo sapiens
ttcattctttactgcactca

SEQ ID NO: 1561170 - DNA, 22 bp, Homo sapiens
ttcattctttactgcactcaga

SEQ ID NO: 1561171 - DNA, 14 bp, Homo sapiens
ttcattgacctcat

SEQ ID NO: 1561172 - DNA, 17 bp, Homo sapiens
ttcattgacctcatcat

SEQ ID NO: 1561173 - DNA, 19 bp, Homo sapiens
ttcattgagagttttgtct

SEQ ID NO: 1561174 - DNA, 22 bp, Homo sapiens
ttcattgagagttttgtcttga

SEQ ID NO: 1561175 - DNA, 19 bp, Homo sapiens
ttcattgcactttgattag

SEQ ID NO: 1561176 - DNA, 16 bp, Homo sapiens
ttcattgcccactagg

SEQ ID NO: 1561177 - DNA, 21 bp, Homo sapiens
ttcattgccttaactggagcc

SEQ ID NO: 1561178 - DNA, 17 bp, Homo sapiens
ttcattgtaaatcactt

SEQ ID NO: 1561179 - DNA, 16 bp, Homo sapiens
ttcattgttttgcaaa

SEQ ID NO: 1561180 - DNA, 17 bp, Homo sapiens
ttcattgttttgcaaaa

SEQ ID NO: 1561181 - DNA, 14 bp, Homo sapiens
ttcatttaaaatga

SEQ ID NO: 1561182 - DNA, 16 bp, Homo sapiens
ttcatttaaaatgatt

SEQ ID NO: 1561183 - DNA, 18 bp, Homo sapiens
ttcatttcagggtcttgg

SEQ ID NO: 1561184 - DNA, 11 bp, Homo sapiens
ttcatttcatt

SEQ ID NO: 1561185 - DNA, 15 bp, Homo sapiens
ttcatttctaattaa

SEQ ID NO: 1561186 - DNA, 14 bp, Homo sapiens
ttcatttgtacaag

SEQ ID NO: 1561187 - DNA, 12 bp, Homo sapiens
ttcatttgtatt

SEQ ID NO: 1561188 - DNA, 16 bp, Homo sapiens
ttcatttgttttgctt

SEQ ID NO: 1561189 - DNA, 17 bp, Homo sapiens
ttcattttagtgactgt

SEQ ID NO: 1561190 - DNA, 20 bp, Homo sapiens
ttcattttcctgttcagtga

SEQ ID NO: 1561191 - DNA, 13 bp, Homo sapiens
ttcattttgagct

SEQ ID NO: 1561192 - DNA, 13 bp, Homo sapiens
ttcattttgcttt

SEQ ID NO: 1561193 - DNA, 15 bp, Homo sapiens
ttcattttgctttaa

SEQ ID NO: 1561194 - DNA, 19 bp, Homo sapiens
ttcattttgttttgctctg

SEQ ID NO: 1561195 - DNA, 23 bp, Homo sapiens
ttcatttttttcactggagttac

SEQ ID NO: 1561196 - DNA, 18 bp, Homo sapiens
ttcatttttttctctctg

SEQ ID NO: 1561197 - DNA, 21 bp, Homo sapiens
ttcatttttttctctctggag

SEQ ID NO: 1561198 - DNA, 21 bp, Homo sapiens
ttccaaaaagattttcagaaa

SEQ ID NO: 1561199 - DNA, 15 bp, Homo sapiens
ttccaaaacctgctt

SEQ ID NO: 1561200 - DNA, 17 bp, Homo sapiens
ttccaaaagtgatagtg

SEQ ID NO: 1561201 - DNA, 19 bp, Homo sapiens
ttccaaaatattgacattg

SEQ ID NO: 1561202 - DNA, 16 bp, Homo sapiens
ttccaaacatccaaaa

SEQ ID NO: 1561203 - DNA, 14 bp, Homo sapiens
ttccaaacatggtt

SEQ ID NO: 1561204 - DNA, 14 bp, Homo sapiens
ttccaaaccctcct

SEQ ID NO: 1561205 - DNA, 20 bp, Homo sapiens
ttccaaactcttccctctct

SEQ ID NO: 1561206 - DNA, 19 bp, Homo sapiens
ttccaaagcacattgaaag

SEQ ID NO: 1561207 - DNA, 20 bp, Homo sapiens
ttccaaagcacattgaaaga

SEQ ID NO: 1561208 - DNA, 16 bp, Homo sapiens
ttccaaagtcacagga

SEQ ID NO: 1561209 - DNA, 16 bp, Homo sapiens
ttccaaagtctctaat

SEQ ID NO: 1561210 - DNA, 22 bp, Homo sapiens
ttccaaatcctggaaggacaca

SEQ ID NO: 1561211 - DNA, 19 bp, Homo sapiens
ttccaaatgatcctagtaa

SEQ ID NO: 1561212 - DNA, 21 bp, Homo sapiens
ttccaaatgtaataaacttta

SEQ ID NO: 1561213 - DNA, 15 bp, Homo sapiens
ttccaaattcacaag

SEQ ID NO: 1561214 - DNA, 15 bp, Homo sapiens
ttccaaattctgctt

SEQ ID NO: 1561215 - DNA, 23 bp, Homo sapiens
ttccaaattgccctatgctgtgc

SEQ ID NO: 1561216 - DNA, 20 bp, Homo sapiens
ttccaacaccacagacacac

SEQ ID NO: 1561217 - DNA, 11 bp, Homo sapiens
ttccaacagca

SEQ ID NO: 1561218 - DNA, 17 bp, Homo sapiens
ttccaaccatttatctt

SEQ ID NO: 1561219 - DNA, 18 bp, Homo sapiens
ttccaacctcacttcccg

SEQ ID NO: 1561220 - DNA, 14 bp, Homo sapiens
ttccaactcaggtt

SEQ ID NO: 1561221 - DNA, 16 bp, Homo sapiens
ttccaagacagagtct

SEQ ID NO: 1561222 - DNA, 15 bp, Homo sapiens
ttccaagactctaga

SEQ ID NO: 1561223 - DNA, 14 bp, Homo sapiens
ttccaagagtctaa

SEQ ID NO: 1561224 - DNA, 22 bp, Homo sapiens
ttccaagttccccatccctgtc

SEQ ID NO: 1561225 - DNA, 21 bp, Homo sapiens
ttccaattttctggaatacat

SEQ ID NO: 1561226 - DNA, 16 bp, Homo sapiens
ttccacaaaattagaa

SEQ ID NO: 1561227 - DNA, 22 bp, Homo sapiens
ttccacaaaattagaaaggaca

SEQ ID NO: 1561228 - DNA, 19 bp, Homo sapiens
ttccacaagattcccagag

SEQ ID NO: 1561229 - DNA, 22 bp, Homo sapiens
ttccacagcacaaacacacctc

SEQ ID NO: 1561230 - DNA, 15 bp, Homo sapiens
ttccacagcagcaga

SEQ ID NO: 1561231 - DNA, 16 bp, Homo sapiens
ttccacagcagcagaa

SEQ ID NO: 1561232 - DNA, 11 bp, Homo sapiens
ttccaccagcc

SEQ ID NO: 1561233 - DNA, 18 bp, Homo sapiens
ttccaccccaagagaact

SEQ ID NO: 1561234 - DNA, 19 bp, Homo sapiens
ttccaccccaagagaactc

SEQ ID NO: 1561235 - DNA, 18 bp, Homo sapiens
ttcccagctccccccgcc

SEQ ID NO: 1561236 - DNA, 22 bp, Homo sapiens
ttcccagctccccccgcccacc

SEQ ID NO: 1561237 - DNA, 14 bp, Homo sapiens
ttcccagctctccc

SEQ ID NO: 1561238 - DNA, 19 bp, Homo sapiens
ttcccagctctccctctgg

SEQ ID NO: 1561239 - DNA, 21 bp, Homo sapiens
ttcccaggaggtgcagacttc

SEQ ID NO: 1561240 - DNA, 12 bp, Homo sapiens
ttcccaggccca

SEQ ID NO: 1561241 - DNA, 12 bp, Homo sapiens
ttcccagtattt

SEQ ID NO: 1561242 - DNA, 14 bp, Homo sapiens
ttcccagttaaaga

SEQ ID NO: 1561243 - DNA, 15 bp, Homo sapiens
ttcccataattttct

SEQ ID NO: 1561244 - DNA, 18 bp, Homo sapiens
ttcccataattttcttca

SEQ ID NO: 1561245 - DNA, 22 bp, Homo sapiens
ttcccatagtggggcctgggag

SEQ ID NO: 1561246 - DNA, 23 bp, Homo sapiens
ttcccatcactggagcaccaggc

SEQ ID NO: 1561247 - DNA, 14 bp, Homo sapiens
ttcccatcctaccc

SEQ ID NO: 1561248 - DNA, 16 bp, Homo sapiens
ttcccatgtatttgtt

SEQ ID NO: 1561249 - DNA, 15 bp, Homo sapiens
ttcccatttagaatg

SEQ ID NO: 1561250 - DNA, 18 bp, Homo sapiens
ttcccatttctctacact

SEQ ID NO: 1561251 - DNA, 15 bp, Homo sapiens
ttcccatttcttccc

SEQ ID NO: 1561252 - DNA, 14 bp, Homo sapiens
ttcccattttgcaa

SEQ ID NO: 1561253 - DNA, 15 bp, Homo sapiens
ttccccacacagggc

SEQ ID NO: 1561254 - DNA, 23 bp, Homo sapiens
ttccccacccccctctctttctc

SEQ ID NO: 1561255 - DNA, 17 bp, Homo sapiens
ttccccactgacagcct

SEQ ID NO: 1561256 - DNA, 23 bp, Homo sapiens
ttccccactgacagcctcccacc

SEQ ID NO: 1561257 - DNA, 22 bp, Homo sapiens
ttccccacttctgtgccacccc

SEQ ID NO: 1561258 - DNA, 12 bp, Homo sapiens
ttccccagagaa

SEQ ID NO: 1561259 - DNA, 18 bp, Homo sapiens
ttccccagaggctcccaa

SEQ ID NO: 1561260 - DNA, 24 bp, Homo sapiens
ttccccagaggctcccaatcagct

SEQ ID NO: 1561261 - DNA, 12 bp, Homo sapiens
ttccccagccac

SEQ ID NO: 1561262 - DNA, 14 bp, Homo sapiens
ttccccagctctca

SEQ ID NO: 1561263 - DNA, 17 bp, Homo sapiens
ttccccagggaaggaaa

SEQ ID NO: 1561264 - DNA, 18 bp, Homo sapiens
ttccccaggggaaaatga

SEQ ID NO: 1561265 - DNA, 23 bp, Homo sapiens
ttccccatctttgatccttctga

SEQ ID NO: 1561266 - DNA, 11 bp, Homo sapiens
ttccccatggg

SEQ ID NO: 1561267 - DNA, 17 bp, Homo sapiens
ttccccatggggctgcg

SEQ ID NO: 1561268 - DNA, 22 bp, Homo sapiens
ttccccattatatcacacttat

SEQ ID NO: 1561269 - DNA, 14 bp, Homo sapiens
tcatgtacttcctg

SEQ ID NO: 1561270 - DNA, 15 bp, Homo sapiens
tcatgtatgatgagc

SEQ ID NO: 1561271 - DNA, 13 bp, Homo sapiens
tcatgtcctgtcc

SEQ ID NO: 1561272 - DNA, 16 bp, Homo sapiens
tcatgtcctgtcctgg

SEQ ID NO: 1561273 - DNA, 20 bp, Homo sapiens
tcatgtctgaaacagagaac

SEQ ID NO: 1561274 - DNA, 11 bp, Homo sapiens
tcatgtctgta

SEQ ID NO: 1561275 - DNA, 18 bp, Homo sapiens
tcatgtgcatctggtgta

SEQ ID NO: 1561276 - DNA, 14 bp, Homo sapiens
tcatgtgtataaaa

SEQ ID NO: 1561277 - DNA, 15 bp, Homo sapiens
tcatgtgtataaaaa

SEQ ID NO: 1561278 - DNA, 23 bp, Homo sapiens
tcatgttagttaccttatagtta

SEQ ID NO: 1561279 - DNA, 12 bp, Homo sapiens
tcatgttatttt

SEQ ID NO: 1561280 - DNA, 16 bp, Homo sapiens
tcatgttcactgtgag

SEQ ID NO: 1561281 - DNA, 16 bp, Homo sapiens
tcatgttcatgtgatt

SEQ ID NO: 1561282 - DNA, 13 bp, Homo sapiens
tcatgttccaaat

SEQ ID NO: 1561283 - DNA, 13 bp, Homo sapiens
tcatgttctgtgg

SEQ ID NO: 1561284 - DNA, 19 bp, Homo sapiens
tcatgttgatcatgtactt

SEQ ID NO: 1561285 - DNA, 15 bp, Homo sapiens
tcatgtttgctctcc

SEQ ID NO: 1561286 - DNA, 15 bp, Homo sapiens
tcatgtttgcttcat

SEQ ID NO: 1561287 - DNA, 21 bp, Homo sapiens
tcatgttttgatgagaaaaaa

SEQ ID NO: 1561288 - DNA, 12 bp, Homo sapiens
tcatgtttttga

SEQ ID NO: 1561289 - DNA, 15 bp, Homo sapiens
tcatgtttttgatca

SEQ ID NO: 1561290 - DNA, 14 bp, Homo sapiens
tcattaaacttgaa

SEQ ID NO: 1561291 - DNA, 12 bp, Homo sapiens
tcattaaataaa

SEQ ID NO: 1561292 - DNA, 13 bp, Homo sapiens
tcattaaataaat

SEQ ID NO: 1561293 - DNA, 22 bp, Homo sapiens
tcattaaggttatgcactgcct

SEQ ID NO: 1561294 - DNA, 22 bp, Homo sapiens
tcattaatagctgccttcaagg

SEQ ID NO: 1561295 - DNA, 14 bp, Homo sapiens
tcattaatgtaata

SEQ ID NO: 1561296 - DNA, 14 bp, Homo sapiens
tcattacaaatggt

SEQ ID NO: 1561297 - DNA, 18 bp, Homo sapiens
tcattacaattttctgta

SEQ ID NO: 1561298 - DNA, 19 bp, Homo sapiens
tcattacaattttctgtaa

SEQ ID NO: 1561299 - DNA, 15 bp, Homo sapiens
tcattacagttcttt

SEQ ID NO: 1561300 - DNA, 17 bp, Homo sapiens
tcattactggtaaagcc

SEQ ID NO: 1561301 - DNA, 16 bp, Homo sapiens
tcattataatctcaaa

SEQ ID NO: 1561302 - DNA, 17 bp, Homo sapiens
tcattataatctcaaag

SEQ ID NO: 1561303 - DNA, 22 bp, Homo sapiens
tcattataatgtcattaaacat

SEQ ID NO: 1561304 - DNA, 19 bp, Homo sapiens
tcattatctcaaaactgca

SEQ ID NO: 1561305 - DNA, 20 bp, Homo sapiens
tcattatgtaaaatgtttta

SEQ ID NO: 1561306 - DNA, 13 bp, Homo sapiens
tcattatgtcaac

SEQ ID NO: 1561307 - DNA, 18 bp, Homo sapiens
tcattattcaagaatgaa

SEQ ID NO: 1561308 - DNA, 22 bp, Homo sapiens
tcattattcaagaatgaaaaat

SEQ ID NO: 1561309 - DNA, 15 bp, Homo sapiens
tcattcaaatcagtg

SEQ ID NO: 1561310 - DNA, 19 bp, Homo sapiens
tcattcaaatcagtgatct

SEQ ID NO: 1561311 - DNA, 21 bp, Homo sapiens
tcattcaaatcagtgatctat

SEQ ID NO: 1561312 - DNA, 22 bp, Homo sapiens
tcattcaaatcagtgatctatg

SEQ ID NO: 1561313 - DNA, 14 bp, Homo sapiens
tcattcaagctatt

SEQ ID NO: 1561314 - DNA, 20 bp, Homo sapiens
tgtgatttcctaaacataat

SEQ ID NO: 1561315 - DNA, 21 bp, Homo sapiens
tgtgatttcctaaacataatt

SEQ ID NO: 1561316 - DNA, 14 bp, Homo sapiens
tgtgatttcctaca

SEQ ID NO: 1561317 - DNA, 17 bp, Homo sapiens
tgtgatttcctacagaa

SEQ ID NO: 1561318 - DNA, 12 bp, Homo sapiens
tgtgatttttgt

SEQ ID NO: 1561319 - DNA, 18 bp, Homo sapiens
tgtgatttttgtttgcag

SEQ ID NO: 1561320 - DNA, 14 bp, Homo sapiens
tgtgcaacagacaa

SEQ ID NO: 1561321 - DNA, 14 bp, Homo sapiens
tgtgcaacggccag

SEQ ID NO: 1561322 - DNA, 22 bp, Homo sapiens
tgtgcaataatttgtacaatgg

SEQ ID NO: 1561323 - DNA, 15 bp, Homo sapiens
tgtgcaatacatttt

SEQ ID NO: 1561324 - DNA, 22 bp, Homo sapiens
tgtgcaataggtgagagaatgt

SEQ ID NO: 1561325 - DNA, 15 bp, Homo sapiens
tgtgcacaattctgt

SEQ ID NO: 1561326 - DNA, 20 bp, Homo sapiens
tgtgcacaattctgttttag

SEQ ID NO: 1561327 - DNA, 17 bp, Homo sapiens
tgtgcacagtggcttct

SEQ ID NO: 1561328 - DNA, 19 bp, Homo sapiens
tgtgcacagtggcttcttt

SEQ ID NO: 1561329 - DNA, 21 bp, Homo sapiens
tgtgcacatacgggctttaat

SEQ ID NO: 1561330 - DNA, 10 bp, Homo sapiens
tgtgcacatc

SEQ ID NO: 1561331 - DNA, 14 bp, Homo sapiens
tgtgcacatttctt

SEQ ID NO: 1561332 - DNA, 21 bp, Homo sapiens
tgtgcacgagtgggaaggact

SEQ ID NO: 1561333 - DNA, 21 bp, Homo sapiens
tgtgcactgcctgcatgagct

SEQ ID NO: 1561334 - DNA, 15 bp, Homo sapiens
tgtgcagaagacgcc

SEQ ID NO: 1561335 - DNA, 18 bp, Homo sapiens
tgtgcagacagccatgcg

SEQ ID NO: 1561336 - DNA, 17 bp, Homo sapiens
tgtgcagggagggcagt

SEQ ID NO: 1561337 - DNA, 19 bp, Homo sapiens
tgtgcagggatattgcctt

SEQ ID NO: 1561338 - DNA, 20 bp, Homo sapiens
tgtgcatagcgtcctgccct

SEQ ID NO: 1561339 - DNA, 17 bp, Homo sapiens
tgtgcatgtgctgtgtg

SEQ ID NO: 1561340 - DNA, 12 bp, Homo sapiens
tgtgcatgtgtg

SEQ ID NO: 1561341 - DNA, 15 bp, Homo sapiens
tgtgcatgtgtgtgt

SEQ ID NO: 1561342 - DNA, 14 bp, Homo sapiens
tgtgccaacctgtt

SEQ ID NO: 1561343 - DNA, 22 bp, Homo sapiens
tgtgccaactgccaggctgcct

SEQ ID NO: 1561344 - DNA, 23 bp, Homo sapiens
tgtgccactcaccgaagccactt

SEQ ID NO: 1561345 - DNA, 23 bp, Homo sapiens
tgtgccagaggaatcctggcagc

SEQ ID NO: 1561346 - DNA, 16 bp, Homo sapiens
tgtgccagttcctgta

SEQ ID NO: 1561347 - DNA, 20 bp, Homo sapiens
tgtgcccacccgtcttcaat

SEQ ID NO: 1561348 - DNA, 14 bp, Homo sapiens
tgtgcccagcaggc

SEQ ID NO: 1561349 - DNA, 18 bp, Homo sapiens
tgtgcccagcaggcccag

SEQ ID NO: 1561350 - DNA, 19 bp, Homo sapiens
tgtgcccagcaggcccagc

SEQ ID NO: 1561351 - DNA, 13 bp, Homo sapiens
tgtgccccactcc

SEQ ID NO: 1561352 - DNA, 14 bp, Homo sapiens
tgtgccccactcca

SEQ ID NO: 1561353 - DNA, 22 bp, Homo sapiens
tgtgccccactccagcctgggg

SEQ ID NO: 1561354 - DNA, 23 bp, Homo sapiens
tgtgccccatgcctgtccagcct

SEQ ID NO: 1561355 - DNA, 15 bp, Homo sapiens
tgtgccctgcctcca

SEQ ID NO: 1561356 - DNA, 11 bp, Homo sapiens
tgtgccctggt

SEQ ID NO: 1561357 - DNA, 13 bp, Homo sapiens
tgtgccctggtgg

SEQ ID NO: 1561358 - DNA, 12 bp, Homo sapiens
tgtgcccttggg

SEQ ID NO: 1561359 - DNA, 16 bp, Homo sapiens
tgtgccgtaattatgt

SEQ ID NO: 1561360 - DNA, 17 bp, Homo sapiens
tgtgccgtaattatgta

SEQ ID NO: 1561361 - DNA, 14 bp, Homo sapiens
tgtgcctcccccca

SEQ ID NO: 1561362 - DNA, 16 bp, Homo sapiens
tgtgcctccccccaga

SEQ ID NO: 1561363 - DNA, 12 bp, Homo sapiens
tgtgcctcctca

SEQ ID NO: 1561364 - DNA, 15 bp, Homo sapiens
tgtgcctctgggact

SEQ ID NO: 1561365 - DNA, 16 bp, Homo sapiens
tgtgcctctgggactg

SEQ ID NO: 1561366 - DNA, 16 bp, Homo sapiens
tgtgcctgcaccagga

SEQ ID NO: 1561367 - DNA, 13 bp, Homo sapiens
tgtgcctgcagcc

SEQ ID NO: 1561368 - DNA, 13 bp, Homo sapiens
tgtgcctgctaga

SEQ ID NO: 1561369 - DNA, 19 bp, Homo sapiens
tgtgcctgctagagcaacc

SEQ ID NO: 1561370 - DNA, 14 bp, Homo sapiens
tgtgcctgggccct

SEQ ID NO: 1561371 - DNA, 13 bp, Homo sapiens
tgtgcctgtgctc

SEQ ID NO: 1561372 - DNA, 20 bp, Homo sapiens
tgtgcctgtgctcctgccca

SEQ ID NO: 1561373 - DNA, 22 bp, Homo sapiens
tgtgcctgtgctcctgcccagg

SEQ ID NO: 1561374 - DNA, 21 bp, Homo sapiens
tgtgccttaaaaggagagaag

SEQ ID NO: 1561375 - DNA, 16 bp, Homo sapiens
tgtgccttaagtttta

SEQ ID NO: 1561376 - DNA, 16 bp, Homo sapiens
tgtgccttcttttgat

SEQ ID NO: 1561377 - DNA, 17 bp, Homo sapiens
tgtgcctttctttgcct

SEQ ID NO: 1561378 - DNA, 18 bp, Homo sapiens
tgtgcctttctttgcctc

SEQ ID NO: 1561379 - DNA, 20 bp, Homo sapiens
tgtgcctttctttgcctctg

SEQ ID NO: 1561380 - DNA, 16 bp, Homo sapiens
tgtgcctttggcctgg

SEQ ID NO: 1561381 - DNA, 13 bp, Homo sapiens
tgtgccttttctg

SEQ ID NO: 1561382 - DNA, 16 bp, Homo sapiens
tgtgcgctgcctggcc

SEQ ID NO: 1561383 - DNA, 22 bp, Homo sapiens
tgtgcgctgcctggccaggccc

SEQ ID NO: 1561384 - DNA, 15 bp, Homo sapiens
tgtgcgtcccagctg

SEQ ID NO: 1561385 - DNA, 19 bp, Homo sapiens
tgtgcgtctctctttctcc

SEQ ID NO: 1561386 - DNA, 18 bp, Homo sapiens
tgtgctaatcaaaacttt

SEQ ID NO: 1561387 - DNA, 14 bp, Homo sapiens
tgtgctacagatga

SEQ ID NO: 1561388 - DNA, 16 bp, Homo sapiens
tgtgctacccctttga

SEQ ID NO: 1561389 - DNA, 16 bp, Homo sapiens
tgtgctagaatacttt

SEQ ID NO: 1561390 - DNA, 13 bp, Homo sapiens
tgtgctagatgtg

SEQ ID NO: 1561391 - DNA, 20 bp, Homo sapiens
tgtgctagggaaacttcccg

SEQ ID NO: 1561392 - DNA, 16 bp, Homo sapiens
tgtgctagtcactggc

SEQ ID NO: 1561393 - DNA, 22 bp, Homo sapiens
tgtgctagtcactggcagcctg

SEQ ID NO: 1561394 - DNA, 11 bp, Homo sapiens
tgtgctatttg

SEQ ID NO: 1561395 - DNA, 21 bp, Homo sapiens
tgtgctatttgtacaaataaa

SEQ ID NO: 1561396 - DNA, 14 bp, Homo sapiens
tgtgctcacgctcc

SEQ ID NO: 1561397 - DNA, 17 bp, Homo sapiens
tgtgctcccctgccaca

SEQ ID NO: 1561398 - DNA, 23 bp, Homo sapiens
tgtgctcccctgccacactgatg

SEQ ID NO: 1561399 - DNA, 17 bp, Homo sapiens
tgtgctcccctttgcct

SEQ ID NO: 1561400 - DNA, 14 bp, Homo sapiens
tgtgctccgtgcct

SEQ ID NO: 1561401 - DNA, 23 bp, Homo sapiens
tgtgctcctcttgattcctggtt

SEQ ID NO: 1561402 - DNA, 20 bp, Homo sapiens
tgtgctcctgcccaggagca

SEQ ID NO: 1561403 - DNA, 17 bp, Homo sapiens
tgtgctctccccggcag

SEQ ID NO: 1561404 - DNA, 13 bp, Homo sapiens
tgtgctctggagg

SEQ ID NO: 1561405 - DNA, 15 bp, Homo sapiens
tgtgctctggcacca

SEQ ID NO: 1561406 - DNA, 21 bp, Homo sapiens
tgtgctctggcaccatcagcc

SEQ ID NO: 1561407 - DNA, 16 bp, Homo sapiens
tgtgctctgttccatt

SEQ ID NO: 1561408 - DNA, 19 bp, Homo sapiens
tgtgctcttgttttgtctt

SEQ ID NO: 1561409 - DNA, 15 bp, Homo sapiens
tgtgctctttgaaga

SEQ ID NO: 1561410 - DNA, 19 bp, Homo sapiens
tgtgctgacaacttagctc

SEQ ID NO: 1561411 - DNA, 22 bp, Homo sapiens
tgtgctgacaacttagctcagg

SEQ ID NO: 1561412 - DNA, 16 bp, Homo sapiens
tgtgctgatcctgctg

SEQ ID NO: 1561413 - DNA, 17 bp, Homo sapiens
tgtgctgatcctgctga

SEQ ID NO: 1561414 - DNA, 22 bp, Homo sapiens
tgtgctgcatgcgacagcgtcc

SEQ ID NO: 1561415 - DNA, 12 bp, Homo sapiens
tgtgctgggagc

SEQ ID NO: 1561416 - DNA, 12 bp, Homo sapiens
tgtgctgtaatt

SEQ ID NO: 1561417 - DNA, 14 bp, Homo sapiens
tgtgctgtgcctgc

SEQ ID NO: 1561418 - DNA, 22 bp, Homo sapiens
tgtgctgtgtgagtgagcacac

SEQ ID NO: 1561419 - DNA, 15 bp, Homo sapiens
tgtgctgtgtgtgac

SEQ ID NO: 1561420 - DNA, 13 bp, Homo sapiens
tgtgcttacagta

SEQ ID NO: 1561421 - DNA, 15 bp, Homo sapiens
tgtgcttcacagtag

SEQ ID NO: 1561422 - DNA, 17 bp, Homo sapiens
tgtgcttcgactactgc

SEQ ID NO: 1561423 - DNA, 15 bp, Homo sapiens
tgtgcttgaaggccc

SEQ ID NO: 1561424 - DNA, 17 bp, Homo sapiens
tgtgcttgaaggccctg

SEQ ID NO: 1561425 - DNA, 14 bp, Homo sapiens
tgtgcttggggcta

SEQ ID NO: 1561426 - DNA, 19 bp, Homo sapiens
tgtgcttgtgacaaactgg

SEQ ID NO: 1561427 - DNA, 19 bp, Homo sapiens
tgtgcttgttttataaaat

SEQ ID NO: 1561428 - DNA, 14 bp, Homo sapiens
tgtgcttttcctga

SEQ ID NO: 1561429 - DNA, 22 bp, Homo sapiens
tgtgctttttaagaatattttt

SEQ ID NO: 1561430 - DNA, 16 bp, Homo sapiens
tgtggtgtgagcttca

SEQ ID NO: 1561431 - DNA, 21 bp, Homo sapiens
tgtggttacagtgcagacagg

SEQ ID NO: 1561432 - DNA, 22 bp, Homo sapiens
tgtggttccatgcagccttggg

SEQ ID NO: 1561433 - DNA, 12 bp, Homo sapiens
tgtggttgaaaa

SEQ ID NO: 1561434 - DNA, 18 bp, Homo sapiens
tgtggtttactagcagga

SEQ ID NO: 1561435 - DNA, 22 bp, Homo sapiens
tgtggtttcagatgtgcaataa

SEQ ID NO: 1561436 - DNA, 13 bp, Homo sapiens
tgtggtttggaat

SEQ ID NO: 1561437 - DNA, 18 bp, Homo sapiens
tgtggtttggaatattaa

SEQ ID NO: 1561438 - DNA, 18 bp, Homo sapiens
tgtggttttcccctccct

SEQ ID NO: 1561439 - DNA, 20 bp, Homo sapiens
tgtgtaaaaaatggaaaaaa

SEQ ID NO: 1561440 - DNA, 14 bp, Homo sapiens
tgtgtaaaatgtga

SEQ ID NO: 1561441 - DNA, 19 bp, Homo sapiens
tgtgtaaaggtttcatgtt

SEQ ID NO: 1561442 - DNA, 22 bp, Homo sapiens
tgtgtaacatccaagccagagt

SEQ ID NO: 1561443 - DNA, 14 bp, Homo sapiens
tgtgtaagattttt

SEQ ID NO: 1561444 - DNA, 16 bp, Homo sapiens
tgtgtaatctctgatt

SEQ ID NO: 1561445 - DNA, 10 bp, Homo sapiens
tgtgtaatta

SEQ ID NO: 1561446 - DNA, 21 bp, Homo sapiens
tgtgtaattagtgccacttaa

SEQ ID NO: 1561447 - DNA, 18 bp, Homo sapiens
tgtgtaatttaaaattgt

SEQ ID NO: 1561448 - DNA, 23 bp, Homo sapiens
tgtgtaatttaaaattgtgatgt

SEQ ID NO: 1561449 - DNA, 16 bp, Homo sapiens
tgtgtaatttaagtga

SEQ ID NO: 1561450 - DNA, 18 bp, Homo sapiens
tgtgtacagatgaatgat

SEQ ID NO: 1561451 - DNA, 15 bp, Homo sapiens
tgtgtacagtgaatt

SEQ ID NO: 1561452 - DNA, 20 bp, Homo sapiens
tgtgtacagtgaattgtctt

SEQ ID NO: 1561453 - DNA, 21 bp, Homo sapiens
tgtgtacagtgaattgtcttt

SEQ ID NO: 1561454 - DNA, 23 bp, Homo sapiens
tgtgtacagtgaattgtctttta

SEQ ID NO: 1561455 - DNA, 15 bp, Homo sapiens
tgtgtacataactga

SEQ ID NO: 1561456 - DNA, 14 bp, Homo sapiens
tgtgtacatatatg

SEQ ID NO: 1561457 - DNA, 21 bp, Homo sapiens
tgtgtaccacttcctgaggcc

SEQ ID NO: 1561458 - DNA, 17 bp, Homo sapiens
tgtgtaccttaagatat

SEQ ID NO: 1561459 - DNA, 14 bp, Homo sapiens
tgtgtactctgtcc

SEQ ID NO: 1561460 - DNA, 16 bp, Homo sapiens
tgtgtactgataaaat

SEQ ID NO: 1561461 - DNA, 13 bp, Homo sapiens
tgtgtagcctttt

SEQ ID NO: 1561462 - DNA, 13 bp, Homo sapiens
tgtgtatatggta

SEQ ID NO: 1561463 - DNA, 18 bp, Homo sapiens
tgtgtatattttaatgaa

SEQ ID NO: 1561464 - DNA, 14 bp, Homo sapiens
tgtgtatgtactta

SEQ ID NO: 1561465 - DNA, 13 bp, Homo sapiens
tgtgtatgtgggg

SEQ ID NO: 1561466 - DNA, 13 bp, Homo sapiens
tgtgtatgtgtgt

SEQ ID NO: 1561467 - DNA, 17 bp, Homo sapiens
tgtgtattcagaggcag

SEQ ID NO: 1561468 - DNA, 14 bp, Homo sapiens
tgtgtattccaaga

SEQ ID NO: 1561469 - DNA, 18 bp, Homo sapiens
tgtgtattgatgcaatat

SEQ ID NO: 1561470 - DNA, 14 bp, Homo sapiens
tgtgtatttgtatt

SEQ ID NO: 1561471 - DNA, 15 bp, Homo sapiens
tgtgtatttgtatta

SEQ ID NO: 1561472 - DNA, 17 bp, Homo sapiens
tgtgtcaaaactggttt

SEQ ID NO: 1561473 - DNA, 23 bp, Homo sapiens
tgtgtcactgcatggcttctgaa

SEQ ID NO: 1561474 - DNA, 21 bp, Homo sapiens
tgtgtcagaaacatgaaatgc

SEQ ID NO: 1561475 - DNA, 21 bp, Homo sapiens
tgtgtcagagcccagcccagg

SEQ ID NO: 1561476 - DNA, 14 bp, Homo sapiens
tgtgtcagctgagg

SEQ ID NO: 1561477 - DNA, 19 bp, Homo sapiens
tgtgtcataccagaaagct

SEQ ID NO: 1561478 - DNA, 13 bp, Homo sapiens
tgtgtccagcagc

SEQ ID NO: 1561479 - DNA, 16 bp, Homo sapiens
tgtgtccagcagctgc

SEQ ID NO: 1561480 - DNA, 16 bp, Homo sapiens
tgtgtccatcccagcg

SEQ ID NO: 1561481 - DNA, 20 bp, Homo sapiens
tgtgtccatgcgctcagggc

SEQ ID NO: 1561482 - DNA, 13 bp, Homo sapiens
tgtgtcccaggca

SEQ ID NO: 1561483 - DNA, 14 bp, Homo sapiens
tgtgtcccaggcag

SEQ ID NO: 1561484 - DNA, 14 bp, Homo sapiens
tgtgtcccatgacc

SEQ ID NO: 1561485 - DNA, 22 bp, Homo sapiens
tgtgtcccatgacccacccctg

SEQ ID NO: 1561486 - DNA, 14 bp, Homo sapiens
tgtgtccctggaca

SEQ ID NO: 1561487 - DNA, 15 bp, Homo sapiens
tgtgtccctggacac

SEQ ID NO: 1561488 - DNA, 14 bp, Homo sapiens
tgtgtcctcaggga

SEQ ID NO: 1561489 - DNA, 20 bp, Homo sapiens
tgtgtcctgaaacgctcctt

SEQ ID NO: 1561490 - DNA, 12 bp, Homo sapiens
tgtgtcctggta

SEQ ID NO: 1561491 - DNA, 22 bp, Homo sapiens
tgtgtcctggtaattcctctcc

SEQ ID NO: 1561492 - DNA, 22 bp, Homo sapiens
tgtgtcctgtcctttcttgcag

SEQ ID NO: 1561493 - DNA, 23 bp, Homo sapiens
tgtgtcctgtcctttcttgcaga

SEQ ID NO: 1561494 - DNA, 14 bp, Homo sapiens
tgtgtccttgcacc

SEQ ID NO: 1561495 - DNA, 18 bp, Homo sapiens
tgtgtcctttggtactat

SEQ ID NO: 1561496 - DNA, 19 bp, Homo sapiens
tgtgtctaaatttgaatgt

SEQ ID NO: 1561497 - DNA, 15 bp, Homo sapiens
tgtgtctaagattct

SEQ ID NO: 1561498 - DNA, 19 bp, Homo sapiens
tgtgtctaagattctagat

SEQ ID NO: 1561499 - DNA, 16 bp, Homo sapiens
tgtgtctcctctcaga

SEQ ID NO: 1561500 - DNA, 21 bp, Homo sapiens
tgtgtctgccaaacacattta

SEQ ID NO: 1561501 - DNA, 12 bp, Homo sapiens
tgtgtctgctga

SEQ ID NO: 1561502 - DNA, 13 bp, Homo sapiens
tgtgtctggtgca

SEQ ID NO: 1561503 - DNA, 16 bp, Homo sapiens
tgtgtctggtgcagaa

SEQ ID NO: 1561504 - DNA, 21 bp, Homo sapiens
tgtgtctgtacacgtgtcctg

SEQ ID NO: 1561505 - DNA, 19 bp, Homo sapiens
tgtgtctgtctttgtggga

SEQ ID NO: 1561506 - DNA, 14 bp, Homo sapiens
tgtgtcttaattat

SEQ ID NO: 1561507 - DNA, 21 bp, Homo sapiens
tgtgtcttatgaggaattgga

SEQ ID NO: 1561508 - DNA, 18 bp, Homo sapiens
tgtgtcttcattttcatt

SEQ ID NO: 1561509 - DNA, 22 bp, Homo sapiens
tgtgtgaaacaatgttgtccaa

SEQ ID NO: 1561510 - DNA, 20 bp, Homo sapiens
tgtgtgacaattctgttttt

SEQ ID NO: 1561511 - DNA, 21 bp, Homo sapiens
tgtgtgagacttaaaacatgg

SEQ ID NO: 1561512 - DNA, 20 bp, Homo sapiens
tgtgtgaggagctgctggct

SEQ ID NO: 1561513 - DNA, 14 bp, Homo sapiens
tgtgtgagttgagt

SEQ ID NO: 1561514 - DNA, 18 bp, Homo sapiens
tgtgtgatatttcagaaa

SEQ ID NO: 1561515 - DNA, 19 bp, Homo sapiens
tgtgtgatccggtttcttt

SEQ ID NO: 1561516 - DNA, 20 bp, Homo sapiens
tgtgtgatttcctaaacata

SEQ ID NO: 1561517 - DNA, 23 bp, Homo sapiens
tgtgtgatttcctaaacataatt

SEQ ID NO: 1561518 - DNA, 22 bp, Homo sapiens
tgtgtgcaacagggtatggact

SEQ ID NO: 1561519 - DNA, 18 bp, Homo sapiens
tgtgtgcagagtccattt

SEQ ID NO: 1561520 - DNA, 13 bp, Homo sapiens
tgtgtgcccagca

SEQ ID NO: 1561521 - DNA, 17 bp, Homo sapiens
tgtgtgcccagcacctg

SEQ ID NO: 1561522 - DNA, 17 bp, Homo sapiens
tgtgtgccccactccag

SEQ ID NO: 1561523 - DNA, 16 bp, Homo sapiens
tgtgtgcctgtggcag

SEQ ID NO: 1561524 - DNA, 14 bp, Homo sapiens
tgtgtgcttacagt

SEQ ID NO: 1561525 - DNA, 21 bp, Homo sapiens
tgtgtggagagggaatgtgaa

SEQ ID NO: 1561526 - DNA, 22 bp, Homo sapiens
tgtgtggagagggaatgtgaaa

SEQ ID NO: 1561527 - DNA, 14 bp, Homo sapiens
tgtgtggattcttt

SEQ ID NO: 1561528 - DNA, 12 bp, Homo sapiens
tgtgtggcaggg

SEQ ID NO: 1561529 - DNA, 18 bp, Homo sapiens
tgtgtggccgcctggcag

SEQ ID NO: 1561530 - DNA, 23 bp, Homo sapiens
atcccaggggaccacacctccct

SEQ ID NO: 1561531 - DNA, 17 bp, Homo sapiens
atcccatcattttccat

SEQ ID NO: 1561532 - DNA, 23 bp, Homo sapiens
atcccatcgtctcggccttcaca

SEQ ID NO: 1561533 - DNA, 15 bp, Homo sapiens
atcccatctgctaga

SEQ ID NO: 1561534 - DNA, 16 bp, Homo sapiens
atcccatgtcacctca

SEQ ID NO: 1561535 - DNA, 17 bp, Homo sapiens
atcccatgtcacctcag

SEQ ID NO: 1561536 - DNA, 15 bp, Homo sapiens
atcccattccaggca

SEQ ID NO: 1561537 - DNA, 16 bp, Homo sapiens
atcccattgccctggt

SEQ ID NO: 1561538 - DNA, 13 bp, Homo sapiens
atccccaactcca

SEQ ID NO: 1561539 - DNA, 16 bp, Homo sapiens
atccccaagtgtgaac

SEQ ID NO: 1561540 - DNA, 19 bp, Homo sapiens
atccccacagctggctctg

SEQ ID NO: 1561541 - DNA, 13 bp, Homo sapiens
atccccaccccac

SEQ ID NO: 1561542 - DNA, 13 bp, Homo sapiens
atccccacccttg

SEQ ID NO: 1561543 - DNA, 15 bp, Homo sapiens
atccccagagcccag

SEQ ID NO: 1561544 - DNA, 16 bp, Homo sapiens
atccccagagcccagc

SEQ ID NO: 1561545 - DNA, 22 bp, Homo sapiens
atccccagctggtggccctgtg

SEQ ID NO: 1561546 - DNA, 19 bp, Homo sapiens
atccccaggggtcccagcc

SEQ ID NO: 1561547 - DNA, 15 bp, Homo sapiens
atccccatctccctg

SEQ ID NO: 1561548 - DNA, 18 bp, Homo sapiens
atccccatctccctgcct

SEQ ID NO: 1561549 - DNA, 18 bp, Homo sapiens
atcccccactgccacacc

SEQ ID NO: 1561550 - DNA, 22 bp, Homo sapiens
atcccccactgccacaccctcc

SEQ ID NO: 1561551 - DNA, 15 bp, Homo sapiens
atccccccatcttgc

SEQ ID NO: 1561552 - DNA, 14 bp, Homo sapiens
atcccccctgctgc

SEQ ID NO: 1561553 - DNA, 16 bp, Homo sapiens
atcccccctgctgccc

SEQ ID NO: 1561554 - DNA, 14 bp, Homo sapiens
atccccctaaacta

SEQ ID NO: 1561555 - DNA, 14 bp, Homo sapiens
atccccgcctggcc

SEQ ID NO: 1561556 - DNA, 20 bp, Homo sapiens
atccccgcctggccaggagc

SEQ ID NO: 1561557 - DNA, 16 bp, Homo sapiens
atcccctcgtcctgtc

SEQ ID NO: 1561558 - DNA, 13 bp, Homo sapiens
atcccctgcctcc

SEQ ID NO: 1561559 - DNA, 17 bp, Homo sapiens
atcccctgcctcctgcc

SEQ ID NO: 1561560 - DNA, 18 bp, Homo sapiens
atcccctgcctcctgcca

SEQ ID NO: 1561561 - DNA, 22 bp, Homo sapiens
atccccttctcccctgcactgt

SEQ ID NO: 1561562 - DNA, 23 bp, Homo sapiens
atcccgaagccatcacttctccc

SEQ ID NO: 1561563 - DNA, 16 bp, Homo sapiens
atcccgatacctcagc

SEQ ID NO: 1561564 - DNA, 18 bp, Homo sapiens
atcccgatacctcagccc

SEQ ID NO: 1561565 - DNA, 22 bp, Homo sapiens
atcccgatacctcagccctggc

SEQ ID NO: 1561566 - DNA, 15 bp, Homo sapiens
atcccgattcaccct

SEQ ID NO: 1561567 - DNA, 20 bp, Homo sapiens
atcccggccggccctggctt

SEQ ID NO: 1561568 - DNA, 21 bp, Homo sapiens
atcccggccggccctggcttg

SEQ ID NO: 1561569 - DNA, 21 bp, Homo sapiens
atccctagtccccctgttttc

SEQ ID NO: 1561570 - DNA, 16 bp, Homo sapiens
atccctcaccttctga

SEQ ID NO: 1561571 - DNA, 16 bp, Homo sapiens
atccctccccagttca

SEQ ID NO: 1561572 - DNA, 17 bp, Homo sapiens
atccctcccccagcaga

SEQ ID NO: 1561573 - DNA, 14 bp, Homo sapiens
atccctcctgagct

SEQ ID NO: 1561574 - DNA, 17 bp, Homo sapiens
atccctcctgagctcgg

SEQ ID NO: 1561575 - DNA, 19 bp, Homo sapiens
atccctcggaagccgtctg

SEQ ID NO: 1561576 - DNA, 20 bp, Homo sapiens
atccctcgggaagcagccag

SEQ ID NO: 1561577 - DNA, 22 bp, Homo sapiens
atccctcgggaagcagccagct

SEQ ID NO: 1561578 - DNA, 13 bp, Homo sapiens
atccctctcttcc

SEQ ID NO: 1561579 - DNA, 14 bp, Homo sapiens
atccctctcttccc

SEQ ID NO: 1561580 - DNA, 19 bp, Homo sapiens
atccctctcttccccttcc

SEQ ID NO: 1561581 - DNA, 15 bp, Homo sapiens
atccctcttgtaagt

SEQ ID NO: 1561582 - DNA, 18 bp, Homo sapiens
atccctgaacccctggcc

SEQ ID NO: 1561583 - DNA, 21 bp, Homo sapiens
atccctgaacccctggccagc

SEQ ID NO: 1561584 - DNA, 22 bp, Homo sapiens
atccctgaggactgatttcaga

SEQ ID NO: 1561585 - DNA, 22 bp, Homo sapiens
atccctgataaatattcacact

SEQ ID NO: 1561586 - DNA, 16 bp, Homo sapiens
atccctgcagaggaaa

SEQ ID NO: 1561587 - DNA, 18 bp, Homo sapiens
atccctgcccttctcaag

SEQ ID NO: 1561588 - DNA, 15 bp, Homo sapiens
atccctgctctctga

SEQ ID NO: 1561589 - DNA, 16 bp, Homo sapiens
atccctgctctctgag

SEQ ID NO: 1561590 - DNA, 14 bp, Homo sapiens
atccctggagcagg

SEQ ID NO: 1561591 - DNA, 17 bp, Homo sapiens
atccctggagcaggagc

SEQ ID NO: 1561592 - DNA, 22 bp, Homo sapiens
atccctggagcaggagccccgc

SEQ ID NO: 1561593 - DNA, 19 bp, Homo sapiens
atccctgggggccttgggt

SEQ ID NO: 1561594 - DNA, 15 bp, Homo sapiens
atccctgtaaattgc

SEQ ID NO: 1561595 - DNA, 18 bp, Homo sapiens
atccctgtgtccactgag

SEQ ID NO: 1561596 - DNA, 18 bp, Homo sapiens
atccctgtgttgtctcta

SEQ ID NO: 1561597 - DNA, 21 bp, Homo sapiens
atcccttaagaatgagtttct

SEQ ID NO: 1561598 - DNA, 14 bp, Homo sapiens
atcccttcctggaa

SEQ ID NO: 1561599 - DNA, 15 bp, Homo sapiens
atcccttcctggaaa

SEQ ID NO: 1561600 - DNA, 19 bp, Homo sapiens
atcccttcctggaaacagc

SEQ ID NO: 1561601 - DNA, 22 bp, Homo sapiens
atcccttcctggaaacagcatg

SEQ ID NO: 1561602 - DNA, 21 bp, Homo sapiens
atcccttccttttagcctagt

SEQ ID NO: 1561603 - DNA, 13 bp, Homo sapiens
atccctttattac

SEQ ID NO: 1561604 - DNA, 22 bp, Homo sapiens
atccctttattaccccctcctt

SEQ ID NO: 1561605 - DNA, 17 bp, Homo sapiens
atccgactgctttggac

SEQ ID NO: 1561606 - DNA, 22 bp, Homo sapiens
atccgagtgtgatttgaattct

SEQ ID NO: 1561607 - DNA, 22 bp, Homo sapiens
atccgcctgtgggcgcatacta

SEQ ID NO: 1561608 - DNA, 16 bp, Homo sapiens
atccgcgtgtgcctgt

SEQ ID NO: 1561609 - DNA, 15 bp, Homo sapiens
atccggcagcctgga

SEQ ID NO: 1561610 - DNA, 15 bp, Homo sapiens
atccgggacacctgg

SEQ ID NO: 1561611 - DNA, 18 bp, Homo sapiens
atccgtcattgctgctgc

SEQ ID NO: 1561612 - DNA, 19 bp, Homo sapiens
atccgtcattgctgctgct

SEQ ID NO: 1561613 - DNA, 14 bp, Homo sapiens
atcctaaaatatgt

SEQ ID NO: 1561614 - DNA, 16 bp, Homo sapiens
atcctaaactttagac

SEQ ID NO: 1561615 - DNA, 13 bp, Homo sapiens
atcctaagaattt

SEQ ID NO: 1561616 - DNA, 21 bp, Homo sapiens
atcctaagatgtgttcttatt

SEQ ID NO: 1561617 - DNA, 21 bp, Homo sapiens
atcctaagctattcagtaata

SEQ ID NO: 1561618 - DNA, 19 bp, Homo sapiens
atcctaagggtcgaaagct

SEQ ID NO: 1561619 - DNA, 21 bp, Homo sapiens
atcctagaaccaagcttcaga

SEQ ID NO: 1561620 - DNA, 20 bp, Homo sapiens
atcctagccccgagacacca

SEQ ID NO: 1561621 - DNA, 18 bp, Homo sapiens
atcctagtcttcacaact

SEQ ID NO: 1561622 - DNA, 15 bp, Homo sapiens
atcctagtgggcact

SEQ ID NO: 1561623 - DNA, 19 bp, Homo sapiens
atcctcaaagaaagtgtat

SEQ ID NO: 1561624 - DNA, 14 bp, Homo sapiens
atcctcactgggtg

SEQ ID NO: 1561625 - DNA, 15 bp, Homo sapiens
atcctcattgcctcc

SEQ ID NO: 1561626 - DNA, 16 bp, Homo sapiens
atcctcattgcctcct

SEQ ID NO: 1561627 - DNA, 18 bp, Homo sapiens
atcctcattgcctcctgt

SEQ ID NO: 1561628 - DNA, 23 bp, Homo sapiens
atcctccaacttcatttgatgct

SEQ ID NO: 1561629 - DNA, 12 bp, Homo sapiens
atcctccacaga

SEQ ID NO: 1561630 - DNA, 21 bp, Homo sapiens
atcctccagcttttgaacctt

SEQ ID NO: 1561631 - DNA, 19 bp, Homo sapiens
atcctccagtaccttgctt

SEQ ID NO: 1561632 - DNA, 16 bp, Homo sapiens
atcctccccagcgcca

SEQ ID NO: 1561633 - DNA, 15 bp, Homo sapiens
atcctcccttcccag

SEQ ID NO: 1561634 - DNA, 17 bp, Homo sapiens
atcctcccttcccagga

SEQ ID NO: 1561635 - DNA, 15 bp, Homo sapiens
atcctccgtccagcc

SEQ ID NO: 1561636 - DNA, 21 bp, Homo sapiens
atcctctattaattactgtgt

SEQ ID NO: 1561637 - DNA, 18 bp, Homo sapiens
atcctctctcccctctgc

SEQ ID NO: 1561638 - DNA, 16 bp, Homo sapiens
atcctctctctcttct

SEQ ID NO: 1561639 - DNA, 13 bp, Homo sapiens
atcctctcttcct

SEQ ID NO: 1561640 - DNA, 18 bp, Homo sapiens
atcctctgagtgtgacca

SEQ ID NO: 1561641 - DNA, 10 bp, Homo sapiens
atcctctggc

SEQ ID NO: 1561642 - DNA, 18 bp, Homo sapiens
atcctcttttaatggcat

SEQ ID NO: 1561643 - DNA, 23 bp, Homo sapiens
atcctcttttaatggcatttctc

SEQ ID NO: 1561644 - DNA, 18 bp, Homo sapiens
atcctgaaatagaggcta

SEQ ID NO: 1561645 - DNA, 16 bp, Homo sapiens
atcctgaaatttcaga

SEQ ID NO: 1561646 - DNA, 16 bp, Homo sapiens
aataaattggattatt

SEQ ID NO: 1561647 - DNA, 18 bp, Homo sapiens
aataaatttggttctaat

SEQ ID NO: 1561648 - DNA, 13 bp, Homo sapiens
aataaattttgtt

SEQ ID NO: 1561649 - DNA, 19 bp, Homo sapiens
aataaattttttttggtca

SEQ ID NO: 1561650 - DNA, 16 bp, Homo sapiens
aataacaacaacaaaa

SEQ ID NO: 1561651 - DNA, 12 bp, Homo sapiens
aataacacacat

SEQ ID NO: 1561652 - DNA, 23 bp, Homo sapiens
aataacacagagagacagacttg

SEQ ID NO: 1561653 - DNA, 12 bp, Homo sapiens
aataacactgca

SEQ ID NO: 1561654 - DNA, 15 bp, Homo sapiens
aataacactgtattt

SEQ ID NO: 1561655 - DNA, 15 bp, Homo sapiens
aataacatatctaaa

SEQ ID NO: 1561656 - DNA, 14 bp, Homo sapiens
aataacatctgaaa

SEQ ID NO: 1561657 - DNA, 14 bp, Homo sapiens
aataaccacttaaa

SEQ ID NO: 1561658 - DNA, 22 bp, Homo sapiens
aataaccacttaaaaaatgtcc

SEQ ID NO: 1561659 - DNA, 18 bp, Homo sapiens
aataaccctttggttttt

SEQ ID NO: 1561660 - DNA, 18 bp, Homo sapiens
aataacctcaaagtgact

SEQ ID NO: 1561661 - DNA, 14 bp, Homo sapiens
aataacctttctgg

SEQ ID NO: 1561662 - DNA, 15 bp, Homo sapiens
aataactaaaaggta

SEQ ID NO: 1561663 - DNA, 21 bp, Homo sapiens
aataactaagatatagaaact

SEQ ID NO: 1561664 - DNA, 15 bp, Homo sapiens
aataactagaacaaa

SEQ ID NO: 1561665 - DNA, 14 bp, Homo sapiens
aataactatgccag

SEQ ID NO: 1561666 - DNA, 23 bp, Homo sapiens
aataactatgccagcaaccttgt

SEQ ID NO: 1561667 - DNA, 21 bp, Homo sapiens
aataactggaaaacagaacac

SEQ ID NO: 1561668 - DNA, 21 bp, Homo sapiens
aataactggaacaaattattt

SEQ ID NO: 1561669 - DNA, 14 bp, Homo sapiens
aataactgtgaagt

SEQ ID NO: 1561670 - DNA, 13 bp, Homo sapiens
aataactgtgtgg

SEQ ID NO: 1561671 - DNA, 13 bp, Homo sapiens
aataacttctata

SEQ ID NO: 1561672 - DNA, 20 bp, Homo sapiens
aataacttctatattttaat

SEQ ID NO: 1561673 - DNA, 14 bp, Homo sapiens
aataagaacttgaa

SEQ ID NO: 1561674 - DNA, 20 bp, Homo sapiens
aataagaatagaacaacata

SEQ ID NO: 1561675 - DNA, 13 bp, Homo sapiens
aataagacaaaaa

SEQ ID NO: 1561676 - DNA, 15 bp, Homo sapiens
aataagagaaagaaa

SEQ ID NO: 1561677 - DNA, 18 bp, Homo sapiens
aataagagaatgttccta

SEQ ID NO: 1561678 - DNA, 20 bp, Homo sapiens
aataagagagtcataaacct

SEQ ID NO: 1561679 - DNA, 13 bp, Homo sapiens
aataagagatttg

SEQ ID NO: 1561680 - DNA, 18 bp, Homo sapiens
aataagagtgattagagc

SEQ ID NO: 1561681 - DNA, 13 bp, Homo sapiens
aataagattctaa

SEQ ID NO: 1561682 - DNA, 23 bp, Homo sapiens
aataagcaggtggatctatttca

SEQ ID NO: 1561683 - DNA, 13 bp, Homo sapiens
aataagctaaaga

SEQ ID NO: 1561684 - DNA, 21 bp, Homo sapiens
aataaggacaagcctaacttc

SEQ ID NO: 1561685 - DNA, 22 bp, Homo sapiens
aataaggacaagcctaacttca

SEQ ID NO: 1561686 - DNA, 14 bp, Homo sapiens
aataaggaggagga

SEQ ID NO: 1561687 - DNA, 14 bp, Homo sapiens
aataaggagggaca

SEQ ID NO: 1561688 - DNA, 17 bp, Homo sapiens
aataaggccttaatatg

SEQ ID NO: 1561689 - DNA, 18 bp, Homo sapiens
aataaggtcaagggaaaa

SEQ ID NO: 1561690 - DNA, 15 bp, Homo sapiens
aataaggttatatga

SEQ ID NO: 1561691 - DNA, 16 bp, Homo sapiens
aataagtatttataat

SEQ ID NO: 1561692 - DNA, 18 bp, Homo sapiens
aataagtatttctgattt

SEQ ID NO: 1561693 - DNA, 16 bp, Homo sapiens
aataagtcaacagtaa

SEQ ID NO: 1561694 - DNA, 22 bp, Homo sapiens
aataagtcaacagtaaaccact

SEQ ID NO: 1561695 - DNA, 15 bp, Homo sapiens
aataagtgaagaata

SEQ ID NO: 1561696 - DNA, 23 bp, Homo sapiens
aataagtggattttgtattttaa

SEQ ID NO: 1561697 - DNA, 19 bp, Homo sapiens
aataagttcatacaatcgt

SEQ ID NO: 1561698 - DNA, 16 bp, Homo sapiens
aataataaagatgtga

SEQ ID NO: 1561699 - DNA, 16 bp, Homo sapiens
aataataaatgccctc

SEQ ID NO: 1561700 - DNA, 19 bp, Homo sapiens
aataataagtgatgtgctg

SEQ ID NO: 1561701 - DNA, 16 bp, Homo sapiens
aataataataataata

SEQ ID NO: 1561702 - DNA, 16 bp, Homo sapiens
aataataccttagaag

SEQ ID NO: 1561703 - DNA, 20 bp, Homo sapiens
aataatactgacctacctca

SEQ ID NO: 1561704 - DNA, 17 bp, Homo sapiens
aataatatgcattgtca

SEQ ID NO: 1561705 - DNA, 17 bp, Homo sapiens
aataatatgtactaaga

SEQ ID NO: 1561706 - DNA, 14 bp, Homo sapiens
aataatatttcaag

SEQ ID NO: 1561707 - DNA, 19 bp, Homo sapiens
aataatatttcaagtgcct

SEQ ID NO: 1561708 - DNA, 11 bp, Homo sapiens
aataatcaaga

SEQ ID NO: 1561709 - DNA, 18 bp, Homo sapiens
aataatcaagattttagg

SEQ ID NO: 1561710 - DNA, 21 bp, Homo sapiens
aataatcacgctttcctgaat

SEQ ID NO: 1561711 - DNA, 13 bp, Homo sapiens
aataatgaaaata

SEQ ID NO: 1561712 - DNA, 17 bp, Homo sapiens
aataatggagaacaagt

SEQ ID NO: 1561713 - DNA, 19 bp, Homo sapiens
aataatgtacatctggcct

SEQ ID NO: 1561714 - DNA, 14 bp, Homo sapiens
aataatgtactcac

SEQ ID NO: 1561715 - DNA, 15 bp, Homo sapiens
aataatgtactcaca

SEQ ID NO: 1561716 - DNA, 17 bp, Homo sapiens
aataatgtactcacata

SEQ ID NO: 1561717 - DNA, 22 bp, Homo sapiens
aataattacagtgcctaaaata

SEQ ID NO: 1561718 - DNA, 15 bp, Homo sapiens
aataattctacatgt

SEQ ID NO: 1561719 - DNA, 21 bp, Homo sapiens
aataattctgagttttgtgtt

SEQ ID NO: 1561720 - DNA, 16 bp, Homo sapiens
aataattcttttctga

SEQ ID NO: 1561721 - DNA, 20 bp, Homo sapiens
aataattgatttcaagacct

SEQ ID NO: 1561722 - DNA, 21 bp, Homo sapiens
aataattgcagaactaaactc

SEQ ID NO: 1561723 - DNA, 13 bp, Homo sapiens
aataattgtttcc

SEQ ID NO: 1561724 - DNA, 15 bp, Homo sapiens
aataatttctaatgt

SEQ ID NO: 1561725 - DNA, 12 bp, Homo sapiens
aataatttctac

SEQ ID NO: 1561726 - DNA, 12 bp, Homo sapiens
aataatttctat

SEQ ID NO: 1561727 - DNA, 15 bp, Homo sapiens
aataatttctctaca

SEQ ID NO: 1561728 - DNA, 10 bp, Homo sapiens
aataatttga

SEQ ID NO: 1561729 - DNA, 20 bp, Homo sapiens
aataatttgaatgtatttga

SEQ ID NO: 1561730 - DNA, 13 bp, Homo sapiens
aataatttgtaca

SEQ ID NO: 1561731 - DNA, 22 bp, Homo sapiens
aataattttggaataatttcta

SEQ ID NO: 1561732 - DNA, 14 bp, Homo sapiens
aatacaaaaattag

SEQ ID NO: 1561733 - DNA, 17 bp, Homo sapiens
aatacaaaaattagctg

SEQ ID NO: 1561734 - DNA, 13 bp, Homo sapiens
aatacaaacaatg

SEQ ID NO: 1561735 - DNA, 13 bp, Homo sapiens
aatacaaatggat

SEQ ID NO: 1561736 - DNA, 12 bp, Homo sapiens
aatacaaggtat

SEQ ID NO: 1561737 - DNA, 17 bp, Homo sapiens
aatacaaggtataataa

SEQ ID NO: 1561738 - DNA, 12 bp, Homo sapiens
aatacaataaac

SEQ ID NO: 1561739 - DNA, 14 bp, Homo sapiens
aatacaattcacag

SEQ ID NO: 1561740 - DNA, 13 bp, Homo sapiens
aatacacagtact

SEQ ID NO: 1561741 - DNA, 19 bp, Homo sapiens
aatacacagtactttattg

SEQ ID NO: 1561742 - DNA, 15 bp, Homo sapiens
aatacacatttgcta

SEQ ID NO: 1561743 - DNA, 13 bp, Homo sapiens
aatacagacacta

SEQ ID NO: 1561744 - DNA, 18 bp, Homo sapiens
aatacagataattcattt

SEQ ID NO: 1561745 - DNA, 19 bp, Homo sapiens
aatacagataattcatttg

SEQ ID NO: 1561746 - DNA, 17 bp, Homo sapiens
aatacagcatacttcaa

SEQ ID NO: 1561747 - DNA, 17 bp, Homo sapiens
aatacagctcagtaaat

SEQ ID NO: 1561748 - DNA, 23 bp, Homo sapiens
aatacaggaaacagttgcatgta

SEQ ID NO: 1561749 - DNA, 16 bp, Homo sapiens
aatacagggcatgcat

SEQ ID NO: 1561750 - DNA, 14 bp, Homo sapiens
ttttgttttaatct

SEQ ID NO: 1561751 - DNA, 13 bp, Homo sapiens
ttttgttttacaa

SEQ ID NO: 1561752 - DNA, 16 bp, Homo sapiens
ttttgttttacaatgt

SEQ ID NO: 1561753 - DNA, 20 bp, Homo sapiens
ttttgtttttattttcaaga

SEQ ID NO: 1561754 - DNA, 12 bp, Homo sapiens
tggactggcctg

SEQ ID NO: 1561755 - DNA, 13 bp, Homo sapiens
tggactggctaga

SEQ ID NO: 1561756 - DNA, 22 bp, Homo sapiens
tggactggctagagtcctcact

SEQ ID NO: 1561757 - DNA, 17 bp, Homo sapiens
tggactggtggcccctg

SEQ ID NO: 1561758 - DNA, 15 bp, Homo sapiens
tggactgtcatagaa

SEQ ID NO: 1561759 - DNA, 13 bp, Homo sapiens
tggactgtctttt

SEQ ID NO: 1561760 - DNA, 13 bp, Homo sapiens
aaaaaaaacactt

SEQ ID NO: 1561761 - DNA, 12 bp, Homo sapiens
aaaaaaaacagt

SEQ ID NO: 1561762 - DNA, 10 bp, Homo sapiens
aaaaaaagag

SEQ ID NO: 1561763 - DNA, 12 bp, Homo sapiens
aaaaaaagcaaa

SEQ ID NO: 1561764 - DNA, 13 bp, Homo sapiens
aaaaaaatggaaa

SEQ ID NO: 1561765 - DNA, 10 bp, Homo sapiens
aaaaaaatgt

SEQ ID NO: 1561766 - DNA, 15 bp, Homo sapiens
aaaaaacagaggcca

SEQ ID NO: 1561767 - DNA, 11 bp, Homo sapiens
aaaaaagatga

SEQ ID NO: 1561768 - DNA, 12 bp, Homo sapiens
aaaaaagcctcc

SEQ ID NO: 1561769 - DNA, 12 bp, Homo sapiens
aaaaaaggaaaa

SEQ ID NO: 1561770 - DNA, 13 bp, Homo sapiens
aaaaaagggctga

SEQ ID NO: 1561771 - DNA, 18 bp, Homo sapiens
aaaaaagttttgatgaaa

SEQ ID NO: 1561772 - DNA, 12 bp, Homo sapiens
aaaaaataacac

SEQ ID NO: 1561773 - DNA, 21 bp, Homo sapiens
aaaaaataacatattcttgct

SEQ ID NO: 1561774 - DNA, 20 bp, Homo sapiens
aaaaaataatctatttctat

SEQ ID NO: 1561775 - DNA, 9 bp, Homo sapiens
aaaaaatag

SEQ ID NO: 1561776 - DNA, 12 bp, Homo sapiens
aaaaaatggttc

SEQ ID NO: 1561777 - DNA, 22 bp, Homo sapiens
aaaaaatgtagcgacagcattt

SEQ ID NO: 1561778 - DNA, 11 bp, Homo sapiens
aaaaaatgtcc

SEQ ID NO: 1561779 - DNA, 11 bp, Homo sapiens
aaaaaattttt

SEQ ID NO: 1561780 - DNA, 23 bp, Homo sapiens
aaaaacaaacaaacaaactgttg

SEQ ID NO: 1561781 - DNA, 12 bp, Homo sapiens
aaaaacaacttt

SEQ ID NO: 1561782 - DNA, 15 bp, Homo sapiens
aaaaacacctagctt

SEQ ID NO: 1561783 - DNA, 17 bp, Homo sapiens
aaaaacacctagcttta

SEQ ID NO: 1561784 - DNA, 12 bp, Homo sapiens
aaaaacactagt

SEQ ID NO: 1561785 - DNA, 16 bp, Homo sapiens
aaaaacataaaaagca

SEQ ID NO: 1561786 - DNA, 18 bp, Homo sapiens
aaaaacataacataaatt

SEQ ID NO: 1561787 - DNA, 14 bp, Homo sapiens
aaaaacatgaccac

SEQ ID NO: 1561788 - DNA, 16 bp, Homo sapiens
aaaaacatgtatgtgc

SEQ ID NO: 1561789 - DNA, 16 bp, Homo sapiens
aaaaaccacacaaaga

SEQ ID NO: 1561790 - DNA, 14 bp, Homo sapiens
aaaaacctgtatct

SEQ ID NO: 1561791 - DNA, 17 bp, Homo sapiens
aaaaactacattttgca

SEQ ID NO: 1561792 - DNA, 14 bp, Homo sapiens
aaaaactccttttg

SEQ ID NO: 1561793 - DNA, 15 bp, Homo sapiens
aaaaactctctccca

SEQ ID NO: 1561794 - DNA, 15 bp, Homo sapiens
aaaaactctttggtg

SEQ ID NO: 1561795 - DNA, 15 bp, Homo sapiens
aaaaactgatttgct

SEQ ID NO: 1561796 - DNA, 22 bp, Homo sapiens
aaaaactggaacggtgaaggtg

SEQ ID NO: 1561797 - DNA, 21 bp, Homo sapiens
aaaaacttagtgacaaaatag

SEQ ID NO: 1561798 - DNA, 12 bp, Homo sapiens
aaaaacttgtaa

SEQ ID NO: 1561799 - DNA, 18 bp, Homo sapiens
aaaaacttgtaaatgctg

SEQ ID NO: 1561800 - DNA, 22 bp, Homo sapiens
aaaaacttgtactatgttaata

SEQ ID NO: 1561801 - DNA, 20 bp, Homo sapiens
aaaaactttggaaccagact

SEQ ID NO: 1561802 - DNA, 23 bp, Homo sapiens
aaaaagaaaggctgttaaataca

SEQ ID NO: 1561803 - DNA, 11 bp, Homo sapiens
aaaaagaaatg

SEQ ID NO: 1561804 - DNA, 21 bp, Homo sapiens
aaaaagactgaacatgtttac

SEQ ID NO: 1561805 - DNA, 14 bp, Homo sapiens
aaaaagatccaggg

SEQ ID NO: 1561806 - DNA, 11 bp, Homo sapiens
aaaaagatccc

SEQ ID NO: 1561807 - DNA, 15 bp, Homo sapiens
aaaaagcaagggaga

SEQ ID NO: 1561808 - DNA, 17 bp, Homo sapiens
aaaaagcactagtataa

SEQ ID NO: 1561809 - DNA, 23 bp, Homo sapiens
aaaaagcagagtggactgcattt

SEQ ID NO: 1561810 - DNA, 22 bp, Homo sapiens
aaaaagctaatgtgcagggata

SEQ ID NO: 1561811 - DNA, 19 bp, Homo sapiens
aaaaagctcaatgcattgt

SEQ ID NO: 1561812 - DNA, 13 bp, Homo sapiens
aaaaaggaaaaat

SEQ ID NO: 1561813 - DNA, 24 bp, Homo sapiens
aaaaaggaaatattctttctcata

SEQ ID NO: 1561814 - DNA, 12 bp, Homo sapiens
aaaaaggcaaat

SEQ ID NO: 1561815 - DNA, 17 bp, Homo sapiens
aaaaaggcaaatattga

SEQ ID NO: 1561816 - DNA, 16 bp, Homo sapiens
aaaaagggagtttttg

SEQ ID NO: 1561817 - DNA, 22 bp, Homo sapiens
aaaaagggcagggcatctcctg

SEQ ID NO: 1561818 - DNA, 18 bp, Homo sapiens
aaaaaggtggtatgtaat

SEQ ID NO: 1561819 - DNA, 21 bp, Homo sapiens
aaaaagtaagtaccactcagg

SEQ ID NO: 1561820 - DNA, 20 bp, Homo sapiens
aaaaagtgggttttttagtt

SEQ ID NO: 1561821 - DNA, 12 bp, Homo sapiens
aaaaagtgtctc

SEQ ID NO: 1561822 - DNA, 15 bp, Homo sapiens
aaaaataaaatgttt

SEQ ID NO: 1561823 - DNA, 13 bp, Homo sapiens
aaaaataaactag

SEQ ID NO: 1561824 - DNA, 15 bp, Homo sapiens
aaaaataaactagtt

SEQ ID NO: 1561825 - DNA, 24 bp, Homo sapiens
aaaaataaatatatctaccccaga

SEQ ID NO: 1561826 - DNA, 19 bp, Homo sapiens
aaaaataactgtaattatt

SEQ ID NO: 1561827 - DNA, 21 bp, Homo sapiens
aaaaataagtcaacagtaaac

SEQ ID NO: 1561828 - DNA, 12 bp, Homo sapiens
aaaaataatcaa

SEQ ID NO: 1561829 - DNA, 19 bp, Homo sapiens
aaaaataatcaagatttta

SEQ ID NO: 1561830 - DNA, 15 bp, Homo sapiens
aaaaatagaaattag

SEQ ID NO: 1561831 - DNA, 18 bp, Homo sapiens
aaaaatagtcttccacaa

SEQ ID NO: 1561832 - DNA, 21 bp, Homo sapiens
aaaaatagttctaaactatca

SEQ ID NO: 1561833 - DNA, 12 bp, Homo sapiens
aaaaatataatg

SEQ ID NO: 1561834 - DNA, 14 bp, Homo sapiens
aaaaatatacatgt

SEQ ID NO: 1561835 - DNA, 16 bp, Homo sapiens
aaaaatatacatgttt

SEQ ID NO: 1561836 - DNA, 17 bp, Homo sapiens
aaaaatatacatgttta

SEQ ID NO: 1561837 - DNA, 17 bp, Homo sapiens
aaaaatatatgtatata

SEQ ID NO: 1561838 - DNA, 23 bp, Homo sapiens
aaaaatatgaacctattttcatt

SEQ ID NO: 1561839 - DNA, 13 bp, Homo sapiens
aaaaatatttaat

SEQ ID NO: 1561840 - DNA, 22 bp, Homo sapiens
aaaaatattttctctgtacttt

SEQ ID NO: 1561841 - DNA, 15 bp, Homo sapiens
aaaaatcaaagaaca

SEQ ID NO: 1561842 - DNA, 12 bp, Homo sapiens
aaaaatcaagta

SEQ ID NO: 1561843 - DNA, 22 bp, Homo sapiens
aaaaatcagatgaattgataaa

SEQ ID NO: 1561844 - DNA, 19 bp, Homo sapiens
aaaaatcatgggccagagc

SEQ ID NO: 1561845 - DNA, 21 bp, Homo sapiens
aaaaatccaaatattgttaag

SEQ ID NO: 1561846 - DNA, 22 bp, Homo sapiens
aaaaatctgaccaaaacaaaca

SEQ ID NO: 1561847 - DNA, 12 bp, Homo sapiens
aaaaatctgttt

SEQ ID NO: 1561848 - DNA, 18 bp, Homo sapiens
aaaaatcttaatactgtt

SEQ ID NO: 1561849 - DNA, 19 bp, Homo sapiens
aaaaatcttaatactgtta

SEQ ID NO: 1561850 - DNA, 20 bp, Homo sapiens
aaaaatcttgtgctagaata

SEQ ID NO: 1561851 - DNA, 12 bp, Homo sapiens
aaaaatgaaatt

SEQ ID NO: 1561852 - DNA, 19 bp, Homo sapiens
aaaaatgacaacagaaaaa

SEQ ID NO: 1561853 - DNA, 20 bp, Homo sapiens
aaaaatgagagctgtaactg

SEQ ID NO: 1561854 - DNA, 12 bp, Homo sapiens
aaaaatgagttg

SEQ ID NO: 1561855 - DNA, 21 bp, Homo sapiens
aaaaatggttgatggaaaata

SEQ ID NO: 1561856 - DNA, 12 bp, Homo sapiens
aaaaatgtaaat

SEQ ID NO: 1561857 - DNA, 14 bp, Homo sapiens
aaaaatgtaacatc

SEQ ID NO: 1561858 - DNA, 12 bp, Homo sapiens
aaaaatgtacat

SEQ ID NO: 1561859 - DNA, 18 bp, Homo sapiens
aaaaatgtcctgcctttt

SEQ ID NO: 1561860 - DNA, 23 bp, Homo sapiens
aaaaatgtttttggtcttttata

SEQ ID NO: 1561861 - DNA, 21 bp, Homo sapiens
aaaaattaaaccggaccatct

SEQ ID NO: 1561862 - DNA, 15 bp, Homo sapiens
aaaaattaacttttt

SEQ ID NO: 1561863 - DNA, 23 bp, Homo sapiens
aaaaattacagcttcaccctgtc

SEQ ID NO: 1561864 - DNA, 20 bp, Homo sapiens
aaaaattacctttaatttta

SEQ ID NO: 1561865 - DNA, 23 bp, Homo sapiens
aaaaattacctttaattttaatg

SEQ ID NO: 1561866 - DNA, 14 bp, Homo sapiens
aaaaattactaatt

SEQ ID NO: 1561867 - DNA, 15 bp, Homo sapiens
aaaaattagccgggc

SEQ ID NO: 1561868 - DNA, 13 bp, Homo sapiens
aaaaattagctga

SEQ ID NO: 1561869 - DNA, 19 bp, Homo sapiens
aaaaattcaatagtaatat

SEQ ID NO: 1561870 - DNA, 16 bp, Homo sapiens
aaaaattcataaccaa

SEQ ID NO: 1561871 - DNA, 19 bp, Homo sapiens
aaaaattcctttgtgtttc

SEQ ID NO: 1561872 - DNA, 22 bp, Homo sapiens
aaaaattctgcccccacctaga

SEQ ID NO: 1561873 - DNA, 14 bp, Homo sapiens
aaaaattgaaagaa

SEQ ID NO: 1561874 - DNA, 17 bp, Homo sapiens
aaaaattgaaagaactt

SEQ ID NO: 1561875 - DNA, 11 bp, Homo sapiens
aaaaattgttt

SEQ ID NO: 1561876 - DNA, 16 bp, Homo sapiens
aaaaattgtttcttga

SEQ ID NO: 1561877 - DNA, 21 bp, Homo sapiens
aaaaatttactacaatatgta

SEQ ID NO: 1561878 - DNA, 19 bp, Homo sapiens
aaaaatttgcatgcaaaat

SEQ ID NO: 1561879 - DNA, 17 bp, Homo sapiens
aaaaatttttataaatt

SEQ ID NO: 1561880 - DNA, 19 bp, Homo sapiens
aaaaatttttatgtaaaac

SEQ ID NO: 1561881 - DNA, 10 bp, Homo sapiens
aaaacaaaaa

SEQ ID NO: 1561882 - DNA, 15 bp, Homo sapiens
aaaacaaaaacagaa

SEQ ID NO: 1561883 - DNA, 10 bp, Homo sapiens
aaaacaaaac

SEQ ID NO: 1561884 - DNA, 11 bp, Homo sapiens
aaaacaaaaca

SEQ ID NO: 1561885 - DNA, 12 bp, Homo sapiens
aaaacaaaacaa

SEQ ID NO: 1561886 - DNA, 17 bp, Homo sapiens
aaaacaaaaccaagcct

SEQ ID NO: 1561887 - DNA, 13 bp, Homo sapiens
aaaacaaaaccag

SEQ ID NO: 1561888 - DNA, 18 bp, Homo sapiens
aaaacaaaaccagctgct

SEQ ID NO: 1561889 - DNA, 16 bp, Homo sapiens
aaaacaaaagagagaa

SEQ ID NO: 1561890 - DNA, 17 bp, Homo sapiens
aaaacaaatatacattt

SEQ ID NO: 1561891 - DNA, 16 bp, Homo sapiens
aaaacaacttggcatt

SEQ ID NO: 1561892 - DNA, 21 bp, Homo sapiens
aaaacaataaatgaatgaata

SEQ ID NO: 1561893 - DNA, 13 bp, Homo sapiens
aaaacaatcttat

SEQ ID NO: 1561894 - DNA, 14 bp, Homo sapiens
aaaacaattttctg

SEQ ID NO: 1561895 - DNA, 12 bp, Homo sapiens
aaaacacagcaa

SEQ ID NO: 1561896 - DNA, 13 bp, Homo sapiens
aaaacacagcaag

SEQ ID NO: 1561897 - DNA, 18 bp, Homo sapiens
aaaacacagcaagggtga

SEQ ID NO: 1561898 - DNA, 17 bp, Homo sapiens
aaaacacttagtatgca

SEQ ID NO: 1561899 - DNA, 12 bp, Homo sapiens
aaaacagaaacc

SEQ ID NO: 1561900 - DNA, 14 bp, Homo sapiens
aaaacagaacactt

SEQ ID NO: 1561901 - DNA, 22 bp, Homo sapiens
aaaacagaacatcattagaaca

SEQ ID NO: 1561902 - DNA, 22 bp, Homo sapiens
aaaacaggagcaaatggcgttt

SEQ ID NO: 1561903 - DNA, 18 bp, Homo sapiens
aaaacagggccacataga

SEQ ID NO: 1561904 - DNA, 12 bp, Homo sapiens
aaaacaggtaga

SEQ ID NO: 1561905 - DNA, 22 bp, Homo sapiens
aaaacaggtagaattatctaat

SEQ ID NO: 1561906 - DNA, 14 bp, Homo sapiens
aaaacagtacagaa

SEQ ID NO: 1561907 - DNA, 13 bp, Homo sapiens
aaaacataaagaa

SEQ ID NO: 1561908 - DNA, 17 bp, Homo sapiens
aaaacataacataaatt

SEQ ID NO: 1561909 - DNA, 18 bp, Homo sapiens
aaaacataatcttctgcc

SEQ ID NO: 1561910 - DNA, 20 bp, Homo sapiens
aaaacataatcttctgcctt

SEQ ID NO: 1561911 - DNA, 23 bp, Homo sapiens
aaaacatagaaatggaaattttg

SEQ ID NO: 1561912 - DNA, 19 bp, Homo sapiens
aaaacatattcttgtgctt

SEQ ID NO: 1561913 - DNA, 15 bp, Homo sapiens
aaaacatgtactaca

SEQ ID NO: 1561914 - DNA, 23 bp, Homo sapiens
aaaacatgtttaaatagcctaaa

SEQ ID NO: 1561915 - DNA, 15 bp, Homo sapiens
aaaacatttcaaagc

SEQ ID NO: 1561916 - DNA, 16 bp, Homo sapiens
aaaacatttgtttccc

SEQ ID NO: 1561917 - DNA, 20 bp, Homo sapiens
aaaaccaaaagttattaaaa

SEQ ID NO: 1561918 - DNA, 23 bp, Homo sapiens
aaaaccaaaagttattaaaattg

SEQ ID NO: 1561919 - DNA, 13 bp, Homo sapiens
aaaaccaaagagg

SEQ ID NO: 1561920 - DNA, 19 bp, Homo sapiens
aaaaccaagccgtggcttc

SEQ ID NO: 1561921 - DNA, 13 bp, Homo sapiens
aaaaccacagcag

SEQ ID NO: 1561922 - DNA, 17 bp, Homo sapiens
aaaaccacagctgggca

SEQ ID NO: 1561923 - DNA, 18 bp, Homo sapiens
aaaaccacagctgggcag

SEQ ID NO: 1561924 - DNA, 20 bp, Homo sapiens
aaaaccagctgctactcata

SEQ ID NO: 1561925 - DNA, 22 bp, Homo sapiens
aaaaccatcagatatttcttat

SEQ ID NO: 1561926 - DNA, 15 bp, Homo sapiens
aaaacccagagagga

SEQ ID NO: 1561927 - DNA, 14 bp, Homo sapiens
aaaacccagggcaa

SEQ ID NO: 1561928 - DNA, 22 bp, Homo sapiens
aaaacctcagttaaactgtgaa

SEQ ID NO: 1561929 - DNA, 13 bp, Homo sapiens
aaaacctgacaaa

SEQ ID NO: 1561930 - DNA, 19 bp, Homo sapiens
aaaacctgcttccttcagt

SEQ ID NO: 1561931 - DNA, 19 bp, Homo sapiens
aaaacctgtgccaggctga

SEQ ID NO: 1561932 - DNA, 15 bp, Homo sapiens
aaaaccttccttccc

SEQ ID NO: 1561933 - DNA, 23 bp, Homo sapiens
aaaaccttgtaaaaaaagcaaaa

SEQ ID NO: 1561934 - DNA, 14 bp, Homo sapiens
aaaactaaatttca

SEQ ID NO: 1561935 - DNA, 15 bp, Homo sapiens
aaaactaagcacaaa

SEQ ID NO: 1561936 - DNA, 13 bp, Homo sapiens
aaaactaatttca

SEQ ID NO: 1561937 - DNA, 14 bp, Homo sapiens
aaaactatcctgat

SEQ ID NO: 1561938 - DNA, 17 bp, Homo sapiens
aaaactatggttcccaa

SEQ ID NO: 1561939 - DNA, 14 bp, Homo sapiens
aaaactcagaatat

SEQ ID NO: 1561940 - DNA, 14 bp, Homo sapiens
aaaactctctccca

SEQ ID NO: 1561941 - DNA, 15 bp, Homo sapiens
aaaactgacagagga

SEQ ID NO: 1561942 - DNA, 18 bp, Homo sapiens
aaaactgatcaaaaataa

SEQ ID NO: 1561943 - DNA, 17 bp, Homo sapiens
aaaactggatatttcaa

SEQ ID NO: 1561944 - DNA, 22 bp, Homo sapiens
aaaactgggattaagaaacctt

SEQ ID NO: 1561945 - DNA, 14 bp, Homo sapiens
aaaactgtactgtg

SEQ ID NO: 1561946 - DNA, 17 bp, Homo sapiens
aaaacttcatgtaattt

SEQ ID NO: 1561947 - DNA, 22 bp, Homo sapiens
aaaacttgtactatgttaataa

SEQ ID NO: 1561948 - DNA, 18 bp, Homo sapiens
aaaagaaaaaaatggaaa

SEQ ID NO: 1561949 - DNA, 16 bp, Homo sapiens
aaaagaaaaaagcaat

SEQ ID NO: 1561950 - DNA, 12 bp, Homo sapiens
aaaagaaaacaa

SEQ ID NO: 1561951 - DNA, 11 bp, Homo sapiens
aaaagaaaggc

SEQ ID NO: 1561952 - DNA, 16 bp, Homo sapiens
aaaagaaatatatttt

SEQ ID NO: 1561953 - DNA, 13 bp, Homo sapiens
aaaagaaatccag

SEQ ID NO: 1561954 - DNA, 19 bp, Homo sapiens
aaaagaaatccagtttgtg

SEQ ID NO: 1561955 - DNA, 22 bp, Homo sapiens
aaaagaaatctcctaacaaaag

SEQ ID NO: 1561956 - DNA, 11 bp, Homo sapiens
aaaagaacaat

SEQ ID NO: 1561957 - DNA, 12 bp, Homo sapiens
aaaagaagaaga

SEQ ID NO: 1561958 - DNA, 13 bp, Homo sapiens
aaaagaaggaaaa

SEQ ID NO: 1561959 - DNA, 14 bp, Homo sapiens
aaaagaaggaatat

SEQ ID NO: 1561960 - DNA, 19 bp, Homo sapiens
aaaagaagttgcaagactc

SEQ ID NO: 1561961 - DNA, 11 bp, Homo sapiens
aaaagaagttt

SEQ ID NO: 1561962 - DNA, 13 bp, Homo sapiens
aaaagaatatttt

SEQ ID NO: 1561963 - DNA, 13 bp, Homo sapiens
aaaagacattttt

SEQ ID NO: 1561964 - DNA, 15 bp, Homo sapiens
aaaagaccaagactt

SEQ ID NO: 1561965 - DNA, 17 bp, Homo sapiens
aaaagactgcagctgct

SEQ ID NO: 1561966 - DNA, 16 bp, Homo sapiens
aaaagagatttcaaga

SEQ ID NO: 1561967 - DNA, 16 bp, Homo sapiens
aaaagaggttacttta

SEQ ID NO: 1561968 - DNA, 12 bp, Homo sapiens
aaaagagtaatt

SEQ ID NO: 1561969 - DNA, 14 bp, Homo sapiens
aaaagattgctgaa

SEQ ID NO: 1561970 - DNA, 16 bp, Homo sapiens
aaaagatttgtttttg

SEQ ID NO: 1561971 - DNA, 19 bp, Homo sapiens
aaaagcaaaaatgacaaca

SEQ ID NO: 1561972 - DNA, 19 bp, Homo sapiens
aaaagcacaagtacttttg

SEQ ID NO: 1561973 - DNA, 18 bp, Homo sapiens
aaaagcacacacaataaa

SEQ ID NO: 1561974 - DNA, 15 bp, Homo sapiens
aaaagcactcctgct

SEQ ID NO: 1561975 - DNA, 13 bp, Homo sapiens
aaaagcactttga

SEQ ID NO: 1561976 - DNA, 18 bp, Homo sapiens
aaaagcagagtggactgc

SEQ ID NO: 1561977 - DNA, 18 bp, Homo sapiens
aaaagcagtcccattcat

SEQ ID NO: 1561978 - DNA, 12 bp, Homo sapiens
aaaagcagtcct

SEQ ID NO: 1561979 - DNA, 15 bp, Homo sapiens
aaaagcataaatgca

SEQ ID NO: 1561980 - DNA, 10 bp, Homo sapiens
aaaagcattt

SEQ ID NO: 1561981 - DNA, 17 bp, Homo sapiens
aaaagccaaaggtcaaa

SEQ ID NO: 1561982 - DNA, 22 bp, Homo sapiens
aaaagccagccaagctttaaat

SEQ ID NO: 1561983 - DNA, 12 bp, Homo sapiens
aaaagccattat

SEQ ID NO: 1561984 - DNA, 16 bp, Homo sapiens
aaaagcctgaactatt

SEQ ID NO: 1561985 - DNA, 19 bp, Homo sapiens
aaaagcctgcaatttcata

SEQ ID NO: 1561986 - DNA, 11 bp, Homo sapiens
aaaagccttgg

SEQ ID NO: 1561987 - DNA, 16 bp, Homo sapiens
aaaagctaaattacat

SEQ ID NO: 1561988 - DNA, 15 bp, Homo sapiens
aaaagctataaagta

SEQ ID NO: 1561989 - DNA, 22 bp, Homo sapiens
aaaagctataaagtatatatta

SEQ ID NO: 1561990 - DNA, 14 bp, Homo sapiens
aaaagctcttttaa

SEQ ID NO: 1561991 - DNA, 16 bp, Homo sapiens
aaaagctgaacacatt

SEQ ID NO: 1561992 - DNA, 20 bp, Homo sapiens
aaaagctgaacacatttctt

SEQ ID NO: 1561993 - DNA, 14 bp, Homo sapiens
aaaagcttcaaatt

SEQ ID NO: 1561994 - DNA, 18 bp, Homo sapiens
aaaagctttttaaaattt

SEQ ID NO: 1561995 - DNA, 13 bp, Homo sapiens
aaaaggaaaaaaa

SEQ ID NO: 1561996 - DNA, 14 bp, Homo sapiens
aaaaggaaacttcc

SEQ ID NO: 1561997 - DNA, 13 bp, Homo sapiens
aaaaggaaagaaa

SEQ ID NO: 1561998 - DNA, 15 bp, Homo sapiens
aaaaggaaatttgtt

SEQ ID NO: 1561999 - DNA, 12 bp, Homo sapiens
aaaaggaatttt

SEQ ID NO: 1562000 - DNA, 13 bp, Homo sapiens
aaaaggagagaag

SEQ ID NO: 1562001 - DNA, 13 bp, Homo sapiens
aaaaggaggaaat

SEQ ID NO: 1562002 - DNA, 20 bp, Homo sapiens
aaaaggatggtggttatttt

SEQ ID NO: 1562003 - DNA, 18 bp, Homo sapiens
aaaaggatttttatcttt

SEQ ID NO: 1562004 - DNA, 16 bp, Homo sapiens
aaaaggccaaagataa

SEQ ID NO: 1562005 - DNA, 18 bp, Homo sapiens
aaaaggccaaagataaaa

SEQ ID NO: 1562006 - DNA, 18 bp, Homo sapiens
aaaaggctaagaatagtg

SEQ ID NO: 1562007 - DNA, 17 bp, Homo sapiens
aaaaggctcgtttggat

SEQ ID NO: 1562008 - DNA, 13 bp, Homo sapiens
aaaagggagaata

SEQ ID NO: 1562009 - DNA, 23 bp, Homo sapiens
aaaagggcagggcatctcctgtg

SEQ ID NO: 1562010 - DNA, 16 bp, Homo sapiens
aaaagggcggaagagt

SEQ ID NO: 1562011 - DNA, 18 bp, Homo sapiens
aaaagggcggaagagtta

SEQ ID NO: 1562012 - DNA, 21 bp, Homo sapiens
aaaagggcggaagagttacaa

SEQ ID NO: 1562013 - DNA, 22 bp, Homo sapiens
aaaaggggaaataactgccttg

SEQ ID NO: 1562014 - DNA, 15 bp, Homo sapiens
aaaaggtattaaatt

SEQ ID NO: 1562015 - DNA, 14 bp, Homo sapiens
aaaaggtattatac

SEQ ID NO: 1562016 - DNA, 18 bp, Homo sapiens
aaaaggtattttgaatac

SEQ ID NO: 1562017 - DNA, 19 bp, Homo sapiens
aaaaggtattttgaatacc

SEQ ID NO: 1562018 - DNA, 21 bp, Homo sapiens
aaaaggtattttgaataccat

SEQ ID NO: 1562019 - DNA, 17 bp, Homo sapiens
aaaaggtgtcaactttt

SEQ ID NO: 1562020 - DNA, 20 bp, Homo sapiens
aaaaggttcttcatcccttt

SEQ ID NO: 1562021 - DNA, 22 bp, Homo sapiens
aaaagtaagtaccactcaggcc

SEQ ID NO: 1562022 - DNA, 13 bp, Homo sapiens
aaaagtacattta

SEQ ID NO: 1562023 - DNA, 14 bp, Homo sapiens
aaaagtactttaaa

SEQ ID NO: 1562024 - DNA, 17 bp, Homo sapiens
aaaagtactttaaaaag

SEQ ID NO: 1562025 - DNA, 22 bp, Homo sapiens
aaaagtatattaaacaaagttt

SEQ ID NO: 1562026 - DNA, 19 bp, Homo sapiens
aaaagtattgaaagccaac

SEQ ID NO: 1562027 - DNA, 19 bp, Homo sapiens
aaaagtattttttcaagtt

SEQ ID NO: 1562028 - DNA, 19 bp, Homo sapiens
aaaagtcagactgctggga

SEQ ID NO: 1562029 - DNA, 14 bp, Homo sapiens
aaaagtctatttta

SEQ ID NO: 1562030 - DNA, 13 bp, Homo sapiens
aaaagtgacacag

SEQ ID NO: 1562031 - DNA, 14 bp, Homo sapiens
aaaagtgactctca

SEQ ID NO: 1562032 - DNA, 15 bp, Homo sapiens
aaaagtgcaagtcca

SEQ ID NO: 1562033 - DNA, 15 bp, Homo sapiens
aaaagtggtctctgc

SEQ ID NO: 1562034 - DNA, 21 bp, Homo sapiens
aaaagtgtctcaaaggagctt

SEQ ID NO: 1562035 - DNA, 18 bp, Homo sapiens
aaaagttagtattaaaat

SEQ ID NO: 1562036 - DNA, 21 bp, Homo sapiens
aaaagttagtattaaaatcta

SEQ ID NO: 1562037 - DNA, 17 bp, Homo sapiens
aaaagttattaaaattg

SEQ ID NO: 1562038 - DNA, 14 bp, Homo sapiens
aaaagttgaaatta

SEQ ID NO: 1562039 - DNA, 14 bp, Homo sapiens
aaaagttgagattt

SEQ ID NO: 1562040 - DNA, 13 bp, Homo sapiens
aaaagttgttctt

SEQ ID NO: 1562041 - DNA, 14 bp, Homo sapiens
aaaagttgttcttt

SEQ ID NO: 1562042 - DNA, 13 bp, Homo sapiens
aaaagtttacaac

SEQ ID NO: 1562043 - DNA, 17 bp, Homo sapiens
aaaagtttacaacataa

SEQ ID NO: 1562044 - DNA, 17 bp, Homo sapiens
aaaagtttgccagaagt

SEQ ID NO: 1562045 - DNA, 14 bp, Homo sapiens
aaaagtttttgctt

SEQ ID NO: 1562046 - DNA, 12 bp, Homo sapiens
aaaataaaaaga

SEQ ID NO: 1562047 - DNA, 20 bp, Homo sapiens
aaaataaaaagatcactttc

SEQ ID NO: 1562048 - DNA, 13 bp, Homo sapiens
aaaataaaaatgg

SEQ ID NO: 1562049 - DNA, 20 bp, Homo sapiens
aaaataaaatatttttttcc

SEQ ID NO: 1562050 - DNA, 17 bp, Homo sapiens
aaaataaaatgcattta

SEQ ID NO: 1562051 - DNA, 14 bp, Homo sapiens
aaaataaaatgttt

SEQ ID NO: 1562052 - DNA, 12 bp, Homo sapiens
aaaataaaatta

SEQ ID NO: 1562053 - DNA, 21 bp, Homo sapiens
aaaataaaatttccttcaggt

SEQ ID NO: 1562054 - DNA, 15 bp, Homo sapiens
aaaataaactagttt

SEQ ID NO: 1562055 - DNA, 14 bp, Homo sapiens
aaaataaagcaatg

SEQ ID NO: 1562056 - DNA, 12 bp, Homo sapiens
aaaataaagttg

SEQ ID NO: 1562057 - DNA, 21 bp, Homo sapiens
aaaataaagttgagcttagtt

SEQ ID NO: 1562058 - DNA, 17 bp, Homo sapiens
aaaataaatatatctac

SEQ ID NO: 1562059 - DNA, 23 bp, Homo sapiens
aaaataaatgtcaccaggtactt

SEQ ID NO: 1562060 - DNA, 13 bp, Homo sapiens
aaaataacaacta

SEQ ID NO: 1562061 - DNA, 13 bp, Homo sapiens
aaaataacagtat

SEQ ID NO: 1562062 - DNA, 20 bp, Homo sapiens
aaaataacatattcttgctt

SEQ ID NO: 1562063 - DNA, 16 bp, Homo sapiens
aaaataacatctgaaa

SEQ ID NO: 1562064 - DNA, 20 bp, Homo sapiens
aaaataacatctgaaaagaa

SEQ ID NO: 1562065 - DNA, 18 bp, Homo sapiens
aaaataacctaattaata

SEQ ID NO: 1562066 - DNA, 15 bp, Homo sapiens
aaaataactgaattt

SEQ ID NO: 1562067 - DNA, 12 bp, Homo sapiens
aaaataactgta

SEQ ID NO: 1562068 - DNA, 13 bp, Homo sapiens
aaaataactgtaa

SEQ ID NO: 1562069 - DNA, 14 bp, Homo sapiens
aaaataactgtaat

SEQ ID NO: 1562070 - DNA, 15 bp, Homo sapiens
aaaataactgtaatt

SEQ ID NO: 1562071 - DNA, 12 bp, Homo sapiens
aaaataagacaa

SEQ ID NO: 1562072 - DNA, 16 bp, Homo sapiens
aaaataagtcaacagt

SEQ ID NO: 1562073 - DNA, 12 bp, Homo sapiens
aaaataatacaa

SEQ ID NO: 1562074 - DNA, 16 bp, Homo sapiens
aaaataatagttttag

SEQ ID NO: 1562075 - DNA, 20 bp, Homo sapiens
aaaataattatataactgta

SEQ ID NO: 1562076 - DNA, 15 bp, Homo sapiens
aaaataattttccaa

SEQ ID NO: 1562077 - DNA, 15 bp, Homo sapiens
aaaatacaataaact

SEQ ID NO: 1562078 - DNA, 14 bp, Homo sapiens
aaaatacacactca

SEQ ID NO: 1562079 - DNA, 16 bp, Homo sapiens
aaaataccactgtaat

SEQ ID NO: 1562080 - DNA, 22 bp, Homo sapiens
aaaataccagagccttcaagtg

SEQ ID NO: 1562081 - DNA, 21 bp, Homo sapiens
aaaatacctctaataaacact

SEQ ID NO: 1562082 - DNA, 21 bp, Homo sapiens
aaaatactatttaagatgtga

SEQ ID NO: 1562083 - DNA, 15 bp, Homo sapiens
aaaatactcaccaaa

SEQ ID NO: 1562084 - DNA, 14 bp, Homo sapiens
aaaatacttaaatg

SEQ ID NO: 1562085 - DNA, 15 bp, Homo sapiens
aaaatacttaaatgt

SEQ ID NO: 1562086 - DNA, 20 bp, Homo sapiens
aaaatacttaaatgttatgt

SEQ ID NO: 1562087 - DNA, 17 bp, Homo sapiens
aaaatagaaattttgta

SEQ ID NO: 1562088 - DNA, 18 bp, Homo sapiens
aaaatagaataattcttt

SEQ ID NO: 1562089 - DNA, 21 bp, Homo sapiens
aaaatagagcttttaaaaatg

SEQ ID NO: 1562090 - DNA, 23 bp, Homo sapiens
aaaatagatataaatttttaaga

SEQ ID NO: 1562091 - DNA, 21 bp, Homo sapiens
aaaatagcaacactctatatt

SEQ ID NO: 1562092 - DNA, 22 bp, Homo sapiens
aaaatagcaacactctatattt

SEQ ID NO: 1562093 - DNA, 13 bp, Homo sapiens
aaaatagtgtaag

SEQ ID NO: 1562094 - DNA, 17 bp, Homo sapiens
aaaatagtgtaagaact

SEQ ID NO: 1562095 - DNA, 12 bp, Homo sapiens
aaaatagttacc

SEQ ID NO: 1562096 - DNA, 19 bp, Homo sapiens
aaaatagttctatttctat

SEQ ID NO: 1562097 - DNA, 15 bp, Homo sapiens
aaaatataaacaaag

SEQ ID NO: 1562098 - DNA, 14 bp, Homo sapiens
aaaatatacatgtt

SEQ ID NO: 1562099 - DNA, 18 bp, Homo sapiens
aaaatatataccccccca

SEQ ID NO: 1562100 - DNA, 23 bp, Homo sapiens
aaaatatgaacctattttcattt

SEQ ID NO: 1562101 - DNA, 15 bp, Homo sapiens
aaaatatgtaatttc

SEQ ID NO: 1562102 - DNA, 19 bp, Homo sapiens
aaaatattacttatttatc

SEQ ID NO: 1562103 - DNA, 15 bp, Homo sapiens
aaaatattatgtgtt

SEQ ID NO: 1562104 - DNA, 18 bp, Homo sapiens
aaaatatttaatatcaaa

SEQ ID NO: 1562105 - DNA, 15 bp, Homo sapiens
aaaatatttatgaag

SEQ ID NO: 1562106 - DNA, 17 bp, Homo sapiens
aaaatatttatgaagaa

SEQ ID NO: 1562107 - DNA, 20 bp, Homo sapiens
aaaatatttatgaagaaaat

SEQ ID NO: 1562108 - DNA, 11 bp, Homo sapiens
aaaatatttca

SEQ ID NO: 1562109 - DNA, 14 bp, Homo sapiens
aaaatatttcagat

SEQ ID NO: 1562110 - DNA, 20 bp, Homo sapiens
aaaatatttcagatatcaaa

SEQ ID NO: 1562111 - DNA, 11 bp, Homo sapiens
aaaatatttcc

SEQ ID NO: 1562112 - DNA, 15 bp, Homo sapiens
aaaatatttcctgac

SEQ ID NO: 1562113 - DNA, 21 bp, Homo sapiens
aaaatatttcctgacttgagt

SEQ ID NO: 1562114 - DNA, 20 bp, Homo sapiens
aaaatatttctaagcttatt

SEQ ID NO: 1562115 - DNA, 20 bp, Homo sapiens
aaaatattttcatacagcat

SEQ ID NO: 1562116 - DNA, 18 bp, Homo sapiens
aaaatcaaagaacagatg

SEQ ID NO: 1562117 - DNA, 16 bp, Homo sapiens
aaaatcaagtattata

SEQ ID NO: 1562118 - DNA, 23 bp, Homo sapiens
aaaatcacactgtaaatatgaat

SEQ ID NO: 1562119 - DNA, 21 bp, Homo sapiens
aaaatcactttgtctaactca

SEQ ID NO: 1562120 - DNA, 21 bp, Homo sapiens
aaaatcataggaataaaatta

SEQ ID NO: 1562121 - DNA, 20 bp, Homo sapiens
aaaatcatcaagaagggctg

SEQ ID NO: 1562122 - DNA, 22 bp, Homo sapiens
aaaatcatgatccttgtgttca

SEQ ID NO: 1562123 - DNA, 18 bp, Homo sapiens
aaaatcatgccagtattt

SEQ ID NO: 1562124 - DNA, 19 bp, Homo sapiens
aaaatcatgccagtatttt

SEQ ID NO: 1562125 - DNA, 12 bp, Homo sapiens
aaaatcatgttt

SEQ ID NO: 1562126 - DNA, 15 bp, Homo sapiens
aaaatcatgtttgct

SEQ ID NO: 1562127 - DNA, 12 bp, Homo sapiens
aaaatcattgat

SEQ ID NO: 1562128 - DNA, 11 bp, Homo sapiens
aaaatcatttc

SEQ ID NO: 1562129 - DNA, 15 bp, Homo sapiens
aaaatccaaaaagaa

SEQ ID NO: 1562130 - DNA, 16 bp, Homo sapiens
aaaatccaaaacttct

SEQ ID NO: 1562131 - DNA, 16 bp, Homo sapiens
aaaatccaaaatgaat

SEQ ID NO: 1562132 - DNA, 17 bp, Homo sapiens
aaaatccccttcgctga

SEQ ID NO: 1562133 - DNA, 15 bp, Homo sapiens
aaaatccttatgcat

SEQ ID NO: 1562134 - DNA, 13 bp, Homo sapiens
aaaatccttgctt

SEQ ID NO: 1562135 - DNA, 20 bp, Homo sapiens
aaaatccttgcttatgacat

SEQ ID NO: 1562136 - DNA, 15 bp, Homo sapiens
aaaatcgatgagcgc

SEQ ID NO: 1562137 - DNA, 22 bp, Homo sapiens
aaaatctagtgggttgaccttt

SEQ ID NO: 1562138 - DNA, 15 bp, Homo sapiens
aaaatctcaattgaa

SEQ ID NO: 1562139 - DNA, 17 bp, Homo sapiens
aaaatctgaattttgca

SEQ ID NO: 1562140 - DNA, 24 bp, Homo sapiens
aaaatctgaattttgcaatgtatt

SEQ ID NO: 1562141 - DNA, 15 bp, Homo sapiens
aaaatctgctaggga

SEQ ID NO: 1562142 - DNA, 21 bp, Homo sapiens
aaaatctgttgataaatccat

SEQ ID NO: 1562143 - DNA, 19 bp, Homo sapiens
aaaatctgtttgatccctg

SEQ ID NO: 1562144 - DNA, 17 bp, Homo sapiens
aaaatcttaatactgtt

SEQ ID NO: 1562145 - DNA, 20 bp, Homo sapiens
aaaatcttaatactgttatt

SEQ ID NO: 1562146 - DNA, 18 bp, Homo sapiens
aaaatcttggcacagaaa

SEQ ID NO: 1562147 - DNA, 19 bp, Homo sapiens
aaaatcttgtgctagaata

SEQ ID NO: 1562148 - DNA, 13 bp, Homo sapiens
aaaatgaagggat

SEQ ID NO: 1562149 - DNA, 20 bp, Homo sapiens
aaaatgaaggttaggattta

SEQ ID NO: 1562150 - DNA, 18 bp, Homo sapiens
aaaatgaatactgaattt

SEQ ID NO: 1562151 - DNA, 21 bp, Homo sapiens
aaaatgaatgcaaaattgttt

SEQ ID NO: 1562152 - DNA, 13 bp, Homo sapiens
aaaatgaattgaa

SEQ ID NO: 1562153 - DNA, 21 bp, Homo sapiens
aaaatgaattgaaaaacaatt

SEQ ID NO: 1562154 - DNA, 15 bp, Homo sapiens
aaaatgaattttgta

SEQ ID NO: 1562155 - DNA, 19 bp, Homo sapiens
aaaatgacaacagaaaaac

SEQ ID NO: 1562156 - DNA, 13 bp, Homo sapiens
aaaatgacaatga

SEQ ID NO: 1562157 - DNA, 17 bp, Homo sapiens
aaaatgaggaatccaaa

SEQ ID NO: 1562158 - DNA, 17 bp, Homo sapiens
aaaatgcaaagctgaag

SEQ ID NO: 1562159 - DNA, 16 bp, Homo sapiens
aaaatgccatgaatta

SEQ ID NO: 1562160 - DNA, 18 bp, Homo sapiens
aaaatgcggttataaaaa

SEQ ID NO: 1562161 - DNA, 22 bp, Homo sapiens
aaaatgcggttataaaaaatgg

SEQ ID NO: 1562162 - DNA, 12 bp, Homo sapiens
aaaatgctgctc

SEQ ID NO: 1562163 - DNA, 12 bp, Homo sapiens
aaaatggaaaat

SEQ ID NO: 1562164 - DNA, 13 bp, Homo sapiens
aaaatggaaagaa

SEQ ID NO: 1562165 - DNA, 22 bp, Homo sapiens
aaaatggaggccattgtgtgag

SEQ ID NO: 1562166 - DNA, 20 bp, Homo sapiens
aaaatggatattattagaaa

SEQ ID NO: 1562167 - DNA, 22 bp, Homo sapiens
aaaatggatattattagaaatt

SEQ ID NO: 1562168 - DNA, 21 bp, Homo sapiens
aaaatggtacagcttctggag

SEQ ID NO: 1562169 - DNA, 15 bp, Homo sapiens
aaaatggtctctaac

SEQ ID NO: 1562170 - DNA, 16 bp, Homo sapiens
aaaatggttgatggaa

SEQ ID NO: 1562171 - DNA, 18 bp, Homo sapiens
aaaatggttgatggaaaa

SEQ ID NO: 1562172 - DNA, 22 bp, Homo sapiens
aaaatggttgatggaaaataaa

SEQ ID NO: 1562173 - DNA, 16 bp, Homo sapiens
aaaatgtaaaggaggg

SEQ ID NO: 1562174 - DNA, 11 bp, Homo sapiens
aaaatgtaaat

SEQ ID NO: 1562175 - DNA, 11 bp, Homo sapiens
aaaatgtaaca

SEQ ID NO: 1562176 - DNA, 19 bp, Homo sapiens
aaaatgtaaggattctgga

SEQ ID NO: 1562177 - DNA, 18 bp, Homo sapiens
aaaatgtaatttaaatga

SEQ ID NO: 1562178 - DNA, 19 bp, Homo sapiens
aaaatgtaatttaaatgaa

SEQ ID NO: 1562179 - DNA, 20 bp, Homo sapiens
aaaatgtagcgacagcattt

SEQ ID NO: 1562180 - DNA, 21 bp, Homo sapiens
aaaatgtaggcttagtttgtg

SEQ ID NO: 1562181 - DNA, 21 bp, Homo sapiens
aaaatgtatccaaggaaacat

SEQ ID NO: 1562182 - DNA, 17 bp, Homo sapiens
aaaatgtcctgcctttt

SEQ ID NO: 1562183 - DNA, 11 bp, Homo sapiens
aaaatgtctgt

SEQ ID NO: 1562184 - DNA, 12 bp, Homo sapiens
aaaatgtctgta

SEQ ID NO: 1562185 - DNA, 15 bp, Homo sapiens
aaaatgtgatgttct

SEQ ID NO: 1562186 - DNA, 19 bp, Homo sapiens
aaaatgtgctatactgcat

SEQ ID NO: 1562187 - DNA, 14 bp, Homo sapiens
aaaatgtgtacagt

SEQ ID NO: 1562188 - DNA, 18 bp, Homo sapiens
aaaatgtgtacagtgaat

SEQ ID NO: 1562189 - DNA, 19 bp, Homo sapiens
aaaatgtgtacagtgaatt

SEQ ID NO: 1562190 - DNA, 23 bp, Homo sapiens
aaaatgttacggcatcacactta

SEQ ID NO: 1562191 - DNA, 16 bp, Homo sapiens
aaaatgttcagaaggt

SEQ ID NO: 1562192 - DNA, 11 bp, Homo sapiens
aaaatgttcta

SEQ ID NO: 1562193 - DNA, 20 bp, Homo sapiens
aaaatgttctatttaacaac

SEQ ID NO: 1562194 - DNA, 16 bp, Homo sapiens
aaaatgtttactgtaa

SEQ ID NO: 1562195 - DNA, 19 bp, Homo sapiens
aaaatgtttactgtaaatt

SEQ ID NO: 1562196 - DNA, 16 bp, Homo sapiens
aaaatgtttccactgg

SEQ ID NO: 1562197 - DNA, 14 bp, Homo sapiens
aaaatgttttacat

SEQ ID NO: 1562198 - DNA, 20 bp, Homo sapiens
aaaattaaaccggaccatct

SEQ ID NO: 1562199 - DNA, 11 bp, Homo sapiens
aaaattaaagc

SEQ ID NO: 1562200 - DNA, 17 bp, Homo sapiens
aaaattaaatgccttgt

SEQ ID NO: 1562201 - DNA, 17 bp, Homo sapiens
aaaattaacaaatttct

SEQ ID NO: 1562202 - DNA, 15 bp, Homo sapiens
aaaattaatcttgct

SEQ ID NO: 1562203 - DNA, 18 bp, Homo sapiens
aaaattaatcttgcttca

SEQ ID NO: 1562204 - DNA, 21 bp, Homo sapiens
aaaattaatgcagatttctct

SEQ ID NO: 1562205 - DNA, 17 bp, Homo sapiens
aaaattactaattttac

SEQ ID NO: 1562206 - DNA, 17 bp, Homo sapiens
aaaattagaaaggacaa

SEQ ID NO: 1562207 - DNA, 14 bp, Homo sapiens
aaaattagaaattg

SEQ ID NO: 1562208 - DNA, 20 bp, Homo sapiens
aaaattagaaattggctgga

SEQ ID NO: 1562209 - DNA, 16 bp, Homo sapiens
aaaattagacaaatgc

SEQ ID NO: 1562210 - DNA, 15 bp, Homo sapiens
aaaattagccgggca

SEQ ID NO: 1562211 - DNA, 17 bp, Homo sapiens
aaaattagcctaagata

SEQ ID NO: 1562212 - DNA, 13 bp, Homo sapiens
aaaattagtcttt

SEQ ID NO: 1562213 - DNA, 21 bp, Homo sapiens
aaaattattttgttcatacat

SEQ ID NO: 1562214 - DNA, 21 bp, Homo sapiens
aaaattcaaagcatggacatt

SEQ ID NO: 1562215 - DNA, 18 bp, Homo sapiens
aaaattcagcaaaccatt

SEQ ID NO: 1562216 - DNA, 12 bp, Homo sapiens
aaaattcatagc

SEQ ID NO: 1562217 - DNA, 18 bp, Homo sapiens
aaaattcatagtaagatt

SEQ ID NO: 1562218 - DNA, 15 bp, Homo sapiens
aaaattcctgtgttc

SEQ ID NO: 1562219 - DNA, 20 bp, Homo sapiens
aaaattgagttgcacttatt

SEQ ID NO: 1562220 - DNA, 12 bp, Homo sapiens
aaaattgatgtg

SEQ ID NO: 1562221 - DNA, 14 bp, Homo sapiens
aaaattgatgtgtt

SEQ ID NO: 1562222 - DNA, 15 bp, Homo sapiens
aaaattgatttttct

SEQ ID NO: 1562223 - DNA, 22 bp, Homo sapiens
aaaattgctatgttactatttt

SEQ ID NO: 1562224 - DNA, 13 bp, Homo sapiens
aaaattgtattga

SEQ ID NO: 1562225 - DNA, 20 bp, Homo sapiens
aaaattgttaatttttccta

SEQ ID NO: 1562226 - DNA, 16 bp, Homo sapiens
aaaattgtttagtgat

SEQ ID NO: 1562227 - DNA, 13 bp, Homo sapiens
aaaattgtttctt

SEQ ID NO: 1562228 - DNA, 12 bp, Homo sapiens
aaaattgttttc

SEQ ID NO: 1562229 - DNA, 16 bp, Homo sapiens
aaaattgttttcactt

SEQ ID NO: 1562230 - DNA, 19 bp, Homo sapiens
aaaattgttttcacttgta

SEQ ID NO: 1562231 - DNA, 13 bp, Homo sapiens
aaaatttaaaatt

SEQ ID NO: 1562232 - DNA, 19 bp, Homo sapiens
aaaatttaagtatcttttt

SEQ ID NO: 1562233 - DNA, 12 bp, Homo sapiens
aaaatttaattt

SEQ ID NO: 1562234 - DNA, 19 bp, Homo sapiens
aaaatttacatttaataca

SEQ ID NO: 1562235 - DNA, 19 bp, Homo sapiens
aaaatttactacaatatgt

SEQ ID NO: 1562236 - DNA, 19 bp, Homo sapiens
aaaatttagaaatataatt

SEQ ID NO: 1562237 - DNA, 12 bp, Homo sapiens
aaaatttataac

SEQ ID NO: 1562238 - DNA, 17 bp, Homo sapiens
aaaatttccagtacctt

SEQ ID NO: 1562239 - DNA, 22 bp, Homo sapiens
aaaatttcgttgtccaatttgt

SEQ ID NO: 1562240 - DNA, 22 bp, Homo sapiens
aaaatttggagtaaatatatat

SEQ ID NO: 1562241 - DNA, 13 bp, Homo sapiens
aaaatttgtaata

SEQ ID NO: 1562242 - DNA, 20 bp, Homo sapiens
aaaatttgttcttgtattta

SEQ ID NO: 1562243 - DNA, 16 bp, Homo sapiens
aaaatttgttttgacg

SEQ ID NO: 1562244 - DNA, 13 bp, Homo sapiens
aaaattttacttc

SEQ ID NO: 1562245 - DNA, 16 bp, Homo sapiens
aaaattttacttccat

SEQ ID NO: 1562246 - DNA, 13 bp, Homo sapiens
aaaattttattcc

SEQ ID NO: 1562247 - DNA, 18 bp, Homo sapiens
aaaattttgtaaaacaat

SEQ ID NO: 1562248 - DNA, 18 bp, Homo sapiens
aaacaaaaaaaatgttaa

SEQ ID NO: 1562249 - DNA, 12 bp, Homo sapiens
aaacaaaacaaa

SEQ ID NO: 1562250 - DNA, 12 bp, Homo sapiens
aaacaaaaccaa

SEQ ID NO: 1562251 - DNA, 17 bp, Homo sapiens
aaacaaaaccagctgct

SEQ ID NO: 1562252 - DNA, 17 bp, Homo sapiens
aaacaaaacttgcatct

SEQ ID NO: 1562253 - DNA, 23 bp, Homo sapiens
aaacaaaagctgaacacatttct

SEQ ID NO: 1562254 - DNA, 18 bp, Homo sapiens
aaacaaaagggtgtatag

SEQ ID NO: 1562255 - DNA, 23 bp, Homo sapiens
aaacaaaagggtgtatagtgttc

SEQ ID NO: 1562256 - DNA, 20 bp, Homo sapiens
aaacaaaatttgtttgaaat

SEQ ID NO: 1562257 - DNA, 13 bp, Homo sapiens
aaacaaacaaaac

SEQ ID NO: 1562258 - DNA, 12 bp, Homo sapiens
aaacaaacaaac

SEQ ID NO: 1562259 - DNA, 16 bp, Homo sapiens
aaacaaacaaacaaaa

SEQ ID NO: 1562260 - DNA, 21 bp, Homo sapiens
aaacaaagcagctttaaaaaa

SEQ ID NO: 1562261 - DNA, 17 bp, Homo sapiens
aaacaaaggttgagatg

SEQ ID NO: 1562262 - DNA, 23 bp, Homo sapiens
aaacaaagtttacattgtcctgt

SEQ ID NO: 1562263 - DNA, 10 bp, Homo sapiens
aaacaaatga

SEQ ID NO: 1562264 - DNA, 11 bp, Homo sapiens
aaacaaatgat

SEQ ID NO: 1562265 - DNA, 16 bp, Homo sapiens
aaacaaatgatttcca

SEQ ID NO: 1562266 - DNA, 14 bp, Homo sapiens
aaacaaatgttcat

SEQ ID NO: 1562267 - DNA, 13 bp, Homo sapiens
aaacaaattcttt

SEQ ID NO: 1562268 - DNA, 15 bp, Homo sapiens
aaacaacagctgaag

SEQ ID NO: 1562269 - DNA, 12 bp, Homo sapiens
aaacaacattta

SEQ ID NO: 1562270 - DNA, 13 bp, Homo sapiens
aaacaactttcac

SEQ ID NO: 1562271 - DNA, 19 bp, Homo sapiens
aaacaactttcacttcttc

SEQ ID NO: 1562272 - DNA, 21 bp, Homo sapiens
aaacaagaaagaaatggcttt

SEQ ID NO: 1562273 - DNA, 15 bp, Homo sapiens
aaacaagaatgaagg

SEQ ID NO: 1562274 - DNA, 22 bp, Homo sapiens
aaacaagattttaaagacatgt

SEQ ID NO: 1562275 - DNA, 20 bp, Homo sapiens
aaacaagctgtgcaggcatg

SEQ ID NO: 1562276 - DNA, 12 bp, Homo sapiens
aaacaaggaagc

SEQ ID NO: 1562277 - DNA, 16 bp, Homo sapiens
aaacaaggaagccaaa

SEQ ID NO: 1562278 - DNA, 16 bp, Homo sapiens
aaacaatattgtttct

SEQ ID NO: 1562279 - DNA, 21 bp, Homo sapiens
aaacaatcctgttactctgtc

SEQ ID NO: 1562280 - DNA, 12 bp, Homo sapiens
aaacaatcttat

SEQ ID NO: 1562281 - DNA, 12 bp, Homo sapiens
aaacaatgccat

SEQ ID NO: 1562282 - DNA, 20 bp, Homo sapiens
aaacaatgccatgaacaaat

SEQ ID NO: 1562283 - DNA, 21 bp, Homo sapiens
aaacaatgccatgaacaaatt

SEQ ID NO: 1562284 - DNA, 22 bp, Homo sapiens
aaacaatgtataaagattgtac

SEQ ID NO: 1562285 - DNA, 18 bp, Homo sapiens
aaacaatgttgtccaaca

SEQ ID NO: 1562286 - DNA, 21 bp, Homo sapiens
aaacaatgttgtccaacaata

SEQ ID NO: 1562287 - DNA, 22 bp, Homo sapiens
aaacacaaaccacaactgacac

SEQ ID NO: 1562288 - DNA, 22 bp, Homo sapiens
aaacacaaagaagtttttcttt

SEQ ID NO: 1562289 - DNA, 13 bp, Homo sapiens
aaacacaaatgca

SEQ ID NO: 1562290 - DNA, 19 bp, Homo sapiens
aaacacaaatgcagggatt

SEQ ID NO: 1562291 - DNA, 21 bp, Homo sapiens
aaacacacagatacacacaca

SEQ ID NO: 1562292 - DNA, 11 bp, Homo sapiens
aaacacacatt

SEQ ID NO: 1562293 - DNA, 18 bp, Homo sapiens
aaacacaccctctgtgct

SEQ ID NO: 1562294 - DNA, 14 bp, Homo sapiens
aaacacacctcgtg

SEQ ID NO: 1562295 - DNA, 12 bp, Homo sapiens
aaacacagcaag

SEQ ID NO: 1562296 - DNA, 12 bp, Homo sapiens
aaacacagctgt

SEQ ID NO: 1562297 - DNA, 14 bp, Homo sapiens
aaacacataattaa

SEQ ID NO: 1562298 - DNA, 19 bp, Homo sapiens
aaacacataattaacactt

SEQ ID NO: 1562299 - DNA, 16 bp, Homo sapiens
aaacacccctctgtct

SEQ ID NO: 1562300 - DNA, 15 bp, Homo sapiens
aaacacctagcttta

SEQ ID NO: 1562301 - DNA, 13 bp, Homo sapiens
aaacacctcccca

SEQ ID NO: 1562302 - DNA, 18 bp, Homo sapiens
aaacacctcctcatgtac

SEQ ID NO: 1562303 - DNA, 17 bp, Homo sapiens
aaacactaagctctctg

SEQ ID NO: 1562304 - DNA, 15 bp, Homo sapiens
aaacactacacattt

SEQ ID NO: 1562305 - DNA, 20 bp, Homo sapiens
aaacactacctcttttgaga

SEQ ID NO: 1562306 - DNA, 20 bp, Homo sapiens
aaacactccaccctccacct

SEQ ID NO: 1562307 - DNA, 13 bp, Homo sapiens
aaacactgccttt

SEQ ID NO: 1562308 - DNA, 22 bp, Homo sapiens
aaacactgcctttttatttata

SEQ ID NO: 1562309 - DNA, 21 bp, Homo sapiens
aaacactgtaatcttaaaagt

SEQ ID NO: 1562310 - DNA, 20 bp, Homo sapiens
aaacactgttttatagaaaa

SEQ ID NO: 1562311 - DNA, 14 bp, Homo sapiens
aaacacttctgctt

SEQ ID NO: 1562312 - DNA, 15 bp, Homo sapiens
aaacacttctgcttt

SEQ ID NO: 1562313 - DNA, 13 bp, Homo sapiens
aaacagaacactt

SEQ ID NO: 1562314 - DNA, 22 bp, Homo sapiens
aaacagacaatatgtgagtgcc

SEQ ID NO: 1562315 - DNA, 11 bp, Homo sapiens
aaacagagaac

SEQ ID NO: 1562316 - DNA, 16 bp, Homo sapiens
aaacagagctactgag

SEQ ID NO: 1562317 - DNA, 20 bp, Homo sapiens
aaacagaggccatggcagaa

SEQ ID NO: 1562318 - DNA, 15 bp, Homo sapiens
aaacagagtggcctc

SEQ ID NO: 1562319 - DNA, 20 bp, Homo sapiens
aaacagatctcctggcaaag

SEQ ID NO: 1562320 - DNA, 18 bp, Homo sapiens
aaacagatgtgaatattc

SEQ ID NO: 1562321 - DNA, 19 bp, Homo sapiens
aaacagatttttacaaatg

SEQ ID NO: 1562322 - DNA, 15 bp, Homo sapiens
aaacagcacacctgt

SEQ ID NO: 1562323 - DNA, 22 bp, Homo sapiens
aaacagcacacctgtgtccaag

SEQ ID NO: 1562324 - DNA, 14 bp, Homo sapiens
aaacagcagctcat

SEQ ID NO: 1562325 - DNA, 11 bp, Homo sapiens
aaacagcatga

SEQ ID NO: 1562326 - DNA, 14 bp, Homo sapiens
aaacagcatgaata

SEQ ID NO: 1562327 - DNA, 21 bp, Homo sapiens
aaacagcattgctttctgaaa

SEQ ID NO: 1562328 - DNA, 20 bp, Homo sapiens
aaacagccaccgtttcttcc

SEQ ID NO: 1562329 - DNA, 13 bp, Homo sapiens
aaacagctcagcc

SEQ ID NO: 1562330 - DNA, 17 bp, Homo sapiens
aaacaggaattttattt

SEQ ID NO: 1562331 - DNA, 19 bp, Homo sapiens
aaacaggaattttattttg

SEQ ID NO: 1562332 - DNA, 13 bp, Homo sapiens
aaacaggcaaagt

SEQ ID NO: 1562333 - DNA, 14 bp, Homo sapiens
aaacaggcccagca

SEQ ID NO: 1562334 - DNA, 15 bp, Homo sapiens
aaacagggctgcctt

SEQ ID NO: 1562335 - DNA, 18 bp, Homo sapiens
aaacaggtatatactttg

SEQ ID NO: 1562336 - DNA, 15 bp, Homo sapiens
aaacagtctcaggaa

SEQ ID NO: 1562337 - DNA, 20 bp, Homo sapiens
aaacagtctcaggaaatcaa

SEQ ID NO: 1562338 - DNA, 12 bp, Homo sapiens
aaacagtgcctg

SEQ ID NO: 1562339 - DNA, 23 bp, Homo sapiens
aaacagttaactttcagaagaga

SEQ ID NO: 1562340 - DNA, 13 bp, Homo sapiens
aaacataaaaact

SEQ ID NO: 1562341 - DNA, 14 bp, Homo sapiens
aaacataaaaagca

SEQ ID NO: 1562342 - DNA, 22 bp, Homo sapiens
aaacataaaaagcagaatttta

SEQ ID NO: 1562343 - DNA, 16 bp, Homo sapiens
aaacataagagagcct

SEQ ID NO: 1562344 - DNA, 12 bp, Homo sapiens
aaacataattgt

SEQ ID NO: 1562345 - DNA, 16 bp, Homo sapiens
aaacatacataataca

SEQ ID NO: 1562346 - DNA, 21 bp, Homo sapiens
aaacatagaaatggaaatttt

SEQ ID NO: 1562347 - DNA, 17 bp, Homo sapiens
aaacatatttttatact

SEQ ID NO: 1562348 - DNA, 14 bp, Homo sapiens
aaacatcacacaca

SEQ ID NO: 1562349 - DNA, 15 bp, Homo sapiens
aaacatcactccctc

SEQ ID NO: 1562350 - DNA, 17 bp, Homo sapiens
aaacatcagacctgtct

SEQ ID NO: 1562351 - DNA, 18 bp, Homo sapiens
aaacatcagacctgtctt

SEQ ID NO: 1562352 - DNA, 17 bp, Homo sapiens
aaacatcagctgaattc

SEQ ID NO: 1562353 - DNA, 19 bp, Homo sapiens
aaacatcagttactctgaa

SEQ ID NO: 1562354 - DNA, 20 bp, Homo sapiens
aaacatcagttactctgaag

SEQ ID NO: 1562355 - DNA, 16 bp, Homo sapiens
aaacatcccactgact

SEQ ID NO: 1562356 - DNA, 15 bp, Homo sapiens
aaacatgagatgtgt

SEQ ID NO: 1562357 - DNA, 21 bp, Homo sapiens
aaacatggtagaattggagag

SEQ ID NO: 1562358 - DNA, 20 bp, Homo sapiens
aaacatgtactacagctata

SEQ ID NO: 1562359 - DNA, 22 bp, Homo sapiens
aaacatgtctcctatcctggtt

SEQ ID NO: 1562360 - DNA, 22 bp, Homo sapiens
aaacatgtttaaatagcctaaa

SEQ ID NO: 1562361 - DNA, 13 bp, Homo sapiens
aaacattaaacac

SEQ ID NO: 1562362 - DNA, 14 bp, Homo sapiens
aaacattaaacact

SEQ ID NO: 1562363 - DNA, 16 bp, Homo sapiens
aaacattaagtaaatg

SEQ ID NO: 1562364 - DNA, 20 bp, Homo sapiens
aaacattaatagcagccttt

SEQ ID NO: 1562365 - DNA, 20 bp, Homo sapiens
aaacattaatatttaccaaa

SEQ ID NO: 1562366 - DNA, 17 bp, Homo sapiens
aaacattaattttgtgc

SEQ ID NO: 1562367 - DNA, 19 bp, Homo sapiens
aaacattaattttgtgcat

SEQ ID NO: 1562368 - DNA, 21 bp, Homo sapiens
aaacattaattttgtgcattc

SEQ ID NO: 1562369 - DNA, 21 bp, Homo sapiens
aaacattcaattccagagaac

SEQ ID NO: 1562370 - DNA, 23 bp, Homo sapiens
aaacattcacacagggctctttg

SEQ ID NO: 1562371 - DNA, 13 bp, Homo sapiens
aaacattcttatt

SEQ ID NO: 1562372 - DNA, 17 bp, Homo sapiens
aaacattctttaacata

SEQ ID NO: 1562373 - DNA, 19 bp, Homo sapiens
aaacattctttaacataca

SEQ ID NO: 1562374 - DNA, 16 bp, Homo sapiens
aaacattgaagtaatg

SEQ ID NO: 1562375 - DNA, 13 bp, Homo sapiens
aaacatttacaat

SEQ ID NO: 1562376 - DNA, 16 bp, Homo sapiens
aaacatttactgacca

SEQ ID NO: 1562377 - DNA, 12 bp, Homo sapiens
aaacatttgctg

SEQ ID NO: 1562378 - DNA, 14 bp, Homo sapiens
aaacattttaaaaa

SEQ ID NO: 1562379 - DNA, 23 bp, Homo sapiens
aaacattttatcattaaaaatta

SEQ ID NO: 1562380 - DNA, 19 bp, Homo sapiens
aaacattttctcttagaaa

SEQ ID NO: 1562381 - DNA, 20 bp, Homo sapiens
aaacattttctcttagaaaa

SEQ ID NO: 1562382 - DNA, 13 bp, Homo sapiens
aaacattttgact

SEQ ID NO: 1562383 - DNA, 19 bp, Homo sapiens
aaacattttttaagaaaac

SEQ ID NO: 1562384 - DNA, 23 bp, Homo sapiens
aaacattttttaagaaaacattt

SEQ ID NO: 1562385 - DNA, 19 bp, Homo sapiens
aaaccaaaagttattaaaa

SEQ ID NO: 1562386 - DNA, 15 bp, Homo sapiens
aaaccaacaataaat

SEQ ID NO: 1562387 - DNA, 14 bp, Homo sapiens
aaaccaacatcttt

SEQ ID NO: 1562388 - DNA, 19 bp, Homo sapiens
aaaccacaaacggagcccc

SEQ ID NO: 1562389 - DNA, 13 bp, Homo sapiens
aaaccacagcagg

SEQ ID NO: 1562390 - DNA, 16 bp, Homo sapiens
aaaccacagcagttga

SEQ ID NO: 1562391 - DNA, 20 bp, Homo sapiens
aaaccacctcagaaaggatt

SEQ ID NO: 1562392 - DNA, 18 bp, Homo sapiens
aaaccacttctccatgct

SEQ ID NO: 1562393 - DNA, 13 bp, Homo sapiens
aaaccagccaggc

SEQ ID NO: 1562394 - DNA, 11 bp, Homo sapiens
aaaccagctgc

SEQ ID NO: 1562395 - DNA, 19 bp, Homo sapiens
aaaccagtgtagccttgcc

SEQ ID NO: 1562396 - DNA, 17 bp, Homo sapiens
aaaccatcagatatttc

SEQ ID NO: 1562397 - DNA, 23 bp, Homo sapiens
aaaccatccagtgacaaaccatc

SEQ ID NO: 1562398 - DNA, 16 bp, Homo sapiens
aaaccatcctgtttga

SEQ ID NO: 1562399 - DNA, 16 bp, Homo sapiens
aaaccatgagaatttg

SEQ ID NO: 1562400 - DNA, 21 bp, Homo sapiens
aaaccatgagaatttgcaaca

SEQ ID NO: 1562401 - DNA, 15 bp, Homo sapiens
aaaccatgcaaatgc

SEQ ID NO: 1562402 - DNA, 17 bp, Homo sapiens
aaaccatttttaaagta

SEQ ID NO: 1562403 - DNA, 19 bp, Homo sapiens
aaaccatttttgctgaatt

SEQ ID NO: 1562404 - DNA, 20 bp, Homo sapiens
aaaccatttttgctgaattc

SEQ ID NO: 1562405 - DNA, 14 bp, Homo sapiens
aaacccaagtgctg

SEQ ID NO: 1562406 - DNA, 14 bp, Homo sapiens
aaacccaccagcct

SEQ ID NO: 1562407 - DNA, 15 bp, Homo sapiens
aaacccatacaatgt

SEQ ID NO: 1562408 - DNA, 22 bp, Homo sapiens
aaacccatacaatgtatgtaca

SEQ ID NO: 1562409 - DNA, 21 bp, Homo sapiens
aaacccccaaaatccaaaact

SEQ ID NO: 1562410 - DNA, 13 bp, Homo sapiens
aaaccccgtctct

SEQ ID NO: 1562411 - DNA, 13 bp, Homo sapiens
aaaccctagcctt

SEQ ID NO: 1562412 - DNA, 16 bp, Homo sapiens
aaaccctagccttgct

SEQ ID NO: 1562413 - DNA, 17 bp, Homo sapiens
aaaccctagccttgctt

SEQ ID NO: 1562414 - DNA, 17 bp, Homo sapiens
aaaccctgaagccattg

SEQ ID NO: 1562415 - DNA, 20 bp, Homo sapiens
aaaccctgcttctgctgccc

SEQ ID NO: 1562416 - DNA, 23 bp, Homo sapiens
aaacccttcagtgctacattttg

SEQ ID NO: 1562417 - DNA, 19 bp, Homo sapiens
aaaccgtcctgtgtacaca

SEQ ID NO: 1562418 - DNA, 12 bp, Homo sapiens
aaacctaaaaat

SEQ ID NO: 1562419 - DNA, 14 bp, Homo sapiens
aaacctactgccca

SEQ ID NO: 1562420 - DNA, 17 bp, Homo sapiens
aaacctactttttatgt

SEQ ID NO: 1562421 - DNA, 17 bp, Homo sapiens
aaacctcaaaatgtcta

SEQ ID NO: 1562422 - DNA, 14 bp, Homo sapiens
aaacctcacatttg

SEQ ID NO: 1562423 - DNA, 17 bp, Homo sapiens
aaacctcacatttgtga

SEQ ID NO: 1562424 - DNA, 23 bp, Homo sapiens
aaacctcatgacagccagagcct

SEQ ID NO: 1562425 - DNA, 16 bp, Homo sapiens
aaacctctactaaaaa

SEQ ID NO: 1562426 - DNA, 14 bp, Homo sapiens
aaacctgatgttaa

SEQ ID NO: 1562427 - DNA, 12 bp, Homo sapiens
aaacctgccctg

SEQ ID NO: 1562428 - DNA, 16 bp, Homo sapiens
aaacctgccctgcctg

SEQ ID NO: 1562429 - DNA, 18 bp, Homo sapiens
aaacctgcctaaattaaa

SEQ ID NO: 1562430 - DNA, 15 bp, Homo sapiens
aaacctggatgtcac

SEQ ID NO: 1562431 - DNA, 18 bp, Homo sapiens
aaacctgggattatatat

SEQ ID NO: 1562432 - DNA, 17 bp, Homo sapiens
aaacctgggctcagcct

SEQ ID NO: 1562433 - DNA, 16 bp, Homo sapiens
aaaccttattgtacct

SEQ ID NO: 1562434 - DNA, 19 bp, Homo sapiens
aaaccttattttttcccaa

SEQ ID NO: 1562435 - DNA, 16 bp, Homo sapiens
aaaccttccacccagt

SEQ ID NO: 1562436 - DNA, 11 bp, Homo sapiens
aaaccttcctt

SEQ ID NO: 1562437 - DNA, 17 bp, Homo sapiens
aaaccttgctctcctca

SEQ ID NO: 1562438 - DNA, 20 bp, Homo sapiens
aaaccttgctctcctcatct

SEQ ID NO: 1562439 - DNA, 11 bp, Homo sapiens
aaaccttggag

SEQ ID NO: 1562440 - DNA, 15 bp, Homo sapiens
aaaccttgtaaaaaa

SEQ ID NO: 1562441 - DNA, 17 bp, Homo sapiens
aaaccttgtaaaaaaag

SEQ ID NO: 1562442 - DNA, 17 bp, Homo sapiens
aaacctttagggcagct

SEQ ID NO: 1562443 - DNA, 12 bp, Homo sapiens
aaaccttttatt

SEQ ID NO: 1562444 - DNA, 14 bp, Homo sapiens
aaaccttttatttt

SEQ ID NO: 1562445 - DNA, 23 bp, Homo sapiens
aaaccttttatttttatttctga

SEQ ID NO: 1562446 - DNA, 20 bp, Homo sapiens
aaaccttttggaaaatctgc

SEQ ID NO: 1562447 - DNA, 19 bp, Homo sapiens
aaacgaagccatctttctt

SEQ ID NO: 1562448 - DNA, 23 bp, Homo sapiens
aaacgagggctgatggaggaaaa

SEQ ID NO: 1562449 - DNA, 13 bp, Homo sapiens
aaacgcagacact

SEQ ID NO: 1562450 - DNA, 21 bp, Homo sapiens
aaacgctacctctctgtccct

SEQ ID NO: 1562451 - DNA, 14 bp, Homo sapiens
aaacgctcctttgt

SEQ ID NO: 1562452 - DNA, 21 bp, Homo sapiens
aaacggaataataaaaagcat

SEQ ID NO: 1562453 - DNA, 23 bp, Homo sapiens
aaacggaggaagcccacatattc

SEQ ID NO: 1562454 - DNA, 21 bp, Homo sapiens
aaacggcaacgtagcctgggc

SEQ ID NO: 1562455 - DNA, 16 bp, Homo sapiens
aaacgtctattttgta

SEQ ID NO: 1562456 - DNA, 20 bp, Homo sapiens
aaacgtctattttgtatatt

SEQ ID NO: 1562457 - DNA, 16 bp, Homo sapiens
aaacgtggtcaccttc

SEQ ID NO: 1562458 - DNA, 21 bp, Homo sapiens
aaacgtttctcaaatctgctt

SEQ ID NO: 1562459 - DNA, 12 bp, Homo sapiens
aaactaatacgt

SEQ ID NO: 1562460 - DNA, 18 bp, Homo sapiens
aaactacaaagtaaaatg

SEQ ID NO: 1562461 - DNA, 15 bp, Homo sapiens
aaactaccaaattag

SEQ ID NO: 1562462 - DNA, 15 bp, Homo sapiens
aaactagctcgtgat

SEQ ID NO: 1562463 - DNA, 23 bp, Homo sapiens
aaactagctcgtgattggcatat

SEQ ID NO: 1562464 - DNA, 15 bp, Homo sapiens
aaactagctgtcact

SEQ ID NO: 1562465 - DNA, 15 bp, Homo sapiens
aaactaggtaaaatt

SEQ ID NO: 1562466 - DNA, 16 bp, Homo sapiens
aaactataaagtttta

SEQ ID NO: 1562467 - DNA, 17 bp, Homo sapiens
aaactatcctgattcca

SEQ ID NO: 1562468 - DNA, 19 bp, Homo sapiens
aaactatcctgattccaaa

SEQ ID NO: 1562469 - DNA, 21 bp, Homo sapiens
aaactatcggttcaagttgat

SEQ ID NO: 1562470 - DNA, 17 bp, Homo sapiens
aaactatgatcacagtg

SEQ ID NO: 1562471 - DNA, 17 bp, Homo sapiens
aaactattagagtattt

SEQ ID NO: 1562472 - DNA, 23 bp, Homo sapiens
aaactattagagtatttcccttc

SEQ ID NO: 1562473 - DNA, 22 bp, Homo sapiens
aaactatttatctgtgtttttg

SEQ ID NO: 1562474 - DNA, 13 bp, Homo sapiens
aaactcaaaatat

SEQ ID NO: 1562475 - DNA, 18 bp, Homo sapiens
aaactcaccatgtaaaag

SEQ ID NO: 1562476 - DNA, 15 bp, Homo sapiens
aaactcactgctcaa

SEQ ID NO: 1562477 - DNA, 19 bp, Homo sapiens
aaactcagaatataacatg

SEQ ID NO: 1562478 - DNA, 14 bp, Homo sapiens
aaactcagatctga

SEQ ID NO: 1562479 - DNA, 11 bp, Homo sapiens
aaactcagccg

SEQ ID NO: 1562480 - DNA, 16 bp, Homo sapiens
aaactcagttaaaatg

SEQ ID NO: 1562481 - DNA, 24 bp, Homo sapiens
aaactcatttataaagctaaaata

SEQ ID NO: 1562482 - DNA, 16 bp, Homo sapiens
aaactccacatctgcc

SEQ ID NO: 1562483 - DNA, 18 bp, Homo sapiens
aaactccacatctgcctt

SEQ ID NO: 1562484 - DNA, 15 bp, Homo sapiens
aaactccaccttccc

SEQ ID NO: 1562485 - DNA, 19 bp, Homo sapiens
aaactccatctcaaaacaa

SEQ ID NO: 1562486 - DNA, 21 bp, Homo sapiens
aaactccatctcaaaacaaaa

SEQ ID NO: 1562487 - DNA, 22 bp, Homo sapiens
aaactccatctcaaaacaaaac

SEQ ID NO: 1562488 - DNA, 19 bp, Homo sapiens
aaactcctgattttgtagt

SEQ ID NO: 1562489 - DNA, 20 bp, Homo sapiens
aaactccttcctggcctgag

SEQ ID NO: 1562490 - DNA, 16 bp, Homo sapiens
aaactctctcccagga

SEQ ID NO: 1562491 - DNA, 15 bp, Homo sapiens
aaactctgaatttat

SEQ ID NO: 1562492 - DNA, 22 bp, Homo sapiens
aaactctgggaaataagagaga

SEQ ID NO: 1562493 - DNA, 20 bp, Homo sapiens
aaactctgttgcaagtgcaa

SEQ ID NO: 1562494 - DNA, 16 bp, Homo sapiens
aaactcttcagttaat

SEQ ID NO: 1562495 - DNA, 22 bp, Homo sapiens
aaactcttcagttaattcttag

SEQ ID NO: 1562496 - DNA, 11 bp, Homo sapiens
aaactctttgg

SEQ ID NO: 1562497 - DNA, 13 bp, Homo sapiens
aaactcttttccc

SEQ ID NO: 1562498 - DNA, 22 bp, Homo sapiens
aaactgaagcagcctctcccca

SEQ ID NO: 1562499 - DNA, 14 bp, Homo sapiens
aaactgaatggaag

SEQ ID NO: 1562500 - DNA, 11 bp, Homo sapiens
aaactgaattt

SEQ ID NO: 1562501 - DNA, 23 bp, Homo sapiens
aaactgagatgtgaacacatcag

SEQ ID NO: 1562502 - DNA, 18 bp, Homo sapiens
aaactgagcctcacttgc

SEQ ID NO: 1562503 - DNA, 19 bp, Homo sapiens
aaactgatcaaaaataaac

SEQ ID NO: 1562504 - DNA, 22 bp, Homo sapiens
aaactgatccagtataagacta

SEQ ID NO: 1562505 - DNA, 17 bp, Homo sapiens
aaactgcaatagagact

SEQ ID NO: 1562506 - DNA, 21 bp, Homo sapiens
aaactgcaatagagactgtag

SEQ ID NO: 1562507 - DNA, 19 bp, Homo sapiens
aaactgccagcaacgcagg

SEQ ID NO: 1562508 - DNA, 18 bp, Homo sapiens
aaactgcgaggacatcaa

SEQ ID NO: 1562509 - DNA, 22 bp, Homo sapiens
aaactgcttcccttactttgct

SEQ ID NO: 1562510 - DNA, 21 bp, Homo sapiens
aaactggaaatactagatttg

SEQ ID NO: 1562511 - DNA, 20 bp, Homo sapiens
aaactggaacggtgaaggtg

SEQ ID NO: 1562512 - DNA, 20 bp, Homo sapiens
aaactggatatttcaatctt

SEQ ID NO: 1562513 - DNA, 14 bp, Homo sapiens
aaactggcttcccc

SEQ ID NO: 1562514 - DNA, 20 bp, Homo sapiens
aaactgggctggaagatatt

SEQ ID NO: 1562515 - DNA, 16 bp, Homo sapiens
aaactgtacatttaaa

SEQ ID NO: 1562516 - DNA, 13 bp, Homo sapiens
aaactgtactgtg

SEQ ID NO: 1562517 - DNA, 14 bp, Homo sapiens
aaactgtagatgaa

SEQ ID NO: 1562518 - DNA, 17 bp, Homo sapiens
aaactgtagatgaagag

SEQ ID NO: 1562519 - DNA, 18 bp, Homo sapiens
aaactgtctttaaaagag

SEQ ID NO: 1562520 - DNA, 11 bp, Homo sapiens
aaactgtgaaa

SEQ ID NO: 1562521 - DNA, 21 bp, Homo sapiens
aaactgtgactaggcatacac

SEQ ID NO: 1562522 - DNA, 21 bp, Homo sapiens
aaactgtgtacataactgaaa

SEQ ID NO: 1562523 - DNA, 22 bp, Homo sapiens
aaactgtgtatagcttacctga

SEQ ID NO: 1562524 - DNA, 19 bp, Homo sapiens
aaactgtgtggactgtgat

SEQ ID NO: 1562525 - DNA, 20 bp, Homo sapiens
aaactgtgtggactgtgatg

SEQ ID NO: 1562526 - DNA, 22 bp, Homo sapiens
aaactgttatttttacagcaaa

SEQ ID NO: 1562527 - DNA, 14 bp, Homo sapiens
aaactgttctctat

SEQ ID NO: 1562528 - DNA, 13 bp, Homo sapiens
aaacttaaaaaca

SEQ ID NO: 1562529 - DNA, 15 bp, Homo sapiens
aaacttaaaaacaag

SEQ ID NO: 1562530 - DNA, 21 bp, Homo sapiens
aaacttaaatgttattatctg

SEQ ID NO: 1562531 - DNA, 23 bp, Homo sapiens
aaacttactgtcagagaatatga

SEQ ID NO: 1562532 - DNA, 15 bp, Homo sapiens
aaacttagaggaaaa

SEQ ID NO: 1562533 - DNA, 16 bp, Homo sapiens
aaacttagaggaaaat

SEQ ID NO: 1562534 - DNA, 20 bp, Homo sapiens
aaacttagcatctaatttca

SEQ ID NO: 1562535 - DNA, 17 bp, Homo sapiens
aaacttagtgacaaaat

SEQ ID NO: 1562536 - DNA, 13 bp, Homo sapiens
aaacttatgctag

SEQ ID NO: 1562537 - DNA, 22 bp, Homo sapiens
aaacttcagtttcacagaaaat

SEQ ID NO: 1562538 - DNA, 23 bp, Homo sapiens
aaacttcccgtcccatatcctgc

SEQ ID NO: 1562539 - DNA, 12 bp, Homo sapiens
aaacttgaaata

SEQ ID NO: 1562540 - DNA, 18 bp, Homo sapiens
aaacttgaaatatataat

SEQ ID NO: 1562541 - DNA, 13 bp, Homo sapiens
aaacttgaagcag

SEQ ID NO: 1562542 - DNA, 18 bp, Homo sapiens
aaacttgctttatgcctt

SEQ ID NO: 1562543 - DNA, 16 bp, Homo sapiens
aaacttgtttcactga

SEQ ID NO: 1562544 - DNA, 17 bp, Homo sapiens
aaacttgtttcactgaa

SEQ ID NO: 1562545 - DNA, 21 bp, Homo sapiens
aaactttagagtagcatgaga

SEQ ID NO: 1562546 - DNA, 18 bp, Homo sapiens
aaactttcctcgcctgac

SEQ ID NO: 1562547 - DNA, 15 bp, Homo sapiens
aaactttctttctaa

SEQ ID NO: 1562548 - DNA, 20 bp, Homo sapiens
aaactttgagatctaaaaat

SEQ ID NO: 1562549 - DNA, 19 bp, Homo sapiens
aaactttgagtacagatac

SEQ ID NO: 1562550 - DNA, 19 bp, Homo sapiens
aaactttggaaccagactc

SEQ ID NO: 1562551 - DNA, 13 bp, Homo sapiens
aaacttttaactg

SEQ ID NO: 1562552 - DNA, 14 bp, Homo sapiens
aaacttttctcaga

SEQ ID NO: 1562553 - DNA, 15 bp, Homo sapiens
aaacttttttatttt

SEQ ID NO: 1562554 - DNA, 24 bp, Homo sapiens
aaacttttttgaaataataaatct

SEQ ID NO: 1562555 - DNA, 21 bp, Homo sapiens
aaagaaaaaaaaaaaagccag

SEQ ID NO: 1562556 - DNA, 22 bp, Homo sapiens
aaagaaaaaaaaaaaagccagc

SEQ ID NO: 1562557 - DNA, 17 bp, Homo sapiens
aaagaaaaaaatggaaa

SEQ ID NO: 1562558 - DNA, 21 bp, Homo sapiens
aaagaaaaatgcctgtctcta

SEQ ID NO: 1562559 - DNA, 18 bp, Homo sapiens
aaagaaaaggatttaagc

SEQ ID NO: 1562560 - DNA, 16 bp, Homo sapiens
aaagaaacaagctgtg

SEQ ID NO: 1562561 - DNA, 18 bp, Homo sapiens
aaagaaacaagctgtgca

SEQ ID NO: 1562562 - DNA, 12 bp, Homo sapiens
aaagaaacatgg

SEQ ID NO: 1562563 - DNA, 13 bp, Homo sapiens
aaagaaagtgtat

SEQ ID NO: 1562564 - DNA, 16 bp, Homo sapiens
aaagaactccttattt

SEQ ID NO: 1562565 - DNA, 21 bp, Homo sapiens
aaagaactttaaagctcagga

SEQ ID NO: 1562566 - DNA, 16 bp, Homo sapiens
aaagaagaaaataacc

SEQ ID NO: 1562567 - DNA, 14 bp, Homo sapiens
aaagaagaaacttt

SEQ ID NO: 1562568 - DNA, 16 bp, Homo sapiens
aaagaagaaagtctat

SEQ ID NO: 1562569 - DNA, 13 bp, Homo sapiens
aaagaagcaagac

SEQ ID NO: 1562570 - DNA, 17 bp, Homo sapiens
aaagaaggaaagatggt

SEQ ID NO: 1562571 - DNA, 15 bp, Homo sapiens
aaagaaggacccaga

SEQ ID NO: 1562572 - DNA, 18 bp, Homo sapiens
aaagaagggatccctaac

SEQ ID NO: 1562573 - DNA, 18 bp, Homo sapiens
aaagaagggggccctgct

SEQ ID NO: 1562574 - DNA, 13 bp, Homo sapiens
aaagaagtggaga

SEQ ID NO: 1562575 - DNA, 15 bp, Homo sapiens
aaagaagtggagaca

SEQ ID NO: 1562576 - DNA, 20 bp, Homo sapiens
aaagaatatgactttttata

SEQ ID NO: 1562577 - DNA, 17 bp, Homo sapiens
aaagaatccttatctat

SEQ ID NO: 1562578 - DNA, 19 bp, Homo sapiens
aaagaatccttatctataa

SEQ ID NO: 1562579 - DNA, 19 bp, Homo sapiens
aaagaatctactatacttt

SEQ ID NO: 1562580 - DNA, 14 bp, Homo sapiens
aaagaattacagta

SEQ ID NO: 1562581 - DNA, 16 bp, Homo sapiens
aaagaatttagtatta

SEQ ID NO: 1562582 - DNA, 15 bp, Homo sapiens
aaagaatttcataga

SEQ ID NO: 1562583 - DNA, 21 bp, Homo sapiens
aaagacaaaaatcaaagaaca

SEQ ID NO: 1562584 - DNA, 22 bp, Homo sapiens
aaagacaaaaatccttgttgaa

SEQ ID NO: 1562585 - DNA, 16 bp, Homo sapiens
aaagacaaattctgtt

SEQ ID NO: 1562586 - DNA, 17 bp, Homo sapiens
aaagacaaattctgttt

SEQ ID NO: 1562587 - DNA, 9 bp, Homo sapiens
aaagacaga

SEQ ID NO: 1562588 - DNA, 14 bp, Homo sapiens
aaagacatacctga

SEQ ID NO: 1562589 - DNA, 11 bp, Homo sapiens
aaagacatcaa

SEQ ID NO: 1562590 - DNA, 16 bp, Homo sapiens
aaagacatcaatgaaa

SEQ ID NO: 1562591 - DNA, 17 bp, Homo sapiens
aaagaccaaatctcagt

SEQ ID NO: 1562592 - DNA, 14 bp, Homo sapiens
aaagaccagaaatt

SEQ ID NO: 1562593 - DNA, 16 bp, Homo sapiens
aaagacccgggagctg

SEQ ID NO: 1562594 - DNA, 15 bp, Homo sapiens
aaagacctgcctgtg

SEQ ID NO: 1562595 - DNA, 23 bp, Homo sapiens
aaagacgaccagcatttaaccaa

SEQ ID NO: 1562596 - DNA, 17 bp, Homo sapiens
aaagactatctaaatgt

SEQ ID NO: 1562597 - DNA, 17 bp, Homo sapiens
aaagactattcaaacag

SEQ ID NO: 1562598 - DNA, 23 bp, Homo sapiens
aaagactattcaaacagtctcag

SEQ ID NO: 1562599 - DNA, 18 bp, Homo sapiens
aaagactatttcaaaatg

SEQ ID NO: 1562600 - DNA, 19 bp, Homo sapiens
aaagactatttcaaaatgt

SEQ ID NO: 1562601 - DNA, 17 bp, Homo sapiens
aaagactcaagagaatt

SEQ ID NO: 1562602 - DNA, 14 bp, Homo sapiens
aaagactgaacatg

SEQ ID NO: 1562603 - DNA, 14 bp, Homo sapiens
aaagactgatctca

SEQ ID NO: 1562604 - DNA, 13 bp, Homo sapiens
aaagactgtacaa

SEQ ID NO: 1562605 - DNA, 14 bp, Homo sapiens
aaagactgtgaaca

SEQ ID NO: 1562606 - DNA, 18 bp, Homo sapiens
aaagactgtgaacagctt

SEQ ID NO: 1562607 - DNA, 13 bp, Homo sapiens
aaagacttaaagg

SEQ ID NO: 1562608 - DNA, 18 bp, Homo sapiens
aaagactttaaaagtgat

SEQ ID NO: 1562609 - DNA, 18 bp, Homo sapiens
aaagagaaaaaaagtttg

SEQ ID NO: 1562610 - DNA, 22 bp, Homo sapiens
aaagagaaacagttggtaactt

SEQ ID NO: 1562611 - DNA, 20 bp, Homo sapiens
aaagagaaaccgaggtgcaa

SEQ ID NO: 1562612 - DNA, 10 bp, Homo sapiens
aaagagacca

SEQ ID NO: 1562613 - DNA, 16 bp, Homo sapiens
aaagagagaagccagc

SEQ ID NO: 1562614 - DNA, 13 bp, Homo sapiens
aaagagagaatgt

SEQ ID NO: 1562615 - DNA, 11 bp, Homo sapiens
aaagagagaga

SEQ ID NO: 1562616 - DNA, 23 bp, Homo sapiens
aaagagcaagtctggatctggga

SEQ ID NO: 1562617 - DNA, 17 bp, Homo sapiens
aaagagctcagacattt

SEQ ID NO: 1562618 - DNA, 16 bp, Homo sapiens
aaagagctgcctggat

SEQ ID NO: 1562619 - DNA, 12 bp, Homo sapiens
aaagaggcatct

SEQ ID NO: 1562620 - DNA, 20 bp, Homo sapiens
aaagaggctgcccctctcac

SEQ ID NO: 1562621 - DNA, 15 bp, Homo sapiens
aaagagggcttcctc

SEQ ID NO: 1562622 - DNA, 13 bp, Homo sapiens
aaagagtctagat

SEQ ID NO: 1562623 - DNA, 21 bp, Homo sapiens
aaagagtctagattcaaaggt

SEQ ID NO: 1562624 - DNA, 14 bp, Homo sapiens
aaagagtcttccaa

SEQ ID NO: 1562625 - DNA, 14 bp, Homo sapiens
aaagagtctttctt

SEQ ID NO: 1562626 - DNA, 13 bp, Homo sapiens
aaagagttaagaa

SEQ ID NO: 1562627 - DNA, 22 bp, Homo sapiens
aaagataacaagatctttcagg

SEQ ID NO: 1562628 - DNA, 17 bp, Homo sapiens
aaagatagacaggtcct

SEQ ID NO: 1562629 - DNA, 16 bp, Homo sapiens
aaagatcaaaataaaa

SEQ ID NO: 1562630 - DNA, 18 bp, Homo sapiens
aaagatcaccttgtattc

SEQ ID NO: 1562631 - DNA, 20 bp, Homo sapiens
aaagatccagggatggagat

SEQ ID NO: 1562632 - DNA, 18 bp, Homo sapiens
aaagatctgtcctcagcc

SEQ ID NO: 1562633 - DNA, 19 bp, Homo sapiens
aaagatgaaactgaaagca

SEQ ID NO: 1562634 - DNA, 11 bp, Homo sapiens
aaagatgagtt

SEQ ID NO: 1562635 - DNA, 23 bp, Homo sapiens
aaagatgcagagtaagtattatg

SEQ ID NO: 1562636 - DNA, 12 bp, Homo sapiens
aaagatgcattt

SEQ ID NO: 1562637 - DNA, 18 bp, Homo sapiens
aaagatgctagaaaaatg

SEQ ID NO: 1562638 - DNA, 18 bp, Homo sapiens
aaagatgctgtcggcacc

SEQ ID NO: 1562639 - DNA, 15 bp, Homo sapiens
aaagatggagtttct

SEQ ID NO: 1562640 - DNA, 16 bp, Homo sapiens
aaagatggagtttcta

SEQ ID NO: 1562641 - DNA, 17 bp, Homo sapiens
aaagatggagtttctaa

SEQ ID NO: 1562642 - DNA, 21 bp, Homo sapiens
aaagatggagtttctaaggtc

SEQ ID NO: 1562643 - DNA, 17 bp, Homo sapiens
aaagatggttaaacatt

SEQ ID NO: 1562644 - DNA, 19 bp, Homo sapiens
aaagatggttaaacatttt

SEQ ID NO: 1562645 - DNA, 20 bp, Homo sapiens
aaagatggttaaacattttc

SEQ ID NO: 1562646 - DNA, 16 bp, Homo sapiens
aaagatggttgtagca

SEQ ID NO: 1562647 - DNA, 20 bp, Homo sapiens
aaagatggtttatgcatgta

SEQ ID NO: 1562648 - DNA, 20 bp, Homo sapiens
aaagatgtttgtcagatatg

SEQ ID NO: 1562649 - DNA, 21 bp, Homo sapiens
aaagatgtttgtcagatatga

SEQ ID NO: 1562650 - DNA, 17 bp, Homo sapiens
aaagattaatctttaaa

SEQ ID NO: 1562651 - DNA, 24 bp, Homo sapiens
aaagattataatatgtgccttaag

SEQ ID NO: 1562652 - DNA, 17 bp, Homo sapiens
aaagattatgatgcata

SEQ ID NO: 1562653 - DNA, 23 bp, Homo sapiens
aaagattattgtgacttcactgt

SEQ ID NO: 1562654 - DNA, 19 bp, Homo sapiens
aaagattcaggtatgttgc

SEQ ID NO: 1562655 - DNA, 19 bp, Homo sapiens
aaagattcatttttaatca

SEQ ID NO: 1562656 - DNA, 18 bp, Homo sapiens
aaagattctatagttcta

SEQ ID NO: 1562657 - DNA, 20 bp, Homo sapiens
aaagattctatagttctaga

SEQ ID NO: 1562658 - DNA, 23 bp, Homo sapiens
aaagattctctttaaaaaagact

SEQ ID NO: 1562659 - DNA, 13 bp, Homo sapiens
aaagatttatcaa

SEQ ID NO: 1562660 - DNA, 16 bp, Homo sapiens
aaagatttcaaataaa

SEQ ID NO: 1562661 - DNA, 19 bp, Homo sapiens
aaagatttctagtaggcag

SEQ ID NO: 1562662 - DNA, 12 bp, Homo sapiens
aaagatttcttc

SEQ ID NO: 1562663 - DNA, 14 bp, Homo sapiens
aaagatttcttgag

SEQ ID NO: 1562664 - DNA, 12 bp, Homo sapiens
aaagatttgtta

SEQ ID NO: 1562665 - DNA, 20 bp, Homo sapiens
aaagatttgttactgtattt

SEQ ID NO: 1562666 - DNA, 12 bp, Homo sapiens
aaagattttatt

SEQ ID NO: 1562667 - DNA, 21 bp, Homo sapiens
aaagattttattgtataaaaa

SEQ ID NO: 1562668 - DNA, 15 bp, Homo sapiens
aaagattttcagaaa

SEQ ID NO: 1562669 - DNA, 18 bp, Homo sapiens
aaagatttttactaatat

SEQ ID NO: 1562670 - DNA, 20 bp, Homo sapiens
aaagatttttactaatatat

SEQ ID NO: 1562671 - DNA, 16 bp, Homo sapiens
aaagcaaaagcaaggg

SEQ ID NO: 1562672 - DNA, 16 bp, Homo sapiens
aaagcaaatgtgacct

SEQ ID NO: 1562673 - DNA, 14 bp, Homo sapiens
aaagcaagactgtt

SEQ ID NO: 1562674 - DNA, 17 bp, Homo sapiens
aaagcaagggctccagc

SEQ ID NO: 1562675 - DNA, 22 bp, Homo sapiens
aaagcaataatggtcccatcca

SEQ ID NO: 1562676 - DNA, 23 bp, Homo sapiens
aaagcaataatggtcccatccag

SEQ ID NO: 1562677 - DNA, 17 bp, Homo sapiens
aaagcaattctgactgt

SEQ ID NO: 1562678 - DNA, 19 bp, Homo sapiens
aaagcaattgccctgtaac

SEQ ID NO: 1562679 - DNA, 15 bp, Homo sapiens
aaagcacagtttgaa

SEQ ID NO: 1562680 - DNA, 17 bp, Homo sapiens
aaagcacagtttgaaca

SEQ ID NO: 1562681 - DNA, 20 bp, Homo sapiens
aaagcacatgaataatttca

SEQ ID NO: 1562682 - DNA, 16 bp, Homo sapiens
aaagcacattgaaaga

SEQ ID NO: 1562683 - DNA, 12 bp, Homo sapiens
aaagcacctgcc

SEQ ID NO: 1562684 - DNA, 19 bp, Homo sapiens
aaagcacgaaatgttattt

SEQ ID NO: 1562685 - DNA, 14 bp, Homo sapiens
aaagcactgacctg

SEQ ID NO: 1562686 - DNA, 15 bp, Homo sapiens
aaagcactttgcact

SEQ ID NO: 1562687 - DNA, 22 bp, Homo sapiens
aaaggcagctaagatagaaagc

SEQ ID NO: 1562688 - DNA, 11 bp, Homo sapiens
aaaggcagctg

SEQ ID NO: 1562689 - DNA, 20 bp, Homo sapiens
aaaggcagctgcctctgctc

SEQ ID NO: 1562690 - DNA, 22 bp, Homo sapiens
aaaggcagctgcctctgctccc

SEQ ID NO: 1562691 - DNA, 23 bp, Homo sapiens
aaaggcagctgcctctgctccct

SEQ ID NO: 1562692 - DNA, 16 bp, Homo sapiens
aaaggcagtattttgt

SEQ ID NO: 1562693 - DNA, 13 bp, Homo sapiens
aaaggcagttttc

SEQ ID NO: 1562694 - DNA, 14 bp, Homo sapiens
aaaggcattgtcca

SEQ ID NO: 1562695 - DNA, 16 bp, Homo sapiens
aaaggccaaagataaa

SEQ ID NO: 1562696 - DNA, 17 bp, Homo sapiens
aaaggccaaagataaaa

SEQ ID NO: 1562697 - DNA, 18 bp, Homo sapiens
aaaggccaaagataaaag

SEQ ID NO: 1562698 - DNA, 18 bp, Homo sapiens
aaaggcctcaagaacaaa

SEQ ID NO: 1562699 - DNA, 16 bp, Homo sapiens
aaaggcctcatctcct

SEQ ID NO: 1562700 - DNA, 12 bp, Homo sapiens
aaaggctcattt

SEQ ID NO: 1562701 - DNA, 16 bp, Homo sapiens
aaaggctcatttaaaa

SEQ ID NO: 1562702 - DNA, 17 bp, Homo sapiens
aaaggctcatttaaaac

SEQ ID NO: 1562703 - DNA, 18 bp, Homo sapiens
aaaggctcatttaaaaca

SEQ ID NO: 1562704 - DNA, 20 bp, Homo sapiens
aaaggctctgaaagccagct

SEQ ID NO: 1562705 - DNA, 20 bp, Homo sapiens
aaaggctggagagagattct

SEQ ID NO: 1562706 - DNA, 15 bp, Homo sapiens
aaaggctgttaaata

SEQ ID NO: 1562707 - DNA, 22 bp, Homo sapiens
aaaggctgttaaatacaggaaa

SEQ ID NO: 1562708 - DNA, 17 bp, Homo sapiens
aaaggcttggctggtgt

SEQ ID NO: 1562709 - DNA, 18 bp, Homo sapiens
aaagggaactagataaca

SEQ ID NO: 1562710 - DNA, 18 bp, Homo sapiens
aaagggaagtgaggccca

SEQ ID NO: 1562711 - DNA, 19 bp, Homo sapiens
aaagggaagtgaggcccaa

SEQ ID NO: 1562712 - DNA, 16 bp, Homo sapiens
aaagggagaatggtgc

SEQ ID NO: 1562713 - DNA, 14 bp, Homo sapiens
aaagggagagaaaa

SEQ ID NO: 1562714 - DNA, 23 bp, Homo sapiens
aaagggagcactgggttgacttt

SEQ ID NO: 1562715 - DNA, 20 bp, Homo sapiens
aaagggagcccctcctctga

SEQ ID NO: 1562716 - DNA, 18 bp, Homo sapiens
aaagggagctatcaggaa

SEQ ID NO: 1562717 - DNA, 15 bp, Homo sapiens
aaagggatggacttg

SEQ ID NO: 1562718 - DNA, 15 bp, Homo sapiens
aaagggattgaggag

SEQ ID NO: 1562719 - DNA, 16 bp, Homo sapiens
aaagggcactcccaac

SEQ ID NO: 1562720 - DNA, 15 bp, Homo sapiens
aaagggcagttttga

SEQ ID NO: 1562721 - DNA, 19 bp, Homo sapiens
aaagggcccacacctggtg

SEQ ID NO: 1562722 - DNA, 20 bp, Homo sapiens
aaagggcccacacctggtgg

SEQ ID NO: 1562723 - DNA, 15 bp, Homo sapiens
aaagggcctggccag

SEQ ID NO: 1562724 - DNA, 14 bp, Homo sapiens
aaagggcggaagag

SEQ ID NO: 1562725 - DNA, 20 bp, Homo sapiens
aaagggcggaagagttacaa

SEQ ID NO: 1562726 - DNA, 20 bp, Homo sapiens
aaaggggacacctgtacatt

SEQ ID NO: 1562727 - DNA, 19 bp, Homo sapiens
aaaggggagagcctgctgg

SEQ ID NO: 1562728 - DNA, 19 bp, Homo sapiens
aaaggggctgctggggcat

SEQ ID NO: 1562729 - DNA, 21 bp, Homo sapiens
aaagggggtcccagtgggagg

SEQ ID NO: 1562730 - DNA, 14 bp, Homo sapiens
aaagggtgaagcta

SEQ ID NO: 1562731 - DNA, 17 bp, Homo sapiens
aaagggtgtaggggcca

SEQ ID NO: 1562732 - DNA, 19 bp, Homo sapiens
aaaggtaccaaacaaggaa

SEQ ID NO: 1562733 - DNA, 14 bp, Homo sapiens
aaaggtataatttt

SEQ ID NO: 1562734 - DNA, 14 bp, Homo sapiens
aaaggtcaataagg

SEQ ID NO: 1562735 - DNA, 23 bp, Homo sapiens
aaaggtcagcccgtttcagaagg

SEQ ID NO: 1562736 - DNA, 23 bp, Homo sapiens
aaaggtgacatcggaaaaataat

SEQ ID NO: 1562737 - DNA, 21 bp, Homo sapiens
aaaggtgagtttgagctgcct

SEQ ID NO: 1562738 - DNA, 22 bp, Homo sapiens
aaaggtgagtttgagctgcctt

SEQ ID NO: 1562739 - DNA, 13 bp, Homo sapiens
aaaggtgataaaa

SEQ ID NO: 1562740 - DNA, 14 bp, Homo sapiens
aaaggtgataaaat

SEQ ID NO: 1562741 - DNA, 17 bp, Homo sapiens
aaaggtgataaaatcat

SEQ ID NO: 1562742 - DNA, 19 bp, Homo sapiens
aaaggtggaataaacatta

SEQ ID NO: 1562743 - DNA, 19 bp, Homo sapiens
aaaggtggattttgtttaa

SEQ ID NO: 1562744 - DNA, 17 bp, Homo sapiens
aaaggtgtagaaaaggt

SEQ ID NO: 1562745 - DNA, 13 bp, Homo sapiens
aaaggtgtattta

SEQ ID NO: 1562746 - DNA, 18 bp, Homo sapiens
aaaggtgtcaacttttga

SEQ ID NO: 1562747 - DNA, 15 bp, Homo sapiens
aaaggttcttcatcc

SEQ ID NO: 1562748 - DNA, 19 bp, Homo sapiens
aaaggtttgcattctcaca

SEQ ID NO: 1562749 - DNA, 22 bp, Homo sapiens
aaaggttttctctaacttctca

SEQ ID NO: 1562750 - DNA, 22 bp, Homo sapiens
aaagtaaaggcctcatctcctt

SEQ ID NO: 1562751 - DNA, 15 bp, Homo sapiens
aaagtaacaatctat

SEQ ID NO: 1562752 - DNA, 14 bp, Homo sapiens
aaagtaactcattt

SEQ ID NO: 1562753 - DNA, 13 bp, Homo sapiens
aaagtaagacatc

SEQ ID NO: 1562754 - DNA, 19 bp, Homo sapiens
aaagtaagtaccactcagg

SEQ ID NO: 1562755 - DNA, 16 bp, Homo sapiens
aaagtaatctttaaac

SEQ ID NO: 1562756 - DNA, 21 bp, Homo sapiens
aaagtaatgacttagaaactg

SEQ ID NO: 1562757 - DNA, 16 bp, Homo sapiens
aaagtaatgatttctt

SEQ ID NO: 1562758 - DNA, 15 bp, Homo sapiens
aaagtacaaatgaag

SEQ ID NO: 1562759 - DNA, 15 bp, Homo sapiens
aaagtacagaatttg

SEQ ID NO: 1562760 - DNA, 15 bp, Homo sapiens
aaagtacatttaata

SEQ ID NO: 1562761 - DNA, 21 bp, Homo sapiens
aaagtactctttaacatacaa

SEQ ID NO: 1562762 - DNA, 18 bp, Homo sapiens
aaagtagaagcatgtttg

SEQ ID NO: 1562763 - DNA, 20 bp, Homo sapiens
aaagtagaagtcttagatgt

SEQ ID NO: 1562764 - DNA, 13 bp, Homo sapiens
aaagtataatgtt

SEQ ID NO: 1562765 - DNA, 14 bp, Homo sapiens
aaagtataatgttt

SEQ ID NO: 1562766 - DNA, 20 bp, Homo sapiens
aaagtataatgtttattaaa

SEQ ID NO: 1562767 - DNA, 23 bp, Homo sapiens
aaagtataatgtttattaaatgc

SEQ ID NO: 1562768 - DNA, 17 bp, Homo sapiens
aaagtatatatagaatc

SEQ ID NO: 1562769 - DNA, 18 bp, Homo sapiens
aaagtatatatagaatct

SEQ ID NO: 1562770 - DNA, 20 bp, Homo sapiens
aaagtatgcattattaaatt

SEQ ID NO: 1562771 - DNA, 17 bp, Homo sapiens
aaagtatgtattattta

SEQ ID NO: 1562772 - DNA, 13 bp, Homo sapiens
aaagtatgtgttt

SEQ ID NO: 1562773 - DNA, 17 bp, Homo sapiens
aaagtattcaacaattt

SEQ ID NO: 1562774 - DNA, 15 bp, Homo sapiens
aaagtatttactttt

SEQ ID NO: 1562775 - DNA, 15 bp, Homo sapiens
aaagtcaaatgccaa

SEQ ID NO: 1562776 - DNA, 16 bp, Homo sapiens
aaagtcaaatgccaaa

SEQ ID NO: 1562777 - DNA, 23 bp, Homo sapiens
aaagtcacccaaacacttctgct

SEQ ID NO: 1562778 - DNA, 14 bp, Homo sapiens
aaagtcacttctcc

SEQ ID NO: 1562779 - DNA, 13 bp, Homo sapiens
aaagtcagaagtt

SEQ ID NO: 1562780 - DNA, 16 bp, Homo sapiens
aaagtcaggtccaatt

SEQ ID NO: 1562781 - DNA, 21 bp, Homo sapiens
aaagtcgccagtcactgctgc

SEQ ID NO: 1562782 - DNA, 15 bp, Homo sapiens
aaagtctaagcaaga

SEQ ID NO: 1562783 - DNA, 19 bp, Homo sapiens
aaagtctaagcaagatgtt

SEQ ID NO: 1562784 - DNA, 14 bp, Homo sapiens
aaagtctatgctta

SEQ ID NO: 1562785 - DNA, 12 bp, Homo sapiens
aaagtctccagc

SEQ ID NO: 1562786 - DNA, 14 bp, Homo sapiens
aaagtctccagccc

SEQ ID NO: 1562787 - DNA, 15 bp, Homo sapiens
aaagtcttggtttta

SEQ ID NO: 1562788 - DNA, 18 bp, Homo sapiens
aaagtcttttttttcctg

SEQ ID NO: 1562789 - DNA, 13 bp, Homo sapiens
aaagtgacacagc

SEQ ID NO: 1562790 - DNA, 15 bp, Homo sapiens
aaagtgacagagacc

SEQ ID NO: 1562791 - DNA, 22 bp, Homo sapiens
aaagtgacagagacccagatct

SEQ ID NO: 1562792 - DNA, 13 bp, Homo sapiens
aaagtgataaatt

SEQ ID NO: 1562793 - DNA, 15 bp, Homo sapiens
aaagtgataatttct

SEQ ID NO: 1562794 - DNA, 21 bp, Homo sapiens
aaagtgataatttctggaatt

SEQ ID NO: 1562795 - DNA, 23 bp, Homo sapiens
aaagtgatcaataaaatgtgatt

SEQ ID NO: 1562796 - DNA, 10 bp, Homo sapiens
aaagtgatta

SEQ ID NO: 1562797 - DNA, 13 bp, Homo sapiens
aaagtgcacacct

SEQ ID NO: 1562798 - DNA, 16 bp, Homo sapiens
aaagtgccagaaagtg

SEQ ID NO: 1562799 - DNA, 20 bp, Homo sapiens
aaagtgcctgagctggggaa

SEQ ID NO: 1562800 - DNA, 22 bp, Homo sapiens
aaagtgcgtgtgtgtatgtgtg

SEQ ID NO: 1562801 - DNA, 16 bp, Homo sapiens
aaagtgctaaggttct

SEQ ID NO: 1562802 - DNA, 17 bp, Homo sapiens
aaagtgctaaggttcta

SEQ ID NO: 1562803 - DNA, 21 bp, Homo sapiens
aaagtgctaaggttctaaggc

SEQ ID NO: 1562804 - DNA, 14 bp, Homo sapiens
aaagcagaagtctg

SEQ ID NO: 1562805 - DNA, 18 bp, Homo sapiens
aaagcagaagtctggctt

SEQ ID NO: 1562806 - DNA, 17 bp, Homo sapiens
aaagcagacttttgtgt

SEQ ID NO: 1562807 - DNA, 20 bp, Homo sapiens
aaagcagaggcaacactgga

SEQ ID NO: 1562808 - DNA, 22 bp, Homo sapiens
aaagcagagtggactgcattta

SEQ ID NO: 1562809 - DNA, 20 bp, Homo sapiens
aaagcagcattctggagggg

SEQ ID NO: 1562810 - DNA, 21 bp, Homo sapiens
aaagcagcattctggagggga

SEQ ID NO: 1562811 - DNA, 23 bp, Homo sapiens
aaagcagctaaatgtaacttatt

SEQ ID NO: 1562812 - DNA, 24 bp, Homo sapiens
aaagcaggcttgcccagtacattt

SEQ ID NO: 1562813 - DNA, 15 bp, Homo sapiens
aaagcagtatttttc

SEQ ID NO: 1562814 - DNA, 22 bp, Homo sapiens
aaagcagttcatgtctgaaaca

SEQ ID NO: 1562815 - DNA, 13 bp, Homo sapiens
aaagcataaagct

SEQ ID NO: 1562816 - DNA, 15 bp, Homo sapiens
aaagcatccctcacc

SEQ ID NO: 1562817 - DNA, 16 bp, Homo sapiens
aaagcatgaaatgtga

SEQ ID NO: 1562818 - DNA, 18 bp, Homo sapiens
aaagcatgaaatgtgaat

SEQ ID NO: 1562819 - DNA, 19 bp, Homo sapiens
aaagcatgatgggaaaata

SEQ ID NO: 1562820 - DNA, 22 bp, Homo sapiens
aaagcatgatgggaaaatattt

SEQ ID NO: 1562821 - DNA, 18 bp, Homo sapiens
aaagcatggacatttaga

SEQ ID NO: 1562822 - DNA, 12 bp, Homo sapiens
aaagcatggact

SEQ ID NO: 1562823 - DNA, 20 bp, Homo sapiens
aaagcattgtaaatgtgctt

SEQ ID NO: 1562824 - DNA, 19 bp, Homo sapiens
aaagcattttcagtcttgt

SEQ ID NO: 1562825 - DNA, 11 bp, Homo sapiens
aaagcattttt

SEQ ID NO: 1562826 - DNA, 16 bp, Homo sapiens
aaagcatttttcaata

SEQ ID NO: 1562827 - DNA, 15 bp, Homo sapiens
aaagccaaaggtcaa

SEQ ID NO: 1562828 - DNA, 12 bp, Homo sapiens
aaagccaagcct

SEQ ID NO: 1562829 - DNA, 18 bp, Homo sapiens
aaagccacattatttcta

SEQ ID NO: 1562830 - DNA, 17 bp, Homo sapiens
aaagccacttctggctt

SEQ ID NO: 1562831 - DNA, 17 bp, Homo sapiens
aaagccattctgattat

SEQ ID NO: 1562832 - DNA, 16 bp, Homo sapiens
aaagcccaacctcctg

SEQ ID NO: 1562833 - DNA, 12 bp, Homo sapiens
aaagccccagct

SEQ ID NO: 1562834 - DNA, 12 bp, Homo sapiens
aaagccctgcct

SEQ ID NO: 1562835 - DNA, 21 bp, Homo sapiens
aaagcccttggaacaccctgg

SEQ ID NO: 1562836 - DNA, 21 bp, Homo sapiens
aaagccgttgtttacttaaag

SEQ ID NO: 1562837 - DNA, 23 bp, Homo sapiens
aaagccgttgtttacttaaagat

SEQ ID NO: 1562838 - DNA, 18 bp, Homo sapiens
aaagcctagacaaccttt

SEQ ID NO: 1562839 - DNA, 17 bp, Homo sapiens
aaagcctatttttcaaa

SEQ ID NO: 1562840 - DNA, 17 bp, Homo sapiens
aaagcctccgctgggct

SEQ ID NO: 1562841 - DNA, 15 bp, Homo sapiens
aaagcctccttgtgc

SEQ ID NO: 1562842 - DNA, 19 bp, Homo sapiens
aaagcctctctctccctcc

SEQ ID NO: 1562843 - DNA, 13 bp, Homo sapiens
aaagcctctggcc

SEQ ID NO: 1562844 - DNA, 22 bp, Homo sapiens
aaagcctgaactatttattaaa

SEQ ID NO: 1562845 - DNA, 13 bp, Homo sapiens
aaagcctgctcaa

SEQ ID NO: 1562846 - DNA, 17 bp, Homo sapiens
aaagcctgtattctcaa

SEQ ID NO: 1562847 - DNA, 22 bp, Homo sapiens
aaagcctttcattttgctttaa

SEQ ID NO: 1562848 - DNA, 19 bp, Homo sapiens
aaagcctttgtatctttct

SEQ ID NO: 1562849 - DNA, 16 bp, Homo sapiens
aaagcgggaaccctgg

SEQ ID NO: 1562850 - DNA, 15 bp, Homo sapiens
aaagcggtccctgtc

SEQ ID NO: 1562851 - DNA, 17 bp, Homo sapiens
aaagcgtttctttactt

SEQ ID NO: 1562852 - DNA, 19 bp, Homo sapiens
aaagcgtttctttacttct

SEQ ID NO: 1562853 - DNA, 22 bp, Homo sapiens
aaagctagtgtacctcctctca

SEQ ID NO: 1562854 - DNA, 18 bp, Homo sapiens
aaagctatatctatttga

SEQ ID NO: 1562855 - DNA, 14 bp, Homo sapiens
aaagctatgttaca

SEQ ID NO: 1562856 - DNA, 18 bp, Homo sapiens
aaagctatttatgggccc

SEQ ID NO: 1562857 - DNA, 19 bp, Homo sapiens
aaagctcaaatgaaatgta

SEQ ID NO: 1562858 - DNA, 20 bp, Homo sapiens
aaagctcctggggcgtccag

SEQ ID NO: 1562859 - DNA, 17 bp, Homo sapiens
aaagctctacatttgca

SEQ ID NO: 1562860 - DNA, 14 bp, Homo sapiens
aaagctgaatttat

SEQ ID NO: 1562861 - DNA, 15 bp, Homo sapiens
aaagctgagcctgca

SEQ ID NO: 1562862 - DNA, 22 bp, Homo sapiens
aaagctgcccactgtttctctt

SEQ ID NO: 1562863 - DNA, 13 bp, Homo sapiens
aaagctggactga

SEQ ID NO: 1562864 - DNA, 14 bp, Homo sapiens
aaagctggactgac

SEQ ID NO: 1562865 - DNA, 15 bp, Homo sapiens
aaagctggactgacc

SEQ ID NO: 1562866 - DNA, 22 bp, Homo sapiens
aaagctggactgaccaaagact

SEQ ID NO: 1562867 - DNA, 23 bp, Homo sapiens
aaagctgtggccagcttgttatt

SEQ ID NO: 1562868 - DNA, 23 bp, Homo sapiens
aaagcttacattttcctgagacc

SEQ ID NO: 1562869 - DNA, 18 bp, Homo sapiens
aaagcttattttgtaaga

SEQ ID NO: 1562870 - DNA, 21 bp, Homo sapiens
aaagcttcagactcaagtacc

SEQ ID NO: 1562871 - DNA, 20 bp, Homo sapiens
aaagcttgaagatcgttagt

SEQ ID NO: 1562872 - DNA, 16 bp, Homo sapiens
aaagctttactactgt

SEQ ID NO: 1562873 - DNA, 13 bp, Homo sapiens
aaagctttcctgc

SEQ ID NO: 1562874 - DNA, 13 bp, Homo sapiens
aaagctttgctac

SEQ ID NO: 1562875 - DNA, 18 bp, Homo sapiens
aaagctttgctacaaatt

SEQ ID NO: 1562876 - DNA, 18 bp, Homo sapiens
aaagctttggctgagacc

SEQ ID NO: 1562877 - DNA, 14 bp, Homo sapiens
aaagctttgtttgt

SEQ ID NO: 1562878 - DNA, 14 bp, Homo sapiens
aaagcttttaaaat

SEQ ID NO: 1562879 - DNA, 15 bp, Homo sapiens
aaaggaaaaataatc

SEQ ID NO: 1562880 - DNA, 13 bp, Homo sapiens
aaaggaaaagaaa

SEQ ID NO: 1562881 - DNA, 16 bp, Homo sapiens
aaaggaaagaaaacat

SEQ ID NO: 1562882 - DNA, 19 bp, Homo sapiens
aaaggaaatttgtttgtat

SEQ ID NO: 1562883 - DNA, 16 bp, Homo sapiens
aaaggaacactggctt

SEQ ID NO: 1562884 - DNA, 14 bp, Homo sapiens
aaaggaagtctagg

SEQ ID NO: 1562885 - DNA, 20 bp, Homo sapiens
aaaggaataacctttctgga

SEQ ID NO: 1562886 - DNA, 18 bp, Homo sapiens
aaaggacaacagttctga

SEQ ID NO: 1562887 - DNA, 15 bp, Homo sapiens
aaaggacagagccag

SEQ ID NO: 1562888 - DNA, 23 bp, Homo sapiens
aaaggacagagccagcggctcca

SEQ ID NO: 1562889 - DNA, 20 bp, Homo sapiens
aaaggacttcaggaacaagt

SEQ ID NO: 1562890 - DNA, 20 bp, Homo sapiens
aaaggagaaaaaaaaccttg

SEQ ID NO: 1562891 - DNA, 19 bp, Homo sapiens
aaaggagactgtgtttggt

SEQ ID NO: 1562892 - DNA, 19 bp, Homo sapiens
aaaggagccttttgctctc

SEQ ID NO: 1562893 - DNA, 21 bp, Homo sapiens
aaaggaggccctgttccctgg

SEQ ID NO: 1562894 - DNA, 13 bp, Homo sapiens
aaaggaggctggc

SEQ ID NO: 1562895 - DNA, 12 bp, Homo sapiens
aaaggagggaga

SEQ ID NO: 1562896 - DNA, 21 bp, Homo sapiens
aaaggatagtaagcatagaaa

SEQ ID NO: 1562897 - DNA, 13 bp, Homo sapiens
aaaggatatttaa

SEQ ID NO: 1562898 - DNA, 12 bp, Homo sapiens
aaaggatatttt

SEQ ID NO: 1562899 - DNA, 24 bp, Homo sapiens
aaaggatctaagggaagatcactg

SEQ ID NO: 1562900 - DNA, 22 bp, Homo sapiens
aaaggatctgtgattggctggt

SEQ ID NO: 1562901 - DNA, 13 bp, Homo sapiens
aaaggatgaagaa

SEQ ID NO: 1562902 - DNA, 20 bp, Homo sapiens
aaaggatggtggttatttta

SEQ ID NO: 1562903 - DNA, 16 bp, Homo sapiens
aaaggatgttggtgtt

SEQ ID NO: 1562904 - DNA, 18 bp, Homo sapiens
aaaggatgttttgtccca

SEQ ID NO: 1562905 - DNA, 14 bp, Homo sapiens
aaaggattttacca

SEQ ID NO: 1562906 - DNA, 18 bp, Homo sapiens
aaaggattttaccaaagc

SEQ ID NO: 1562907 - DNA, 15 bp, Homo sapiens
aaaggcaaatattga

SEQ ID NO: 1562908 - DNA, 17 bp, Homo sapiens
aaaggcaaatattgaag

SEQ ID NO: 1562909 - DNA, 20 bp, Homo sapiens
aaaggcaaatattgaagttg

SEQ ID NO: 1562910 - DNA, 23 bp, Homo sapiens
aaaggcaaatattgaagttgttt

SEQ ID NO: 1562911 - DNA, 17 bp, Homo sapiens
aaaggcaaatgtgtaca

SEQ ID NO: 1562912 - DNA, 13 bp, Homo sapiens
aaaggcaagcttg

SEQ ID NO: 1562913 - DNA, 14 bp, Homo sapiens
aaaggcaagcttga

SEQ ID NO: 1562914 - DNA, 20 bp, Homo sapiens
aaaggcaagcttgaggccaa

SEQ ID NO: 1562915 - DNA, 13 bp, Homo sapiens
aaaggcaaggtcc

SEQ ID NO: 1562916 - DNA, 13 bp, Homo sapiens
aaaggcagacaca

SEQ ID NO: 1562917 - DNA, 23 bp, Homo sapiens
aaaggcagacacaccgcggccag

SEQ ID NO: 1562918 - DNA, 23 bp, Homo sapiens
aaaggcagccctcacctctgagg

SEQ ID NO: 1562919 - DNA, 21 bp, Homo sapiens
aaaggcagctaagatagaaag

SEQ ID NO: 1562920 - DNA, 22 bp, Homo sapiens
aaatgaggaatccaaaagacaa

SEQ ID NO: 1562921 - DNA, 18 bp, Homo sapiens
aaatgaggattattgata

SEQ ID NO: 1562922 - DNA, 13 bp, Homo sapiens
aaatgagtaaaaa

SEQ ID NO: 1562923 - DNA, 15 bp, Homo sapiens
aaatgagtaaaaact

SEQ ID NO: 1562924 - DNA, 20 bp, Homo sapiens
aaatgagtaaaaactagaag

SEQ ID NO: 1562925 - DNA, 13 bp, Homo sapiens
aaatgagtaacat

SEQ ID NO: 1562926 - DNA, 14 bp, Homo sapiens
aaatgagtaacatt

SEQ ID NO: 1562927 - DNA, 12 bp, Homo sapiens
aaatgagtgtgt

SEQ ID NO: 1562928 - DNA, 15 bp, Homo sapiens
aaatgagttgtcaca

SEQ ID NO: 1562929 - DNA, 22 bp, Homo sapiens
aaatgagtttaaaaaaataaca

SEQ ID NO: 1562930 - DNA, 22 bp, Homo sapiens
aaatgagtttttatggggctga

SEQ ID NO: 1562931 - DNA, 20 bp, Homo sapiens
aaatgatagaactgtactgt

SEQ ID NO: 1562932 - DNA, 17 bp, Homo sapiens
aaatgatagttttctag

SEQ ID NO: 1562933 - DNA, 18 bp, Homo sapiens
aaatgatcctcccacctc

SEQ ID NO: 1562934 - DNA, 13 bp, Homo sapiens
aaatgatgttggt

SEQ ID NO: 1562935 - DNA, 18 bp, Homo sapiens
aaatgattcaaattgctg

SEQ ID NO: 1562936 - DNA, 23 bp, Homo sapiens
aaatgatttttacaagttttaaa

SEQ ID NO: 1562937 - DNA, 22 bp, Homo sapiens
aaatgcaaactgggctggaaga

SEQ ID NO: 1562938 - DNA, 17 bp, Homo sapiens
aaatgcaagtgcctaga

SEQ ID NO: 1562939 - DNA, 18 bp, Homo sapiens
aaatgcacatttgtcact

SEQ ID NO: 1562940 - DNA, 22 bp, Homo sapiens
aaatgcagggattgctgccact

SEQ ID NO: 1562941 - DNA, 12 bp, Homo sapiens
aaatgcagtgaa

SEQ ID NO: 1562942 - DNA, 16 bp, Homo sapiens
aaatgcagttttaaga

SEQ ID NO: 1562943 - DNA, 17 bp, Homo sapiens
aaatgcagttttaagaa

SEQ ID NO: 1562944 - DNA, 18 bp, Homo sapiens
aaatgcagttttaagaat

SEQ ID NO: 1562945 - DNA, 20 bp, Homo sapiens
aaatgcatatcctgagccat

SEQ ID NO: 1562946 - DNA, 23 bp, Homo sapiens
aaatgcatccattcctcagggac

SEQ ID NO: 1562947 - DNA, 12 bp, Homo sapiens
aaatgcattgaa

SEQ ID NO: 1562948 - DNA, 22 bp, Homo sapiens
aaatgccaagggggtgactgga

SEQ ID NO: 1562949 - DNA, 15 bp, Homo sapiens
aaatgccagagccaa

SEQ ID NO: 1562950 - DNA, 22 bp, Homo sapiens
aaatgccagagccaacctggac

SEQ ID NO: 1562951 - DNA, 21 bp, Homo sapiens
aaatgccatttatttattgat

SEQ ID NO: 1562952 - DNA, 22 bp, Homo sapiens
aaatgccatttatttattgatt

SEQ ID NO: 1562953 - DNA, 21 bp, Homo sapiens
aaatgccctacatcttatttc

SEQ ID NO: 1562954 - DNA, 14 bp, Homo sapiens
aaatgcctcttaaa

SEQ ID NO: 1562955 - DNA, 22 bp, Homo sapiens
aaatgcctcttaaattatatat

SEQ ID NO: 1562956 - DNA, 13 bp, Homo sapiens
aaatgccttgtat

SEQ ID NO: 1562957 - DNA, 15 bp, Homo sapiens
aaatgcggttataaa

SEQ ID NO: 1562958 - DNA, 23 bp, Homo sapiens
aaatgcggttataaaaaatggtt

SEQ ID NO: 1562959 - DNA, 15 bp, Homo sapiens
aaatgcgtccctgta

SEQ ID NO: 1562960 - DNA, 21 bp, Homo sapiens
aaatgctattgttgtgggctt

SEQ ID NO: 1562961 - DNA, 21 bp, Homo sapiens
aaatgctcattttctggtttg

SEQ ID NO: 1562962 - DNA, 13 bp, Homo sapiens
aaatgctccccac

SEQ ID NO: 1562963 - DNA, 14 bp, Homo sapiens
aaatgctcttttgc

SEQ ID NO: 1562964 - DNA, 21 bp, Homo sapiens
aaatgctcttttgcacaagga

SEQ ID NO: 1562965 - DNA, 16 bp, Homo sapiens
aaatgctgaaaattgc

SEQ ID NO: 1562966 - DNA, 13 bp, Homo sapiens
aaatgctgcctgc

SEQ ID NO: 1562967 - DNA, 12 bp, Homo sapiens
aaatgctgctct

SEQ ID NO: 1562968 - DNA, 15 bp, Homo sapiens
aaatgcttaaaaaat

SEQ ID NO: 1562969 - DNA, 19 bp, Homo sapiens
aaatgcttaaaaaataata

SEQ ID NO: 1562970 - DNA, 13 bp, Homo sapiens
aaatgcttatttt

SEQ ID NO: 1562971 - DNA, 23 bp, Homo sapiens
aaatgcttcatttgtatgtcaaa

SEQ ID NO: 1562972 - DNA, 13 bp, Homo sapiens
aaatggacattga

SEQ ID NO: 1562973 - DNA, 19 bp, Homo sapiens
aaatggagaagctctgttt

SEQ ID NO: 1562974 - DNA, 14 bp, Homo sapiens
aaatggagctcagt

SEQ ID NO: 1562975 - DNA, 18 bp, Homo sapiens
aaatggagctcagtaaca

SEQ ID NO: 1562976 - DNA, 18 bp, Homo sapiens
aaatggaggcttttcact

SEQ ID NO: 1562977 - DNA, 13 bp, Homo sapiens
aaatggatactgg

SEQ ID NO: 1562978 - DNA, 22 bp, Homo sapiens
aaatggattcagtataaggata

SEQ ID NO: 1562979 - DNA, 18 bp, Homo sapiens
aaatggccatgcaggagg

SEQ ID NO: 1562980 - DNA, 15 bp, Homo sapiens
aaatggcctcatgtg

SEQ ID NO: 1562981 - DNA, 16 bp, Homo sapiens
aaatggcgtctgctct

SEQ ID NO: 1562982 - DNA, 17 bp, Homo sapiens
aaatggctaataaactg

SEQ ID NO: 1562983 - DNA, 18 bp, Homo sapiens
aaatggctaataaactgt

SEQ ID NO: 1562984 - DNA, 12 bp, Homo sapiens
aaatggctgggg

SEQ ID NO: 1562985 - DNA, 13 bp, Homo sapiens
aaatggctggggc

SEQ ID NO: 1562986 - DNA, 21 bp, Homo sapiens
aaatggctgtaatcatttgtt

SEQ ID NO: 1562987 - DNA, 22 bp, Homo sapiens
aaatggcttttcttacccagat

SEQ ID NO: 1562988 - DNA, 15 bp, Homo sapiens
aaatgggaaaaaact

SEQ ID NO: 1562989 - DNA, 18 bp, Homo sapiens
aaatgggactgatgtcat

SEQ ID NO: 1562990 - DNA, 20 bp, Homo sapiens
aaatgggactgatgtcatct

SEQ ID NO: 1562991 - DNA, 16 bp, Homo sapiens
aaatgggagccaggag

SEQ ID NO: 1562992 - DNA, 15 bp, Homo sapiens
aaatggggattatta

SEQ ID NO: 1562993 - DNA, 16 bp, Homo sapiens
aaatggggccagatcc

SEQ ID NO: 1562994 - DNA, 17 bp, Homo sapiens
aaatggggccagatcca

SEQ ID NO: 1562995 - DNA, 15 bp, Homo sapiens
aaatgggtgttattt

SEQ ID NO: 1562996 - DNA, 21 bp, Homo sapiens
aaatggtacagcttctggagc

SEQ ID NO: 1562997 - DNA, 19 bp, Homo sapiens
aaatggtagttagcaacta

SEQ ID NO: 1562998 - DNA, 14 bp, Homo sapiens
aaatggtataaaag

SEQ ID NO: 1562999 - DNA, 15 bp, Homo sapiens
aaatggtataaaagg

SEQ ID NO: 1563000 - DNA, 20 bp, Homo sapiens
aaatggtataaaaggttgcc

SEQ ID NO: 1563001 - DNA, 22 bp, Homo sapiens
aaatggtccaattagtttcctt

SEQ ID NO: 1563002 - DNA, 17 bp, Homo sapiens
aaatggtcgcccaggag

SEQ ID NO: 1563003 - DNA, 20 bp, Homo sapiens
aaatggtctctaacatttcc

SEQ ID NO: 1563004 - DNA, 19 bp, Homo sapiens
aaatggttaatttttcctg

SEQ ID NO: 1563005 - DNA, 15 bp, Homo sapiens
aaatggttcagaatt

SEQ ID NO: 1563006 - DNA, 17 bp, Homo sapiens
aaatggttgatggaaaa

SEQ ID NO: 1563007 - DNA, 23 bp, Homo sapiens
aaatggttgtcacctctctctga

SEQ ID NO: 1563008 - DNA, 18 bp, Homo sapiens
aaatggtttcaagttatt

SEQ ID NO: 1563009 - DNA, 14 bp, Homo sapiens
aaatgtaaaggagg

SEQ ID NO: 1563010 - DNA, 15 bp, Homo sapiens
aaatgtaaatattct

SEQ ID NO: 1563011 - DNA, 14 bp, Homo sapiens
aaatgtaaatcaat

SEQ ID NO: 1563012 - DNA, 20 bp, Homo sapiens
aaatgtaacttattccaagt

SEQ ID NO: 1563013 - DNA, 14 bp, Homo sapiens
aaatgtaagatcgt

SEQ ID NO: 1563014 - DNA, 19 bp, Homo sapiens
aaatgtaaggattctggaa

SEQ ID NO: 1563015 - DNA, 22 bp, Homo sapiens
aaatgtaaggattctggaatac

SEQ ID NO: 1563016 - DNA, 12 bp, Homo sapiens
aaatgtaattga

SEQ ID NO: 1563017 - DNA, 13 bp, Homo sapiens
aaatgtaatttaa

SEQ ID NO: 1563018 - DNA, 18 bp, Homo sapiens
aaatgtaatttaaatgaa

SEQ ID NO: 1563019 - DNA, 12 bp, Homo sapiens
aaatgtacatgt

SEQ ID NO: 1563020 - DNA, 19 bp, Homo sapiens
aaatgtacccgagcacata

SEQ ID NO: 1563021 - DNA, 20 bp, Homo sapiens
aaatgtaccttcagaataag

SEQ ID NO: 1563022 - DNA, 17 bp, Homo sapiens
aaatgtaccttctttca

SEQ ID NO: 1563023 - DNA, 13 bp, Homo sapiens
aaatgtactggta

SEQ ID NO: 1563024 - DNA, 23 bp, Homo sapiens
aaatgtactggtaattgtacaat

SEQ ID NO: 1563025 - DNA, 21 bp, Homo sapiens
aaatgtagaattgaaaatgca

SEQ ID NO: 1563026 - DNA, 19 bp, Homo sapiens
aaatgtagcgacagcattt

SEQ ID NO: 1563027 - DNA, 17 bp, Homo sapiens
aaatgtataaatataca

SEQ ID NO: 1563028 - DNA, 14 bp, Homo sapiens
aaatgtatcttatt

SEQ ID NO: 1563029 - DNA, 20 bp, Homo sapiens
aaatgtatgtatcatcagtt

SEQ ID NO: 1563030 - DNA, 21 bp, Homo sapiens
aaatgtatgtatcatcagttg

SEQ ID NO: 1563031 - DNA, 14 bp, Homo sapiens
aaatgtattgattc

SEQ ID NO: 1563032 - DNA, 13 bp, Homo sapiens
aaatgtcaagaca

SEQ ID NO: 1563033 - DNA, 17 bp, Homo sapiens
aaatgtcacagaagcag

SEQ ID NO: 1563034 - DNA, 20 bp, Homo sapiens
aaatgtcagatacaatgtat

SEQ ID NO: 1563035 - DNA, 20 bp, Homo sapiens
aaatgtcatgagattgctgt

SEQ ID NO: 1563036 - DNA, 22 bp, Homo sapiens
aaatgtcctccagaagcctctg

SEQ ID NO: 1563037 - DNA, 17 bp, Homo sapiens
aaatgtctaattgtccc

SEQ ID NO: 1563038 - DNA, 17 bp, Homo sapiens
aaatgtgaatttttatt

SEQ ID NO: 1563039 - DNA, 18 bp, Homo sapiens
aaatgtgaatttttattg

SEQ ID NO: 1563040 - DNA, 19 bp, Homo sapiens
aaatgtgatgttctaaggc

SEQ ID NO: 1563041 - DNA, 20 bp, Homo sapiens
aaatgtgatgttctaaggct

SEQ ID NO: 1563042 - DNA, 18 bp, Homo sapiens
aaatgtgccttcattttt

SEQ ID NO: 1563043 - DNA, 22 bp, Homo sapiens
aaatgtgggattatgggtcaca

SEQ ID NO: 1563044 - DNA, 21 bp, Homo sapiens
aaatgtgtaattgttttggaa

SEQ ID NO: 1563045 - DNA, 17 bp, Homo sapiens
aaatgtgtacagtgaat

SEQ ID NO: 1563046 - DNA, 22 bp, Homo sapiens
aaatgtgtacagtgaattgtct

SEQ ID NO: 1563047 - DNA, 20 bp, Homo sapiens
aaatgtgtatcggatgcttt

SEQ ID NO: 1563048 - DNA, 13 bp, Homo sapiens
aaatgtgtatttt

SEQ ID NO: 1563049 - DNA, 13 bp, Homo sapiens
aaatgtgtttctg

SEQ ID NO: 1563050 - DNA, 14 bp, Homo sapiens
aaatgtgtttctgt

SEQ ID NO: 1563051 - DNA, 14 bp, Homo sapiens
aaatgttaaaagtt

SEQ ID NO: 1563052 - DNA, 14 bp, Homo sapiens
aaatgttaagaaat

SEQ ID NO: 1563053 - DNA, 19 bp, Homo sapiens
aaatgttacctctgaattt

SEQ ID NO: 1563054 - DNA, 23 bp, Homo sapiens
aaatgttatcttctcaagttcta

SEQ ID NO: 1563055 - DNA, 12 bp, Homo sapiens
aaatgttatgta

SEQ ID NO: 1563056 - DNA, 16 bp, Homo sapiens
aaatgttattatctgg

SEQ ID NO: 1563057 - DNA, 14 bp, Homo sapiens
aaatgttctaagtt

SEQ ID NO: 1563058 - DNA, 21 bp, Homo sapiens
aaatgttctaagtttctaaga

SEQ ID NO: 1563059 - DNA, 21 bp, Homo sapiens
aaatgttctatttaacaactg

SEQ ID NO: 1563060 - DNA, 18 bp, Homo sapiens
aaatgttgctttaacctg

SEQ ID NO: 1563061 - DNA, 18 bp, Homo sapiens
aaatgttggaatgttatg

SEQ ID NO: 1563062 - DNA, 19 bp, Homo sapiens
aaatgtttactgtaaattt

SEQ ID NO: 1563063 - DNA, 20 bp, Homo sapiens
aaatgtttccttaaacatga

SEQ ID NO: 1563064 - DNA, 21 bp, Homo sapiens
aaatgtttccttaaacatgaa

SEQ ID NO: 1563065 - DNA, 18 bp, Homo sapiens
aaatgtttgttatttaca

SEQ ID NO: 1563066 - DNA, 22 bp, Homo sapiens
aaatgtttgttatttacactgg

SEQ ID NO: 1563067 - DNA, 17 bp, Homo sapiens
aaatgtttttatttttg

SEQ ID NO: 1563068 - DNA, 21 bp, Homo sapiens
aaatgtttttctgccagggag

SEQ ID NO: 1563069 - DNA, 12 bp, Homo sapiens
aaatgtttttgg

SEQ ID NO: 1563070 - DNA, 14 bp, Homo sapiens
aaatgtttttggtc

SEQ ID NO: 1563071 - DNA, 14 bp, Homo sapiens
aaattaaaaaatga

SEQ ID NO: 1563072 - DNA, 18 bp, Homo sapiens
aaattaaaaaatgaaatt

SEQ ID NO: 1563073 - DNA, 14 bp, Homo sapiens
aaattaaaacaaat

SEQ ID NO: 1563074 - DNA, 22 bp, Homo sapiens
aaattaaaacaaatatacattt

SEQ ID NO: 1563075 - DNA, 19 bp, Homo sapiens
aaattaaaccaatgaagaa

SEQ ID NO: 1563076 - DNA, 12 bp, Homo sapiens
aaattaaagccc

SEQ ID NO: 1563077 - DNA, 18 bp, Homo sapiens
aaattaaatgccttgtat

SEQ ID NO: 1563078 - DNA, 20 bp, Homo sapiens
aaattaaatgccttgtataa

SEQ ID NO: 1563079 - DNA, 22 bp, Homo sapiens
aaattaactcaccagatttact

SEQ ID NO: 1563080 - DNA, 12 bp, Homo sapiens
aaattaagattt

SEQ ID NO: 1563081 - DNA, 16 bp, Homo sapiens
aaattaagatttcctt

SEQ ID NO: 1563082 - DNA, 16 bp, Homo sapiens
aaattaagcaaatgtt

SEQ ID NO: 1563083 - DNA, 17 bp, Homo sapiens
aaattaagcaaatgtta

SEQ ID NO: 1563084 - DNA, 12 bp, Homo sapiens
aaattaagcatt

SEQ ID NO: 1563085 - DNA, 14 bp, Homo sapiens
aaattaagttgaaa

SEQ ID NO: 1563086 - DNA, 22 bp, Homo sapiens
aaattaataaatcatgttttga

SEQ ID NO: 1563087 - DNA, 16 bp, Homo sapiens
aaattaatacttcatt

SEQ ID NO: 1563088 - DNA, 21 bp, Homo sapiens
aaattaatatggtgtattttt

SEQ ID NO: 1563089 - DNA, 17 bp, Homo sapiens
aaattaatcttgcttca

SEQ ID NO: 1563090 - DNA, 16 bp, Homo sapiens
aaattaattgaatcta

SEQ ID NO: 1563091 - DNA, 13 bp, Homo sapiens
aaattacaatttt

SEQ ID NO: 1563092 - DNA, 21 bp, Homo sapiens
aaattacatagacttaggcat

SEQ ID NO: 1563093 - DNA, 13 bp, Homo sapiens
aaattacatttgt

SEQ ID NO: 1563094 - DNA, 18 bp, Homo sapiens
aaattacctgtggatatt

SEQ ID NO: 1563095 - DNA, 20 bp, Homo sapiens
aaattacctttaattttaat

SEQ ID NO: 1563096 - DNA, 15 bp, Homo sapiens
aaattactacaaaat

SEQ ID NO: 1563097 - DNA, 19 bp, Homo sapiens
aaattactatctgttgaaa

SEQ ID NO: 1563098 - DNA, 15 bp, Homo sapiens
aaattactctttctc

SEQ ID NO: 1563099 - DNA, 12 bp, Homo sapiens
aaattagaaaaa

SEQ ID NO: 1563100 - DNA, 19 bp, Homo sapiens
aaattagaaaggacaacag

SEQ ID NO: 1563101 - DNA, 16 bp, Homo sapiens
aaattagacttatagt

SEQ ID NO: 1563102 - DNA, 13 bp, Homo sapiens
aaattagatttgt

SEQ ID NO: 1563103 - DNA, 16 bp, Homo sapiens
aaattagatttgtgca

SEQ ID NO: 1563104 - DNA, 21 bp, Homo sapiens
aaattagcctaagatatactt

SEQ ID NO: 1563105 - DNA, 14 bp, Homo sapiens
aaattaggaataaa

SEQ ID NO: 1563106 - DNA, 18 bp, Homo sapiens
aaattaggaataaataaa

SEQ ID NO: 1563107 - DNA, 22 bp, Homo sapiens
aaattagtcttttgtaatatca

SEQ ID NO: 1563108 - DNA, 19 bp, Homo sapiens
aaattataacttaaaatat

SEQ ID NO: 1563109 - DNA, 23 bp, Homo sapiens
aaattataatgtattcatatttg

SEQ ID NO: 1563110 - DNA, 13 bp, Homo sapiens
aaattatatattt

SEQ ID NO: 1563111 - DNA, 19 bp, Homo sapiens
aaattatatccgtgagttg

SEQ ID NO: 1563112 - DNA, 19 bp, Homo sapiens
aaattatcaaaaagctaat

SEQ ID NO: 1563113 - DNA, 16 bp, Homo sapiens
aaattatgcaaaagca

SEQ ID NO: 1563114 - DNA, 19 bp, Homo sapiens
aaattatgcaaaagcagct

SEQ ID NO: 1563115 - DNA, 18 bp, Homo sapiens
aaattatggcatttctat

SEQ ID NO: 1563116 - DNA, 13 bp, Homo sapiens
aaattatgtaatg

SEQ ID NO: 1563117 - DNA, 19 bp, Homo sapiens
aaattatgtatgtttacat

SEQ ID NO: 1563118 - DNA, 19 bp, Homo sapiens
aaattattagtttacatca

SEQ ID NO: 1563119 - DNA, 15 bp, Homo sapiens
aaattattatatata

SEQ ID NO: 1563120 - DNA, 12 bp, Homo sapiens
aaattattctag

SEQ ID NO: 1563121 - DNA, 20 bp, Homo sapiens
aaattattttaatattttgt

SEQ ID NO: 1563122 - DNA, 22 bp, Homo sapiens
aaattattttgttcatacatat

SEQ ID NO: 1563123 - DNA, 19 bp, Homo sapiens
aaattcaaaacctgcagtt

SEQ ID NO: 1563124 - DNA, 21 bp, Homo sapiens
aaattcaaagcataaaacttt

SEQ ID NO: 1563125 - DNA, 21 bp, Homo sapiens
aaattcaaagcatggacattt

SEQ ID NO: 1563126 - DNA, 16 bp, Homo sapiens
aaattcaactttgtaa

SEQ ID NO: 1563127 - DNA, 17 bp, Homo sapiens
aaattcaagaaaataaa

SEQ ID NO: 1563128 - DNA, 20 bp, Homo sapiens
aaattcaagaaaataaaact

SEQ ID NO: 1563129 - DNA, 22 bp, Homo sapiens
aaattcaccccctttcctggac

SEQ ID NO: 1563130 - DNA, 17 bp, Homo sapiens
aaattcactaatcttga

SEQ ID NO: 1563131 - DNA, 16 bp, Homo sapiens
aaattcagaacagcct

SEQ ID NO: 1563132 - DNA, 13 bp, Homo sapiens
aaattcagacaac

SEQ ID NO: 1563133 - DNA, 20 bp, Homo sapiens
aaattcaggatgctgtgata

SEQ ID NO: 1563134 - DNA, 16 bp, Homo sapiens
aaattcaggtacagaa

SEQ ID NO: 1563135 - DNA, 17 bp, Homo sapiens
aaattcagtcctaagaa

SEQ ID NO: 1563136 - DNA, 20 bp, Homo sapiens
aaattcagtttttttccagt

SEQ ID NO: 1563137 - DNA, 16 bp, Homo sapiens
aaattcatttctaatt

SEQ ID NO: 1563138 - DNA, 13 bp, Homo sapiens
aaattcattttta

SEQ ID NO: 1563139 - DNA, 24 bp, Homo sapiens
aaattcatttttaagatagaacac

SEQ ID NO: 1563140 - DNA, 13 bp, Homo sapiens
aaattcatttttt

SEQ ID NO: 1563141 - DNA, 12 bp, Homo sapiens
aaattccaaagt

SEQ ID NO: 1563142 - DNA, 17 bp, Homo sapiens
aaattccaaagtctcta

SEQ ID NO: 1563143 - DNA, 22 bp, Homo sapiens
aaattcctgtgttcaatattta

SEQ ID NO: 1563144 - DNA, 22 bp, Homo sapiens
aaattccttagcttagacctca

SEQ ID NO: 1563145 - DNA, 21 bp, Homo sapiens
aaattcgctgcaacctgttga

SEQ ID NO: 1563146 - DNA, 14 bp, Homo sapiens
aaattcgctttcta

SEQ ID NO: 1563147 - DNA, 14 bp, Homo sapiens
aaattctattgaaa

SEQ ID NO: 1563148 - DNA, 22 bp, Homo sapiens
aaattctattgaaaacagtgtc

SEQ ID NO: 1563149 - DNA, 22 bp, Homo sapiens
aaattctccaacagctgactct

SEQ ID NO: 1563150 - DNA, 19 bp, Homo sapiens
aaattctgaaaactgaatg

SEQ ID NO: 1563151 - DNA, 18 bp, Homo sapiens
aaattctgatgtttctgt

SEQ ID NO: 1563152 - DNA, 12 bp, Homo sapiens
aaattctgtttt

SEQ ID NO: 1563153 - DNA, 15 bp, Homo sapiens
aaattctgtttttaa

SEQ ID NO: 1563154 - DNA, 17 bp, Homo sapiens
aaattctgtttttaaaa

SEQ ID NO: 1563155 - DNA, 21 bp, Homo sapiens
aaattcttctaattgctgtgt

SEQ ID NO: 1563156 - DNA, 18 bp, Homo sapiens
aaattctttagtactcaa

SEQ ID NO: 1563157 - DNA, 14 bp, Homo sapiens
aaattgaaaagtta

SEQ ID NO: 1563158 - DNA, 14 bp, Homo sapiens
aaattgaaagaact

SEQ ID NO: 1563159 - DNA, 22 bp, Homo sapiens
aaattgaaaggcattctctgaa

SEQ ID NO: 1563160 - DNA, 23 bp, Homo sapiens
aaattgaaaggcattctctgaag

SEQ ID NO: 1563161 - DNA, 20 bp, Homo sapiens
aaattgacacaagtggacct

SEQ ID NO: 1563162 - DNA, 18 bp, Homo sapiens
aaattgagcagttcatga

SEQ ID NO: 1563163 - DNA, 16 bp, Homo sapiens
aaattgagctgctttt

SEQ ID NO: 1563164 - DNA, 23 bp, Homo sapiens
aaattgagctgctttttttgaaa

SEQ ID NO: 1563165 - DNA, 19 bp, Homo sapiens
aaattgagttgcacttatt

SEQ ID NO: 1563166 - DNA, 19 bp, Homo sapiens
aaattgattaaggctttct

SEQ ID NO: 1563167 - DNA, 18 bp, Homo sapiens
aaattgattgaattaaat

SEQ ID NO: 1563168 - DNA, 20 bp, Homo sapiens
aaattgatttttctcttcat

SEQ ID NO: 1563169 - DNA, 12 bp, Homo sapiens
aaattgcatact

SEQ ID NO: 1563170 - DNA, 15 bp, Homo sapiens
aaattgccttcagcc

SEQ ID NO: 1563171 - DNA, 22 bp, Homo sapiens
aaattgctatgttactattttc

SEQ ID NO: 1563172 - DNA, 17 bp, Homo sapiens
aaattgctgcatatttg

SEQ ID NO: 1563173 - DNA, 19 bp, Homo sapiens
aaattgctggcagatgctt

SEQ ID NO: 1563174 - DNA, 14 bp, Homo sapiens
aaattgctgtgctt

SEQ ID NO: 1563175 - DNA, 19 bp, Homo sapiens
aaattgcttctaaaacaat

SEQ ID NO: 1563176 - DNA, 17 bp, Homo sapiens
aaattgctttacagttt

SEQ ID NO: 1563177 - DNA, 19 bp, Homo sapiens
aaattgcttttgttgtgac

SEQ ID NO: 1563178 - DNA, 16 bp, Homo sapiens
aaattggaatggaact

SEQ ID NO: 1563179 - DNA, 22 bp, Homo sapiens
aaattggaatggaactactgta

SEQ ID NO: 1563180 - DNA, 23 bp, Homo sapiens
aaattggagttggagtagaatgt

SEQ ID NO: 1563181 - DNA, 15 bp, Homo sapiens
aaattggattatttt

SEQ ID NO: 1563182 - DNA, 15 bp, Homo sapiens
aaattgggaaaggag

SEQ ID NO: 1563183 - DNA, 20 bp, Homo sapiens
aaattgggaaaggagtagaa

SEQ ID NO: 1563184 - DNA, 20 bp, Homo sapiens
aaattggtatcaagaaagtc

SEQ ID NO: 1563185 - DNA, 19 bp, Homo sapiens
aaattgtatgaaaatcctt

SEQ ID NO: 1563186 - DNA, 23 bp, Homo sapiens
aaattgtccgtgttcatacattt

SEQ ID NO: 1563187 - DNA, 15 bp, Homo sapiens
aaattgtgatgtgtc

SEQ ID NO: 1563188 - DNA, 23 bp, Homo sapiens
aaattgtgcagtactttgtgcat

SEQ ID NO: 1563189 - DNA, 14 bp, Homo sapiens
aaattgtgtttgct

SEQ ID NO: 1563190 - DNA, 14 bp, Homo sapiens
aaattgttgtgctt

SEQ ID NO: 1563191 - DNA, 21 bp, Homo sapiens
aaattgttgtgcttagaattg

SEQ ID NO: 1563192 - DNA, 21 bp, Homo sapiens
aaattgtttatgtgttatgaa

SEQ ID NO: 1563193 - DNA, 12 bp, Homo sapiens
aaattgtttctt

SEQ ID NO: 1563194 - DNA, 19 bp, Homo sapiens
aaattgtttggcttcctcc

SEQ ID NO: 1563195 - DNA, 18 bp, Homo sapiens
aaattgttttaccagctc

SEQ ID NO: 1563196 - DNA, 14 bp, Homo sapiens
aaattgttttcact

SEQ ID NO: 1563197 - DNA, 17 bp, Homo sapiens
aaattgttttcacttgt

SEQ ID NO: 1563198 - DNA, 13 bp, Homo sapiens
aaatttaaaaaat

SEQ ID NO: 1563199 - DNA, 19 bp, Homo sapiens
aaatttaaaaaataaataa

SEQ ID NO: 1563200 - DNA, 14 bp, Homo sapiens
aaatttaagcaaac

SEQ ID NO: 1563201 - DNA, 20 bp, Homo sapiens
aaatttaatatactgcatat

SEQ ID NO: 1563202 - DNA, 17 bp, Homo sapiens
aaatttaattcatgttt

SEQ ID NO: 1563203 - DNA, 23 bp, Homo sapiens
aaatttacatttaatacagataa

SEQ ID NO: 1563204 - DNA, 16 bp, Homo sapiens
aaatttagccgggcgc

SEQ ID NO: 1563205 - DNA, 10 bp, Homo sapiens
aaatttataa

SEQ ID NO: 1563206 - DNA, 16 bp, Homo sapiens
aaatttatgcatttca

SEQ ID NO: 1563207 - DNA, 17 bp, Homo sapiens
aaatttatgcatttcat

SEQ ID NO: 1563208 - DNA, 21 bp, Homo sapiens
aaatttatgcatttcattcaa

SEQ ID NO: 1563209 - DNA, 15 bp, Homo sapiens
aaatttatgtgatgg

SEQ ID NO: 1563210 - DNA, 19 bp, Homo sapiens
aaatttattttataagaaa

SEQ ID NO: 1563211 - DNA, 22 bp, Homo sapiens
aaatttattttataagaaaaac

SEQ ID NO: 1563212 - DNA, 16 bp, Homo sapiens
aaatttcaaatgcaga

SEQ ID NO: 1563213 - DNA, 18 bp, Homo sapiens
aaatttcactactagatt

SEQ ID NO: 1563214 - DNA, 12 bp, Homo sapiens
aaatttcagatt

SEQ ID NO: 1563215 - DNA, 22 bp, Homo sapiens
aaatttccagtacctttgtcac

SEQ ID NO: 1563216 - DNA, 15 bp, Homo sapiens
aaatttcctgtttga

SEQ ID NO: 1563217 - DNA, 15 bp, Homo sapiens
aaatttcgttgtcca

SEQ ID NO: 1563218 - DNA, 18 bp, Homo sapiens
aaatttctgtaaaacagg

SEQ ID NO: 1563219 - DNA, 14 bp, Homo sapiens
aaatttcttatgtg

SEQ ID NO: 1563220 - DNA, 20 bp, Homo sapiens
aaatttcttatgtgacatta

SEQ ID NO: 1563221 - DNA, 10 bp, Homo sapiens
aaatttgaat

SEQ ID NO: 1563222 - DNA, 20 bp, Homo sapiens
aaatttgaatgggtccattt

SEQ ID NO: 1563223 - DNA, 13 bp, Homo sapiens
aaatttgatttcc

SEQ ID NO: 1563224 - DNA, 12 bp, Homo sapiens
aaatttgccaag

SEQ ID NO: 1563225 - DNA, 13 bp, Homo sapiens
aaatttgctagca

SEQ ID NO: 1563226 - DNA, 14 bp, Homo sapiens
aaatttgctagcag

SEQ ID NO: 1563227 - DNA, 14 bp, Homo sapiens
aaatttggagtaaa

SEQ ID NO: 1563228 - DNA, 20 bp, Homo sapiens
aaatttggccttaagaactg

SEQ ID NO: 1563229 - DNA, 22 bp, Homo sapiens
aaatttggccttaagaactgtg

SEQ ID NO: 1563230 - DNA, 15 bp, Homo sapiens
aaatttgtaatattt

SEQ ID NO: 1563231 - DNA, 24 bp, Homo sapiens
aaatttgtacaggactgtaaagat

SEQ ID NO: 1563232 - DNA, 11 bp, Homo sapiens
aaatttgtact

SEQ ID NO: 1563233 - DNA, 23 bp, Homo sapiens
aaatttgtcttgccttattaaag

SEQ ID NO: 1563234 - DNA, 17 bp, Homo sapiens
aaatttgtgctttttaa

SEQ ID NO: 1563235 - DNA, 14 bp, Homo sapiens
aaatttgtgtcata

SEQ ID NO: 1563236 - DNA, 15 bp, Homo sapiens
aaatttgttcttgta

SEQ ID NO: 1563237 - DNA, 14 bp, Homo sapiens
aaatttgtttgaaa

SEQ ID NO: 1563238 - DNA, 18 bp, Homo sapiens
aaatttgtttgtattttt

SEQ ID NO: 1563239 - DNA, 10 bp, Homo sapiens
aaattttaaa

SEQ ID NO: 1563240 - DNA, 15 bp, Homo sapiens
aaattttaaaaatct

SEQ ID NO: 1563241 - DNA, 13 bp, Homo sapiens
aaattttaaaaca

SEQ ID NO: 1563242 - DNA, 15 bp, Homo sapiens
aaattttaactaaat

SEQ ID NO: 1563243 - DNA, 14 bp, Homo sapiens
aaattttagaaata

SEQ ID NO: 1563244 - DNA, 13 bp, Homo sapiens
aaattttgtttca

SEQ ID NO: 1563245 - DNA, 22 bp, Homo sapiens
aaattttgtttcagaattttgt

SEQ ID NO: 1563246 - DNA, 23 bp, Homo sapiens
aaattttgtttcagaattttgta

SEQ ID NO: 1563247 - DNA, 18 bp, Homo sapiens
aaatttttacctgtttaa

SEQ ID NO: 1563248 - DNA, 13 bp, Homo sapiens
aaatttttataaa

SEQ ID NO: 1563249 - DNA, 15 bp, Homo sapiens
aaatttttatgtaaa

SEQ ID NO: 1563250 - DNA, 20 bp, Homo sapiens
aaatttttcagatgcttctg

SEQ ID NO: 1563251 - DNA, 21 bp, Homo sapiens
aaatttttcagatgcttctgg

SEQ ID NO: 1563252 - DNA, 17 bp, Homo sapiens
aaattttttttttaata

SEQ ID NO: 1563253 - DNA, 20 bp, Homo sapiens
aacaaaaaaaaaccatgcat

SEQ ID NO: 1563254 - DNA, 17 bp, Homo sapiens
aacaaaaaaaatgttaa

SEQ ID NO: 1563255 - DNA, 13 bp, Homo sapiens
aacaaaaaataaa

SEQ ID NO: 1563256 - DNA, 22 bp, Homo sapiens
aacaaaaaataaattttaaaaa

SEQ ID NO: 1563257 - DNA, 19 bp, Homo sapiens
aacaaaaacactaaaaata

SEQ ID NO: 1563258 - DNA, 13 bp, Homo sapiens
aacaaaaagatgt

SEQ ID NO: 1563259 - DNA, 13 bp, Homo sapiens
aacaaaaagcccc

SEQ ID NO: 1563260 - DNA, 11 bp, Homo sapiens
aacaaaaataa

SEQ ID NO: 1563261 - DNA, 11 bp, Homo sapiens
aacaaaacaaa

SEQ ID NO: 1563262 - DNA, 12 bp, Homo sapiens
aacaaaacaaaa

SEQ ID NO: 1563263 - DNA, 14 bp, Homo sapiens
aacaaaacaaaaca

SEQ ID NO: 1563264 - DNA, 14 bp, Homo sapiens
aacaaaaccaagcc

SEQ ID NO: 1563265 - DNA, 9 bp, Homo sapiens
aacaaaact

SEQ ID NO: 1563266 - DNA, 15 bp, Homo sapiens
aacaaaagatttgtt

SEQ ID NO: 1563267 - DNA, 13 bp, Homo sapiens
aacaaaatacatt

SEQ ID NO: 1563268 - DNA, 17 bp, Homo sapiens
aacaaaatacattcttt

SEQ ID NO: 1563269 - DNA, 18 bp, Homo sapiens
aacaaaatacattctttt

SEQ ID NO: 1563270 - DNA, 20 bp, Homo sapiens
aacaaaatctcctcttttag

SEQ ID NO: 1563271 - DNA, 11 bp, Homo sapiens
aacaaaatttg

SEQ ID NO: 1563272 - DNA, 20 bp, Homo sapiens
aacaaaatttgactaatttt

SEQ ID NO: 1563273 - DNA, 24 bp, Homo sapiens
aacaaaatttgactaattttacat

SEQ ID NO: 1563274 - DNA, 19 bp, Homo sapiens
aacaaaatttgtttgaaat

SEQ ID NO: 1563275 - DNA, 21 bp, Homo sapiens
aacaaaattttattttgtgct

SEQ ID NO: 1563276 - DNA, 15 bp, Homo sapiens
aacaaaccaacatct

SEQ ID NO: 1563277 - DNA, 21 bp, Homo sapiens
aacaaaccgaaaatggacatt

SEQ ID NO: 1563278 - DNA, 21 bp, Homo sapiens
aacaaactatgatcacagtga

SEQ ID NO: 1563279 - DNA, 12 bp, Homo sapiens
aacaaagacatg

SEQ ID NO: 1563280 - DNA, 19 bp, Homo sapiens
aacaaagacatgctttcca

SEQ ID NO: 1563281 - DNA, 16 bp, Homo sapiens
aacaaaggttgagatg

SEQ ID NO: 1563282 - DNA, 17 bp, Homo sapiens
aacaaagtgctagactt

SEQ ID NO: 1563283 - DNA, 12 bp, Homo sapiens
aacaaatatgca

SEQ ID NO: 1563284 - DNA, 22 bp, Homo sapiens
aacaaatgtgtttttctatata

SEQ ID NO: 1563285 - DNA, 15 bp, Homo sapiens
aacaaattatttttg

SEQ ID NO: 1563286 - DNA, 15 bp, Homo sapiens
aacaaattctttagt

SEQ ID NO: 1563287 - DNA, 18 bp, Homo sapiens
aacaaattctttagtact

SEQ ID NO: 1563288 - DNA, 14 bp, Homo sapiens
aacaacaataataa

SEQ ID NO: 1563289 - DNA, 17 bp, Homo sapiens
aacaacatttatatgta

SEQ ID NO: 1563290 - DNA, 14 bp, Homo sapiens
aacaacctgcccaa

SEQ ID NO: 1563291 - DNA, 23 bp, Homo sapiens
aacaacgtgagagaaagagagaa

SEQ ID NO: 1563292 - DNA, 13 bp, Homo sapiens
aacaactctgcct

SEQ ID NO: 1563293 - DNA, 14 bp, Homo sapiens
aacaactgctctta

SEQ ID NO: 1563294 - DNA, 17 bp, Homo sapiens
aacaacttggcatttct

SEQ ID NO: 1563295 - DNA, 14 bp, Homo sapiens
aacaacttgtagca

SEQ ID NO: 1563296 - DNA, 16 bp, Homo sapiens
aacaacttgtagcagc

SEQ ID NO: 1563297 - DNA, 17 bp, Homo sapiens
aacaacttgtagcagct

SEQ ID NO: 1563298 - DNA, 21 bp, Homo sapiens
aacaagaaagaaatggctttt

SEQ ID NO: 1563299 - DNA, 14 bp, Homo sapiens
aacaagaaatctga

SEQ ID NO: 1563300 - DNA, 12 bp, Homo sapiens
aacaagaaatgg

SEQ ID NO: 1563301 - DNA, 18 bp, Homo sapiens
aacaagaatattgtatgt

SEQ ID NO: 1563302 - DNA, 19 bp, Homo sapiens
aacaagaccccgtctcaaa

SEQ ID NO: 1563303 - DNA, 22 bp, Homo sapiens
aacaagacctcagtgccttcct

SEQ ID NO: 1563304 - DNA, 19 bp, Homo sapiens
aacaagatggttctagcat

SEQ ID NO: 1563305 - DNA, 14 bp, Homo sapiens
aacaagatttccct

SEQ ID NO: 1563306 - DNA, 20 bp, Homo sapiens
aacaagatttccctaaaaat

SEQ ID NO: 1563307 - DNA, 22 bp, Homo sapiens
aacaagccaaacattcttattt

SEQ ID NO: 1563308 - DNA, 22 bp, Homo sapiens
aacaagccaaagagcctcccac

SEQ ID NO: 1563309 - DNA, 12 bp, Homo sapiens
aacaagctgtgc

SEQ ID NO: 1563310 - DNA, 22 bp, Homo sapiens
aacaagggaaaaatttttatgt

SEQ ID NO: 1563311 - DNA, 17 bp, Homo sapiens
aacaagggctgcaatgc

SEQ ID NO: 1563312 - DNA, 23 bp, Homo sapiens
aacaaggtgccctttagccagat

SEQ ID NO: 1563313 - DNA, 15 bp, Homo sapiens
aacaagtaaatatat

SEQ ID NO: 1563314 - DNA, 14 bp, Homo sapiens
aacaagtaagaaaa

SEQ ID NO: 1563315 - DNA, 16 bp, Homo sapiens
aacaagtcacagctgc

SEQ ID NO: 1563316 - DNA, 19 bp, Homo sapiens
aacaagtcacagctgcagc

SEQ ID NO: 1563317 - DNA, 21 bp, Homo sapiens
aacaagtcacagctgcagctg

SEQ ID NO: 1563318 - DNA, 14 bp, Homo sapiens
aacaagtcattttt

SEQ ID NO: 1563319 - DNA, 16 bp, Homo sapiens
aacaagttgttaaaac

SEQ ID NO: 1563320 - DNA, 23 bp, Homo sapiens
aacaataaatgaatgaataacta

SEQ ID NO: 1563321 - DNA, 15 bp, Homo sapiens
aacaataatatttca

SEQ ID NO: 1563322 - DNA, 20 bp, Homo sapiens
aacaataatatttcaagtgc

SEQ ID NO: 1563323 - DNA, 13 bp, Homo sapiens
aacaatacaaatg

SEQ ID NO: 1563324 - DNA, 23 bp, Homo sapiens
aacaatattactttgtcttttca

SEQ ID NO: 1563325 - DNA, 17 bp, Homo sapiens
aacaatctggaagaaaa

SEQ ID NO: 1563326 - DNA, 18 bp, Homo sapiens
aacaatgaagataaaaag

SEQ ID NO: 1563327 - DNA, 17 bp, Homo sapiens
aacaatgacaagatgtt

SEQ ID NO: 1563328 - DNA, 19 bp, Homo sapiens
aacaatgacactagaaaac

SEQ ID NO: 1563329 - DNA, 20 bp, Homo sapiens
aacaatgacactagaaaact

SEQ ID NO: 1563330 - DNA, 18 bp, Homo sapiens
aacaatgccatgaacaaa

SEQ ID NO: 1563331 - DNA, 18 bp, Homo sapiens
aacaatgcctacagctgt

SEQ ID NO: 1563332 - DNA, 21 bp, Homo sapiens
aacaatggttgaatgaataaa

SEQ ID NO: 1563333 - DNA, 23 bp, Homo sapiens
aacaatggttgaatgaataaaac

SEQ ID NO: 1563334 - DNA, 14 bp, Homo sapiens
aacaatgtaaagta

SEQ ID NO: 1563335 - DNA, 22 bp, Homo sapiens
aacaatgtattttaataacata

SEQ ID NO: 1563336 - DNA, 17 bp, Homo sapiens
aacaatgttgtccaaca

SEQ ID NO: 1563337 - DNA, 16 bp, Homo sapiens
aacaattgaagtaaac

SEQ ID NO: 1563338 - DNA, 18 bp, Homo sapiens
aacaattgtgtagccttt

SEQ ID NO: 1563339 - DNA, 23 bp, Homo sapiens
aacaattgtgtagcctttttgta

SEQ ID NO: 1563340 - DNA, 13 bp, Homo sapiens
aacaatttatgaa

SEQ ID NO: 1563341 - DNA, 13 bp, Homo sapiens
aacaattttaatg

SEQ ID NO: 1563342 - DNA, 12 bp, Homo sapiens
aacaatttttga

SEQ ID NO: 1563343 - DNA, 20 bp, Homo sapiens
aacacaaagagaaaaagaaa

SEQ ID NO: 1563344 - DNA, 13 bp, Homo sapiens
aacacaaatgcag

SEQ ID NO: 1563345 - DNA, 13 bp, Homo sapiens
aacacaagcaaaa

SEQ ID NO: 1563346 - DNA, 23 bp, Homo sapiens
aacacaagggatataaaatgaaa

SEQ ID NO: 1563347 - DNA, 14 bp, Homo sapiens
aacacacaaaggta

SEQ ID NO: 1563348 - DNA, 10 bp, Homo sapiens
aacacacctc

SEQ ID NO: 1563349 - DNA, 12 bp, Homo sapiens
aacacactggcc

SEQ ID NO: 1563350 - DNA, 15 bp, Homo sapiens
aacacagcaagggtg

SEQ ID NO: 1563351 - DNA, 14 bp, Homo sapiens
aacacagcatgtgc

SEQ ID NO: 1563352 - DNA, 16 bp, Homo sapiens
aacacagcctgggccc

SEQ ID NO: 1563353 - DNA, 24 bp, Homo sapiens
aacacagctgttcttctgttctgc

SEQ ID NO: 1563354 - DNA, 15 bp, Homo sapiens
aacacagctttacaa

SEQ ID NO: 1563355 - DNA, 15 bp, Homo sapiens
aacacaggcaaaatc

SEQ ID NO: 1563356 - DNA, 14 bp, Homo sapiens
aacacagggaaagc

SEQ ID NO: 1563357 - DNA, 17 bp, Homo sapiens
aacacagggttttgtat

SEQ ID NO: 1563358 - DNA, 14 bp, Homo sapiens
aacacagtgtctgt

SEQ ID NO: 1563359 - DNA, 22 bp, Homo sapiens
aacacagtgtctgttcagcaaa

SEQ ID NO: 1563360 - DNA, 19 bp, Homo sapiens
aacacagtttagtgcttta

SEQ ID NO: 1563361 - DNA, 21 bp, Homo sapiens
aacacatacaggaaggtagaa

SEQ ID NO: 1563362 - DNA, 17 bp, Homo sapiens
aacacatcaaataaact

SEQ ID NO: 1563363 - DNA, 12 bp, Homo sapiens
aacacatcagct

SEQ ID NO: 1563364 - DNA, 17 bp, Homo sapiens
aacacatgtttttatac

SEQ ID NO: 1563365 - DNA, 12 bp, Homo sapiens
aacacatttctt

SEQ ID NO: 1563366 - DNA, 20 bp, Homo sapiens
aacacatttttttgcatgca

SEQ ID NO: 1563367 - DNA, 17 bp, Homo sapiens
aacaccaaaaaatatct

SEQ ID NO: 1563368 - DNA, 13 bp, Homo sapiens
aacaccaacccct

SEQ ID NO: 1563369 - DNA, 17 bp, Homo sapiens
aacaccaacccctgacc

SEQ ID NO: 1563370 - DNA, 15 bp, Homo sapiens
aacaccacagacaca

SEQ ID NO: 1563371 - DNA, 16 bp, Homo sapiens
aacaccacagacacac

SEQ ID NO: 1563372 - DNA, 17 bp, Homo sapiens
aacaccacagacacaca

SEQ ID NO: 1563373 - DNA, 19 bp, Homo sapiens
aacaccacagacacacaca

SEQ ID NO: 1563374 - DNA, 21 bp, Homo sapiens
aacaccaggtttatggaaaat

SEQ ID NO: 1563375 - DNA, 22 bp, Homo sapiens
aacaccattttttttttctttt

SEQ ID NO: 1563376 - DNA, 20 bp, Homo sapiens
aacacccagtctgttcccca

SEQ ID NO: 1563377 - DNA, 16 bp, Homo sapiens
aacaccccgcctgcct

SEQ ID NO: 1563378 - DNA, 17 bp, Homo sapiens
aacaccctggatgctgt

SEQ ID NO: 1563379 - DNA, 20 bp, Homo sapiens
aacaccgcttctgccttttc

SEQ ID NO: 1563380 - DNA, 19 bp, Homo sapiens
aacacctagctttattctt

SEQ ID NO: 1563381 - DNA, 23 bp, Homo sapiens
aacacctcccaggagacagttca

SEQ ID NO: 1563382 - DNA, 16 bp, Homo sapiens
aacacctcctcatgta

SEQ ID NO: 1563383 - DNA, 17 bp, Homo sapiens
aacaccttccagctcct

SEQ ID NO: 1563384 - DNA, 15 bp, Homo sapiens
aacacgagcaggcta

SEQ ID NO: 1563385 - DNA, 15 bp, Homo sapiens
aacacgctgcctggt

SEQ ID NO: 1563386 - DNA, 18 bp, Homo sapiens
aacactaacatataatgt

SEQ ID NO: 1563387 - DNA, 18 bp, Homo sapiens
aacactaactatgcatgg

SEQ ID NO: 1563388 - DNA, 15 bp, Homo sapiens
aacactaagctctct

SEQ ID NO: 1563389 - DNA, 13 bp, Homo sapiens
aacactaatatat

SEQ ID NO: 1563390 - DNA, 23 bp, Homo sapiens
aacactagggccttggaaattcc

SEQ ID NO: 1563391 - DNA, 13 bp, Homo sapiens
aacactatgtata

SEQ ID NO: 1563392 - DNA, 12 bp, Homo sapiens
aacactcagtcc

SEQ ID NO: 1563393 - DNA, 14 bp, Homo sapiens
aacactcagtccac

SEQ ID NO: 1563394 - DNA, 12 bp, Homo sapiens
aacactgcagcc

SEQ ID NO: 1563395 - DNA, 11 bp, Homo sapiens
aacactgccat

SEQ ID NO: 1563396 - DNA, 23 bp, Homo sapiens
aacactgcctttttatttatatg

SEQ ID NO: 1563397 - DNA, 14 bp, Homo sapiens
aacactgctcacag

SEQ ID NO: 1563398 - DNA, 17 bp, Homo sapiens
aacactggcctgggtct

SEQ ID NO: 1563399 - DNA, 17 bp, Homo sapiens
aacactgggggagggga

SEQ ID NO: 1563400 - DNA, 16 bp, Homo sapiens
aacactggttaaatta

SEQ ID NO: 1563401 - DNA, 17 bp, Homo sapiens
aacactggttaaattaa

SEQ ID NO: 1563402 - DNA, 13 bp, Homo sapiens
aacactgtatttt

SEQ ID NO: 1563403 - DNA, 22 bp, Homo sapiens
aacactgtattttaatgtactt

SEQ ID NO: 1563404 - DNA, 21 bp, Homo sapiens
aacactgtccttccctgccac

SEQ ID NO: 1563405 - DNA, 15 bp, Homo sapiens
aacacttaaatttct

SEQ ID NO: 1563406 - DNA, 16 bp, Homo sapiens
aacacttatcttctgg

SEQ ID NO: 1563407 - DNA, 18 bp, Homo sapiens
aacacttattttctgaat

SEQ ID NO: 1563408 - DNA, 23 bp, Homo sapiens
aacacttattttctgaattcata

SEQ ID NO: 1563409 - DNA, 22 bp, Homo sapiens
aacacttggcatacaaaatatt

SEQ ID NO: 1563410 - DNA, 11 bp, Homo sapiens
aacactttgta

SEQ ID NO: 1563411 - DNA, 14 bp, Homo sapiens
aacagaaaaacaat

SEQ ID NO: 1563412 - DNA, 16 bp, Homo sapiens
aacagaaaaacaatct

SEQ ID NO: 1563413 - DNA, 19 bp, Homo sapiens
aacagaaaacattctgatt

SEQ ID NO: 1563414 - DNA, 13 bp, Homo sapiens
aacagaaacaaaa

SEQ ID NO: 1563415 - DNA, 20 bp, Homo sapiens
aacagaaacgagatttgcca

SEQ ID NO: 1563416 - DNA, 23 bp, Homo sapiens
aacagaaagttggaaaggaaaaa

SEQ ID NO: 1563417 - DNA, 17 bp, Homo sapiens
aacagaaattgtatatt

SEQ ID NO: 1563418 - DNA, 14 bp, Homo sapiens
aacagaagcagagg

SEQ ID NO: 1563419 - DNA, 14 bp, Homo sapiens
aacagaatttgaga

SEQ ID NO: 1563420 - DNA, 14 bp, Homo sapiens
aacagaatttttcc

SEQ ID NO: 1563421 - DNA, 16 bp, Homo sapiens
aacagacaacagaagt

SEQ ID NO: 1563422 - DNA, 19 bp, Homo sapiens
aacagaccaatagacattt

SEQ ID NO: 1563423 - DNA, 13 bp, Homo sapiens
aacagagaaggca

SEQ ID NO: 1563424 - DNA, 15 bp, Homo sapiens
aacagagaaggcagg

SEQ ID NO: 1563425 - DNA, 16 bp, Homo sapiens
aacagagagaatgaga

SEQ ID NO: 1563426 - DNA, 20 bp, Homo sapiens
aacagagctactgagacttg

SEQ ID NO: 1563427 - DNA, 21 bp, Homo sapiens
aacagaggccatggcagaata

SEQ ID NO: 1563428 - DNA, 13 bp, Homo sapiens
aacagagggctgc

SEQ ID NO: 1563429 - DNA, 20 bp, Homo sapiens
aacagatagttgtgttttta

SEQ ID NO: 1563430 - DNA, 17 bp, Homo sapiens
aacagatatcagtgtct

SEQ ID NO: 1563431 - DNA, 21 bp, Homo sapiens
aacagatattacagcttattt

SEQ ID NO: 1563432 - DNA, 13 bp, Homo sapiens
aacagatctggaa

SEQ ID NO: 1563433 - DNA, 21 bp, Homo sapiens
aacagatctggaacctcagcc

SEQ ID NO: 1563434 - DNA, 22 bp, Homo sapiens
aacagatctggaacctcagcct

SEQ ID NO: 1563435 - DNA, 14 bp, Homo sapiens
aacagatcttttac

SEQ ID NO: 1563436 - DNA, 15 bp, Homo sapiens
aacagatgctaggaa

SEQ ID NO: 1563437 - DNA, 23 bp, Homo sapiens
aacagatggggtctgtgactgga

SEQ ID NO: 1563438 - DNA, 20 bp, Homo sapiens
aacagattcaggccagccca

SEQ ID NO: 1563439 - DNA, 17 bp, Homo sapiens
aacagatttttacaaat

SEQ ID NO: 1563440 - DNA, 14 bp, Homo sapiens
aacagcacacctgt

SEQ ID NO: 1563441 - DNA, 15 bp, Homo sapiens
aacagcacacctgtg

SEQ ID NO: 1563442 - DNA, 16 bp, Homo sapiens
aacagcacacctgtgt

SEQ ID NO: 1563443 - DNA, 21 bp, Homo sapiens
aacagcagggtagtctggttt

SEQ ID NO: 1563444 - DNA, 23 bp, Homo sapiens
aacagcagtgatctcagggcaga

SEQ ID NO: 1563445 - DNA, 23 bp, Homo sapiens
aacagcattcttgtcacaataaa

SEQ ID NO: 1563446 - DNA, 12 bp, Homo sapiens
aacagcattgct

SEQ ID NO: 1563447 - DNA, 14 bp, Homo sapiens
aacagcattgcttt

SEQ ID NO: 1563448 - DNA, 15 bp, Homo sapiens
aacagcattgctttc

SEQ ID NO: 1563449 - DNA, 16 bp, Homo sapiens
aacagcattgctttct

SEQ ID NO: 1563450 - DNA, 11 bp, Homo sapiens
aacagccatgc

SEQ ID NO: 1563451 - DNA, 16 bp, Homo sapiens
aacagccatgcccgca

SEQ ID NO: 1563452 - DNA, 14 bp, Homo sapiens
aacagcctcacaga

SEQ ID NO: 1563453 - DNA, 16 bp, Homo sapiens
aacagcctctttttga

SEQ ID NO: 1563454 - DNA, 22 bp, Homo sapiens
aacagctatgggagccccaggg

SEQ ID NO: 1563455 - DNA, 12 bp, Homo sapiens
aacagctcccag

SEQ ID NO: 1563456 - DNA, 18 bp, Homo sapiens
aacagctgcattagaaaa

SEQ ID NO: 1563457 - DNA, 13 bp, Homo sapiens
aacagctgtgtct

SEQ ID NO: 1563458 - DNA, 14 bp, Homo sapiens
aacagctgtgtctg

SEQ ID NO: 1563459 - DNA, 20 bp, Homo sapiens
aacagcttcagaaagagctc

SEQ ID NO: 1563460 - DNA, 20 bp, Homo sapiens
aacagcttcatgcctttgta

SEQ ID NO: 1563461 - DNA, 21 bp, Homo sapiens
aacagcttcatgcctttgtaa

SEQ ID NO: 1563462 - DNA, 13 bp, Homo sapiens
aacagcttgctgt

SEQ ID NO: 1563463 - DNA, 16 bp, Homo sapiens
aacagctttcaagtgc

SEQ ID NO: 1563464 - DNA, 22 bp, Homo sapiens
aacaggaaaggctcgaaataca

SEQ ID NO: 1563465 - DNA, 16 bp, Homo sapiens
aacaggaatccttact

SEQ ID NO: 1563466 - DNA, 23 bp, Homo sapiens
aacaggaatccttactgatattt

SEQ ID NO: 1563467 - DNA, 21 bp, Homo sapiens
aacaggaatctcagagacagg

SEQ ID NO: 1563468 - DNA, 15 bp, Homo sapiens
aacaggaattttatt

SEQ ID NO: 1563469 - DNA, 21 bp, Homo sapiens
aacaggaattttattttgctg

SEQ ID NO: 1563470 - DNA, 20 bp, Homo sapiens
aacaggaccacaaaaatgaa

SEQ ID NO: 1563471 - DNA, 22 bp, Homo sapiens
aacaggcaaacattttctctta

SEQ ID NO: 1563472 - DNA, 12 bp, Homo sapiens
aacaggcccagc

SEQ ID NO: 1563473 - DNA, 23 bp, Homo sapiens
aacaggcccagcattgctggttc

SEQ ID NO: 1563474 - DNA, 21 bp, Homo sapiens
aacaggctcaatattcctgaa

SEQ ID NO: 1563475 - DNA, 22 bp, Homo sapiens
aacaggctgttctgcactgaaa

SEQ ID NO: 1563476 - DNA, 18 bp, Homo sapiens
aacagggagaagtagcta

SEQ ID NO: 1563477 - DNA, 16 bp, Homo sapiens
aacagggattgatttt

SEQ ID NO: 1563478 - DNA, 17 bp, Homo sapiens
aacagggattgatttta

SEQ ID NO: 1563479 - DNA, 21 bp, Homo sapiens
aacagggctgccttctggcct

SEQ ID NO: 1563480 - DNA, 22 bp, Homo sapiens
aacaggggaggaaaaaagaacc

SEQ ID NO: 1563481 - DNA, 15 bp, Homo sapiens
aacaggtatatactt

SEQ ID NO: 1563482 - DNA, 19 bp, Homo sapiens
aacaggtctcctcttaaaa

SEQ ID NO: 1563483 - DNA, 20 bp, Homo sapiens
aacaggtctcctcttaaaaa

SEQ ID NO: 1563484 - DNA, 22 bp, Homo sapiens
aacaggtgtggggacacagcag

SEQ ID NO: 1563485 - DNA, 13 bp, Homo sapiens
aacagtaaaccac

SEQ ID NO: 1563486 - DNA, 18 bp, Homo sapiens
aacagtaaaccactgaaa

SEQ ID NO: 1563487 - DNA, 19 bp, Homo sapiens
aacagtaaagaaagcagaa

SEQ ID NO: 1563488 - DNA, 14 bp, Homo sapiens
aacagtaaatgtgc

SEQ ID NO: 1563489 - DNA, 23 bp, Homo sapiens
aacagtataacaactatttacat

SEQ ID NO: 1563490 - DNA, 17 bp, Homo sapiens
aacagtcttcaggcaaa

SEQ ID NO: 1563491 - DNA, 21 bp, Homo sapiens
aacagtgaagttttactgtct

SEQ ID NO: 1563492 - DNA, 12 bp, Homo sapiens
aacagtgcctgc

SEQ ID NO: 1563493 - DNA, 14 bp, Homo sapiens
aacagtggatcaca

SEQ ID NO: 1563494 - DNA, 13 bp, Homo sapiens
aacagtgtttccc

SEQ ID NO: 1563495 - DNA, 23 bp, Homo sapiens
aacagtgtttcccataattttct

SEQ ID NO: 1563496 - DNA, 13 bp, Homo sapiens
aacagttaacttt

SEQ ID NO: 1563497 - DNA, 19 bp, Homo sapiens
aacagttaataccattttt

SEQ ID NO: 1563498 - DNA, 11 bp, Homo sapiens
aacagttcaaa

SEQ ID NO: 1563499 - DNA, 16 bp, Homo sapiens
aacagttcatgtttgc

SEQ ID NO: 1563500 - DNA, 15 bp, Homo sapiens
aacagttctcactgg

SEQ ID NO: 1563501 - DNA, 16 bp, Homo sapiens
aacagttctcactggg

SEQ ID NO: 1563502 - DNA, 14 bp, Homo sapiens
aacagttgcatgta

SEQ ID NO: 1563503 - DNA, 21 bp, Homo sapiens
aacagttgcatgtagtaacac

SEQ ID NO: 1563504 - DNA, 14 bp, Homo sapiens
aacagttggtaact

SEQ ID NO: 1563505 - DNA, 22 bp, Homo sapiens
aacagttggtaacttttgtgaa

SEQ ID NO: 1563506 - DNA, 14 bp, Homo sapiens
aacagttgtatgtt

SEQ ID NO: 1563507 - DNA, 17 bp, Homo sapiens
aacagtttcttgcttgg

SEQ ID NO: 1563508 - DNA, 16 bp, Homo sapiens
aacagtttggaaaagt

SEQ ID NO: 1563509 - DNA, 21 bp, Homo sapiens
aacagttttttatgctaatca

SEQ ID NO: 1563510 - DNA, 13 bp, Homo sapiens
aacataaaaagca

SEQ ID NO: 1563511 - DNA, 12 bp, Homo sapiens
aacataaaacaa

SEQ ID NO: 1563512 - DNA, 14 bp, Homo sapiens
aacataaagcaaat

SEQ ID NO: 1563513 - DNA, 13 bp, Homo sapiens
aacataacataaa

SEQ ID NO: 1563514 - DNA, 17 bp, Homo sapiens
aacataattcttgtata

SEQ ID NO: 1563515 - DNA, 19 bp, Homo sapiens
aacataattgtggattata

SEQ ID NO: 1563516 - DNA, 16 bp, Homo sapiens
aacatacataatacaa

SEQ ID NO: 1563517 - DNA, 23 bp, Homo sapiens
aacatacatctaagtcagtttca

SEQ ID NO: 1563518 - DNA, 13 bp, Homo sapiens
aacatagaaaaat

SEQ ID NO: 1563519 - DNA, 18 bp, Homo sapiens
aacatagtttaagttgat

SEQ ID NO: 1563520 - DNA, 19 bp, Homo sapiens
aacatagtttaagttgatt

SEQ ID NO: 1563521 - DNA, 21 bp, Homo sapiens
aacatataatgttgttattta

SEQ ID NO: 1563522 - DNA, 15 bp, Homo sapiens
aacatattcatgaaa

SEQ ID NO: 1563523 - DNA, 19 bp, Homo sapiens
aacatattcatgaaatgtg

SEQ ID NO: 1563524 - DNA, 21 bp, Homo sapiens
aacatattcttgctttcacaa

SEQ ID NO: 1563525 - DNA, 13 bp, Homo sapiens
aacatatttttat

SEQ ID NO: 1563526 - DNA, 14 bp, Homo sapiens
aacatcaacatctt

SEQ ID NO: 1563527 - DNA, 13 bp, Homo sapiens
aacatcacacaca

SEQ ID NO: 1563528 - DNA, 16 bp, Homo sapiens
aacatcagctgaattc

SEQ ID NO: 1563529 - DNA, 17 bp, Homo sapiens
aacatcagctgaattca

SEQ ID NO: 1563530 - DNA, 18 bp, Homo sapiens
aacatcagttactctgaa

SEQ ID NO: 1563531 - DNA, 21 bp, Homo sapiens
aacatcagttactctgaaggg

SEQ ID NO: 1563532 - DNA, 17 bp, Homo sapiens
aacatcataattacatt

SEQ ID NO: 1563533 - DNA, 14 bp, Homo sapiens
aacatcattagaac

SEQ ID NO: 1563534 - DNA, 14 bp, Homo sapiens
aacatcattccaaa

SEQ ID NO: 1563535 - DNA, 21 bp, Homo sapiens
aacatccaaaaaaagggaagg

SEQ ID NO: 1563536 - DNA, 13 bp, Homo sapiens
aacatccaagcca

SEQ ID NO: 1563537 - DNA, 15 bp, Homo sapiens
aacatccaagccaga

SEQ ID NO: 1563538 - DNA, 16 bp, Homo sapiens
aacatccaagccagag

SEQ ID NO: 1563539 - DNA, 19 bp, Homo sapiens
aacatccaaggagaaacag

SEQ ID NO: 1563540 - DNA, 22 bp, Homo sapiens
aacatccaaggagaaacagaga

SEQ ID NO: 1563541 - DNA, 16 bp, Homo sapiens
aacatcccattgccct

SEQ ID NO: 1563542 - DNA, 17 bp, Homo sapiens
aacatctagcaaatgtt

SEQ ID NO: 1563543 - DNA, 14 bp, Homo sapiens
aacatctattctct

SEQ ID NO: 1563544 - DNA, 14 bp, Homo sapiens
aacatctcgagccc

SEQ ID NO: 1563545 - DNA, 21 bp, Homo sapiens
aacatctcgagccccctggat

SEQ ID NO: 1563546 - DNA, 15 bp, Homo sapiens
aacatctcttgaaac

SEQ ID NO: 1563547 - DNA, 13 bp, Homo sapiens
aacatctgaaaag

SEQ ID NO: 1563548 - DNA, 12 bp, Homo sapiens
aacatctttaag

SEQ ID NO: 1563549 - DNA, 18 bp, Homo sapiens
aacatctttattgaaatt

SEQ ID NO: 1563550 - DNA, 16 bp, Homo sapiens
aacatgaaactgccta

SEQ ID NO: 1563551 - DNA, 13 bp, Homo sapiens
aacatgacactga

SEQ ID NO: 1563552 - DNA, 16 bp, Homo sapiens
aacatgacccagcctg

SEQ ID NO: 1563553 - DNA, 15 bp, Homo sapiens
aacatgaggacagaa

SEQ ID NO: 1563554 - DNA, 18 bp, Homo sapiens
aacatgaggacagaagga

SEQ ID NO: 1563555 - DNA, 21 bp, Homo sapiens
aacatgaggacagaaggactg

SEQ ID NO: 1563556 - DNA, 16 bp, Homo sapiens
aacatgcactgatgtt

SEQ ID NO: 1563557 - DNA, 16 bp, Homo sapiens
aacatgcttgatgttt

SEQ ID NO: 1563558 - DNA, 15 bp, Homo sapiens
aacatggacttgtat

SEQ ID NO: 1563559 - DNA, 16 bp, Homo sapiens
aacatggacttgtata

SEQ ID NO: 1563560 - DNA, 17 bp, Homo sapiens
aacatggcttaatctta

SEQ ID NO: 1563561 - DNA, 21 bp, Homo sapiens
aacatgggagcttattgctaa

SEQ ID NO: 1563562 - DNA, 22 bp, Homo sapiens
aacatggtaattcacttcagtt

SEQ ID NO: 1563563 - DNA, 20 bp, Homo sapiens
aacatggttttgaaatgctt

SEQ ID NO: 1563564 - DNA, 19 bp, Homo sapiens
aacatgtaatataaagatg

SEQ ID NO: 1563565 - DNA, 14 bp, Homo sapiens
aacatgtaattaag

SEQ ID NO: 1563566 - DNA, 21 bp, Homo sapiens
aacatgtaattaagtactatg

SEQ ID NO: 1563567 - DNA, 19 bp, Homo sapiens
aacatgtactacagctata

SEQ ID NO: 1563568 - DNA, 13 bp, Homo sapiens
aacatgtctccta

SEQ ID NO: 1563569 - DNA, 12 bp, Homo sapiens
aacatgttaaga

SEQ ID NO: 1563570 - DNA, 13 bp, Homo sapiens
aacatgttcctga

SEQ ID NO: 1563571 - DNA, 21 bp, Homo sapiens
aacatgtttaaatagcctaaa

SEQ ID NO: 1563572 - DNA, 22 bp, Homo sapiens
aacatgtttaaatagcctaaat

SEQ ID NO: 1563573 - DNA, 11 bp, Homo sapiens
aacattaaaca

SEQ ID NO: 1563574 - DNA, 13 bp, Homo sapiens
aacattaaacact

SEQ ID NO: 1563575 - DNA, 21 bp, Homo sapiens
aacattaattttgtgcattct

SEQ ID NO: 1563576 - DNA, 22 bp, Homo sapiens
aacattaattttgtgcattctt

SEQ ID NO: 1563577 - DNA, 14 bp, Homo sapiens
aacattatgatcta

SEQ ID NO: 1563578 - DNA, 17 bp, Homo sapiens
aacattatgatctaata

SEQ ID NO: 1563579 - DNA, 12 bp, Homo sapiens
aacattatttat

SEQ ID NO: 1563580 - DNA, 14 bp, Homo sapiens
aacattcagctctg

SEQ ID NO: 1563581 - DNA, 17 bp, Homo sapiens
aacattcagctctggag

SEQ ID NO: 1563582 - DNA, 19 bp, Homo sapiens
aacattcagctctggagaa

SEQ ID NO: 1563583 - DNA, 11 bp, Homo sapiens
aacattccaag

SEQ ID NO: 1563584 - DNA, 12 bp, Homo sapiens
aacattcccact

SEQ ID NO: 1563585 - DNA, 14 bp, Homo sapiens
aacattcccagccc

SEQ ID NO: 1563586 - DNA, 17 bp, Homo sapiens
aacattcccagcccagc

SEQ ID NO: 1563587 - DNA, 22 bp, Homo sapiens
aacattcctcatgaatgtaaat

SEQ ID NO: 1563588 - DNA, 19 bp, Homo sapiens
aacattcgtgagctgggga

SEQ ID NO: 1563589 - DNA, 19 bp, Homo sapiens
aacattgaagtaatgaatt

SEQ ID NO: 1563590 - DNA, 18 bp, Homo sapiens
aacattgaccaagaactg

SEQ ID NO: 1563591 - DNA, 20 bp, Homo sapiens
aacattgaccaagaactgca

SEQ ID NO: 1563592 - DNA, 23 bp, Homo sapiens
aacattgaccaagaactgcatgg

SEQ ID NO: 1563593 - DNA, 19 bp, Homo sapiens
aacattggagctgactgtt

SEQ ID NO: 1563594 - DNA, 18 bp, Homo sapiens
aacattgtactgttgctt

SEQ ID NO: 1563595 - DNA, 23 bp, Homo sapiens
aacattgtgttcccatttcagct

SEQ ID NO: 1563596 - DNA, 21 bp, Homo sapiens
aacatttaatattatatagga

SEQ ID NO: 1563597 - DNA, 20 bp, Homo sapiens
aacatttacaataaatattc

SEQ ID NO: 1563598 - DNA, 22 bp, Homo sapiens
aacatttacaataaatattctg

SEQ ID NO: 1563599 - DNA, 14 bp, Homo sapiens
aacatttattttga

SEQ ID NO: 1563600 - DNA, 12 bp, Homo sapiens
aacatttctctc

SEQ ID NO: 1563601 - DNA, 13 bp, Homo sapiens
aacatttctgttc

SEQ ID NO: 1563602 - DNA, 21 bp, Homo sapiens
aacatttgatatttttccatt

SEQ ID NO: 1563603 - DNA, 22 bp, Homo sapiens
aacatttgccaagtgagttgaa

SEQ ID NO: 1563604 - DNA, 16 bp, Homo sapiens
aacatttgctgtttta

SEQ ID NO: 1563605 - DNA, 18 bp, Homo sapiens
aacattttctcttagaaa

SEQ ID NO: 1563606 - DNA, 19 bp, Homo sapiens
aacattttctcttagaaaa

SEQ ID NO: 1563607 - DNA, 15 bp, Homo sapiens
aacattttgaaggaa

SEQ ID NO: 1563608 - DNA, 21 bp, Homo sapiens
aacattttttaagaaaacatt

SEQ ID NO: 1563609 - DNA, 20 bp, Homo sapiens
aacatttttttttctccata

SEQ ID NO: 1563610 - DNA, 17 bp, Homo sapiens
aaccaaaaatagaaatt

SEQ ID NO: 1563611 - DNA, 11 bp, Homo sapiens
aaccaaaacag

SEQ ID NO: 1563612 - DNA, 15 bp, Homo sapiens
aaccaaaacttccaa

SEQ ID NO: 1563613 - DNA, 21 bp, Homo sapiens
aaccaaaagaacaagaatttc

SEQ ID NO: 1563614 - DNA, 21 bp, Homo sapiens
aaccaaagagaatcccacatt

SEQ ID NO: 1563615 - DNA, 19 bp, Homo sapiens
aaccaaagagggcttcctc

SEQ ID NO: 1563616 - DNA, 14 bp, Homo sapiens
aaccaacaataaat

SEQ ID NO: 1563617 - DNA, 17 bp, Homo sapiens
aaccaactatttttgag

SEQ ID NO: 1563618 - DNA, 18 bp, Homo sapiens
aaccaagccgtggcttcc

SEQ ID NO: 1563619 - DNA, 15 bp, Homo sapiens
aaccaagctctctgc

SEQ ID NO: 1563620 - DNA, 19 bp, Homo sapiens
aaccaagctgagtttccta

SEQ ID NO: 1563621 - DNA, 15 bp, Homo sapiens
aaccaagcttcagag

SEQ ID NO: 1563622 - DNA, 20 bp, Homo sapiens
aaccaagcttcagagcctag

SEQ ID NO: 1563623 - DNA, 13 bp, Homo sapiens
aaccaaggcagcc

SEQ ID NO: 1563624 - DNA, 20 bp, Homo sapiens
aaccaagtcatgtgcatttc

SEQ ID NO: 1563625 - DNA, 20 bp, Homo sapiens
aaccaagtgatcaaactaca

SEQ ID NO: 1563626 - DNA, 23 bp, Homo sapiens
aaccaatcccgtgaaagaattat

SEQ ID NO: 1563627 - DNA, 22 bp, Homo sapiens
aaccaatgcctttttagatgta

SEQ ID NO: 1563628 - DNA, 18 bp, Homo sapiens
aaccaattgaaaagtgtt

SEQ ID NO: 1563629 - DNA, 15 bp, Homo sapiens
aaccacacaaagaca

SEQ ID NO: 1563630 - DNA, 20 bp, Homo sapiens
aaccacagtcagtggagcct

SEQ ID NO: 1563631 - DNA, 21 bp, Homo sapiens
aaccaccccggccccctgccc

SEQ ID NO: 1563632 - DNA, 16 bp, Homo sapiens
aaccacctatttttga

SEQ ID NO: 1563633 - DNA, 19 bp, Homo sapiens
aaccactcaaattaatctt

SEQ ID NO: 1563634 - DNA, 15 bp, Homo sapiens
aaccactgaaaaaat

SEQ ID NO: 1563635 - DNA, 16 bp, Homo sapiens
aaccactgcttctctt

SEQ ID NO: 1563636 - DNA, 15 bp, Homo sapiens
aaccactgtaaaatg

SEQ ID NO: 1563637 - DNA, 16 bp, Homo sapiens
aaccactgtaaaatga

SEQ ID NO: 1563638 - DNA, 20 bp, Homo sapiens
aaccactgtaaaatgaaatt

SEQ ID NO: 1563639 - DNA, 17 bp, Homo sapiens
aaccactgtctagagca

SEQ ID NO: 1563640 - DNA, 18 bp, Homo sapiens
aaccactgtgccactgac

SEQ ID NO: 1563641 - DNA, 23 bp, Homo sapiens
aaccactgtggcgttctgctgcc

SEQ ID NO: 1563642 - DNA, 19 bp, Homo sapiens
aaccacttaaaaaatgtcc

SEQ ID NO: 1563643 - DNA, 22 bp, Homo sapiens
aaccagaaaagcaatactgttt

SEQ ID NO: 1563644 - DNA, 18 bp, Homo sapiens
aaccagaataaagttctg

SEQ ID NO: 1563645 - DNA, 12 bp, Homo sapiens
aaccagacctgg

SEQ ID NO: 1563646 - DNA, 23 bp, Homo sapiens
aaccagagggcatgctgaatgcc

SEQ ID NO: 1563647 - DNA, 13 bp, Homo sapiens
aaccagattccag

SEQ ID NO: 1563648 - DNA, 15 bp, Homo sapiens
aaccagcattcccta

SEQ ID NO: 1563649 - DNA, 12 bp, Homo sapiens
aaccagccacag

SEQ ID NO: 1563650 - DNA, 20 bp, Homo sapiens
aaccagctggtctgggtgta

SEQ ID NO: 1563651 - DNA, 15 bp, Homo sapiens
aaccaggaaatggaa

SEQ ID NO: 1563652 - DNA, 18 bp, Homo sapiens
aaccagtccccccaccct

SEQ ID NO: 1563653 - DNA, 14 bp, Homo sapiens
aaccagtgtagcct

SEQ ID NO: 1563654 - DNA, 13 bp, Homo sapiens
aaccagttaaagc

SEQ ID NO: 1563655 - DNA, 16 bp, Homo sapiens
aaccagttaaagccac

SEQ ID NO: 1563656 - DNA, 14 bp, Homo sapiens
aaccataaaagaag

SEQ ID NO: 1563657 - DNA, 21 bp, Homo sapiens
aaccataccttccttccctgg

SEQ ID NO: 1563658 - DNA, 22 bp, Homo sapiens
aaccataggctgctctgcctgt

SEQ ID NO: 1563659 - DNA, 15 bp, Homo sapiens
aaccatagttactgt

SEQ ID NO: 1563660 - DNA, 18 bp, Homo sapiens
aaccatagttactgtaaa

SEQ ID NO: 1563661 - DNA, 20 bp, Homo sapiens
aaccatagttactgtaaaat

SEQ ID NO: 1563662 - DNA, 23 bp, Homo sapiens
aaccatagttactgtaaaatgca

SEQ ID NO: 1563663 - DNA, 14 bp, Homo sapiens
aaccatatgatact

SEQ ID NO: 1563664 - DNA, 19 bp, Homo sapiens
aaccatatgattgaaaaga

SEQ ID NO: 1563665 - DNA, 21 bp, Homo sapiens
aaccatatgattgaaaagaag

SEQ ID NO: 1563666 - DNA, 22 bp, Homo sapiens
aaccatccagtgacaaaccatc

SEQ ID NO: 1563667 - DNA, 16 bp, Homo sapiens
aaccatccccaactcc

SEQ ID NO: 1563668 - DNA, 22 bp, Homo sapiens
aaccatccctgatgtctgtctg

SEQ ID NO: 1563669 - DNA, 15 bp, Homo sapiens
aaccatcggtccaca

SEQ ID NO: 1563670 - DNA, 20 bp, Homo sapiens
aaccatgcctggtattttca

SEQ ID NO: 1563671 - DNA, 17 bp, Homo sapiens
aaccatgtcatttcaga

SEQ ID NO: 1563672 - DNA, 12 bp, Homo sapiens
aaccattcaaat

SEQ ID NO: 1563673 - DNA, 23 bp, Homo sapiens
aaccattccatttccaagcactt

SEQ ID NO: 1563674 - DNA, 15 bp, Homo sapiens
aaccattcgaagtca

SEQ ID NO: 1563675 - DNA, 16 bp, Homo sapiens
aaccattcgacctata

SEQ ID NO: 1563676 - DNA, 12 bp, Homo sapiens
aaccatttatct

SEQ ID NO: 1563677 - DNA, 19 bp, Homo sapiens
aaccatttatcttgaagga

SEQ ID NO: 1563678 - DNA, 12 bp, Homo sapiens
aaccatttccaa

SEQ ID NO: 1563679 - DNA, 13 bp, Homo sapiens
aaccatttccaac

SEQ ID NO: 1563680 - DNA, 22 bp, Homo sapiens
aaccatttgggatggagaagca

SEQ ID NO: 1563681 - DNA, 19 bp, Homo sapiens
aacccaaatcttgtttaca

SEQ ID NO: 1563682 - DNA, 22 bp, Homo sapiens
aacccaaggtgggtagatcacg

SEQ ID NO: 1563683 - DNA, 18 bp, Homo sapiens
aacccaagtccaagcata

SEQ ID NO: 1563684 - DNA, 14 bp, Homo sapiens
aacccacagctcag

SEQ ID NO: 1563685 - DNA, 21 bp, Homo sapiens
aacccacataaaagccccagc

SEQ ID NO: 1563686 - DNA, 23 bp, Homo sapiens
aacccaccagcctaagaagctct

SEQ ID NO: 1563687 - DNA, 15 bp, Homo sapiens
aacccacctctcctg

SEQ ID NO: 1563688 - DNA, 14 bp, Homo sapiens
aacccacctctctg

SEQ ID NO: 1563689 - DNA, 17 bp, Homo sapiens
aacccactccggttccc

SEQ ID NO: 1563690 - DNA, 16 bp, Homo sapiens
aacccagactcagaca

SEQ ID NO: 1563691 - DNA, 17 bp, Homo sapiens
aacccagcaacagaaaa

SEQ ID NO: 1563692 - DNA, 11 bp, Homo sapiens
aacccaggagg

SEQ ID NO: 1563693 - DNA, 12 bp, Homo sapiens
aacccaggaggt

SEQ ID NO: 1563694 - DNA, 23 bp, Homo sapiens
aacccagttaacttactctttaa

SEQ ID NO: 1563695 - DNA, 23 bp, Homo sapiens
aacccatacaatgtatgtacaat

SEQ ID NO: 1563696 - DNA, 21 bp, Homo sapiens
aacccatattgtaaaacaggt

SEQ ID NO: 1563697 - DNA, 23 bp, Homo sapiens
aacccattaaggggaagaatgaa

SEQ ID NO: 1563698 - DNA, 20 bp, Homo sapiens
aaccccagggcccccacagg

SEQ ID NO: 1563699 - DNA, 10 bp, Homo sapiens
aacccccacc

SEQ ID NO: 1563700 - DNA, 12 bp, Homo sapiens
aacccccacccc

SEQ ID NO: 1563701 - DNA, 15 bp, Homo sapiens
aacccccaggtggcc

SEQ ID NO: 1563702 - DNA, 13 bp, Homo sapiens
aacccccctcctg

SEQ ID NO: 1563703 - DNA, 14 bp, Homo sapiens
aacccccctcctgc

SEQ ID NO: 1563704 - DNA, 18 bp, Homo sapiens
aacccccctcctgctcct

SEQ ID NO: 1563705 - DNA, 22 bp, Homo sapiens
aacccccctcctgctcctccct

SEQ ID NO: 1563706 - DNA, 15 bp, Homo sapiens
aaccccctccctgtc

SEQ ID NO: 1563707 - DNA, 18 bp, Homo sapiens
aaccccgcggtgctctgg

SEQ ID NO: 1563708 - DNA, 21 bp, Homo sapiens
aaccccgcggtgctctggcgg

SEQ ID NO: 1563709 - DNA, 20 bp, Homo sapiens
aacccctgacctaccccagc

SEQ ID NO: 1563710 - DNA, 21 bp, Homo sapiens
aacccctgtacccagctcctt

SEQ ID NO: 1563711 - DNA, 22 bp, Homo sapiens
aacccgaggctgagaatcagac

SEQ ID NO: 1563712 - DNA, 14 bp, Homo sapiens
aacccgggaggcag

SEQ ID NO: 1563713 - DNA, 23 bp, Homo sapiens
aaccctaaataataaaaataaac

SEQ ID NO: 1563714 - DNA, 13 bp, Homo sapiens
aaccctagccttg

SEQ ID NO: 1563715 - DNA, 16 bp, Homo sapiens
aaccctagccttgctt

SEQ ID NO: 1563716 - DNA, 18 bp, Homo sapiens
aaccctagccttgcttgt

SEQ ID NO: 1563717 - DNA, 17 bp, Homo sapiens
aaccctaggaatttaga

SEQ ID NO: 1563718 - DNA, 19 bp, Homo sapiens
aaccctatcctaattgtcc

SEQ ID NO: 1563719 - DNA, 20 bp, Homo sapiens
aaccctcccagaaacatctc

SEQ ID NO: 1563720 - DNA, 20 bp, Homo sapiens
aaccctcctgggaaggccac

SEQ ID NO: 1563721 - DNA, 22 bp, Homo sapiens
aaccctcctgggaaggccacct

SEQ ID NO: 1563722 - DNA, 19 bp, Homo sapiens
aaccctgccctgccccacc

SEQ ID NO: 1563723 - DNA, 19 bp, Homo sapiens
aaccctggagccatccctt

SEQ ID NO: 1563724 - DNA, 14 bp, Homo sapiens
aaccctgtgctgtc

SEQ ID NO: 1563725 - DNA, 17 bp, Homo sapiens
aaccctgtgctgtcaga

SEQ ID NO: 1563726 - DNA, 20 bp, Homo sapiens
aaccctgttttatactgtac

SEQ ID NO: 1563727 - DNA, 22 bp, Homo sapiens
aaccctgttttatactgtactt

SEQ ID NO: 1563728 - DNA, 23 bp, Homo sapiens
aacccttaccccttagcctccct

SEQ ID NO: 1563729 - DNA, 14 bp, Homo sapiens
aacccttattccat

SEQ ID NO: 1563730 - DNA, 21 bp, Homo sapiens
aacccttcagtgctacatttt

SEQ ID NO: 1563731 - DNA, 16 bp, Homo sapiens
aacccttcatcttcct

SEQ ID NO: 1563732 - DNA, 13 bp, Homo sapiens
aacccttgctgct

SEQ ID NO: 1563733 - DNA, 16 bp, Homo sapiens
aacccttgctgcttta

SEQ ID NO: 1563734 - DNA, 20 bp, Homo sapiens
aacccttgctttcctgggcc

SEQ ID NO: 1563735 - DNA, 14 bp, Homo sapiens
aacccttgggccag

SEQ ID NO: 1563736 - DNA, 15 bp, Homo sapiens
aaccgagcaaagatc

SEQ ID NO: 1563737 - DNA, 17 bp, Homo sapiens
aaccgagcaaagatcaa

SEQ ID NO: 1563738 - DNA, 12 bp, Homo sapiens
aaccgcacagct

SEQ ID NO: 1563739 - DNA, 13 bp, Homo sapiens
aaccgcacagctc

SEQ ID NO: 1563740 - DNA, 16 bp, Homo sapiens
aaccgcatgtgatctc

SEQ ID NO: 1563741 - DNA, 16 bp, Homo sapiens
aaccggaaggaggcca

SEQ ID NO: 1563742 - DNA, 16 bp, Homo sapiens
aaccgtctgttatgct

SEQ ID NO: 1563743 - DNA, 23 bp, Homo sapiens
aaccgtggagatcgcttttctca

SEQ ID NO: 1563744 - DNA, 16 bp, Homo sapiens
aaccgtgtccagcaca

SEQ ID NO: 1563745 - DNA, 22 bp, Homo sapiens
aacctaaatttggttctaggcc

SEQ ID NO: 1563746 - DNA, 15 bp, Homo sapiens
aacctaactgcaatg

SEQ ID NO: 1563747 - DNA, 18 bp, Homo sapiens
aacctaattaatatatta

SEQ ID NO: 1563748 - DNA, 16 bp, Homo sapiens
aacctacacacatacc

SEQ ID NO: 1563749 - DNA, 21 bp, Homo sapiens
aacctacacacataccttcat

SEQ ID NO: 1563750 - DNA, 21 bp, Homo sapiens
aacctacacacgtaccttcat

SEQ ID NO: 1563751 - DNA, 23 bp, Homo sapiens
aacctacagactccatctcttct

SEQ ID NO: 1563752 - DNA, 13 bp, Homo sapiens
aacctactgccca

SEQ ID NO: 1563753 - DNA, 16 bp, Homo sapiens
aacctactgtctaagc

SEQ ID NO: 1563754 - DNA, 17 bp, Homo sapiens
aacctagtactgccccc

SEQ ID NO: 1563755 - DNA, 22 bp, Homo sapiens
aacctagttaaagaaaggaaaa

SEQ ID NO: 1563756 - DNA, 22 bp, Homo sapiens
aacctatgatattttctgtgcc

SEQ ID NO: 1563757 - DNA, 18 bp, Homo sapiens
aacctattttcatttgta

SEQ ID NO: 1563758 - DNA, 14 bp, Homo sapiens
aacctcaaatatag

SEQ ID NO: 1563759 - DNA, 16 bp, Homo sapiens
aacctcaaatatagta

SEQ ID NO: 1563760 - DNA, 16 bp, Homo sapiens
aacctcaactgcctac

SEQ ID NO: 1563761 - DNA, 17 bp, Homo sapiens
aacctcaactgcctact

SEQ ID NO: 1563762 - DNA, 22 bp, Homo sapiens
aacctcactgagaggcctggag

SEQ ID NO: 1563763 - DNA, 13 bp, Homo sapiens
aacctcacttccc

SEQ ID NO: 1563764 - DNA, 12 bp, Homo sapiens
aacctcagcctg

SEQ ID NO: 1563765 - DNA, 17 bp, Homo sapiens
aacctcagggctcccag

SEQ ID NO: 1563766 - DNA, 19 bp, Homo sapiens
aacctcagggctcccaggg

SEQ ID NO: 1563767 - DNA, 22 bp, Homo sapiens
aacctcaggtacggagaagaat

SEQ ID NO: 1563768 - DNA, 19 bp, Homo sapiens
aacctcagtgtcatttatg

SEQ ID NO: 1563769 - DNA, 18 bp, Homo sapiens
aacctcatgacagccaga

SEQ ID NO: 1563770 - DNA, 14 bp, Homo sapiens
aacctccagcctcc

SEQ ID NO: 1563771 - DNA, 18 bp, Homo sapiens
aacctccatactcaagct

SEQ ID NO: 1563772 - DNA, 14 bp, Homo sapiens
aacctcccatccca

SEQ ID NO: 1563773 - DNA, 22 bp, Homo sapiens
aacctcccttaagcagcaacag

SEQ ID NO: 1563774 - DNA, 14 bp, Homo sapiens
aacctcctgctctg

SEQ ID NO: 1563775 - DNA, 17 bp, Homo sapiens
aacctcctgctctggga

SEQ ID NO: 1563776 - DNA, 23 bp, Homo sapiens
aacctctactaaaaagaaggaaa

SEQ ID NO: 1563777 - DNA, 14 bp, Homo sapiens
aacctctcctgacc

SEQ ID NO: 1563778 - DNA, 15 bp, Homo sapiens
aacctctcctgaccc

SEQ ID NO: 1563779 - DNA, 19 bp, Homo sapiens
aacctctcgccatgatcag

SEQ ID NO: 1563780 - DNA, 15 bp, Homo sapiens
aacctctctgatctt

SEQ ID NO: 1563781 - DNA, 18 bp, Homo sapiens
aacctcttttctgcatca

SEQ ID NO: 1563782 - DNA, 20 bp, Homo sapiens
aacctgacagatgtcagccg

SEQ ID NO: 1563783 - DNA, 19 bp, Homo sapiens
aacctgacccctgctcagt

SEQ ID NO: 1563784 - DNA, 20 bp, Homo sapiens
aacctgagtcgtacagaaag

SEQ ID NO: 1563785 - DNA, 22 bp, Homo sapiens
aacctgcccaaagattgatttg

SEQ ID NO: 1563786 - DNA, 21 bp, Homo sapiens
aacctgcctaaattaaattgg

SEQ ID NO: 1563787 - DNA, 22 bp, Homo sapiens
aacctgctttcaagacccctgt

SEQ ID NO: 1563788 - DNA, 16 bp, Homo sapiens
aacctggaaatgatgt

SEQ ID NO: 1563789 - DNA, 19 bp, Homo sapiens
aacctggacttcctgtcat

SEQ ID NO: 1563790 - DNA, 17 bp, Homo sapiens
aacctggagatgcagct

SEQ ID NO: 1563791 - DNA, 17 bp, Homo sapiens
aacctgggattcaggaa

SEQ ID NO: 1563792 - DNA, 15 bp, Homo sapiens
aacctggttcatatt

SEQ ID NO: 1563793 - DNA, 16 bp, Homo sapiens
aacctgtattactgaa

SEQ ID NO: 1563794 - DNA, 17 bp, Homo sapiens
aacctgttacactgggc

SEQ ID NO: 1563795 - DNA, 18 bp, Homo sapiens
aacctgttacactgggct

SEQ ID NO: 1563796 - DNA, 21 bp, Homo sapiens
aacctgttgatagcaagtgaa

SEQ ID NO: 1563797 - DNA, 12 bp, Homo sapiens
aaccttaagtaa

SEQ ID NO: 1563798 - DNA, 12 bp, Homo sapiens
aaccttccttcc

SEQ ID NO: 1563799 - DNA, 13 bp, Homo sapiens
aaccttccttccc

SEQ ID NO: 1563800 - DNA, 15 bp, Homo sapiens
aaccttgaatgctgc

SEQ ID NO: 1563801 - DNA, 17 bp, Homo sapiens
aaccttgaatgctgcca

SEQ ID NO: 1563802 - DNA, 20 bp, Homo sapiens
aaccttgaatgctgccagtg

SEQ ID NO: 1563803 - DNA, 14 bp, Homo sapiens
aaccttgcaacggt

SEQ ID NO: 1563804 - DNA, 15 bp, Homo sapiens
aaccttgctctcctc

SEQ ID NO: 1563805 - DNA, 21 bp, Homo sapiens
aaccttgctctcctcatctcc

SEQ ID NO: 1563806 - DNA, 20 bp, Homo sapiens
aaccttggaccactcctgtc

SEQ ID NO: 1563807 - DNA, 15 bp, Homo sapiens
aaccttgtaaaaaaa

SEQ ID NO: 1563808 - DNA, 19 bp, Homo sapiens
aaccttgtctctatgccag

SEQ ID NO: 1563809 - DNA, 19 bp, Homo sapiens
aaccttgttctctgcttga

SEQ ID NO: 1563810 - DNA, 14 bp, Homo sapiens
aacctttagggcag

SEQ ID NO: 1563811 - DNA, 19 bp, Homo sapiens
aacctttagggcagcttgc

SEQ ID NO: 1563812 - DNA, 21 bp, Homo sapiens
aacctttgagtagatccattt

SEQ ID NO: 1563813 - DNA, 17 bp, Homo sapiens
aacctttttcttgatct

SEQ ID NO: 1563814 - DNA, 13 bp, Homo sapiens
aacgaagaaaaaa

SEQ ID NO: 1563815 - DNA, 23 bp, Homo sapiens
aacgaaggggccccggggctggc

SEQ ID NO: 1563816 - DNA, 14 bp, Homo sapiens
aacgacaatagctt

SEQ ID NO: 1563817 - DNA, 12 bp, Homo sapiens
aacgagacacat

SEQ ID NO: 1563818 - DNA, 15 bp, Homo sapiens
aacgagacacattgc

SEQ ID NO: 1563819 - DNA, 14 bp, Homo sapiens
aacgagcactggcc

SEQ ID NO: 1563820 - DNA, 18 bp, Homo sapiens
aacgagcactggccagag

SEQ ID NO: 1563821 - DNA, 19 bp, Homo sapiens
aacgagcactggccagaga

SEQ ID NO: 1563822 - DNA, 17 bp, Homo sapiens
aacgagcagcccagggc

SEQ ID NO: 1563823 - DNA, 22 bp, Homo sapiens
aacgatgatgcttgtaacaaga

SEQ ID NO: 1563824 - DNA, 14 bp, Homo sapiens
aacgcagaagaaag

SEQ ID NO: 1563825 - DNA, 16 bp, Homo sapiens
aacgcagccctgcttt

SEQ ID NO: 1563826 - DNA, 11 bp, Homo sapiens
aacgcccctcc

SEQ ID NO: 1563827 - DNA, 15 bp, Homo sapiens
aacgcccctccaaac

SEQ ID NO: 1563828 - DNA, 13 bp, Homo sapiens
aacgcccctgtgg

SEQ ID NO: 1563829 - DNA, 17 bp, Homo sapiens
aacgcctcccctgcccc

SEQ ID NO: 1563830 - DNA, 20 bp, Homo sapiens
aacgctctaggtacgatgac

SEQ ID NO: 1563831 - DNA, 19 bp, Homo sapiens
aacggaggcctgcgaccct

SEQ ID NO: 1563832 - DNA, 14 bp, Homo sapiens
aacggcaacagcat

SEQ ID NO: 1563833 - DNA, 19 bp, Homo sapiens
aacggccctgcagccagct

SEQ ID NO: 1563834 - DNA, 14 bp, Homo sapiens
aacggctccaggat

SEQ ID NO: 1563835 - DNA, 19 bp, Homo sapiens
aacgggaacatgccccctg

SEQ ID NO: 1563836 - DNA, 13 bp, Homo sapiens
aacgggctccttc

SEQ ID NO: 1563837 - DNA, 14 bp, Homo sapiens
aacggtgctaaaaa

SEQ ID NO: 1563838 - DNA, 17 bp, Homo sapiens
aacgtaaccacggaaaa

SEQ ID NO: 1563839 - DNA, 13 bp, Homo sapiens
aacgtcatctcag

SEQ ID NO: 1563840 - DNA, 15 bp, Homo sapiens
aacgtcatctcaggg

SEQ ID NO: 1563841 - DNA, 19 bp, Homo sapiens
aacgtcctctttagttttt

SEQ ID NO: 1563842 - DNA, 16 bp, Homo sapiens
aacgtctattttgtat

SEQ ID NO: 1563843 - DNA, 16 bp, Homo sapiens
aacgtgagagaaagag

SEQ ID NO: 1563844 - DNA, 17 bp, Homo sapiens
aacgtgcagactatgca

SEQ ID NO: 1563845 - DNA, 21 bp, Homo sapiens
aacgtgcgtgtctctgccatg

SEQ ID NO: 1563846 - DNA, 12 bp, Homo sapiens
aacgtgcttctt

SEQ ID NO: 1563847 - DNA, 18 bp, Homo sapiens
aacgtgcttctttgtaat

SEQ ID NO: 1563848 - DNA, 20 bp, Homo sapiens
aacgtgcttctttgtaatga

SEQ ID NO: 1563849 - DNA, 15 bp, Homo sapiens
aacgtggacctgcct

SEQ ID NO: 1563850 - DNA, 13 bp, Homo sapiens
aacgtggcccaga

SEQ ID NO: 1563851 - DNA, 23 bp, Homo sapiens
aacgtggtttgcctgaggctgta

SEQ ID NO: 1563852 - DNA, 23 bp, Homo sapiens
aacgtgtcagaatcctttacatt

SEQ ID NO: 1563853 - DNA, 17 bp, Homo sapiens
aacgtgttcaatatttt

SEQ ID NO: 1563854 - DNA, 18 bp, Homo sapiens
aacgttttcttctttccc

SEQ ID NO: 1563855 - DNA, 20 bp, Homo sapiens
aacgttttgaactaataaaa

SEQ ID NO: 1563856 - DNA, 19 bp, Homo sapiens
aactaaaaaaaaaaaggcc

SEQ ID NO: 1563857 - DNA, 22 bp, Homo sapiens
aactaaaatctgttaccattct

SEQ ID NO: 1563858 - DNA, 16 bp, Homo sapiens
aactaaaattcaacaa

SEQ ID NO: 1563859 - DNA, 15 bp, Homo sapiens
aactaaactcattta

SEQ ID NO: 1563860 - DNA, 16 bp, Homo sapiens
aactaaactcatttat

SEQ ID NO: 1563861 - DNA, 15 bp, Homo sapiens
aactaaagttgtact

SEQ ID NO: 1563862 - DNA, 16 bp, Homo sapiens
aactaaagttgtactt

SEQ ID NO: 1563863 - DNA, 17 bp, Homo sapiens
aactaaagttgtacttt

SEQ ID NO: 1563864 - DNA, 18 bp, Homo sapiens
aactaaataccattcact

SEQ ID NO: 1563865 - DNA, 18 bp, Homo sapiens
aactaaattttaaagcca

SEQ ID NO: 1563866 - DNA, 23 bp, Homo sapiens
aactaagaaatatgcacaatagc

SEQ ID NO: 1563867 - DNA, 19 bp, Homo sapiens
aactaagaggcccagccct

SEQ ID NO: 1563868 - DNA, 15 bp, Homo sapiens
aactaaggatttttc

SEQ ID NO: 1563869 - DNA, 15 bp, Homo sapiens
aactaaggtgaagaa

SEQ ID NO: 1563870 - DNA, 15 bp, Homo sapiens
aactaataaaagcat

SEQ ID NO: 1563871 - DNA, 14 bp, Homo sapiens
aactaataaaataa

SEQ ID NO: 1563872 - DNA, 16 bp, Homo sapiens
aactaataaaataagt

SEQ ID NO: 1563873 - DNA, 19 bp, Homo sapiens
aactaatacgtgccagata

SEQ ID NO: 1563874 - DNA, 14 bp, Homo sapiens
aactaatgtttgaa

SEQ ID NO: 1563875 - DNA, 23 bp, Homo sapiens
aactaatttgaatgtggttactt

SEQ ID NO: 1563876 - DNA, 22 bp, Homo sapiens
aactaatttgtggtaaagtagt

SEQ ID NO: 1563877 - DNA, 19 bp, Homo sapiens
aactacaaacaaaatttct

SEQ ID NO: 1563878 - DNA, 20 bp, Homo sapiens
aactacaaagctttgctaca

SEQ ID NO: 1563879 - DNA, 18 bp, Homo sapiens
aactacaaagtaaaatga

SEQ ID NO: 1563880 - DNA, 15 bp, Homo sapiens
aactacctgagctaa

SEQ ID NO: 1563881 - DNA, 19 bp, Homo sapiens
aactactgaatgaagcagt

SEQ ID NO: 1563882 - DNA, 14 bp, Homo sapiens
aactactgtacttt

SEQ ID NO: 1563883 - DNA, 17 bp, Homo sapiens
aactacttgcatttgat

SEQ ID NO: 1563884 - DNA, 13 bp, Homo sapiens
aactactttataa

SEQ ID NO: 1563885 - DNA, 15 bp, Homo sapiens
aactactttttatac

SEQ ID NO: 1563886 - DNA, 16 bp, Homo sapiens
aactactttttatact

SEQ ID NO: 1563887 - DNA, 21 bp, Homo sapiens
aactagaattagtatgtctgt

SEQ ID NO: 1563888 - DNA, 20 bp, Homo sapiens
aactagagatgactgagtcc

SEQ ID NO: 1563889 - DNA, 22 bp, Homo sapiens
aactagaggtgttacagaggac

SEQ ID NO: 1563890 - DNA, 17 bp, Homo sapiens
aactagatcaaggagcc

SEQ ID NO: 1563891 - DNA, 15 bp, Homo sapiens
aactagatttgtcct

SEQ ID NO: 1563892 - DNA, 17 bp, Homo sapiens
aactagcattacattat

SEQ ID NO: 1563893 - DNA, 14 bp, Homo sapiens
aactagccaaggct

SEQ ID NO: 1563894 - DNA, 20 bp, Homo sapiens
aactagctctatgtttacaa

SEQ ID NO: 1563895 - DNA, 13 bp, Homo sapiens
aactaggctctta

SEQ ID NO: 1563896 - DNA, 17 bp, Homo sapiens
aactagggctagtcttc

SEQ ID NO: 1563897 - DNA, 18 bp, Homo sapiens
aactaggtttttgcttct

SEQ ID NO: 1563898 - DNA, 23 bp, Homo sapiens
aactagtactcaaggtttaacct

SEQ ID NO: 1563899 - DNA, 16 bp, Homo sapiens
aactagtttccagtgg

SEQ ID NO: 1563900 - DNA, 14 bp, Homo sapiens
aactataaacttaa

SEQ ID NO: 1563901 - DNA, 17 bp, Homo sapiens
aactataacaatcactg

SEQ ID NO: 1563902 - DNA, 18 bp, Homo sapiens
aactatatgtgaaacatt

SEQ ID NO: 1563903 - DNA, 11 bp, Homo sapiens
aactatcttgg

SEQ ID NO: 1563904 - DNA, 13 bp, Homo sapiens
aactatcttgtgt

SEQ ID NO: 1563905 - DNA, 17 bp, Homo sapiens
aactatctttttgaaag

SEQ ID NO: 1563906 - DNA, 17 bp, Homo sapiens
aactatgaactacaaag

SEQ ID NO: 1563907 - DNA, 18 bp, Homo sapiens
aactatgatcacagtgac

SEQ ID NO: 1563908 - DNA, 16 bp, Homo sapiens
aactatgattattaac

SEQ ID NO: 1563909 - DNA, 16 bp, Homo sapiens
aactatggttcccaat

SEQ ID NO: 1563910 - DNA, 17 bp, Homo sapiens
aactatggttcccaata

SEQ ID NO: 1563911 - DNA, 20 bp, Homo sapiens
aactatggttcccaataaaa

SEQ ID NO: 1563912 - DNA, 13 bp, Homo sapiens
aactatgtaattt

SEQ ID NO: 1563913 - DNA, 16 bp, Homo sapiens
aactatgttcctaaca

SEQ ID NO: 1563914 - DNA, 17 bp, Homo sapiens
aactatgttcctaacaa

SEQ ID NO: 1563915 - DNA, 20 bp, Homo sapiens
aactatgttcctaacaaaat

SEQ ID NO: 1563916 - DNA, 22 bp, Homo sapiens
aactattaagaggcagaaaatt

SEQ ID NO: 1563917 - DNA, 23 bp, Homo sapiens
aactattagagtatttcccttcc

SEQ ID NO: 1563918 - DNA, 14 bp, Homo sapiens
aactattataaggc

SEQ ID NO: 1563919 - DNA, 21 bp, Homo sapiens
aactatttatatcacacaata

SEQ ID NO: 1563920 - DNA, 16 bp, Homo sapiens
aactatttattaaaaa

SEQ ID NO: 1563921 - DNA, 21 bp, Homo sapiens
aactatttattaaaaacatga

SEQ ID NO: 1563922 - DNA, 13 bp, Homo sapiens
aactatttcacat

SEQ ID NO: 1563923 - DNA, 17 bp, Homo sapiens
aactattttaaataaaa

SEQ ID NO: 1563924 - DNA, 16 bp, Homo sapiens
aactatttttgaggaa

SEQ ID NO: 1563925 - DNA, 15 bp, Homo sapiens
aactcaaaatatttg

SEQ ID NO: 1563926 - DNA, 22 bp, Homo sapiens
aactcaaactgaggaatttcac

SEQ ID NO: 1563927 - DNA, 18 bp, Homo sapiens
aactcaaatggggccaga

SEQ ID NO: 1563928 - DNA, 21 bp, Homo sapiens
aactcaaatggggccagatcc

SEQ ID NO: 1563929 - DNA, 23 bp, Homo sapiens
aactcaaggataccttcttattt

SEQ ID NO: 1563930 - DNA, 15 bp, Homo sapiens
aactcaccatgtaaa

SEQ ID NO: 1563931 - DNA, 23 bp, Homo sapiens
aactcaccctgggagccagtcct

SEQ ID NO: 1563932 - DNA, 17 bp, Homo sapiens
aactcacctaatgttta

SEQ ID NO: 1563933 - DNA, 22 bp, Homo sapiens
aactcactaacagggagaagta

SEQ ID NO: 1563934 - DNA, 21 bp, Homo sapiens
aactcagaaacatcagttact

SEQ ID NO: 1563935 - DNA, 22 bp, Homo sapiens
aactcagatccagggacagagg

SEQ ID NO: 1563936 - DNA, 19 bp, Homo sapiens
aactcagatctgatcaaga

SEQ ID NO: 1563937 - DNA, 14 bp, Homo sapiens
aactcagcagttga

SEQ ID NO: 1563938 - DNA, 10 bp, Homo sapiens
aactcagccg

SEQ ID NO: 1563939 - DNA, 14 bp, Homo sapiens
aactcagtatttta

SEQ ID NO: 1563940 - DNA, 15 bp, Homo sapiens
aactcagttttaact

SEQ ID NO: 1563941 - DNA, 14 bp, Homo sapiens
aactcatcataaaa

SEQ ID NO: 1563942 - DNA, 17 bp, Homo sapiens
aactcatcataaaataa

SEQ ID NO: 1563943 - DNA, 17 bp, Homo sapiens
aactcatctgttatcct

SEQ ID NO: 1563944 - DNA, 23 bp, Homo sapiens
aactcattcctgcctgtctcctt

SEQ ID NO: 1563945 - DNA, 19 bp, Homo sapiens
aactcatttgttaaaatta

SEQ ID NO: 1563946 - DNA, 21 bp, Homo sapiens
aactccaccgaccaactgccc

SEQ ID NO: 1563947 - DNA, 22 bp, Homo sapiens
aactccaccgaccaactgccct

SEQ ID NO: 1563948 - DNA, 15 bp, Homo sapiens
aactccaccttccca

SEQ ID NO: 1563949 - DNA, 17 bp, Homo sapiens
aactccatacagcctct

SEQ ID NO: 1563950 - DNA, 20 bp, Homo sapiens
aactccatcgccatcttctt

SEQ ID NO: 1563951 - DNA, 22 bp, Homo sapiens
aactccatcgccatcttcttcc

SEQ ID NO: 1563952 - DNA, 17 bp, Homo sapiens
aactccatggggttcga

SEQ ID NO: 1563953 - DNA, 22 bp, Homo sapiens
aactcccccattttacagattt

SEQ ID NO: 1563954 - DNA, 11 bp, Homo sapiens
aactccctcca

SEQ ID NO: 1563955 - DNA, 17 bp, Homo sapiens
aactccctccaccagcc

SEQ ID NO: 1563956 - DNA, 20 bp, Homo sapiens
aactccctccaccagcctgc

SEQ ID NO: 1563957 - DNA, 21 bp, Homo sapiens
aactcctgattttgtagttaa

SEQ ID NO: 1563958 - DNA, 11 bp, Homo sapiens
aactcctggcc

SEQ ID NO: 1563959 - DNA, 17 bp, Homo sapiens
aactcctggcctcaagt

SEQ ID NO: 1563960 - DNA, 20 bp, Homo sapiens
aactcctgtcccttttccct

SEQ ID NO: 1563961 - DNA, 21 bp, Homo sapiens
aactcctgtttctccttagtt

SEQ ID NO: 1563962 - DNA, 14 bp, Homo sapiens
aactccttcctggc

SEQ ID NO: 1563963 - DNA, 20 bp, Homo sapiens
aactccttcctggcctgaga

SEQ ID NO: 1563964 - DNA, 24 bp, Homo sapiens
aactccttgttagcccttcagatt

SEQ ID NO: 1563965 - DNA, 17 bp, Homo sapiens
aactcctttcagccaca

SEQ ID NO: 1563966 - DNA, 19 bp, Homo sapiens
aactccttttgctgtcttt

SEQ ID NO: 1563967 - DNA, 20 bp, Homo sapiens
aactccttttgctgtctttc

SEQ ID NO: 1563968 - DNA, 16 bp, Homo sapiens
aactctaaccagtgta

SEQ ID NO: 1563969 - DNA, 14 bp, Homo sapiens
aactctacccctgc

SEQ ID NO: 1563970 - DNA, 17 bp, Homo sapiens
aactctacccctgctcc

SEQ ID NO: 1563971 - DNA, 18 bp, Homo sapiens
aactctacccctgctccc

SEQ ID NO: 1563972 - DNA, 19 bp, Homo sapiens
aactctactcaacccattg

SEQ ID NO: 1563973 - DNA, 18 bp, Homo sapiens
aactctagagagccttaa

SEQ ID NO: 1563974 - DNA, 22 bp, Homo sapiens
aactctcaccatgatgtgaaga

SEQ ID NO: 1563975 - DNA, 12 bp, Homo sapiens
aactctctccac

SEQ ID NO: 1563976 - DNA, 22 bp, Homo sapiens
aactctctccaccctatatgta

SEQ ID NO: 1563977 - DNA, 11 bp, Homo sapiens
aactctgaagg

SEQ ID NO: 1563978 - DNA, 19 bp, Homo sapiens
aactctgaatttatctttg

SEQ ID NO: 1563979 - DNA, 17 bp, Homo sapiens
aactctgacaagggctg

SEQ ID NO: 1563980 - DNA, 19 bp, Homo sapiens
aactctgacaagggctgac

SEQ ID NO: 1563981 - DNA, 23 bp, Homo sapiens
aactctgagagatttggggctaa

SEQ ID NO: 1563982 - DNA, 20 bp, Homo sapiens
aactctgcactccatggcca

SEQ ID NO: 1563983 - DNA, 15 bp, Homo sapiens
aactctgcatgtaga

SEQ ID NO: 1563984 - DNA, 14 bp, Homo sapiens
aactctgccagcca

SEQ ID NO: 1563985 - DNA, 22 bp, Homo sapiens
aactctgcctttatgatgctaa

SEQ ID NO: 1563986 - DNA, 15 bp, Homo sapiens
aactctgtagcttaa

SEQ ID NO: 1563987 - DNA, 17 bp, Homo sapiens
aactctgtgcaggtgct

SEQ ID NO: 1563988 - DNA, 16 bp, Homo sapiens
aactctgtggcattat

SEQ ID NO: 1563989 - DNA, 18 bp, Homo sapiens
aactctgttcccccaccc

SEQ ID NO: 1563990 - DNA, 19 bp, Homo sapiens
aactcttagaagtgttgta

SEQ ID NO: 1563991 - DNA, 21 bp, Homo sapiens
aactcttcaatctcttgcact

SEQ ID NO: 1563992 - DNA, 23 bp, Homo sapiens
aactcttcagttaattcttagat

SEQ ID NO: 1563993 - DNA, 22 bp, Homo sapiens
aactcttttttaaaaattactt

SEQ ID NO: 1563994 - DNA, 20 bp, Homo sapiens
aactgaaacatgcacatttt

SEQ ID NO: 1563995 - DNA, 21 bp, Homo sapiens
aactgaacaccattgaaggct

SEQ ID NO: 1563996 - DNA, 22 bp, Homo sapiens
aactgaacaccattgaaggctt

SEQ ID NO: 1563997 - DNA, 18 bp, Homo sapiens
aactgaagcagcctctcc

SEQ ID NO: 1563998 - DNA, 20 bp, Homo sapiens
aactgaagcagcctctcccc

SEQ ID NO: 1563999 - DNA, 13 bp, Homo sapiens
aactgaaggagaa

SEQ ID NO: 1564000 - DNA, 15 bp, Homo sapiens
aactgaaggagaagg

SEQ ID NO: 1564001 - DNA, 19 bp, Homo sapiens
aactgaaggcaacctggaa

SEQ ID NO: 1564002 - DNA, 19 bp, Homo sapiens
aactgaaggggtgcaccca

SEQ ID NO: 1564003 - DNA, 15 bp, Homo sapiens
aactgaatacctaag

SEQ ID NO: 1564004 - DNA, 18 bp, Homo sapiens
aactgaatagctgtcata

SEQ ID NO: 1564005 - DNA, 11 bp, Homo sapiens
aactgacacag

SEQ ID NO: 1564006 - DNA, 14 bp, Homo sapiens
aactgacacaggaa

SEQ ID NO: 1564007 - DNA, 22 bp, Homo sapiens
aactgacctgaccccattcctg

SEQ ID NO: 1564008 - DNA, 20 bp, Homo sapiens
aactgactattcttgatgta

SEQ ID NO: 1564009 - DNA, 19 bp, Homo sapiens
aactgactgaaggaaaagc

SEQ ID NO: 1564010 - DNA, 18 bp, Homo sapiens
aactgactttttcccccc

SEQ ID NO: 1564011 - DNA, 15 bp, Homo sapiens
aactgagagaaagat

SEQ ID NO: 1564012 - DNA, 13 bp, Homo sapiens
aactgagcctagc

SEQ ID NO: 1564013 - DNA, 18 bp, Homo sapiens
aactgaggaatttcacct

SEQ ID NO: 1564014 - DNA, 16 bp, Homo sapiens
aactgaggaattttct

SEQ ID NO: 1564015 - DNA, 19 bp, Homo sapiens
aactgaggcttagagatag

SEQ ID NO: 1564016 - DNA, 23 bp, Homo sapiens
aactgagtattaatatctgagga

SEQ ID NO: 1564017 - DNA, 21 bp, Homo sapiens
aactgagtcatcttgtgagtg

SEQ ID NO: 1564018 - DNA, 19 bp, Homo sapiens
aactgatcaaaaataaact

SEQ ID NO: 1564019 - DNA, 20 bp, Homo sapiens
aactgatcaaaaataaacta

SEQ ID NO: 1564020 - DNA, 17 bp, Homo sapiens
aactgatcctgctccag

SEQ ID NO: 1564021 - DNA, 15 bp, Homo sapiens
aactgatggaccggg

SEQ ID NO: 1564022 - DNA, 22 bp, Homo sapiens
aactgatggaccgggtgggcct

SEQ ID NO: 1564023 - DNA, 18 bp, Homo sapiens
aactgattagtaagtctt

SEQ ID NO: 1564024 - DNA, 23 bp, Homo sapiens
aactgattctctatgacatgaaa

SEQ ID NO: 1564025 - DNA, 17 bp, Homo sapiens
aactgcaaaaaaagcct

SEQ ID NO: 1564026 - DNA, 14 bp, Homo sapiens
aactgcaaagaaag

SEQ ID NO: 1564027 - DNA, 13 bp, Homo sapiens
aactgcaaagctt

SEQ ID NO: 1564028 - DNA, 18 bp, Homo sapiens
aactgcaaagtgaagttg

SEQ ID NO: 1564029 - DNA, 13 bp, Homo sapiens
aactgcaatagag

SEQ ID NO: 1564030 - DNA, 16 bp, Homo sapiens
aactgcaatagagact

SEQ ID NO: 1564031 - DNA, 22 bp, Homo sapiens
aactgcaatagagactgtagat

SEQ ID NO: 1564032 - DNA, 17 bp, Homo sapiens
aactgcacacacagctc

SEQ ID NO: 1564033 - DNA, 17 bp, Homo sapiens
aactgcacatgaaagtt

SEQ ID NO: 1564034 - DNA, 22 bp, Homo sapiens
aactgcagaccatgaagtaaat

SEQ ID NO: 1564035 - DNA, 16 bp, Homo sapiens
aactgcaggccctggc

SEQ ID NO: 1564036 - DNA, 23 bp, Homo sapiens
aactgcagttcatccgcactgta

SEQ ID NO: 1564037 - DNA, 15 bp, Homo sapiens
aactgcatggaccta

SEQ ID NO: 1564038 - DNA, 14 bp, Homo sapiens
aactgcattagaaa

SEQ ID NO: 1564039 - DNA, 17 bp, Homo sapiens
aactgccagccttggag

SEQ ID NO: 1564040 - DNA, 16 bp, Homo sapiens
aactgccaggctgcct

SEQ ID NO: 1564041 - DNA, 17 bp, Homo sapiens
aactgccaggctgcctc

SEQ ID NO: 1564042 - DNA, 20 bp, Homo sapiens
aactgccaggctgcctcctg

SEQ ID NO: 1564043 - DNA, 14 bp, Homo sapiens
aactgccctaagcc

SEQ ID NO: 1564044 - DNA, 18 bp, Homo sapiens
aactgccctaagccccca

SEQ ID NO: 1564045 - DNA, 19 bp, Homo sapiens
aactgccctaagcccccag

SEQ ID NO: 1564046 - DNA, 12 bp, Homo sapiens
aactgcccttcc

SEQ ID NO: 1564047 - DNA, 19 bp, Homo sapiens
aactgcctggggggcaggg

SEQ ID NO: 1564048 - DNA, 16 bp, Homo sapiens
aactgctcagctctgg

SEQ ID NO: 1564049 - DNA, 13 bp, Homo sapiens
aactgctccaagt

SEQ ID NO: 1564050 - DNA, 15 bp, Homo sapiens
aactgctcttacttt

SEQ ID NO: 1564051 - DNA, 16 bp, Homo sapiens
aactgctgagccactc

SEQ ID NO: 1564052 - DNA, 14 bp, Homo sapiens
aactgctgcatact

SEQ ID NO: 1564053 - DNA, 20 bp, Homo sapiens
aactgctgttttatgtcata

SEQ ID NO: 1564054 - DNA, 23 bp, Homo sapiens
aactgcttcccttactttgctga

SEQ ID NO: 1564055 - DNA, 12 bp, Homo sapiens
aactgctttgca

SEQ ID NO: 1564056 - DNA, 21 bp, Homo sapiens
aactgcttttcctcaagcaat

SEQ ID NO: 1564057 - DNA, 15 bp, Homo sapiens
aactggaaaacagaa

SEQ ID NO: 1564058 - DNA, 16 bp, Homo sapiens
aactggacatgaagga

SEQ ID NO: 1564059 - DNA, 17 bp, Homo sapiens
aactggacatgaaggaa

SEQ ID NO: 1564060 - DNA, 23 bp, Homo sapiens
aactggagttccttatccctctc

SEQ ID NO: 1564061 - DNA, 19 bp, Homo sapiens
aactggcaattgtctattt

SEQ ID NO: 1564062 - DNA, 16 bp, Homo sapiens
aactggcatctgctct

SEQ ID NO: 1564063 - DNA, 16 bp, Homo sapiens
aactggcttgtacatt

SEQ ID NO: 1564064 - DNA, 22 bp, Homo sapiens
aactggggttcaagcccaggct

SEQ ID NO: 1564065 - DNA, 23 bp, Homo sapiens
aactgggttaaatattttgctaa

SEQ ID NO: 1564066 - DNA, 23 bp, Homo sapiens
aactgggttctttggaagcagcc

SEQ ID NO: 1564067 - DNA, 21 bp, Homo sapiens
aactgggtttctcattaaagt

SEQ ID NO: 1564068 - DNA, 22 bp, Homo sapiens
aactggtaagcgatttgaaaca

SEQ ID NO: 1564069 - DNA, 22 bp, Homo sapiens
aactggtattttatctttgatt

SEQ ID NO: 1564070 - DNA, 19 bp, Homo sapiens
aactggtcaccatgaaact

SEQ ID NO: 1564071 - DNA, 20 bp, Homo sapiens
aactgtaaataaaatgtgta

SEQ ID NO: 1564072 - DNA, 20 bp, Homo sapiens
aactgtaattatttgaatga

SEQ ID NO: 1564073 - DNA, 13 bp, Homo sapiens
aactgtactgtgt

SEQ ID NO: 1564074 - DNA, 14 bp, Homo sapiens
aactgtactgtgtt

SEQ ID NO: 1564075 - DNA, 17 bp, Homo sapiens
aactgtactgttttctg

SEQ ID NO: 1564076 - DNA, 18 bp, Homo sapiens
aactgtacttttaaggca

SEQ ID NO: 1564077 - DNA, 14 bp, Homo sapiens
aactgtagaaatga

SEQ ID NO: 1564078 - DNA, 15 bp, Homo sapiens
aactgtagaaatgat

SEQ ID NO: 1564079 - DNA, 20 bp, Homo sapiens
aactgtatttgaaataagaa

SEQ ID NO: 1564080 - DNA, 17 bp, Homo sapiens
aactgtcccacaaaata

SEQ ID NO: 1564081 - DNA, 17 bp, Homo sapiens
aactgtcccagctacca

SEQ ID NO: 1564082 - DNA, 19 bp, Homo sapiens
aactgtccgtaagcagtat

SEQ ID NO: 1564083 - DNA, 11 bp, Homo sapiens
aactgtcctgt

SEQ ID NO: 1564084 - DNA, 13 bp, Homo sapiens
aactgtcctgtcc

SEQ ID NO: 1564085 - DNA, 14 bp, Homo sapiens
aactgtcctttcct

SEQ ID NO: 1564086 - DNA, 20 bp, Homo sapiens
aactgtctgaatattctaga

SEQ ID NO: 1564087 - DNA, 11 bp, Homo sapiens
aactgtcttgt

SEQ ID NO: 1564088 - DNA, 15 bp, Homo sapiens
aactgtcttgtttca

SEQ ID NO: 1564089 - DNA, 19 bp, Homo sapiens
aactgtctttaaaagagag

SEQ ID NO: 1564090 - DNA, 19 bp, Homo sapiens
aactgtgaaataccacaag

SEQ ID NO: 1564091 - DNA, 21 bp, Homo sapiens
aactgtgaatacttgaactct

SEQ ID NO: 1564092 - DNA, 22 bp, Homo sapiens
aactgtgcagagtctagaagtt

SEQ ID NO: 1564093 - DNA, 18 bp, Homo sapiens
aactgtggatattgttac

SEQ ID NO: 1564094 - DNA, 18 bp, Homo sapiens
aactgtggtagctccagc

SEQ ID NO: 1564095 - DNA, 19 bp, Homo sapiens
aactgtggtagctccagcg

SEQ ID NO: 1564096 - DNA, 21 bp, Homo sapiens
aactgtgtacataactgaaaa

SEQ ID NO: 1564097 - DNA, 23 bp, Homo sapiens
aactgtgtacataactgaaaatg

SEQ ID NO: 1564098 - DNA, 23 bp, Homo sapiens
aactgttacaacttgtatttcca

SEQ ID NO: 1564099 - DNA, 16 bp, Homo sapiens
aactgttagaatgtaa

SEQ ID NO: 1564100 - DNA, 21 bp, Homo sapiens
aactgttctctattagacttt

SEQ ID NO: 1564101 - DNA, 14 bp, Homo sapiens
aactgttgattgca

SEQ ID NO: 1564102 - DNA, 18 bp, Homo sapiens
aactgtttccctgctgaa

SEQ ID NO: 1564103 - DNA, 13 bp, Homo sapiens
aactgttttttaa

SEQ ID NO: 1564104 - DNA, 15 bp, Homo sapiens
aactgttttttaagt

SEQ ID NO: 1564105 - DNA, 18 bp, Homo sapiens
aacttaaaaattaatatg

SEQ ID NO: 1564106 - DNA, 11 bp, Homo sapiens
aacttaaaata

SEQ ID NO: 1564107 - DNA, 13 bp, Homo sapiens
aacttaaaatatt

SEQ ID NO: 1564108 - DNA, 13 bp, Homo sapiens
aacttaaacaaaa

SEQ ID NO: 1564109 - DNA, 14 bp, Homo sapiens
aacttaaataataa

SEQ ID NO: 1564110 - DNA, 21 bp, Homo sapiens
aacttaaatgcccccctccca

SEQ ID NO: 1564111 - DNA, 19 bp, Homo sapiens
aacttaaattttaatttat

SEQ ID NO: 1564112 - DNA, 18 bp, Homo sapiens
aacttacacttggagccc

SEQ ID NO: 1564113 - DNA, 19 bp, Homo sapiens
aacttacacttggagcccg

SEQ ID NO: 1564114 - DNA, 19 bp, Homo sapiens
aacttacctgggcattctt

SEQ ID NO: 1564115 - DNA, 14 bp, Homo sapiens
aacttactgtatat

SEQ ID NO: 1564116 - DNA, 14 bp, Homo sapiens
aacttagaggaaaa

SEQ ID NO: 1564117 - DNA, 19 bp, Homo sapiens
aacttagcatgtgttgaaa

SEQ ID NO: 1564118 - DNA, 19 bp, Homo sapiens
aacttagccagagttaggt

SEQ ID NO: 1564119 - DNA, 13 bp, Homo sapiens
aacttagctcagg

SEQ ID NO: 1564120 - DNA, 21 bp, Homo sapiens
aacttaggcatgcacagctgt

SEQ ID NO: 1564121 - DNA, 22 bp, Homo sapiens
aacttagtgcggacaagtttta

SEQ ID NO: 1564122 - DNA, 19 bp, Homo sapiens
aacttatcctaaaacaaat

SEQ ID NO: 1564123 - DNA, 20 bp, Homo sapiens
aacttattccaagtgcattt

SEQ ID NO: 1564124 - DNA, 14 bp, Homo sapiens
aacttattctgtag

SEQ ID NO: 1564125 - DNA, 17 bp, Homo sapiens
aacttattctttgagta

SEQ ID NO: 1564126 - DNA, 17 bp, Homo sapiens
aacttatttaaaaatat

SEQ ID NO: 1564127 - DNA, 19 bp, Homo sapiens
aacttatttaaaaatattt

SEQ ID NO: 1564128 - DNA, 19 bp, Homo sapiens
aacttattttaaatatgcc

SEQ ID NO: 1564129 - DNA, 22 bp, Homo sapiens
aacttcaagtgcatgctctctg

SEQ ID NO: 1564130 - DNA, 16 bp, Homo sapiens
aacttcacaactaggc

SEQ ID NO: 1564131 - DNA, 22 bp, Homo sapiens
aacttcaccaccccctgtccca

SEQ ID NO: 1564132 - DNA, 17 bp, Homo sapiens
aacttcagctgtacttc

SEQ ID NO: 1564133 - DNA, 14 bp, Homo sapiens
aacttcatttgaca

SEQ ID NO: 1564134 - DNA, 21 bp, Homo sapiens
aacttcatttgacacaaagct

SEQ ID NO: 1564135 - DNA, 15 bp, Homo sapiens
aacttccaaagaaag

SEQ ID NO: 1564136 - DNA, 16 bp, Homo sapiens
aacttccaaggccctg

SEQ ID NO: 1564137 - DNA, 21 bp, Homo sapiens
aacttccaaggccctgctttt

SEQ ID NO: 1564138 - DNA, 14 bp, Homo sapiens
aacttccgcctcct

SEQ ID NO: 1564139 - DNA, 15 bp, Homo sapiens
aacttccgcctcctg

SEQ ID NO: 1564140 - DNA, 22 bp, Homo sapiens
aacttccttggactcattttaa

SEQ ID NO: 1564141 - DNA, 12 bp, Homo sapiens
aacttcttcctg

SEQ ID NO: 1564142 - DNA, 22 bp, Homo sapiens
aacttcttgcttctttctagaa

SEQ ID NO: 1564143 - DNA, 24 bp, Homo sapiens
aacttgaaacagattcaggccagc

SEQ ID NO: 1564144 - DNA, 13 bp, Homo sapiens
aacttgaaatata

SEQ ID NO: 1564145 - DNA, 14 bp, Homo sapiens
aacttgactgggtg

SEQ ID NO: 1564146 - DNA, 22 bp, Homo sapiens
aacttgagcgtgaatctgtatc

SEQ ID NO: 1564147 - DNA, 22 bp, Homo sapiens
aacttgcatctaggctgggcgt

SEQ ID NO: 1564148 - DNA, 22 bp, Homo sapiens
aacttgcctggggtctgagcat

SEQ ID NO: 1564149 - DNA, 14 bp, Homo sapiens
aacttgctgctgtc

SEQ ID NO: 1564150 - DNA, 16 bp, Homo sapiens
aacttgctgctgtctt

SEQ ID NO: 1564151 - DNA, 15 bp, Homo sapiens
aacttgcttaaattt

SEQ ID NO: 1564152 - DNA, 20 bp, Homo sapiens
aacttgcttaaatttcttat

SEQ ID NO: 1564153 - DNA, 13 bp, Homo sapiens
aacttggattctc

SEQ ID NO: 1564154 - DNA, 12 bp, Homo sapiens
aacttggcattt

SEQ ID NO: 1564155 - DNA, 14 bp, Homo sapiens
aacttggcatttct

SEQ ID NO: 1564156 - DNA, 15 bp, Homo sapiens
aacttggcatttcta

SEQ ID NO: 1564157 - DNA, 22 bp, Homo sapiens
aacttgggagtgtggtttcttt

SEQ ID NO: 1564158 - DNA, 21 bp, Homo sapiens
aacttggggagttaagacctg

SEQ ID NO: 1564159 - DNA, 22 bp, Homo sapiens
aacttgggttcttctcagcggg

SEQ ID NO: 1564160 - DNA, 17 bp, Homo sapiens
aacttggtcagagccac

SEQ ID NO: 1564161 - DNA, 23 bp, Homo sapiens
aacttggtcagagccactctatg

SEQ ID NO: 1564162 - DNA, 17 bp, Homo sapiens
aacttggttctgcttca

SEQ ID NO: 1564163 - DNA, 15 bp, Homo sapiens
aacttgtaaatacac

SEQ ID NO: 1564164 - DNA, 18 bp, Homo sapiens
aacttgtaaatgctgtca

SEQ ID NO: 1564165 - DNA, 14 bp, Homo sapiens
aacttgtatattcc

SEQ ID NO: 1564166 - DNA, 22 bp, Homo sapiens
aacttgtcagaatttctttgtc

SEQ ID NO: 1564167 - DNA, 18 bp, Homo sapiens
aacttgtgagcatcagag

SEQ ID NO: 1564168 - DNA, 19 bp, Homo sapiens
aacttgtgtccctaatgtg

SEQ ID NO: 1564169 - DNA, 20 bp, Homo sapiens
aacttgtttgctgtgaacaa

SEQ ID NO: 1564170 - DNA, 11 bp, Homo sapiens
aactttaatac

SEQ ID NO: 1564171 - DNA, 19 bp, Homo sapiens
aactttaatgttttttgcc

SEQ ID NO: 1564172 - DNA, 17 bp, Homo sapiens
aactttacctatggaag

SEQ ID NO: 1564173 - DNA, 12 bp, Homo sapiens
aactttactgta

SEQ ID NO: 1564174 - DNA, 22 bp, Homo sapiens
aactttagagtagcatgagaga

SEQ ID NO: 1564175 - DNA, 18 bp, Homo sapiens
aactttatacacttggat

SEQ ID NO: 1564176 - DNA, 13 bp, Homo sapiens
aactttatgtgta

SEQ ID NO: 1564177 - DNA, 14 bp, Homo sapiens
aactttatgtgtaa

SEQ ID NO: 1564178 - DNA, 17 bp, Homo sapiens
aactttatgtgtaaata

SEQ ID NO: 1564179 - DNA, 22 bp, Homo sapiens
aactttcacagtgaagtgcctt

SEQ ID NO: 1564180 - DNA, 16 bp, Homo sapiens
aactttcacttcttcc

SEQ ID NO: 1564181 - DNA, 18 bp, Homo sapiens
aactttcataccacttga

SEQ ID NO: 1564182 - DNA, 17 bp, Homo sapiens
aactttcgttgttatta

SEQ ID NO: 1564183 - DNA, 16 bp, Homo sapiens
aactttgagatctaaa

SEQ ID NO: 1564184 - DNA, 17 bp, Homo sapiens
aactttgcagcatacca

SEQ ID NO: 1564185 - DNA, 16 bp, Homo sapiens
aactttggaacaagat

SEQ ID NO: 1564186 - DNA, 15 bp, Homo sapiens
aactttggaaccaga

SEQ ID NO: 1564187 - DNA, 18 bp, Homo sapiens
aactttggagtcccctca

SEQ ID NO: 1564188 - DNA, 14 bp, Homo sapiens
aactttggtgcatt

SEQ ID NO: 1564189 - DNA, 14 bp, Homo sapiens
aactttgtaaaaat

SEQ ID NO: 1564190 - DNA, 22 bp, Homo sapiens
aacttttatgcagcaaatatat

SEQ ID NO: 1564191 - DNA, 12 bp, Homo sapiens
aacttttctcag

SEQ ID NO: 1564192 - DNA, 13 bp, Homo sapiens
aacttttctcttt

SEQ ID NO: 1564193 - DNA, 22 bp, Homo sapiens
aacttttgagaatgtttgaaaa

SEQ ID NO: 1564194 - DNA, 18 bp, Homo sapiens
aacttttgtactgaattt

SEQ ID NO: 1564195 - DNA, 19 bp, Homo sapiens
aacttttgtgaattaggct

SEQ ID NO: 1564196 - DNA, 23 bp, Homo sapiens
aacttttgttaggaaaaaattga

SEQ ID NO: 1564197 - DNA, 19 bp, Homo sapiens
aacttttttgaaataataa

SEQ ID NO: 1564198 - DNA, 21 bp, Homo sapiens
aacttttttgtggcaattagt

SEQ ID NO: 1564199 - DNA, 16 bp, Homo sapiens
aacttttttgtgtatg

SEQ ID NO: 1564200 - DNA, 20 bp, Homo sapiens
aacttttttgtgtatgtact

SEQ ID NO: 1564201 - DNA, 22 bp, Homo sapiens
aactttttttaggggatttttt

SEQ ID NO: 1564202 - DNA, 15 bp, Homo sapiens
aagaaaaaaaatgta

SEQ ID NO: 1564203 - DNA, 16 bp, Homo sapiens
aagaaaaaaaatgtac

SEQ ID NO: 1564204 - DNA, 10 bp, Homo sapiens
aagaaaaaag

SEQ ID NO: 1564205 - DNA, 13 bp, Homo sapiens
aagaaaaaagctt

SEQ ID NO: 1564206 - DNA, 15 bp, Homo sapiens
aagaaaaacatgtca

SEQ ID NO: 1564207 - DNA, 19 bp, Homo sapiens
aagaaaaataaaatttcct

SEQ ID NO: 1564208 - DNA, 21 bp, Homo sapiens
aagaaaaatgcctgtctctag

SEQ ID NO: 1564209 - DNA, 21 bp, Homo sapiens
aagaaaacaaagttctatttt

SEQ ID NO: 1564210 - DNA, 15 bp, Homo sapiens
aagaaaacactgtta

SEQ ID NO: 1564211 - DNA, 14 bp, Homo sapiens
aagaaaagaccctg

SEQ ID NO: 1564212 - DNA, 22 bp, Homo sapiens
aagaaaagtaggtttacattca

SEQ ID NO: 1564213 - DNA, 16 bp, Homo sapiens
aagaaaatacttaaat

SEQ ID NO: 1564214 - DNA, 13 bp, Homo sapiens
aagaaaatcactt

SEQ ID NO: 1564215 - DNA, 15 bp, Homo sapiens
aagaaaatctttata

SEQ ID NO: 1564216 - DNA, 16 bp, Homo sapiens
aagaaaattgctgtgc

SEQ ID NO: 1564217 - DNA, 15 bp, Homo sapiens
aagaaacaaagatgt

SEQ ID NO: 1564218 - DNA, 16 bp, Homo sapiens
aagaaacaagctgtgc

SEQ ID NO: 1564219 - DNA, 17 bp, Homo sapiens
aagaaacaagctgtgca

SEQ ID NO: 1564220 - DNA, 14 bp, Homo sapiens
aagaaacagccagc

SEQ ID NO: 1564221 - DNA, 13 bp, Homo sapiens
aagaaactgaatg

SEQ ID NO: 1564222 - DNA, 20 bp, Homo sapiens
aagaaactggtccatgtaaa

SEQ ID NO: 1564223 - DNA, 23 bp, Homo sapiens
aagaaacttttttattttttaaa

SEQ ID NO: 1564224 - DNA, 13 bp, Homo sapiens
aagaaagaaggaa

SEQ ID NO: 1564225 - DNA, 23 bp, Homo sapiens
aagaaagagcaacaatccatctc

SEQ ID NO: 1564226 - DNA, 12 bp, Homo sapiens
aagaaagatttg

SEQ ID NO: 1564227 - DNA, 16 bp, Homo sapiens
aagaaagcaaaagcaa

SEQ ID NO: 1564228 - DNA, 15 bp, Homo sapiens
aagaaagtctatgct

SEQ ID NO: 1564229 - DNA, 13 bp, Homo sapiens
aagaaataaaaat

SEQ ID NO: 1564230 - DNA, 12 bp, Homo sapiens
aagaaatagaat

SEQ ID NO: 1564231 - DNA, 17 bp, Homo sapiens
aagaaatagcagagcct

SEQ ID NO: 1564232 - DNA, 16 bp, Homo sapiens
aagaaatcatgtccat

SEQ ID NO: 1564233 - DNA, 23 bp, Homo sapiens
aagaaatgatgttggagaaggga

SEQ ID NO: 1564234 - DNA, 11 bp, Homo sapiens
aagaaatgatt

SEQ ID NO: 1564235 - DNA, 16 bp, Homo sapiens
aagaaatgcaaaaatc

SEQ ID NO: 1564236 - DNA, 16 bp, Homo sapiens
aagaaatgctaatgta

SEQ ID NO: 1564237 - DNA, 20 bp, Homo sapiens
aagaaatgctaatgtaatca

SEQ ID NO: 1564238 - DNA, 20 bp, Homo sapiens
aagaaatggcgtctgctctg

SEQ ID NO: 1564239 - DNA, 21 bp, Homo sapiens
aagaaatggcgtctgctctgg

SEQ ID NO: 1564240 - DNA, 13 bp, Homo sapiens
aagaaatggtgaa

SEQ ID NO: 1564241 - DNA, 14 bp, Homo sapiens
aagaaatgtaaggg

SEQ ID NO: 1564242 - DNA, 15 bp, Homo sapiens
aagaaattcaggtac

SEQ ID NO: 1564243 - DNA, 21 bp, Homo sapiens
aagaaattcaggtacagaaaa

SEQ ID NO: 1564244 - DNA, 15 bp, Homo sapiens
aagaaattttttaaa

SEQ ID NO: 1564245 - DNA, 21 bp, Homo sapiens
aagaacaaagagaaaaaatac

SEQ ID NO: 1564246 - DNA, 14 bp, Homo sapiens
aagaacaagaaatg

SEQ ID NO: 1564247 - DNA, 21 bp, Homo sapiens
aagaacacaaagcggggggag

SEQ ID NO: 1564248 - DNA, 17 bp, Homo sapiens
aagaacacagcatgtgc

SEQ ID NO: 1564249 - DNA, 19 bp, Homo sapiens
aagaacacagcatgtgcca

SEQ ID NO: 1564250 - DNA, 16 bp, Homo sapiens
aagaacacattttaaa

SEQ ID NO: 1564251 - DNA, 16 bp, Homo sapiens
aagaacaccctctaaa

SEQ ID NO: 1564252 - DNA, 12 bp, Homo sapiens
aagaacagatgg

SEQ ID NO: 1564253 - DNA, 13 bp, Homo sapiens
aagaacaggcctc

SEQ ID NO: 1564254 - DNA, 12 bp, Homo sapiens
aagaacatagaa

SEQ ID NO: 1564255 - DNA, 17 bp, Homo sapiens
aagaaccaaaacttcca

SEQ ID NO: 1564256 - DNA, 12 bp, Homo sapiens
aagaaccaaata

SEQ ID NO: 1564257 - DNA, 20 bp, Homo sapiens
aagaaccagtccccccaccc

SEQ ID NO: 1564258 - DNA, 21 bp, Homo sapiens
aagaacccctcgttagccttc

SEQ ID NO: 1564259 - DNA, 20 bp, Homo sapiens
aagaactacaaacaaaattt

SEQ ID NO: 1564260 - DNA, 17 bp, Homo sapiens
aagaactccttattttg

SEQ ID NO: 1564261 - DNA, 19 bp, Homo sapiens
aagaactctaaccagtgta

SEQ ID NO: 1564262 - DNA, 23 bp, Homo sapiens
aagaactgcaggccctggcctcc

SEQ ID NO: 1564263 - DNA, 16 bp, Homo sapiens
aagaactgtacattgt

SEQ ID NO: 1564264 - DNA, 20 bp, Homo sapiens
aagaactgtacattgtgagc

SEQ ID NO: 1564265 - DNA, 14 bp, Homo sapiens
aagaactgtgtctg

SEQ ID NO: 1564266 - DNA, 13 bp, Homo sapiens
aagaacttgctgc

SEQ ID NO: 1564267 - DNA, 19 bp, Homo sapiens
aagaacttgctgctgcctt

SEQ ID NO: 1564268 - DNA, 22 bp, Homo sapiens
aagaactttaaagctcaggagg

SEQ ID NO: 1564269 - DNA, 17 bp, Homo sapiens
aagaactttaaattgtg

SEQ ID NO: 1564270 - DNA, 21 bp, Homo sapiens
aagaagaaaattgctgtgcct

SEQ ID NO: 1564271 - DNA, 12 bp, Homo sapiens
aagaagaaagca

SEQ ID NO: 1564272 - DNA, 16 bp, Homo sapiens
aagaagaaagcaaaag

SEQ ID NO: 1564273 - DNA, 15 bp, Homo sapiens
aagaagaagaagaag

SEQ ID NO: 1564274 - DNA, 15 bp, Homo sapiens
aagaagaaggagagc

SEQ ID NO: 1564275 - DNA, 13 bp, Homo sapiens
aagaagaagggca

SEQ ID NO: 1564276 - DNA, 12 bp, Homo sapiens
aagaagacatga

SEQ ID NO: 1564277 - DNA, 17 bp, Homo sapiens
aagaagacatggagact

SEQ ID NO: 1564278 - DNA, 13 bp, Homo sapiens
aagaagacttttt

SEQ ID NO: 1564279 - DNA, 18 bp, Homo sapiens
aagaagagaagctgctga

SEQ ID NO: 1564280 - DNA, 19 bp, Homo sapiens
aagaagagaagctgctgac

SEQ ID NO: 1564281 - DNA, 20 bp, Homo sapiens
aagaagaggaagaaattcag

SEQ ID NO: 1564282 - DNA, 21 bp, Homo sapiens
aagaagaggagcctcagaaga

SEQ ID NO: 1564283 - DNA, 12 bp, Homo sapiens
aagaagagtaaa

SEQ ID NO: 1564284 - DNA, 14 bp, Homo sapiens
aagaagagtttaca

SEQ ID NO: 1564285 - DNA, 22 bp, Homo sapiens
aagaagcagtggccttattgca

SEQ ID NO: 1564286 - DNA, 17 bp, Homo sapiens
aagaagccgggaacaga

SEQ ID NO: 1564287 - DNA, 18 bp, Homo sapiens
aagaagccttaatttgca

SEQ ID NO: 1564288 - DNA, 19 bp, Homo sapiens
aagaagctctccaggcccc

SEQ ID NO: 1564289 - DNA, 23 bp, Homo sapiens
aagaaggaaaatgatctgagtcc

SEQ ID NO: 1564290 - DNA, 14 bp, Homo sapiens
aagaaggaaagatg

SEQ ID NO: 1564291 - DNA, 11 bp, Homo sapiens
aagaaggaagt

SEQ ID NO: 1564292 - DNA, 18 bp, Homo sapiens
aagaaggaatataccttt

SEQ ID NO: 1564293 - DNA, 14 bp, Homo sapiens
aagaaggagagcaa

SEQ ID NO: 1564294 - DNA, 16 bp, Homo sapiens
aagaaggagagcaaga

SEQ ID NO: 1564295 - DNA, 23 bp, Homo sapiens
aagaaggcaattttagtgtatta

SEQ ID NO: 1564296 - DNA, 11 bp, Homo sapiens
aagaagggctg

SEQ ID NO: 1564297 - DNA, 19 bp, Homo sapiens
aagaagggggccctgctac

SEQ ID NO: 1564298 - DNA, 20 bp, Homo sapiens
aagaagtaggggaagacatg

SEQ ID NO: 1564299 - DNA, 22 bp, Homo sapiens
aagaagtaggttctgttttgtt

SEQ ID NO: 1564300 - DNA, 12 bp, Homo sapiens
aagaagtcttga

SEQ ID NO: 1564301 - DNA, 19 bp, Homo sapiens
aagaagtggagacagtcct

SEQ ID NO: 1564302 - DNA, 22 bp, Homo sapiens
aagaagttaaaaaacagctgca

SEQ ID NO: 1564303 - DNA, 20 bp, Homo sapiens
aagaagttctttgattctgt

SEQ ID NO: 1564304 - DNA, 23 bp, Homo sapiens
aagaagttgctaagtgtgcttag

SEQ ID NO: 1564305 - DNA, 21 bp, Homo sapiens
aagaagtttttctttgtgttt

SEQ ID NO: 1564306 - DNA, 16 bp, Homo sapiens
aagaataatcacgctt

SEQ ID NO: 1564307 - DNA, 19 bp, Homo sapiens
aagaataggcattaacaca

SEQ ID NO: 1564308 - DNA, 20 bp, Homo sapiens
aagaatatcctttaaaattt

SEQ ID NO: 1564309 - DNA, 20 bp, Homo sapiens
aagaatatctgtaatggtac

SEQ ID NO: 1564310 - DNA, 13 bp, Homo sapiens
aagaatattcagg

SEQ ID NO: 1564311 - DNA, 14 bp, Homo sapiens
aagaatatttttag

SEQ ID NO: 1564312 - DNA, 16 bp, Homo sapiens
aagaatccaatactgc

SEQ ID NO: 1564313 - DNA, 19 bp, Homo sapiens
aagaatccacatttctaaa

SEQ ID NO: 1564314 - DNA, 15 bp, Homo sapiens
aagaatctaatgaat

SEQ ID NO: 1564315 - DNA, 14 bp, Homo sapiens
aagaatctagaaga

SEQ ID NO: 1564316 - DNA, 16 bp, Homo sapiens
aagaatctagaagatg

SEQ ID NO: 1564317 - DNA, 18 bp, Homo sapiens
aagaatcttaatgcttgt

SEQ ID NO: 1564318 - DNA, 14 bp, Homo sapiens
aagaatgaaaaata

SEQ ID NO: 1564319 - DNA, 15 bp, Homo sapiens
aagaatgaaaaatat

SEQ ID NO: 1564320 - DNA, 13 bp, Homo sapiens
aagaatgaaagct

SEQ ID NO: 1564321 - DNA, 19 bp, Homo sapiens
aagaatgaaagctgttcct

SEQ ID NO: 1564322 - DNA, 21 bp, Homo sapiens
aagaatgagtttcttagactt

SEQ ID NO: 1564323 - DNA, 15 bp, Homo sapiens
aagaatgctggtttt

SEQ ID NO: 1564324 - DNA, 18 bp, Homo sapiens
aagaatgctggttttcct

SEQ ID NO: 1564325 - DNA, 22 bp, Homo sapiens
aagaatgctggttttcctaaat

SEQ ID NO: 1564326 - DNA, 13 bp, Homo sapiens
aagaatgcttaaa

SEQ ID NO: 1564327 - DNA, 16 bp, Homo sapiens
aagaatggagcagtac

SEQ ID NO: 1564328 - DNA, 16 bp, Homo sapiens
aagaatgtacgtccag

SEQ ID NO: 1564329 - DNA, 17 bp, Homo sapiens
aagaatgtcgattaaaa

SEQ ID NO: 1564330 - DNA, 13 bp, Homo sapiens
aagaatgtttctg

SEQ ID NO: 1564331 - DNA, 18 bp, Homo sapiens
aagaattaagatacaaat

SEQ ID NO: 1564332 - DNA, 19 bp, Homo sapiens
aagaattatgtaatatatt

SEQ ID NO: 1564333 - DNA, 21 bp, Homo sapiens
aagaattatgtaatatattgt

SEQ ID NO: 1564334 - DNA, 22 bp, Homo sapiens
aagaattatgtaatatattgta

SEQ ID NO: 1564335 - DNA, 23 bp, Homo sapiens
aagaattatgtaatatattgtac

SEQ ID NO: 1564336 - DNA, 14 bp, Homo sapiens
aagaattatttttg

SEQ ID NO: 1564337 - DNA, 15 bp, Homo sapiens
aagaattatttttgt

SEQ ID NO: 1564338 - DNA, 19 bp, Homo sapiens
aagaattcaaactggggcc

SEQ ID NO: 1564339 - DNA, 19 bp, Homo sapiens
aagaattgaaaagtttttg

SEQ ID NO: 1564340 - DNA, 20 bp, Homo sapiens
aagaattgaacccaggaggt

SEQ ID NO: 1564341 - DNA, 23 bp, Homo sapiens
aagaatttcttggtaagaagccg

SEQ ID NO: 1564342 - DNA, 19 bp, Homo sapiens
aagaattttatttttctgt

SEQ ID NO: 1564343 - DNA, 14 bp, Homo sapiens
aagacaaaaatcaa

SEQ ID NO: 1564344 - DNA, 16 bp, Homo sapiens
aagacaaacactgcca

SEQ ID NO: 1564345 - DNA, 22 bp, Homo sapiens
aagacaaacactgccatattgt

SEQ ID NO: 1564346 - DNA, 16 bp, Homo sapiens
aagacaaattctgttt

SEQ ID NO: 1564347 - DNA, 18 bp, Homo sapiens
aagacaaattctgtttct

SEQ ID NO: 1564348 - DNA, 16 bp, Homo sapiens
aagacaacaaaagaaa

SEQ ID NO: 1564349 - DNA, 13 bp, Homo sapiens
aagacaacagaaa

SEQ ID NO: 1564350 - DNA, 22 bp, Homo sapiens
aagacaagagatctacacatgt

SEQ ID NO: 1564351 - DNA, 12 bp, Homo sapiens
aagacaaggctg

SEQ ID NO: 1564352 - DNA, 17 bp, Homo sapiens
aagacaagtatgaatat

SEQ ID NO: 1564353 - DNA, 19 bp, Homo sapiens
aagacaataattacattgg

SEQ ID NO: 1564354 - DNA, 22 bp, Homo sapiens
aagacaatatgaacaaactatg

SEQ ID NO: 1564355 - DNA, 15 bp, Homo sapiens
aagacaatcactgcc

SEQ ID NO: 1564356 - DNA, 16 bp, Homo sapiens
aagacaatccatgtaa

SEQ ID NO: 1564357 - DNA, 16 bp, Homo sapiens
aagacacagcctcccc

SEQ ID NO: 1564358 - DNA, 22 bp, Homo sapiens
aagacacgtggcctcgtgaggg

SEQ ID NO: 1564359 - DNA, 16 bp, Homo sapiens
aagacactgcctgggc

SEQ ID NO: 1564360 - DNA, 17 bp, Homo sapiens
aagacactgcctgggct

SEQ ID NO: 1564361 - DNA, 13 bp, Homo sapiens
aagacacttcaga

SEQ ID NO: 1564362 - DNA, 16 bp, Homo sapiens
aagacagaaaagtgcc

SEQ ID NO: 1564363 - DNA, 19 bp, Homo sapiens
aagacagaaaagtgcctga

SEQ ID NO: 1564364 - DNA, 12 bp, Homo sapiens
aagacagagtct

SEQ ID NO: 1564365 - DNA, 22 bp, Homo sapiens
aagacagatgccccagagctgt

SEQ ID NO: 1564366 - DNA, 23 bp, Homo sapiens
aagacaggacagtgcttcagcct

SEQ ID NO: 1564367 - DNA, 17 bp, Homo sapiens
aagacagtgccctgaga

SEQ ID NO: 1564368 - DNA, 23 bp, Homo sapiens
aagacagtgtacaaaactgtaaa

SEQ ID NO: 1564369 - DNA, 23 bp, Homo sapiens
aagacatactccttccatcaaat

SEQ ID NO: 1564370 - DNA, 11 bp, Homo sapiens
aagacatcaat

SEQ ID NO: 1564371 - DNA, 18 bp, Homo sapiens
aagacatgaatgcacact

SEQ ID NO: 1564372 - DNA, 16 bp, Homo sapiens
aagacatgctttccat

SEQ ID NO: 1564373 - DNA, 18 bp, Homo sapiens
aagacatggagactcctg

SEQ ID NO: 1564374 - DNA, 17 bp, Homo sapiens
aagacatgtctgttcta

SEQ ID NO: 1564375 - DNA, 17 bp, Homo sapiens
aagacatgtgaggagga

SEQ ID NO: 1564376 - DNA, 19 bp, Homo sapiens
aagacatgtgaggaggaaa

SEQ ID NO: 1564377 - DNA, 18 bp, Homo sapiens
aagacatttatactcttt

SEQ ID NO: 1564378 - DNA, 15 bp, Homo sapiens
aagacatttcctttt

SEQ ID NO: 1564379 - DNA, 18 bp, Homo sapiens
aagacatttgctgaactc

SEQ ID NO: 1564380 - DNA, 13 bp, Homo sapiens
aagacatttgtat

SEQ ID NO: 1564381 - DNA, 16 bp, Homo sapiens
aagacatttgtatatt

SEQ ID NO: 1564382 - DNA, 18 bp, Homo sapiens
aagacatttgtatattgt

SEQ ID NO: 1564383 - DNA, 19 bp, Homo sapiens
aagacattttaagtttgta

SEQ ID NO: 1564384 - DNA, 22 bp, Homo sapiens
aagacattttaagtttgtagta

SEQ ID NO: 1564385 - DNA, 16 bp, Homo sapiens
aagacattttgttaca

SEQ ID NO: 1564386 - DNA, 18 bp, Homo sapiens
aagaccaaaatgacaatg

SEQ ID NO: 1564387 - DNA, 23 bp, Homo sapiens
aagaccagaattcccttgaattg

SEQ ID NO: 1564388 - DNA, 12 bp, Homo sapiens
aagaccagcctg

SEQ ID NO: 1564389 - DNA, 18 bp, Homo sapiens
aagaccaggctgcagcct

SEQ ID NO: 1564390 - DNA, 17 bp, Homo sapiens
aagacccagcaggaagc

SEQ ID NO: 1564391 - DNA, 20 bp, Homo sapiens
aagaccccgcaggatccctc

SEQ ID NO: 1564392 - DNA, 23 bp, Homo sapiens
aagaccccgcaggatccctcctg

SEQ ID NO: 1564393 - DNA, 15 bp, Homo sapiens
aagacccctgactca

SEQ ID NO: 1564394 - DNA, 13 bp, Homo sapiens
aagaccctgagac

SEQ ID NO: 1564395 - DNA, 15 bp, Homo sapiens
aagaccctgagactc

SEQ ID NO: 1564396 - DNA, 16 bp, Homo sapiens
aagaccgccccagggc

SEQ ID NO: 1564397 - DNA, 15 bp, Homo sapiens
aagaccgtgtcccaa

SEQ ID NO: 1564398 - DNA, 22 bp, Homo sapiens
aagaccgtgtcccaaggagctg

SEQ ID NO: 1564399 - DNA, 16 bp, Homo sapiens
aagacctcacctagaa

SEQ ID NO: 1564400 - DNA, 17 bp, Homo sapiens
aagacctcacctagaaa

SEQ ID NO: 1564401 - DNA, 22 bp, Homo sapiens
aagacctcatctgtggagctgc

SEQ ID NO: 1564402 - DNA, 15 bp, Homo sapiens
aagacctcttccctc

SEQ ID NO: 1564403 - DNA, 17 bp, Homo sapiens
aagacctcttccctctg

SEQ ID NO: 1564404 - DNA, 16 bp, Homo sapiens
aagacctgagtatttt

SEQ ID NO: 1564405 - DNA, 23 bp, Homo sapiens
aagaccttgcttatgattgcaga

SEQ ID NO: 1564406 - DNA, 20 bp, Homo sapiens
aagacctttattcacccctg

SEQ ID NO: 1564407 - DNA, 19 bp, Homo sapiens
aagacgaggggcagggaag

SEQ ID NO: 1564408 - DNA, 19 bp, Homo sapiens
aagacggaggaggggaagg

SEQ ID NO: 1564409 - DNA, 22 bp, Homo sapiens
aagacgggtattgttgggaaag

SEQ ID NO: 1564410 - DNA, 20 bp, Homo sapiens
aagactatatatataaatgt

SEQ ID NO: 1564411 - DNA, 20 bp, Homo sapiens
aagactatccaacttaacat

SEQ ID NO: 1564412 - DNA, 17 bp, Homo sapiens
aagactcaaatgttcta

SEQ ID NO: 1564413 - DNA, 18 bp, Homo sapiens
aagactcaaatgttctaa

SEQ ID NO: 1564414 - DNA, 13 bp, Homo sapiens
aagactcaggagt

SEQ ID NO: 1564415 - DNA, 23 bp, Homo sapiens
aagactcagtatgctttccctga

SEQ ID NO: 1564416 - DNA, 12 bp, Homo sapiens
aagactccctga

SEQ ID NO: 1564417 - DNA, 14 bp, Homo sapiens
aagactccttgtgg

SEQ ID NO: 1564418 - DNA, 21 bp, Homo sapiens
aagactctagagtccaaggtt

SEQ ID NO: 1564419 - DNA, 14 bp, Homo sapiens
aagactctggaggt

SEQ ID NO: 1564420 - DNA, 13 bp, Homo sapiens
aagactgaacatg

SEQ ID NO: 1564421 - DNA, 15 bp, Homo sapiens
aagactgaacatgtt

SEQ ID NO: 1564422 - DNA, 16 bp, Homo sapiens
aagactgaacatgttt

SEQ ID NO: 1564423 - DNA, 14 bp, Homo sapiens
aagactgataacaa

SEQ ID NO: 1564424 - DNA, 12 bp, Homo sapiens
aagactgcagct

SEQ ID NO: 1564425 - DNA, 13 bp, Homo sapiens
aagactgcagctg

SEQ ID NO: 1564426 - DNA, 15 bp, Homo sapiens
aagactgcagctgct

SEQ ID NO: 1564427 - DNA, 17 bp, Homo sapiens
aagactgtacaaagtag

SEQ ID NO: 1564428 - DNA, 20 bp, Homo sapiens
aagactgtgaacagcttgct

SEQ ID NO: 1564429 - DNA, 15 bp, Homo sapiens
aagactgtgcagaag

SEQ ID NO: 1564430 - DNA, 18 bp, Homo sapiens
aagactgtggctgctagc

SEQ ID NO: 1564431 - DNA, 14 bp, Homo sapiens
aagacttactctaa

SEQ ID NO: 1564432 - DNA, 16 bp, Homo sapiens
aagacttactctaaga

SEQ ID NO: 1564433 - DNA, 20 bp, Homo sapiens
aagactttagcttttccttc

SEQ ID NO: 1564434 - DNA, 15 bp, Homo sapiens
aagacttttattaat

SEQ ID NO: 1564435 - DNA, 18 bp, Homo sapiens
aagacttttattaataaa

SEQ ID NO: 1564436 - DNA, 21 bp, Homo sapiens
aagacttttggtagagaagga

SEQ ID NO: 1564437 - DNA, 22 bp, Homo sapiens
aagagaaaaaaagtttgccaga

SEQ ID NO: 1564438 - DNA, 15 bp, Homo sapiens
aagagaaaagagaga

SEQ ID NO: 1564439 - DNA, 14 bp, Homo sapiens
aagagaaaggactc

SEQ ID NO: 1564440 - DNA, 19 bp, Homo sapiens
aagagaaaggactcagtgt

SEQ ID NO: 1564441 - DNA, 22 bp, Homo sapiens
aagagaagagggcccagcccag

SEQ ID NO: 1564442 - DNA, 13 bp, Homo sapiens
aagagaagctgct

SEQ ID NO: 1564443 - DNA, 16 bp, Homo sapiens
aagagaagctgctgac

SEQ ID NO: 1564444 - DNA, 14 bp, Homo sapiens
aagagaaggcacac

SEQ ID NO: 1564445 - DNA, 21 bp, Homo sapiens
aagagaagttattttctacag

SEQ ID NO: 1564446 - DNA, 21 bp, Homo sapiens
aagagacaaacacctcccagg

SEQ ID NO: 1564447 - DNA, 13 bp, Homo sapiens
aagagacaaagat

SEQ ID NO: 1564448 - DNA, 15 bp, Homo sapiens
aagagacaaagattt

SEQ ID NO: 1564449 - DNA, 22 bp, Homo sapiens
aagagacagagacaagtaattt

SEQ ID NO: 1564450 - DNA, 14 bp, Homo sapiens
aagagagaaagaag

SEQ ID NO: 1564451 - DNA, 21 bp, Homo sapiens
aagagagaaagaagtaggcat

SEQ ID NO: 1564452 - DNA, 13 bp, Homo sapiens
aagagagaagcca

SEQ ID NO: 1564453 - DNA, 18 bp, Homo sapiens
aagagagaagccagccac

SEQ ID NO: 1564454 - DNA, 12 bp, Homo sapiens
aagagagaatgt

SEQ ID NO: 1564455 - DNA, 17 bp, Homo sapiens
aagagagtggggcctgc

SEQ ID NO: 1564456 - DNA, 21 bp, Homo sapiens
aagagagtggggcctgccctc

SEQ ID NO: 1564457 - DNA, 18 bp, Homo sapiens
aagagatcgagaccatcc

SEQ ID NO: 1564458 - DNA, 18 bp, Homo sapiens
aagagatctacacatgtt

SEQ ID NO: 1564459 - DNA, 14 bp, Homo sapiens
aagagatctgtgtg

SEQ ID NO: 1564460 - DNA, 14 bp, Homo sapiens
aagagatctttctt

SEQ ID NO: 1564461 - DNA, 20 bp, Homo sapiens
aagagatctttctttccaaa

SEQ ID NO: 1564462 - DNA, 17 bp, Homo sapiens
aagagatgagaaatgat

SEQ ID NO: 1564463 - DNA, 17 bp, Homo sapiens
aagagatgggcttgttt

SEQ ID NO: 1564464 - DNA, 14 bp, Homo sapiens
aagagatgtttaca

SEQ ID NO: 1564465 - DNA, 17 bp, Homo sapiens
aagagatgtttacagta

SEQ ID NO: 1564466 - DNA, 21 bp, Homo sapiens
aagagatttaaactctgaatt

SEQ ID NO: 1564467 - DNA, 16 bp, Homo sapiens
aagagatttaattaat

SEQ ID NO: 1564468 - DNA, 17 bp, Homo sapiens
aagagcaaggaaggtaa

SEQ ID NO: 1564469 - DNA, 15 bp, Homo sapiens
aagagcaagtctgga

SEQ ID NO: 1564470 - DNA, 10 bp, Homo sapiens
aagagcacaa

SEQ ID NO: 1564471 - DNA, 14 bp, Homo sapiens
aagagcagaacaga

SEQ ID NO: 1564472 - DNA, 15 bp, Homo sapiens
aagagcagcctgatg

SEQ ID NO: 1564473 - DNA, 22 bp, Homo sapiens
aagagcagctccttcctagcct

SEQ ID NO: 1564474 - DNA, 17 bp, Homo sapiens
aagagcaggactccagg

SEQ ID NO: 1564475 - DNA, 22 bp, Homo sapiens
aagagcaggactccaggcccaa

SEQ ID NO: 1564476 - DNA, 23 bp, Homo sapiens
aagagcaggcacatggaggagct

SEQ ID NO: 1564477 - DNA, 16 bp, Homo sapiens
aagagccaagttccaa

SEQ ID NO: 1564478 - DNA, 19 bp, Homo sapiens
aagagccacctgcaagatg

SEQ ID NO: 1564479 - DNA, 18 bp, Homo sapiens
aagagccactttcaagct

SEQ ID NO: 1564480 - DNA, 24 bp, Homo sapiens
aagagccactttcaagctgcactg

SEQ ID NO: 1564481 - DNA, 9 bp, Homo sapiens
aagagccat

SEQ ID NO: 1564482 - DNA, 17 bp, Homo sapiens
aagagccattttggtaa

SEQ ID NO: 1564483 - DNA, 23 bp, Homo sapiens
aagagcccgcagggccatgcaga

SEQ ID NO: 1564484 - DNA, 23 bp, Homo sapiens
aagagcccgtcgcgctggacagc

SEQ ID NO: 1564485 - DNA, 23 bp, Homo sapiens
aagagccctgtggccgccacctg

SEQ ID NO: 1564486 - DNA, 20 bp, Homo sapiens
aagagccttggtgtccacct

SEQ ID NO: 1564487 - DNA, 16 bp, Homo sapiens
aagagctagaaaaata

SEQ ID NO: 1564488 - DNA, 17 bp, Homo sapiens
aagagctcccctccaca

SEQ ID NO: 1564489 - DNA, 21 bp, Homo sapiens
aagagctgcctggatgagaaa

SEQ ID NO: 1564490 - DNA, 14 bp, Homo sapiens
aagagcttagaaac

SEQ ID NO: 1564491 - DNA, 19 bp, Homo sapiens
aagagcttagaaactggaa

SEQ ID NO: 1564492 - DNA, 21 bp, Homo sapiens
aagagcttattacttatttgt

SEQ ID NO: 1564493 - DNA, 18 bp, Homo sapiens
aagagcttgcacagccaa

SEQ ID NO: 1564494 - DNA, 23 bp, Homo sapiens
aagagcttgctccagattctgat

SEQ ID NO: 1564495 - DNA, 21 bp, Homo sapiens
aagagcttgtgtcctgtcctt

SEQ ID NO: 1564496 - DNA, 20 bp, Homo sapiens
aagaggaacagcactgggga

SEQ ID NO: 1564497 - DNA, 22 bp, Homo sapiens
aagaggaacagcactggggagt

SEQ ID NO: 1564498 - DNA, 13 bp, Homo sapiens
aagaggaagcaaa

SEQ ID NO: 1564499 - DNA, 14 bp, Homo sapiens
aagaggaatctgtt

SEQ ID NO: 1564500 - DNA, 15 bp, Homo sapiens
aagaggactgagact

SEQ ID NO: 1564501 - DNA, 17 bp, Homo sapiens
aagaggactgagactgg

SEQ ID NO: 1564502 - DNA, 15 bp, Homo sapiens
aagaggagaccctgg

SEQ ID NO: 1564503 - DNA, 12 bp, Homo sapiens
aagaggagcaga

SEQ ID NO: 1564504 - DNA, 19 bp, Homo sapiens
aagaggagcagagggcagg

SEQ ID NO: 1564505 - DNA, 18 bp, Homo sapiens
aagaggagctttttagtt

SEQ ID NO: 1564506 - DNA, 17 bp, Homo sapiens
aagaggaggggaagagg

SEQ ID NO: 1564507 - DNA, 17 bp, Homo sapiens
aagaggatgagcagagg

SEQ ID NO: 1564508 - DNA, 19 bp, Homo sapiens
aagaggatgagcagaggga

SEQ ID NO: 1564509 - DNA, 16 bp, Homo sapiens
aagaggcagaaaattg

SEQ ID NO: 1564510 - DNA, 19 bp, Homo sapiens
aagaggcagaaaattgcac

SEQ ID NO: 1564511 - DNA, 17 bp, Homo sapiens
aagaggcccactagagg

SEQ ID NO: 1564512 - DNA, 22 bp, Homo sapiens
aagaggcccactagagggccca

SEQ ID NO: 1564513 - DNA, 15 bp, Homo sapiens
aagaggcgggccagc

SEQ ID NO: 1564514 - DNA, 22 bp, Homo sapiens
aagaggcgggccagccaggcgg

SEQ ID NO: 1564515 - DNA, 16 bp, Homo sapiens
aagaggctgaaagagg

SEQ ID NO: 1564516 - DNA, 13 bp, Homo sapiens
aagaggctgaggc

SEQ ID NO: 1564517 - DNA, 14 bp, Homo sapiens
aagaggctgaggca

SEQ ID NO: 1564518 - DNA, 15 bp, Homo sapiens
aagaggctgaggcct

SEQ ID NO: 1564519 - DNA, 17 bp, Homo sapiens
aagagggagaagcatga

SEQ ID NO: 1564520 - DNA, 15 bp, Homo sapiens
aagagggcccagccc

SEQ ID NO: 1564521 - DNA, 16 bp, Homo sapiens
aagagggcccagccca

SEQ ID NO: 1564522 - DNA, 17 bp, Homo sapiens
aagagggcccagcccag

SEQ ID NO: 1564523 - DNA, 23 bp, Homo sapiens
aagagggcccagcccagagccac

SEQ ID NO: 1564524 - DNA, 13 bp, Homo sapiens
aagaggggcagcc

SEQ ID NO: 1564525 - DNA, 16 bp, Homo sapiens
aagaggggcagccctt

SEQ ID NO: 1564526 - DNA, 13 bp, Homo sapiens
aagaggggctggg

SEQ ID NO: 1564527 - DNA, 13 bp, Homo sapiens
aagagggggtgga

SEQ ID NO: 1564528 - DNA, 17 bp, Homo sapiens
aagaggtctgattggct

SEQ ID NO: 1564529 - DNA, 15 bp, Homo sapiens
aagaggtgggagggc

SEQ ID NO: 1564530 - DNA, 16 bp, Homo sapiens
aagaggtgggagggcc

SEQ ID NO: 1564531 - DNA, 17 bp, Homo sapiens
aagaggtgttatttgga

SEQ ID NO: 1564532 - DNA, 18 bp, Homo sapiens
aagaggttggagcaacaa

SEQ ID NO: 1564533 - DNA, 14 bp, Homo sapiens
aagagtaatttcat

SEQ ID NO: 1564534 - DNA, 16 bp, Homo sapiens
aagagtagtaatagag

SEQ ID NO: 1564535 - DNA, 21 bp, Homo sapiens
aagagtgagactccacctcaa

SEQ ID NO: 1564536 - DNA, 17 bp, Homo sapiens
aagagtgattgcagctt

SEQ ID NO: 1564537 - DNA, 22 bp, Homo sapiens
aagagtggcagctataggaaat

SEQ ID NO: 1564538 - DNA, 15 bp, Homo sapiens
aagagttacaataaa

SEQ ID NO: 1564539 - DNA, 22 bp, Homo sapiens
aagagttacaataaagtttaca

SEQ ID NO: 1564540 - DNA, 17 bp, Homo sapiens
aagagttctatccccaa

SEQ ID NO: 1564541 - DNA, 21 bp, Homo sapiens
aagagttctatccccaagctg

SEQ ID NO: 1564542 - DNA, 18 bp, Homo sapiens
aagagtttcagtttgttg

SEQ ID NO: 1564543 - DNA, 18 bp, Homo sapiens
aagataaaatatcctcag

SEQ ID NO: 1564544 - DNA, 13 bp, Homo sapiens
aagataaatgtgc

SEQ ID NO: 1564545 - DNA, 14 bp, Homo sapiens
aagataacttactg

SEQ ID NO: 1564546 - DNA, 17 bp, Homo sapiens
aagataacttactgtat

SEQ ID NO: 1564547 - DNA, 19 bp, Homo sapiens
aagataagaaatgatcttt

SEQ ID NO: 1564548 - DNA, 12 bp, Homo sapiens
aagataatgttc

SEQ ID NO: 1564549 - DNA, 16 bp, Homo sapiens
aagataatgttcttta

SEQ ID NO: 1564550 - DNA, 15 bp, Homo sapiens
aagatacaaaagctt

SEQ ID NO: 1564551 - DNA, 18 bp, Homo sapiens
aagatacaaattaatttt

SEQ ID NO: 1564552 - DNA, 20 bp, Homo sapiens
aagatacaagtttcagacag

SEQ ID NO: 1564553 - DNA, 22 bp, Homo sapiens
aagatacagcctgcaagtggta

SEQ ID NO: 1564554 - DNA, 22 bp, Homo sapiens
aagatacctaaaagagatttca

SEQ ID NO: 1564555 - DNA, 18 bp, Homo sapiens
aagatacctttttttttc

SEQ ID NO: 1564556 - DNA, 20 bp, Homo sapiens
aagatactaaggacgttgtt

SEQ ID NO: 1564557 - DNA, 14 bp, Homo sapiens
aagatagaaagctg

SEQ ID NO: 1564558 - DNA, 16 bp, Homo sapiens
aagatagaaagctgga

SEQ ID NO: 1564559 - DNA, 12 bp, Homo sapiens
aagatagacagg

SEQ ID NO: 1564560 - DNA, 16 bp, Homo sapiens
aagatagatcctttta

SEQ ID NO: 1564561 - DNA, 23 bp, Homo sapiens
aagatagatttggaataggaata

SEQ ID NO: 1564562 - DNA, 14 bp, Homo sapiens
aagataggctctgc

SEQ ID NO: 1564563 - DNA, 16 bp, Homo sapiens
aagatagtcttggaag

SEQ ID NO: 1564564 - DNA, 20 bp, Homo sapiens
aagatagtcttggaagctgt

SEQ ID NO: 1564565 - DNA, 21 bp, Homo sapiens
aagatagtgtaacttgcttaa

SEQ ID NO: 1564566 - DNA, 15 bp, Homo sapiens
aagatatacttgttt

SEQ ID NO: 1564567 - DNA, 18 bp, Homo sapiens
aagatatttatatatatt

SEQ ID NO: 1564568 - DNA, 17 bp, Homo sapiens
aagatatttttatcttt

SEQ ID NO: 1564569 - DNA, 17 bp, Homo sapiens
aagatcaccttgtattc

SEQ ID NO: 1564570 - DNA, 18 bp, Homo sapiens
aagatcaccttgtattct

SEQ ID NO: 1564571 - DNA, 24 bp, Homo sapiens
aagatcactgtagtttagttctgt

SEQ ID NO: 1564572 - DNA, 15 bp, Homo sapiens
aagatcactttctca

SEQ ID NO: 1564573 - DNA, 12 bp, Homo sapiens
aagatccagaaa

SEQ ID NO: 1564574 - DNA, 15 bp, Homo sapiens
aagatcctgaagcag

SEQ ID NO: 1564575 - DNA, 22 bp, Homo sapiens
aagatccttcgggtgctggaag

SEQ ID NO: 1564576 - DNA, 14 bp, Homo sapiens
aagatcgcatggca

SEQ ID NO: 1564577 - DNA, 14 bp, Homo sapiens
aagatcgttagtat

SEQ ID NO: 1564578 - DNA, 17 bp, Homo sapiens
aagatcgttctctgcct

SEQ ID NO: 1564579 - DNA, 18 bp, Homo sapiens
aagatctgtcctcagcct

SEQ ID NO: 1564580 - DNA, 19 bp, Homo sapiens
aagatctgtcctcagcctt

SEQ ID NO: 1564581 - DNA, 13 bp, Homo sapiens
aagatcttagatt

SEQ ID NO: 1564582 - DNA, 15 bp, Homo sapiens
aagatcttagattct

SEQ ID NO: 1564583 - DNA, 15 bp, Homo sapiens
aagatcttgtctcca

SEQ ID NO: 1564584 - DNA, 24 bp, Homo sapiens
aagatcttgtctccactaaatgag

SEQ ID NO: 1564585 - DNA, 13 bp, Homo sapiens
aagatctttcagg

SEQ ID NO: 1564586 - DNA, 14 bp, Homo sapiens
aagatgaaaatatt

SEQ ID NO: 1564587 - DNA, 13 bp, Homo sapiens
aagatgacacaag

SEQ ID NO: 1564588 - DNA, 18 bp, Homo sapiens
aagatgagagaactggag

SEQ ID NO: 1564589 - DNA, 18 bp, Homo sapiens
aagatgagatttgccagc

SEQ ID NO: 1564590 - DNA, 19 bp, Homo sapiens
aagatgagccttgcagata

SEQ ID NO: 1564591 - DNA, 17 bp, Homo sapiens
aagatgatctactcaga

SEQ ID NO: 1564592 - DNA, 23 bp, Homo sapiens
aagatgcactgaaaacttagcca

SEQ ID NO: 1564593 - DNA, 22 bp, Homo sapiens
aagatgccagcttctctctcca

SEQ ID NO: 1564594 - DNA, 11 bp, Homo sapiens
aagatgctgcc

SEQ ID NO: 1564595 - DNA, 11 bp, Homo sapiens
aagatgctggg

SEQ ID NO: 1564596 - DNA, 20 bp, Homo sapiens
aagatgctgggttggtgcac

SEQ ID NO: 1564597 - DNA, 14 bp, Homo sapiens
aagatgctgtaaat

SEQ ID NO: 1564598 - DNA, 15 bp, Homo sapiens
aagatgctgtaaata

SEQ ID NO: 1564599 - DNA, 21 bp, Homo sapiens
aagatgctgtaaataggttca

SEQ ID NO: 1564600 - DNA, 21 bp, Homo sapiens
aagatggaaattctgaaaact

SEQ ID NO: 1564601 - DNA, 20 bp, Homo sapiens
aagatggagacaccctctgg

SEQ ID NO: 1564602 - DNA, 14 bp, Homo sapiens
aagatggagtttct

SEQ ID NO: 1564603 - DNA, 18 bp, Homo sapiens
aagatggagtttctaagg

SEQ ID NO: 1564604 - DNA, 16 bp, Homo sapiens
aagatggctgctgcct

SEQ ID NO: 1564605 - DNA, 12 bp, Homo sapiens
aagatgggacag

SEQ ID NO: 1564606 - DNA, 13 bp, Homo sapiens
aagatgggacagc

SEQ ID NO: 1564607 - DNA, 19 bp, Homo sapiens
aagatgggggcagggctgt

SEQ ID NO: 1564608 - DNA, 16 bp, Homo sapiens
aagatggtatatttgg

SEQ ID NO: 1564609 - DNA, 15 bp, Homo sapiens
aagatggtccatttg

SEQ ID NO: 1564610 - DNA, 19 bp, Homo sapiens
aagatggtccgtgcccagg

SEQ ID NO: 1564611 - DNA, 22 bp, Homo sapiens
aagatggtccgtgcccaggccc

SEQ ID NO: 1564612 - DNA, 23 bp, Homo sapiens
aagatggtccgtgcccaggccct

SEQ ID NO: 1564613 - DNA, 22 bp, Homo sapiens
aagatggtttatgcatgtatat

SEQ ID NO: 1564614 - DNA, 17 bp, Homo sapiens
aagatgtacttctctgt

SEQ ID NO: 1564615 - DNA, 16 bp, Homo sapiens
aagatgtcaaagatat

SEQ ID NO: 1564616 - DNA, 16 bp, Homo sapiens
aagatgtcagactggc

SEQ ID NO: 1564617 - DNA, 14 bp, Homo sapiens
aagatgtgaaaact

SEQ ID NO: 1564618 - DNA, 14 bp, Homo sapiens
aagatgtgaaaatt

SEQ ID NO: 1564619 - DNA, 13 bp, Homo sapiens
aagatgtgaatta

SEQ ID NO: 1564620 - DNA, 23 bp, Homo sapiens
aagatgtgaattattgacactga

SEQ ID NO: 1564621 - DNA, 18 bp, Homo sapiens
aagatgtgatattctaag

SEQ ID NO: 1564622 - DNA, 17 bp, Homo sapiens
aagatgtgttcttattt

SEQ ID NO: 1564623 - DNA, 11 bp, Homo sapiens
aagatgttaag

SEQ ID NO: 1564624 - DNA, 17 bp, Homo sapiens
aagatgttaagcattta

SEQ ID NO: 1564625 - DNA, 13 bp, Homo sapiens
aagatgttccagt

SEQ ID NO: 1564626 - DNA, 16 bp, Homo sapiens
aagatgttgattttta

SEQ ID NO: 1564627 - DNA, 21 bp, Homo sapiens
aagatgtttgtttacataaga

SEQ ID NO: 1564628 - DNA, 14 bp, Homo sapiens
aagatgttttgtat

SEQ ID NO: 1564629 - DNA, 18 bp, Homo sapiens
aagatgttttgtataaaa

SEQ ID NO: 1564630 - DNA, 18 bp, Homo sapiens
aagattaaatgtgtcatt

SEQ ID NO: 1564631 - DNA, 16 bp, Homo sapiens
aagattaatctttaaa

SEQ ID NO: 1564632 - DNA, 12 bp, Homo sapiens
aagattaatttt

SEQ ID NO: 1564633 - DNA, 20 bp, Homo sapiens
aagattacaaatcagaagtc

SEQ ID NO: 1564634 - DNA, 20 bp, Homo sapiens
aagattacttagaggaaata

SEQ ID NO: 1564635 - DNA, 13 bp, Homo sapiens
aagattagaagct

SEQ ID NO: 1564636 - DNA, 20 bp, Homo sapiens
aagattattgtgacttcact

SEQ ID NO: 1564637 - DNA, 23 bp, Homo sapiens
aagattcacacctgactctgaaa

SEQ ID NO: 1564638 - DNA, 13 bp, Homo sapiens
aagattcccagag

SEQ ID NO: 1564639 - DNA, 14 bp, Homo sapiens
aagattcccagaga

SEQ ID NO: 1564640 - DNA, 12 bp, Homo sapiens
aagattctaaaa

SEQ ID NO: 1564641 - DNA, 23 bp, Homo sapiens
aagattctactcttgtcattttt

SEQ ID NO: 1564642 - DNA, 13 bp, Homo sapiens
aagattctagatc

SEQ ID NO: 1564643 - DNA, 17 bp, Homo sapiens
aagattctatagttcta

SEQ ID NO: 1564644 - DNA, 20 bp, Homo sapiens
aagattcttctgtgtttata

SEQ ID NO: 1564645 - DNA, 15 bp, Homo sapiens
aagattgagaagcca

SEQ ID NO: 1564646 - DNA, 14 bp, Homo sapiens
aagattgatatcta

SEQ ID NO: 1564647 - DNA, 18 bp, Homo sapiens
aagattgccccatctaga

SEQ ID NO: 1564648 - DNA, 13 bp, Homo sapiens
aagattggaaatg

SEQ ID NO: 1564649 - DNA, 17 bp, Homo sapiens
aagatttatcaaatcag

SEQ ID NO: 1564650 - DNA, 22 bp, Homo sapiens
aagatttatgaacagaaatatt

SEQ ID NO: 1564651 - DNA, 19 bp, Homo sapiens
aagatttccctaaaaattc

SEQ ID NO: 1564652 - DNA, 16 bp, Homo sapiens
aagatttccttgtgca

SEQ ID NO: 1564653 - DNA, 17 bp, Homo sapiens
aagatttggaaagatat

SEQ ID NO: 1564654 - DNA, 20 bp, Homo sapiens
aagatttgtgaactggaaga

SEQ ID NO: 1564655 - DNA, 20 bp, Homo sapiens
aagatttgttactgtatttt

SEQ ID NO: 1564656 - DNA, 13 bp, Homo sapiens
aagattttaaatt

SEQ ID NO: 1564657 - DNA, 14 bp, Homo sapiens
aagattttagggct

SEQ ID NO: 1564658 - DNA, 15 bp, Homo sapiens
aagattttattgtat

SEQ ID NO: 1564659 - DNA, 19 bp, Homo sapiens
aagattttgaaatttttat

SEQ ID NO: 1564660 - DNA, 15 bp, Homo sapiens
aagattttgaatgct

SEQ ID NO: 1564661 - DNA, 17 bp, Homo sapiens
aagattttgaatgcttc

SEQ ID NO: 1564662 - DNA, 21 bp, Homo sapiens
aagattttgaatgcttcctga

SEQ ID NO: 1564663 - DNA, 17 bp, Homo sapiens
aagatttttactaatat

SEQ ID NO: 1564664 - DNA, 22 bp, Homo sapiens
aagatttttactaatatatatt

SEQ ID NO: 1564665 - DNA, 20 bp, Homo sapiens
aagcaaaaggctgagaagga

SEQ ID NO: 1564666 - DNA, 12 bp, Homo sapiens
aagcaaacaagc

SEQ ID NO: 1564667 - DNA, 21 bp, Homo sapiens
aagcaaactctaaaattataa

SEQ ID NO: 1564668 - DNA, 14 bp, Homo sapiens
aagcaaagggctcc

SEQ ID NO: 1564669 - DNA, 16 bp, Homo sapiens
aagcaaatcatttgtt

SEQ ID NO: 1564670 - DNA, 17 bp, Homo sapiens
aagcaaatgttaaaagt

SEQ ID NO: 1564671 - DNA, 21 bp, Homo sapiens
aagcaacaaagattgagaagc

SEQ ID NO: 1564672 - DNA, 16 bp, Homo sapiens
aagcaacttcatttga

SEQ ID NO: 1564673 - DNA, 22 bp, Homo sapiens
aagcaagaggcaagctgaaatt

SEQ ID NO: 1564674 - DNA, 23 bp, Homo sapiens
aagcaagaggcaagctgaaattt

SEQ ID NO: 1564675 - DNA, 20 bp, Homo sapiens
aagcaagatgttttgtataa

SEQ ID NO: 1564676 - DNA, 13 bp, Homo sapiens
aagcaagggagaa

SEQ ID NO: 1564677 - DNA, 22 bp, Homo sapiens
aagcaagggagaaaagagaaac

SEQ ID NO: 1564678 - DNA, 20 bp, Homo sapiens
aagcaagggctccagcatcc

SEQ ID NO: 1564679 - DNA, 19 bp, Homo sapiens
aagcaagtaaaaaggctaa

SEQ ID NO: 1564680 - DNA, 12 bp, Homo sapiens
aagcaagtgttg

SEQ ID NO: 1564681 - DNA, 14 bp, Homo sapiens
aagcaataattgtt

SEQ ID NO: 1564682 - DNA, 17 bp, Homo sapiens
aagcaatactgtttcca

SEQ ID NO: 1564683 - DNA, 21 bp, Homo sapiens
aagcaattaggtagcacagca

SEQ ID NO: 1564684 - DNA, 18 bp, Homo sapiens
aagcacaacccaccacaa

SEQ ID NO: 1564685 - DNA, 23 bp, Homo sapiens
aagcacaagcagagtgcacagct

SEQ ID NO: 1564686 - DNA, 15 bp, Homo sapiens
aagcacaagtacttt

SEQ ID NO: 1564687 - DNA, 11 bp, Homo sapiens
aagcacacaca

SEQ ID NO: 1564688 - DNA, 18 bp, Homo sapiens
aagcacacacaataaaga

SEQ ID NO: 1564689 - DNA, 16 bp, Homo sapiens
aagcacacacatctgg

SEQ ID NO: 1564690 - DNA, 15 bp, Homo sapiens
aagcacactggaata

SEQ ID NO: 1564691 - DNA, 13 bp, Homo sapiens
aagcacagccctt

SEQ ID NO: 1564692 - DNA, 17 bp, Homo sapiens
aagcacagctcctgcca

SEQ ID NO: 1564693 - DNA, 20 bp, Homo sapiens
aagcacagtctgatgacaca

SEQ ID NO: 1564694 - DNA, 17 bp, Homo sapiens
aagcacagtttgaacaa

SEQ ID NO: 1564695 - DNA, 18 bp, Homo sapiens
aagcacagtttgaacaaa

SEQ ID NO: 1564696 - DNA, 16 bp, Homo sapiens
aagcacatctgcattt

SEQ ID NO: 1564697 - DNA, 13 bp, Homo sapiens
aagcacatgtaat

SEQ ID NO: 1564698 - DNA, 14 bp, Homo sapiens
aagcaccccatgcc

SEQ ID NO: 1564699 - DNA, 23 bp, Homo sapiens
aagcactacaccttgccttgctg

SEQ ID NO: 1564700 - DNA, 19 bp, Homo sapiens
aagcactattttatattta

SEQ ID NO: 1564701 - DNA, 16 bp, Homo sapiens
aagcactgacctgtca

SEQ ID NO: 1564702 - DNA, 17 bp, Homo sapiens
aagcactgacttctaag

SEQ ID NO: 1564703 - DNA, 12 bp, Homo sapiens
aagcactgctca

SEQ ID NO: 1564704 - DNA, 21 bp, Homo sapiens
aagcacttaagtcttccttaa

SEQ ID NO: 1564705 - DNA, 18 bp, Homo sapiens
aagcactttaatggcctg

SEQ ID NO: 1564706 - DNA, 20 bp, Homo sapiens
aagcacttttaaaaaaattt

SEQ ID NO: 1564707 - DNA, 13 bp, Homo sapiens
aagcagaacaaat

SEQ ID NO: 1564708 - DNA, 16 bp, Homo sapiens
aagcagaacaaatgtg

SEQ ID NO: 1564709 - DNA, 17 bp, Homo sapiens
aagcagaagtctggctt

SEQ ID NO: 1564710 - DNA, 17 bp, Homo sapiens
aagcagaatcctcagtt

SEQ ID NO: 1564711 - DNA, 19 bp, Homo sapiens
aagcagagtgcacagctgt

SEQ ID NO: 1564712 - DNA, 20 bp, Homo sapiens
aagcagagtgcacagctgtc

SEQ ID NO: 1564713 - DNA, 17 bp, Homo sapiens
aagcagagtggactgca

SEQ ID NO: 1564714 - DNA, 15 bp, Homo sapiens
aagcagagttttcat

SEQ ID NO: 1564715 - DNA, 19 bp, Homo sapiens
aagcagatggaatgctgtg

SEQ ID NO: 1564716 - DNA, 15 bp, Homo sapiens
aagcagcactgtgag

SEQ ID NO: 1564717 - DNA, 18 bp, Homo sapiens
aagcagcagctaggactg

SEQ ID NO: 1564718 - DNA, 16 bp, Homo sapiens
aagcagcatcttctgg

SEQ ID NO: 1564719 - DNA, 14 bp, Homo sapiens
aagcagcatggaaa

SEQ ID NO: 1564720 - DNA, 15 bp, Homo sapiens
aagcagcatggaaaa

SEQ ID NO: 1564721 - DNA, 19 bp, Homo sapiens
aagcagcatggaaaaatgg

SEQ ID NO: 1564722 - DNA, 16 bp, Homo sapiens
aagcagcattctggag

SEQ ID NO: 1564723 - DNA, 10 bp, Homo sapiens
aagcagccag

SEQ ID NO: 1564724 - DNA, 22 bp, Homo sapiens
aagcagccagccagtcttgcct

SEQ ID NO: 1564725 - DNA, 16 bp, Homo sapiens
aagcagccagccgtga

SEQ ID NO: 1564726 - DNA, 17 bp, Homo sapiens
aagcagcctcagagtgg

SEQ ID NO: 1564727 - DNA, 17 bp, Homo sapiens
aagcagcctctccccag

SEQ ID NO: 1564728 - DNA, 22 bp, Homo sapiens
aagcagcctctccccaggtcca

SEQ ID NO: 1564729 - DNA, 24 bp, Homo sapiens
aagcagctaaatgtaacttattcc

SEQ ID NO: 1564730 - DNA, 22 bp, Homo sapiens
aagcagctggtcagtctttgct

SEQ ID NO: 1564731 - DNA, 13 bp, Homo sapiens
aagcagctttaaa

SEQ ID NO: 1564732 - DNA, 23 bp, Homo sapiens
aagcaggactttgaggcaagtgt

SEQ ID NO: 1564733 - DNA, 15 bp, Homo sapiens
aagcaggagcagctg

SEQ ID NO: 1564734 - DNA, 20 bp, Homo sapiens
aagcagggaaagctccacgg

SEQ ID NO: 1564735 - DNA, 17 bp, Homo sapiens
aagcaggtgctacaaca

SEQ ID NO: 1564736 - DNA, 20 bp, Homo sapiens
aagcaggtggatctatttca

SEQ ID NO: 1564737 - DNA, 16 bp, Homo sapiens
aagcaggttcttgatg

SEQ ID NO: 1564738 - DNA, 17 bp, Homo sapiens
aagcagtaaatttgcta

SEQ ID NO: 1564739 - DNA, 21 bp, Homo sapiens
aagcagtagaaataatatgca

SEQ ID NO: 1564740 - DNA, 22 bp, Homo sapiens
aagcagtagaaataatatgcat

SEQ ID NO: 1564741 - DNA, 13 bp, Homo sapiens
aagcagtattttg

SEQ ID NO: 1564742 - DNA, 15 bp, Homo sapiens
aagcagtattttggt

SEQ ID NO: 1564743 - DNA, 23 bp, Homo sapiens
aagcagtcctcccaccttggcct

SEQ ID NO: 1564744 - DNA, 20 bp, Homo sapiens
aagcagtcctcttattccta

SEQ ID NO: 1564745 - DNA, 17 bp, Homo sapiens
aagcagtcgtgcctgtg

SEQ ID NO: 1564746 - DNA, 14 bp, Homo sapiens
aagcagtcttgctc

SEQ ID NO: 1564747 - DNA, 12 bp, Homo sapiens
aagcagtgcctc

SEQ ID NO: 1564748 - DNA, 20 bp, Homo sapiens
aagcagtgcctcgaggcacc

SEQ ID NO: 1564749 - DNA, 17 bp, Homo sapiens
aagcagtgccttccata

SEQ ID NO: 1564750 - DNA, 18 bp, Homo sapiens
aagcagtgccttccataa

SEQ ID NO: 1564751 - DNA, 21 bp, Homo sapiens
aagcagttatggtgatgactt

SEQ ID NO: 1564752 - DNA, 14 bp, Homo sapiens
aagcagttttgtaa

SEQ ID NO: 1564753 - DNA, 16 bp, Homo sapiens
aagcagttttgtaaat

SEQ ID NO: 1564754 - DNA, 15 bp, Homo sapiens
aagcataaaaacatt

SEQ ID NO: 1564755 - DNA, 14 bp, Homo sapiens
aagcataaaacttt

SEQ ID NO: 1564756 - DNA, 13 bp, Homo sapiens
aagcataaggccg

SEQ ID NO: 1564757 - DNA, 18 bp, Homo sapiens
aagcatactttgtaaata

SEQ ID NO: 1564758 - DNA, 20 bp, Homo sapiens
aagcatagataatattgttt

SEQ ID NO: 1564759 - DNA, 21 bp, Homo sapiens
aagcatatataactattttaa

SEQ ID NO: 1564760 - DNA, 21 bp, Homo sapiens
aagcatatgggttagatgttg

SEQ ID NO: 1564761 - DNA, 17 bp, Homo sapiens
aagcatattttgctggt

SEQ ID NO: 1564762 - DNA, 19 bp, Homo sapiens
aagcatcacctcaggccag

SEQ ID NO: 1564763 - DNA, 23 bp, Homo sapiens
aagcatcacctcaggccaggtgc

SEQ ID NO: 1564764 - DNA, 19 bp, Homo sapiens
aagcatcagttctacggat

SEQ ID NO: 1564765 - DNA, 23 bp, Homo sapiens
aagcatccctcacccatcctaga

SEQ ID NO: 1564766 - DNA, 13 bp, Homo sapiens
aagcatctaagtt

SEQ ID NO: 1564767 - DNA, 18 bp, Homo sapiens
aagcatctaagttataag

SEQ ID NO: 1564768 - DNA, 17 bp, Homo sapiens
aagcatctggctctaat

SEQ ID NO: 1564769 - DNA, 14 bp, Homo sapiens
aagcatgaaatgtg

SEQ ID NO: 1564770 - DNA, 17 bp, Homo sapiens
aagcatgaaatgtgaat

SEQ ID NO: 1564771 - DNA, 19 bp, Homo sapiens
aagcatgacagaaaatatg

SEQ ID NO: 1564772 - DNA, 20 bp, Homo sapiens
aagcatgacagaaaatatgt

SEQ ID NO: 1564773 - DNA, 15 bp, Homo sapiens
aagcatgatgggaaa

SEQ ID NO: 1564774 - DNA, 21 bp, Homo sapiens
aagcatgcttgtgaaaatgtg

SEQ ID NO: 1564775 - DNA, 17 bp, Homo sapiens
aagcatgctttgctgct

SEQ ID NO: 1564776 - DNA, 20 bp, Homo sapiens
aagcatgctttgctgctatg

SEQ ID NO: 1564777 - DNA, 11 bp, Homo sapiens
aagcatggact

SEQ ID NO: 1564778 - DNA, 16 bp, Homo sapiens
aagcatggcctggact

SEQ ID NO: 1564779 - DNA, 13 bp, Homo sapiens
aagcatgtcaatt

SEQ ID NO: 1564780 - DNA, 21 bp, Homo sapiens
aagcatgtctctctgccaaga

SEQ ID NO: 1564781 - DNA, 19 bp, Homo sapiens
aagcatgtggcatgttcat

SEQ ID NO: 1564782 - DNA, 18 bp, Homo sapiens
aagcattaagaacacttt

SEQ ID NO: 1564783 - DNA, 14 bp, Homo sapiens
aagcattgcctgga

SEQ ID NO: 1564784 - DNA, 16 bp, Homo sapiens
aagcattgcctggact

SEQ ID NO: 1564785 - DNA, 18 bp, Homo sapiens
aagcattgcctggactga

SEQ ID NO: 1564786 - DNA, 22 bp, Homo sapiens
aagcattgcctggactgaccac

SEQ ID NO: 1564787 - DNA, 15 bp, Homo sapiens
aagcattgtaaaata

SEQ ID NO: 1564788 - DNA, 18 bp, Homo sapiens
aagcattgtaaaataatt

SEQ ID NO: 1564789 - DNA, 13 bp, Homo sapiens
aagcattgtaaat

SEQ ID NO: 1564790 - DNA, 19 bp, Homo sapiens
aagcattgtaaatgtgctt

SEQ ID NO: 1564791 - DNA, 19 bp, Homo sapiens
aagcatttcaaagccctgc

SEQ ID NO: 1564792 - DNA, 19 bp, Homo sapiens
aagcatttcatgaaaaagc

SEQ ID NO: 1564793 - DNA, 20 bp, Homo sapiens
aagcattttgaaacaaagta

SEQ ID NO: 1564794 - DNA, 19 bp, Homo sapiens
aagcatttttcaatatatt

SEQ ID NO: 1564795 - DNA, 18 bp, Homo sapiens
aagccaaactcaggccca

SEQ ID NO: 1564796 - DNA, 14 bp, Homo sapiens
aagccaaactctgc

SEQ ID NO: 1564797 - DNA, 16 bp, Homo sapiens
aagccaaactctgcca

SEQ ID NO: 1564798 - DNA, 20 bp, Homo sapiens
aagccaaactctgccagcca

SEQ ID NO: 1564799 - DNA, 12 bp, Homo sapiens
aagccaaagaaa

SEQ ID NO: 1564800 - DNA, 19 bp, Homo sapiens
aagccaaagagcctcccac

SEQ ID NO: 1564801 - DNA, 14 bp, Homo sapiens
aagccaaaggcagc

SEQ ID NO: 1564802 - DNA, 19 bp, Homo sapiens
aagccaaaggtcaaacagg

SEQ ID NO: 1564803 - DNA, 22 bp, Homo sapiens
aagccaaagttttcaaactgct

SEQ ID NO: 1564804 - DNA, 16 bp, Homo sapiens
aagccaacaactctgc

SEQ ID NO: 1564805 - DNA, 20 bp, Homo sapiens
aagccaacaactctgccttt

SEQ ID NO: 1564806 - DNA, 23 bp, Homo sapiens
aagccaacaactctgcctttatg

SEQ ID NO: 1564807 - DNA, 16 bp, Homo sapiens
aagccaacaccctgtc

SEQ ID NO: 1564808 - DNA, 17 bp, Homo sapiens
aagccaacttgtaaata

SEQ ID NO: 1564809 - DNA, 24 bp, Homo sapiens
aagccaaggcagcgaccccaggac

SEQ ID NO: 1564810 - DNA, 14 bp, Homo sapiens
aagccaagggaaag

SEQ ID NO: 1564811 - DNA, 23 bp, Homo sapiens
aagccaagggaaaggggtgcttt

SEQ ID NO: 1564812 - DNA, 18 bp, Homo sapiens
aagccaagggaacctgtg

SEQ ID NO: 1564813 - DNA, 13 bp, Homo sapiens
aagccaagtgggg

SEQ ID NO: 1564814 - DNA, 15 bp, Homo sapiens
aagccaatcccctcc

SEQ ID NO: 1564815 - DNA, 16 bp, Homo sapiens
aagccaatcccctcct

SEQ ID NO: 1564816 - DNA, 19 bp, Homo sapiens
aagccaatcccctccttgg

SEQ ID NO: 1564817 - DNA, 12 bp, Homo sapiens
aagccacagaaa

SEQ ID NO: 1564818 - DNA, 14 bp, Homo sapiens
aagccacaggcctg

SEQ ID NO: 1564819 - DNA, 17 bp, Homo sapiens
aagccacaggcctgaga

SEQ ID NO: 1564820 - DNA, 22 bp, Homo sapiens
aagccacaggcctgagatttca

SEQ ID NO: 1564821 - DNA, 14 bp, Homo sapiens
aagccacagtgccc

SEQ ID NO: 1564822 - DNA, 18 bp, Homo sapiens
aagccaccatccccaccc

SEQ ID NO: 1564823 - DNA, 14 bp, Homo sapiens
aagccactgaagct

SEQ ID NO: 1564824 - DNA, 14 bp, Homo sapiens
aagccactggaagg

SEQ ID NO: 1564825 - DNA, 15 bp, Homo sapiens
aagccactggaagga

SEQ ID NO: 1564826 - DNA, 20 bp, Homo sapiens
aagccactggaaggagcaca

SEQ ID NO: 1564827 - DNA, 20 bp, Homo sapiens
aagccagaagctaagctgca

SEQ ID NO: 1564828 - DNA, 14 bp, Homo sapiens
aagccagagcctgg

SEQ ID NO: 1564829 - DNA, 20 bp, Homo sapiens
aagccagaggagaagacaac

SEQ ID NO: 1564830 - DNA, 21 bp, Homo sapiens
aagccagagtttttaaagcct

SEQ ID NO: 1564831 - DNA, 20 bp, Homo sapiens
aagccagccaagctttaaat

SEQ ID NO: 1564832 - DNA, 22 bp, Homo sapiens
aagccagccaagctttaaatta

SEQ ID NO: 1564833 - DNA, 12 bp, Homo sapiens
aagccagccaca

SEQ ID NO: 1564834 - DNA, 19 bp, Homo sapiens
aagccagccacagacccct

SEQ ID NO: 1564835 - DNA, 21 bp, Homo sapiens
aagccagctgccgaccagagc

SEQ ID NO: 1564836 - DNA, 15 bp, Homo sapiens
aagccagctttccct

SEQ ID NO: 1564837 - DNA, 23 bp, Homo sapiens
aagccagctttccctgcctctca

SEQ ID NO: 1564838 - DNA, 21 bp, Homo sapiens
aagccaggaatttcccaggac

SEQ ID NO: 1564839 - DNA, 23 bp, Homo sapiens
aagccaggaatttcccaggaccc

SEQ ID NO: 1564840 - DNA, 18 bp, Homo sapiens
aagccaggctgagtgagc

SEQ ID NO: 1564841 - DNA, 16 bp, Homo sapiens
aagccagggtgtgtct

SEQ ID NO: 1564842 - DNA, 14 bp, Homo sapiens
aagccaggtacagg

SEQ ID NO: 1564843 - DNA, 23 bp, Homo sapiens
aagccagtggggtcccccctgag

SEQ ID NO: 1564844 - DNA, 21 bp, Homo sapiens
aagccatcacttctccccgca

SEQ ID NO: 1564845 - DNA, 18 bp, Homo sapiens
aagccatcatcctccatt

SEQ ID NO: 1564846 - DNA, 22 bp, Homo sapiens
aagccatgagttccagaaagta

SEQ ID NO: 1564847 - DNA, 13 bp, Homo sapiens
aagccatgtgctg

SEQ ID NO: 1564848 - DNA, 16 bp, Homo sapiens
aagccatgtgctgcgg

SEQ ID NO: 1564849 - DNA, 23 bp, Homo sapiens
aagccatgtgctgcggtcactca

SEQ ID NO: 1564850 - DNA, 20 bp, Homo sapiens
aagccattctaaggaaatta

SEQ ID NO: 1564851 - DNA, 22 bp, Homo sapiens
aagccattctcctgcctcagcc

SEQ ID NO: 1564852 - DNA, 16 bp, Homo sapiens
aagcccaacctcctga

SEQ ID NO: 1564853 - DNA, 13 bp, Homo sapiens
aagcccaactgtg

SEQ ID NO: 1564854 - DNA, 12 bp, Homo sapiens
aagcccaggctc

SEQ ID NO: 1564855 - DNA, 17 bp, Homo sapiens
aagcccaggcttcctgg

SEQ ID NO: 1564856 - DNA, 20 bp, Homo sapiens
aagcccatgagtccttgaaa

SEQ ID NO: 1564857 - DNA, 21 bp, Homo sapiens
aagcccattttcaactgcttt

SEQ ID NO: 1564858 - DNA, 15 bp, Homo sapiens
aagccccatttcctc

SEQ ID NO: 1564859 - DNA, 12 bp, Homo sapiens
aagcccccaggg

SEQ ID NO: 1564860 - DNA, 13 bp, Homo sapiens
aagcccccagggc

SEQ ID NO: 1564861 - DNA, 21 bp, Homo sapiens
aagcccccagggcctccaggg

SEQ ID NO: 1564862 - DNA, 17 bp, Homo sapiens
aagccccctcttcctcc

SEQ ID NO: 1564863 - DNA, 15 bp, Homo sapiens
aagcccctcagccct

SEQ ID NO: 1564864 - DNA, 16 bp, Homo sapiens
aagcccctcagccctt

SEQ ID NO: 1564865 - DNA, 20 bp, Homo sapiens
aagcccctcagcccttgccc

SEQ ID NO: 1564866 - DNA, 14 bp, Homo sapiens
aagccccttggaga

SEQ ID NO: 1564867 - DNA, 17 bp, Homo sapiens
aagcccgacttgctgtt

SEQ ID NO: 1564868 - DNA, 16 bp, Homo sapiens
aagccctacagagctg

SEQ ID NO: 1564869 - DNA, 21 bp, Homo sapiens
aagccctcaaagaagtcggaa

SEQ ID NO: 1564870 - DNA, 12 bp, Homo sapiens
aagccctccttc

SEQ ID NO: 1564871 - DNA, 13 bp, Homo sapiens
aagccctgcctct

SEQ ID NO: 1564872 - DNA, 15 bp, Homo sapiens
aagccctgcctctgt

SEQ ID NO: 1564873 - DNA, 18 bp, Homo sapiens
aagccctgtcgagacact

SEQ ID NO: 1564874 - DNA, 19 bp, Homo sapiens
aagccctgtcgagacactt

SEQ ID NO: 1564875 - DNA, 20 bp, Homo sapiens
aagccctgtcgagacacttg

SEQ ID NO: 1564876 - DNA, 18 bp, Homo sapiens
aagccctgttctcctgtc

SEQ ID NO: 1564877 - DNA, 23 bp, Homo sapiens
aagcccttggaacaccctggatg

SEQ ID NO: 1564878 - DNA, 16 bp, Homo sapiens
aagccctttgctctgg

SEQ ID NO: 1564879 - DNA, 16 bp, Homo sapiens
aagccgactctggccc

SEQ ID NO: 1564880 - DNA, 19 bp, Homo sapiens
aagccgcaagctctcagca

SEQ ID NO: 1564881 - DNA, 18 bp, Homo sapiens
aagccggacacggcttca

SEQ ID NO: 1564882 - DNA, 20 bp, Homo sapiens
aagccggacagctgcccaga

SEQ ID NO: 1564883 - DNA, 19 bp, Homo sapiens
aagccggcggcccaagccc

SEQ ID NO: 1564884 - DNA, 13 bp, Homo sapiens
aagccgtcctggc

SEQ ID NO: 1564885 - DNA, 13 bp, Homo sapiens
aagccgtggcttc

SEQ ID NO: 1564886 - DNA, 22 bp, Homo sapiens
aagccgttgtttacttaaagat

SEQ ID NO: 1564887 - DNA, 14 bp, Homo sapiens
aagcctaaatttgt

SEQ ID NO: 1564888 - DNA, 16 bp, Homo sapiens
aagcctaaatttgtgc

SEQ ID NO: 1564889 - DNA, 23 bp, Homo sapiens
aagcctagacaacctttctgtag

SEQ ID NO: 1564890 - DNA, 23 bp, Homo sapiens
aagcctcaaggttttaggttcta

SEQ ID NO: 1564891 - DNA, 22 bp, Homo sapiens
aagcctcatttgaatgtgtgaa

SEQ ID NO: 1564892 - DNA, 19 bp, Homo sapiens
aagcctccaagcctgcctc

SEQ ID NO: 1564893 - DNA, 19 bp, Homo sapiens
aagcctccgctgggcttca

SEQ ID NO: 1564894 - DNA, 17 bp, Homo sapiens
aagcctctctccttggc

SEQ ID NO: 1564895 - DNA, 14 bp, Homo sapiens
aagcctctctctcc

SEQ ID NO: 1564896 - DNA, 11 bp, Homo sapiens
aagcctctgct

SEQ ID NO: 1564897 - DNA, 19 bp, Homo sapiens
aagcctctggccgtcacac

SEQ ID NO: 1564898 - DNA, 13 bp, Homo sapiens
aagcctcttctga

SEQ ID NO: 1564899 - DNA, 12 bp, Homo sapiens
aagcctctttct

SEQ ID NO: 1564900 - DNA, 22 bp, Homo sapiens
aagcctgaactatttattaaaa

SEQ ID NO: 1564901 - DNA, 23 bp, Homo sapiens
aagcctgatactttagccatcat

SEQ ID NO: 1564902 - DNA, 13 bp, Homo sapiens
aagcctgatccag

SEQ ID NO: 1564903 - DNA, 21 bp, Homo sapiens
aagcctgcacaataaaaatgt

SEQ ID NO: 1564904 - DNA, 22 bp, Homo sapiens
aagcctgcacaataaaaatgtt

SEQ ID NO: 1564905 - DNA, 12 bp, Homo sapiens
aagcctgcattc

SEQ ID NO: 1564906 - DNA, 15 bp, Homo sapiens
aagcctgcattctta

SEQ ID NO: 1564907 - DNA, 21 bp, Homo sapiens
aagcctgcctaggaattccca

SEQ ID NO: 1564908 - DNA, 23 bp, Homo sapiens
aagcctgcctaggaattcccagc

SEQ ID NO: 1564909 - DNA, 15 bp, Homo sapiens
aagcctgctggctgc

SEQ ID NO: 1564910 - DNA, 14 bp, Homo sapiens
aagcctggaaaaaa

SEQ ID NO: 1564911 - DNA, 22 bp, Homo sapiens
aagcctggatgccaaggagccc

SEQ ID NO: 1564912 - DNA, 17 bp, Homo sapiens
aagcctgtaatcccagc

SEQ ID NO: 1564913 - DNA, 13 bp, Homo sapiens
aagccttaaaaat

SEQ ID NO: 1564914 - DNA, 12 bp, Homo sapiens
aagccttacaaa

SEQ ID NO: 1564915 - DNA, 16 bp, Homo sapiens
aagccttcagctccag

SEQ ID NO: 1564916 - DNA, 19 bp, Homo sapiens
aagccttcagctccaggga

SEQ ID NO: 1564917 - DNA, 16 bp, Homo sapiens
aagccttcattgcctt

SEQ ID NO: 1564918 - DNA, 13 bp, Homo sapiens
aagccttctggat

SEQ ID NO: 1564919 - DNA, 15 bp, Homo sapiens
aagccttctggatcc

SEQ ID NO: 1564920 - DNA, 21 bp, Homo sapiens
aagccttctggatccatgggg

SEQ ID NO: 1564921 - DNA, 17 bp, Homo sapiens
aagcctttcattttgct

SEQ ID NO: 1564922 - DNA, 15 bp, Homo sapiens
aagcctttccataag

SEQ ID NO: 1564923 - DNA, 19 bp, Homo sapiens
aagcctttgtatctttctt

SEQ ID NO: 1564924 - DNA, 14 bp, Homo sapiens
aagcctttgttgaa

SEQ ID NO: 1564925 - DNA, 16 bp, Homo sapiens
aagcgaagatgatttc

SEQ ID NO: 1564926 - DNA, 19 bp, Homo sapiens
aagcgacctctcttgaggt

SEQ ID NO: 1564927 - DNA, 16 bp, Homo sapiens
aagcgcttctgctgaa

SEQ ID NO: 1564928 - DNA, 17 bp, Homo sapiens
aagcgcttctgctgaaa

SEQ ID NO: 1564929 - DNA, 20 bp, Homo sapiens
aagcggccctaagggagtgt

SEQ ID NO: 1564930 - DNA, 13 bp, Homo sapiens
aagcggggggagg

SEQ ID NO: 1564931 - DNA, 12 bp, Homo sapiens
aagcgtttttct

SEQ ID NO: 1564932 - DNA, 16 bp, Homo sapiens
aagctaaaaggaaaag

SEQ ID NO: 1564933 - DNA, 12 bp, Homo sapiens
aagctaaaatgt

SEQ ID NO: 1564934 - DNA, 21 bp, Homo sapiens
aagctaatgtgcagggatatt

SEQ ID NO: 1564935 - DNA, 21 bp, Homo sapiens
aagctagacacatgaaggtaa

SEQ ID NO: 1564936 - DNA, 14 bp, Homo sapiens
aagctaggccccag

SEQ ID NO: 1564937 - DNA, 15 bp, Homo sapiens
aagctagggtggccc

SEQ ID NO: 1564938 - DNA, 18 bp, Homo sapiens
aagctagtggcttcaaaa

SEQ ID NO: 1564939 - DNA, 13 bp, Homo sapiens
aagctataaagca

SEQ ID NO: 1564940 - DNA, 21 bp, Homo sapiens
aagctatcacctagcagcctc

SEQ ID NO: 1564941 - DNA, 23 bp, Homo sapiens
aagctattggaatttttttttcc

SEQ ID NO: 1564942 - DNA, 15 bp, Homo sapiens
aagctattgtctgta

SEQ ID NO: 1564943 - DNA, 23 bp, Homo sapiens
aagctatttaatatctggcactg

SEQ ID NO: 1564944 - DNA, 17 bp, Homo sapiens
aagctatttatctgtag

SEQ ID NO: 1564945 - DNA, 17 bp, Homo sapiens
aagctatttatgggccc

SEQ ID NO: 1564946 - DNA, 18 bp, Homo sapiens
aagctcaaataaaaataa

SEQ ID NO: 1564947 - DNA, 17 bp, Homo sapiens
aagctcaaatgaaatgt

SEQ ID NO: 1564948 - DNA, 18 bp, Homo sapiens
aagctcaaatgaaatgta

SEQ ID NO: 1564949 - DNA, 16 bp, Homo sapiens
aagctcacaccaaatt

SEQ ID NO: 1564950 - DNA, 15 bp, Homo sapiens
aagctcacagttcct

SEQ ID NO: 1564951 - DNA, 18 bp, Homo sapiens
aagctcacgtcctgagaa

SEQ ID NO: 1564952 - DNA, 23 bp, Homo sapiens
aagctcacttctgggcttcatct

SEQ ID NO: 1564953 - DNA, 12 bp, Homo sapiens
aagctcagaatc

SEQ ID NO: 1564954 - DNA, 15 bp, Homo sapiens
aagctcagaatccaa

SEQ ID NO: 1564955 - DNA, 15 bp, Homo sapiens
aagctcagccttctc

SEQ ID NO: 1564956 - DNA, 13 bp, Homo sapiens
aagctcaggaggg

SEQ ID NO: 1564957 - DNA, 20 bp, Homo sapiens
aagctcatagaggtgagaaa

SEQ ID NO: 1564958 - DNA, 22 bp, Homo sapiens
aagctcattcccaacgtgcaaa

SEQ ID NO: 1564959 - DNA, 21 bp, Homo sapiens
aagctcctctccccagcccag

SEQ ID NO: 1564960 - DNA, 12 bp, Homo sapiens
aagctcctgcta

SEQ ID NO: 1564961 - DNA, 22 bp, Homo sapiens
aagctccttgagtaaaaaggtg

SEQ ID NO: 1564962 - DNA, 20 bp, Homo sapiens
aagctctagttcttaacaac

SEQ ID NO: 1564963 - DNA, 17 bp, Homo sapiens
aagctctccgagctctg

SEQ ID NO: 1564964 - DNA, 18 bp, Homo sapiens
aagctctccgagctctgg

SEQ ID NO: 1564965 - DNA, 22 bp, Homo sapiens
aagctctctgcatctactccca

SEQ ID NO: 1564966 - DNA, 20 bp, Homo sapiens
aagctctctgggcctgggtt

SEQ ID NO: 1564967 - DNA, 12 bp, Homo sapiens
aagctctcttaa

SEQ ID NO: 1564968 - DNA, 12 bp, Homo sapiens
aagctctgaagt

SEQ ID NO: 1564969 - DNA, 16 bp, Homo sapiens
aagctctgaagtcaca

SEQ ID NO: 1564970 - DNA, 12 bp, Homo sapiens
aagctctgacat

SEQ ID NO: 1564971 - DNA, 18 bp, Homo sapiens
aagctctggccccaggct

SEQ ID NO: 1564972 - DNA, 22 bp, Homo sapiens
aagctctggctgaaccctgtgc

SEQ ID NO: 1564973 - DNA, 23 bp, Homo sapiens
aagctctgttccatgcaactgga

SEQ ID NO: 1564974 - DNA, 15 bp, Homo sapiens
aagctctttgagaac

SEQ ID NO: 1564975 - DNA, 12 bp, Homo sapiens
aagctgaaattt

SEQ ID NO: 1564976 - DNA, 20 bp, Homo sapiens
aagctgaaattttagaaata

SEQ ID NO: 1564977 - DNA, 22 bp, Homo sapiens
aagctgaaattttagaaatatt

SEQ ID NO: 1564978 - DNA, 17 bp, Homo sapiens
aagctgaaccccctcca

SEQ ID NO: 1564979 - DNA, 22 bp, Homo sapiens
aagctgaactaaaataaaaatg

SEQ ID NO: 1564980 - DNA, 18 bp, Homo sapiens
aagctgaagaccatggat

SEQ ID NO: 1564981 - DNA, 22 bp, Homo sapiens
aagctgaagattaggcacacag

SEQ ID NO: 1564982 - DNA, 23 bp, Homo sapiens
aagctgaatacattctgctttca

SEQ ID NO: 1564983 - DNA, 13 bp, Homo sapiens
aagctgaatcccg

SEQ ID NO: 1564984 - DNA, 11 bp, Homo sapiens
aagctgagcct

SEQ ID NO: 1564985 - DNA, 15 bp, Homo sapiens
aagctgagcctgcag

SEQ ID NO: 1564986 - DNA, 21 bp, Homo sapiens
aagctgagttacttgtctgag

SEQ ID NO: 1564987 - DNA, 23 bp, Homo sapiens
aagctgagttaggtgtctgtcct

SEQ ID NO: 1564988 - DNA, 15 bp, Homo sapiens
aagctgagtttccta

SEQ ID NO: 1564989 - DNA, 19 bp, Homo sapiens
aagctgatattatttcttc

SEQ ID NO: 1564990 - DNA, 20 bp, Homo sapiens
aagctgatattatttcttct

SEQ ID NO: 1564991 - DNA, 17 bp, Homo sapiens
aagctgattactgtcaa

SEQ ID NO: 1564992 - DNA, 19 bp, Homo sapiens
aagctgattactgtcaata

SEQ ID NO: 1564993 - DNA, 19 bp, Homo sapiens
aagctgcaaatctgatggc

SEQ ID NO: 1564994 - DNA, 15 bp, Homo sapiens
aagctgccctgccca

SEQ ID NO: 1564995 - DNA, 21 bp, Homo sapiens
aagctgccgaaccaaaagaat

SEQ ID NO: 1564996 - DNA, 15 bp, Homo sapiens
aagctgcctctgggc

SEQ ID NO: 1564997 - DNA, 20 bp, Homo sapiens
aagctgcctggtatatccaa

SEQ ID NO: 1564998 - DNA, 12 bp, Homo sapiens
aagctgctctga

SEQ ID NO: 1564999 - DNA, 20 bp, Homo sapiens
aagctgctctgagccacagt

SEQ ID NO: 1565000 - DNA, 13 bp, Homo sapiens
aagctgctgacca

SEQ ID NO: 1565001 - DNA, 13 bp, Homo sapiens
aagctgctgcagc

SEQ ID NO: 1565002 - DNA, 19 bp, Homo sapiens
aagctgcttgtcctgggcc

SEQ ID NO: 1565003 - DNA, 15 bp, Homo sapiens
aagctggaacatttg

SEQ ID NO: 1565004 - DNA, 14 bp, Homo sapiens
aagctggactgacc

SEQ ID NO: 1565005 - DNA, 16 bp, Homo sapiens
aagctggactgaccaa

SEQ ID NO: 1565006 - DNA, 13 bp, Homo sapiens
aagctggagcagc

SEQ ID NO: 1565007 - DNA, 16 bp, Homo sapiens
aagctggagcagcgga

SEQ ID NO: 1565008 - DNA, 21 bp, Homo sapiens
aagctggagcagcggattgct

SEQ ID NO: 1565009 - DNA, 20 bp, Homo sapiens
aagctggagctcttggaaga

SEQ ID NO: 1565010 - DNA, 19 bp, Homo sapiens
aagctggcagaacggagga

SEQ ID NO: 1565011 - DNA, 12 bp, Homo sapiens
aagctggctctg

SEQ ID NO: 1565012 - DNA, 15 bp, Homo sapiens
aagctgggccgaggc

SEQ ID NO: 1565013 - DNA, 18 bp, Homo sapiens
aagctgtactcagagcag

SEQ ID NO: 1565014 - DNA, 13 bp, Homo sapiens
aagctgtactttt

SEQ ID NO: 1565015 - DNA, 12 bp, Homo sapiens
aagctgtcccct

SEQ ID NO: 1565016 - DNA, 17 bp, Homo sapiens
aagctgtggcagccgtc

SEQ ID NO: 1565017 - DNA, 13 bp, Homo sapiens
aagctgtggccag

SEQ ID NO: 1565018 - DNA, 21 bp, Homo sapiens
aagctgttattcttgttatac

SEQ ID NO: 1565019 - DNA, 16 bp, Homo sapiens
aagctgttatttcttc

SEQ ID NO: 1565020 - DNA, 17 bp, Homo sapiens
aagctgttatttcttcc

SEQ ID NO: 1565021 - DNA, 16 bp, Homo sapiens
aagctgttgggagaaa

SEQ ID NO: 1565022 - DNA, 15 bp, Homo sapiens
aagctgtttccatag

SEQ ID NO: 1565023 - DNA, 18 bp, Homo sapiens
aagcttattaaaactcat

SEQ ID NO: 1565024 - DNA, 20 bp, Homo sapiens
aagcttcaaagtttatatgc

SEQ ID NO: 1565025 - DNA, 15 bp, Homo sapiens
aagcttcaaccctca

SEQ ID NO: 1565026 - DNA, 18 bp, Homo sapiens
aagcttcaaccctcagcc

SEQ ID NO: 1565027 - DNA, 19 bp, Homo sapiens
aagcttcaaccctcagcct

SEQ ID NO: 1565028 - DNA, 15 bp, Homo sapiens
aagcttcagagccta

SEQ ID NO: 1565029 - DNA, 16 bp, Homo sapiens
aagcttcagagcctag

SEQ ID NO: 1565030 - DNA, 18 bp, Homo sapiens
aagcttcagagcctagcc

SEQ ID NO: 1565031 - DNA, 21 bp, Homo sapiens
aagcttcattctccttgttgt

SEQ ID NO: 1565032 - DNA, 16 bp, Homo sapiens
aagcttccacaaaatt

SEQ ID NO: 1565033 - DNA, 20 bp, Homo sapiens
aagcttccacaaaattagaa

SEQ ID NO: 1565034 - DNA, 22 bp, Homo sapiens
aagcttcgaggcccagcgacct

SEQ ID NO: 1565035 - DNA, 13 bp, Homo sapiens
aagcttctaaagc

SEQ ID NO: 1565036 - DNA, 14 bp, Homo sapiens
aagcttcttgctga

SEQ ID NO: 1565037 - DNA, 15 bp, Homo sapiens
aagcttgactcccaa

SEQ ID NO: 1565038 - DNA, 13 bp, Homo sapiens
aagcttgagcctc

SEQ ID NO: 1565039 - DNA, 22 bp, Homo sapiens
aagcttgtggtgttcctgaagc

SEQ ID NO: 1565040 - DNA, 15 bp, Homo sapiens
aagctttaccagctg

SEQ ID NO: 1565041 - DNA, 17 bp, Homo sapiens
aagctttactactgtgg

SEQ ID NO: 1565042 - DNA, 19 bp, Homo sapiens
aagctttactactgtggaa

SEQ ID NO: 1565043 - DNA, 17 bp, Homo sapiens
aagctttgctacaaatt

SEQ ID NO: 1565044 - DNA, 21 bp, Homo sapiens
aagctttgctacaaatttatg

SEQ ID NO: 1565045 - DNA, 23 bp, Homo sapiens
aagcttttatttaacagtgcaaa

SEQ ID NO: 1565046 - DNA, 13 bp, Homo sapiens
aagcttttgctca

SEQ ID NO: 1565047 - DNA, 14 bp, Homo sapiens
aaggaaaaataatc

SEQ ID NO: 1565048 - DNA, 16 bp, Homo sapiens
aaggaaaaataatcaa

SEQ ID NO: 1565049 - DNA, 19 bp, Homo sapiens
aaggaaaaataatcaagat

SEQ ID NO: 1565050 - DNA, 14 bp, Homo sapiens
aaggaaaaggagga

SEQ ID NO: 1565051 - DNA, 17 bp, Homo sapiens
aaggaaaatagtaatgt

SEQ ID NO: 1565052 - DNA, 15 bp, Homo sapiens
aaggaaaatctatat

SEQ ID NO: 1565053 - DNA, 14 bp, Homo sapiens
aaggaaaatgatct

SEQ ID NO: 1565054 - DNA, 21 bp, Homo sapiens
aaggaaaccgcctagtttact

SEQ ID NO: 1565055 - DNA, 16 bp, Homo sapiens
aaggaaacgctacctc

SEQ ID NO: 1565056 - DNA, 17 bp, Homo sapiens
aaggaaagatttgtgaa

SEQ ID NO: 1565057 - DNA, 13 bp, Homo sapiens
aaggaaagcaata

SEQ ID NO: 1565058 - DNA, 12 bp, Homo sapiens
aaggaaagctgt

SEQ ID NO: 1565059 - DNA, 18 bp, Homo sapiens
aaggaaaggctcatttaa

SEQ ID NO: 1565060 - DNA, 22 bp, Homo sapiens
aaggaaagggggtcccagtggg

SEQ ID NO: 1565061 - DNA, 20 bp, Homo sapiens
aaggaaatctcctcttttgt

SEQ ID NO: 1565062 - DNA, 13 bp, Homo sapiens
aaggaacactgac

SEQ ID NO: 1565063 - DNA, 13 bp, Homo sapiens
aaggaaccttcct

SEQ ID NO: 1565064 - DNA, 21 bp, Homo sapiens
aaggaaccttccttcctgctt

SEQ ID NO: 1565065 - DNA, 23 bp, Homo sapiens
aaggaactaggtcaaaaatctgt

SEQ ID NO: 1565066 - DNA, 14 bp, Homo sapiens
aaggaagaagaaat

SEQ ID NO: 1565067 - DNA, 13 bp, Homo sapiens
aaggaagactaga

SEQ ID NO: 1565068 - DNA, 22 bp, Homo sapiens
aaggaagataggacgtatttat

SEQ ID NO: 1565069 - DNA, 22 bp, Homo sapiens
aaggaagatcttgagagctgct

SEQ ID NO: 1565070 - DNA, 23 bp, Homo sapiens
aaggaagatcttgagagctgctg

SEQ ID NO: 1565071 - DNA, 18 bp, Homo sapiens
aaggaagcattgtaaaat

SEQ ID NO: 1565072 - DNA, 22 bp, Homo sapiens
aaggaagcattgtaaaataatt

SEQ ID NO: 1565073 - DNA, 13 bp, Homo sapiens
aaggaagccaaag

SEQ ID NO: 1565074 - DNA, 12 bp, Homo sapiens
aaggaaggaaag

SEQ ID NO: 1565075 - DNA, 16 bp, Homo sapiens
aaggaaggaaagaaag

SEQ ID NO: 1565076 - DNA, 20 bp, Homo sapiens
aaggaaggagactcacctct

SEQ ID NO: 1565077 - DNA, 22 bp, Homo sapiens
aaggaaggagactcacctctgc

SEQ ID NO: 1565078 - DNA, 16 bp, Homo sapiens
aaggaaggagggcaca

SEQ ID NO: 1565079 - DNA, 12 bp, Homo sapiens
aaggaaggtgga

SEQ ID NO: 1565080 - DNA, 21 bp, Homo sapiens
aaggaagttttaactttaata

SEQ ID NO: 1565081 - DNA, 21 bp, Homo sapiens
aaggaatctgtgcagatgagc

SEQ ID NO: 1565082 - DNA, 14 bp, Homo sapiens
aaggaatgatatat

SEQ ID NO: 1565083 - DNA, 16 bp, Homo sapiens
aaggaatgatatattc

SEQ ID NO: 1565084 - DNA, 17 bp, Homo sapiens
aaggaatgcctgtgcca

SEQ ID NO: 1565085 - DNA, 15 bp, Homo sapiens
aaggaattctaggca

SEQ ID NO: 1565086 - DNA, 14 bp, Homo sapiens
aaggaatttcttaa

SEQ ID NO: 1565087 - DNA, 15 bp, Homo sapiens
aaggaatttgtactt

SEQ ID NO: 1565088 - DNA, 14 bp, Homo sapiens
aaggaattttgtaa

SEQ ID NO: 1565089 - DNA, 14 bp, Homo sapiens
aaggacacactaat

SEQ ID NO: 1565090 - DNA, 20 bp, Homo sapiens
aaggacacagtgatgaatgt

SEQ ID NO: 1565091 - DNA, 13 bp, Homo sapiens
aaggacactagaa

SEQ ID NO: 1565092 - DNA, 17 bp, Homo sapiens
aaggacacttcctgcct

SEQ ID NO: 1565093 - DNA, 13 bp, Homo sapiens
aaggacagcagct

SEQ ID NO: 1565094 - DNA, 23 bp, Homo sapiens
aaggacagggctggctcctctgc

SEQ ID NO: 1565095 - DNA, 21 bp, Homo sapiens
aaggacattgtatgcagggag

SEQ ID NO: 1565096 - DNA, 18 bp, Homo sapiens
aaggaccaaattgcttta

SEQ ID NO: 1565097 - DNA, 23 bp, Homo sapiens
aaggaccacattttatatttatt

SEQ ID NO: 1565098 - DNA, 18 bp, Homo sapiens
aaggacccggaggggcct

SEQ ID NO: 1565099 - DNA, 18 bp, Homo sapiens
aaggacctgaaattccaa

SEQ ID NO: 1565100 - DNA, 19 bp, Homo sapiens
aaggacctgaaattccaaa

SEQ ID NO: 1565101 - DNA, 16 bp, Homo sapiens
aaggacggcaggagtg

SEQ ID NO: 1565102 - DNA, 21 bp, Homo sapiens
aaggacggtgccaagggcccc

SEQ ID NO: 1565103 - DNA, 20 bp, Homo sapiens
aaggactgagcaccctctgg

SEQ ID NO: 1565104 - DNA, 19 bp, Homo sapiens
aaggactgagggcagtgcc

SEQ ID NO: 1565105 - DNA, 22 bp, Homo sapiens
aaggactgagggcagtgccctt

SEQ ID NO: 1565106 - DNA, 17 bp, Homo sapiens
aaggactggattggcca

SEQ ID NO: 1565107 - DNA, 20 bp, Homo sapiens
aaggactggtgcgacccccc

SEQ ID NO: 1565108 - DNA, 21 bp, Homo sapiens
aaggactggtgcgacccccca

SEQ ID NO: 1565109 - DNA, 17 bp, Homo sapiens
aaggacttcctgtccag

SEQ ID NO: 1565110 - DNA, 20 bp, Homo sapiens
aaggacttcctgtccagctc

SEQ ID NO: 1565111 - DNA, 21 bp, Homo sapiens
aaggacttcctgtccagctcc

SEQ ID NO: 1565112 - DNA, 14 bp, Homo sapiens
aaggactttgtaca

SEQ ID NO: 1565113 - DNA, 15 bp, Homo sapiens
aaggactttgtacat

SEQ ID NO: 1565114 - DNA, 18 bp, Homo sapiens
aaggagaaaaaaaacctt

SEQ ID NO: 1565115 - DNA, 21 bp, Homo sapiens
aaggagaaaaaaaaccttgta

SEQ ID NO: 1565116 - DNA, 19 bp, Homo sapiens
aaggagaatcatgtttctt

SEQ ID NO: 1565117 - DNA, 20 bp, Homo sapiens
aaggagaatttaataaagat

SEQ ID NO: 1565118 - DNA, 22 bp, Homo sapiens
aaggagactcacctctgcctca

SEQ ID NO: 1565119 - DNA, 11 bp, Homo sapiens
aaggagagaag

SEQ ID NO: 1565120 - DNA, 22 bp, Homo sapiens
aaggagagcaagaaggaaagat

SEQ ID NO: 1565121 - DNA, 20 bp, Homo sapiens
aaggagaggcccggtgcagc

SEQ ID NO: 1565122 - DNA, 22 bp, Homo sapiens
aaggagagttcaagcctgtggg

SEQ ID NO: 1565123 - DNA, 22 bp, Homo sapiens
aaggagatagacgggttgaaag

SEQ ID NO: 1565124 - DNA, 20 bp, Homo sapiens
aaggagatttcttagttcat

SEQ ID NO: 1565125 - DNA, 19 bp, Homo sapiens
aaggagcccagaaaacctc

SEQ ID NO: 1565126 - DNA, 16 bp, Homo sapiens
aaggagctcaccctgc

SEQ ID NO: 1565127 - DNA, 19 bp, Homo sapiens
aaggagcttacccaagctg

SEQ ID NO: 1565128 - DNA, 21 bp, Homo sapiens
aaggagcttacccaagctgtg

SEQ ID NO: 1565129 - DNA, 13 bp, Homo sapiens
aaggagctttctc

SEQ ID NO: 1565130 - DNA, 19 bp, Homo sapiens
aaggaggaggagggagaag

SEQ ID NO: 1565131 - DNA, 21 bp, Homo sapiens
aaggaggccctgttccctgga

SEQ ID NO: 1565132 - DNA, 14 bp, Homo sapiens
aaggaggctggcag

SEQ ID NO: 1565133 - DNA, 11 bp, Homo sapiens
aaggagggaga

SEQ ID NO: 1565134 - DNA, 16 bp, Homo sapiens
aaggagggagctgctc

SEQ ID NO: 1565135 - DNA, 13 bp, Homo sapiens
aaggaggggaacc

SEQ ID NO: 1565136 - DNA, 19 bp, Homo sapiens
aaggagggttagggagggg

SEQ ID NO: 1565137 - DNA, 15 bp, Homo sapiens
aaggagtaagaacct

SEQ ID NO: 1565138 - DNA, 22 bp, Homo sapiens
aaggagttacagggaagtggtc

SEQ ID NO: 1565139 - DNA, 20 bp, Homo sapiens
aaggagtttaaatgagacta

SEQ ID NO: 1565140 - DNA, 22 bp, Homo sapiens
aaggataaatcataaagtcagt

SEQ ID NO: 1565141 - DNA, 17 bp, Homo sapiens
aaggatacacttatttg

SEQ ID NO: 1565142 - DNA, 19 bp, Homo sapiens
aaggataccttcttattta

SEQ ID NO: 1565143 - DNA, 15 bp, Homo sapiens
aaggatagatgctgg

SEQ ID NO: 1565144 - DNA, 17 bp, Homo sapiens
aaggatatttaagaaaa

SEQ ID NO: 1565145 - DNA, 18 bp, Homo sapiens
aaggatatttaagaaaat

SEQ ID NO: 1565146 - DNA, 23 bp, Homo sapiens
aaggatatttaagaaaatacaat

SEQ ID NO: 1565147 - DNA, 22 bp, Homo sapiens
aaggatatttactacttttgca

SEQ ID NO: 1565148 - DNA, 16 bp, Homo sapiens
aaggatccggaaagaa

SEQ ID NO: 1565149 - DNA, 15 bp, Homo sapiens
aaggatccttttcct

SEQ ID NO: 1565150 - DNA, 15 bp, Homo sapiens
aaggatctgctgagg

SEQ ID NO: 1565151 - DNA, 14 bp, Homo sapiens
aaggatcttcatct

SEQ ID NO: 1565152 - DNA, 19 bp, Homo sapiens
aaggatgaagaacacagca

SEQ ID NO: 1565153 - DNA, 13 bp, Homo sapiens
aaggatgactttt

SEQ ID NO: 1565154 - DNA, 17 bp, Homo sapiens
aaggatgacttttttat

SEQ ID NO: 1565155 - DNA, 14 bp, Homo sapiens
aaggatggatggca

SEQ ID NO: 1565156 - DNA, 18 bp, Homo sapiens
aaggatggatggcaccct

SEQ ID NO: 1565157 - DNA, 19 bp, Homo sapiens
aaggatggatggcaccctg

SEQ ID NO: 1565158 - DNA, 19 bp, Homo sapiens
aaggatgtaaacagtgcct

SEQ ID NO: 1565159 - DNA, 21 bp, Homo sapiens
aaggatttaagcaaaggctcc

SEQ ID NO: 1565160 - DNA, 19 bp, Homo sapiens
aaggcaaaaactgtactgt

SEQ ID NO: 1565161 - DNA, 15 bp, Homo sapiens
aaggcaaacatttga

SEQ ID NO: 1565162 - DNA, 18 bp, Homo sapiens
aaggcaaagtacattgta

SEQ ID NO: 1565163 - DNA, 20 bp, Homo sapiens
aaggcaaatattgaagttgt

SEQ ID NO: 1565164 - DNA, 12 bp, Homo sapiens
aaggcaactggg

SEQ ID NO: 1565165 - DNA, 13 bp, Homo sapiens
aaggcaagagggg

SEQ ID NO: 1565166 - DNA, 19 bp, Homo sapiens
aaggcaagagggggtggag

SEQ ID NO: 1565167 - DNA, 21 bp, Homo sapiens
aaggcaagagggggtggaggg

SEQ ID NO: 1565168 - DNA, 11 bp, Homo sapiens
aaggcaagcca

SEQ ID NO: 1565169 - DNA, 20 bp, Homo sapiens
aaggcaagtttctagctaga

SEQ ID NO: 1565170 - DNA, 14 bp, Homo sapiens
aaggcaatggaaac

SEQ ID NO: 1565171 - DNA, 15 bp, Homo sapiens
aaggcaatggaaact

SEQ ID NO: 1565172 - DNA, 15 bp, Homo sapiens
aaggcacaatatggg

SEQ ID NO: 1565173 - DNA, 22 bp, Homo sapiens
aaggcacagtgggagctgagct

SEQ ID NO: 1565174 - DNA, 19 bp, Homo sapiens
aaggcactgtcaggaatgg

SEQ ID NO: 1565175 - DNA, 16 bp, Homo sapiens
aaggcagaggcctggg

SEQ ID NO: 1565176 - DNA, 18 bp, Homo sapiens
aaggcagaggcctgggct

SEQ ID NO: 1565177 - DNA, 16 bp, Homo sapiens
aaggcagcctccagag

SEQ ID NO: 1565178 - DNA, 20 bp, Homo sapiens
aaggcagcctccagagccag

SEQ ID NO: 1565179 - DNA, 21 bp, Homo sapiens
aaggcagcctccagagccagc

SEQ ID NO: 1565180 - DNA, 15 bp, Homo sapiens
aaggcagcgacccca

SEQ ID NO: 1565181 - DNA, 17 bp, Homo sapiens
aaggcagcgaccccagg

SEQ ID NO: 1565182 - DNA, 20 bp, Homo sapiens
aaggcagcgaccccaggacc

SEQ ID NO: 1565183 - DNA, 11 bp, Homo sapiens
aaggcagctgc

SEQ ID NO: 1565184 - DNA, 15 bp, Homo sapiens
aaggcagctgcctct

SEQ ID NO: 1565185 - DNA, 18 bp, Homo sapiens
aaggcagctgcctctgct

SEQ ID NO: 1565186 - DNA, 20 bp, Homo sapiens
aaggcagctgcctctgctcc

SEQ ID NO: 1565187 - DNA, 21 bp, Homo sapiens
aaggcagctgcctctgctccc

SEQ ID NO: 1565188 - DNA, 14 bp, Homo sapiens
aaggcagctgctct

SEQ ID NO: 1565189 - DNA, 16 bp, Homo sapiens
aaggcaggaatgtgtg

SEQ ID NO: 1565190 - DNA, 23 bp, Homo sapiens
aaggcaggtagatcgcttgagcc

SEQ ID NO: 1565191 - DNA, 16 bp, Homo sapiens
aaggcaggtgcctcca

SEQ ID NO: 1565192 - DNA, 20 bp, Homo sapiens
aaggcaggtgcctccaggtg

SEQ ID NO: 1565193 - DNA, 22 bp, Homo sapiens
aaggcagtctctatattatgtc

SEQ ID NO: 1565194 - DNA, 18 bp, Homo sapiens
aaggcagtggcaggggag

SEQ ID NO: 1565195 - DNA, 22 bp, Homo sapiens
aaggcatacgagagcagaggtc

SEQ ID NO: 1565196 - DNA, 20 bp, Homo sapiens
aaggcatcagtccctatgta

SEQ ID NO: 1565197 - DNA, 17 bp, Homo sapiens
aaggcatccaggccagg

SEQ ID NO: 1565198 - DNA, 19 bp, Homo sapiens
aaggcatccaggccagggc

SEQ ID NO: 1565199 - DNA, 15 bp, Homo sapiens
aaggcatgagaaaga

SEQ ID NO: 1565200 - DNA, 22 bp, Homo sapiens
aaggcatgtggcctttatctca

SEQ ID NO: 1565201 - DNA, 19 bp, Homo sapiens
aaggcattataaaaagaat

SEQ ID NO: 1565202 - DNA, 12 bp, Homo sapiens
aaggcattctct

SEQ ID NO: 1565203 - DNA, 14 bp, Homo sapiens
aaggcattctctga

SEQ ID NO: 1565204 - DNA, 17 bp, Homo sapiens
aaggcatttattgccat

SEQ ID NO: 1565205 - DNA, 18 bp, Homo sapiens
aaggccaaaatcaagagt

SEQ ID NO: 1565206 - DNA, 17 bp, Homo sapiens
aaggccaaagataaaag

SEQ ID NO: 1565207 - DNA, 13 bp, Homo sapiens
aaggccaaggtgc

SEQ ID NO: 1565208 - DNA, 15 bp, Homo sapiens
aaggccagcaacatt

SEQ ID NO: 1565209 - DNA, 17 bp, Homo sapiens
aaggccccagagagacc

SEQ ID NO: 1565210 - DNA, 14 bp, Homo sapiens
aaggcccctgcaat

SEQ ID NO: 1565211 - DNA, 16 bp, Homo sapiens
aaggcccctgcaatgt

SEQ ID NO: 1565212 - DNA, 15 bp, Homo sapiens
aaggccccttccctg

SEQ ID NO: 1565213 - DNA, 22 bp, Homo sapiens
aaggccccttccctggcaggtg

SEQ ID NO: 1565214 - DNA, 13 bp, Homo sapiens
aaggccctgctga

SEQ ID NO: 1565215 - DNA, 20 bp, Homo sapiens
aaggccgaagctctggctga

SEQ ID NO: 1565216 - DNA, 19 bp, Homo sapiens
aaggccgctgccccagccc

SEQ ID NO: 1565217 - DNA, 15 bp, Homo sapiens
aaggcctaggattct

SEQ ID NO: 1565218 - DNA, 18 bp, Homo sapiens
aaggcctcatctccttta

SEQ ID NO: 1565219 - DNA, 20 bp, Homo sapiens
aaggcctggtgtttcttgat

SEQ ID NO: 1565220 - DNA, 17 bp, Homo sapiens
aaggcctgtggggagcc

SEQ ID NO: 1565221 - DNA, 12 bp, Homo sapiens
aaggcctttctt

SEQ ID NO: 1565222 - DNA, 13 bp, Homo sapiens
aaggcctttcttc

SEQ ID NO: 1565223 - DNA, 14 bp, Homo sapiens
aaggcctttcttct

SEQ ID NO: 1565224 - DNA, 17 bp, Homo sapiens
aaggcctttcttctgtg

SEQ ID NO: 1565225 - DNA, 23 bp, Homo sapiens
aaggccttttgcccgttgaggta

SEQ ID NO: 1565226 - DNA, 17 bp, Homo sapiens
aaggctaagcatggcct

SEQ ID NO: 1565227 - DNA, 21 bp, Homo sapiens
aaggctatgaagggacagctg

SEQ ID NO: 1565228 - DNA, 23 bp, Homo sapiens
aaggctatggggatagatgtgtg

SEQ ID NO: 1565229 - DNA, 16 bp, Homo sapiens
aaggctcagtctcagg

SEQ ID NO: 1565230 - DNA, 13 bp, Homo sapiens
aaggctccctcgc

SEQ ID NO: 1565231 - DNA, 12 bp, Homo sapiens
aaggctctagat

SEQ ID NO: 1565232 - DNA, 13 bp, Homo sapiens
aaggctctcaccc

SEQ ID NO: 1565233 - DNA, 17 bp, Homo sapiens
aaggctctgaaagccag

SEQ ID NO: 1565234 - DNA, 16 bp, Homo sapiens
aaggctctgagagtct

SEQ ID NO: 1565235 - DNA, 17 bp, Homo sapiens
aaggctctgagagtcta

SEQ ID NO: 1565236 - DNA, 15 bp, Homo sapiens
aaggctgaaaagaag

SEQ ID NO: 1565237 - DNA, 19 bp, Homo sapiens
aaggctgaactcttcagaa

SEQ ID NO: 1565238 - DNA, 16 bp, Homo sapiens
aaggctgaccaagaga

SEQ ID NO: 1565239 - DNA, 12 bp, Homo sapiens
aaggctgagaag

SEQ ID NO: 1565240 - DNA, 14 bp, Homo sapiens
aaggctgagaagga

SEQ ID NO: 1565241 - DNA, 23 bp, Homo sapiens
aaggctgagacagtgaatttggg

SEQ ID NO: 1565242 - DNA, 20 bp, Homo sapiens
aaggctggtaagagaagtga

SEQ ID NO: 1565243 - DNA, 22 bp, Homo sapiens
aaggctggtacaacggaggcct

SEQ ID NO: 1565244 - DNA, 22 bp, Homo sapiens
aaggctgttaaatacaggaaac

SEQ ID NO: 1565245 - DNA, 15 bp, Homo sapiens
aaggcttaaacccat

SEQ ID NO: 1565246 - DNA, 14 bp, Homo sapiens
aaggcttgaagctg

SEQ ID NO: 1565247 - DNA, 16 bp, Homo sapiens
aaggcttgaagctgtg

SEQ ID NO: 1565248 - DNA, 15 bp, Homo sapiens
aaggcttggctggtg

SEQ ID NO: 1565249 - DNA, 22 bp, Homo sapiens
aaggcttttggtctccctggga

SEQ ID NO: 1565250 - DNA, 17 bp, Homo sapiens
aagggaaaaaaaatgta

SEQ ID NO: 1565251 - DNA, 16 bp, Homo sapiens
aagggaaacaaagaag

SEQ ID NO: 1565252 - DNA, 17 bp, Homo sapiens
aagggaaagcctctggc

SEQ ID NO: 1565253 - DNA, 18 bp, Homo sapiens
aagggaaaggcaagcttg

SEQ ID NO: 1565254 - DNA, 16 bp, Homo sapiens
aagggaaatatcattt

SEQ ID NO: 1565255 - DNA, 15 bp, Homo sapiens
aagggaagtggggag

SEQ ID NO: 1565256 - DNA, 14 bp, Homo sapiens
aagggaatgcatta

SEQ ID NO: 1565257 - DNA, 13 bp, Homo sapiens
aagggacaggaga

SEQ ID NO: 1565258 - DNA, 20 bp, Homo sapiens
aagggacaggagaagagagg

SEQ ID NO: 1565259 - DNA, 13 bp, Homo sapiens
aagggaccaaggc

SEQ ID NO: 1565260 - DNA, 21 bp, Homo sapiens
aagggaccagggagatgccac

SEQ ID NO: 1565261 - DNA, 17 bp, Homo sapiens
aagggactgatgtttgt

SEQ ID NO: 1565262 - DNA, 15 bp, Homo sapiens
aagggagaagaaagg

SEQ ID NO: 1565263 - DNA, 19 bp, Homo sapiens
aagggagaatggtgctgtt

SEQ ID NO: 1565264 - DNA, 17 bp, Homo sapiens
aagggagagctgagcca

SEQ ID NO: 1565265 - DNA, 18 bp, Homo sapiens
aagggagctatcaggaac

SEQ ID NO: 1565266 - DNA, 16 bp, Homo sapiens
aagggaggaaggcctt

SEQ ID NO: 1565267 - DNA, 19 bp, Homo sapiens
aagggaggaaggcctttct

SEQ ID NO: 1565268 - DNA, 22 bp, Homo sapiens
aagggaggaaggcctttcttct

SEQ ID NO: 1565269 - DNA, 19 bp, Homo sapiens
aagggagtaggctgtattt

SEQ ID NO: 1565270 - DNA, 13 bp, Homo sapiens
aagggataaagaa

SEQ ID NO: 1565271 - DNA, 16 bp, Homo sapiens
aagggatataaaatga

SEQ ID NO: 1565272 - DNA, 12 bp, Homo sapiens
aagggatatttt

SEQ ID NO: 1565273 - DNA, 16 bp, Homo sapiens
aagggatgagtgttgg

SEQ ID NO: 1565274 - DNA, 21 bp, Homo sapiens
aagggatggaaaaggaagact

SEQ ID NO: 1565275 - DNA, 24 bp, Homo sapiens
aagggatggaggtcacactggtag

SEQ ID NO: 1565276 - DNA, 22 bp, Homo sapiens
aagggatgttattatccttggg

SEQ ID NO: 1565277 - DNA, 17 bp, Homo sapiens
aagggattgaggagttg

SEQ ID NO: 1565278 - DNA, 15 bp, Homo sapiens
aagggattgctgagg

SEQ ID NO: 1565279 - DNA, 17 bp, Homo sapiens
aagggattgctgaggca

SEQ ID NO: 1565280 - DNA, 11 bp, Homo sapiens
aagggcagaga

SEQ ID NO: 1565281 - DNA, 13 bp, Homo sapiens
aagggcagagtta

SEQ ID NO: 1565282 - DNA, 14 bp, Homo sapiens
aagggcagtgccca

SEQ ID NO: 1565283 - DNA, 17 bp, Homo sapiens
aagggcatcaggcactg

SEQ ID NO: 1565284 - DNA, 18 bp, Homo sapiens
aagggcatcaggcactgg

SEQ ID NO: 1565285 - DNA, 9 bp, Homo sapiens
aagggccag

SEQ ID NO: 1565286 - DNA, 21 bp, Homo sapiens
aagggccagcgtggctctaaa

SEQ ID NO: 1565287 - DNA, 18 bp, Homo sapiens
aagggcccacacctggtg

SEQ ID NO: 1565288 - DNA, 12 bp, Homo sapiens
aagggcccagac

SEQ ID NO: 1565289 - DNA, 20 bp, Homo sapiens
aagggcccttcccctccccc

SEQ ID NO: 1565290 - DNA, 19 bp, Homo sapiens
aagggccggcttctgcctg

SEQ ID NO: 1565291 - DNA, 15 bp, Homo sapiens
aagggccggggatgg

SEQ ID NO: 1565292 - DNA, 16 bp, Homo sapiens
aagggccgtgcccttg

SEQ ID NO: 1565293 - DNA, 23 bp, Homo sapiens
aagggccgtgcccttgcccttgg

SEQ ID NO: 1565294 - DNA, 11 bp, Homo sapiens
aagggcctggc

SEQ ID NO: 1565295 - DNA, 19 bp, Homo sapiens
aagggctgagaggaagcaa

SEQ ID NO: 1565296 - DNA, 12 bp, Homo sapiens
aagggctgcaat

SEQ ID NO: 1565297 - DNA, 22 bp, Homo sapiens
aagggctttggttccttctctg

SEQ ID NO: 1565298 - DNA, 14 bp, Homo sapiens
aaggggaaaaatgg

SEQ ID NO: 1565299 - DNA, 14 bp, Homo sapiens
aaggggagagcctg

SEQ ID NO: 1565300 - DNA, 15 bp, Homo sapiens
aaggggagagcctgc

SEQ ID NO: 1565301 - DNA, 22 bp, Homo sapiens
aaggggcagcaggaggagtgga

SEQ ID NO: 1565302 - DNA, 15 bp, Homo sapiens
aaggggcattttgta

SEQ ID NO: 1565303 - DNA, 18 bp, Homo sapiens
aaggggccccggggctgg

SEQ ID NO: 1565304 - DNA, 14 bp, Homo sapiens
aaggggccctggtc

SEQ ID NO: 1565305 - DNA, 23 bp, Homo sapiens
aaggggcctcaccgagtgggggc

SEQ ID NO: 1565306 - DNA, 12 bp, Homo sapiens
aaggggctgctg

SEQ ID NO: 1565307 - DNA, 14 bp, Homo sapiens
aaggggctgctggg

SEQ ID NO: 1565308 - DNA, 13 bp, Homo sapiens
aaggggcttctgg

SEQ ID NO: 1565309 - DNA, 12 bp, Homo sapiens
aagggggccctg

SEQ ID NO: 1565310 - DNA, 17 bp, Homo sapiens
aagggggtcaaaggaag

SEQ ID NO: 1565311 - DNA, 19 bp, Homo sapiens
aagggggtcccagtgggag

SEQ ID NO: 1565312 - DNA, 19 bp, Homo sapiens
aagggggtgactggaagtt

SEQ ID NO: 1565313 - DNA, 17 bp, Homo sapiens
aagggggtggggggagt

SEQ ID NO: 1565314 - DNA, 13 bp, Homo sapiens
aaggggtaaaagg

SEQ ID NO: 1565315 - DNA, 18 bp, Homo sapiens
aaggggtgcacccacctg

SEQ ID NO: 1565316 - DNA, 19 bp, Homo sapiens
aaggggtgcacccacctgt

SEQ ID NO: 1565317 - DNA, 16 bp, Homo sapiens
aaggggttggattgca

SEQ ID NO: 1565318 - DNA, 19 bp, Homo sapiens
aagggtcgaaagctctaga

SEQ ID NO: 1565319 - DNA, 20 bp, Homo sapiens
aagggtctagggagagaccc

SEQ ID NO: 1565320 - DNA, 22 bp, Homo sapiens
aagggtctagggagagaccctt

SEQ ID NO: 1565321 - DNA, 16 bp, Homo sapiens
aagggtcttcttggca

SEQ ID NO: 1565322 - DNA, 15 bp, Homo sapiens
aagggtgaaaattat

SEQ ID NO: 1565323 - DNA, 12 bp, Homo sapiens
aagggtggaaat

SEQ ID NO: 1565324 - DNA, 12 bp, Homo sapiens
aagggtgtatag

SEQ ID NO: 1565325 - DNA, 21 bp, Homo sapiens
aagggtgttgggagggtggtt

SEQ ID NO: 1565326 - DNA, 19 bp, Homo sapiens
aagggtttcgactggtcca

SEQ ID NO: 1565327 - DNA, 14 bp, Homo sapiens
aagggtttctctat

SEQ ID NO: 1565328 - DNA, 15 bp, Homo sapiens
aagggtttgtaatac

SEQ ID NO: 1565329 - DNA, 17 bp, Homo sapiens
aagggtttgtggctggg

SEQ ID NO: 1565330 - DNA, 20 bp, Homo sapiens
aagggtttgtggctgggggc

SEQ ID NO: 1565331 - DNA, 16 bp, Homo sapiens
aagggttttcttttct

SEQ ID NO: 1565332 - DNA, 19 bp, Homo sapiens
aaggtaaataaaaagaaag

SEQ ID NO: 1565333 - DNA, 13 bp, Homo sapiens
aaggtaatgtgtg

SEQ ID NO: 1565334 - DNA, 12 bp, Homo sapiens
aaggtaattctg

SEQ ID NO: 1565335 - DNA, 19 bp, Homo sapiens
aaggtaccaaacaaggaag

SEQ ID NO: 1565336 - DNA, 18 bp, Homo sapiens
aaggtaccgatttctgct

SEQ ID NO: 1565337 - DNA, 21 bp, Homo sapiens
aaggtaccgatttctgctaag

SEQ ID NO: 1565338 - DNA, 20 bp, Homo sapiens
aaggtagatcctgagatgat

SEQ ID NO: 1565339 - DNA, 18 bp, Homo sapiens
aaggtagcattctttgga

SEQ ID NO: 1565340 - DNA, 17 bp, Homo sapiens
aaggtagcccagcactg

SEQ ID NO: 1565341 - DNA, 20 bp, Homo sapiens
aaggtagcccagcactgtga

SEQ ID NO: 1565342 - DNA, 20 bp, Homo sapiens
aaggtaggggccgtgtcccg

SEQ ID NO: 1565343 - DNA, 12 bp, Homo sapiens
aaggtagttttt

SEQ ID NO: 1565344 - DNA, 22 bp, Homo sapiens
aaggtagtttttacctaccaca

SEQ ID NO: 1565345 - DNA, 18 bp, Homo sapiens
aaggtataataaaattat

SEQ ID NO: 1565346 - DNA, 16 bp, Homo sapiens
aaggtatatcattcta

SEQ ID NO: 1565347 - DNA, 15 bp, Homo sapiens
aaggtattagcaaag

SEQ ID NO: 1565348 - DNA, 15 bp, Homo sapiens
aaggtattttgaata

SEQ ID NO: 1565349 - DNA, 19 bp, Homo sapiens
aaggtattttgtagatgtg

SEQ ID NO: 1565350 - DNA, 13 bp, Homo sapiens
aaggtcatcatcg

SEQ ID NO: 1565351 - DNA, 16 bp, Homo sapiens
aaggtcccatgctcca

SEQ ID NO: 1565352 - DNA, 23 bp, Homo sapiens
aaggtcctctcagttctctccct

SEQ ID NO: 1565353 - DNA, 24 bp, Homo sapiens
aaggtcctgctcaactctacccct

SEQ ID NO: 1565354 - DNA, 15 bp, Homo sapiens
aaggtcctgctgtgg

SEQ ID NO: 1565355 - DNA, 22 bp, Homo sapiens
aaggtctccttactctgagccc

SEQ ID NO: 1565356 - DNA, 23 bp, Homo sapiens
aaggtctccttactctgagccca

SEQ ID NO: 1565357 - DNA, 17 bp, Homo sapiens
aaggtctgtttgctgtt

SEQ ID NO: 1565358 - DNA, 12 bp, Homo sapiens
aaggtctttcag

SEQ ID NO: 1565359 - DNA, 13 bp, Homo sapiens
aaggtgaagcaca

SEQ ID NO: 1565360 - DNA, 23 bp, Homo sapiens
aaggtgaagcacatacggcagac

SEQ ID NO: 1565361 - DNA, 20 bp, Homo sapiens
aaggtgacatcggaaaaata

SEQ ID NO: 1565362 - DNA, 16 bp, Homo sapiens
aaggtgagaattaagt

SEQ ID NO: 1565363 - DNA, 17 bp, Homo sapiens
aaggtgagcataaatca

SEQ ID NO: 1565364 - DNA, 16 bp, Homo sapiens
aaggtgagtgtgactt

SEQ ID NO: 1565365 - DNA, 15 bp, Homo sapiens
aaggtgataaaatca

SEQ ID NO: 1565366 - DNA, 22 bp, Homo sapiens
aaggtgataaaatcataagtat

SEQ ID NO: 1565367 - DNA, 19 bp, Homo sapiens
aaggtgataagggaaaaga

SEQ ID NO: 1565368 - DNA, 19 bp, Homo sapiens
aaggtgatttcagactgca

SEQ ID NO: 1565369 - DNA, 16 bp, Homo sapiens
aaggtgccgtgagcag

SEQ ID NO: 1565370 - DNA, 18 bp, Homo sapiens
aaggtgccgtgagcaggc

SEQ ID NO: 1565371 - DNA, 14 bp, Homo sapiens
aaggtgcctcagtt

SEQ ID NO: 1565372 - DNA, 19 bp, Homo sapiens
aaggtgcctcagttttcct

SEQ ID NO: 1565373 - DNA, 20 bp, Homo sapiens
aaggtgcctcatagcatagc

SEQ ID NO: 1565374 - DNA, 18 bp, Homo sapiens
aaggtgcctgtgaggcag

SEQ ID NO: 1565375 - DNA, 14 bp, Homo sapiens
aaggtgctaacata

SEQ ID NO: 1565376 - DNA, 16 bp, Homo sapiens
aaggtgcttggagttt

SEQ ID NO: 1565377 - DNA, 15 bp, Homo sapiens
aaggtggacctggca

SEQ ID NO: 1565378 - DNA, 16 bp, Homo sapiens
aaggtggacctggcag

SEQ ID NO: 1565379 - DNA, 15 bp, Homo sapiens
aaggtggagggaagg

SEQ ID NO: 1565380 - DNA, 19 bp, Homo sapiens
aaggtggatggccccagca

SEQ ID NO: 1565381 - DNA, 16 bp, Homo sapiens
aaggtggcctctgcct

SEQ ID NO: 1565382 - DNA, 18 bp, Homo sapiens
aaggtggcctctgcctgg

SEQ ID NO: 1565383 - DNA, 21 bp, Homo sapiens
aaggtggggtctttgtgagag

SEQ ID NO: 1565384 - DNA, 14 bp, Homo sapiens
aaggtggtaaattc

SEQ ID NO: 1565385 - DNA, 17 bp, Homo sapiens
aaggtggtaaattcaga

SEQ ID NO: 1565386 - DNA, 23 bp, Homo sapiens
aaggtggtggggctgccggatct

SEQ ID NO: 1565387 - DNA, 17 bp, Homo sapiens
aaggtgtaactctaatt

SEQ ID NO: 1565388 - DNA, 12 bp, Homo sapiens
aaggtgtccagg

SEQ ID NO: 1565389 - DNA, 15 bp, Homo sapiens
aaggtgtccttttcc

SEQ ID NO: 1565390 - DNA, 18 bp, Homo sapiens
aaggtgtgctagaacaag

SEQ ID NO: 1565391 - DNA, 22 bp, Homo sapiens
aaggtgttcattcacttgcatt

SEQ ID NO: 1565392 - DNA, 21 bp, Homo sapiens
aaggtgtttccatttctcaat

SEQ ID NO: 1565393 - DNA, 22 bp, Homo sapiens
aaggttaattctctagggctag

SEQ ID NO: 1565394 - DNA, 15 bp, Homo sapiens
aaggttactgagtga

SEQ ID NO: 1565395 - DNA, 22 bp, Homo sapiens
aaggttcctaggcattgcagga

SEQ ID NO: 1565396 - DNA, 12 bp, Homo sapiens
aaggttctaggt

SEQ ID NO: 1565397 - DNA, 17 bp, Homo sapiens
aaggttgtatgtaaatc

SEQ ID NO: 1565398 - DNA, 19 bp, Homo sapiens
aaggttgtatgtaaatctg

SEQ ID NO: 1565399 - DNA, 14 bp, Homo sapiens
aaggttgtgcaggg

SEQ ID NO: 1565400 - DNA, 21 bp, Homo sapiens
aaggtttaaagagtctagatt

SEQ ID NO: 1565401 - DNA, 13 bp, Homo sapiens
aaggtttattgtt

SEQ ID NO: 1565402 - DNA, 22 bp, Homo sapiens
aaggtttcgtttctgtatacaa

SEQ ID NO: 1565403 - DNA, 21 bp, Homo sapiens
aaggtttgttttcattaaatt

SEQ ID NO: 1565404 - DNA, 15 bp, Homo sapiens
aaggttttaggttct

SEQ ID NO: 1565405 - DNA, 16 bp, Homo sapiens
aaggttttaggttcta

SEQ ID NO: 1565406 - DNA, 17 bp, Homo sapiens
aaggttttaggttctaa

SEQ ID NO: 1565407 - DNA, 13 bp, Homo sapiens
aaggtttttagca

SEQ ID NO: 1565408 - DNA, 11 bp, Homo sapiens
aagtaaaaaca

SEQ ID NO: 1565409 - DNA, 17 bp, Homo sapiens
aagtaaaaccacagcag

SEQ ID NO: 1565410 - DNA, 20 bp, Homo sapiens
aagtaaactttttgttctgg

SEQ ID NO: 1565411 - DNA, 19 bp, Homo sapiens
aagtaaagtgatgtttgtg

SEQ ID NO: 1565412 - DNA, 13 bp, Homo sapiens
aagtaaagtgctt

SEQ ID NO: 1565413 - DNA, 12 bp, Homo sapiens
aagtaaatgctg

SEQ ID NO: 1565414 - DNA, 14 bp, Homo sapiens
aagtaactcatttg

SEQ ID NO: 1565415 - DNA, 21 bp, Homo sapiens
aagtaactcatttgttaaaat

SEQ ID NO: 1565416 - DNA, 17 bp, Homo sapiens
aagtaacttatttgact

SEQ ID NO: 1565417 - DNA, 18 bp, Homo sapiens
aagtaagaagaggagcct

SEQ ID NO: 1565418 - DNA, 20 bp, Homo sapiens
aagtaagaagaggagcctca

SEQ ID NO: 1565419 - DNA, 16 bp, Homo sapiens
aagtaagacttttatt

SEQ ID NO: 1565420 - DNA, 17 bp, Homo sapiens
aagtaagcaacagcata

SEQ ID NO: 1565421 - DNA, 19 bp, Homo sapiens
aagtaagcaacagcataac

SEQ ID NO: 1565422 - DNA, 17 bp, Homo sapiens
aagtaatcatctaagtc

SEQ ID NO: 1565423 - DNA, 18 bp, Homo sapiens
aagtaatctttaaactgg

SEQ ID NO: 1565424 - DNA, 19 bp, Homo sapiens
aagtaatgacttagaaact

SEQ ID NO: 1565425 - DNA, 20 bp, Homo sapiens
aagtaatgacttagaaactg

SEQ ID NO: 1565426 - DNA, 15 bp, Homo sapiens
aagtaattgcctaca

SEQ ID NO: 1565427 - DNA, 19 bp, Homo sapiens
aagtaattgcctacaataa

SEQ ID NO: 1565428 - DNA, 17 bp, Homo sapiens
aagtacaaatgaagaaa

SEQ ID NO: 1565429 - DNA, 12 bp, Homo sapiens
aagtacaatgaa

SEQ ID NO: 1565430 - DNA, 16 bp, Homo sapiens
aagtacaattcattgt

SEQ ID NO: 1565431 - DNA, 13 bp, Homo sapiens
aagtacagaattt

SEQ ID NO: 1565432 - DNA, 16 bp, Homo sapiens
aagtacagaatttgaa

SEQ ID NO: 1565433 - DNA, 14 bp, Homo sapiens
aagtacattgtaaa

SEQ ID NO: 1565434 - DNA, 16 bp, Homo sapiens
aagtacattgtaaaat

SEQ ID NO: 1565435 - DNA, 18 bp, Homo sapiens
aagtacattgtaaaataa

SEQ ID NO: 1565436 - DNA, 16 bp, Homo sapiens
aagtacattttttgaa

SEQ ID NO: 1565437 - DNA, 16 bp, Homo sapiens
aagtaccaatgctgtt

SEQ ID NO: 1565438 - DNA, 17 bp, Homo sapiens
aagtaccactcaggcca

SEQ ID NO: 1565439 - DNA, 12 bp, Homo sapiens
aagtaccagact

SEQ ID NO: 1565440 - DNA, 13 bp, Homo sapiens
aagtaccagacta

SEQ ID NO: 1565441 - DNA, 12 bp, Homo sapiens
aagtacctgtag

SEQ ID NO: 1565442 - DNA, 17 bp, Homo sapiens
aagtactgctgtaaata

SEQ ID NO: 1565443 - DNA, 20 bp, Homo sapiens
aagtactgctgtaaataaat

SEQ ID NO: 1565444 - DNA, 23 bp, Homo sapiens
aagtacttccacttgtgtatatt

SEQ ID NO: 1565445 - DNA, 17 bp, Homo sapiens
aagtactttaaaaagga

SEQ ID NO: 1565446 - DNA, 19 bp, Homo sapiens
aagtactttaaaaaggaaa

SEQ ID NO: 1565447 - DNA, 16 bp, Homo sapiens
aagtagaacaaaaaac

SEQ ID NO: 1565448 - DNA, 20 bp, Homo sapiens
aagtagaagtcttagatgta

SEQ ID NO: 1565449 - DNA, 20 bp, Homo sapiens
aagtagagctagctgccact

SEQ ID NO: 1565450 - DNA, 17 bp, Homo sapiens
aagtagcaactgctggt

SEQ ID NO: 1565451 - DNA, 20 bp, Homo sapiens
aagtagcaataggctgtaat

SEQ ID NO: 1565452 - DNA, 19 bp, Homo sapiens
aagtagcctcttgtgtaac

SEQ ID NO: 1565453 - DNA, 14 bp, Homo sapiens
aagtaggaaagtca

SEQ ID NO: 1565454 - DNA, 15 bp, Homo sapiens
aagtaggcatgaggg

SEQ ID NO: 1565455 - DNA, 19 bp, Homo sapiens
aagtaggtggcttgagcta

SEQ ID NO: 1565456 - DNA, 13 bp, Homo sapiens
aagtagtaaatca

SEQ ID NO: 1565457 - DNA, 16 bp, Homo sapiens
aagtagttggtttgta

SEQ ID NO: 1565458 - DNA, 23 bp, Homo sapiens
aagtatacaggaggatgtgaata

SEQ ID NO: 1565459 - DNA, 18 bp, Homo sapiens
aagtatactgtattttta

SEQ ID NO: 1565460 - DNA, 16 bp, Homo sapiens
aagtatatgtgcagtc

SEQ ID NO: 1565461 - DNA, 12 bp, Homo sapiens
aagtatattaaa

SEQ ID NO: 1565462 - DNA, 21 bp, Homo sapiens
aagtatgaatattactctcaa

SEQ ID NO: 1565463 - DNA, 14 bp, Homo sapiens
aagtatgaatctat

SEQ ID NO: 1565464 - DNA, 17 bp, Homo sapiens
aagtatgagggaaaatg

SEQ ID NO: 1565465 - DNA, 21 bp, Homo sapiens
aagtatgagggaaaatgagta

SEQ ID NO: 1565466 - DNA, 21 bp, Homo sapiens
aagtatgcattattaaattgt

SEQ ID NO: 1565467 - DNA, 12 bp, Homo sapiens
aagtatgcctta

SEQ ID NO: 1565468 - DNA, 14 bp, Homo sapiens
aagtatgccttaag

SEQ ID NO: 1565469 - DNA, 22 bp, Homo sapiens
aagtatgccttaagcagaacaa

SEQ ID NO: 1565470 - DNA, 18 bp, Homo sapiens
aagtatgtgtaaaatgtg

SEQ ID NO: 1565471 - DNA, 17 bp, Homo sapiens
aagtattatcattgctc

SEQ ID NO: 1565472 - DNA, 21 bp, Homo sapiens
aagtattcaacaatttcaata

SEQ ID NO: 1565473 - DNA, 16 bp, Homo sapiens
aagtattcaagtattt

SEQ ID NO: 1565474 - DNA, 12 bp, Homo sapiens
aagtattcacaa

SEQ ID NO: 1565475 - DNA, 14 bp, Homo sapiens
aagtattcctgttg

SEQ ID NO: 1565476 - DNA, 23 bp, Homo sapiens
aagtattcctgttgctgtcttca

SEQ ID NO: 1565477 - DNA, 13 bp, Homo sapiens
aagtattctcttt

SEQ ID NO: 1565478 - DNA, 21 bp, Homo sapiens
aagtattctgtactcttagat

SEQ ID NO: 1565479 - DNA, 19 bp, Homo sapiens
aagtattcttatttaatga

SEQ ID NO: 1565480 - DNA, 23 bp, Homo sapiens
aagtattcttttcaattatattg

SEQ ID NO: 1565481 - DNA, 22 bp, Homo sapiens
aagtattgaaagccaacaactc

SEQ ID NO: 1565482 - DNA, 21 bp, Homo sapiens
aagtattgagaacctggcctg

SEQ ID NO: 1565483 - DNA, 13 bp, Homo sapiens
aagtatttaagcc

SEQ ID NO: 1565484 - DNA, 16 bp, Homo sapiens
aagtatttatatattt

SEQ ID NO: 1565485 - DNA, 20 bp, Homo sapiens
aagtatttatatatttataa

SEQ ID NO: 1565486 - DNA, 20 bp, Homo sapiens
aagtggaccttgagaccaca

SEQ ID NO: 1565487 - DNA, 14 bp, Homo sapiens
aagtggatgggaat

SEQ ID NO: 1565488 - DNA, 14 bp, Homo sapiens
aagtggattttgta

SEQ ID NO: 1565489 - DNA, 18 bp, Homo sapiens
aagtggcatgtgctgtga

SEQ ID NO: 1565490 - DNA, 19 bp, Homo sapiens
aagtggccaagaagcagtg

SEQ ID NO: 1565491 - DNA, 13 bp, Homo sapiens
aagtggctgcctt

SEQ ID NO: 1565492 - DNA, 20 bp, Homo sapiens
aagtggggttgcaaccactg

SEQ ID NO: 1565493 - DNA, 18 bp, Homo sapiens
aagtggtaaatactgtga

SEQ ID NO: 1565494 - DNA, 23 bp, Homo sapiens
aagtggtaaatactgtgaaatac

SEQ ID NO: 1565495 - DNA, 14 bp, Homo sapiens
aagtggtacaggaa

SEQ ID NO: 1565496 - DNA, 20 bp, Homo sapiens
aagtggtccagaaacaaaaa

SEQ ID NO: 1565497 - DNA, 22 bp, Homo sapiens
aagtggtccagcgtcactccag

SEQ ID NO: 1565498 - DNA, 13 bp, Homo sapiens
aagtggtctctgc

SEQ ID NO: 1565499 - DNA, 14 bp, Homo sapiens
aagtgtaaaaaatg

SEQ ID NO: 1565500 - DNA, 14 bp, Homo sapiens
aagtgtaacagctg

SEQ ID NO: 1565501 - DNA, 21 bp, Homo sapiens
aagtgtaacagctgaggtctc

SEQ ID NO: 1565502 - DNA, 18 bp, Homo sapiens
aagtgtaagttcacaact

SEQ ID NO: 1565503 - DNA, 21 bp, Homo sapiens
aagtgtaccaacataagtgtt

SEQ ID NO: 1565504 - DNA, 11 bp, Homo sapiens
aagtgtagctc

SEQ ID NO: 1565505 - DNA, 14 bp, Homo sapiens
aagtgtaggccacc

SEQ ID NO: 1565506 - DNA, 15 bp, Homo sapiens
aagtgtatatttatt

SEQ ID NO: 1565507 - DNA, 21 bp, Homo sapiens
aagtgtatatttattcataat

SEQ ID NO: 1565508 - DNA, 17 bp, Homo sapiens
aagtgtatgtgtgaatt

SEQ ID NO: 1565509 - DNA, 16 bp, Homo sapiens
aagtgtctctgccttg

SEQ ID NO: 1565510 - DNA, 17 bp, Homo sapiens
aagtgtgaacaaaagat

SEQ ID NO: 1565511 - DNA, 13 bp, Homo sapiens
aagtgtgagcaaa

SEQ ID NO: 1565512 - DNA, 19 bp, Homo sapiens
aagtgtgagctcttccctt

SEQ ID NO: 1565513 - DNA, 11 bp, Homo sapiens
aagtgtgagta

SEQ ID NO: 1565514 - DNA, 16 bp, Homo sapiens
aagtgtgtatatattt

SEQ ID NO: 1565515 - DNA, 18 bp, Homo sapiens
aagtgtgtgattgaaggt

SEQ ID NO: 1565516 - DNA, 13 bp, Homo sapiens
aagtgttcaagaa

SEQ ID NO: 1565517 - DNA, 18 bp, Homo sapiens
aagtgttcaagaaataaa

SEQ ID NO: 1565518 - DNA, 21 bp, Homo sapiens
aagtgttcaagaaataaaaat

SEQ ID NO: 1565519 - DNA, 22 bp, Homo sapiens
aagtgttccctgagaaacccac

SEQ ID NO: 1565520 - DNA, 12 bp, Homo sapiens
aagtgttctcat

SEQ ID NO: 1565521 - DNA, 18 bp, Homo sapiens
aagtgttctgtgcgtctg

SEQ ID NO: 1565522 - DNA, 22 bp, Homo sapiens
aagtgttcttaggtttactgtg

SEQ ID NO: 1565523 - DNA, 23 bp, Homo sapiens
aagtgttcttaggtttactgtga

SEQ ID NO: 1565524 - DNA, 16 bp, Homo sapiens
aagtgttcttcagtgt

SEQ ID NO: 1565525 - DNA, 19 bp, Homo sapiens
aagtgttcttcagtgtaat

SEQ ID NO: 1565526 - DNA, 16 bp, Homo sapiens
aagtgttgctcttgga

SEQ ID NO: 1565527 - DNA, 18 bp, Homo sapiens
aagtgttgctcttggaaa

SEQ ID NO: 1565528 - DNA, 18 bp, Homo sapiens
aagtgttgtgttcctggc

SEQ ID NO: 1565529 - DNA, 17 bp, Homo sapiens
aagtgtttatgtaatag

SEQ ID NO: 1565530 - DNA, 17 bp, Homo sapiens
aagttaaaaaacagctg

SEQ ID NO: 1565531 - DNA, 19 bp, Homo sapiens
aagttaaaaaacagctgca

SEQ ID NO: 1565532 - DNA, 13 bp, Homo sapiens
aagttaaactaaa

SEQ ID NO: 1565533 - DNA, 16 bp, Homo sapiens
aagttaaatatgtaga

SEQ ID NO: 1565534 - DNA, 21 bp, Homo sapiens
aagttacacagaaatgctgct

SEQ ID NO: 1565535 - DNA, 16 bp, Homo sapiens
aagttagtatcttttg

SEQ ID NO: 1565536 - DNA, 19 bp, Homo sapiens
aagttagtatcttttgata

SEQ ID NO: 1565537 - DNA, 21 bp, Homo sapiens
aagttagtattaaaatctaca

SEQ ID NO: 1565538 - DNA, 16 bp, Homo sapiens
aagttagtggaaatct

SEQ ID NO: 1565539 - DNA, 19 bp, Homo sapiens
aagttagtggaaatctgaa

SEQ ID NO: 1565540 - DNA, 15 bp, Homo sapiens
aagttagtttgtata

SEQ ID NO: 1565541 - DNA, 22 bp, Homo sapiens
aagttagtttgtatatattatt

SEQ ID NO: 1565542 - DNA, 17 bp, Homo sapiens
aagttatagtatatctg

SEQ ID NO: 1565543 - DNA, 15 bp, Homo sapiens
aagttatagtgaata

SEQ ID NO: 1565544 - DNA, 15 bp, Homo sapiens
aagttatgtatttaa

SEQ ID NO: 1565545 - DNA, 14 bp, Homo sapiens
aagttatgtgtatg

SEQ ID NO: 1565546 - DNA, 17 bp, Homo sapiens
aagttattaactttaat

SEQ ID NO: 1565547 - DNA, 18 bp, Homo sapiens
aagttattcaaatttgta

SEQ ID NO: 1565548 - DNA, 20 bp, Homo sapiens
aagttattgataagttcata

SEQ ID NO: 1565549 - DNA, 20 bp, Homo sapiens
aagttattgctggtgcaaag

SEQ ID NO: 1565550 - DNA, 15 bp, Homo sapiens
aagttatttgttcat

SEQ ID NO: 1565551 - DNA, 20 bp, Homo sapiens
aagttatttgttcattattt

SEQ ID NO: 1565552 - DNA, 10 bp, Homo sapiens
aagttatttt

SEQ ID NO: 1565553 - DNA, 19 bp, Homo sapiens
aagttatttttgtacatgt

SEQ ID NO: 1565554 - DNA, 21 bp, Homo sapiens
aagttcacgtaagatacaagt

SEQ ID NO: 1565555 - DNA, 13 bp, Homo sapiens
aagttcagggacc

SEQ ID NO: 1565556 - DNA, 12 bp, Homo sapiens
aagttcatacat

SEQ ID NO: 1565557 - DNA, 15 bp, Homo sapiens
aagttcatacattgt

SEQ ID NO: 1565558 - DNA, 21 bp, Homo sapiens
aagttcatattccatatttat

SEQ ID NO: 1565559 - DNA, 23 bp, Homo sapiens
aagttcatattccatatttattc

SEQ ID NO: 1565560 - DNA, 17 bp, Homo sapiens
aagttcatctcatttgt

SEQ ID NO: 1565561 - DNA, 22 bp, Homo sapiens
aagttcatcttgcagcatttac

SEQ ID NO: 1565562 - DNA, 21 bp, Homo sapiens
aagttcatgtccaaacgtcct

SEQ ID NO: 1565563 - DNA, 15 bp, Homo sapiens
aagttccaagagtct

SEQ ID NO: 1565564 - DNA, 20 bp, Homo sapiens
aagttccaagagtctaaaga

SEQ ID NO: 1565565 - DNA, 14 bp, Homo sapiens
aagttcccaactga

SEQ ID NO: 1565566 - DNA, 23 bp, Homo sapiens
aagttcccattattatttctgtt

SEQ ID NO: 1565567 - DNA, 20 bp, Homo sapiens
aagttcccccatcagttccc

SEQ ID NO: 1565568 - DNA, 11 bp, Homo sapiens
aagttccttaa

SEQ ID NO: 1565569 - DNA, 12 bp, Homo sapiens
aagttccttaag

SEQ ID NO: 1565570 - DNA, 15 bp, Homo sapiens
aagttctaagattct

SEQ ID NO: 1565571 - DNA, 16 bp, Homo sapiens
aagttctaagattcta

SEQ ID NO: 1565572 - DNA, 18 bp, Homo sapiens
aagttctaagattctaat

SEQ ID NO: 1565573 - DNA, 19 bp, Homo sapiens
aagttctaataatttctaa

SEQ ID NO: 1565574 - DNA, 21 bp, Homo sapiens
aagttctcagaataactacct

SEQ ID NO: 1565575 - DNA, 16 bp, Homo sapiens
aagttctccagcttca

SEQ ID NO: 1565576 - DNA, 22 bp, Homo sapiens
aagttctccagcttcagctcaa

SEQ ID NO: 1565577 - DNA, 18 bp, Homo sapiens
aagttctccttttgaact

SEQ ID NO: 1565578 - DNA, 20 bp, Homo sapiens
aagttctccttttgaacttg

SEQ ID NO: 1565579 - DNA, 18 bp, Homo sapiens
aagttcttattttagtat

SEQ ID NO: 1565580 - DNA, 15 bp, Homo sapiens
aagttctttgattct

SEQ ID NO: 1565581 - DNA, 11 bp, Homo sapiens
aagttgaaaaa

SEQ ID NO: 1565582 - DNA, 21 bp, Homo sapiens
aagttgaaaaaggaaatattc

SEQ ID NO: 1565583 - DNA, 17 bp, Homo sapiens
aagttgaaattaaccat

SEQ ID NO: 1565584 - DNA, 21 bp, Homo sapiens
aagttgaatggcctgccttga

SEQ ID NO: 1565585 - DNA, 19 bp, Homo sapiens
aagttgagatgttgtgtgg

SEQ ID NO: 1565586 - DNA, 14 bp, Homo sapiens
aagttgcgacggag

SEQ ID NO: 1565587 - DNA, 14 bp, Homo sapiens
aagttgctggaaag

SEQ ID NO: 1565588 - DNA, 16 bp, Homo sapiens
aagttgctgtcactgt

SEQ ID NO: 1565589 - DNA, 17 bp, Homo sapiens
aagttgcttttttgact

SEQ ID NO: 1565590 - DNA, 12 bp, Homo sapiens
aagttggaagga

SEQ ID NO: 1565591 - DNA, 19 bp, Homo sapiens
aagttggaaggatctgctg

SEQ ID NO: 1565592 - DNA, 23 bp, Homo sapiens
aagttggagttttgtttcctctg

SEQ ID NO: 1565593 - DNA, 16 bp, Homo sapiens
aagttgggtgtttcca

SEQ ID NO: 1565594 - DNA, 21 bp, Homo sapiens
aagttgggttaataccagctt

SEQ ID NO: 1565595 - DNA, 20 bp, Homo sapiens
aagttggtatcgaaatttgt

SEQ ID NO: 1565596 - DNA, 23 bp, Homo sapiens
aagttggtcctttacactcaggc

SEQ ID NO: 1565597 - DNA, 21 bp, Homo sapiens
aagttggtttagctttggaaa

SEQ ID NO: 1565598 - DNA, 22 bp, Homo sapiens
aagttggtttagctttggaaag

SEQ ID NO: 1565599 - DNA, 15 bp, Homo sapiens
aagttgtaaaataga

SEQ ID NO: 1565600 - DNA, 19 bp, Homo sapiens
aagttgtaacttatattga

SEQ ID NO: 1565601 - DNA, 15 bp, Homo sapiens
aagttgtactttaaa

SEQ ID NO: 1565602 - DNA, 20 bp, Homo sapiens
aagttgtgcttgagccagga

SEQ ID NO: 1565603 - DNA, 14 bp, Homo sapiens
aagttgttgactgt

SEQ ID NO: 1565604 - DNA, 17 bp, Homo sapiens
aagttgttgactgtgat

SEQ ID NO: 1565605 - DNA, 16 bp, Homo sapiens
aagtttacaagcgaga

SEQ ID NO: 1565606 - DNA, 18 bp, Homo sapiens
aagtttacaatcaaagga

SEQ ID NO: 1565607 - DNA, 19 bp, Homo sapiens
aagtttacaatcaaaggaa

SEQ ID NO: 1565608 - DNA, 22 bp, Homo sapiens
aagtttacattgtcctgtagct

SEQ ID NO: 1565609 - DNA, 11 bp, Homo sapiens
aagtttagaga

SEQ ID NO: 1565610 - DNA, 20 bp, Homo sapiens
aagtttcaaacttactattt

SEQ ID NO: 1565611 - DNA, 21 bp, Homo sapiens
aagtttcacaggtcaataaac

SEQ ID NO: 1565612 - DNA, 14 bp, Homo sapiens
aagtttcagacagg

SEQ ID NO: 1565613 - DNA, 18 bp, Homo sapiens
aagtttcagagtatattg

SEQ ID NO: 1565614 - DNA, 23 bp, Homo sapiens
aagtttcattctccctttcacta

SEQ ID NO: 1565615 - DNA, 20 bp, Homo sapiens
aagtttccatagcaacagga

SEQ ID NO: 1565616 - DNA, 11 bp, Homo sapiens
aagtttctaag

SEQ ID NO: 1565617 - DNA, 13 bp, Homo sapiens
aagtttctaagat

SEQ ID NO: 1565618 - DNA, 15 bp, Homo sapiens
aagtttctaagattc

SEQ ID NO: 1565619 - DNA, 21 bp, Homo sapiens
aagtttctaagattctaaagg

SEQ ID NO: 1565620 - DNA, 22 bp, Homo sapiens
aagtttctcagatccttgtttc

SEQ ID NO: 1565621 - DNA, 23 bp, Homo sapiens
aagtttctcagatccttgtttca

SEQ ID NO: 1565622 - DNA, 15 bp, Homo sapiens
aagtttctcttcacc

SEQ ID NO: 1565623 - DNA, 17 bp, Homo sapiens
aagtttctggtgccatt

SEQ ID NO: 1565624 - DNA, 16 bp, Homo sapiens
aagtttgatttcatta

SEQ ID NO: 1565625 - DNA, 21 bp, Homo sapiens
aagtttgcactgtatgctgga

SEQ ID NO: 1565626 - DNA, 13 bp, Homo sapiens
aagtttgcttaga

SEQ ID NO: 1565627 - DNA, 12 bp, Homo sapiens
aagtttgtagcc

SEQ ID NO: 1565628 - DNA, 19 bp, Homo sapiens
aagtttgtagtaaaagtgg

SEQ ID NO: 1565629 - DNA, 15 bp, Homo sapiens
aagtttgtgttctgt

SEQ ID NO: 1565630 - DNA, 16 bp, Homo sapiens
aagtttgtttttgcgt

SEQ ID NO: 1565631 - DNA, 11 bp, Homo sapiens
aagttttagtc

SEQ ID NO: 1565632 - DNA, 15 bp, Homo sapiens
aagttttcaaactgc

SEQ ID NO: 1565633 - DNA, 23 bp, Homo sapiens
aagttttcaaactgctgcatact

SEQ ID NO: 1565634 - DNA, 23 bp, Homo sapiens
aagttttcagaacctcttcccca

SEQ ID NO: 1565635 - DNA, 15 bp, Homo sapiens
aagttttgagtttct

SEQ ID NO: 1565636 - DNA, 20 bp, Homo sapiens
aagttttgctagtgtgcttt

SEQ ID NO: 1565637 - DNA, 12 bp, Homo sapiens
aagttttgctgt

SEQ ID NO: 1565638 - DNA, 13 bp, Homo sapiens
aagttttgtaaaa

SEQ ID NO: 1565639 - DNA, 14 bp, Homo sapiens
aagttttgtcagaa

SEQ ID NO: 1565640 - DNA, 12 bp, Homo sapiens
aagttttgttgt

SEQ ID NO: 1565641 - DNA, 11 bp, Homo sapiens
aagtttttaat

SEQ ID NO: 1565642 - DNA, 16 bp, Homo sapiens
aagtttttctttgtgt

SEQ ID NO: 1565643 - DNA, 15 bp, Homo sapiens
aagtttttgtttgga

SEQ ID NO: 1565644 - DNA, 13 bp, Homo sapiens
aagttttttatgc

SEQ ID NO: 1565645 - DNA, 23 bp, Homo sapiens
aagtttttttgctgctgcctctt

SEQ ID NO: 1565646 - DNA, 15 bp, Homo sapiens
aagttttttttctgg

SEQ ID NO: 1565647 - DNA, 15 bp, Homo sapiens
aataaaaaagatccc

SEQ ID NO: 1565648 - DNA, 21 bp, Homo sapiens
aataaaaaattatgacaatgt

SEQ ID NO: 1565649 - DNA, 20 bp, Homo sapiens
aataaaaagagaaacaagta

SEQ ID NO: 1565650 - DNA, 11 bp, Homo sapiens
aataaaaagga

SEQ ID NO: 1565651 - DNA, 19 bp, Homo sapiens
aataaaaagtgacacagca

SEQ ID NO: 1565652 - DNA, 20 bp, Homo sapiens
aataaaaagtgacacagcag

SEQ ID NO: 1565653 - DNA, 14 bp, Homo sapiens
aataaaaatgttta

SEQ ID NO: 1565654 - DNA, 22 bp, Homo sapiens
aataaaacttatgctagtttat

SEQ ID NO: 1565655 - DNA, 16 bp, Homo sapiens
aataaaagctataaag

SEQ ID NO: 1565656 - DNA, 22 bp, Homo sapiens
aataaaagctataaagtatata

SEQ ID NO: 1565657 - DNA, 12 bp, Homo sapiens
aataaaagtgac

SEQ ID NO: 1565658 - DNA, 13 bp, Homo sapiens
aataaaatatata

SEQ ID NO: 1565659 - DNA, 14 bp, Homo sapiens
aataaaatatatat

SEQ ID NO: 1565660 - DNA, 20 bp, Homo sapiens
aataaaatattcactctcca

SEQ ID NO: 1565661 - DNA, 14 bp, Homo sapiens
aataaaatgtgtac

SEQ ID NO: 1565662 - DNA, 21 bp, Homo sapiens
aataaaatgtgtacagtgaat

SEQ ID NO: 1565663 - DNA, 19 bp, Homo sapiens
aataaaatgtttcattatg

SEQ ID NO: 1565664 - DNA, 15 bp, Homo sapiens
aataaaattgcactt

SEQ ID NO: 1565665 - DNA, 15 bp, Homo sapiens
aataaaattggcacc

SEQ ID NO: 1565666 - DNA, 16 bp, Homo sapiens
aataaacagacaaaaa

SEQ ID NO: 1565667 - DNA, 16 bp, Homo sapiens
aataaacaggaatttt

SEQ ID NO: 1565668 - DNA, 13 bp, Homo sapiens
aataaacattaat

SEQ ID NO: 1565669 - DNA, 22 bp, Homo sapiens
aataaacattaattttgtgcat

SEQ ID NO: 1565670 - DNA, 23 bp, Homo sapiens
aataaacattaattttgtgcatt

SEQ ID NO: 1565671 - DNA, 19 bp, Homo sapiens
aataaacattttttaagaa

SEQ ID NO: 1565672 - DNA, 14 bp, Homo sapiens
aataaacctgaggc

SEQ ID NO: 1565673 - DNA, 15 bp, Homo sapiens
aataaactattggaa

SEQ ID NO: 1565674 - DNA, 13 bp, Homo sapiens
aataaactgtatt

SEQ ID NO: 1565675 - DNA, 14 bp, Homo sapiens
aataaactgtatta

SEQ ID NO: 1565676 - DNA, 17 bp, Homo sapiens
aataaactgtattaaat

SEQ ID NO: 1565677 - DNA, 19 bp, Homo sapiens
aataaacttagaggaaaat

SEQ ID NO: 1565678 - DNA, 12 bp, Homo sapiens
aataaacttttt

SEQ ID NO: 1565679 - DNA, 17 bp, Homo sapiens
aataaacttttttttga

SEQ ID NO: 1565680 - DNA, 20 bp, Homo sapiens
aataaagaactccttatttt

SEQ ID NO: 1565681 - DNA, 21 bp, Homo sapiens
aataaagaactccttattttg

SEQ ID NO: 1565682 - DNA, 19 bp, Homo sapiens
aataaagaagaaaataacc

SEQ ID NO: 1565683 - DNA, 11 bp, Homo sapiens
aataaagacag

SEQ ID NO: 1565684 - DNA, 17 bp, Homo sapiens
aataaagatgtgaaaac

SEQ ID NO: 1565685 - DNA, 14 bp, Homo sapiens
aataaagcaatgtg

SEQ ID NO: 1565686 - DNA, 11 bp, Homo sapiens
aataaagcatt

SEQ ID NO: 1565687 - DNA, 15 bp, Homo sapiens
aataaagcttttgga

SEQ ID NO: 1565688 - DNA, 11 bp, Homo sapiens
aataaaggcag

SEQ ID NO: 1565689 - DNA, 12 bp, Homo sapiens
aataaaggcagc

SEQ ID NO: 1565690 - DNA, 13 bp, Homo sapiens
aataaaggcagct

SEQ ID NO: 1565691 - DNA, 16 bp, Homo sapiens
aataaaggcagctgcc

SEQ ID NO: 1565692 - DNA, 17 bp, Homo sapiens
aataaaggcagctgcct

SEQ ID NO: 1565693 - DNA, 20 bp, Homo sapiens
aataaaggcagctgcctctg

SEQ ID NO: 1565694 - DNA, 21 bp, Homo sapiens
aataaaggcagctgcctctgc

SEQ ID NO: 1565695 - DNA, 22 bp, Homo sapiens
aataaaggcagctgcctctgct

SEQ ID NO: 1565696 - DNA, 15 bp, Homo sapiens
aataaaggcagtttt

SEQ ID NO: 1565697 - DNA, 18 bp, Homo sapiens
aataaaggcagttttcta

SEQ ID NO: 1565698 - DNA, 23 bp, Homo sapiens
aataaagggagaatggtgctgtt

SEQ ID NO: 1565699 - DNA, 20 bp, Homo sapiens
aataaaggtcccttagcccc

SEQ ID NO: 1565700 - DNA, 16 bp, Homo sapiens
aataaaggtctttgca

SEQ ID NO: 1565701 - DNA, 18 bp, Homo sapiens
aataaaggttgttttgaa

SEQ ID NO: 1565702 - DNA, 14 bp, Homo sapiens
aataaagtaattat

SEQ ID NO: 1565703 - DNA, 15 bp, Homo sapiens
aataaagtataatgt

SEQ ID NO: 1565704 - DNA, 14 bp, Homo sapiens
aataaagtatataa

SEQ ID NO: 1565705 - DNA, 15 bp, Homo sapiens
aataaagtgtaacaa

SEQ ID NO: 1565706 - DNA, 18 bp, Homo sapiens
aataaagtgtaacaattg

SEQ ID NO: 1565707 - DNA, 21 bp, Homo sapiens
aataaagttgagcttagtttt

SEQ ID NO: 1565708 - DNA, 14 bp, Homo sapiens
aataaagtttacaa

SEQ ID NO: 1565709 - DNA, 18 bp, Homo sapiens
aataaataaaaactaatt

SEQ ID NO: 1565710 - DNA, 14 bp, Homo sapiens
aataaataaaaatg

SEQ ID NO: 1565711 - DNA, 23 bp, Homo sapiens
aataaataaaattcatttctaca

SEQ ID NO: 1565712 - DNA, 17 bp, Homo sapiens
aataaataaagaagaaa

SEQ ID NO: 1565713 - DNA, 22 bp, Homo sapiens
aataaatagggaagatggagac

SEQ ID NO: 1565714 - DNA, 11 bp, Homo sapiens
aataaatatgt

SEQ ID NO: 1565715 - DNA, 12 bp, Homo sapiens
aataaatatgta

SEQ ID NO: 1565716 - DNA, 15 bp, Homo sapiens
aataaatatgtaata

SEQ ID NO: 1565717 - DNA, 14 bp, Homo sapiens
aataaatattctgc

SEQ ID NO: 1565718 - DNA, 14 bp, Homo sapiens
aataaatatttatg

SEQ ID NO: 1565719 - DNA, 19 bp, Homo sapiens
aataaatccacccatgtta

SEQ ID NO: 1565720 - DNA, 19 bp, Homo sapiens
aataaatctaggatgtgat

SEQ ID NO: 1565721 - DNA, 19 bp, Homo sapiens
aataaatctcttctttgct

SEQ ID NO: 1565722 - DNA, 17 bp, Homo sapiens
aataaatctgacccagt

SEQ ID NO: 1565723 - DNA, 11 bp, Homo sapiens
aataaatcttt

SEQ ID NO: 1565724 - DNA, 22 bp, Homo sapiens
aataaatgagctatgtattaac

SEQ ID NO: 1565725 - DNA, 20 bp, Homo sapiens
aataaatgtatcttattcac

SEQ ID NO: 1565726 - DNA, 21 bp, Homo sapiens
aataaatgtatcttattcaca

SEQ ID NO: 1565727 - DNA, 12 bp, Homo sapiens
aataaatgtgcc

SEQ ID NO: 1565728 - DNA, 16 bp, Homo sapiens
aataaattatggcatt

SEQ ID NO: 1565729 - DNA, 14 bp, Homo sapiens
aataaattctgact

SEQ ID NO: 1565730 - DNA, 23 bp, Homo sapiens
aataaattgaataggtagtatca

SEQ ID NO: 1565731 - DNA, 16 bp, Homo sapiens
aataaattttgtttca

SEQ ID NO: 1565732 - DNA, 22 bp, Homo sapiens
aataaattttttataaaagtgt

SEQ ID NO: 1565733 - DNA, 15 bp, Homo sapiens
aataacaaagccctt

SEQ ID NO: 1565734 - DNA, 18 bp, Homo sapiens
aataacaaggagatttct

SEQ ID NO: 1565735 - DNA, 13 bp, Homo sapiens
aataacaatgtgc

SEQ ID NO: 1565736 - DNA, 14 bp, Homo sapiens
aataacactgtatt

SEQ ID NO: 1565737 - DNA, 20 bp, Homo sapiens
aataacataatttgtacata

SEQ ID NO: 1565738 - DNA, 17 bp, Homo sapiens
aataacatatctaaagt

SEQ ID NO: 1565739 - DNA, 15 bp, Homo sapiens
aataacatattcttg

SEQ ID NO: 1565740 - DNA, 18 bp, Homo sapiens
aataacatattcttgctt

SEQ ID NO: 1565741 - DNA, 16 bp, Homo sapiens
aataacatctgaaaag

SEQ ID NO: 1565742 - DNA, 20 bp, Homo sapiens
aataaccgcttggtttgcaa

SEQ ID NO: 1565743 - DNA, 17 bp, Homo sapiens
aataaccggatatatac

SEQ ID NO: 1565744 - DNA, 13 bp, Homo sapiens
aataacctttctg

SEQ ID NO: 1565745 - DNA, 22 bp, Homo sapiens
aataactaatgctaagaaatgc

SEQ ID NO: 1565746 - DNA, 13 bp, Homo sapiens
aataactgaattt

SEQ ID NO: 1565747 - DNA, 16 bp, Homo sapiens
aataactgaatttgga

SEQ ID NO: 1565748 - DNA, 20 bp, Homo sapiens
aataactgatctcaagtata

SEQ ID NO: 1565749 - DNA, 13 bp, Homo sapiens
aataactgtgaag

SEQ ID NO: 1565750 - DNA, 20 bp, Homo sapiens
aataactgtgaagtttacat

SEQ ID NO: 1565751 - DNA, 15 bp, Homo sapiens
aataactgtgtactg

SEQ ID NO: 1565752 - DNA, 23 bp, Homo sapiens
aataacttagactctagtattta

SEQ ID NO: 1565753 - DNA, 15 bp, Homo sapiens
aataagaaagtataa

SEQ ID NO: 1565754 - DNA, 14 bp, Homo sapiens
aataagaacagatc

SEQ ID NO: 1565755 - DNA, 14 bp, Homo sapiens
aataagacaagaga

SEQ ID NO: 1565756 - DNA, 21 bp, Homo sapiens
aataagacaagagatctacac

SEQ ID NO: 1565757 - DNA, 14 bp, Homo sapiens
aataagagaaagaa

SEQ ID NO: 1565758 - DNA, 15 bp, Homo sapiens
aataagatggctgtg

SEQ ID NO: 1565759 - DNA, 16 bp, Homo sapiens
aataagattggtgttc

SEQ ID NO: 1565760 - DNA, 22 bp, Homo sapiens
aataagattggtgttcgtttcc

SEQ ID NO: 1565761 - DNA, 19 bp, Homo sapiens
aataagcactgtaaacttc

SEQ ID NO: 1565762 - DNA, 18 bp, Homo sapiens
aataagctagatacgaaa

SEQ ID NO: 1565763 - DNA, 15 bp, Homo sapiens
aataagctctagttc

SEQ ID NO: 1565764 - DNA, 22 bp, Homo sapiens
aataagctctagttcttaacaa

SEQ ID NO: 1565765 - DNA, 19 bp, Homo sapiens
aataaggaggaggagggag

SEQ ID NO: 1565766 - DNA, 16 bp, Homo sapiens
aataaggcccagagcg

SEQ ID NO: 1565767 - DNA, 21 bp, Homo sapiens
aataagggaaaaatcaagtat

SEQ ID NO: 1565768 - DNA, 22 bp, Homo sapiens
aataagtgaagaatacatcaga

SEQ ID NO: 1565769 - DNA, 17 bp, Homo sapiens
aataagtggattttgta

SEQ ID NO: 1565770 - DNA, 22 bp, Homo sapiens
aataagttcaaattcttctgaa

SEQ ID NO: 1565771 - DNA, 16 bp, Homo sapiens
aataagttcatacaat

SEQ ID NO: 1565772 - DNA, 17 bp, Homo sapiens
aataataaaaaatttca

SEQ ID NO: 1565773 - DNA, 13 bp, Homo sapiens
aataataaacttt

SEQ ID NO: 1565774 - DNA, 15 bp, Homo sapiens
aataataaagtatga

SEQ ID NO: 1565775 - DNA, 14 bp, Homo sapiens
aataataaatattg

SEQ ID NO: 1565776 - DNA, 14 bp, Homo sapiens
aataataaatattt

SEQ ID NO: 1565777 - DNA, 12 bp, Homo sapiens
aataataataat

SEQ ID NO: 1565778 - DNA, 18 bp, Homo sapiens
aataatacctaagccttc

SEQ ID NO: 1565779 - DNA, 18 bp, Homo sapiens
aataatagggaaaatacc

SEQ ID NO: 1565780 - DNA, 15 bp, Homo sapiens
aataatatgcattgt

SEQ ID NO: 1565781 - DNA, 22 bp, Homo sapiens
aataatatttcaagtgcctaga

SEQ ID NO: 1565782 - DNA, 15 bp, Homo sapiens
aataatcacattgac

SEQ ID NO: 1565783 - DNA, 17 bp, Homo sapiens
aataatcacattgactt

SEQ ID NO: 1565784 - DNA, 20 bp, Homo sapiens
aataatcacgctttcctgaa

SEQ ID NO: 1565785 - DNA, 15 bp, Homo sapiens
aataatcatgtgaaa

SEQ ID NO: 1565786 - DNA, 16 bp, Homo sapiens
aataatcggcccacag

SEQ ID NO: 1565787 - DNA, 16 bp, Homo sapiens
aataatctatttctat

SEQ ID NO: 1565788 - DNA, 14 bp, Homo sapiens
aataatctttgggt

SEQ ID NO: 1565789 - DNA, 12 bp, Homo sapiens
aataatgaaaat

SEQ ID NO: 1565790 - DNA, 14 bp, Homo sapiens
aataatgagagcaa

SEQ ID NO: 1565791 - DNA, 19 bp, Homo sapiens
aataatgagagcaaatgca

SEQ ID NO: 1565792 - DNA, 19 bp, Homo sapiens
aataatgctacaattttaa

SEQ ID NO: 1565793 - DNA, 21 bp, Homo sapiens
aataatgctacaattttaaga

SEQ ID NO: 1565794 - DNA, 14 bp, Homo sapiens
aataatgcttcaga

SEQ ID NO: 1565795 - DNA, 17 bp, Homo sapiens
aataatgctttaaaata

SEQ ID NO: 1565796 - DNA, 13 bp, Homo sapiens
aataatgtactca

SEQ ID NO: 1565797 - DNA, 16 bp, Homo sapiens
aataatgtactcacat

SEQ ID NO: 1565798 - DNA, 19 bp, Homo sapiens
aataatgtactcacatata

SEQ ID NO: 1565799 - DNA, 11 bp, Homo sapiens
aataatgtctc

SEQ ID NO: 1565800 - DNA, 12 bp, Homo sapiens
aataatgtctct

SEQ ID NO: 1565801 - DNA, 19 bp, Homo sapiens
aataatgttaacatggaca

SEQ ID NO: 1565802 - DNA, 15 bp, Homo sapiens
aataatgttctgtca

SEQ ID NO: 1565803 - DNA, 17 bp, Homo sapiens
aataattctgagttttg

SEQ ID NO: 1565804 - DNA, 17 bp, Homo sapiens
aataattcttttctgag

SEQ ID NO: 1565805 - DNA, 21 bp, Homo sapiens
aataattgtttccaacttgtc

SEQ ID NO: 1565806 - DNA, 13 bp, Homo sapiens
aataatttctaat

SEQ ID NO: 1565807 - DNA, 12 bp, Homo sapiens
aataatttgaat

SEQ ID NO: 1565808 - DNA, 12 bp, Homo sapiens
aataattttcca

SEQ ID NO: 1565809 - DNA, 20 bp, Homo sapiens
aataattttccaagtaaagt

SEQ ID NO: 1565810 - DNA, 13 bp, Homo sapiens
aataattttggaa

SEQ ID NO: 1565811 - DNA, 18 bp, Homo sapiens
aatacaaatggattttgg

SEQ ID NO: 1565812 - DNA, 17 bp, Homo sapiens
aatacaacaacaacaaa

SEQ ID NO: 1565813 - DNA, 19 bp, Homo sapiens
aatacaacaacaacaaaaa

SEQ ID NO: 1565814 - DNA, 13 bp, Homo sapiens
aatacaaccagcc

SEQ ID NO: 1565815 - DNA, 18 bp, Homo sapiens
aatacaacttaaataata

SEQ ID NO: 1565816 - DNA, 20 bp, Homo sapiens
aatacaaggtataataaaat

SEQ ID NO: 1565817 - DNA, 22 bp, Homo sapiens
aatacaaggtataataaaatta

SEQ ID NO: 1565818 - DNA, 13 bp, Homo sapiens
aatacaatgtaca

SEQ ID NO: 1565819 - DNA, 15 bp, Homo sapiens
aatacaatttgtact

SEQ ID NO: 1565820 - DNA, 14 bp, Homo sapiens
aatacacactcaaa

SEQ ID NO: 1565821 - DNA, 23 bp, Homo sapiens
aatacacatagcatgtaatggta

SEQ ID NO: 1565822 - DNA, 20 bp, Homo sapiens
aatacaccacctcactcctg

SEQ ID NO: 1565823 - DNA, 22 bp, Homo sapiens
aatacaccacctcactcctgtt

SEQ ID NO: 1565824 - DNA, 18 bp, Homo sapiens
aatacaccgtttagaaaa

SEQ ID NO: 1565825 - DNA, 21 bp, Homo sapiens
aatacacgcgtgtgctcctct

SEQ ID NO: 1565826 - DNA, 17 bp, Homo sapiens
aatacactagttgtttc

SEQ ID NO: 1565827 - DNA, 15 bp, Homo sapiens
aatacagacactaag

SEQ ID NO: 1565828 - DNA, 20 bp, Homo sapiens
aatacagacactaagttata

SEQ ID NO: 1565829 - DNA, 20 bp, Homo sapiens
aatacagataattcatttgt

SEQ ID NO: 1565830 - DNA, 16 bp, Homo sapiens
aatacagatcatcttg

SEQ ID NO: 1565831 - DNA, 20 bp, Homo sapiens
aatacagctgaagtcaaaat

SEQ ID NO: 1565832 - DNA, 13 bp, Homo sapiens
aatacaggaaaca

SEQ ID NO: 1565833 - DNA, 19 bp, Homo sapiens
aatacagtaagctgctcta

SEQ ID NO: 1565834 - DNA, 14 bp, Homo sapiens
aatacagttatttc

SEQ ID NO: 1565835 - DNA, 16 bp, Homo sapiens
aatacagttatttcat

SEQ ID NO: 1565836 - DNA, 21 bp, Homo sapiens
aatacatattccatgggactt

SEQ ID NO: 1565837 - DNA, 22 bp, Homo sapiens
aagtatttttgattaacaatgt

SEQ ID NO: 1565838 - DNA, 24 bp, Homo sapiens
aagtatttttgattaacaatgtat

SEQ ID NO: 1565839 - DNA, 22 bp, Homo sapiens
aagtatttttgtctcttagaaa

SEQ ID NO: 1565840 - DNA, 13 bp, Homo sapiens
aagtcaaaaaatt

SEQ ID NO: 1565841 - DNA, 16 bp, Homo sapiens
aagtcaaaaggtgcct

SEQ ID NO: 1565842 - DNA, 14 bp, Homo sapiens
aagtcaaaatatgt

SEQ ID NO: 1565843 - DNA, 17 bp, Homo sapiens
aagtcaaaatatgtaag

SEQ ID NO: 1565844 - DNA, 16 bp, Homo sapiens
aagtcaaacacttgtg

SEQ ID NO: 1565845 - DNA, 22 bp, Homo sapiens
aagtcaaagtaaaacttgctgc

SEQ ID NO: 1565846 - DNA, 14 bp, Homo sapiens
aagtcaacagtaaa

SEQ ID NO: 1565847 - DNA, 19 bp, Homo sapiens
aagtcaacagtaaaccact

SEQ ID NO: 1565848 - DNA, 14 bp, Homo sapiens
aagtcaagcacatg

SEQ ID NO: 1565849 - DNA, 13 bp, Homo sapiens
aagtcacagctgc

SEQ ID NO: 1565850 - DNA, 14 bp, Homo sapiens
aagtcacagctgca

SEQ ID NO: 1565851 - DNA, 16 bp, Homo sapiens
aagtcacagctgcagc

SEQ ID NO: 1565852 - DNA, 22 bp, Homo sapiens
aagtcacagctgcagctgggcc

SEQ ID NO: 1565853 - DNA, 19 bp, Homo sapiens
aagtcacagttaaggagaa

SEQ ID NO: 1565854 - DNA, 17 bp, Homo sapiens
aagtcacatcacaggac

SEQ ID NO: 1565855 - DNA, 22 bp, Homo sapiens
aagtcacatccctgtaaattgc

SEQ ID NO: 1565856 - DNA, 21 bp, Homo sapiens
aagtcacggctgcgcactgtg

SEQ ID NO: 1565857 - DNA, 21 bp, Homo sapiens
aagtcactcacactggccaca

SEQ ID NO: 1565858 - DNA, 16 bp, Homo sapiens
aagtcactgaacaaaa

SEQ ID NO: 1565859 - DNA, 21 bp, Homo sapiens
aagtcactggccagtggctgg

SEQ ID NO: 1565860 - DNA, 17 bp, Homo sapiens
aagtcacttaactataa

SEQ ID NO: 1565861 - DNA, 14 bp, Homo sapiens
aagtcacttccagt

SEQ ID NO: 1565862 - DNA, 15 bp, Homo sapiens
aagtcacttccagtg

SEQ ID NO: 1565863 - DNA, 18 bp, Homo sapiens
aagtcagaatcagaagat

SEQ ID NO: 1565864 - DNA, 16 bp, Homo sapiens
aagtcagactgctggg

SEQ ID NO: 1565865 - DNA, 20 bp, Homo sapiens
aagtcagatggaaaattcat

SEQ ID NO: 1565866 - DNA, 20 bp, Homo sapiens
aagtcagatttttatttatg

SEQ ID NO: 1565867 - DNA, 22 bp, Homo sapiens
aagtcagctaattggactttta

SEQ ID NO: 1565868 - DNA, 15 bp, Homo sapiens
aagtcaggtccaatt

SEQ ID NO: 1565869 - DNA, 16 bp, Homo sapiens
aagtcaggtccaattt

SEQ ID NO: 1565870 - DNA, 19 bp, Homo sapiens
aagtcatctacttaataaa

SEQ ID NO: 1565871 - DNA, 17 bp, Homo sapiens
aagtcatgaagcccaag

SEQ ID NO: 1565872 - DNA, 17 bp, Homo sapiens
aagtcatggagaatctg

SEQ ID NO: 1565873 - DNA, 18 bp, Homo sapiens
aagtcatttttgtatttt

SEQ ID NO: 1565874 - DNA, 22 bp, Homo sapiens
aagtcatttttgtatttttcat

SEQ ID NO: 1565875 - DNA, 14 bp, Homo sapiens
aagtccaggactgg

SEQ ID NO: 1565876 - DNA, 18 bp, Homo sapiens
aagtccaggactgggtct

SEQ ID NO: 1565877 - DNA, 20 bp, Homo sapiens
aagtccagtgtttctttttt

SEQ ID NO: 1565878 - DNA, 23 bp, Homo sapiens
aagtcccaccctcttcccatgtc

SEQ ID NO: 1565879 - DNA, 20 bp, Homo sapiens
aagtcccagagcacctcacc

SEQ ID NO: 1565880 - DNA, 21 bp, Homo sapiens
aagtcctagctcctcctcctg

SEQ ID NO: 1565881 - DNA, 15 bp, Homo sapiens
aagtcctctgctcca

SEQ ID NO: 1565882 - DNA, 12 bp, Homo sapiens
aagtcctggcta

SEQ ID NO: 1565883 - DNA, 18 bp, Homo sapiens
aagtcgccagtcactgct

SEQ ID NO: 1565884 - DNA, 20 bp, Homo sapiens
aagtcgccagtcactgctgc

SEQ ID NO: 1565885 - DNA, 22 bp, Homo sapiens
aagtcgggtcaaaaataaaata

SEQ ID NO: 1565886 - DNA, 16 bp, Homo sapiens
aagtctaaatatttcc

SEQ ID NO: 1565887 - DNA, 18 bp, Homo sapiens
aagtctaagcaagatgtt

SEQ ID NO: 1565888 - DNA, 13 bp, Homo sapiens
aagtctaatgaag

SEQ ID NO: 1565889 - DNA, 12 bp, Homo sapiens
aagtctatgctt

SEQ ID NO: 1565890 - DNA, 13 bp, Homo sapiens
aagtctatgctta

SEQ ID NO: 1565891 - DNA, 12 bp, Homo sapiens
aagtctatttta

SEQ ID NO: 1565892 - DNA, 11 bp, Homo sapiens
aagtctcagct

SEQ ID NO: 1565893 - DNA, 13 bp, Homo sapiens
aagtctccagccc

SEQ ID NO: 1565894 - DNA, 21 bp, Homo sapiens
aagtctccctgcacagcctct

SEQ ID NO: 1565895 - DNA, 14 bp, Homo sapiens
aagtctccttcccc

SEQ ID NO: 1565896 - DNA, 18 bp, Homo sapiens
aagtctctaattctatta

SEQ ID NO: 1565897 - DNA, 21 bp, Homo sapiens
aagtctctgctggcccagcca

SEQ ID NO: 1565898 - DNA, 11 bp, Homo sapiens
aagtctctgtg

SEQ ID NO: 1565899 - DNA, 14 bp, Homo sapiens
aagtctctgtgaat

SEQ ID NO: 1565900 - DNA, 15 bp, Homo sapiens
aagtctggctttgct

SEQ ID NO: 1565901 - DNA, 17 bp, Homo sapiens
aagtctgggatgtagaa

SEQ ID NO: 1565902 - DNA, 20 bp, Homo sapiens
aagtctgggatgtagaactt

SEQ ID NO: 1565903 - DNA, 17 bp, Homo sapiens
aagtcttagatgtatat

SEQ ID NO: 1565904 - DNA, 12 bp, Homo sapiens
aagtcttatctt

SEQ ID NO: 1565905 - DNA, 14 bp, Homo sapiens
aagtctttaataaa

SEQ ID NO: 1565906 - DNA, 15 bp, Homo sapiens
aagtctttcatggct

SEQ ID NO: 1565907 - DNA, 17 bp, Homo sapiens
aagtctttgccttctct

SEQ ID NO: 1565908 - DNA, 11 bp, Homo sapiens
aagtctttgct

SEQ ID NO: 1565909 - DNA, 16 bp, Homo sapiens
aagtcttttttgatca

SEQ ID NO: 1565910 - DNA, 11 bp, Homo sapiens
aagtgaaatta

SEQ ID NO: 1565911 - DNA, 14 bp, Homo sapiens
aagtgaagtgatac

SEQ ID NO: 1565912 - DNA, 17 bp, Homo sapiens
aagtgaatctgattgca

SEQ ID NO: 1565913 - DNA, 21 bp, Homo sapiens
aagtgacaaagccagaggaga

SEQ ID NO: 1565914 - DNA, 12 bp, Homo sapiens
aagtgacacaga

SEQ ID NO: 1565915 - DNA, 17 bp, Homo sapiens
aagtgacaccaataaat

SEQ ID NO: 1565916 - DNA, 15 bp, Homo sapiens
aagtgactctcagcg

SEQ ID NO: 1565917 - DNA, 18 bp, Homo sapiens
aagtgacttctggagaaa

SEQ ID NO: 1565918 - DNA, 18 bp, Homo sapiens
aagtgagagccagcagca

SEQ ID NO: 1565919 - DNA, 18 bp, Homo sapiens
aagtgagatggtatgaaa

SEQ ID NO: 1565920 - DNA, 19 bp, Homo sapiens
aagtgagatggtatgaaat

SEQ ID NO: 1565921 - DNA, 14 bp, Homo sapiens
aagtgagcagaaca

SEQ ID NO: 1565922 - DNA, 22 bp, Homo sapiens
aagtgagcagagatgtactgca

SEQ ID NO: 1565923 - DNA, 16 bp, Homo sapiens
aagtgaggcccaagga

SEQ ID NO: 1565924 - DNA, 19 bp, Homo sapiens
aagtgagggctcactcagc

SEQ ID NO: 1565925 - DNA, 20 bp, Homo sapiens
aagtgagtggtgtgactctt

SEQ ID NO: 1565926 - DNA, 18 bp, Homo sapiens
aagtgagtttgtaaatat

SEQ ID NO: 1565927 - DNA, 22 bp, Homo sapiens
aagtgatatcacctctcttcag

SEQ ID NO: 1565928 - DNA, 22 bp, Homo sapiens
aagtgatctaaaatttgtaata

SEQ ID NO: 1565929 - DNA, 14 bp, Homo sapiens
aagtgattcaccca

SEQ ID NO: 1565930 - DNA, 17 bp, Homo sapiens
aagtgattctaagattt

SEQ ID NO: 1565931 - DNA, 20 bp, Homo sapiens
aagtgcagggaggaaaagtg

SEQ ID NO: 1565932 - DNA, 16 bp, Homo sapiens
aagtgcatgctctctg

SEQ ID NO: 1565933 - DNA, 12 bp, Homo sapiens
aagtgcccaaag

SEQ ID NO: 1565934 - DNA, 17 bp, Homo sapiens
aagtgcccaaagtgggg

SEQ ID NO: 1565935 - DNA, 18 bp, Homo sapiens
aagtgcccaaagtgggga

SEQ ID NO: 1565936 - DNA, 19 bp, Homo sapiens
aagtgcccaaagtggggag

SEQ ID NO: 1565937 - DNA, 17 bp, Homo sapiens
aagtgcccacatttgat

SEQ ID NO: 1565938 - DNA, 13 bp, Homo sapiens
aagtgcccagccc

SEQ ID NO: 1565939 - DNA, 17 bp, Homo sapiens
aagtgcccagcccctgc

SEQ ID NO: 1565940 - DNA, 18 bp, Homo sapiens
aagtgcccagtggagcct

SEQ ID NO: 1565941 - DNA, 19 bp, Homo sapiens
aagtgcctagactgttact

SEQ ID NO: 1565942 - DNA, 17 bp, Homo sapiens
aagtgcctcttgttgca

SEQ ID NO: 1565943 - DNA, 23 bp, Homo sapiens
aagtgcctttctgcagtttttca

SEQ ID NO: 1565944 - DNA, 17 bp, Homo sapiens
aagtgcggtgctttagc

SEQ ID NO: 1565945 - DNA, 18 bp, Homo sapiens
aagtgctaaggttctaag

SEQ ID NO: 1565946 - DNA, 13 bp, Homo sapiens
aagtgctccctgg

SEQ ID NO: 1565947 - DNA, 11 bp, Homo sapiens
aagtgctcttt

SEQ ID NO: 1565948 - DNA, 13 bp, Homo sapiens
aagtgctgagatt

SEQ ID NO: 1565949 - DNA, 14 bp, Homo sapiens
aagtgctgtttatt

SEQ ID NO: 1565950 - DNA, 22 bp, Homo sapiens
aagtgctgtttattaatcttag

SEQ ID NO: 1565951 - DNA, 20 bp, Homo sapiens
aagtggaacgaaaatgaaag

SEQ ID NO: 1565952 - DNA, 20 bp, Homo sapiens
aagtggaccaggacaggacc

SEQ ID NO: 1565953 - DNA, 22 bp, Homo sapiens
aagtggaccttaggccttcctc

SEQ ID NO: 1565954 - DNA, 14 bp, Homo sapiens
aatacatgctgcta

SEQ ID NO: 1565955 - DNA, 18 bp, Homo sapiens
aatacattccattgtttt

SEQ ID NO: 1565956 - DNA, 20 bp, Homo sapiens
aatacattccattgttttag

SEQ ID NO: 1565957 - DNA, 13 bp, Homo sapiens
aatacattctttt

SEQ ID NO: 1565958 - DNA, 20 bp, Homo sapiens
aatacatttgtatttatgtg

SEQ ID NO: 1565959 - DNA, 20 bp, Homo sapiens
aatacatttgtattttgtga

SEQ ID NO: 1565960 - DNA, 21 bp, Homo sapiens
aataccacatcaaataagaaa

SEQ ID NO: 1565961 - DNA, 15 bp, Homo sapiens
aataccactgtaatt

SEQ ID NO: 1565962 - DNA, 15 bp, Homo sapiens
aataccattaaaact

SEQ ID NO: 1565963 - DNA, 18 bp, Homo sapiens
aataccatttagtaagaa

SEQ ID NO: 1565964 - DNA, 20 bp, Homo sapiens
aataccattttttaaggaaa

SEQ ID NO: 1565965 - DNA, 21 bp, Homo sapiens
aatacccttgtgagagcccat

SEQ ID NO: 1565966 - DNA, 17 bp, Homo sapiens
aataccgctcagtattt

SEQ ID NO: 1565967 - DNA, 15 bp, Homo sapiens
aatacctcatgcttc

SEQ ID NO: 1565968 - DNA, 15 bp, Homo sapiens
aatacctctgtgtgc

SEQ ID NO: 1565969 - DNA, 16 bp, Homo sapiens
aatacctctgtgtgct

SEQ ID NO: 1565970 - DNA, 18 bp, Homo sapiens
aatacctgattgatcaca

SEQ ID NO: 1565971 - DNA, 15 bp, Homo sapiens
aatacggaagagcag

SEQ ID NO: 1565972 - DNA, 20 bp, Homo sapiens
aatacgtgccagatataact

SEQ ID NO: 1565973 - DNA, 21 bp, Homo sapiens
aatacgtgccagatataactg

SEQ ID NO: 1565974 - DNA, 15 bp, Homo sapiens
aatactatttaagat

SEQ ID NO: 1565975 - DNA, 19 bp, Homo sapiens
aatactatttaagatgtga

SEQ ID NO: 1565976 - DNA, 21 bp, Homo sapiens
aatactatttaagatgtgaaa

SEQ ID NO: 1565977 - DNA, 16 bp, Homo sapiens
aatactcaccaaaata

SEQ ID NO: 1565978 - DNA, 17 bp, Homo sapiens
aatactctacttacagt

SEQ ID NO: 1565979 - DNA, 20 bp, Homo sapiens
aatactctagcctgggccag

SEQ ID NO: 1565980 - DNA, 23 bp, Homo sapiens
aatactctgctatttctcttgct

SEQ ID NO: 1565981 - DNA, 11 bp, Homo sapiens
aatactgacct

SEQ ID NO: 1565982 - DNA, 14 bp, Homo sapiens
aatactgcaaatca

SEQ ID NO: 1565983 - DNA, 13 bp, Homo sapiens
aatactgctctga

SEQ ID NO: 1565984 - DNA, 16 bp, Homo sapiens
aatactggtctcaggc

SEQ ID NO: 1565985 - DNA, 14 bp, Homo sapiens
aatactgttattct

SEQ ID NO: 1565986 - DNA, 17 bp, Homo sapiens
aatactgttattctttg

SEQ ID NO: 1565987 - DNA, 18 bp, Homo sapiens
aatactgttattctttgc

SEQ ID NO: 1565988 - DNA, 21 bp, Homo sapiens
aatactgttattctttgcact

SEQ ID NO: 1565989 - DNA, 17 bp, Homo sapiens
aatacttcgatgatgat

SEQ ID NO: 1565990 - DNA, 15 bp, Homo sapiens
aatacttgactcatt

SEQ ID NO: 1565991 - DNA, 20 bp, Homo sapiens
aatacttttgcatttttcct

SEQ ID NO: 1565992 - DNA, 20 bp, Homo sapiens
aatagaaataaattcctaaa

SEQ ID NO: 1565993 - DNA, 15 bp, Homo sapiens
aatagaaattttgta

SEQ ID NO: 1565994 - DNA, 17 bp, Homo sapiens
aatagaaattttgtaag

SEQ ID NO: 1565995 - DNA, 19 bp, Homo sapiens
aatagaaattttgtaagaa

SEQ ID NO: 1565996 - DNA, 22 bp, Homo sapiens
aatagaaggatgtacatttcca

SEQ ID NO: 1565997 - DNA, 20 bp, Homo sapiens
aatagaatataattatcgga

SEQ ID NO: 1565998 - DNA, 16 bp, Homo sapiens
aatagaattataactg

SEQ ID NO: 1565999 - DNA, 22 bp, Homo sapiens
aatagacaaatagaaaatggtc

SEQ ID NO: 1566000 - DNA, 15 bp, Homo sapiens
aatagacacatacat

SEQ ID NO: 1566001 - DNA, 20 bp, Homo sapiens
aatagacagtatatttatag

SEQ ID NO: 1566002 - DNA, 20 bp, Homo sapiens
aatagagcaaaattgatgtg

SEQ ID NO: 1566003 - DNA, 22 bp, Homo sapiens
aatagagtttgctattagagca

SEQ ID NO: 1566004 - DNA, 22 bp, Homo sapiens
aatagatataaatttttaagag

SEQ ID NO: 1566005 - DNA, 18 bp, Homo sapiens
aatagatatgaaagctga

SEQ ID NO: 1566006 - DNA, 16 bp, Homo sapiens
aatagatgctgactgt

SEQ ID NO: 1566007 - DNA, 13 bp, Homo sapiens
aatagatggaatt

SEQ ID NO: 1566008 - DNA, 19 bp, Homo sapiens
aatagatggaatttggaac

SEQ ID NO: 1566009 - DNA, 15 bp, Homo sapiens
aatagatgtctcaaa

SEQ ID NO: 1566010 - DNA, 19 bp, Homo sapiens
aatagattactgatgtgat

SEQ ID NO: 1566011 - DNA, 21 bp, Homo sapiens
aatagattactgatgtgatat

SEQ ID NO: 1566012 - DNA, 17 bp, Homo sapiens
aatagcaacttttgtgt

SEQ ID NO: 1566013 - DNA, 18 bp, Homo sapiens
aatagcagagagccaaat

SEQ ID NO: 1566014 - DNA, 14 bp, Homo sapiens
aatagcagcctttc

SEQ ID NO: 1566015 - DNA, 19 bp, Homo sapiens
aatagcattgtttttgtca

SEQ ID NO: 1566016 - DNA, 21 bp, Homo sapiens
aatagccaaaaaggcaaataa

SEQ ID NO: 1566017 - DNA, 20 bp, Homo sapiens
aatagccacaattatataaa

SEQ ID NO: 1566018 - DNA, 22 bp, Homo sapiens
aatagccagagaggagcacctg

SEQ ID NO: 1566019 - DNA, 12 bp, Homo sapiens
aatagccccaga

SEQ ID NO: 1566020 - DNA, 13 bp, Homo sapiens
aatagcctgaatt

SEQ ID NO: 1566021 - DNA, 16 bp, Homo sapiens
aatagcttctgtgtgt

SEQ ID NO: 1566022 - DNA, 18 bp, Homo sapiens
aatagcttctgtgtgtga

SEQ ID NO: 1566023 - DNA, 21 bp, Homo sapiens
aatagctttaccctcaggcat

SEQ ID NO: 1566024 - DNA, 11 bp, Homo sapiens
aataggaataa

SEQ ID NO: 1566025 - DNA, 20 bp, Homo sapiens
aataggaatcattcagaaat

SEQ ID NO: 1566026 - DNA, 16 bp, Homo sapiens
aataggaattggtttc

SEQ ID NO: 1566027 - DNA, 21 bp, Homo sapiens
aataggagtggtgatttgaaa

SEQ ID NO: 1566028 - DNA, 22 bp, Homo sapiens
aataggcattaacacaaaggag

SEQ ID NO: 1566029 - DNA, 21 bp, Homo sapiens
aataggctattaaaaaagtct

SEQ ID NO: 1566030 - DNA, 22 bp, Homo sapiens
aatagggaaaatacctatttta

SEQ ID NO: 1566031 - DNA, 23 bp, Homo sapiens
aatagggagacagggtaggaaag

SEQ ID NO: 1566032 - DNA, 21 bp, Homo sapiens
aatagggctgagctctctgtg

SEQ ID NO: 1566033 - DNA, 15 bp, Homo sapiens
aataggggatattta

SEQ ID NO: 1566034 - DNA, 19 bp, Homo sapiens
aatagggtagaatgattaa

SEQ ID NO: 1566035 - DNA, 13 bp, Homo sapiens
aataggtatatag

SEQ ID NO: 1566036 - DNA, 15 bp, Homo sapiens
aataggtatatagaa

SEQ ID NO: 1566037 - DNA, 19 bp, Homo sapiens
aatagtaaacattaagtaa

SEQ ID NO: 1566038 - DNA, 14 bp, Homo sapiens
aatagtaatataat

SEQ ID NO: 1566039 - DNA, 15 bp, Homo sapiens
aatagtaatataata

SEQ ID NO: 1566040 - DNA, 18 bp, Homo sapiens
aatagtatacattgtctt

SEQ ID NO: 1566041 - DNA, 20 bp, Homo sapiens
aatagtatttgagagttcta

SEQ ID NO: 1566042 - DNA, 18 bp, Homo sapiens
aatagtcattccaaatat

SEQ ID NO: 1566043 - DNA, 16 bp, Homo sapiens
aatagtctgattttaa

SEQ ID NO: 1566044 - DNA, 21 bp, Homo sapiens
aatagtgcaacatctctgaat

SEQ ID NO: 1566045 - DNA, 20 bp, Homo sapiens
aatagtgcttaaaaatcatt

SEQ ID NO: 1566046 - DNA, 16 bp, Homo sapiens
aatagtgtaagaactg

SEQ ID NO: 1566047 - DNA, 15 bp, Homo sapiens
aatagtgtgaaatat

SEQ ID NO: 1566048 - DNA, 17 bp, Homo sapiens
aatagtgtgaaatatat

SEQ ID NO: 1566049 - DNA, 13 bp, Homo sapiens
aatagttctattt

SEQ ID NO: 1566050 - DNA, 15 bp, Homo sapiens
aatagttctatttct

SEQ ID NO: 1566051 - DNA, 18 bp, Homo sapiens
aatagttctatttctatc

SEQ ID NO: 1566052 - DNA, 19 bp, Homo sapiens
aatagttctatttctatct

SEQ ID NO: 1566053 - DNA, 15 bp, Homo sapiens
aatagttctgtatat

SEQ ID NO: 1566054 - DNA, 15 bp, Homo sapiens
aatagttgaattagt

SEQ ID NO: 1566055 - DNA, 14 bp, Homo sapiens
aatagttgagcccc

SEQ ID NO: 1566056 - DNA, 16 bp, Homo sapiens
aatagtttaggagaaa

SEQ ID NO: 1566057 - DNA, 17 bp, Homo sapiens
aatagtttgtctatttt

SEQ ID NO: 1566058 - DNA, 12 bp, Homo sapiens
aatataaaaaat

SEQ ID NO: 1566059 - DNA, 22 bp, Homo sapiens
aatataaaaggcaaatgtgtac

SEQ ID NO: 1566060 - DNA, 23 bp, Homo sapiens
aatataaaaggcaaatgtgtaca

SEQ ID NO: 1566061 - DNA, 12 bp, Homo sapiens
aatataaaatta

SEQ ID NO: 1566062 - DNA, 23 bp, Homo sapiens
aatataaacaaagattcatgatt

SEQ ID NO: 1566063 - DNA, 15 bp, Homo sapiens
aatataaatgtttaa

SEQ ID NO: 1566064 - DNA, 16 bp, Homo sapiens
aatataaatttaagca

SEQ ID NO: 1566065 - DNA, 20 bp, Homo sapiens
aatataaatttaagcaaacg

SEQ ID NO: 1566066 - DNA, 15 bp, Homo sapiens
aatataacacatttt

SEQ ID NO: 1566067 - DNA, 12 bp, Homo sapiens
aatataacatgt

SEQ ID NO: 1566068 - DNA, 13 bp, Homo sapiens
aatataagaagca

SEQ ID NO: 1566069 - DNA, 17 bp, Homo sapiens
aatataataatgatgat

SEQ ID NO: 1566070 - DNA, 12 bp, Homo sapiens
aatataatgttg

SEQ ID NO: 1566071 - DNA, 14 bp, Homo sapiens
aatataattatcgg

SEQ ID NO: 1566072 - DNA, 15 bp, Homo sapiens
aatataattctgtaa

SEQ ID NO: 1566073 - DNA, 15 bp, Homo sapiens
aatatacatctgtgt

SEQ ID NO: 1566074 - DNA, 16 bp, Homo sapiens
aatatacattttctaa

SEQ ID NO: 1566075 - DNA, 19 bp, Homo sapiens
aatatacattttctaaata

SEQ ID NO: 1566076 - DNA, 21 bp, Homo sapiens
aatatacattttctaaataaa

SEQ ID NO: 1566077 - DNA, 14 bp, Homo sapiens
aatatacctggttt

SEQ ID NO: 1566078 - DNA, 15 bp, Homo sapiens
aatataccttattta

SEQ ID NO: 1566079 - DNA, 21 bp, Homo sapiens
aatataccttttttgttccac

SEQ ID NO: 1566080 - DNA, 17 bp, Homo sapiens
aatatacttaaaaatta

SEQ ID NO: 1566081 - DNA, 18 bp, Homo sapiens
aatatacttaaaaattaa

SEQ ID NO: 1566082 - DNA, 18 bp, Homo sapiens
aatatagacattctcaca

SEQ ID NO: 1566083 - DNA, 21 bp, Homo sapiens
aatatagatcagttataagta

SEQ ID NO: 1566084 - DNA, 23 bp, Homo sapiens
aatatagatgtaatttttcaaaa

SEQ ID NO: 1566085 - DNA, 19 bp, Homo sapiens
aatatagcagacgtatatt

SEQ ID NO: 1566086 - DNA, 17 bp, Homo sapiens
aatatagttgaacaaga

SEQ ID NO: 1566087 - DNA, 23 bp, Homo sapiens
aatatagttttttctttcccatg

SEQ ID NO: 1566088 - DNA, 13 bp, Homo sapiens
aatatataaacaa

SEQ ID NO: 1566089 - DNA, 14 bp, Homo sapiens
aatatataatattc

SEQ ID NO: 1566090 - DNA, 13 bp, Homo sapiens
aatatatacattt

SEQ ID NO: 1566091 - DNA, 16 bp, Homo sapiens
aatatatatacatata

SEQ ID NO: 1566092 - DNA, 18 bp, Homo sapiens
aatatatatgtcaatatt

SEQ ID NO: 1566093 - DNA, 13 bp, Homo sapiens
aatatatattaag

SEQ ID NO: 1566094 - DNA, 14 bp, Homo sapiens
aatatatattatat

SEQ ID NO: 1566095 - DNA, 16 bp, Homo sapiens
aatatatattatatat

SEQ ID NO: 1566096 - DNA, 20 bp, Homo sapiens
aatatatattatatatatct

SEQ ID NO: 1566097 - DNA, 14 bp, Homo sapiens
aatatatattttaa

SEQ ID NO: 1566098 - DNA, 16 bp, Homo sapiens
aatatatattttaagg

SEQ ID NO: 1566099 - DNA, 18 bp, Homo sapiens
aatatatgatatttttca

SEQ ID NO: 1566100 - DNA, 18 bp, Homo sapiens
aatatatgattctagtgt

SEQ ID NO: 1566101 - DNA, 14 bp, Homo sapiens
aatatatgcttttg

SEQ ID NO: 1566102 - DNA, 14 bp, Homo sapiens
aatatatgtattat

SEQ ID NO: 1566103 - DNA, 16 bp, Homo sapiens
aatatatgttttgtct

SEQ ID NO: 1566104 - DNA, 15 bp, Homo sapiens
aatatattaccagca

SEQ ID NO: 1566105 - DNA, 22 bp, Homo sapiens
aatatattaccagcaagaataa

SEQ ID NO: 1566106 - DNA, 18 bp, Homo sapiens
aatatattacttaactgt

SEQ ID NO: 1566107 - DNA, 18 bp, Homo sapiens
aatatattgaacttttgt

SEQ ID NO: 1566108 - DNA, 19 bp, Homo sapiens
aatatattgaacttttgta

SEQ ID NO: 1566109 - DNA, 17 bp, Homo sapiens
aatatattgctgcattt

SEQ ID NO: 1566110 - DNA, 11 bp, Homo sapiens
aatatattgta

SEQ ID NO: 1566111 - DNA, 13 bp, Homo sapiens
aatatattgtaca

SEQ ID NO: 1566112 - DNA, 15 bp, Homo sapiens
aatatattgtacaaa

SEQ ID NO: 1566113 - DNA, 20 bp, Homo sapiens
aatatattgtacaaatgtaa

SEQ ID NO: 1566114 - DNA, 16 bp, Homo sapiens
aatatatttaaaaata

SEQ ID NO: 1566115 - DNA, 14 bp, Homo sapiens
aatatatttaaagg

SEQ ID NO: 1566116 - DNA, 22 bp, Homo sapiens
aatatatttcagacattttcac

SEQ ID NO: 1566117 - DNA, 13 bp, Homo sapiens
aatatatttcttc

SEQ ID NO: 1566118 - DNA, 15 bp, Homo sapiens
aatatatttttagac

SEQ ID NO: 1566119 - DNA, 12 bp, Homo sapiens
aatatcaaataa

SEQ ID NO: 1566120 - DNA, 16 bp, Homo sapiens
aatatcaaataaaata

SEQ ID NO: 1566121 - DNA, 17 bp, Homo sapiens
aatatcaaataaaatat

SEQ ID NO: 1566122 - DNA, 16 bp, Homo sapiens
aatatcagacaagcac

SEQ ID NO: 1566123 - DNA, 18 bp, Homo sapiens
aatatcagacaagcacta

SEQ ID NO: 1566124 - DNA, 15 bp, Homo sapiens
aatatcagactagtg

SEQ ID NO: 1566125 - DNA, 23 bp, Homo sapiens
aatatcagctttgataattgtgt

SEQ ID NO: 1566126 - DNA, 13 bp, Homo sapiens
aatatcataaagc

SEQ ID NO: 1566127 - DNA, 15 bp, Homo sapiens
aatatcataaagcat

SEQ ID NO: 1566128 - DNA, 16 bp, Homo sapiens
aatatcataaagcatt

SEQ ID NO: 1566129 - DNA, 18 bp, Homo sapiens
aatatcataaagcatttt

SEQ ID NO: 1566130 - DNA, 13 bp, Homo sapiens
aatatcatttatt

SEQ ID NO: 1566131 - DNA, 15 bp, Homo sapiens
aatatccatttatct

SEQ ID NO: 1566132 - DNA, 14 bp, Homo sapiens
aatatcctatactg

SEQ ID NO: 1566133 - DNA, 14 bp, Homo sapiens
aatatcctgtgtaa

SEQ ID NO: 1566134 - DNA, 19 bp, Homo sapiens
aatatccttgatgtacaga

SEQ ID NO: 1566135 - DNA, 19 bp, Homo sapiens
aatatcgtacctgtccctc

SEQ ID NO: 1566136 - DNA, 21 bp, Homo sapiens
aatatctagtaatatatttaa

SEQ ID NO: 1566137 - DNA, 16 bp, Homo sapiens
aatatctgaaaatgta

SEQ ID NO: 1566138 - DNA, 14 bp, Homo sapiens
aatatctggcactg

SEQ ID NO: 1566139 - DNA, 20 bp, Homo sapiens
aatatctgtatttaattttg

SEQ ID NO: 1566140 - DNA, 22 bp, Homo sapiens
aatatctgtatttaattttgac

SEQ ID NO: 1566141 - DNA, 23 bp, Homo sapiens
aatatctgtatttaattttgaca

SEQ ID NO: 1566142 - DNA, 22 bp, Homo sapiens
aatatctgtgaggtgctgatga

SEQ ID NO: 1566143 - DNA, 16 bp, Homo sapiens
aatatcttactaaggc

SEQ ID NO: 1566144 - DNA, 15 bp, Homo sapiens
aatatctttctctta

SEQ ID NO: 1566145 - DNA, 18 bp, Homo sapiens
aatatctttctcttacct

SEQ ID NO: 1566146 - DNA, 18 bp, Homo sapiens
aatatgaacctattttca

SEQ ID NO: 1566147 - DNA, 20 bp, Homo sapiens
aatatgaatctgctcacttt

SEQ ID NO: 1566148 - DNA, 22 bp, Homo sapiens
aatatgaattcaagaaaggaaa

SEQ ID NO: 1566149 - DNA, 22 bp, Homo sapiens
aatatgacaatctaccaactgt

SEQ ID NO: 1566150 - DNA, 16 bp, Homo sapiens
aatatgacagctgtcc

SEQ ID NO: 1566151 - DNA, 20 bp, Homo sapiens
aatatgactttttataaaat

SEQ ID NO: 1566152 - DNA, 21 bp, Homo sapiens
aatatgagcttcaatataaga

SEQ ID NO: 1566153 - DNA, 17 bp, Homo sapiens
aatatgcaaagcactga

SEQ ID NO: 1566154 - DNA, 23 bp, Homo sapiens
aatatgcctgcaatctgagccag

SEQ ID NO: 1566155 - DNA, 14 bp, Homo sapiens
aatatgctgccaaa

SEQ ID NO: 1566156 - DNA, 16 bp, Homo sapiens
aatatgctgttatgtc

SEQ ID NO: 1566157 - DNA, 17 bp, Homo sapiens
aatatgcttataaccta

SEQ ID NO: 1566158 - DNA, 15 bp, Homo sapiens
aatatggctataaat

SEQ ID NO: 1566159 - DNA, 19 bp, Homo sapiens
aatatgtaagaacacattt

SEQ ID NO: 1566160 - DNA, 18 bp, Homo sapiens
aatatgtaatataaattt

SEQ ID NO: 1566161 - DNA, 15 bp, Homo sapiens
aatatgtaatttcaa

SEQ ID NO: 1566162 - DNA, 19 bp, Homo sapiens
aatatgtaatttcaaaata

SEQ ID NO: 1566163 - DNA, 22 bp, Homo sapiens
aatatgtaatttcaaaatacat

SEQ ID NO: 1566164 - DNA, 23 bp, Homo sapiens
aatatgtaatttcaaaatacatt

SEQ ID NO: 1566165 - DNA, 14 bp, Homo sapiens
aatatgtacatttc

SEQ ID NO: 1566166 - DNA, 15 bp, Homo sapiens
aatatgtacatttct

SEQ ID NO: 1566167 - DNA, 18 bp, Homo sapiens
aatatgtacatttctaag

SEQ ID NO: 1566168 - DNA, 19 bp, Homo sapiens
aatatgtacatttctaagt

SEQ ID NO: 1566169 - DNA, 17 bp, Homo sapiens
aatatgtattttcctaa

SEQ ID NO: 1566170 - DNA, 13 bp, Homo sapiens
aatatgtcctggg

SEQ ID NO: 1566171 - DNA, 21 bp, Homo sapiens
aatatgtgaaaggaacatttt

SEQ ID NO: 1566172 - DNA, 15 bp, Homo sapiens
aatatgtgccttaag

SEQ ID NO: 1566173 - DNA, 12 bp, Homo sapiens
aatatgttagaa

SEQ ID NO: 1566174 - DNA, 13 bp, Homo sapiens
aatatgttcttta

SEQ ID NO: 1566175 - DNA, 16 bp, Homo sapiens
aatatgtttcaaactt

SEQ ID NO: 1566176 - DNA, 16 bp, Homo sapiens
aatatgtttgtgcctt

SEQ ID NO: 1566177 - DNA, 17 bp, Homo sapiens
aatattaaaccctggat

SEQ ID NO: 1566178 - DNA, 19 bp, Homo sapiens
aatattaacacgctgcctg

SEQ ID NO: 1566179 - DNA, 21 bp, Homo sapiens
aatattaagcatgacagaaaa

SEQ ID NO: 1566180 - DNA, 22 bp, Homo sapiens
aatattaagcatgacagaaaat

SEQ ID NO: 1566181 - DNA, 20 bp, Homo sapiens
aatattactttgtcttttca

SEQ ID NO: 1566182 - DNA, 15 bp, Homo sapiens
aatattagtgattct

SEQ ID NO: 1566183 - DNA, 20 bp, Homo sapiens
aatattagtgattctgattt

SEQ ID NO: 1566184 - DNA, 22 bp, Homo sapiens
aatattatattttttctataaa

SEQ ID NO: 1566185 - DNA, 14 bp, Homo sapiens
aatattatgtgttt

SEQ ID NO: 1566186 - DNA, 16 bp, Homo sapiens
aatattattcaagtgc

SEQ ID NO: 1566187 - DNA, 12 bp, Homo sapiens
aatattcactct

SEQ ID NO: 1566188 - DNA, 19 bp, Homo sapiens
aatattcagccagcttaaa

SEQ ID NO: 1566189 - DNA, 20 bp, Homo sapiens
aatattcccctatctctaga

SEQ ID NO: 1566190 - DNA, 15 bp, Homo sapiens
aatattcctgaatga

SEQ ID NO: 1566191 - DNA, 18 bp, Homo sapiens
aatattctacacatgtaa

SEQ ID NO: 1566192 - DNA, 20 bp, Homo sapiens
aatattctatatgaatttaa

SEQ ID NO: 1566193 - DNA, 17 bp, Homo sapiens
aatattctttctcataa

SEQ ID NO: 1566194 - DNA, 14 bp, Homo sapiens
aatattgaaaattg

SEQ ID NO: 1566195 - DNA, 20 bp, Homo sapiens
aatattgaaaattgaaaagt

SEQ ID NO: 1566196 - DNA, 21 bp, Homo sapiens
aatattgaaaattgaaaagta

SEQ ID NO: 1566197 - DNA, 20 bp, Homo sapiens
aatattgaaaggcaaacatt

SEQ ID NO: 1566198 - DNA, 15 bp, Homo sapiens
aatattgaagttgtt

SEQ ID NO: 1566199 - DNA, 16 bp, Homo sapiens
aatattgaagttgttt

SEQ ID NO: 1566200 - DNA, 20 bp, Homo sapiens
aatattgacatttgtagttg

SEQ ID NO: 1566201 - DNA, 19 bp, Homo sapiens
aatattgagaaagaaacta

SEQ ID NO: 1566202 - DNA, 20 bp, Homo sapiens
aatattgaggctgcagcagg

SEQ ID NO: 1566203 - DNA, 18 bp, Homo sapiens
aatattgatatgcttata

SEQ ID NO: 1566204 - DNA, 17 bp, Homo sapiens
aatattgtaaatactgg

SEQ ID NO: 1566205 - DNA, 18 bp, Homo sapiens
aatattgtaaatactgga

SEQ ID NO: 1566206 - DNA, 23 bp, Homo sapiens
aatattgtgaagaaaaataaagt

SEQ ID NO: 1566207 - DNA, 17 bp, Homo sapiens
aatattgtgttgtgaat

SEQ ID NO: 1566208 - DNA, 14 bp, Homo sapiens
aatattgttaaggg

SEQ ID NO: 1566209 - DNA, 16 bp, Homo sapiens
aatattgttgacaact

SEQ ID NO: 1566210 - DNA, 20 bp, Homo sapiens
aatattgtttggtaaatgtt

SEQ ID NO: 1566211 - DNA, 22 bp, Homo sapiens
aatattgtttggtaaatgtttc

SEQ ID NO: 1566212 - DNA, 16 bp, Homo sapiens
aatatttaagtatata

SEQ ID NO: 1566213 - DNA, 19 bp, Homo sapiens
aatatttaagtatatagta

SEQ ID NO: 1566214 - DNA, 23 bp, Homo sapiens
aatatttaagtatatagtatatt

SEQ ID NO: 1566215 - DNA, 13 bp, Homo sapiens
aatatttaagtga

SEQ ID NO: 1566216 - DNA, 15 bp, Homo sapiens
aatatttaatatcaa

SEQ ID NO: 1566217 - DNA, 14 bp, Homo sapiens
aatatttaatgttg

SEQ ID NO: 1566218 - DNA, 14 bp, Homo sapiens
aatatttactgtta

SEQ ID NO: 1566219 - DNA, 17 bp, Homo sapiens
aatatttataacagcat

SEQ ID NO: 1566220 - DNA, 13 bp, Homo sapiens
aatatttatgaag

SEQ ID NO: 1566221 - DNA, 22 bp, Homo sapiens
aatatttatgaagaaaatactt

SEQ ID NO: 1566222 - DNA, 12 bp, Homo sapiens
aatatttatgtt

SEQ ID NO: 1566223 - DNA, 18 bp, Homo sapiens
aatatttattacctctga

SEQ ID NO: 1566224 - DNA, 19 bp, Homo sapiens
aatatttattattttcacc

SEQ ID NO: 1566225 - DNA, 20 bp, Homo sapiens
aatatttattattttcacct

SEQ ID NO: 1566226 - DNA, 13 bp, Homo sapiens
aatatttatttat

SEQ ID NO: 1566227 - DNA, 16 bp, Homo sapiens
aatatttcaagacatt

SEQ ID NO: 1566228 - DNA, 18 bp, Homo sapiens
aatatttcaagtgcctag

SEQ ID NO: 1566229 - DNA, 17 bp, Homo sapiens
aatatttcccctagttt

SEQ ID NO: 1566230 - DNA, 21 bp, Homo sapiens
aatatttccttaaactgtgtg

SEQ ID NO: 1566231 - DNA, 21 bp, Homo sapiens
aatatttctaagcttatttct

SEQ ID NO: 1566232 - DNA, 13 bp, Homo sapiens
aatatttctattg

SEQ ID NO: 1566233 - DNA, 18 bp, Homo sapiens
aatatttctattgaattc

SEQ ID NO: 1566234 - DNA, 23 bp, Homo sapiens
aatatttggagctatcagtgctt

SEQ ID NO: 1566235 - DNA, 20 bp, Homo sapiens
aatattttaatttttaaatg

SEQ ID NO: 1566236 - DNA, 13 bp, Homo sapiens
aatattttatcct

SEQ ID NO: 1566237 - DNA, 15 bp, Homo sapiens
aatattttatcctgt

SEQ ID NO: 1566238 - DNA, 11 bp, Homo sapiens
aatattttcat

SEQ ID NO: 1566239 - DNA, 16 bp, Homo sapiens
aatattttctatttta

SEQ ID NO: 1566240 - DNA, 12 bp, Homo sapiens
aatattttgcta

SEQ ID NO: 1566241 - DNA, 10 bp, Homo sapiens
aatattttgt

SEQ ID NO: 1566242 - DNA, 12 bp, Homo sapiens
aatattttgtat

SEQ ID NO: 1566243 - DNA, 14 bp, Homo sapiens
aatattttgtattt

SEQ ID NO: 1566244 - DNA, 19 bp, Homo sapiens
aatattttttatatataca

SEQ ID NO: 1566245 - DNA, 13 bp, Homo sapiens
aatattttttgct

SEQ ID NO: 1566246 - DNA, 20 bp, Homo sapiens
aatattttttgctctaatct

SEQ ID NO: 1566247 - DNA, 15 bp, Homo sapiens
aatatttttttctag

SEQ ID NO: 1566248 - DNA, 17 bp, Homo sapiens
aatatttttttctagct

SEQ ID NO: 1566249 - DNA, 19 bp, Homo sapiens
aatatttttttctagctat

SEQ ID NO: 1566250 - DNA, 20 bp, Homo sapiens
aatcaaaaccagtgaacttt

SEQ ID NO: 1566251 - DNA, 10 bp, Homo sapiens
aatcaaaact

SEQ ID NO: 1566252 - DNA, 20 bp, Homo sapiens
aatcaaaactttcgttgtta

SEQ ID NO: 1566253 - DNA, 16 bp, Homo sapiens
aatcaaagaattacag

SEQ ID NO: 1566254 - DNA, 17 bp, Homo sapiens
aatcaaagaattacagt

SEQ ID NO: 1566255 - DNA, 19 bp, Homo sapiens
aatcaaagcaagggctcca

SEQ ID NO: 1566256 - DNA, 15 bp, Homo sapiens
aatcaaataagtatt

SEQ ID NO: 1566257 - DNA, 19 bp, Homo sapiens
aatcaaataagtatttata

SEQ ID NO: 1566258 - DNA, 22 bp, Homo sapiens
aatcaaatatgcaaagcactga

SEQ ID NO: 1566259 - DNA, 13 bp, Homo sapiens
aatcaaatgtaaa

SEQ ID NO: 1566260 - DNA, 18 bp, Homo sapiens
aatcaaatgtatgtatca

SEQ ID NO: 1566261 - DNA, 18 bp, Homo sapiens
aatcaacagcatgtctac

SEQ ID NO: 1566262 - DNA, 15 bp, Homo sapiens
aatcaacagggcagc

SEQ ID NO: 1566263 - DNA, 14 bp, Homo sapiens
aatcaactctaata

SEQ ID NO: 1566264 - DNA, 11 bp, Homo sapiens
aatcaacttta

SEQ ID NO: 1566265 - DNA, 15 bp, Homo sapiens
aatcaagaaacttaa

SEQ ID NO: 1566266 - DNA, 15 bp, Homo sapiens
aatcaagagaaactt

SEQ ID NO: 1566267 - DNA, 19 bp, Homo sapiens
aatcaagagcattgctttt

SEQ ID NO: 1566268 - DNA, 10 bp, Homo sapiens
aatcaagagt

SEQ ID NO: 1566269 - DNA, 18 bp, Homo sapiens
aatcaagattttagggct

SEQ ID NO: 1566270 - DNA, 23 bp, Homo sapiens
aatcaagcctctggtcacatggc

SEQ ID NO: 1566271 - DNA, 22 bp, Homo sapiens
aatcaaggaaaggctcatttaa

SEQ ID NO: 1566272 - DNA, 23 bp, Homo sapiens
aatcaaggaaaggctcatttaaa

SEQ ID NO: 1566273 - DNA, 15 bp, Homo sapiens
aatcaagttgtaact

SEQ ID NO: 1566274 - DNA, 15 bp, Homo sapiens
aatcaatacagacaa

SEQ ID NO: 1566275 - DNA, 12 bp, Homo sapiens
aatcaatagttg

SEQ ID NO: 1566276 - DNA, 21 bp, Homo sapiens
aatcaatctttaacaacctct

SEQ ID NO: 1566277 - DNA, 20 bp, Homo sapiens
aatcaattactggtccaaaa

SEQ ID NO: 1566278 - DNA, 15 bp, Homo sapiens
aatcaattctagtca

SEQ ID NO: 1566279 - DNA, 13 bp, Homo sapiens
aatcacagaatca

SEQ ID NO: 1566280 - DNA, 23 bp, Homo sapiens
aatcacagatgggtattaaactt

SEQ ID NO: 1566281 - DNA, 20 bp, Homo sapiens
aatcacaggcttctgagcac

SEQ ID NO: 1566282 - DNA, 15 bp, Homo sapiens
aatcacagttggcct

SEQ ID NO: 1566283 - DNA, 20 bp, Homo sapiens
aatcacataatttgttttgt

SEQ ID NO: 1566284 - DNA, 22 bp, Homo sapiens
aatcacatattttaaaatttgt

SEQ ID NO: 1566285 - DNA, 11 bp, Homo sapiens
aatcacatcct

SEQ ID NO: 1566286 - DNA, 21 bp, Homo sapiens
aatcacattttgtatggagtt

SEQ ID NO: 1566287 - DNA, 19 bp, Homo sapiens
aatcaccatgtaagcactc

SEQ ID NO: 1566288 - DNA, 23 bp, Homo sapiens
aatcaccatgtaagcactctgga

SEQ ID NO: 1566289 - DNA, 19 bp, Homo sapiens
aatcaccgatgcaaacatt

SEQ ID NO: 1566290 - DNA, 22 bp, Homo sapiens
aatcacctggtattatttttct

SEQ ID NO: 1566291 - DNA, 16 bp, Homo sapiens
aatcacgctttcctga

SEQ ID NO: 1566292 - DNA, 17 bp, Homo sapiens
aatcactatctttctga

SEQ ID NO: 1566293 - DNA, 18 bp, Homo sapiens
aatcactatctttctgat

SEQ ID NO: 1566294 - DNA, 11 bp, Homo sapiens
aatcactgcca

SEQ ID NO: 1566295 - DNA, 22 bp, Homo sapiens
aatcactggctaccgaagtaaa

SEQ ID NO: 1566296 - DNA, 17 bp, Homo sapiens
aatcactgtaacctgat

SEQ ID NO: 1566297 - DNA, 20 bp, Homo sapiens
aatcactgtaacctgattca

SEQ ID NO: 1566298 - DNA, 15 bp, Homo sapiens
aatcactttcataat

SEQ ID NO: 1566299 - DNA, 17 bp, Homo sapiens
aatcagaaagtaacaat

SEQ ID NO: 1566300 - DNA, 11 bp, Homo sapiens
aatcagaactc

SEQ ID NO: 1566301 - DNA, 20 bp, Homo sapiens
aatcagaagtcatcttgcta

SEQ ID NO: 1566302 - DNA, 16 bp, Homo sapiens
aatcagaatttttaga

SEQ ID NO: 1566303 - DNA, 20 bp, Homo sapiens
aatcagaccctaccccacca

SEQ ID NO: 1566304 - DNA, 16 bp, Homo sapiens
aatcagagctccagtt

SEQ ID NO: 1566305 - DNA, 19 bp, Homo sapiens
aatcagaggagagacggtg

SEQ ID NO: 1566306 - DNA, 21 bp, Homo sapiens
aatcagatgaattgataaaag

SEQ ID NO: 1566307 - DNA, 12 bp, Homo sapiens
aatcagcactga

SEQ ID NO: 1566308 - DNA, 17 bp, Homo sapiens
aatcagcactgaaaata

SEQ ID NO: 1566309 - DNA, 12 bp, Homo sapiens
aatcagcattct

SEQ ID NO: 1566310 - DNA, 15 bp, Homo sapiens
aatcagccagtctca

SEQ ID NO: 1566311 - DNA, 17 bp, Homo sapiens
aatcagcccagtgcaaa

SEQ ID NO: 1566312 - DNA, 20 bp, Homo sapiens
aatcagcttttgttctagac

SEQ ID NO: 1566313 - DNA, 21 bp, Homo sapiens
aatcagcttttgttctagact

SEQ ID NO: 1566314 - DNA, 14 bp, Homo sapiens
aatcaggaaaaatg

SEQ ID NO: 1566315 - DNA, 14 bp, Homo sapiens
aatcaggcagcctt

SEQ ID NO: 1566316 - DNA, 19 bp, Homo sapiens
aatcagggaggtcattttg

SEQ ID NO: 1566317 - DNA, 15 bp, Homo sapiens
aatcaggtagacttt

SEQ ID NO: 1566318 - DNA, 22 bp, Homo sapiens
aatcagtaagaggtgttatttg

SEQ ID NO: 1566319 - DNA, 13 bp, Homo sapiens
aatcagtattttt

SEQ ID NO: 1566320 - DNA, 22 bp, Homo sapiens
aatcagtcatgtgtaatatgca

SEQ ID NO: 1566321 - DNA, 11 bp, Homo sapiens
aatcagtgaag

SEQ ID NO: 1566322 - DNA, 21 bp, Homo sapiens
aatcagtgactgaaaccattt

SEQ ID NO: 1566323 - DNA, 13 bp, Homo sapiens
aatcagtgataat

SEQ ID NO: 1566324 - DNA, 17 bp, Homo sapiens
aatcagtgtgtctaaat

SEQ ID NO: 1566325 - DNA, 18 bp, Homo sapiens
aatcagtgtgtctaaatt

SEQ ID NO: 1566326 - DNA, 20 bp, Homo sapiens
aatcagttgtgaatacattc

SEQ ID NO: 1566327 - DNA, 14 bp, Homo sapiens
aatcataagtattt

SEQ ID NO: 1566328 - DNA, 20 bp, Homo sapiens
aatcatacaaactctcacca

SEQ ID NO: 1566329 - DNA, 15 bp, Homo sapiens
aatcataccagttgt

SEQ ID NO: 1566330 - DNA, 19 bp, Homo sapiens
aatcatagattattataaa

SEQ ID NO: 1566331 - DNA, 19 bp, Homo sapiens
aatcatagtactctttgta

SEQ ID NO: 1566332 - DNA, 22 bp, Homo sapiens
aatcatagtactctttgtagca

SEQ ID NO: 1566333 - DNA, 24 bp, Homo sapiens
aatcatcggagtcagccaggagct

SEQ ID NO: 1566334 - DNA, 15 bp, Homo sapiens
aatcatctataaaga

SEQ ID NO: 1566335 - DNA, 16 bp, Homo sapiens
aatcatctggattttt

SEQ ID NO: 1566336 - DNA, 16 bp, Homo sapiens
aatcatgaaatatgca

SEQ ID NO: 1566337 - DNA, 16 bp, Homo sapiens
aatcatgaaattactt

SEQ ID NO: 1566338 - DNA, 22 bp, Homo sapiens
aatcatgaatgtgtaacacagt

SEQ ID NO: 1566339 - DNA, 17 bp, Homo sapiens
aatcatgagcctgctgg

SEQ ID NO: 1566340 - DNA, 17 bp, Homo sapiens
aatcatgtccatacact

SEQ ID NO: 1566341 - DNA, 19 bp, Homo sapiens
aatcatgtgggtgagccag

SEQ ID NO: 1566342 - DNA, 22 bp, Homo sapiens
aatcatgttgatcatgtacttt

SEQ ID NO: 1566343 - DNA, 19 bp, Homo sapiens
aatcatgtttctttgatca

SEQ ID NO: 1566344 - DNA, 23 bp, Homo sapiens
aatcatgttttgatgagaaaaaa

SEQ ID NO: 1566345 - DNA, 14 bp, Homo sapiens
aatcattgtagaaa

SEQ ID NO: 1566346 - DNA, 14 bp, Homo sapiens
aatcatttatctta

SEQ ID NO: 1566347 - DNA, 20 bp, Homo sapiens
aatcatttggttaagttttt

SEQ ID NO: 1566348 - DNA, 17 bp, Homo sapiens
aatcatttgtttaaaaa

SEQ ID NO: 1566349 - DNA, 16 bp, Homo sapiens
aatcatttgtttacat

SEQ ID NO: 1566350 - DNA, 22 bp, Homo sapiens
aatcatttgtttacatttgatg

SEQ ID NO: 1566351 - DNA, 13 bp, Homo sapiens
aatcattttcatt

SEQ ID NO: 1566352 - DNA, 18 bp, Homo sapiens
aatcattttcattcctaa

SEQ ID NO: 1566353 - DNA, 18 bp, Homo sapiens
aatcattttttatatata

SEQ ID NO: 1566354 - DNA, 15 bp, Homo sapiens
aatccaaaagacaaa

SEQ ID NO: 1566355 - DNA, 13 bp, Homo sapiens
aatccaaaatgaa

SEQ ID NO: 1566356 - DNA, 16 bp, Homo sapiens
aatccaaatattgtta

SEQ ID NO: 1566357 - DNA, 21 bp, Homo sapiens
aatccaaatattgttaaggga

SEQ ID NO: 1566358 - DNA, 16 bp, Homo sapiens
aatccaaatctgtcct

SEQ ID NO: 1566359 - DNA, 22 bp, Homo sapiens
aatccaaatctgtcctctgtag

SEQ ID NO: 1566360 - DNA, 19 bp, Homo sapiens
aatccaactttcacagtga

SEQ ID NO: 1566361 - DNA, 16 bp, Homo sapiens
aatccaagattctgct

SEQ ID NO: 1566362 - DNA, 23 bp, Homo sapiens
aatccaagcctccacagcgaggg

SEQ ID NO: 1566363 - DNA, 23 bp, Homo sapiens
aatccaagcgaggtcaacagaga

SEQ ID NO: 1566364 - DNA, 19 bp, Homo sapiens
aatccaatactgcccaagg

SEQ ID NO: 1566365 - DNA, 21 bp, Homo sapiens
aatccacatctttactcaggc

SEQ ID NO: 1566366 - DNA, 18 bp, Homo sapiens
aatccacctgcctcggcc

SEQ ID NO: 1566367 - DNA, 13 bp, Homo sapiens
aatccagaggaac

SEQ ID NO: 1566368 - DNA, 20 bp, Homo sapiens
aatccagcaggtcacactgg

SEQ ID NO: 1566369 - DNA, 17 bp, Homo sapiens
aatccaggaggcagtgg

SEQ ID NO: 1566370 - DNA, 17 bp, Homo sapiens
aatccaggcacagctga

SEQ ID NO: 1566371 - DNA, 17 bp, Homo sapiens
aatccaggcagatccag

SEQ ID NO: 1566372 - DNA, 14 bp, Homo sapiens
aatccagtggtggg

SEQ ID NO: 1566373 - DNA, 16 bp, Homo sapiens
aatccagtggtgggta

SEQ ID NO: 1566374 - DNA, 19 bp, Homo sapiens
aatccagtgtgcacccctc

SEQ ID NO: 1566375 - DNA, 20 bp, Homo sapiens
aatccagtgtgcacccctcc

SEQ ID NO: 1566376 - DNA, 13 bp, Homo sapiens
aatccagttataa

SEQ ID NO: 1566377 - DNA, 19 bp, Homo sapiens
aatccagttataagaagaa

SEQ ID NO: 1566378 - DNA, 22 bp, Homo sapiens
aatccataaactaagagaaact

SEQ ID NO: 1566379 - DNA, 13 bp, Homo sapiens
aatccatatctta

SEQ ID NO: 1566380 - DNA, 15 bp, Homo sapiens
aatccatgcttgggt

SEQ ID NO: 1566381 - DNA, 12 bp, Homo sapiens
aatccatgtaag

SEQ ID NO: 1566382 - DNA, 17 bp, Homo sapiens
aatccatgttagttttt

SEQ ID NO: 1566383 - DNA, 19 bp, Homo sapiens
aatccattgaactggaaga

SEQ ID NO: 1566384 - DNA, 18 bp, Homo sapiens
aatccattttctaaactg

SEQ ID NO: 1566385 - DNA, 16 bp, Homo sapiens
aatcccacccacctca

SEQ ID NO: 1566386 - DNA, 13 bp, Homo sapiens
aatcccagctact

SEQ ID NO: 1566387 - DNA, 14 bp, Homo sapiens
aatcccagctactg

SEQ ID NO: 1566388 - DNA, 18 bp, Homo sapiens
aatccccaacatgcactg

SEQ ID NO: 1566389 - DNA, 22 bp, Homo sapiens
aatccccatcattactggtaaa

SEQ ID NO: 1566390 - DNA, 21 bp, Homo sapiens
aatcccctccctgtcaaagct

SEQ ID NO: 1566391 - DNA, 18 bp, Homo sapiens
aatcccctccttgggcac

SEQ ID NO: 1566392 - DNA, 17 bp, Homo sapiens
aatccccttctcccctg

SEQ ID NO: 1566393 - DNA, 23 bp, Homo sapiens
aatccccttctcccctgcactgt

SEQ ID NO: 1566394 - DNA, 16 bp, Homo sapiens
aatcccgattcaccct

SEQ ID NO: 1566395 - DNA, 13 bp, Homo sapiens
aatccctgctttt

SEQ ID NO: 1566396 - DNA, 14 bp, Homo sapiens
aatccctgcttttt

SEQ ID NO: 1566397 - DNA, 14 bp, Homo sapiens
aatccctggcaaag

SEQ ID NO: 1566398 - DNA, 19 bp, Homo sapiens
aatccctgggcattgcttt

SEQ ID NO: 1566399 - DNA, 19 bp, Homo sapiens
aatccctttattaccccct

SEQ ID NO: 1566400 - DNA, 13 bp, Homo sapiens
aatccgacttgaa

SEQ ID NO: 1566401 - DNA, 23 bp, Homo sapiens
aatccgggacacctgggccgggc

SEQ ID NO: 1566402 - DNA, 15 bp, Homo sapiens
aatcctaaaagaagc

SEQ ID NO: 1566403 - DNA, 19 bp, Homo sapiens
aatcctaatttctcctccc

SEQ ID NO: 1566404 - DNA, 18 bp, Homo sapiens
aatcctattaaaacacag

SEQ ID NO: 1566405 - DNA, 21 bp, Homo sapiens
aatcctattctgatgaatctc

SEQ ID NO: 1566406 - DNA, 14 bp, Homo sapiens
aatcctcccttccc

SEQ ID NO: 1566407 - DNA, 17 bp, Homo sapiens
aatcctcccttcccagg

SEQ ID NO: 1566408 - DNA, 9 bp, Homo sapiens
aatcctcct

SEQ ID NO: 1566409 - DNA, 21 bp, Homo sapiens
aatcctggaaggacacagtga

SEQ ID NO: 1566410 - DNA, 16 bp, Homo sapiens
aatcctggcagcccag

SEQ ID NO: 1566411 - DNA, 15 bp, Homo sapiens
aatccttaacatttc

SEQ ID NO: 1566412 - DNA, 17 bp, Homo sapiens
aatccttccctgctctt

SEQ ID NO: 1566413 - DNA, 13 bp, Homo sapiens
aatccttctagtt

SEQ ID NO: 1566414 - DNA, 21 bp, Homo sapiens
aatccttctagtttcccacaa

SEQ ID NO: 1566415 - DNA, 19 bp, Homo sapiens
aatccttctattctagcct

SEQ ID NO: 1566416 - DNA, 17 bp, Homo sapiens
aatccttgcttatgaca

SEQ ID NO: 1566417 - DNA, 18 bp, Homo sapiens
aatccttgcttatgacat

SEQ ID NO: 1566418 - DNA, 20 bp, Homo sapiens
aatcctttttctttataaac

SEQ ID NO: 1566419 - DNA, 17 bp, Homo sapiens
aatcgaagtgtttatgt

SEQ ID NO: 1566420 - DNA, 20 bp, Homo sapiens
aatcgagatttgggagctga

SEQ ID NO: 1566421 - DNA, 14 bp, Homo sapiens
aatcgcttaaagat

SEQ ID NO: 1566422 - DNA, 12 bp, Homo sapiens
aatcggactgcc

SEQ ID NO: 1566423 - DNA, 14 bp, Homo sapiens
aatcggactgccaa

SEQ ID NO: 1566424 - DNA, 18 bp, Homo sapiens
aatcggagcgaagcagag

SEQ ID NO: 1566425 - DNA, 21 bp, Homo sapiens
aatcggatctggggctctggg

SEQ ID NO: 1566426 - DNA, 22 bp, Homo sapiens
aatcggcccacagctcccaccc

SEQ ID NO: 1566427 - DNA, 22 bp, Homo sapiens
aatcgtcttaagttttttatgc

SEQ ID NO: 1566428 - DNA, 21 bp, Homo sapiens
aatcgtggcacgtattgctgt

SEQ ID NO: 1566429 - DNA, 13 bp, Homo sapiens
aatcgtgtgccat

SEQ ID NO: 1566430 - DNA, 22 bp, Homo sapiens
aatcgtgtgccatggatctgat

SEQ ID NO: 1566431 - DNA, 19 bp, Homo sapiens
aatctaaaagctctgttcc

SEQ ID NO: 1566432 - DNA, 20 bp, Homo sapiens
aatctaaaagctctgttcca

SEQ ID NO: 1566433 - DNA, 12 bp, Homo sapiens
aatctaaaattt

SEQ ID NO: 1566434 - DNA, 18 bp, Homo sapiens
aatctaaaatttaaaatt

SEQ ID NO: 1566435 - DNA, 19 bp, Homo sapiens
aatctaacaataatatttc

SEQ ID NO: 1566436 - DNA, 13 bp, Homo sapiens
aatctaaggataa

SEQ ID NO: 1566437 - DNA, 21 bp, Homo sapiens
aatctaaggataatgaaataa

SEQ ID NO: 1566438 - DNA, 20 bp, Homo sapiens
aatctacaatctctttttgt

SEQ ID NO: 1566439 - DNA, 17 bp, Homo sapiens
aatctacaccaatgaaa

SEQ ID NO: 1566440 - DNA, 17 bp, Homo sapiens
aatctacttgttaaaaa

SEQ ID NO: 1566441 - DNA, 21 bp, Homo sapiens
aatctagaagatgtgtaaaca

SEQ ID NO: 1566442 - DNA, 12 bp, Homo sapiens
aatctagagttt

SEQ ID NO: 1566443 - DNA, 16 bp, Homo sapiens
aatctaggatgtgatg

SEQ ID NO: 1566444 - DNA, 19 bp, Homo sapiens
aatctagtatttcatgctg

SEQ ID NO: 1566445 - DNA, 17 bp, Homo sapiens
aatctagtttacagaaa

SEQ ID NO: 1566446 - DNA, 18 bp, Homo sapiens
aatctagtttacagaaaa

SEQ ID NO: 1566447 - DNA, 19 bp, Homo sapiens
aatctagttttttttgtaa

SEQ ID NO: 1566448 - DNA, 20 bp, Homo sapiens
aatctatctgcttatgcagt

SEQ ID NO: 1566449 - DNA, 19 bp, Homo sapiens
aatctatgaagtatataat

SEQ ID NO: 1566450 - DNA, 18 bp, Homo sapiens
aatctatggcttatttct

SEQ ID NO: 1566451 - DNA, 20 bp, Homo sapiens
aatctatggcttatttctat

SEQ ID NO: 1566452 - DNA, 23 bp, Homo sapiens
aatctattacttttgcaaactgt

SEQ ID NO: 1566453 - DNA, 16 bp, Homo sapiens
aatctattatactgta

SEQ ID NO: 1566454 - DNA, 23 bp, Homo sapiens
aatctattcctgtaaataagagt

SEQ ID NO: 1566455 - DNA, 20 bp, Homo sapiens
aatctattgacttttcaata

SEQ ID NO: 1566456 - DNA, 20 bp, Homo sapiens
aatctatttattaatattta

SEQ ID NO: 1566457 - DNA, 12 bp, Homo sapiens
aatctcaaaatt

SEQ ID NO: 1566458 - DNA, 18 bp, Homo sapiens
aatctcaaaggagaaaaa

SEQ ID NO: 1566459 - DNA, 22 bp, Homo sapiens
aatctcaaaggagaaaaaaaac

SEQ ID NO: 1566460 - DNA, 22 bp, Homo sapiens
aatctcaaataggctattaaaa

SEQ ID NO: 1566461 - DNA, 22 bp, Homo sapiens
aatctcaacatgtctcctactg

SEQ ID NO: 1566462 - DNA, 20 bp, Homo sapiens
aatctcagttgtttgcttct

SEQ ID NO: 1566463 - DNA, 22 bp, Homo sapiens
aatctcatacctctgaccaaca

SEQ ID NO: 1566464 - DNA, 11 bp, Homo sapiens
aatctcattcc

SEQ ID NO: 1566465 - DNA, 12 bp, Homo sapiens
aatctcattccc

SEQ ID NO: 1566466 - DNA, 15 bp, Homo sapiens
aatctccgtagaatt

SEQ ID NO: 1566467 - DNA, 15 bp, Homo sapiens
aatctcctcttttat

SEQ ID NO: 1566468 - DNA, 18 bp, Homo sapiens
aatctcctcttttatctt

SEQ ID NO: 1566469 - DNA, 19 bp, Homo sapiens
aatctctcatattcgctag

SEQ ID NO: 1566470 - DNA, 20 bp, Homo sapiens
aatctctcggttccacgtcc

SEQ ID NO: 1566471 - DNA, 16 bp, Homo sapiens
aatctctctgcagctg

SEQ ID NO: 1566472 - DNA, 17 bp, Homo sapiens
aatctctctgcagctgc

SEQ ID NO: 1566473 - DNA, 18 bp, Homo sapiens
aatctctctgcagctgcc

SEQ ID NO: 1566474 - DNA, 13 bp, Homo sapiens
aatctctgtgcct

SEQ ID NO: 1566475 - DNA, 21 bp, Homo sapiens
aatctctgttctgctcccaga

SEQ ID NO: 1566476 - DNA, 22 bp, Homo sapiens
aatctctgttctgtttggcact

SEQ ID NO: 1566477 - DNA, 15 bp, Homo sapiens
aatctcttattctaa

SEQ ID NO: 1566478 - DNA, 19 bp, Homo sapiens
aatctcttcatgcttgaca

SEQ ID NO: 1566479 - DNA, 15 bp, Homo sapiens
aatctctttcccttc

SEQ ID NO: 1566480 - DNA, 23 bp, Homo sapiens
aatctctttttaaaaaactcttt

SEQ ID NO: 1566481 - DNA, 18 bp, Homo sapiens
aatctctttttgtttgcc

SEQ ID NO: 1566482 - DNA, 16 bp, Homo sapiens
aatctgaattttgcaa

SEQ ID NO: 1566483 - DNA, 20 bp, Homo sapiens
aatctgaattttgcaatgta

SEQ ID NO: 1566484 - DNA, 15 bp, Homo sapiens
aatctgacccagtgc

SEQ ID NO: 1566485 - DNA, 17 bp, Homo sapiens
aatctgacctaaaagtt

SEQ ID NO: 1566486 - DNA, 23 bp, Homo sapiens
aatctgacctaaaagttgaaaag

SEQ ID NO: 1566487 - DNA, 18 bp, Homo sapiens
aatctgagaaactctaca

SEQ ID NO: 1566488 - DNA, 23 bp, Homo sapiens
aatctgagattgtgtttgttcat

SEQ ID NO: 1566489 - DNA, 23 bp, Homo sapiens
aatctgaggaatggacatttcta

SEQ ID NO: 1566490 - DNA, 17 bp, Homo sapiens
aatctgaggcctcctct

SEQ ID NO: 1566491 - DNA, 16 bp, Homo sapiens
aatctgatggccttaa

SEQ ID NO: 1566492 - DNA, 18 bp, Homo sapiens
aatctgatggccttaatt

SEQ ID NO: 1566493 - DNA, 18 bp, Homo sapiens
aatctgattggacatttt

SEQ ID NO: 1566494 - DNA, 21 bp, Homo sapiens
aatctgcaaagcatgttttgc

SEQ ID NO: 1566495 - DNA, 23 bp, Homo sapiens
aatctgcaaagcatgttttgcat

SEQ ID NO: 1566496 - DNA, 15 bp, Homo sapiens
aatctgcaattcaaa

SEQ ID NO: 1566497 - DNA, 19 bp, Homo sapiens
aatctgcaattcaaaagtt

SEQ ID NO: 1566498 - DNA, 19 bp, Homo sapiens
aatctgctaccaaaacagt

SEQ ID NO: 1566499 - DNA, 11 bp, Homo sapiens
aatctgctgtt

SEQ ID NO: 1566500 - DNA, 12 bp, Homo sapiens
aatctgctttag

SEQ ID NO: 1566501 - DNA, 14 bp, Homo sapiens
aatctggagaccag

SEQ ID NO: 1566502 - DNA, 22 bp, Homo sapiens
aatctggatgttaagaatgaag

SEQ ID NO: 1566503 - DNA, 20 bp, Homo sapiens
aatctgggtggtaactgcca

SEQ ID NO: 1566504 - DNA, 19 bp, Homo sapiens
aatctggtcttgttagaaa

SEQ ID NO: 1566505 - DNA, 20 bp, Homo sapiens
aatctggtcttgttagaaaa

SEQ ID NO: 1566506 - DNA, 21 bp, Homo sapiens
aatctgtaaactgtgtattcc

SEQ ID NO: 1566507 - DNA, 23 bp, Homo sapiens
aatctgtaaactgtgtattccaa

SEQ ID NO: 1566508 - DNA, 18 bp, Homo sapiens
aatctgtattctgtttgc

SEQ ID NO: 1566509 - DNA, 16 bp, Homo sapiens
aatctgtcagcatctg

SEQ ID NO: 1566510 - DNA, 12 bp, Homo sapiens
aatctgtcataa

SEQ ID NO: 1566511 - DNA, 21 bp, Homo sapiens
aatctgtccaaaggaggctgg

SEQ ID NO: 1566512 - DNA, 17 bp, Homo sapiens
aatctgtcctctgtagt

SEQ ID NO: 1566513 - DNA, 19 bp, Homo sapiens
aatctgtcctctgtagtat

SEQ ID NO: 1566514 - DNA, 14 bp, Homo sapiens
aatctgtctgattc

SEQ ID NO: 1566515 - DNA, 17 bp, Homo sapiens
aatctgtctgattctat

SEQ ID NO: 1566516 - DNA, 18 bp, Homo sapiens
aatctgtctgattctatg

SEQ ID NO: 1566517 - DNA, 23 bp, Homo sapiens
aatctgtgaattaaaaaagctca

SEQ ID NO: 1566518 - DNA, 17 bp, Homo sapiens
aatctgtgtgtgccctg

SEQ ID NO: 1566519 - DNA, 15 bp, Homo sapiens
aatctgtttctctgc

SEQ ID NO: 1566520 - DNA, 23 bp, Homo sapiens
aatctgtttctctgctgtcaact

SEQ ID NO: 1566521 - DNA, 15 bp, Homo sapiens
aatcttaaaagtgta

SEQ ID NO: 1566522 - DNA, 23 bp, Homo sapiens
aatcttaaacaatgtataaagat

SEQ ID NO: 1566523 - DNA, 12 bp, Homo sapiens
aatcttaatact

SEQ ID NO: 1566524 - DNA, 15 bp, Homo sapiens
aatcttaatactgtt

SEQ ID NO: 1566525 - DNA, 16 bp, Homo sapiens
aatcttaatactgtta

SEQ ID NO: 1566526 - DNA, 22 bp, Homo sapiens
aatcttaatactgttattcttt

SEQ ID NO: 1566527 - DNA, 18 bp, Homo sapiens
aatcttattttatcttct

SEQ ID NO: 1566528 - DNA, 17 bp, Homo sapiens
aatcttcacctcagagt

SEQ ID NO: 1566529 - DNA, 20 bp, Homo sapiens
aatcttcagttttatcttta

SEQ ID NO: 1566530 - DNA, 22 bp, Homo sapiens
aatcttcagttttatctttaat

SEQ ID NO: 1566531 - DNA, 15 bp, Homo sapiens
aatcttccttgtgag

SEQ ID NO: 1566532 - DNA, 12 bp, Homo sapiens
aatcttctactt

SEQ ID NO: 1566533 - DNA, 18 bp, Homo sapiens
aatcttctacttttaact

SEQ ID NO: 1566534 - DNA, 19 bp, Homo sapiens
aatcttctacttttaacta

SEQ ID NO: 1566535 - DNA, 18 bp, Homo sapiens
aatcttgactttctgatt

SEQ ID NO: 1566536 - DNA, 13 bp, Homo sapiens
aatcttgctttct

SEQ ID NO: 1566537 - DNA, 16 bp, Homo sapiens
aatcttgctttcttta

SEQ ID NO: 1566538 - DNA, 16 bp, Homo sapiens
aatcttgtcatgtgta

SEQ ID NO: 1566539 - DNA, 14 bp, Homo sapiens
aatcttgtgctaga

SEQ ID NO: 1566540 - DNA, 18 bp, Homo sapiens
aatcttgtgctagaatac

SEQ ID NO: 1566541 - DNA, 19 bp, Homo sapiens
aatcttgtgctagaatact

SEQ ID NO: 1566542 - DNA, 14 bp, Homo sapiens
aatcttgttactgc

SEQ ID NO: 1566543 - DNA, 15 bp, Homo sapiens
aatcttgttactgct

SEQ ID NO: 1566544 - DNA, 21 bp, Homo sapiens
aatcttgttactgctgattct

SEQ ID NO: 1566545 - DNA, 21 bp, Homo sapiens
aatctttaacaacctctgagc

SEQ ID NO: 1566546 - DNA, 18 bp, Homo sapiens
aatctttacctgtataca

SEQ ID NO: 1566547 - DNA, 18 bp, Homo sapiens
aatctttcacttgaaaga

SEQ ID NO: 1566548 - DNA, 20 bp, Homo sapiens
aatctttcacttgaaagatt

SEQ ID NO: 1566549 - DNA, 20 bp, Homo sapiens
aatctttctacctctttttt

SEQ ID NO: 1566550 - DNA, 21 bp, Homo sapiens
aatctttctttacctgagacc

SEQ ID NO: 1566551 - DNA, 22 bp, Homo sapiens
aatctttctttacctgagacca

SEQ ID NO: 1566552 - DNA, 11 bp, Homo sapiens
aatctttgctg

SEQ ID NO: 1566553 - DNA, 18 bp, Homo sapiens
aatctttgtaccaaaatt

SEQ ID NO: 1566554 - DNA, 21 bp, Homo sapiens
aatcttttaaaaattcaaatg

SEQ ID NO: 1566555 - DNA, 20 bp, Homo sapiens
aatctttttgcttctacttt

SEQ ID NO: 1566556 - DNA, 18 bp, Homo sapiens
aatgaaaaatataatgtt

SEQ ID NO: 1566557 - DNA, 14 bp, Homo sapiens
aatgaaaacatgta

SEQ ID NO: 1566558 - DNA, 17 bp, Homo sapiens
aatgaaaacatgtacta

SEQ ID NO: 1566559 - DNA, 19 bp, Homo sapiens
aatgaaaacatgtactaca

SEQ ID NO: 1566560 - DNA, 16 bp, Homo sapiens
aatgaaaactgtaaat

SEQ ID NO: 1566561 - DNA, 17 bp, Homo sapiens
aatgaaaataaaacaca

SEQ ID NO: 1566562 - DNA, 22 bp, Homo sapiens
aatgaaaataaaacacacctcg

SEQ ID NO: 1566563 - DNA, 17 bp, Homo sapiens
aatgaaaatgcagtcct

SEQ ID NO: 1566564 - DNA, 14 bp, Homo sapiens
aatgaaaatgtcag

SEQ ID NO: 1566565 - DNA, 20 bp, Homo sapiens
aatgaaaatgtcagaaacca

SEQ ID NO: 1566566 - DNA, 19 bp, Homo sapiens
aatgaaacaaataatcaca

SEQ ID NO: 1566567 - DNA, 20 bp, Homo sapiens
aatgaaacaaataatcacat

SEQ ID NO: 1566568 - DNA, 13 bp, Homo sapiens
aatgaaacaagca

SEQ ID NO: 1566569 - DNA, 15 bp, Homo sapiens
aatgaaacaagcagg

SEQ ID NO: 1566570 - DNA, 19 bp, Homo sapiens
aatgaaacactcagttgtt

SEQ ID NO: 1566571 - DNA, 17 bp, Homo sapiens
aatgaaacagaacttga

SEQ ID NO: 1566572 - DNA, 23 bp, Homo sapiens
aatgaaactttctttctaaagaa

SEQ ID NO: 1566573 - DNA, 16 bp, Homo sapiens
aatgaaagaaaattga

SEQ ID NO: 1566574 - DNA, 21 bp, Homo sapiens
aatgaaagactgtacaaagta

SEQ ID NO: 1566575 - DNA, 15 bp, Homo sapiens
aatgaaagcatgtgg

SEQ ID NO: 1566576 - DNA, 16 bp, Homo sapiens
aatgaaagctgttcct

SEQ ID NO: 1566577 - DNA, 13 bp, Homo sapiens
aatgaaagggaaa

SEQ ID NO: 1566578 - DNA, 21 bp, Homo sapiens
aatgaaagggaaagtcagctt

SEQ ID NO: 1566579 - DNA, 17 bp, Homo sapiens
aatgaaaggtactatat

SEQ ID NO: 1566580 - DNA, 23 bp, Homo sapiens
aatgaaattactacaaaatttga

SEQ ID NO: 1566581 - DNA, 17 bp, Homo sapiens
aatgaaccataaattca

SEQ ID NO: 1566582 - DNA, 20 bp, Homo sapiens
aatgaactcaagaaggaatt

SEQ ID NO: 1566583 - DNA, 18 bp, Homo sapiens
aatgaacttccatttgta

SEQ ID NO: 1566584 - DNA, 12 bp, Homo sapiens
aatgaagaaagt

SEQ ID NO: 1566585 - DNA, 23 bp, Homo sapiens
aatgaagaaagtcaaaaaattat

SEQ ID NO: 1566586 - DNA, 15 bp, Homo sapiens
aatgaagaattatgt

SEQ ID NO: 1566587 - DNA, 16 bp, Homo sapiens
aatgaagcagaaatgt

SEQ ID NO: 1566588 - DNA, 17 bp, Homo sapiens
aatgaagcagctttaaa

SEQ ID NO: 1566589 - DNA, 14 bp, Homo sapiens
aatgaagcagtatt

SEQ ID NO: 1566590 - DNA, 13 bp, Homo sapiens
aatgaagccagct

SEQ ID NO: 1566591 - DNA, 18 bp, Homo sapiens
aatgaagggaaattgttt

SEQ ID NO: 1566592 - DNA, 19 bp, Homo sapiens
aatgaaggtttttgtaaag

SEQ ID NO: 1566593 - DNA, 22 bp, Homo sapiens
aatgaaggtttttgtaaagatt

SEQ ID NO: 1566594 - DNA, 14 bp, Homo sapiens
aatgaagtgattct

SEQ ID NO: 1566595 - DNA, 15 bp, Homo sapiens
aatgaagtgattcta

SEQ ID NO: 1566596 - DNA, 17 bp, Homo sapiens
aatgaataatggaaaat

SEQ ID NO: 1566597 - DNA, 13 bp, Homo sapiens
aatgaatactgaa

SEQ ID NO: 1566598 - DNA, 14 bp, Homo sapiens
aatgaatatctatt

SEQ ID NO: 1566599 - DNA, 18 bp, Homo sapiens
aatgaatatctattaata

SEQ ID NO: 1566600 - DNA, 14 bp, Homo sapiens
aatgaatgaaacat

SEQ ID NO: 1566601 - DNA, 14 bp, Homo sapiens
aatgaatgaataac

SEQ ID NO: 1566602 - DNA, 18 bp, Homo sapiens
aatgaatgcaaaattgtt

SEQ ID NO: 1566603 - DNA, 20 bp, Homo sapiens
aatgaatgcaaaattgtttt

SEQ ID NO: 1566604 - DNA, 22 bp, Homo sapiens
aatgaatgcaaaattgttttca

SEQ ID NO: 1566605 - DNA, 23 bp, Homo sapiens
aatgaatgcaaaattgttttcac

SEQ ID NO: 1566606 - DNA, 19 bp, Homo sapiens
aatgaatggactcaaactg

SEQ ID NO: 1566607 - DNA, 23 bp, Homo sapiens
aatgaatgtttacactctttgta

SEQ ID NO: 1566608 - DNA, 19 bp, Homo sapiens
aatgaatttatctttacca

SEQ ID NO: 1566609 - DNA, 18 bp, Homo sapiens
aatgacaaaagatacaaa

SEQ ID NO: 1566610 - DNA, 14 bp, Homo sapiens
aatgacaacagaaa

SEQ ID NO: 1566611 - DNA, 16 bp, Homo sapiens
aatgacagataaatcc

SEQ ID NO: 1566612 - DNA, 18 bp, Homo sapiens
aatgacagatttctgtaa

SEQ ID NO: 1566613 - DNA, 15 bp, Homo sapiens
aatgacatgcactga

SEQ ID NO: 1566614 - DNA, 18 bp, Homo sapiens
aatgaccaacgaaattgt

SEQ ID NO: 1566615 - DNA, 19 bp, Homo sapiens
aatgaccaagacaggttca

SEQ ID NO: 1566616 - DNA, 17 bp, Homo sapiens
aatgaccgagccctgga

SEQ ID NO: 1566617 - DNA, 22 bp, Homo sapiens
aatgacggtaagtgttctcatg

SEQ ID NO: 1566618 - DNA, 16 bp, Homo sapiens
aatgacggtgttaatt

SEQ ID NO: 1566619 - DNA, 21 bp, Homo sapiens
aatgacggtgttaattttgct

SEQ ID NO: 1566620 - DNA, 22 bp, Homo sapiens
aatgacggtgttaattttgcta

SEQ ID NO: 1566621 - DNA, 23 bp, Homo sapiens
aatgacggtgttaattttgctaa

SEQ ID NO: 1566622 - DNA, 17 bp, Homo sapiens
aatgactaaaaatatta

SEQ ID NO: 1566623 - DNA, 14 bp, Homo sapiens
aatgacttatttct

SEQ ID NO: 1566624 - DNA, 15 bp, Homo sapiens
aatgacttatttctg

SEQ ID NO: 1566625 - DNA, 20 bp, Homo sapiens
aatgacttatttctgctctg

SEQ ID NO: 1566626 - DNA, 23 bp, Homo sapiens
aatgacttatttctgctctggaa

SEQ ID NO: 1566627 - DNA, 14 bp, Homo sapiens
aatgagaaaattgt

SEQ ID NO: 1566628 - DNA, 12 bp, Homo sapiens
aatgagaaagga

SEQ ID NO: 1566629 - DNA, 18 bp, Homo sapiens
aatgagaaaggacagagc

SEQ ID NO: 1566630 - DNA, 19 bp, Homo sapiens
aatgagactctagggtcca

SEQ ID NO: 1566631 - DNA, 17 bp, Homo sapiens
aatgagagcgacacaga

SEQ ID NO: 1566632 - DNA, 17 bp, Homo sapiens
aatgagaggttcctaag

SEQ ID NO: 1566633 - DNA, 19 bp, Homo sapiens
aatgagagttccttctcac

SEQ ID NO: 1566634 - DNA, 16 bp, Homo sapiens
aatgagatagtagcat

SEQ ID NO: 1566635 - DNA, 20 bp, Homo sapiens
aatgagatgttattactgtt

SEQ ID NO: 1566636 - DNA, 15 bp, Homo sapiens
aatgagccataggaa

SEQ ID NO: 1566637 - DNA, 17 bp, Homo sapiens
aatgagccatcactaga

SEQ ID NO: 1566638 - DNA, 12 bp, Homo sapiens
aatgagctcctg

SEQ ID NO: 1566639 - DNA, 21 bp, Homo sapiens
aatgagctggtttgtcaaaca

SEQ ID NO: 1566640 - DNA, 14 bp, Homo sapiens
aatgaggaatccaa

SEQ ID NO: 1566641 - DNA, 17 bp, Homo sapiens
aatgaggattattgata

SEQ ID NO: 1566642 - DNA, 19 bp, Homo sapiens
aatgaggtcagcatgtcta

SEQ ID NO: 1566643 - DNA, 16 bp, Homo sapiens
aatgaggtcccaggca

SEQ ID NO: 1566644 - DNA, 12 bp, Homo sapiens
aatgagtaacat

SEQ ID NO: 1566645 - DNA, 17 bp, Homo sapiens
aatgagtaacatttgct

SEQ ID NO: 1566646 - DNA, 15 bp, Homo sapiens
aatgagtatttggtc

SEQ ID NO: 1566647 - DNA, 22 bp, Homo sapiens
aatgagtttaaaaaaataacat

SEQ ID NO: 1566648 - DNA, 15 bp, Homo sapiens
aatgataaactctct

SEQ ID NO: 1566649 - DNA, 21 bp, Homo sapiens
aatgataagtaaatgctaggt

SEQ ID NO: 1566650 - DNA, 22 bp, Homo sapiens
aatgatactgtgtgttttccca

SEQ ID NO: 1566651 - DNA, 16 bp, Homo sapiens
aatgatagaactgtac

SEQ ID NO: 1566652 - DNA, 17 bp, Homo sapiens
aatgatcctcccacctc

SEQ ID NO: 1566653 - DNA, 21 bp, Homo sapiens
aatgatctcggatgaccaaac

SEQ ID NO: 1566654 - DNA, 23 bp, Homo sapiens
aatgatctcggatgaccaaacca

SEQ ID NO: 1566655 - DNA, 19 bp, Homo sapiens
aatgatgacaaaaaatgtt

SEQ ID NO: 1566656 - DNA, 13 bp, Homo sapiens
aatgatgatcttc

SEQ ID NO: 1566657 - DNA, 21 bp, Homo sapiens
aatgatgatgatgatgatgaa

SEQ ID NO: 1566658 - DNA, 17 bp, Homo sapiens
aatgatggcaattttgt

SEQ ID NO: 1566659 - DNA, 14 bp, Homo sapiens
aatgatgtccagaa

SEQ ID NO: 1566660 - DNA, 18 bp, Homo sapiens
aatgatgtccagaagaat

SEQ ID NO: 1566661 - DNA, 16 bp, Homo sapiens
aatgattatattcaca

SEQ ID NO: 1566662 - DNA, 21 bp, Homo sapiens
aatgattatattcacagactg

SEQ ID NO: 1566663 - DNA, 21 bp, Homo sapiens
aatgattcaaaaagtcacagt

SEQ ID NO: 1566664 - DNA, 20 bp, Homo sapiens
aatgattcaaattgctgctt

SEQ ID NO: 1566665 - DNA, 19 bp, Homo sapiens
aatgatttccacaaacaga

SEQ ID NO: 1566666 - DNA, 13 bp, Homo sapiens
aatgcaaaaatct

SEQ ID NO: 1566667 - DNA, 22 bp, Homo sapiens
aatgcaaatagtagacatttgt

SEQ ID NO: 1566668 - DNA, 21 bp, Homo sapiens
aatgcaagagtgattgcagct

SEQ ID NO: 1566669 - DNA, 18 bp, Homo sapiens
aatgcaataactctggga

SEQ ID NO: 1566670 - DNA, 16 bp, Homo sapiens
aatgcaatattaatgc

SEQ ID NO: 1566671 - DNA, 17 bp, Homo sapiens
aatgcacaagaatggat

SEQ ID NO: 1566672 - DNA, 17 bp, Homo sapiens
aatgcacactagcctct

SEQ ID NO: 1566673 - DNA, 18 bp, Homo sapiens
aatgcacctcttgttact

SEQ ID NO: 1566674 - DNA, 14 bp, Homo sapiens
aatgcagaggtctc

SEQ ID NO: 1566675 - DNA, 19 bp, Homo sapiens
aatgcagattcctgggcct

SEQ ID NO: 1566676 - DNA, 15 bp, Homo sapiens
aatgcagcaggaagg

SEQ ID NO: 1566677 - DNA, 18 bp, Homo sapiens
aatgcagggaagagggca

SEQ ID NO: 1566678 - DNA, 17 bp, Homo sapiens
aatgcagtcctgaggag

SEQ ID NO: 1566679 - DNA, 20 bp, Homo sapiens
aatgcagtggcgccatctca

SEQ ID NO: 1566680 - DNA, 17 bp, Homo sapiens
aatgcagttacaaatta

SEQ ID NO: 1566681 - DNA, 16 bp, Homo sapiens
aatgcagttttaagaa

SEQ ID NO: 1566682 - DNA, 22 bp, Homo sapiens
aatgcataaatgcataatttat

SEQ ID NO: 1566683 - DNA, 17 bp, Homo sapiens
aatgcataatttatggt

SEQ ID NO: 1566684 - DNA, 14 bp, Homo sapiens
aatgcatacaagtt

SEQ ID NO: 1566685 - DNA, 19 bp, Homo sapiens
aatgcatatcctgagccat

SEQ ID NO: 1566686 - DNA, 16 bp, Homo sapiens
aatgcatattgtatta

SEQ ID NO: 1566687 - DNA, 17 bp, Homo sapiens
aatgcatcacatgatga

SEQ ID NO: 1566688 - DNA, 21 bp, Homo sapiens
aatgcatcatcatagaaaaac

SEQ ID NO: 1566689 - DNA, 19 bp, Homo sapiens
aatgcatccattcctcagg

SEQ ID NO: 1566690 - DNA, 23 bp, Homo sapiens
aatgcatccattcctcagggaca

SEQ ID NO: 1566691 - DNA, 16 bp, Homo sapiens
aatgcattgcctgtaa

SEQ ID NO: 1566692 - DNA, 17 bp, Homo sapiens
aatgcatttaaaatacc

SEQ ID NO: 1566693 - DNA, 15 bp, Homo sapiens
aatgccaaagccatt

SEQ ID NO: 1566694 - DNA, 22 bp, Homo sapiens
aatgccactgggacagctggct

SEQ ID NO: 1566695 - DNA, 12 bp, Homo sapiens
aatgccagagcc

SEQ ID NO: 1566696 - DNA, 20 bp, Homo sapiens
aatgccagagccaacctgga

SEQ ID NO: 1566697 - DNA, 21 bp, Homo sapiens
aatgccagagccaacctggac

SEQ ID NO: 1566698 - DNA, 13 bp, Homo sapiens
aatgccatgaaca

SEQ ID NO: 1566699 - DNA, 16 bp, Homo sapiens
aatgccatgaacaaat

SEQ ID NO: 1566700 - DNA, 13 bp, Homo sapiens
aatgccatgaatt

SEQ ID NO: 1566701 - DNA, 21 bp, Homo sapiens
aatgccatttagaatctagaa

SEQ ID NO: 1566702 - DNA, 22 bp, Homo sapiens
aatgccatttagaatctagaaa

SEQ ID NO: 1566703 - DNA, 14 bp, Homo sapiens
aatgccctgccatt

SEQ ID NO: 1566704 - DNA, 17 bp, Homo sapiens
aatgcccttcactgtca

SEQ ID NO: 1566705 - DNA, 20 bp, Homo sapiens
aatgccgcgaactgggttct

SEQ ID NO: 1566706 - DNA, 15 bp, Homo sapiens
aatgccgctgtctct

SEQ ID NO: 1566707 - DNA, 17 bp, Homo sapiens
aatgcctacagctgtct

SEQ ID NO: 1566708 - DNA, 14 bp, Homo sapiens
aatgcctcctccct

SEQ ID NO: 1566709 - DNA, 16 bp, Homo sapiens
aatgcctcgctccctt

SEQ ID NO: 1566710 - DNA, 23 bp, Homo sapiens
aatgcctcttaaattatatattt

SEQ ID NO: 1566711 - DNA, 17 bp, Homo sapiens
aatgcctgctttttgga

SEQ ID NO: 1566712 - DNA, 22 bp, Homo sapiens
aatgcctgtgaagcagtcagcc

SEQ ID NO: 1566713 - DNA, 15 bp, Homo sapiens
aatgccttgtataaa

SEQ ID NO: 1566714 - DNA, 17 bp, Homo sapiens
aatgccttgtataaaat

SEQ ID NO: 1566715 - DNA, 21 bp, Homo sapiens
aatgcggttataaaaaatggt

SEQ ID NO: 1566716 - DNA, 20 bp, Homo sapiens
aatgctacaattttaagagg

SEQ ID NO: 1566717 - DNA, 22 bp, Homo sapiens
aatgctaccggggaccgggacc

SEQ ID NO: 1566718 - DNA, 21 bp, Homo sapiens
aatgctatcagaaatagattt

SEQ ID NO: 1566719 - DNA, 21 bp, Homo sapiens
aatgctattgttgtgggcttt

SEQ ID NO: 1566720 - DNA, 16 bp, Homo sapiens
aatgctatttgaacaa

SEQ ID NO: 1566721 - DNA, 16 bp, Homo sapiens
aatgctcattttctgg

SEQ ID NO: 1566722 - DNA, 17 bp, Homo sapiens
aatgctcattttctggt

SEQ ID NO: 1566723 - DNA, 22 bp, Homo sapiens
aatgctcccatctcctgatttc

SEQ ID NO: 1566724 - DNA, 23 bp, Homo sapiens
aatgctcccatctcctgatttct

SEQ ID NO: 1566725 - DNA, 16 bp, Homo sapiens
aatgctcgtgtgattt

SEQ ID NO: 1566726 - DNA, 18 bp, Homo sapiens
aatgctgaaaatcaaagt

SEQ ID NO: 1566727 - DNA, 15 bp, Homo sapiens
aatgctgaggttatg

SEQ ID NO: 1566728 - DNA, 17 bp, Homo sapiens
aatgctgccagtgtgga

SEQ ID NO: 1566729 - DNA, 14 bp, Homo sapiens
aatgctgctggcca

SEQ ID NO: 1566730 - DNA, 14 bp, Homo sapiens
aatgctggactgga

SEQ ID NO: 1566731 - DNA, 22 bp, Homo sapiens
aatgctggactggaggcccctg

SEQ ID NO: 1566732 - DNA, 19 bp, Homo sapiens
aatgctggttttcctaaat

SEQ ID NO: 1566733 - DNA, 17 bp, Homo sapiens
aatgctgtcaactatga

SEQ ID NO: 1566734 - DNA, 14 bp, Homo sapiens
aatgctgtttctaa

SEQ ID NO: 1566735 - DNA, 24 bp, Homo sapiens
aatgctgtttctaagaaaatgtag

SEQ ID NO: 1566736 - DNA, 18 bp, Homo sapiens
aatgcttaaaaaataata

SEQ ID NO: 1566737 - DNA, 14 bp, Homo sapiens
aatgcttattttaa

SEQ ID NO: 1566738 - DNA, 11 bp, Homo sapiens
aatgcttcaga

SEQ ID NO: 1566739 - DNA, 16 bp, Homo sapiens
aatgcttcagatatta

SEQ ID NO: 1566740 - DNA, 13 bp, Homo sapiens
aatgcttcattca

SEQ ID NO: 1566741 - DNA, 17 bp, Homo sapiens
aatgcttcattcaatat

SEQ ID NO: 1566742 - DNA, 17 bp, Homo sapiens
aatgcttcattgaaagc

SEQ ID NO: 1566743 - DNA, 21 bp, Homo sapiens
aatgcttcattgaaagcttca

SEQ ID NO: 1566744 - DNA, 17 bp, Homo sapiens
aatgcttccgagacacc

SEQ ID NO: 1566745 - DNA, 21 bp, Homo sapiens
aatgcttcctgacaatcaact

SEQ ID NO: 1566746 - DNA, 13 bp, Homo sapiens
aatgctttcagta

SEQ ID NO: 1566747 - DNA, 13 bp, Homo sapiens
aatgctttctgaa

SEQ ID NO: 1566748 - DNA, 14 bp, Homo sapiens
aatgcttttagtgt

SEQ ID NO: 1566749 - DNA, 16 bp, Homo sapiens
aatggaaaaaaacata

SEQ ID NO: 1566750 - DNA, 20 bp, Homo sapiens
aatggaaaatgccatgaatt

SEQ ID NO: 1566751 - DNA, 19 bp, Homo sapiens
aatggaaaattttctcctt

SEQ ID NO: 1566752 - DNA, 15 bp, Homo sapiens
aatggaaactattat

SEQ ID NO: 1566753 - DNA, 16 bp, Homo sapiens
aatggaaactgaatgc

SEQ ID NO: 1566754 - DNA, 22 bp, Homo sapiens
aatggaaagggtgttggcattg

SEQ ID NO: 1566755 - DNA, 19 bp, Homo sapiens
aatggaaagtaactcattt

SEQ ID NO: 1566756 - DNA, 18 bp, Homo sapiens
aatggaaccccaccactg

SEQ ID NO: 1566757 - DNA, 22 bp, Homo sapiens
aatggaagcctgaactgaggcc

SEQ ID NO: 1566758 - DNA, 17 bp, Homo sapiens
aatggactggaagggga

SEQ ID NO: 1566759 - DNA, 17 bp, Homo sapiens
aatggagctttctgtat

SEQ ID NO: 1566760 - DNA, 20 bp, Homo sapiens
aatggaggaagaacaacaaa

SEQ ID NO: 1566761 - DNA, 17 bp, Homo sapiens
aatggaggccattgtgt

SEQ ID NO: 1566762 - DNA, 14 bp, Homo sapiens
aatggagtcttttc

SEQ ID NO: 1566763 - DNA, 16 bp, Homo sapiens
aatggatcaatacaca

SEQ ID NO: 1566764 - DNA, 18 bp, Homo sapiens
aatggatcacaagatgga

SEQ ID NO: 1566765 - DNA, 15 bp, Homo sapiens
aatggatcagccaag

SEQ ID NO: 1566766 - DNA, 21 bp, Homo sapiens
aatggatttgatgctgtttga

SEQ ID NO: 1566767 - DNA, 21 bp, Homo sapiens
aatggcaatagggtagaatga

SEQ ID NO: 1566768 - DNA, 15 bp, Homo sapiens
aatggcagtcctgga

SEQ ID NO: 1566769 - DNA, 15 bp, Homo sapiens
aatggccagttttct

SEQ ID NO: 1566770 - DNA, 23 bp, Homo sapiens
aatggccatgcaggaggtggaga

SEQ ID NO: 1566771 - DNA, 21 bp, Homo sapiens
aatggccctagaactgtgcct

SEQ ID NO: 1566772 - DNA, 20 bp, Homo sapiens
aatggcctcatgtggctgga

SEQ ID NO: 1566773 - DNA, 22 bp, Homo sapiens
aatggcctcatgtggctggaag

SEQ ID NO: 1566774 - DNA, 22 bp, Homo sapiens
aatggcctgccttgaagccact

SEQ ID NO: 1566775 - DNA, 16 bp, Homo sapiens
aatggcgtctgctctg

SEQ ID NO: 1566776 - DNA, 19 bp, Homo sapiens
aatggcgtctgctctggtg

SEQ ID NO: 1566777 - DNA, 20 bp, Homo sapiens
aatggctaataaactgtatt

SEQ ID NO: 1566778 - DNA, 20 bp, Homo sapiens
aatggctatttttgaagcaa

SEQ ID NO: 1566779 - DNA, 18 bp, Homo sapiens
aatggctcaagtagaaaa

SEQ ID NO: 1566780 - DNA, 20 bp, Homo sapiens
aatggctgcacctttttgca

SEQ ID NO: 1566781 - DNA, 22 bp, Homo sapiens
aatggctggggccgctggggtc

SEQ ID NO: 1566782 - DNA, 20 bp, Homo sapiens
aatgggaaatactactcctg

SEQ ID NO: 1566783 - DNA, 22 bp, Homo sapiens
aatgggaactgcctctttcctg

SEQ ID NO: 1566784 - DNA, 13 bp, Homo sapiens
aatgggaagaaat

SEQ ID NO: 1566785 - DNA, 21 bp, Homo sapiens
aatgggactgatgtcatcttg

SEQ ID NO: 1566786 - DNA, 12 bp, Homo sapiens
aatgggagccag

SEQ ID NO: 1566787 - DNA, 14 bp, Homo sapiens
aatgggagccagaa

SEQ ID NO: 1566788 - DNA, 14 bp, Homo sapiens
aatgggagccagga

SEQ ID NO: 1566789 - DNA, 20 bp, Homo sapiens
aatgggctcttccaacaagg

SEQ ID NO: 1566790 - DNA, 18 bp, Homo sapiens
aatggggaactctccctc

SEQ ID NO: 1566791 - DNA, 14 bp, Homo sapiens
aatggggcagacac

SEQ ID NO: 1566792 - DNA, 14 bp, Homo sapiens
aatggggccagatc

SEQ ID NO: 1566793 - DNA, 21 bp, Homo sapiens
aatgggtgcccgtatccagag

SEQ ID NO: 1566794 - DNA, 16 bp, Homo sapiens
aatgggtttttccctg

SEQ ID NO: 1566795 - DNA, 18 bp, Homo sapiens
aatggtaatagaatagca

SEQ ID NO: 1566796 - DNA, 18 bp, Homo sapiens
aatggtacagcttctgga

SEQ ID NO: 1566797 - DNA, 19 bp, Homo sapiens
aatggtacatgtcttccat

SEQ ID NO: 1566798 - DNA, 18 bp, Homo sapiens
aatggtactgactttgct

SEQ ID NO: 1566799 - DNA, 17 bp, Homo sapiens
aatggtagattcgctgt

SEQ ID NO: 1566800 - DNA, 18 bp, Homo sapiens
aatggtagttagcaacta

SEQ ID NO: 1566801 - DNA, 12 bp, Homo sapiens
aatggtataaaa

SEQ ID NO: 1566802 - DNA, 13 bp, Homo sapiens
aatggtataaaag

SEQ ID NO: 1566803 - DNA, 16 bp, Homo sapiens
aatggtataaatttca

SEQ ID NO: 1566804 - DNA, 16 bp, Homo sapiens
aatggtatggaactct

SEQ ID NO: 1566805 - DNA, 20 bp, Homo sapiens
aatggtccaattagtttcct

SEQ ID NO: 1566806 - DNA, 21 bp, Homo sapiens
aatggtcccaattaagaaatt

SEQ ID NO: 1566807 - DNA, 19 bp, Homo sapiens
aatggtcccatccaggcag

SEQ ID NO: 1566808 - DNA, 13 bp, Homo sapiens
aatggtctggcaa

SEQ ID NO: 1566809 - DNA, 14 bp, Homo sapiens
aatggtctttgctc

SEQ ID NO: 1566810 - DNA, 15 bp, Homo sapiens
aatggtctttgctcc

SEQ ID NO: 1566811 - DNA, 18 bp, Homo sapiens
aatggtctttgctccaga

SEQ ID NO: 1566812 - DNA, 15 bp, Homo sapiens
aatggtgattttaaa

SEQ ID NO: 1566813 - DNA, 13 bp, Homo sapiens
aatggtgctgttt

SEQ ID NO: 1566814 - DNA, 20 bp, Homo sapiens
aatggtgcttcccccacccc

SEQ ID NO: 1566815 - DNA, 15 bp, Homo sapiens
aatggtgtagaacac

SEQ ID NO: 1566816 - DNA, 22 bp, Homo sapiens
aatggtgtgaacccgggagcgg

SEQ ID NO: 1566817 - DNA, 17 bp, Homo sapiens
aatggtgtttttttaat

SEQ ID NO: 1566818 - DNA, 18 bp, Homo sapiens
aatggttaatttttcctg

SEQ ID NO: 1566819 - DNA, 22 bp, Homo sapiens
aatggttcagaattaaactttt

SEQ ID NO: 1566820 - DNA, 17 bp, Homo sapiens
aatggttgactgggttt

SEQ ID NO: 1566821 - DNA, 20 bp, Homo sapiens
aatggttgatggaaaataaa

SEQ ID NO: 1566822 - DNA, 19 bp, Homo sapiens
aatggttgtacgttttgca

SEQ ID NO: 1566823 - DNA, 20 bp, Homo sapiens
aatggttgtacgttttgcac

SEQ ID NO: 1566824 - DNA, 16 bp, Homo sapiens
aatggtttcctctgga

SEQ ID NO: 1566825 - DNA, 14 bp, Homo sapiens
aatggtttgtgtca

SEQ ID NO: 1566826 - DNA, 17 bp, Homo sapiens
aatgtaaaaaagaaaaa

SEQ ID NO: 1566827 - DNA, 14 bp, Homo sapiens
aatgtaaaattcat

SEQ ID NO: 1566828 - DNA, 16 bp, Homo sapiens
aatgtaaaggagggag

SEQ ID NO: 1566829 - DNA, 17 bp, Homo sapiens
aatgtaaaggagggaga

SEQ ID NO: 1566830 - DNA, 12 bp, Homo sapiens
aatgtaaataaa

SEQ ID NO: 1566831 - DNA, 22 bp, Homo sapiens
aatgtaaataaactatttatat

SEQ ID NO: 1566832 - DNA, 16 bp, Homo sapiens
aatgtaaatgatttta

SEQ ID NO: 1566833 - DNA, 16 bp, Homo sapiens
aatgtaaatttgtact

SEQ ID NO: 1566834 - DNA, 21 bp, Homo sapiens
aatgtaacatcataattacat

SEQ ID NO: 1566835 - DNA, 13 bp, Homo sapiens
aatgtaacttatt

SEQ ID NO: 1566836 - DNA, 16 bp, Homo sapiens
aatgtaacttattcca

SEQ ID NO: 1566837 - DNA, 18 bp, Homo sapiens
aatgtaacttattccaag

SEQ ID NO: 1566838 - DNA, 16 bp, Homo sapiens
aatgtaacttttgtaa

SEQ ID NO: 1566839 - DNA, 22 bp, Homo sapiens
aatgtaacttttgtaagacaaa

SEQ ID NO: 1566840 - DNA, 16 bp, Homo sapiens
aatgtaagattataga

SEQ ID NO: 1566841 - DNA, 13 bp, Homo sapiens
aatgtaagctcta

SEQ ID NO: 1566842 - DNA, 17 bp, Homo sapiens
aatgtaaggtatatcat

SEQ ID NO: 1566843 - DNA, 20 bp, Homo sapiens
aatgtaatataatgtatttt

SEQ ID NO: 1566844 - DNA, 14 bp, Homo sapiens
aatgtaatcattta

SEQ ID NO: 1566845 - DNA, 21 bp, Homo sapiens
aatgtaatgatcataagtcta

SEQ ID NO: 1566846 - DNA, 14 bp, Homo sapiens
aatgtaattgaata

SEQ ID NO: 1566847 - DNA, 12 bp, Homo sapiens
aatgtaattgga

SEQ ID NO: 1566848 - DNA, 17 bp, Homo sapiens
aatgtaatttaaatgaa

SEQ ID NO: 1566849 - DNA, 16 bp, Homo sapiens
aatgtacaagttttgt

SEQ ID NO: 1566850 - DNA, 20 bp, Homo sapiens
aatgtacaagttttgtataa

SEQ ID NO: 1566851 - DNA, 20 bp, Homo sapiens
aatgtacaattatgtctctt

SEQ ID NO: 1566852 - DNA, 22 bp, Homo sapiens
aatgtacaattatgtctcttga

SEQ ID NO: 1566853 - DNA, 16 bp, Homo sapiens
aatgtacactggatat

SEQ ID NO: 1566854 - DNA, 16 bp, Homo sapiens
aatgtacagttgaaat

SEQ ID NO: 1566855 - DNA, 17 bp, Homo sapiens
aatgtacagttgaaata

SEQ ID NO: 1566856 - DNA, 20 bp, Homo sapiens
aatgtacatgtattaaatta

SEQ ID NO: 1566857 - DNA, 15 bp, Homo sapiens
aatgtacattaatta

SEQ ID NO: 1566858 - DNA, 21 bp, Homo sapiens
aatgtaccttctttcactctg

SEQ ID NO: 1566859 - DNA, 16 bp, Homo sapiens
aatgtactatgtctga

SEQ ID NO: 1566860 - DNA, 12 bp, Homo sapiens
aatgtactcaca

SEQ ID NO: 1566861 - DNA, 14 bp, Homo sapiens
aatgtactggtaat

SEQ ID NO: 1566862 - DNA, 19 bp, Homo sapiens
aatgtacttgtttctctgt

SEQ ID NO: 1566863 - DNA, 17 bp, Homo sapiens
aatgtagaataggcagg

SEQ ID NO: 1566864 - DNA, 13 bp, Homo sapiens
aatgtagacagat

SEQ ID NO: 1566865 - DNA, 12 bp, Homo sapiens
aatgtagcactt

SEQ ID NO: 1566866 - DNA, 18 bp, Homo sapiens
aatgtagcgacagcattt

SEQ ID NO: 1566867 - DNA, 14 bp, Homo sapiens
aatgtagctggttt

SEQ ID NO: 1566868 - DNA, 12 bp, Homo sapiens
aatgtagggcct

SEQ ID NO: 1566869 - DNA, 16 bp, Homo sapiens
aatgtagtctccctgt

SEQ ID NO: 1566870 - DNA, 22 bp, Homo sapiens
aatgtagtgaagggatgtatca

SEQ ID NO: 1566871 - DNA, 20 bp, Homo sapiens
aatgtagtttgaggaaattt

SEQ ID NO: 1566872 - DNA, 13 bp, Homo sapiens
aatgtataaaaat

SEQ ID NO: 1566873 - DNA, 19 bp, Homo sapiens
aatgtataaaaattatcaa

SEQ ID NO: 1566874 - DNA, 14 bp, Homo sapiens
aatgtatcaggaaa

SEQ ID NO: 1566875 - DNA, 22 bp, Homo sapiens
aatgtatcatagaaatgtaact

SEQ ID NO: 1566876 - DNA, 14 bp, Homo sapiens
aatgtatcctgata

SEQ ID NO: 1566877 - DNA, 17 bp, Homo sapiens
aatgtatctatttgtac

SEQ ID NO: 1566878 - DNA, 21 bp, Homo sapiens
aatgtatctatttgtacaatt

SEQ ID NO: 1566879 - DNA, 17 bp, Homo sapiens
aatgtatcttattcaca

SEQ ID NO: 1566880 - DNA, 17 bp, Homo sapiens
aatgtatctttattaaa

SEQ ID NO: 1566881 - DNA, 21 bp, Homo sapiens
aatgtatctttattaaaacaa

SEQ ID NO: 1566882 - DNA, 13 bp, Homo sapiens
aatgtatgtacaa

SEQ ID NO: 1566883 - DNA, 15 bp, Homo sapiens
aatgtatgtacaata

SEQ ID NO: 1566884 - DNA, 17 bp, Homo sapiens
aatgtatgtacaataca

SEQ ID NO: 1566885 - DNA, 14 bp, Homo sapiens
aatgtatgtatcat

SEQ ID NO: 1566886 - DNA, 15 bp, Homo sapiens
aatgtatgtatcatc

SEQ ID NO: 1566887 - DNA, 19 bp, Homo sapiens
aatgtatgtatcatcagtt

SEQ ID NO: 1566888 - DNA, 17 bp, Homo sapiens
aatgtatgtcagtgcta

SEQ ID NO: 1566889 - DNA, 19 bp, Homo sapiens
aatgtatgtgtaagtattc

SEQ ID NO: 1566890 - DNA, 17 bp, Homo sapiens
aatgtatgttaccaaaa

SEQ ID NO: 1566891 - DNA, 21 bp, Homo sapiens
aatgtatgttaccaaaaataa

SEQ ID NO: 1566892 - DNA, 16 bp, Homo sapiens
aatgtattatgagcca

SEQ ID NO: 1566893 - DNA, 22 bp, Homo sapiens
aatgtattattctgcagcatga

SEQ ID NO: 1566894 - DNA, 16 bp, Homo sapiens
aatgtattcatatttg

SEQ ID NO: 1566895 - DNA, 13 bp, Homo sapiens
aatgtattctgta

SEQ ID NO: 1566896 - DNA, 14 bp, Homo sapiens
aatgtattctgtat

SEQ ID NO: 1566897 - DNA, 15 bp, Homo sapiens
aatgtattctgtatc

SEQ ID NO: 1566898 - DNA, 18 bp, Homo sapiens
aatgtattgaacttggaa

SEQ ID NO: 1566899 - DNA, 15 bp, Homo sapiens
aatgtattgattcaa

SEQ ID NO: 1566900 - DNA, 14 bp, Homo sapiens
aatgtatttagcta

SEQ ID NO: 1566901 - DNA, 14 bp, Homo sapiens
aatgtattttaact

SEQ ID NO: 1566902 - DNA, 14 bp, Homo sapiens
aatgtatttttcct

SEQ ID NO: 1566903 - DNA, 18 bp, Homo sapiens
aatgtcacaacctctctg

SEQ ID NO: 1566904 - DNA, 20 bp, Homo sapiens
aatgtcaccaccttcccagc

SEQ ID NO: 1566905 - DNA, 19 bp, Homo sapiens
aatgtcagaaaccagttat

SEQ ID NO: 1566906 - DNA, 18 bp, Homo sapiens
aatgtcagatttctggtt

SEQ ID NO: 1566907 - DNA, 18 bp, Homo sapiens
aatgtcaggaacagaagg

SEQ ID NO: 1566908 - DNA, 20 bp, Homo sapiens
aatgtcaggaacagaaggat

SEQ ID NO: 1566909 - DNA, 22 bp, Homo sapiens
aatgtcagtatgtggaagtgtg

SEQ ID NO: 1566910 - DNA, 13 bp, Homo sapiens
aatgtcataaatt

SEQ ID NO: 1566911 - DNA, 15 bp, Homo sapiens
aatgtcatatactgc

SEQ ID NO: 1566912 - DNA, 17 bp, Homo sapiens
aatgtcattgctaaaaa

SEQ ID NO: 1566913 - DNA, 21 bp, Homo sapiens
aatgtcattgctaaaaaataa

SEQ ID NO: 1566914 - DNA, 18 bp, Homo sapiens
aatgtcattgtctactcc

SEQ ID NO: 1566915 - DNA, 22 bp, Homo sapiens
aatgtccaccatgaacttgata

SEQ ID NO: 1566916 - DNA, 23 bp, Homo sapiens
aatgtcctccagaagcctctggc

SEQ ID NO: 1566917 - DNA, 16 bp, Homo sapiens
aatgtccttattcttg

SEQ ID NO: 1566918 - DNA, 18 bp, Homo sapiens
aatgtccttattcttgtg

SEQ ID NO: 1566919 - DNA, 15 bp, Homo sapiens
aatgtctaaatgctg

SEQ ID NO: 1566920 - DNA, 18 bp, Homo sapiens
aatgtctaaatgctgaaa

SEQ ID NO: 1566921 - DNA, 13 bp, Homo sapiens
aatgtctcctccc

SEQ ID NO: 1566922 - DNA, 21 bp, Homo sapiens
aatgtctcctttgctcttgcc

SEQ ID NO: 1566923 - DNA, 23 bp, Homo sapiens
aatgtctgtagctcctcaactca

SEQ ID NO: 1566924 - DNA, 12 bp, Homo sapiens
aatgtctgtgct

SEQ ID NO: 1566925 - DNA, 10 bp, Homo sapiens
aatgtctgtt

SEQ ID NO: 1566926 - DNA, 18 bp, Homo sapiens
aatgtcttcttattttgg

SEQ ID NO: 1566927 - DNA, 13 bp, Homo sapiens
aatgtcttttgaa

SEQ ID NO: 1566928 - DNA, 15 bp, Homo sapiens
aatgtcttttgaata

SEQ ID NO: 1566929 - DNA, 17 bp, Homo sapiens
aatgtgaaaaaggaata

SEQ ID NO: 1566930 - DNA, 19 bp, Homo sapiens
aatgtgaagaggtctgatt

SEQ ID NO: 1566931 - DNA, 16 bp, Homo sapiens
aatgtgaagttcatct

SEQ ID NO: 1566932 - DNA, 19 bp, Homo sapiens
aatgtgaatcgcagctgtg

SEQ ID NO: 1566933 - DNA, 18 bp, Homo sapiens
aatgtgaatttttattgt

SEQ ID NO: 1566934 - DNA, 20 bp, Homo sapiens
aatgtgaatttttattgttg

SEQ ID NO: 1566935 - DNA, 15 bp, Homo sapiens
aatgtgagaagccag

SEQ ID NO: 1566936 - DNA, 21 bp, Homo sapiens
aatgtgagaagccagccagag

SEQ ID NO: 1566937 - DNA, 17 bp, Homo sapiens
aatgtgattccttttga

SEQ ID NO: 1566938 - DNA, 15 bp, Homo sapiens
aatgtgcaatagaag

SEQ ID NO: 1566939 - DNA, 19 bp, Homo sapiens
aatgtgcagaaaatattta

SEQ ID NO: 1566940 - DNA, 14 bp, Homo sapiens
aatgtgcagcaaaa

SEQ ID NO: 1566941 - DNA, 23 bp, Homo sapiens
aatgtgcagggatattgccttat

SEQ ID NO: 1566942 - DNA, 20 bp, Homo sapiens
aatgtgcctaatggagaaga

SEQ ID NO: 1566943 - DNA, 14 bp, Homo sapiens
aatgtgcttttcca

SEQ ID NO: 1566944 - DNA, 21 bp, Homo sapiens
aatgtgcttttccatctaaaa

SEQ ID NO: 1566945 - DNA, 18 bp, Homo sapiens
aatgtgggagcagcggtt

SEQ ID NO: 1566946 - DNA, 14 bp, Homo sapiens
aatgtgggattatg

SEQ ID NO: 1566947 - DNA, 16 bp, Homo sapiens
aatgtggtaagtggag

SEQ ID NO: 1566948 - DNA, 18 bp, Homo sapiens
aatgtggttgcttaattc

SEQ ID NO: 1566949 - DNA, 18 bp, Homo sapiens
aatgtgtaattgttttgg

SEQ ID NO: 1566950 - DNA, 16 bp, Homo sapiens
aatgtgtacaacttaa

SEQ ID NO: 1566951 - DNA, 15 bp, Homo sapiens
aatgtgtacagtgaa

SEQ ID NO: 1566952 - DNA, 21 bp, Homo sapiens
aatgtgtacagtgaattgtct

SEQ ID NO: 1566953 - DNA, 13 bp, Homo sapiens
aatgtgtataaga

SEQ ID NO: 1566954 - DNA, 21 bp, Homo sapiens
aatgtgtcagaataggaaaac

SEQ ID NO: 1566955 - DNA, 14 bp, Homo sapiens
aatgtgtcctatct

SEQ ID NO: 1566956 - DNA, 21 bp, Homo sapiens
aatgtgtgagtgcatgtacta

SEQ ID NO: 1566957 - DNA, 23 bp, Homo sapiens
aatgtgtggattgcctctgaaaa

SEQ ID NO: 1566958 - DNA, 19 bp, Homo sapiens
aatgtgttctcggagtgtg

SEQ ID NO: 1566959 - DNA, 14 bp, Homo sapiens
aatgtgttcttttc

SEQ ID NO: 1566960 - DNA, 23 bp, Homo sapiens
aatgtgttcttttctcctttacc

SEQ ID NO: 1566961 - DNA, 13 bp, Homo sapiens
aatgttaaaggga

SEQ ID NO: 1566962 - DNA, 13 bp, Homo sapiens
aatgttaagaaat

SEQ ID NO: 1566963 - DNA, 13 bp, Homo sapiens
aatgttaagcaga

SEQ ID NO: 1566964 - DNA, 23 bp, Homo sapiens
aatgttactaaattttctaatta

SEQ ID NO: 1566965 - DNA, 16 bp, Homo sapiens
aatgttagtcattgtt

SEQ ID NO: 1566966 - DNA, 21 bp, Homo sapiens
aatgttatgggatgtaaacaa

SEQ ID NO: 1566967 - DNA, 21 bp, Homo sapiens
aatgttattttttaattatta

SEQ ID NO: 1566968 - DNA, 18 bp, Homo sapiens
aatgttcacaatatattt

SEQ ID NO: 1566969 - DNA, 15 bp, Homo sapiens
aatgttccctgcacc

SEQ ID NO: 1566970 - DNA, 13 bp, Homo sapiens
aatgttctaagtt

SEQ ID NO: 1566971 - DNA, 14 bp, Homo sapiens
aatgttctaagttt

SEQ ID NO: 1566972 - DNA, 20 bp, Homo sapiens
aatgttctaagtttctaaga

SEQ ID NO: 1566973 - DNA, 21 bp, Homo sapiens
aatgttctgaataatttctta

SEQ ID NO: 1566974 - DNA, 15 bp, Homo sapiens
aatgttgaacaaaat

SEQ ID NO: 1566975 - DNA, 14 bp, Homo sapiens
aatgttggaatgtt

SEQ ID NO: 1566976 - DNA, 17 bp, Homo sapiens
aatgttgtacttgaaaa

SEQ ID NO: 1566977 - DNA, 17 bp, Homo sapiens
aatgttgtattcagtga

SEQ ID NO: 1566978 - DNA, 17 bp, Homo sapiens
aatgttgtatttaattt

SEQ ID NO: 1566979 - DNA, 19 bp, Homo sapiens
aatgttgtccaacaataaa

SEQ ID NO: 1566980 - DNA, 21 bp, Homo sapiens
aatgttgtccaacaataaaca

SEQ ID NO: 1566981 - DNA, 13 bp, Homo sapiens
aatgttgtgaata

SEQ ID NO: 1566982 - DNA, 20 bp, Homo sapiens
aatgttgtgaataattacag

SEQ ID NO: 1566983 - DNA, 14 bp, Homo sapiens
aatgtttaaatata

SEQ ID NO: 1566984 - DNA, 16 bp, Homo sapiens
aatgtttactgtaaat

SEQ ID NO: 1566985 - DNA, 17 bp, Homo sapiens
aatgtttatgagccaga

SEQ ID NO: 1566986 - DNA, 20 bp, Homo sapiens
aatgtttattcctgataata

SEQ ID NO: 1566987 - DNA, 13 bp, Homo sapiens
aatgtttccttaa

SEQ ID NO: 1566988 - DNA, 19 bp, Homo sapiens
aatgtttccttaaacatga

SEQ ID NO: 1566989 - DNA, 12 bp, Homo sapiens
aatgtttctatc

SEQ ID NO: 1566990 - DNA, 15 bp, Homo sapiens
aatgtttctggacat

SEQ ID NO: 1566991 - DNA, 21 bp, Homo sapiens
aatgtttcttcatttctctgc

SEQ ID NO: 1566992 - DNA, 17 bp, Homo sapiens
aatgtttcttttccctt

SEQ ID NO: 1566993 - DNA, 12 bp, Homo sapiens
aatgtttgctat

SEQ ID NO: 1566994 - DNA, 16 bp, Homo sapiens
aatgtttgggatatta

SEQ ID NO: 1566995 - DNA, 13 bp, Homo sapiens
aatgtttgtgaga

SEQ ID NO: 1566996 - DNA, 15 bp, Homo sapiens
aatgtttgtgagaag

SEQ ID NO: 1566997 - DNA, 18 bp, Homo sapiens
aatgtttgttaaaaataa

SEQ ID NO: 1566998 - DNA, 17 bp, Homo sapiens
aatgttttacattccat

SEQ ID NO: 1566999 - DNA, 17 bp, Homo sapiens
aatgttttatactgttt

SEQ ID NO: 1567000 - DNA, 15 bp, Homo sapiens
aatgtttttctgcca

SEQ ID NO: 1567001 - DNA, 13 bp, Homo sapiens
aattaaaacaaat

SEQ ID NO: 1567002 - DNA, 16 bp, Homo sapiens
aattaaaacagctgca

SEQ ID NO: 1567003 - DNA, 18 bp, Homo sapiens
aattaaaccaatgaagaa

SEQ ID NO: 1567004 - DNA, 14 bp, Homo sapiens
aattaaatccaact

SEQ ID NO: 1567005 - DNA, 17 bp, Homo sapiens
aattaaatgccttgtat

SEQ ID NO: 1567006 - DNA, 19 bp, Homo sapiens
aattaaatgccttgtataa

SEQ ID NO: 1567007 - DNA, 14 bp, Homo sapiens
aattaaattaggaa

SEQ ID NO: 1567008 - DNA, 18 bp, Homo sapiens
aattaaattttgtgtctc

SEQ ID NO: 1567009 - DNA, 17 bp, Homo sapiens
aattaacacttaaggtt

SEQ ID NO: 1567010 - DNA, 20 bp, Homo sapiens
aattaactataacaatcact

SEQ ID NO: 1567011 - DNA, 13 bp, Homo sapiens
aattaagaatctc

SEQ ID NO: 1567012 - DNA, 16 bp, Homo sapiens
aattaagcattttgaa

SEQ ID NO: 1567013 - DNA, 23 bp, Homo sapiens
aattaagcattttgaaacaaagt

SEQ ID NO: 1567014 - DNA, 12 bp, Homo sapiens
aattaagtagaa

SEQ ID NO: 1567015 - DNA, 14 bp, Homo sapiens
aattaagtagaaca

SEQ ID NO: 1567016 - DNA, 20 bp, Homo sapiens
aattaagtggtcccaatgct

SEQ ID NO: 1567017 - DNA, 16 bp, Homo sapiens
aattaagttgaaaaag

SEQ ID NO: 1567018 - DNA, 19 bp, Homo sapiens
aattaagttttaaataaac

SEQ ID NO: 1567019 - DNA, 18 bp, Homo sapiens
aattaatcatctggattt

SEQ ID NO: 1567020 - DNA, 19 bp, Homo sapiens
aattaatgaaatatctgta

SEQ ID NO: 1567021 - DNA, 20 bp, Homo sapiens
aattaatgacttactttaat

SEQ ID NO: 1567022 - DNA, 13 bp, Homo sapiens
aattaattttact

SEQ ID NO: 1567023 - DNA, 18 bp, Homo sapiens
aattacaacggagtcaaa

SEQ ID NO: 1567024 - DNA, 19 bp, Homo sapiens
aattacaaggcaatggaaa

SEQ ID NO: 1567025 - DNA, 19 bp, Homo sapiens
aattacaattttatctgtt

SEQ ID NO: 1567026 - DNA, 23 bp, Homo sapiens
aattacacagtaagtcatttaac

SEQ ID NO: 1567027 - DNA, 14 bp, Homo sapiens
aattacacccaaag

SEQ ID NO: 1567028 - DNA, 16 bp, Homo sapiens
aattacagactctgat

SEQ ID NO: 1567029 - DNA, 17 bp, Homo sapiens
aattacagactctgatt

SEQ ID NO: 1567030 - DNA, 17 bp, Homo sapiens
aattacagcttcaccct

SEQ ID NO: 1567031 - DNA, 15 bp, Homo sapiens
aattacatacagatt

SEQ ID NO: 1567032 - DNA, 13 bp, Homo sapiens
aattacattccta

SEQ ID NO: 1567033 - DNA, 19 bp, Homo sapiens
aattacattcctaactaga

SEQ ID NO: 1567034 - DNA, 15 bp, Homo sapiens
aattaccaacctgtt

SEQ ID NO: 1567035 - DNA, 15 bp, Homo sapiens
aattaccattaatta

SEQ ID NO: 1567036 - DNA, 23 bp, Homo sapiens
aattacccctatacctgagcctc

SEQ ID NO: 1567037 - DNA, 16 bp, Homo sapiens
aattactaaattgtat

SEQ ID NO: 1567038 - DNA, 13 bp, Homo sapiens
aattactaatttt

SEQ ID NO: 1567039 - DNA, 15 bp, Homo sapiens
aattactaattttac

SEQ ID NO: 1567040 - DNA, 15 bp, Homo sapiens
aattactacaaaatt

SEQ ID NO: 1567041 - DNA, 20 bp, Homo sapiens
aattactatctgttgaaaag

SEQ ID NO: 1567042 - DNA, 19 bp, Homo sapiens
aattactcaggaagaacac

SEQ ID NO: 1567043 - DNA, 12 bp, Homo sapiens
aattactggaat

SEQ ID NO: 1567044 - DNA, 14 bp, Homo sapiens
aattactgtacaca

SEQ ID NO: 1567045 - DNA, 14 bp, Homo sapiens
aattactgtatata

SEQ ID NO: 1567046 - DNA, 11 bp, Homo sapiens
aattactgtgt

SEQ ID NO: 1567047 - DNA, 16 bp, Homo sapiens
aattactgttttgcca

SEQ ID NO: 1567048 - DNA, 18 bp, Homo sapiens
aattacttgtgttacttg

SEQ ID NO: 1567049 - DNA, 18 bp, Homo sapiens
aattagaaattggctgga

SEQ ID NO: 1567050 - DNA, 15 bp, Homo sapiens
aattagaagacattt

SEQ ID NO: 1567051 - DNA, 13 bp, Homo sapiens
aattagaggagac

SEQ ID NO: 1567052 - DNA, 22 bp, Homo sapiens
aattagatctaaacagttattt

SEQ ID NO: 1567053 - DNA, 15 bp, Homo sapiens
aattagcctaagata

SEQ ID NO: 1567054 - DNA, 20 bp, Homo sapiens
aattagcctaagatatactt

SEQ ID NO: 1567055 - DNA, 17 bp, Homo sapiens
aattaggaagtgattat

SEQ ID NO: 1567056 - DNA, 23 bp, Homo sapiens
aattaggcaaggctatgtgatta

SEQ ID NO: 1567057 - DNA, 21 bp, Homo sapiens
aattaggctgtaactacttta

SEQ ID NO: 1567058 - DNA, 23 bp, Homo sapiens
aattaggctgtaactactttata

SEQ ID NO: 1567059 - DNA, 13 bp, Homo sapiens
aattagtatttca

SEQ ID NO: 1567060 - DNA, 23 bp, Homo sapiens
aattagtgaaccaaaaatagaaa

SEQ ID NO: 1567061 - DNA, 18 bp, Homo sapiens
aattagtggtcataaaat

SEQ ID NO: 1567062 - DNA, 17 bp, Homo sapiens
aattagttccagtttct

SEQ ID NO: 1567063 - DNA, 18 bp, Homo sapiens
aattagttccagtttctc

SEQ ID NO: 1567064 - DNA, 19 bp, Homo sapiens
aattagttccagtttctcc

SEQ ID NO: 1567065 - DNA, 13 bp, Homo sapiens
aattagtttcctt

SEQ ID NO: 1567066 - DNA, 13 bp, Homo sapiens
aattataaatgac

SEQ ID NO: 1567067 - DNA, 18 bp, Homo sapiens
aattataacagttatatt

SEQ ID NO: 1567068 - DNA, 16 bp, Homo sapiens
aattataatatactat

SEQ ID NO: 1567069 - DNA, 14 bp, Homo sapiens
aattataatgtatt

SEQ ID NO: 1567070 - DNA, 14 bp, Homo sapiens
aattatagtagctt

SEQ ID NO: 1567071 - DNA, 13 bp, Homo sapiens
aattatagtttct

SEQ ID NO: 1567072 - DNA, 14 bp, Homo sapiens
aattatagtttctg

SEQ ID NO: 1567073 - DNA, 17 bp, Homo sapiens
aattatagtttctgagg

SEQ ID NO: 1567074 - DNA, 17 bp, Homo sapiens
aattatataactgtatt

SEQ ID NO: 1567075 - DNA, 16 bp, Homo sapiens
aattatataagtattc

SEQ ID NO: 1567076 - DNA, 14 bp, Homo sapiens
aattatatattttg

SEQ ID NO: 1567077 - DNA, 23 bp, Homo sapiens
aattatatattttgttgttcctc

SEQ ID NO: 1567078 - DNA, 22 bp, Homo sapiens
aattatatcagtcctctttcaa

SEQ ID NO: 1567079 - DNA, 18 bp, Homo sapiens
aattatattcaatgcatt

SEQ ID NO: 1567080 - DNA, 15 bp, Homo sapiens
aattatcaaaaagct

SEQ ID NO: 1567081 - DNA, 19 bp, Homo sapiens
aattatcagcaaagaaaaa

SEQ ID NO: 1567082 - DNA, 15 bp, Homo sapiens
aattatccagagttt

SEQ ID NO: 1567083 - DNA, 15 bp, Homo sapiens
aattatcggaagcag

SEQ ID NO: 1567084 - DNA, 20 bp, Homo sapiens
aattatgaatccaacgtgta

SEQ ID NO: 1567085 - DNA, 12 bp, Homo sapiens
aattatgacagt

SEQ ID NO: 1567086 - DNA, 15 bp, Homo sapiens
aattatgacagttat

SEQ ID NO: 1567087 - DNA, 23 bp, Homo sapiens
aattatgagattggttttcctgt

SEQ ID NO: 1567088 - DNA, 19 bp, Homo sapiens
aattatgagttatttttat

SEQ ID NO: 1567089 - DNA, 16 bp, Homo sapiens
aattatggcatttcta

SEQ ID NO: 1567090 - DNA, 15 bp, Homo sapiens
aattatgtatgttta

SEQ ID NO: 1567091 - DNA, 16 bp, Homo sapiens
aattatgtatgtttac

SEQ ID NO: 1567092 - DNA, 18 bp, Homo sapiens
aattatgtcgtaagtcac

SEQ ID NO: 1567093 - DNA, 14 bp, Homo sapiens
aattatgtctcttg

SEQ ID NO: 1567094 - DNA, 20 bp, Homo sapiens
aattatgtctcttgagcatc

SEQ ID NO: 1567095 - DNA, 22 bp, Homo sapiens
aattatgtctgctgaataataa

SEQ ID NO: 1567096 - DNA, 21 bp, Homo sapiens
aattattattcttcataacaa

SEQ ID NO: 1567097 - DNA, 18 bp, Homo sapiens
aattattatttatatatg

SEQ ID NO: 1567098 - DNA, 22 bp, Homo sapiens
aattattatttatatatgtatt

SEQ ID NO: 1567099 - DNA, 13 bp, Homo sapiens
aattattatttta

SEQ ID NO: 1567100 - DNA, 13 bp, Homo sapiens
aattattctagtc

SEQ ID NO: 1567101 - DNA, 22 bp, Homo sapiens
aattattctagtcaactgctgt

SEQ ID NO: 1567102 - DNA, 14 bp, Homo sapiens
aattattgacactg

SEQ ID NO: 1567103 - DNA, 20 bp, Homo sapiens
aattatttatttatggagga

SEQ ID NO: 1567104 - DNA, 22 bp, Homo sapiens
aattatttcatgattagaaatt

SEQ ID NO: 1567105 - DNA, 21 bp, Homo sapiens
aattatttgcatattttgaga

SEQ ID NO: 1567106 - DNA, 15 bp, Homo sapiens
aattattttaaaata

SEQ ID NO: 1567107 - DNA, 19 bp, Homo sapiens
aattattttaaaatattta

SEQ ID NO: 1567108 - DNA, 19 bp, Homo sapiens
aattattttggtactttta

SEQ ID NO: 1567109 - DNA, 16 bp, Homo sapiens
aattattttgttcata

SEQ ID NO: 1567110 - DNA, 19 bp, Homo sapiens
aattattttgttcatacat

SEQ ID NO: 1567111 - DNA, 12 bp, Homo sapiens
aattatttttgt

SEQ ID NO: 1567112 - DNA, 14 bp, Homo sapiens
aattatttttgtgt

SEQ ID NO: 1567113 - DNA, 17 bp, Homo sapiens
aattattttttagataa

SEQ ID NO: 1567114 - DNA, 19 bp, Homo sapiens
aattcaaagcataaaactt

SEQ ID NO: 1567115 - DNA, 18 bp, Homo sapiens
aattcaaagctctattaa

SEQ ID NO: 1567116 - DNA, 15 bp, Homo sapiens
aattcaacaaatgat

SEQ ID NO: 1567117 - DNA, 19 bp, Homo sapiens
aattcaacaaatgatgttg

SEQ ID NO: 1567118 - DNA, 18 bp, Homo sapiens
aattcaaccctttgcccc

SEQ ID NO: 1567119 - DNA, 14 bp, Homo sapiens
aattcaactttgta

SEQ ID NO: 1567120 - DNA, 22 bp, Homo sapiens
aattcaactttgtaaaaatctt

SEQ ID NO: 1567121 - DNA, 23 bp, Homo sapiens
aattcaaggaatttcttaacttc

SEQ ID NO: 1567122 - DNA, 15 bp, Homo sapiens
aattcaatagtaata

SEQ ID NO: 1567123 - DNA, 15 bp, Homo sapiens
aattcaattttaaag

SEQ ID NO: 1567124 - DNA, 16 bp, Homo sapiens
aattcacagcacagta

SEQ ID NO: 1567125 - DNA, 14 bp, Homo sapiens
aattcaccaaagta

SEQ ID NO: 1567126 - DNA, 21 bp, Homo sapiens
aattcaccccctttcctggac

SEQ ID NO: 1567127 - DNA, 15 bp, Homo sapiens
aattcacgtgctttg

SEQ ID NO: 1567128 - DNA, 21 bp, Homo sapiens
aattcactaatcttgaatgtt

SEQ ID NO: 1567129 - DNA, 16 bp, Homo sapiens
aattcactccagtcaa

SEQ ID NO: 1567130 - DNA, 19 bp, Homo sapiens
aattcactccagtcaacag

SEQ ID NO: 1567131 - DNA, 21 bp, Homo sapiens
aattcagacaacattatgatc

SEQ ID NO: 1567132 - DNA, 22 bp, Homo sapiens
aattcagacatctgaggtttta

SEQ ID NO: 1567133 - DNA, 20 bp, Homo sapiens
aattcagatatatttttcac

SEQ ID NO: 1567134 - DNA, 14 bp, Homo sapiens
aattcagcaccctg

SEQ ID NO: 1567135 - DNA, 17 bp, Homo sapiens
aattcagcaccctgggt

SEQ ID NO: 1567136 - DNA, 18 bp, Homo sapiens
aattcagcaccctgggtg

SEQ ID NO: 1567137 - DNA, 16 bp, Homo sapiens
aattcataaaaacaag

SEQ ID NO: 1567138 - DNA, 20 bp, Homo sapiens
aattcatctatttcgagtgt

SEQ ID NO: 1567139 - DNA, 22 bp, Homo sapiens
aattcatgaagcttactttttt

SEQ ID NO: 1567140 - DNA, 22 bp, Homo sapiens
aattcatggcatgcttaaattt

SEQ ID NO: 1567141 - DNA, 18 bp, Homo sapiens
aattcattgttttgcaaa

SEQ ID NO: 1567142 - DNA, 13 bp, Homo sapiens
aattcatttctaa

SEQ ID NO: 1567143 - DNA, 18 bp, Homo sapiens
aattcattttttaaattc

SEQ ID NO: 1567144 - DNA, 17 bp, Homo sapiens
aattccaaacatggttt

SEQ ID NO: 1567145 - DNA, 16 bp, Homo sapiens
aattccacagggacca

SEQ ID NO: 1567146 - DNA, 13 bp, Homo sapiens
aattccactggac

SEQ ID NO: 1567147 - DNA, 22 bp, Homo sapiens
aattccactgtcaagaaagagc

SEQ ID NO: 1567148 - DNA, 20 bp, Homo sapiens
aattccactgtcttgtgttt

SEQ ID NO: 1567149 - DNA, 20 bp, Homo sapiens
aattccagaaaggatattta

SEQ ID NO: 1567150 - DNA, 13 bp, Homo sapiens
aattccaggctga

SEQ ID NO: 1567151 - DNA, 20 bp, Homo sapiens
aattccatacttctctcaga

SEQ ID NO: 1567152 - DNA, 14 bp, Homo sapiens
aattccatgaatgt

SEQ ID NO: 1567153 - DNA, 19 bp, Homo sapiens
aattcccattttgcaaaat

SEQ ID NO: 1567154 - DNA, 21 bp, Homo sapiens
aattcccgttttgtcactttt

SEQ ID NO: 1567155 - DNA, 13 bp, Homo sapiens
aattccctccccc

SEQ ID NO: 1567156 - DNA, 16 bp, Homo sapiens
aattccctccccctcc

SEQ ID NO: 1567157 - DNA, 15 bp, Homo sapiens
aattcccttttaatc

SEQ ID NO: 1567158 - DNA, 13 bp, Homo sapiens
aattccgtcacca

SEQ ID NO: 1567159 - DNA, 13 bp, Homo sapiens
aattcctaacttt

SEQ ID NO: 1567160 - DNA, 22 bp, Homo sapiens
aattcctacaacttaatggaaa

SEQ ID NO: 1567161 - DNA, 21 bp, Homo sapiens
aattcctatatcctgtgactg

SEQ ID NO: 1567162 - DNA, 11 bp, Homo sapiens
aattcctgggc

SEQ ID NO: 1567163 - DNA, 16 bp, Homo sapiens
aattcctgttgacctt

SEQ ID NO: 1567164 - DNA, 13 bp, Homo sapiens
aattccttagctt

SEQ ID NO: 1567165 - DNA, 19 bp, Homo sapiens
aattcgctttctaaagtta

SEQ ID NO: 1567166 - DNA, 18 bp, Homo sapiens
aattcggtgtgctgccaa

SEQ ID NO: 1567167 - DNA, 13 bp, Homo sapiens
aattctaaatgaa

SEQ ID NO: 1567168 - DNA, 19 bp, Homo sapiens
aattctaaatgaatgttta

SEQ ID NO: 1567169 - DNA, 16 bp, Homo sapiens
aattctaacattaaat

SEQ ID NO: 1567170 - DNA, 19 bp, Homo sapiens
aattctaagttatttactt

SEQ ID NO: 1567171 - DNA, 14 bp, Homo sapiens
aattctactggaaa

SEQ ID NO: 1567172 - DNA, 14 bp, Homo sapiens
aattctactttgag

SEQ ID NO: 1567173 - DNA, 23 bp, Homo sapiens
aattctaggcatcccaggggacc

SEQ ID NO: 1567174 - DNA, 16 bp, Homo sapiens
aattctagtgctgctg

SEQ ID NO: 1567175 - DNA, 18 bp, Homo sapiens
aattctagtgctgctgaa

SEQ ID NO: 1567176 - DNA, 21 bp, Homo sapiens
aattctagtgctgctgaagat

SEQ ID NO: 1567177 - DNA, 15 bp, Homo sapiens
aattctattaaagtg

SEQ ID NO: 1567178 - DNA, 20 bp, Homo sapiens
aattctcataggaattaaat

SEQ ID NO: 1567179 - DNA, 13 bp, Homo sapiens
aattctcatttgt

SEQ ID NO: 1567180 - DNA, 13 bp, Homo sapiens
aattctccactgt

SEQ ID NO: 1567181 - DNA, 15 bp, Homo sapiens
aattctccactgtgc

SEQ ID NO: 1567182 - DNA, 22 bp, Homo sapiens
aattctccaggattttaatttc

SEQ ID NO: 1567183 - DNA, 20 bp, Homo sapiens
aattctcctgcctcagcctc

SEQ ID NO: 1567184 - DNA, 15 bp, Homo sapiens
aattctcctggaggt

SEQ ID NO: 1567185 - DNA, 23 bp, Homo sapiens
aattctctccccctatttattga

SEQ ID NO: 1567186 - DNA, 14 bp, Homo sapiens
aattctctttcaaa

SEQ ID NO: 1567187 - DNA, 15 bp, Homo sapiens
aattctgactgtcca

SEQ ID NO: 1567188 - DNA, 21 bp, Homo sapiens
aattctgagaaaacttctttt

SEQ ID NO: 1567189 - DNA, 20 bp, Homo sapiens
aattctgatgtttctgtgaa

SEQ ID NO: 1567190 - DNA, 22 bp, Homo sapiens
aattctgatgtttctgtgaaat

SEQ ID NO: 1567191 - DNA, 23 bp, Homo sapiens
aattctgattctggctttaagcc

SEQ ID NO: 1567192 - DNA, 21 bp, Homo sapiens
aattctgcaactagccaaggc

SEQ ID NO: 1567193 - DNA, 13 bp, Homo sapiens
aattctgcaagtt

SEQ ID NO: 1567194 - DNA, 22 bp, Homo sapiens
aattctgcattgagaaactgaa

SEQ ID NO: 1567195 - DNA, 15 bp, Homo sapiens
aattctgctacctca

SEQ ID NO: 1567196 - DNA, 22 bp, Homo sapiens
aattctgcttgtgacattaaaa

SEQ ID NO: 1567197 - DNA, 15 bp, Homo sapiens
aattctggcccagcc

SEQ ID NO: 1567198 - DNA, 12 bp, Homo sapiens
aattctgtaaat

SEQ ID NO: 1567199 - DNA, 22 bp, Homo sapiens
aattctgtcttgttcattttga

SEQ ID NO: 1567200 - DNA, 18 bp, Homo sapiens
aattctgttactttgcta

SEQ ID NO: 1567201 - DNA, 21 bp, Homo sapiens
aattctgttttaggttaaaaa

SEQ ID NO: 1567202 - DNA, 18 bp, Homo sapiens
aattctgtttttaaaaat

SEQ ID NO: 1567203 - DNA, 16 bp, Homo sapiens
aattcttaagtatgtt

SEQ ID NO: 1567204 - DNA, 15 bp, Homo sapiens
aattcttactctgga

SEQ ID NO: 1567205 - DNA, 19 bp, Homo sapiens
aattcttatgccatataat

SEQ ID NO: 1567206 - DNA, 23 bp, Homo sapiens
aattcttctgaactcaaactgag

SEQ ID NO: 1567207 - DNA, 15 bp, Homo sapiens
aattcttgaaggaaa

SEQ ID NO: 1567208 - DNA, 15 bp, Homo sapiens
aattcttgtatatta

SEQ ID NO: 1567209 - DNA, 20 bp, Homo sapiens
aattcttgtatattatggaa

SEQ ID NO: 1567210 - DNA, 11 bp, Homo sapiens
aattctttctg

SEQ ID NO: 1567211 - DNA, 15 bp, Homo sapiens
aattctttctgtctc

SEQ ID NO: 1567212 - DNA, 17 bp, Homo sapiens
aattctttctgtctccc

SEQ ID NO: 1567213 - DNA, 18 bp, Homo sapiens
aattctttctgtctccct

SEQ ID NO: 1567214 - DNA, 14 bp, Homo sapiens
aattctttgttctg

SEQ ID NO: 1567215 - DNA, 21 bp, Homo sapiens
aattgaaaaaaattgaaataa

SEQ ID NO: 1567216 - DNA, 15 bp, Homo sapiens
aattgaaagaactta

SEQ ID NO: 1567217 - DNA, 16 bp, Homo sapiens
aattgaaagaacttaa

SEQ ID NO: 1567218 - DNA, 21 bp, Homo sapiens
aattgaaagaacttaagtctc

SEQ ID NO: 1567219 - DNA, 17 bp, Homo sapiens
aattgaaaggcattctc

SEQ ID NO: 1567220 - DNA, 14 bp, Homo sapiens
aattgaaataaata

SEQ ID NO: 1567221 - DNA, 17 bp, Homo sapiens
aattgaagtaaactttt

SEQ ID NO: 1567222 - DNA, 21 bp, Homo sapiens
aattgaagtgtataatataaa

SEQ ID NO: 1567223 - DNA, 22 bp, Homo sapiens
aattgaagtgtataatataaaa

SEQ ID NO: 1567224 - DNA, 21 bp, Homo sapiens
aattgactgatgattttcctt

SEQ ID NO: 1567225 - DNA, 23 bp, Homo sapiens
aattgagataatatctgtgaggt

SEQ ID NO: 1567226 - DNA, 19 bp, Homo sapiens
aattgagataatgatactt

SEQ ID NO: 1567227 - DNA, 15 bp, Homo sapiens
aattgagcagttcat

SEQ ID NO: 1567228 - DNA, 18 bp, Homo sapiens
aattgagctgcagaaacg

SEQ ID NO: 1567229 - DNA, 19 bp, Homo sapiens
aattgaggtttggaagagt

SEQ ID NO: 1567230 - DNA, 21 bp, Homo sapiens
aattgagtgcactaaacaaat

SEQ ID NO: 1567231 - DNA, 21 bp, Homo sapiens
aattgagtttaacaataataa

SEQ ID NO: 1567232 - DNA, 17 bp, Homo sapiens
aattgataaaagagttc

SEQ ID NO: 1567233 - DNA, 14 bp, Homo sapiens
aattgatattttta

SEQ ID NO: 1567234 - DNA, 22 bp, Homo sapiens
aattgatcattttccccccact

SEQ ID NO: 1567235 - DNA, 15 bp, Homo sapiens
aattgatgtatatgt

SEQ ID NO: 1567236 - DNA, 23 bp, Homo sapiens
aattgatgtatatgtttatatac

SEQ ID NO: 1567237 - DNA, 18 bp, Homo sapiens
aattgattgaattaaatc

SEQ ID NO: 1567238 - DNA, 14 bp, Homo sapiens
aattgcagaactaa

SEQ ID NO: 1567239 - DNA, 17 bp, Homo sapiens
aattgcagtcatttggt

SEQ ID NO: 1567240 - DNA, 19 bp, Homo sapiens
aattgcatcagttcattga

SEQ ID NO: 1567241 - DNA, 14 bp, Homo sapiens
aattgccaaagctg

SEQ ID NO: 1567242 - DNA, 21 bp, Homo sapiens
aattgcctacaataaaaagaa

SEQ ID NO: 1567243 - DNA, 20 bp, Homo sapiens
aattgctaatacccagttac

SEQ ID NO: 1567244 - DNA, 19 bp, Homo sapiens
aattgctagtcagggtgaa

SEQ ID NO: 1567245 - DNA, 15 bp, Homo sapiens
aattgctattttatt

SEQ ID NO: 1567246 - DNA, 20 bp, Homo sapiens
aattgcttacatttttacaa

SEQ ID NO: 1567247 - DNA, 23 bp, Homo sapiens
aattgcttactttggaatacatt

SEQ ID NO: 1567248 - DNA, 13 bp, Homo sapiens
aattgctttacag

SEQ ID NO: 1567249 - DNA, 15 bp, Homo sapiens
aattgctttgccaaa

SEQ ID NO: 1567250 - DNA, 20 bp, Homo sapiens
aattggaacagaatgtttta

SEQ ID NO: 1567251 - DNA, 14 bp, Homo sapiens
aattggaatcttca

SEQ ID NO: 1567252 - DNA, 18 bp, Homo sapiens
aattggaatcttcacctc

SEQ ID NO: 1567253 - DNA, 17 bp, Homo sapiens
aattggatttcctaata

SEQ ID NO: 1567254 - DNA, 15 bp, Homo sapiens
aattggcaggataag

SEQ ID NO: 1567255 - DNA, 13 bp, Homo sapiens
aattggggcactt

SEQ ID NO: 1567256 - DNA, 23 bp, Homo sapiens
aattggggctgtcgggggctgtg

SEQ ID NO: 1567257 - DNA, 23 bp, Homo sapiens
aattggtaaggcctctggactgg

SEQ ID NO: 1567258 - DNA, 16 bp, Homo sapiens
aattggtaattacctg

SEQ ID NO: 1567259 - DNA, 21 bp, Homo sapiens
aattgtaaagtaaaagctata

SEQ ID NO: 1567260 - DNA, 18 bp, Homo sapiens
aattgtaagtgaaattaa

SEQ ID NO: 1567261 - DNA, 19 bp, Homo sapiens
aattgtaagtgaaattaag

SEQ ID NO: 1567262 - DNA, 14 bp, Homo sapiens
aattgtaatggatt

SEQ ID NO: 1567263 - DNA, 18 bp, Homo sapiens
aattgtacaaaattaagc

SEQ ID NO: 1567264 - DNA, 14 bp, Homo sapiens
aattgtacaataaa

SEQ ID NO: 1567265 - DNA, 18 bp, Homo sapiens
aattgtactaatctgaga

SEQ ID NO: 1567266 - DNA, 20 bp, Homo sapiens
aattgtagttctgtgtactt

SEQ ID NO: 1567267 - DNA, 17 bp, Homo sapiens
aattgtatcaatttgtt

SEQ ID NO: 1567268 - DNA, 18 bp, Homo sapiens
aattgtatcaatttgttt

SEQ ID NO: 1567269 - DNA, 18 bp, Homo sapiens
aattgtatgaaaatcctt

SEQ ID NO: 1567270 - DNA, 18 bp, Homo sapiens
aattgtattgaaaacact

SEQ ID NO: 1567271 - DNA, 20 bp, Homo sapiens
aattgtcattatttttgtta

SEQ ID NO: 1567272 - DNA, 13 bp, Homo sapiens
aattgtccccagt

SEQ ID NO: 1567273 - DNA, 17 bp, Homo sapiens
aattgtccgtgttcata

SEQ ID NO: 1567274 - DNA, 17 bp, Homo sapiens
aattgtctatttatctt

SEQ ID NO: 1567275 - DNA, 18 bp, Homo sapiens
aattgtctatttatcttt

SEQ ID NO: 1567276 - DNA, 18 bp, Homo sapiens
aattgtcttttttttcct

SEQ ID NO: 1567277 - DNA, 12 bp, Homo sapiens
aattgtgaaaaa

SEQ ID NO: 1567278 - DNA, 18 bp, Homo sapiens
aattgtgaccaatacatt

SEQ ID NO: 1567279 - DNA, 20 bp, Homo sapiens
aattgtgaccaatacatttg

SEQ ID NO: 1567280 - DNA, 22 bp, Homo sapiens
aattgtgaccaatacatttgta

SEQ ID NO: 1567281 - DNA, 20 bp, Homo sapiens
aattgtgccgagaaaagcat

SEQ ID NO: 1567282 - DNA, 12 bp, Homo sapiens
aattgtgctgcc

SEQ ID NO: 1567283 - DNA, 15 bp, Homo sapiens
aattgtgctgccatt

SEQ ID NO: 1567284 - DNA, 16 bp, Homo sapiens
aattgtgctgccattt

SEQ ID NO: 1567285 - DNA, 16 bp, Homo sapiens
aattgtgctttcacca

SEQ ID NO: 1567286 - DNA, 15 bp, Homo sapiens
aattgtggattataa

SEQ ID NO: 1567287 - DNA, 15 bp, Homo sapiens
aattgtgtagccttt

SEQ ID NO: 1567288 - DNA, 17 bp, Homo sapiens
aattgtgtagccttttt

SEQ ID NO: 1567289 - DNA, 21 bp, Homo sapiens
aattgtgtatatgttggttta

SEQ ID NO: 1567290 - DNA, 22 bp, Homo sapiens
aattgtgtattgatgcaatata

SEQ ID NO: 1567291 - DNA, 21 bp, Homo sapiens
aattgtgtgatatttcagaaa

SEQ ID NO: 1567292 - DNA, 22 bp, Homo sapiens
aattgtgtgatatttcagaaat

SEQ ID NO: 1567293 - DNA, 23 bp, Homo sapiens
aattgtgtgatatttcagaaata

SEQ ID NO: 1567294 - DNA, 15 bp, Homo sapiens
aattgtgtttgctaa

SEQ ID NO: 1567295 - DNA, 16 bp, Homo sapiens
aattgttaaccttgta

SEQ ID NO: 1567296 - DNA, 11 bp, Homo sapiens
aattgttacaa

SEQ ID NO: 1567297 - DNA, 20 bp, Homo sapiens
aattgttgacagttctgaag

SEQ ID NO: 1567298 - DNA, 23 bp, Homo sapiens
aattgttgctaatcttcttatgc

SEQ ID NO: 1567299 - DNA, 23 bp, Homo sapiens
aattgttgtccggtttactttaa

SEQ ID NO: 1567300 - DNA, 22 bp, Homo sapiens
aattgtttatgtgttatgaaca

SEQ ID NO: 1567301 - DNA, 23 bp, Homo sapiens
aattgtttatgtgttatgaacat

SEQ ID NO: 1567302 - DNA, 12 bp, Homo sapiens
aattgtttccaa

SEQ ID NO: 1567303 - DNA, 17 bp, Homo sapiens
aattgttttaccagctc

SEQ ID NO: 1567304 - DNA, 18 bp, Homo sapiens
aattgttttcacttgtat

SEQ ID NO: 1567305 - DNA, 20 bp, Homo sapiens
aattgttttgcactttttta

SEQ ID NO: 1567306 - DNA, 17 bp, Homo sapiens
aattgtttttgaattta

SEQ ID NO: 1567307 - DNA, 17 bp, Homo sapiens
aatttaaaatatttccc

SEQ ID NO: 1567308 - DNA, 13 bp, Homo sapiens
aatttaaaattaa

SEQ ID NO: 1567309 - DNA, 19 bp, Homo sapiens
aatttaaaattaagtagaa

SEQ ID NO: 1567310 - DNA, 20 bp, Homo sapiens
aatttaaaattaatcttgct

SEQ ID NO: 1567311 - DNA, 10 bp, Homo sapiens
aatttaaaca

SEQ ID NO: 1567312 - DNA, 11 bp, Homo sapiens
aatttaaacag

SEQ ID NO: 1567313 - DNA, 21 bp, Homo sapiens
aatttaaacatttgttcctgg

SEQ ID NO: 1567314 - DNA, 12 bp, Homo sapiens
aatttaaactgt

SEQ ID NO: 1567315 - DNA, 16 bp, Homo sapiens
aatttaaactgtgttt

SEQ ID NO: 1567316 - DNA, 15 bp, Homo sapiens
aatttaaagccacaa

SEQ ID NO: 1567317 - DNA, 12 bp, Homo sapiens
aatttaaataaa

SEQ ID NO: 1567318 - DNA, 14 bp, Homo sapiens
aatttaaataaagt

SEQ ID NO: 1567319 - DNA, 23 bp, Homo sapiens
aatttaaatataattctgtaaat

SEQ ID NO: 1567320 - DNA, 14 bp, Homo sapiens
aatttaaatgacat

SEQ ID NO: 1567321 - DNA, 19 bp, Homo sapiens
aatttaacaccctttagaa

SEQ ID NO: 1567322 - DNA, 20 bp, Homo sapiens
aatttaactactaagaataa

SEQ ID NO: 1567323 - DNA, 12 bp, Homo sapiens
aatttaactgca

SEQ ID NO: 1567324 - DNA, 22 bp, Homo sapiens
aatttaactgcatatagataat

SEQ ID NO: 1567325 - DNA, 16 bp, Homo sapiens
aatttaaggtctgttt

SEQ ID NO: 1567326 - DNA, 15 bp, Homo sapiens
aatttaagtgacaca

SEQ ID NO: 1567327 - DNA, 19 bp, Homo sapiens
aatttaataaaaaggaata

SEQ ID NO: 1567328 - DNA, 23 bp, Homo sapiens
aatttaattcatgtttcttaaat

SEQ ID NO: 1567329 - DNA, 20 bp, Homo sapiens
aatttaattcctctttttag

SEQ ID NO: 1567330 - DNA, 20 bp, Homo sapiens
aatttacaagagctgttcat

SEQ ID NO: 1567331 - DNA, 23 bp, Homo sapiens
aatttacaagatattattaattt

SEQ ID NO: 1567332 - DNA, 19 bp, Homo sapiens
aatttacatactctgctta

SEQ ID NO: 1567333 - DNA, 16 bp, Homo sapiens
aatttacatcatttct

SEQ ID NO: 1567334 - DNA, 22 bp, Homo sapiens
aatttaccaaggatgaattctt

SEQ ID NO: 1567335 - DNA, 13 bp, Homo sapiens
aatttacctaaga

SEQ ID NO: 1567336 - DNA, 16 bp, Homo sapiens
aatttactacaatatg

SEQ ID NO: 1567337 - DNA, 21 bp, Homo sapiens
aatttactacaatatgtacat

SEQ ID NO: 1567338 - DNA, 20 bp, Homo sapiens
aatttagacaacctgaaatt

SEQ ID NO: 1567339 - DNA, 21 bp, Homo sapiens
aatttagagataggaaactga

SEQ ID NO: 1567340 - DNA, 15 bp, Homo sapiens
aatttagatgaattt

SEQ ID NO: 1567341 - DNA, 17 bp, Homo sapiens
aatttagatgaatttag

SEQ ID NO: 1567342 - DNA, 18 bp, Homo sapiens
aatttagtggatggaata

SEQ ID NO: 1567343 - DNA, 22 bp, Homo sapiens
aatttataaaaaggtgttttga

SEQ ID NO: 1567344 - DNA, 17 bp, Homo sapiens
aatttatacaggtcata

SEQ ID NO: 1567345 - DNA, 16 bp, Homo sapiens
aatttatatgtatatt

SEQ ID NO: 1567346 - DNA, 16 bp, Homo sapiens
aatttatattccattt

SEQ ID NO: 1567347 - DNA, 21 bp, Homo sapiens
aatttatattccatttacata

SEQ ID NO: 1567348 - DNA, 18 bp, Homo sapiens
aatttatccaattttgat

SEQ ID NO: 1567349 - DNA, 19 bp, Homo sapiens
aatttatcttgtctctggg

SEQ ID NO: 1567350 - DNA, 12 bp, Homo sapiens
aatttatcttta

SEQ ID NO: 1567351 - DNA, 16 bp, Homo sapiens
aatttatctttaccaa

SEQ ID NO: 1567352 - DNA, 13 bp, Homo sapiens
aatttatctttga

SEQ ID NO: 1567353 - DNA, 21 bp, Homo sapiens
aatttatgaattgaattatct

SEQ ID NO: 1567354 - DNA, 16 bp, Homo sapiens
aatttatgagtttttg

SEQ ID NO: 1567355 - DNA, 16 bp, Homo sapiens
aatttatgcatttcat

SEQ ID NO: 1567356 - DNA, 20 bp, Homo sapiens
aatttatgcatttcattcaa

SEQ ID NO: 1567357 - DNA, 22 bp, Homo sapiens
aatttatgtgaaatgctttctg

SEQ ID NO: 1567358 - DNA, 16 bp, Homo sapiens
aatttattaagtctgg

SEQ ID NO: 1567359 - DNA, 13 bp, Homo sapiens
aatttattacaaa

SEQ ID NO: 1567360 - DNA, 17 bp, Homo sapiens
aatttatttagttttta

SEQ ID NO: 1567361 - DNA, 17 bp, Homo sapiens
aatttatttatactatt

SEQ ID NO: 1567362 - DNA, 16 bp, Homo sapiens
aatttatttatattcc

SEQ ID NO: 1567363 - DNA, 20 bp, Homo sapiens
aatttatttcttaacctttg

SEQ ID NO: 1567364 - DNA, 17 bp, Homo sapiens
aatttattttataagaa

SEQ ID NO: 1567365 - DNA, 18 bp, Homo sapiens
aatttattttataagaaa

SEQ ID NO: 1567366 - DNA, 11 bp, Homo sapiens
aatttcaaaat

SEQ ID NO: 1567367 - DNA, 21 bp, Homo sapiens
aatttcaaaatacatttgtaa

SEQ ID NO: 1567368 - DNA, 23 bp, Homo sapiens
aatttcaaaatacatttgtaagt

SEQ ID NO: 1567369 - DNA, 17 bp, Homo sapiens
aatttcaggcattttgt

SEQ ID NO: 1567370 - DNA, 19 bp, Homo sapiens
aatttcagtgtaaagtgtg

SEQ ID NO: 1567371 - DNA, 18 bp, Homo sapiens
aatttcatagctgtactt

SEQ ID NO: 1567372 - DNA, 18 bp, Homo sapiens
aatttcatttaaatatct

SEQ ID NO: 1567373 - DNA, 15 bp, Homo sapiens
aatttccagtacctt

SEQ ID NO: 1567374 - DNA, 17 bp, Homo sapiens
aatttccagtacctttg

SEQ ID NO: 1567375 - DNA, 23 bp, Homo sapiens
aatttccagtttaagtaattgcc

SEQ ID NO: 1567376 - DNA, 12 bp, Homo sapiens
aatttcccagga

SEQ ID NO: 1567377 - DNA, 22 bp, Homo sapiens
aatttcccaggaccctgaaggg

SEQ ID NO: 1567378 - DNA, 14 bp, Homo sapiens
aatttcctctccac

SEQ ID NO: 1567379 - DNA, 20 bp, Homo sapiens
aatttcctgttggatttgtt

SEQ ID NO: 1567380 - DNA, 15 bp, Homo sapiens
aatttcctgtttgaa

SEQ ID NO: 1567381 - DNA, 17 bp, Homo sapiens
aatttcctttttgacac

SEQ ID NO: 1567382 - DNA, 18 bp, Homo sapiens
aatttcgccgttgaagag

SEQ ID NO: 1567383 - DNA, 13 bp, Homo sapiens
aatttcgccttaa

SEQ ID NO: 1567384 - DNA, 17 bp, Homo sapiens
aatttcgccttaaactc

SEQ ID NO: 1567385 - DNA, 21 bp, Homo sapiens
aatttcgttgtccaatttgta

SEQ ID NO: 1567386 - DNA, 22 bp, Homo sapiens
aatttctaaaaaacagaggcca

SEQ ID NO: 1567387 - DNA, 16 bp, Homo sapiens
aatttctatcagcctt

SEQ ID NO: 1567388 - DNA, 20 bp, Homo sapiens
aatttctcccagtcatttaa

SEQ ID NO: 1567389 - DNA, 23 bp, Homo sapiens
aatttctggaagattcttactgt

SEQ ID NO: 1567390 - DNA, 21 bp, Homo sapiens
aatttctgtgttgccaagctc

SEQ ID NO: 1567391 - DNA, 20 bp, Homo sapiens
aatttcttaacttcttgctt

SEQ ID NO: 1567392 - DNA, 21 bp, Homo sapiens
aatttcttactagtactattt

SEQ ID NO: 1567393 - DNA, 15 bp, Homo sapiens
aatttcttatgtgac

SEQ ID NO: 1567394 - DNA, 16 bp, Homo sapiens
aatttcttctttagat

SEQ ID NO: 1567395 - DNA, 22 bp, Homo sapiens
aatttcttctttagatgccaaa

SEQ ID NO: 1567396 - DNA, 20 bp, Homo sapiens
aatttcttggtaagaagccg

SEQ ID NO: 1567397 - DNA, 22 bp, Homo sapiens
aatttctttttttcctttttaa

SEQ ID NO: 1567398 - DNA, 14 bp, Homo sapiens
aatttgaaatttag

SEQ ID NO: 1567399 - DNA, 15 bp, Homo sapiens
aatttgaagtaactt

SEQ ID NO: 1567400 - DNA, 23 bp, Homo sapiens
aatttgaagtaacttatttgact

SEQ ID NO: 1567401 - DNA, 23 bp, Homo sapiens
aatttgaagtccctgtttgggaa

SEQ ID NO: 1567402 - DNA, 16 bp, Homo sapiens
aatttgactaatttta

SEQ ID NO: 1567403 - DNA, 14 bp, Homo sapiens
aatttgaggacaac

SEQ ID NO: 1567404 - DNA, 13 bp, Homo sapiens
aatttgatacata

SEQ ID NO: 1567405 - DNA, 18 bp, Homo sapiens
aatttgatacataataaa

SEQ ID NO: 1567406 - DNA, 21 bp, Homo sapiens
aatttgatgatgttaaatgta

SEQ ID NO: 1567407 - DNA, 19 bp, Homo sapiens
aatttgatgcccaatatat

SEQ ID NO: 1567408 - DNA, 20 bp, Homo sapiens
aatttgatgcccaatatatt

SEQ ID NO: 1567409 - DNA, 23 bp, Homo sapiens
aatttgatggactaattattatt

SEQ ID NO: 1567410 - DNA, 20 bp, Homo sapiens
aatttgattgactgcccatt

SEQ ID NO: 1567411 - DNA, 22 bp, Homo sapiens
aatttgcaacaggggaggaaaa

SEQ ID NO: 1567412 - DNA, 14 bp, Homo sapiens
aatttgcgcctcgg

SEQ ID NO: 1567413 - DNA, 16 bp, Homo sapiens
aatttggattgctaat

SEQ ID NO: 1567414 - DNA, 23 bp, Homo sapiens
aatttggatttaaaagcctgctc

SEQ ID NO: 1567415 - DNA, 13 bp, Homo sapiens
aatttggccttaa

SEQ ID NO: 1567416 - DNA, 23 bp, Homo sapiens
aatttggccttaagaactgtgtc

SEQ ID NO: 1567417 - DNA, 16 bp, Homo sapiens
aatttggctttcacat

SEQ ID NO: 1567418 - DNA, 14 bp, Homo sapiens
aatttgggatgctg

SEQ ID NO: 1567419 - DNA, 23 bp, Homo sapiens
aatttgggctaaaacttagaaaa

SEQ ID NO: 1567420 - DNA, 15 bp, Homo sapiens
aatttggtctgtata

SEQ ID NO: 1567421 - DNA, 13 bp, Homo sapiens
aatttgtacaatg

SEQ ID NO: 1567422 - DNA, 22 bp, Homo sapiens
aatttgtacaggactgtaaaga

SEQ ID NO: 1567423 - DNA, 12 bp, Homo sapiens
aatttgtacttc

SEQ ID NO: 1567424 - DNA, 12 bp, Homo sapiens
aatttgtacttt

SEQ ID NO: 1567425 - DNA, 23 bp, Homo sapiens
aatttgtacttttttcttaaggc

SEQ ID NO: 1567426 - DNA, 13 bp, Homo sapiens
aatttgtatatca

SEQ ID NO: 1567427 - DNA, 17 bp, Homo sapiens
aatttgtgtgtttttag

SEQ ID NO: 1567428 - DNA, 21 bp, Homo sapiens
aatttgtttaaagaataaagt

SEQ ID NO: 1567429 - DNA, 13 bp, Homo sapiens
aatttgtttgtat

SEQ ID NO: 1567430 - DNA, 19 bp, Homo sapiens
aatttgtttgtgttcaata

SEQ ID NO: 1567431 - DNA, 12 bp, Homo sapiens
aattttaaaaaa

SEQ ID NO: 1567432 - DNA, 18 bp, Homo sapiens
aattttaaaaaataacat

SEQ ID NO: 1567433 - DNA, 20 bp, Homo sapiens
aattttaaaaaataacatat

SEQ ID NO: 1567434 - DNA, 14 bp, Homo sapiens
aattttaaacaaag

SEQ ID NO: 1567435 - DNA, 12 bp, Homo sapiens
aattttaaagcc

SEQ ID NO: 1567436 - DNA, 16 bp, Homo sapiens
aattttaaagtatgca

SEQ ID NO: 1567437 - DNA, 18 bp, Homo sapiens
aattttaaagtatgcatt

SEQ ID NO: 1567438 - DNA, 14 bp, Homo sapiens
aattttaaagttct

SEQ ID NO: 1567439 - DNA, 15 bp, Homo sapiens
aattttaaagttctt

SEQ ID NO: 1567440 - DNA, 16 bp, Homo sapiens
aattttaaagttctta

SEQ ID NO: 1567441 - DNA, 19 bp, Homo sapiens
aattttaacctatgatatt

SEQ ID NO: 1567442 - DNA, 21 bp, Homo sapiens
aattttaacgtaactctttct

SEQ ID NO: 1567443 - DNA, 19 bp, Homo sapiens
aattttaagtgctttgtaa

SEQ ID NO: 1567444 - DNA, 13 bp, Homo sapiens
aattttaatgcta

SEQ ID NO: 1567445 - DNA, 16 bp, Homo sapiens
aattttaatgctgttt

SEQ ID NO: 1567446 - DNA, 19 bp, Homo sapiens
aattttaatgctgtttcta

SEQ ID NO: 1567447 - DNA, 20 bp, Homo sapiens
aattttaatgctgtttctaa

SEQ ID NO: 1567448 - DNA, 21 bp, Homo sapiens
aattttaatgctgtttctaag

SEQ ID NO: 1567449 - DNA, 23 bp, Homo sapiens
aattttaatgtaaaattcatagc

SEQ ID NO: 1567450 - DNA, 22 bp, Homo sapiens
aattttaatgtgaagacatttt

SEQ ID NO: 1567451 - DNA, 20 bp, Homo sapiens
aattttacatgtttataaat

SEQ ID NO: 1567452 - DNA, 17 bp, Homo sapiens
aattttagaaatattca

SEQ ID NO: 1567453 - DNA, 15 bp, Homo sapiens
aattttagaacttta

SEQ ID NO: 1567454 - DNA, 12 bp, Homo sapiens
aattttagtgta

SEQ ID NO: 1567455 - DNA, 20 bp, Homo sapiens
aattttatagctcagtttat

SEQ ID NO: 1567456 - DNA, 11 bp, Homo sapiens
aattttatgta

SEQ ID NO: 1567457 - DNA, 12 bp, Homo sapiens
aattttattcct

SEQ ID NO: 1567458 - DNA, 15 bp, Homo sapiens
aattttattgcaaag

SEQ ID NO: 1567459 - DNA, 21 bp, Homo sapiens
aattttatttgttctttttct

SEQ ID NO: 1567460 - DNA, 20 bp, Homo sapiens
aattttattttgtgctcatt

SEQ ID NO: 1567461 - DNA, 16 bp, Homo sapiens
aattttatttttctgt

SEQ ID NO: 1567462 - DNA, 22 bp, Homo sapiens
aattttcaactgtcttcctcaa

SEQ ID NO: 1567463 - DNA, 14 bp, Homo sapiens
aattttcaaggcct

SEQ ID NO: 1567464 - DNA, 15 bp, Homo sapiens
aattttcaaggcctt

SEQ ID NO: 1567465 - DNA, 17 bp, Homo sapiens
aattttcaaggccttca

SEQ ID NO: 1567466 - DNA, 19 bp, Homo sapiens
aattttcacacacgtgaga

SEQ ID NO: 1567467 - DNA, 20 bp, Homo sapiens
aattttcattaaacttgaag

SEQ ID NO: 1567468 - DNA, 16 bp, Homo sapiens
aattttcctttgtcat

SEQ ID NO: 1567469 - DNA, 21 bp, Homo sapiens
aattttctaaaagctttcatg

SEQ ID NO: 1567470 - DNA, 13 bp, Homo sapiens
aattttctatgtg

SEQ ID NO: 1567471 - DNA, 19 bp, Homo sapiens
aattttctatgtgttgtgt

SEQ ID NO: 1567472 - DNA, 16 bp, Homo sapiens
aattttctgcagctgt

SEQ ID NO: 1567473 - DNA, 17 bp, Homo sapiens
aattttctgcagctgtt

SEQ ID NO: 1567474 - DNA, 16 bp, Homo sapiens
aattttcttgtttgtt

SEQ ID NO: 1567475 - DNA, 20 bp, Homo sapiens
aattttgaagtgctgtttat

SEQ ID NO: 1567476 - DNA, 16 bp, Homo sapiens
aattttgatatacatt

SEQ ID NO: 1567477 - DNA, 17 bp, Homo sapiens
aattttgatctttttat

SEQ ID NO: 1567478 - DNA, 11 bp, Homo sapiens
aattttgcaaa

SEQ ID NO: 1567479 - DNA, 15 bp, Homo sapiens
aattttgcaatgtat

SEQ ID NO: 1567480 - DNA, 19 bp, Homo sapiens
aattttgctaactgggtta

SEQ ID NO: 1567481 - DNA, 17 bp, Homo sapiens
aattttgcttttaatta

SEQ ID NO: 1567482 - DNA, 18 bp, Homo sapiens
aattttgcttttaattaa

SEQ ID NO: 1567483 - DNA, 22 bp, Homo sapiens
aattttggccaaagtgttaatc

SEQ ID NO: 1567484 - DNA, 17 bp, Homo sapiens
aattttgtaaaacaatg

SEQ ID NO: 1567485 - DNA, 19 bp, Homo sapiens
aattttgtaaaacaatgcc

SEQ ID NO: 1567486 - DNA, 18 bp, Homo sapiens
aattttgtaaagtttcta

SEQ ID NO: 1567487 - DNA, 13 bp, Homo sapiens
aattttgtacaaa

SEQ ID NO: 1567488 - DNA, 16 bp, Homo sapiens
aattttgtatgaaaaa

SEQ ID NO: 1567489 - DNA, 16 bp, Homo sapiens
aattttgtatgttaaa

SEQ ID NO: 1567490 - DNA, 20 bp, Homo sapiens
aattttgtattaatttctga

SEQ ID NO: 1567491 - DNA, 15 bp, Homo sapiens
aattttgtcctaata

SEQ ID NO: 1567492 - DNA, 15 bp, Homo sapiens
aattttgtcttaagt

SEQ ID NO: 1567493 - DNA, 18 bp, Homo sapiens
aattttgtcttaagtgtt

SEQ ID NO: 1567494 - DNA, 18 bp, Homo sapiens
aattttgtgcattctttg

SEQ ID NO: 1567495 - DNA, 15 bp, Homo sapiens
aattttgttctctgg

SEQ ID NO: 1567496 - DNA, 17 bp, Homo sapiens
aattttgttctctggga

SEQ ID NO: 1567497 - DNA, 23 bp, Homo sapiens
aattttgttctctgggagaaaat

SEQ ID NO: 1567498 - DNA, 12 bp, Homo sapiens
aattttgtttca

SEQ ID NO: 1567499 - DNA, 13 bp, Homo sapiens
aatttttaaagta

SEQ ID NO: 1567500 - DNA, 11 bp, Homo sapiens
aatttttaagc

SEQ ID NO: 1567501 - DNA, 13 bp, Homo sapiens
aatttttaagcaa

SEQ ID NO: 1567502 - DNA, 11 bp, Homo sapiens
aatttttaata

SEQ ID NO: 1567503 - DNA, 14 bp, Homo sapiens
aatttttaatgatg

SEQ ID NO: 1567504 - DNA, 15 bp, Homo sapiens
aatttttacctaatc

SEQ ID NO: 1567505 - DNA, 13 bp, Homo sapiens
aatttttagaaag

SEQ ID NO: 1567506 - DNA, 13 bp, Homo sapiens
aatttttatgtaa

SEQ ID NO: 1567507 - DNA, 17 bp, Homo sapiens
aatttttattaaattat

SEQ ID NO: 1567508 - DNA, 18 bp, Homo sapiens
aatttttattaaattatg

SEQ ID NO: 1567509 - DNA, 12 bp, Homo sapiens
aatttttattgt

SEQ ID NO: 1567510 - DNA, 13 bp, Homo sapiens
aatttttattgtt

SEQ ID NO: 1567511 - DNA, 15 bp, Homo sapiens
aatttttatttttct

SEQ ID NO: 1567512 - DNA, 18 bp, Homo sapiens
aatttttcaaaatcgttt

SEQ ID NO: 1567513 - DNA, 16 bp, Homo sapiens
aatttttcattctcag

SEQ ID NO: 1567514 - DNA, 16 bp, Homo sapiens
aatttttcccagtatt

SEQ ID NO: 1567515 - DNA, 16 bp, Homo sapiens
aatttttcctgcatgt

SEQ ID NO: 1567516 - DNA, 20 bp, Homo sapiens
aatttttcctgcatgttctg

SEQ ID NO: 1567517 - DNA, 22 bp, Homo sapiens
aatttttctctaactcagaaac

SEQ ID NO: 1567518 - DNA, 16 bp, Homo sapiens
aatttttctctttaaa

SEQ ID NO: 1567519 - DNA, 12 bp, Homo sapiens
aatttttgttct

SEQ ID NO: 1567520 - DNA, 11 bp, Homo sapiens
aattttttcct

SEQ ID NO: 1567521 - DNA, 13 bp, Homo sapiens
aattttttgactt

SEQ ID NO: 1567522 - DNA, 15 bp, Homo sapiens
aatttttttattact

SEQ ID NO: 1567523 - DNA, 15 bp, Homo sapiens
aattttttttagtat

SEQ ID NO: 1567524 - DNA, 19 bp, Homo sapiens
aattttttttggtcaaatt

SEQ ID NO: 1567525 - DNA, 13 bp, Homo sapiens
acaaaaaaatata

SEQ ID NO: 1567526 - DNA, 13 bp, Homo sapiens
acaaaaaatacat

SEQ ID NO: 1567527 - DNA, 16 bp, Homo sapiens
acaaaaacaaaaccag

SEQ ID NO: 1567528 - DNA, 20 bp, Homo sapiens
acaaaaaggttctcaggtgt

SEQ ID NO: 1567529 - DNA, 17 bp, Homo sapiens
acaaaaatcaaagaaca

SEQ ID NO: 1567530 - DNA, 22 bp, Homo sapiens
acaaaaatgaaagcatgtctca

SEQ ID NO: 1567531 - DNA, 13 bp, Homo sapiens
acaaaaatgaata

SEQ ID NO: 1567532 - DNA, 17 bp, Homo sapiens
acaaaaatgtttccact

SEQ ID NO: 1567533 - DNA, 13 bp, Homo sapiens
acaaaacaaaaca

SEQ ID NO: 1567534 - DNA, 15 bp, Homo sapiens
acaaaacaaaacaaa

SEQ ID NO: 1567535 - DNA, 20 bp, Homo sapiens
acaaaacacaggttttttca

SEQ ID NO: 1567536 - DNA, 14 bp, Homo sapiens
acaaaaccaaaagt

SEQ ID NO: 1567537 - DNA, 13 bp, Homo sapiens
acaaaaccaagcc

SEQ ID NO: 1567538 - DNA, 12 bp, Homo sapiens
acaaaaccagct

SEQ ID NO: 1567539 - DNA, 15 bp, Homo sapiens
acaaaaccagctgct

SEQ ID NO: 1567540 - DNA, 18 bp, Homo sapiens
acaaaaccctcagcactg

SEQ ID NO: 1567541 - DNA, 19 bp, Homo sapiens
acaaaaccctcagcactgt

SEQ ID NO: 1567542 - DNA, 15 bp, Homo sapiens
acaaaacttgcatct

SEQ ID NO: 1567543 - DNA, 12 bp, Homo sapiens
acaaaagaaaaa

SEQ ID NO: 1567544 - DNA, 16 bp, Homo sapiens
acaaaagaataagaca

SEQ ID NO: 1567545 - DNA, 21 bp, Homo sapiens
acaaaagaataagacaagaga

SEQ ID NO: 1567546 - DNA, 14 bp, Homo sapiens
acaaaagatacaaa

SEQ ID NO: 1567547 - DNA, 11 bp, Homo sapiens
acaaaagatgt

SEQ ID NO: 1567548 - DNA, 21 bp, Homo sapiens
acaaaagatgtatccttccaa

SEQ ID NO: 1567549 - DNA, 14 bp, Homo sapiens
acaaaagatttgtt

SEQ ID NO: 1567550 - DNA, 23 bp, Homo sapiens
acaaaagcaagactgttgctcaa

SEQ ID NO: 1567551 - DNA, 13 bp, Homo sapiens
acaaaagcagata

SEQ ID NO: 1567552 - DNA, 15 bp, Homo sapiens
acaaaagctttgaat

SEQ ID NO: 1567553 - DNA, 23 bp, Homo sapiens
acaaaagctttttaaaatttaga

SEQ ID NO: 1567554 - DNA, 16 bp, Homo sapiens
acaaaagggtgtatag

SEQ ID NO: 1567555 - DNA, 12 bp, Homo sapiens
acaaaataaaca

SEQ ID NO: 1567556 - DNA, 16 bp, Homo sapiens
acaaaatattgaaagg

SEQ ID NO: 1567557 - DNA, 15 bp, Homo sapiens
acaaaatatttaagt

SEQ ID NO: 1567558 - DNA, 19 bp, Homo sapiens
acaaaatatttctaagctt

SEQ ID NO: 1567559 - DNA, 13 bp, Homo sapiens
acaaaatcaaata

SEQ ID NO: 1567560 - DNA, 20 bp, Homo sapiens
acaaaatccagctatgaata

SEQ ID NO: 1567561 - DNA, 20 bp, Homo sapiens
acaaaatgtagggttataat

SEQ ID NO: 1567562 - DNA, 22 bp, Homo sapiens
acaaaatgtagggttataataa

SEQ ID NO: 1567563 - DNA, 19 bp, Homo sapiens
acaaaattaaaaaaaattg

SEQ ID NO: 1567564 - DNA, 12 bp, Homo sapiens
acaaaatttgag

SEQ ID NO: 1567565 - DNA, 11 bp, Homo sapiens
acaaacaaaac

SEQ ID NO: 1567566 - DNA, 12 bp, Homo sapiens
acaaacaaaact

SEQ ID NO: 1567567 - DNA, 19 bp, Homo sapiens
acaaacaaaatttctatta

SEQ ID NO: 1567568 - DNA, 10 bp, Homo sapiens
acaaacaaac

SEQ ID NO: 1567569 - DNA, 14 bp, Homo sapiens
acaaacaaacaaaa

SEQ ID NO: 1567570 - DNA, 20 bp, Homo sapiens
acaaacaatggaaactgaat

SEQ ID NO: 1567571 - DNA, 14 bp, Homo sapiens
acaaacagtatttc

SEQ ID NO: 1567572 - DNA, 22 bp, Homo sapiens
acaaacatctaataagtatata

SEQ ID NO: 1567573 - DNA, 17 bp, Homo sapiens
acaaaccaccaggactg

SEQ ID NO: 1567574 - DNA, 16 bp, Homo sapiens
acaaaccatttccaac

SEQ ID NO: 1567575 - DNA, 21 bp, Homo sapiens
acaaacctaccaaaatggaat

SEQ ID NO: 1567576 - DNA, 23 bp, Homo sapiens
acaaacctactgcccacatttgg

SEQ ID NO: 1567577 - DNA, 14 bp, Homo sapiens
acaaacggagcccc

SEQ ID NO: 1567578 - DNA, 15 bp, Homo sapiens
acaaactacctctgg

SEQ ID NO: 1567579 - DNA, 23 bp, Homo sapiens
acaaactcactcagtaaaacata

SEQ ID NO: 1567580 - DNA, 14 bp, Homo sapiens
acaaactcttcagt

SEQ ID NO: 1567581 - DNA, 19 bp, Homo sapiens
acaaactgcaatagagact

SEQ ID NO: 1567582 - DNA, 12 bp, Homo sapiens
acaaactgtgaa

SEQ ID NO: 1567583 - DNA, 18 bp, Homo sapiens
acaaactgtgaaaatagt

SEQ ID NO: 1567584 - DNA, 19 bp, Homo sapiens
acaaactgtgaaaatagtg

SEQ ID NO: 1567585 - DNA, 21 bp, Homo sapiens
acaaactgtgaaaatagtgta

SEQ ID NO: 1567586 - DNA, 22 bp, Homo sapiens
acaaactgtgaaaatagtgtaa

SEQ ID NO: 1567587 - DNA, 15 bp, Homo sapiens
acaaacttactgtca

SEQ ID NO: 1567588 - DNA, 18 bp, Homo sapiens
acaaagaaacaaagatgt

SEQ ID NO: 1567589 - DNA, 18 bp, Homo sapiens
acaaagaagacaacatta

SEQ ID NO: 1567590 - DNA, 14 bp, Homo sapiens
acaaagacaggcaa

SEQ ID NO: 1567591 - DNA, 19 bp, Homo sapiens
acaaagacatgctttccat

SEQ ID NO: 1567592 - DNA, 20 bp, Homo sapiens
acaaagactccttgtggact

SEQ ID NO: 1567593 - DNA, 14 bp, Homo sapiens
acaaagagaaaaag

SEQ ID NO: 1567594 - DNA, 21 bp, Homo sapiens
acaaagatgtttgtcagatat

SEQ ID NO: 1567595 - DNA, 14 bp, Homo sapiens
acaaagattgagaa

SEQ ID NO: 1567596 - DNA, 18 bp, Homo sapiens
acaaagattgagaagcca

SEQ ID NO: 1567597 - DNA, 17 bp, Homo sapiens
acaaagcacagtttgaa

SEQ ID NO: 1567598 - DNA, 19 bp, Homo sapiens
acaaagcacagtttgaaca

SEQ ID NO: 1567599 - DNA, 20 bp, Homo sapiens
acaaagccaccctaccatga

SEQ ID NO: 1567600 - DNA, 18 bp, Homo sapiens
acaaagcgtttctttact

SEQ ID NO: 1567601 - DNA, 22 bp, Homo sapiens
acaaagctaggatggttctgtg

SEQ ID NO: 1567602 - DNA, 20 bp, Homo sapiens
acaaagctttgctacaaatt

SEQ ID NO: 1567603 - DNA, 15 bp, Homo sapiens
acaaaggaggaattt

SEQ ID NO: 1567604 - DNA, 21 bp, Homo sapiens
acaaaggatgaagaacacagc

SEQ ID NO: 1567605 - DNA, 22 bp, Homo sapiens
acaaaggatgaagaacacagca

SEQ ID NO: 1567606 - DNA, 15 bp, Homo sapiens
acaaagggaaagcct

SEQ ID NO: 1567607 - DNA, 20 bp, Homo sapiens
acaaagggaaagcctctggc

SEQ ID NO: 1567608 - DNA, 21 bp, Homo sapiens
acaaagggaaagcctctggcc

SEQ ID NO: 1567609 - DNA, 16 bp, Homo sapiens
acaaagggcagccctc

SEQ ID NO: 1567610 - DNA, 21 bp, Homo sapiens
acaaaggtggaataaacatta

SEQ ID NO: 1567611 - DNA, 22 bp, Homo sapiens
acaaaggtggaataaacattaa

SEQ ID NO: 1567612 - DNA, 12 bp, Homo sapiens
acaaaggtggta

SEQ ID NO: 1567613 - DNA, 17 bp, Homo sapiens
acaaaggtggtaaattc

SEQ ID NO: 1567614 - DNA, 24 bp, Homo sapiens
acaaaggttgagatgtaaaaggta

SEQ ID NO: 1567615 - DNA, 21 bp, Homo sapiens
acaaaggttttcctcttctat

SEQ ID NO: 1567616 - DNA, 14 bp, Homo sapiens
acaaagtaaaatga

SEQ ID NO: 1567617 - DNA, 15 bp, Homo sapiens
acaaagtaaaatgaa

SEQ ID NO: 1567618 - DNA, 16 bp, Homo sapiens
acaaagtactctttaa

SEQ ID NO: 1567619 - DNA, 23 bp, Homo sapiens
acaaagtactctttaacatacaa

SEQ ID NO: 1567620 - DNA, 14 bp, Homo sapiens
acaaagtctccagc

SEQ ID NO: 1567621 - DNA, 15 bp, Homo sapiens
acaaagtctccagcc

SEQ ID NO: 1567622 - DNA, 18 bp, Homo sapiens
acaaagtgctatgcggag

SEQ ID NO: 1567623 - DNA, 21 bp, Homo sapiens
acaaagtgtgtaattatgtaa

SEQ ID NO: 1567624 - DNA, 22 bp, Homo sapiens
acaaagtttacattgtcctgta

SEQ ID NO: 1567625 - DNA, 14 bp, Homo sapiens
acaaagtttcagag

SEQ ID NO: 1567626 - DNA, 20 bp, Homo sapiens
acaaagtttcagagtatatt

SEQ ID NO: 1567627 - DNA, 18 bp, Homo sapiens
acaaataaaattggcacc

SEQ ID NO: 1567628 - DNA, 15 bp, Homo sapiens
acaaataaacctgag

SEQ ID NO: 1567629 - DNA, 19 bp, Homo sapiens
acaaataaatgattatatt

SEQ ID NO: 1567630 - DNA, 13 bp, Homo sapiens
acaaataatcaca

SEQ ID NO: 1567631 - DNA, 13 bp, Homo sapiens
acaaatagaaaat

SEQ ID NO: 1567632 - DNA, 15 bp, Homo sapiens
acaaatagaaaatgg

SEQ ID NO: 1567633 - DNA, 11 bp, Homo sapiens
acaaatatgca

SEQ ID NO: 1567634 - DNA, 18 bp, Homo sapiens
acaaatatttattttctt

SEQ ID NO: 1567635 - DNA, 22 bp, Homo sapiens
acaaatctgcaaagcatgtttt

SEQ ID NO: 1567636 - DNA, 15 bp, Homo sapiens
acaaatgaagaaagt

SEQ ID NO: 1567637 - DNA, 16 bp, Homo sapiens
acaaatggaggcctgt

SEQ ID NO: 1567638 - DNA, 18 bp, Homo sapiens
acaaatgggactgatgtc

SEQ ID NO: 1567639 - DNA, 12 bp, Homo sapiens
acaaatgtcatt

SEQ ID NO: 1567640 - DNA, 22 bp, Homo sapiens
acaaatgtgaaacggaagctca

SEQ ID NO: 1567641 - DNA, 23 bp, Homo sapiens
acaaatgtggagtgtctgcgtcc

SEQ ID NO: 1567642 - DNA, 18 bp, Homo sapiens
acaaatgtgtttttctat

SEQ ID NO: 1567643 - DNA, 21 bp, Homo sapiens
acaaatgttcatatttattga

SEQ ID NO: 1567644 - DNA, 13 bp, Homo sapiens
acaaattaatttt

SEQ ID NO: 1567645 - DNA, 22 bp, Homo sapiens
acaaattatgttacatctgttt

SEQ ID NO: 1567646 - DNA, 14 bp, Homo sapiens
acaaattatttttg

SEQ ID NO: 1567647 - DNA, 16 bp, Homo sapiens
acaaattctttagtac

SEQ ID NO: 1567648 - DNA, 21 bp, Homo sapiens
acaaattctttagtactcaat

SEQ ID NO: 1567649 - DNA, 14 bp, Homo sapiens
acaaattggacagc

SEQ ID NO: 1567650 - DNA, 11 bp, Homo sapiens
acaaatttatg

SEQ ID NO: 1567651 - DNA, 15 bp, Homo sapiens
acaaatttatgcatt

SEQ ID NO: 1567652 - DNA, 17 bp, Homo sapiens
acaaatttatgcatttc

SEQ ID NO: 1567653 - DNA, 22 bp, Homo sapiens
acaaatttatgggcttcctgat

SEQ ID NO: 1567654 - DNA, 20 bp, Homo sapiens
acaaatttggccttaagaac

SEQ ID NO: 1567655 - DNA, 17 bp, Homo sapiens
acaaattttcagaaggt

SEQ ID NO: 1567656 - DNA, 16 bp, Homo sapiens
acaaatttttctgtgg

SEQ ID NO: 1567657 - DNA, 11 bp, Homo sapiens
acaacaaaaaa

SEQ ID NO: 1567658 - DNA, 14 bp, Homo sapiens
acaacaaaaaatac

SEQ ID NO: 1567659 - DNA, 12 bp, Homo sapiens
acaacaaagaca

SEQ ID NO: 1567660 - DNA, 16 bp, Homo sapiens
acaacaacaataataa

SEQ ID NO: 1567661 - DNA, 14 bp, Homo sapiens
acaacaatccttct

SEQ ID NO: 1567662 - DNA, 13 bp, Homo sapiens
acaacaccaggac

SEQ ID NO: 1567663 - DNA, 16 bp, Homo sapiens
acaacagaaaaacaat

SEQ ID NO: 1567664 - DNA, 21 bp, Homo sapiens
acaacagaaaaacaatcttat

SEQ ID NO: 1567665 - DNA, 11 bp, Homo sapiens
acaacagaagt

SEQ ID NO: 1567666 - DNA, 13 bp, Homo sapiens
acaacagcagtct

SEQ ID NO: 1567667 - DNA, 23 bp, Homo sapiens
acaacagcagtctccttcagcac

SEQ ID NO: 1567668 - DNA, 16 bp, Homo sapiens
acaacaggtaaaacag

SEQ ID NO: 1567669 - DNA, 19 bp, Homo sapiens
acaacaggttttcaccata

SEQ ID NO: 1567670 - DNA, 16 bp, Homo sapiens
acaacatcattccaaa

SEQ ID NO: 1567671 - DNA, 17 bp, Homo sapiens
acaacatgaaactgcct

SEQ ID NO: 1567672 - DNA, 19 bp, Homo sapiens
acaacatgtttaataaata

SEQ ID NO: 1567673 - DNA, 16 bp, Homo sapiens
acaacattaaaacaat

SEQ ID NO: 1567674 - DNA, 15 bp, Homo sapiens
acaacattatgatct

SEQ ID NO: 1567675 - DNA, 19 bp, Homo sapiens
acaacattatgatctaata

SEQ ID NO: 1567676 - DNA, 17 bp, Homo sapiens
acaacatttatatgtag

SEQ ID NO: 1567677 - DNA, 13 bp, Homo sapiens
acaacatttatgt

SEQ ID NO: 1567678 - DNA, 18 bp, Homo sapiens
acaaccaagctctctgca

SEQ ID NO: 1567679 - DNA, 17 bp, Homo sapiens
acaaccactcattcaaa

SEQ ID NO: 1567680 - DNA, 14 bp, Homo sapiens
acaaccatgtcatt

SEQ ID NO: 1567681 - DNA, 13 bp, Homo sapiens
acaaccattaaag

SEQ ID NO: 1567682 - DNA, 17 bp, Homo sapiens
acaaccctgttttatac

SEQ ID NO: 1567683 - DNA, 18 bp, Homo sapiens
acaaccctgttttatact

SEQ ID NO: 1567684 - DNA, 16 bp, Homo sapiens
acaacctgaaggaata

SEQ ID NO: 1567685 - DNA, 18 bp, Homo sapiens
acaacgggcagaaatcga

SEQ ID NO: 1567686 - DNA, 23 bp, Homo sapiens
acaactagatcaaggagcccaga

SEQ ID NO: 1567687 - DNA, 18 bp, Homo sapiens
acaactagatttgtcctt

SEQ ID NO: 1567688 - DNA, 19 bp, Homo sapiens
acaactaggcttcagcata

SEQ ID NO: 1567689 - DNA, 13 bp, Homo sapiens
acaactgcctggg

SEQ ID NO: 1567690 - DNA, 13 bp, Homo sapiens
acaacttaagttg

SEQ ID NO: 1567691 - DNA, 22 bp, Homo sapiens
acaacttaagttggtcctttac

SEQ ID NO: 1567692 - DNA, 20 bp, Homo sapiens
acaacttatttaaaaatatt

SEQ ID NO: 1567693 - DNA, 17 bp, Homo sapiens
acaacttcaagtgcatg

SEQ ID NO: 1567694 - DNA, 18 bp, Homo sapiens
acaacttcccagtgaatt

SEQ ID NO: 1567695 - DNA, 14 bp, Homo sapiens
acaacttgggttct

SEQ ID NO: 1567696 - DNA, 14 bp, Homo sapiens
acaactttataccc

SEQ ID NO: 1567697 - DNA, 12 bp, Homo sapiens
acaactttcact

SEQ ID NO: 1567698 - DNA, 15 bp, Homo sapiens
acaagaaagaaatgg

SEQ ID NO: 1567699 - DNA, 12 bp, Homo sapiens
acaagaaatctg

SEQ ID NO: 1567700 - DNA, 16 bp, Homo sapiens
acaagaagagtaaaca

SEQ ID NO: 1567701 - DNA, 12 bp, Homo sapiens
acaagaatctag

SEQ ID NO: 1567702 - DNA, 19 bp, Homo sapiens
acaagaatgcattccctga

SEQ ID NO: 1567703 - DNA, 13 bp, Homo sapiens
acaagaatggatc

SEQ ID NO: 1567704 - DNA, 14 bp, Homo sapiens
acaagaatggatca

SEQ ID NO: 1567705 - DNA, 23 bp, Homo sapiens
acaagaatggatcacaagatgga

SEQ ID NO: 1567706 - DNA, 19 bp, Homo sapiens
acaagaccgccccagggct

SEQ ID NO: 1567707 - DNA, 16 bp, Homo sapiens
acaagagatctacaca

SEQ ID NO: 1567708 - DNA, 20 bp, Homo sapiens
acaagagcagcctgtggcat

SEQ ID NO: 1567709 - DNA, 20 bp, Homo sapiens
acaagagggttcacacagcc

SEQ ID NO: 1567710 - DNA, 13 bp, Homo sapiens
acaagagtgaatt

SEQ ID NO: 1567711 - DNA, 13 bp, Homo sapiens
acaagatctttca

SEQ ID NO: 1567712 - DNA, 14 bp, Homo sapiens
acaagatctttcag

SEQ ID NO: 1567713 - DNA, 20 bp, Homo sapiens
acaagatctttcaggaaaga

SEQ ID NO: 1567714 - DNA, 13 bp, Homo sapiens
acaagatgggaca

SEQ ID NO: 1567715 - DNA, 15 bp, Homo sapiens
acaagatgggacagc

SEQ ID NO: 1567716 - DNA, 16 bp, Homo sapiens
acaagattcccagaga

SEQ ID NO: 1567717 - DNA, 14 bp, Homo sapiens
acaagatttagaaa

SEQ ID NO: 1567718 - DNA, 19 bp, Homo sapiens
acaagatttccctaaaaat

SEQ ID NO: 1567719 - DNA, 20 bp, Homo sapiens
acaagatttccttgtgcaaa

SEQ ID NO: 1567720 - DNA, 20 bp, Homo sapiens
acaagattttaaagacatgt

SEQ ID NO: 1567721 - DNA, 11 bp, Homo sapiens
acaagcaacaa

SEQ ID NO: 1567722 - DNA, 15 bp, Homo sapiens
acaagcactatttta

SEQ ID NO: 1567723 - DNA, 17 bp, Homo sapiens
acaagcactattttata

SEQ ID NO: 1567724 - DNA, 20 bp, Homo sapiens
acaagcactattttatattt

SEQ ID NO: 1567725 - DNA, 20 bp, Homo sapiens
acaagcatgtctctctgcca

SEQ ID NO: 1567726 - DNA, 17 bp, Homo sapiens
acaagccaaaatgggag

SEQ ID NO: 1567727 - DNA, 23 bp, Homo sapiens
acaagccaaagagcctcccacca

SEQ ID NO: 1567728 - DNA, 14 bp, Homo sapiens
acaagccaacttgt

SEQ ID NO: 1567729 - DNA, 11 bp, Homo sapiens
acaagccaggg

SEQ ID NO: 1567730 - DNA, 11 bp, Homo sapiens
acaagccctgg

SEQ ID NO: 1567731 - DNA, 13 bp, Homo sapiens
acaagcctgagaa

SEQ ID NO: 1567732 - DNA, 14 bp, Homo sapiens
acaagcctgagaac

SEQ ID NO: 1567733 - DNA, 14 bp, Homo sapiens
acaagctgacttgg

SEQ ID NO: 1567734 - DNA, 16 bp, Homo sapiens
acaagctgcactgtga

SEQ ID NO: 1567735 - DNA, 18 bp, Homo sapiens
acaagctgcactgtgaac

SEQ ID NO: 1567736 - DNA, 19 bp, Homo sapiens
acaagctgcactgtgaacc

SEQ ID NO: 1567737 - DNA, 13 bp, Homo sapiens
acaagctgtccct

SEQ ID NO: 1567738 - DNA, 16 bp, Homo sapiens
acaagctgtccctgca

SEQ ID NO: 1567739 - DNA, 12 bp, Homo sapiens
acaagctgtgca

SEQ ID NO: 1567740 - DNA, 18 bp, Homo sapiens
acaagctgtgcaggcatg

SEQ ID NO: 1567741 - DNA, 18 bp, Homo sapiens
acaaggaaaaggaggagg

SEQ ID NO: 1567742 - DNA, 23 bp, Homo sapiens
acaaggaaaatctatatttgtct

SEQ ID NO: 1567743 - DNA, 17 bp, Homo sapiens
acaaggaaggaaaagaa

SEQ ID NO: 1567744 - DNA, 11 bp, Homo sapiens
acaaggaatgc

SEQ ID NO: 1567745 - DNA, 20 bp, Homo sapiens
acaaggaatgcctgtgccaa

SEQ ID NO: 1567746 - DNA, 18 bp, Homo sapiens
acaaggacgctggctact

SEQ ID NO: 1567747 - DNA, 10 bp, Homo sapiens
acaaggactc

SEQ ID NO: 1567748 - DNA, 15 bp, Homo sapiens
acaaggagatttctt

SEQ ID NO: 1567749 - DNA, 15 bp, Homo sapiens
acaaggagctcaccc

SEQ ID NO: 1567750 - DNA, 14 bp, Homo sapiens
acaaggagggcaca

SEQ ID NO: 1567751 - DNA, 19 bp, Homo sapiens
acaaggcccaggagacctc

SEQ ID NO: 1567752 - DNA, 19 bp, Homo sapiens
acaaggccttgcctggcct

SEQ ID NO: 1567753 - DNA, 13 bp, Homo sapiens
acaaggctgacca

SEQ ID NO: 1567754 - DNA, 19 bp, Homo sapiens
acaagggagaagacaacag

SEQ ID NO: 1567755 - DNA, 15 bp, Homo sapiens
acaagggaggcagtg

SEQ ID NO: 1567756 - DNA, 19 bp, Homo sapiens
acaagggatataaaatgaa

SEQ ID NO: 1567757 - DNA, 21 bp, Homo sapiens
acaagggatataaaatgaaag

SEQ ID NO: 1567758 - DNA, 16 bp, Homo sapiens
acaagggattctggga

SEQ ID NO: 1567759 - DNA, 20 bp, Homo sapiens
acaagggctgcaatgccctc

SEQ ID NO: 1567760 - DNA, 17 bp, Homo sapiens
acaagggtctagggaga

SEQ ID NO: 1567761 - DNA, 10 bp, Homo sapiens
acaaggtaaa

SEQ ID NO: 1567762 - DNA, 15 bp, Homo sapiens
acaaggtaattgttt

SEQ ID NO: 1567763 - DNA, 21 bp, Homo sapiens
acaaggtggggattgcccctg

SEQ ID NO: 1567764 - DNA, 16 bp, Homo sapiens
acaagtaaaactgtgg

SEQ ID NO: 1567765 - DNA, 17 bp, Homo sapiens
acaagtaaaggcattgt

SEQ ID NO: 1567766 - DNA, 16 bp, Homo sapiens
acaagtaaatatatat

SEQ ID NO: 1567767 - DNA, 13 bp, Homo sapiens
acaagtaagaaaa

SEQ ID NO: 1567768 - DNA, 13 bp, Homo sapiens
acaagtaatgtaa

SEQ ID NO: 1567769 - DNA, 15 bp, Homo sapiens
acaagtaatttcagt

SEQ ID NO: 1567770 - DNA, 15 bp, Homo sapiens
acaagtattttgcta

SEQ ID NO: 1567771 - DNA, 21 bp, Homo sapiens
acaagtcattttaactttatc

SEQ ID NO: 1567772 - DNA, 21 bp, Homo sapiens
acaagtcctggatgttgtgtg

SEQ ID NO: 1567773 - DNA, 16 bp, Homo sapiens
acaagtctttccagag

SEQ ID NO: 1567774 - DNA, 18 bp, Homo sapiens
acaagtgactgtatctgt

SEQ ID NO: 1567775 - DNA, 19 bp, Homo sapiens
acaagtgactgtatctgtg

SEQ ID NO: 1567776 - DNA, 20 bp, Homo sapiens
acaagtgactgtatctgtgt

SEQ ID NO: 1567777 - DNA, 17 bp, Homo sapiens
acaagtgagacaaaaag

SEQ ID NO: 1567778 - DNA, 14 bp, Homo sapiens
acaagtgcctcctg

SEQ ID NO: 1567779 - DNA, 14 bp, Homo sapiens
acaagtgctgaaca

SEQ ID NO: 1567780 - DNA, 20 bp, Homo sapiens
acaagtggtaatttttgtac

SEQ ID NO: 1567781 - DNA, 17 bp, Homo sapiens
acaagtggtgtttattg

SEQ ID NO: 1567782 - DNA, 19 bp, Homo sapiens
acaagtggtgtttattgca

SEQ ID NO: 1567783 - DNA, 16 bp, Homo sapiens
acaagtgttcttaggt

SEQ ID NO: 1567784 - DNA, 18 bp, Homo sapiens
acaagtgttcttaggttt

SEQ ID NO: 1567785 - DNA, 15 bp, Homo sapiens
acaagttaaataaat

SEQ ID NO: 1567786 - DNA, 21 bp, Homo sapiens
acaagttcatctcatttgtat

SEQ ID NO: 1567787 - DNA, 22 bp, Homo sapiens
acaagttgcgacggagagaaaa

SEQ ID NO: 1567788 - DNA, 15 bp, Homo sapiens
acaagttgtgtttga

SEQ ID NO: 1567789 - DNA, 21 bp, Homo sapiens
acaagttttgtataaataata

SEQ ID NO: 1567790 - DNA, 16 bp, Homo sapiens
acaataaaaatgttta

SEQ ID NO: 1567791 - DNA, 14 bp, Homo sapiens
acaataaaattttt

SEQ ID NO: 1567792 - DNA, 19 bp, Homo sapiens
acaataaagatatttccaa

SEQ ID NO: 1567793 - DNA, 16 bp, Homo sapiens
acaataaatattctgc

SEQ ID NO: 1567794 - DNA, 18 bp, Homo sapiens
acaataaatgtattcaaa

SEQ ID NO: 1567795 - DNA, 21 bp, Homo sapiens
acaataaattttttttggtca

SEQ ID NO: 1567796 - DNA, 22 bp, Homo sapiens
acaataaattttttttggtcaa

SEQ ID NO: 1567797 - DNA, 16 bp, Homo sapiens
acaataagaatgaatc

SEQ ID NO: 1567798 - DNA, 10 bp, Homo sapiens
acaataataa

SEQ ID NO: 1567799 - DNA, 12 bp, Homo sapiens
acaataataaaa

SEQ ID NO: 1567800 - DNA, 15 bp, Homo sapiens
acaataataaaaagt

SEQ ID NO: 1567801 - DNA, 13 bp, Homo sapiens
acaataataaaga

SEQ ID NO: 1567802 - DNA, 13 bp, Homo sapiens
acaataatatttc

SEQ ID NO: 1567803 - DNA, 20 bp, Homo sapiens
acaataatatttcaagtgcc

SEQ ID NO: 1567804 - DNA, 22 bp, Homo sapiens
acaataatatttcaagtgccta

SEQ ID NO: 1567805 - DNA, 16 bp, Homo sapiens
acaataatgagagcaa

SEQ ID NO: 1567806 - DNA, 18 bp, Homo sapiens
acaataatgattttcttg

SEQ ID NO: 1567807 - DNA, 14 bp, Homo sapiens
acaatacaaatgga

SEQ ID NO: 1567808 - DNA, 15 bp, Homo sapiens
acaatacaaatggat

SEQ ID NO: 1567809 - DNA, 16 bp, Homo sapiens
acaatacaaatggatt

SEQ ID NO: 1567810 - DNA, 22 bp, Homo sapiens
acaatacaatgtacaattatgt

SEQ ID NO: 1567811 - DNA, 17 bp, Homo sapiens
acaatacagatcatctt

SEQ ID NO: 1567812 - DNA, 12 bp, Homo sapiens
acaatacagtat

SEQ ID NO: 1567813 - DNA, 15 bp, Homo sapiens
acaatacagtattat

SEQ ID NO: 1567814 - DNA, 18 bp, Homo sapiens
acaatacagtattataga

SEQ ID NO: 1567815 - DNA, 16 bp, Homo sapiens
acaataccactggtta

SEQ ID NO: 1567816 - DNA, 23 bp, Homo sapiens
acaatagttcttagctttgaaac

SEQ ID NO: 1567817 - DNA, 12 bp, Homo sapiens
acaatagttttt

SEQ ID NO: 1567818 - DNA, 18 bp, Homo sapiens
acaatagtttttaaaaga

SEQ ID NO: 1567819 - DNA, 21 bp, Homo sapiens
acaatatatattatatatatc

SEQ ID NO: 1567820 - DNA, 21 bp, Homo sapiens
acaatatgaatacagggcatg

SEQ ID NO: 1567821 - DNA, 18 bp, Homo sapiens
acaatatgtacatttcta

SEQ ID NO: 1567822 - DNA, 19 bp, Homo sapiens
acaatattactttgtcttt

SEQ ID NO: 1567823 - DNA, 20 bp, Homo sapiens
acaatattactttgtctttt

SEQ ID NO: 1567824 - DNA, 19 bp, Homo sapiens
acaatcaaaggaaaatagt

SEQ ID NO: 1567825 - DNA, 13 bp, Homo sapiens
acaatcactgcca

SEQ ID NO: 1567826 - DNA, 17 bp, Homo sapiens
acaatcagtcccctccc

SEQ ID NO: 1567827 - DNA, 18 bp, Homo sapiens
acaatcagtcccctccca

SEQ ID NO: 1567828 - DNA, 19 bp, Homo sapiens
acaatcagtcccctcccat

SEQ ID NO: 1567829 - DNA, 20 bp, Homo sapiens
acaatcagtcccctcccatc

SEQ ID NO: 1567830 - DNA, 14 bp, Homo sapiens
acaatccttttgat

SEQ ID NO: 1567831 - DNA, 15 bp, Homo sapiens
acaatccttttgata

SEQ ID NO: 1567832 - DNA, 20 bp, Homo sapiens
acaatccttttgataaattt

SEQ ID NO: 1567833 - DNA, 22 bp, Homo sapiens
acaatctaacaataatatttca

SEQ ID NO: 1567834 - DNA, 17 bp, Homo sapiens
acaatctatggcttatt

SEQ ID NO: 1567835 - DNA, 19 bp, Homo sapiens
acaatctctttttgtttgc

SEQ ID NO: 1567836 - DNA, 22 bp, Homo sapiens
acaatctggctcactgcagcct

SEQ ID NO: 1567837 - DNA, 20 bp, Homo sapiens
acaatctggcttagtgccac

SEQ ID NO: 1567838 - DNA, 21 bp, Homo sapiens
acaatcttattccgagcattc

SEQ ID NO: 1567839 - DNA, 13 bp, Homo sapiens
acaatctttgctg

SEQ ID NO: 1567840 - DNA, 18 bp, Homo sapiens
acaatgaactgcttttcc

SEQ ID NO: 1567841 - DNA, 14 bp, Homo sapiens
acaatgaagggaaa

SEQ ID NO: 1567842 - DNA, 15 bp, Homo sapiens
acaatgatatatgga

SEQ ID NO: 1567843 - DNA, 19 bp, Homo sapiens
acaatgatgatgataatga

SEQ ID NO: 1567844 - DNA, 16 bp, Homo sapiens
acaatgccatgaacaa

SEQ ID NO: 1567845 - DNA, 14 bp, Homo sapiens
acaatggaaactga

SEQ ID NO: 1567846 - DNA, 16 bp, Homo sapiens
acaatggaaactgaat

SEQ ID NO: 1567847 - DNA, 17 bp, Homo sapiens
acaatggggtgggccca

SEQ ID NO: 1567848 - DNA, 19 bp, Homo sapiens
acaatggttgaatgaataa

SEQ ID NO: 1567849 - DNA, 17 bp, Homo sapiens
acaatggtttattccca

SEQ ID NO: 1567850 - DNA, 21 bp, Homo sapiens
acaatgtaataaaaagcctct

SEQ ID NO: 1567851 - DNA, 12 bp, Homo sapiens
acaatgtacaat

SEQ ID NO: 1567852 - DNA, 12 bp, Homo sapiens
acaatgtataaa

SEQ ID NO: 1567853 - DNA, 14 bp, Homo sapiens
acaatgtataaaga

SEQ ID NO: 1567854 - DNA, 22 bp, Homo sapiens
acaatgtataaagattgtactt

SEQ ID NO: 1567855 - DNA, 16 bp, Homo sapiens
acaatgtatgtaattt

SEQ ID NO: 1567856 - DNA, 15 bp, Homo sapiens
acaatgtatgtacaa

SEQ ID NO: 1567857 - DNA, 22 bp, Homo sapiens
acaatgtatgtacaatacaatg

SEQ ID NO: 1567858 - DNA, 20 bp, Homo sapiens
acaatgtatttatttaaaag

SEQ ID NO: 1567859 - DNA, 20 bp, Homo sapiens
acaatgtattttaataacat

SEQ ID NO: 1567860 - DNA, 22 bp, Homo sapiens
acaatgtcatatactgccatgt

SEQ ID NO: 1567861 - DNA, 15 bp, Homo sapiens
acaatgtgaaactga

SEQ ID NO: 1567862 - DNA, 21 bp, Homo sapiens
acaatgtggccgaggactttg

SEQ ID NO: 1567863 - DNA, 14 bp, Homo sapiens
acaatgtgtattca

SEQ ID NO: 1567864 - DNA, 19 bp, Homo sapiens
acaatgttccttttttgta

SEQ ID NO: 1567865 - DNA, 15 bp, Homo sapiens
acaatgttgtccaac

SEQ ID NO: 1567866 - DNA, 20 bp, Homo sapiens
acaatgttgtccaacaataa

SEQ ID NO: 1567867 - DNA, 17 bp, Homo sapiens
acaatgtttcttcattt

SEQ ID NO: 1567868 - DNA, 14 bp, Homo sapiens
acaattactaaatt

SEQ ID NO: 1567869 - DNA, 16 bp, Homo sapiens
acaattactcaggttt

SEQ ID NO: 1567870 - DNA, 15 bp, Homo sapiens
acaattactgtacac

SEQ ID NO: 1567871 - DNA, 18 bp, Homo sapiens
acaattactgtacacatt

SEQ ID NO: 1567872 - DNA, 16 bp, Homo sapiens
acaattatgtctcttg

SEQ ID NO: 1567873 - DNA, 13 bp, Homo sapiens
acaattccatgac

SEQ ID NO: 1567874 - DNA, 14 bp, Homo sapiens
acaattccatttcc

SEQ ID NO: 1567875 - DNA, 22 bp, Homo sapiens
acaattctgttttaggttaaaa

SEQ ID NO: 1567876 - DNA, 12 bp, Homo sapiens
acaattgaaatg

SEQ ID NO: 1567877 - DNA, 20 bp, Homo sapiens
acaattgatacttcaggtgc

SEQ ID NO: 1567878 - DNA, 21 bp, Homo sapiens
acaattgatacttcaggtgct

SEQ ID NO: 1567879 - DNA, 21 bp, Homo sapiens
acaattgcttactcattaaaa

SEQ ID NO: 1567880 - DNA, 13 bp, Homo sapiens
acaattgggagct

SEQ ID NO: 1567881 - DNA, 14 bp, Homo sapiens
acaattgtgtagcc

SEQ ID NO: 1567882 - DNA, 16 bp, Homo sapiens
acaattgtgtagcctt

SEQ ID NO: 1567883 - DNA, 17 bp, Homo sapiens
acaattgtgtagccttt

SEQ ID NO: 1567884 - DNA, 21 bp, Homo sapiens
acaattgtgtgaattaatttc

SEQ ID NO: 1567885 - DNA, 16 bp, Homo sapiens
acaatttcatttccag

SEQ ID NO: 1567886 - DNA, 17 bp, Homo sapiens
acaatttcatttccagc

SEQ ID NO: 1567887 - DNA, 12 bp, Homo sapiens
acaatttgtact

SEQ ID NO: 1567888 - DNA, 16 bp, Homo sapiens
acaattttaaagttct

SEQ ID NO: 1567889 - DNA, 17 bp, Homo sapiens
acaattttaaagttctt

SEQ ID NO: 1567890 - DNA, 13 bp, Homo sapiens
acaattttctgta

SEQ ID NO: 1567891 - DNA, 12 bp, Homo sapiens
acaattttgtac

SEQ ID NO: 1567892 - DNA, 20 bp, Homo sapiens
acaattttgtcctaatatat

SEQ ID NO: 1567893 - DNA, 22 bp, Homo sapiens
acaattttgtcttaagtgtttc

SEQ ID NO: 1567894 - DNA, 23 bp, Homo sapiens
acaattttgtcttaagtgtttct

SEQ ID NO: 1567895 - DNA, 10 bp, Homo sapiens
acaattttta

SEQ ID NO: 1567896 - DNA, 21 bp, Homo sapiens
acaattttttattaaatttat

SEQ ID NO: 1567897 - DNA, 20 bp, Homo sapiens
acacaaaccacaactgacac

SEQ ID NO: 1567898 - DNA, 16 bp, Homo sapiens
acacaaagcttctaaa

SEQ ID NO: 1567899 - DNA, 14 bp, Homo sapiens
acacaacacagata

SEQ ID NO: 1567900 - DNA, 12 bp, Homo sapiens
acacaacactga

SEQ ID NO: 1567901 - DNA, 22 bp, Homo sapiens
acacaagaagaagggcacccta

SEQ ID NO: 1567902 - DNA, 17 bp, Homo sapiens
acacaagcaacaaacct

SEQ ID NO: 1567903 - DNA, 17 bp, Homo sapiens
acacaagcactttaatg

SEQ ID NO: 1567904 - DNA, 20 bp, Homo sapiens
acacaagggatataaaatga

SEQ ID NO: 1567905 - DNA, 21 bp, Homo sapiens
acacaagggatataaaatgaa

SEQ ID NO: 1567906 - DNA, 16 bp, Homo sapiens
acacaatacagtatta

SEQ ID NO: 1567907 - DNA, 19 bp, Homo sapiens
acacaattgatacttcagg

SEQ ID NO: 1567908 - DNA, 20 bp, Homo sapiens
acacaattgatacttcaggt

SEQ ID NO: 1567909 - DNA, 19 bp, Homo sapiens
acacaatttcatttccagc

SEQ ID NO: 1567910 - DNA, 21 bp, Homo sapiens
acacaatttcatttccagcat

SEQ ID NO: 1567911 - DNA, 20 bp, Homo sapiens
acacacaaacctactgccca

SEQ ID NO: 1567912 - DNA, 14 bp, Homo sapiens
acacacaacaatta

SEQ ID NO: 1567913 - DNA, 9 bp, Homo sapiens
acacacaca

SEQ ID NO: 1567914 - DNA, 13 bp, Homo sapiens
acacacacaaacc

SEQ ID NO: 1567915 - DNA, 12 bp, Homo sapiens
acacacacacag

SEQ ID NO: 1567916 - DNA, 14 bp, Homo sapiens
acacacacacgatg

SEQ ID NO: 1567917 - DNA, 15 bp, Homo sapiens
acacacacacgatgc

SEQ ID NO: 1567918 - DNA, 16 bp, Homo sapiens
acacacacacgcacgc

SEQ ID NO: 1567919 - DNA, 15 bp, Homo sapiens
acacacacagacata

SEQ ID NO: 1567920 - DNA, 13 bp, Homo sapiens
acacacacataca

SEQ ID NO: 1567921 - DNA, 16 bp, Homo sapiens
acacacacgatgcatt

SEQ ID NO: 1567922 - DNA, 19 bp, Homo sapiens
acacacacgcacgcacaca

SEQ ID NO: 1567923 - DNA, 16 bp, Homo sapiens
acacacagacatatat

SEQ ID NO: 1567924 - DNA, 13 bp, Homo sapiens
acacacagcactc

SEQ ID NO: 1567925 - DNA, 11 bp, Homo sapiens
acacacagctc

SEQ ID NO: 1567926 - DNA, 17 bp, Homo sapiens
acacacaggcaactgag

SEQ ID NO: 1567927 - DNA, 19 bp, Homo sapiens
acacacatacgtgcacagg

SEQ ID NO: 1567928 - DNA, 18 bp, Homo sapiens
acacacatgccctcctgg

SEQ ID NO: 1567929 - DNA, 15 bp, Homo sapiens
acacacatggaaggt

SEQ ID NO: 1567930 - DNA, 16 bp, Homo sapiens
acacacccctcaaaaa

SEQ ID NO: 1567931 - DNA, 14 bp, Homo sapiens
acacacctctgcca

SEQ ID NO: 1567932 - DNA, 13 bp, Homo sapiens
acacacctgcctg

SEQ ID NO: 1567933 - DNA, 24 bp, Homo sapiens
acacacctgtagtcccagctactc

SEQ ID NO: 1567934 - DNA, 19 bp, Homo sapiens
acacacgagcaaacccaga

SEQ ID NO: 1567935 - DNA, 14 bp, Homo sapiens
acacacgatgcatt

SEQ ID NO: 1567936 - DNA, 15 bp, Homo sapiens
acacacgatgcattt

SEQ ID NO: 1567937 - DNA, 19 bp, Homo sapiens
acacacgatgcatttaata

SEQ ID NO: 1567938 - DNA, 20 bp, Homo sapiens
acacacgatgcatttaataa

SEQ ID NO: 1567939 - DNA, 16 bp, Homo sapiens
acacacgcacgcacac

SEQ ID NO: 1567940 - DNA, 17 bp, Homo sapiens
acacacgcacgcacaca

SEQ ID NO: 1567941 - DNA, 23 bp, Homo sapiens
acacacgtatttatatttggaaa

SEQ ID NO: 1567942 - DNA, 21 bp, Homo sapiens
acacacgtgcgtgcgagcaca

SEQ ID NO: 1567943 - DNA, 15 bp, Homo sapiens
acacactcaaatcaa

SEQ ID NO: 1567944 - DNA, 20 bp, Homo sapiens
acacactcacaatttaaaat

SEQ ID NO: 1567945 - DNA, 12 bp, Homo sapiens
acacactggcca

SEQ ID NO: 1567946 - DNA, 13 bp, Homo sapiens
acacactggccat

SEQ ID NO: 1567947 - DNA, 22 bp, Homo sapiens
acacactgtcatgcttcatcat

SEQ ID NO: 1567948 - DNA, 21 bp, Homo sapiens
acacactttccatctctgcct

SEQ ID NO: 1567949 - DNA, 22 bp, Homo sapiens
acacactttccatctctgcctg

SEQ ID NO: 1567950 - DNA, 19 bp, Homo sapiens
acacactttttaagaaata

SEQ ID NO: 1567951 - DNA, 17 bp, Homo sapiens
acacagaaacactgcct

SEQ ID NO: 1567952 - DNA, 21 bp, Homo sapiens
acacagaaacactgccttttt

SEQ ID NO: 1567953 - DNA, 20 bp, Homo sapiens
acacagacattttgtgtgag

SEQ ID NO: 1567954 - DNA, 15 bp, Homo sapiens
acacagactttctgt

SEQ ID NO: 1567955 - DNA, 18 bp, Homo sapiens
acacagactttctgtgac

SEQ ID NO: 1567956 - DNA, 23 bp, Homo sapiens
acacagactttctgtgacgcaga

SEQ ID NO: 1567957 - DNA, 10 bp, Homo sapiens
acacagagaa

SEQ ID NO: 1567958 - DNA, 12 bp, Homo sapiens
acacagagaagg

SEQ ID NO: 1567959 - DNA, 12 bp, Homo sapiens
acacagaggaag

SEQ ID NO: 1567960 - DNA, 17 bp, Homo sapiens
acacagaggaagagcag

SEQ ID NO: 1567961 - DNA, 19 bp, Homo sapiens
acacagaggctgcctctcc

SEQ ID NO: 1567962 - DNA, 20 bp, Homo sapiens
acacagattatgttcctgct

SEQ ID NO: 1567963 - DNA, 21 bp, Homo sapiens
acacagattatgttcctgctg

SEQ ID NO: 1567964 - DNA, 22 bp, Homo sapiens
acacagcagcttcaccagagca

SEQ ID NO: 1567965 - DNA, 23 bp, Homo sapiens
acacagcagtgtcccctgcccca

SEQ ID NO: 1567966 - DNA, 15 bp, Homo sapiens
acacagcatgtgcca

SEQ ID NO: 1567967 - DNA, 14 bp, Homo sapiens
acacagcatgtgta

SEQ ID NO: 1567968 - DNA, 17 bp, Homo sapiens
acacagcattgtatatg

SEQ ID NO: 1567969 - DNA, 19 bp, Homo sapiens
acacagccactaaaacaca

SEQ ID NO: 1567970 - DNA, 15 bp, Homo sapiens
acacagcctggactt

SEQ ID NO: 1567971 - DNA, 14 bp, Homo sapiens
acacagcctgggcc

SEQ ID NO: 1567972 - DNA, 20 bp, Homo sapiens
acacagcctgggccccagct

SEQ ID NO: 1567973 - DNA, 18 bp, Homo sapiens
acacagcgtccctagcag

SEQ ID NO: 1567974 - DNA, 23 bp, Homo sapiens
acacagctactctccccacgagg

SEQ ID NO: 1567975 - DNA, 12 bp, Homo sapiens
acacagctcttc

SEQ ID NO: 1567976 - DNA, 13 bp, Homo sapiens
acacagctcttca

SEQ ID NO: 1567977 - DNA, 18 bp, Homo sapiens
acacagctcttcattcca

SEQ ID NO: 1567978 - DNA, 19 bp, Homo sapiens
acacagctgccctagctga

SEQ ID NO: 1567979 - DNA, 16 bp, Homo sapiens
acacaggacagcggga

SEQ ID NO: 1567980 - DNA, 21 bp, Homo sapiens
acacaggagtcttcagaccca

SEQ ID NO: 1567981 - DNA, 20 bp, Homo sapiens
acacaggcaactgaggcaga

SEQ ID NO: 1567982 - DNA, 12 bp, Homo sapiens
acacaggctggc

SEQ ID NO: 1567983 - DNA, 16 bp, Homo sapiens
acacagggctctttga

SEQ ID NO: 1567984 - DNA, 17 bp, Homo sapiens
acacaggggaggtgata

SEQ ID NO: 1567985 - DNA, 15 bp, Homo sapiens
acacagggttttgta

SEQ ID NO: 1567986 - DNA, 22 bp, Homo sapiens
acacagtaaaaacttgtactat

SEQ ID NO: 1567987 - DNA, 13 bp, Homo sapiens
acacagtattatg

SEQ ID NO: 1567988 - DNA, 19 bp, Homo sapiens
acacagtcttggctcactg

SEQ ID NO: 1567989 - DNA, 20 bp, Homo sapiens
acacagtgacttcctgggga

SEQ ID NO: 1567990 - DNA, 19 bp, Homo sapiens
acacagtgatgaatgtact

SEQ ID NO: 1567991 - DNA, 20 bp, Homo sapiens
acacagtgccttcaataaat

SEQ ID NO: 1567992 - DNA, 19 bp, Homo sapiens
acacagtgggaactctgac

SEQ ID NO: 1567993 - DNA, 22 bp, Homo sapiens
acacagtgggaactctgacaag

SEQ ID NO: 1567994 - DNA, 14 bp, Homo sapiens
acacagtgtctgtt

SEQ ID NO: 1567995 - DNA, 17 bp, Homo sapiens
acacagtgtctgttcag

SEQ ID NO: 1567996 - DNA, 14 bp, Homo sapiens
acacagtgttagtg

SEQ ID NO: 1567997 - DNA, 18 bp, Homo sapiens
acacagttacacttgtgc

SEQ ID NO: 1567998 - DNA, 16 bp, Homo sapiens
acacagttcctgggaa

SEQ ID NO: 1567999 - DNA, 18 bp, Homo sapiens
acacagttcctgggaaca

SEQ ID NO: 1568000 - DNA, 22 bp, Homo sapiens
acacagttgaattttttctaaa

SEQ ID NO: 1568001 - DNA, 15 bp, Homo sapiens
acacagttgctgtca

SEQ ID NO: 1568002 - DNA, 14 bp, Homo sapiens
acacagttttgaaa

SEQ ID NO: 1568003 - DNA, 15 bp, Homo sapiens
acacataattaacac

SEQ ID NO: 1568004 - DNA, 16 bp, Homo sapiens
acacatacatgtcaca

SEQ ID NO: 1568005 - DNA, 15 bp, Homo sapiens
acacataccctcttc

SEQ ID NO: 1568006 - DNA, 19 bp, Homo sapiens
acacatacgtgcacagggt

SEQ ID NO: 1568007 - DNA, 21 bp, Homo sapiens
acacatagattaatggcactg

SEQ ID NO: 1568008 - DNA, 23 bp, Homo sapiens
acacatagattaatggcactgat

SEQ ID NO: 1568009 - DNA, 17 bp, Homo sapiens
acacatagcatgtaatg

SEQ ID NO: 1568010 - DNA, 20 bp, Homo sapiens
acacatcccggcctcttcca

SEQ ID NO: 1568011 - DNA, 13 bp, Homo sapiens
acacatgaaaaca

SEQ ID NO: 1568012 - DNA, 15 bp, Homo sapiens
acacatgccctcctg

SEQ ID NO: 1568013 - DNA, 18 bp, Homo sapiens
acacatgccctcctggac

SEQ ID NO: 1568014 - DNA, 18 bp, Homo sapiens
acacatgtaaaatatgta

SEQ ID NO: 1568015 - DNA, 14 bp, Homo sapiens
acacatgtgtatga

SEQ ID NO: 1568016 - DNA, 16 bp, Homo sapiens
acacattaaacaggat

SEQ ID NO: 1568017 - DNA, 15 bp, Homo sapiens
acacattgccttctg

SEQ ID NO: 1568018 - DNA, 13 bp, Homo sapiens
acacatttcatag

SEQ ID NO: 1568019 - DNA, 16 bp, Homo sapiens
acacatttgctactgt

SEQ ID NO: 1568020 - DNA, 19 bp, Homo sapiens
acacatttgctactgttgt

SEQ ID NO: 1568021 - DNA, 19 bp, Homo sapiens
acacatttggccacaaaac

SEQ ID NO: 1568022 - DNA, 21 bp, Homo sapiens
acacatttggccacaaaacac

SEQ ID NO: 1568023 - DNA, 15 bp, Homo sapiens
acaccaaaaaatatc

SEQ ID NO: 1568024 - DNA, 14 bp, Homo sapiens
acaccaagtggctg

SEQ ID NO: 1568025 - DNA, 18 bp, Homo sapiens
acaccaataaatgtttgt

SEQ ID NO: 1568026 - DNA, 16 bp, Homo sapiens
acaccaatgaaaacat

SEQ ID NO: 1568027 - DNA, 13 bp, Homo sapiens
acaccacagacac

SEQ ID NO: 1568028 - DNA, 14 bp, Homo sapiens
acaccacagacaca

SEQ ID NO: 1568029 - DNA, 17 bp, Homo sapiens
acaccactgccctgcct

SEQ ID NO: 1568030 - DNA, 22 bp, Homo sapiens
acaccagaagctgttgggagaa

SEQ ID NO: 1568031 - DNA, 16 bp, Homo sapiens
acaccagcagcactgg

SEQ ID NO: 1568032 - DNA, 14 bp, Homo sapiens
acaccagctgctgc

SEQ ID NO: 1568033 - DNA, 22 bp, Homo sapiens
acaccaggccgtcctcccgggc

SEQ ID NO: 1568034 - DNA, 20 bp, Homo sapiens
acaccatcgatcatgatgta

SEQ ID NO: 1568035 - DNA, 13 bp, Homo sapiens
acaccatgtgcaa

SEQ ID NO: 1568036 - DNA, 14 bp, Homo sapiens
acaccatgtgcaat

SEQ ID NO: 1568037 - DNA, 16 bp, Homo sapiens
acaccatgtgcaataa

SEQ ID NO: 1568038 - DNA, 15 bp, Homo sapiens
acaccattaccaaaa

SEQ ID NO: 1568039 - DNA, 21 bp, Homo sapiens
acaccattaccaaaataataa

SEQ ID NO: 1568040 - DNA, 22 bp, Homo sapiens
acaccattctcctgcctcaccc

SEQ ID NO: 1568041 - DNA, 13 bp, Homo sapiens
acaccattttttt

SEQ ID NO: 1568042 - DNA, 19 bp, Homo sapiens
acacccaaagaggtattta

SEQ ID NO: 1568043 - DNA, 20 bp, Homo sapiens
acacccaaagaggtatttat

SEQ ID NO: 1568044 - DNA, 21 bp, Homo sapiens
acacccaattttaaaaaataa

SEQ ID NO: 1568045 - DNA, 17 bp, Homo sapiens
acacccaccgtccgccc

SEQ ID NO: 1568046 - DNA, 21 bp, Homo sapiens
acacccaccgtccgccctgct

SEQ ID NO: 1568047 - DNA, 22 bp, Homo sapiens
acacccaccgtccgccctgctc

SEQ ID NO: 1568048 - DNA, 16 bp, Homo sapiens
acacccagcggccccc

SEQ ID NO: 1568049 - DNA, 16 bp, Homo sapiens
acacccatgccagaga

SEQ ID NO: 1568050 - DNA, 18 bp, Homo sapiens
acacccccacctcctgca

SEQ ID NO: 1568051 - DNA, 23 bp, Homo sapiens
acacccctcccctgccctagagc

SEQ ID NO: 1568052 - DNA, 13 bp, Homo sapiens
acacccctgtgct

SEQ ID NO: 1568053 - DNA, 20 bp, Homo sapiens
acaccctaccttccccagac

SEQ ID NO: 1568054 - DNA, 18 bp, Homo sapiens
acaccctcaacctcttct

SEQ ID NO: 1568055 - DNA, 13 bp, Homo sapiens
acaccctctgccg

SEQ ID NO: 1568056 - DNA, 18 bp, Homo sapiens
acaccctggatgctgttg

SEQ ID NO: 1568057 - DNA, 13 bp, Homo sapiens
acaccctggcctg

SEQ ID NO: 1568058 - DNA, 14 bp, Homo sapiens
acaccgccagcagc

SEQ ID NO: 1568059 - DNA, 14 bp, Homo sapiens
acaccgctggtccc

SEQ ID NO: 1568060 - DNA, 19 bp, Homo sapiens
acaccgctggtccctgccc

SEQ ID NO: 1568061 - DNA, 21 bp, Homo sapiens
acaccgggccaagtgaagaat

SEQ ID NO: 1568062 - DNA, 19 bp, Homo sapiens
acaccgtcccagggctctg

SEQ ID NO: 1568063 - DNA, 14 bp, Homo sapiens
acaccgtccctcag

SEQ ID NO: 1568064 - DNA, 18 bp, Homo sapiens
acacctaccatgctgctt

SEQ ID NO: 1568065 - DNA, 21 bp, Homo sapiens
acacctactctatcagagaaa

SEQ ID NO: 1568066 - DNA, 17 bp, Homo sapiens
acacctcagtgggaaga

SEQ ID NO: 1568067 - DNA, 22 bp, Homo sapiens
acacctccctactcccctgggc

SEQ ID NO: 1568068 - DNA, 22 bp, Homo sapiens
acacctccctgaaccatccctg

SEQ ID NO: 1568069 - DNA, 16 bp, Homo sapiens
acacctgactctgaaa

SEQ ID NO: 1568070 - DNA, 18 bp, Homo sapiens
acacctgactctgaaatc

SEQ ID NO: 1568071 - DNA, 11 bp, Homo sapiens
acacctgcacc

SEQ ID NO: 1568072 - DNA, 16 bp, Homo sapiens
acacctgcacctcccc

SEQ ID NO: 1568073 - DNA, 24 bp, Homo sapiens
acacctgcacctccccccactgca

SEQ ID NO: 1568074 - DNA, 13 bp, Homo sapiens
acacctgcagtgc

SEQ ID NO: 1568075 - DNA, 13 bp, Homo sapiens
acacctgcctgcg

SEQ ID NO: 1568076 - DNA, 23 bp, Homo sapiens
acacctggctgaggttcctctgc

SEQ ID NO: 1568077 - DNA, 18 bp, Homo sapiens
acacctggtgcgggcctg

SEQ ID NO: 1568078 - DNA, 19 bp, Homo sapiens
acacctggtgcgggcctgg

SEQ ID NO: 1568079 - DNA, 21 bp, Homo sapiens
acacctggtgcgggcctggcc

SEQ ID NO: 1568080 - DNA, 20 bp, Homo sapiens
acacctgtagcacttactgg

SEQ ID NO: 1568081 - DNA, 16 bp, Homo sapiens
acacctgtagtcccag

SEQ ID NO: 1568082 - DNA, 14 bp, Homo sapiens
acaccttccagctc

SEQ ID NO: 1568083 - DNA, 16 bp, Homo sapiens
acaccttccagctcct

SEQ ID NO: 1568084 - DNA, 14 bp, Homo sapiens
acaccttccagggc

SEQ ID NO: 1568085 - DNA, 22 bp, Homo sapiens
acaccttggcttgttattgcct

SEQ ID NO: 1568086 - DNA, 23 bp, Homo sapiens
acaccttggggtccctccacccc

SEQ ID NO: 1568087 - DNA, 15 bp, Homo sapiens
acacctttaggttct

SEQ ID NO: 1568088 - DNA, 15 bp, Homo sapiens
acaccttttaactca

SEQ ID NO: 1568089 - DNA, 17 bp, Homo sapiens
acaccttttaactcacc

SEQ ID NO: 1568090 - DNA, 15 bp, Homo sapiens
acaccttttccccag

SEQ ID NO: 1568091 - DNA, 14 bp, Homo sapiens
acacgaaagaaatg

SEQ ID NO: 1568092 - DNA, 12 bp, Homo sapiens
acacgagccaca

SEQ ID NO: 1568093 - DNA, 13 bp, Homo sapiens
acacgatgcattt

SEQ ID NO: 1568094 - DNA, 14 bp, Homo sapiens
acacgatgcattta

SEQ ID NO: 1568095 - DNA, 20 bp, Homo sapiens
acacgatgcatttaataaag

SEQ ID NO: 1568096 - DNA, 21 bp, Homo sapiens
acacgatgcatttaataaaga

SEQ ID NO: 1568097 - DNA, 24 bp, Homo sapiens
acacgatgcatttaataaagatga

SEQ ID NO: 1568098 - DNA, 20 bp, Homo sapiens
acacgattttcaagattcta

SEQ ID NO: 1568099 - DNA, 23 bp, Homo sapiens
acacgattttcaagattctaaag

SEQ ID NO: 1568100 - DNA, 22 bp, Homo sapiens
acacgcaagggcatcaggcact

SEQ ID NO: 1568101 - DNA, 13 bp, Homo sapiens
acacgcacgcaca

SEQ ID NO: 1568102 - DNA, 16 bp, Homo sapiens
acacgcacgcacacac

SEQ ID NO: 1568103 - DNA, 23 bp, Homo sapiens
acacgcactctccccgctcaggg

SEQ ID NO: 1568104 - DNA, 18 bp, Homo sapiens
acacgcagcctgctctgg

SEQ ID NO: 1568105 - DNA, 14 bp, Homo sapiens
acacgcgctctcca

SEQ ID NO: 1568106 - DNA, 23 bp, Homo sapiens
acacgcgggcgcgatcccacaca

SEQ ID NO: 1568107 - DNA, 18 bp, Homo sapiens
acacgcggtggcatgcat

SEQ ID NO: 1568108 - DNA, 21 bp, Homo sapiens
acacggatctgctgggctctg

SEQ ID NO: 1568109 - DNA, 20 bp, Homo sapiens
acacgggaaagccttaaaaa

SEQ ID NO: 1568110 - DNA, 20 bp, Homo sapiens
acacgggcgagctttctctc

SEQ ID NO: 1568111 - DNA, 19 bp, Homo sapiens
acacgtacctctcatcagt

SEQ ID NO: 1568112 - DNA, 23 bp, Homo sapiens
acacgtatttatatttggaaaga

SEQ ID NO: 1568113 - DNA, 13 bp, Homo sapiens
acacgtgagaatc

SEQ ID NO: 1568114 - DNA, 16 bp, Homo sapiens
acacgtgagaatccct

SEQ ID NO: 1568115 - DNA, 13 bp, Homo sapiens
acactaaagactg

SEQ ID NO: 1568116 - DNA, 23 bp, Homo sapiens
acactaaattattagcatttgtt

SEQ ID NO: 1568117 - DNA, 17 bp, Homo sapiens
acactaactcaccagcc

SEQ ID NO: 1568118 - DNA, 19 bp, Homo sapiens
acactaactcaccagcccc

SEQ ID NO: 1568119 - DNA, 20 bp, Homo sapiens
acactaactcaccagcccca

SEQ ID NO: 1568120 - DNA, 14 bp, Homo sapiens
acactaagggtgta

SEQ ID NO: 1568121 - DNA, 19 bp, Homo sapiens
acactaagttatagtatat

SEQ ID NO: 1568122 - DNA, 22 bp, Homo sapiens
acactaatatatttaaaaataa

SEQ ID NO: 1568123 - DNA, 13 bp, Homo sapiens
acactaattcata

SEQ ID NO: 1568124 - DNA, 19 bp, Homo sapiens
acactaatttgaataaact

SEQ ID NO: 1568125 - DNA, 22 bp, Homo sapiens
acactaccaaacactcagtcca

SEQ ID NO: 1568126 - DNA, 18 bp, Homo sapiens
acactactgctaaatcct

SEQ ID NO: 1568127 - DNA, 19 bp, Homo sapiens
acactactgctaaatcctc

SEQ ID NO: 1568128 - DNA, 17 bp, Homo sapiens
acactagcccaatgaaa

SEQ ID NO: 1568129 - DNA, 20 bp, Homo sapiens
acactagcccaatgaaatga

SEQ ID NO: 1568130 - DNA, 15 bp, Homo sapiens
acactagcctctcca

SEQ ID NO: 1568131 - DNA, 14 bp, Homo sapiens
acactatatctgta

SEQ ID NO: 1568132 - DNA, 18 bp, Homo sapiens
acactatatctgtatata

SEQ ID NO: 1568133 - DNA, 15 bp, Homo sapiens
acactattatttcct

SEQ ID NO: 1568134 - DNA, 14 bp, Homo sapiens
acactcagacctga

SEQ ID NO: 1568135 - DNA, 19 bp, Homo sapiens
acactcagacctgaattct

SEQ ID NO: 1568136 - DNA, 20 bp, Homo sapiens
acactcagtccactgttgag

SEQ ID NO: 1568137 - DNA, 19 bp, Homo sapiens
acactcatgcacacagata

SEQ ID NO: 1568138 - DNA, 13 bp, Homo sapiens
acactccactctg

SEQ ID NO: 1568139 - DNA, 14 bp, Homo sapiens
acactccactctga

SEQ ID NO: 1568140 - DNA, 16 bp, Homo sapiens
acactccactctgatt

SEQ ID NO: 1568141 - DNA, 12 bp, Homo sapiens
acactccactga

SEQ ID NO: 1568142 - DNA, 13 bp, Homo sapiens
acactccactgac

SEQ ID NO: 1568143 - DNA, 21 bp, Homo sapiens
acactcccaaggttggagccc

SEQ ID NO: 1568144 - DNA, 17 bp, Homo sapiens
acactcccctgcactgg

SEQ ID NO: 1568145 - DNA, 16 bp, Homo sapiens
acactccctctccttg

SEQ ID NO: 1568146 - DNA, 17 bp, Homo sapiens
acactcctctgcgtcta

SEQ ID NO: 1568147 - DNA, 16 bp, Homo sapiens
acactcgcccgcccac

SEQ ID NO: 1568148 - DNA, 15 bp, Homo sapiens
acactctatatgtag

SEQ ID NO: 1568149 - DNA, 14 bp, Homo sapiens
acactctgctctgc

SEQ ID NO: 1568150 - DNA, 22 bp, Homo sapiens
acactcttcagtgactcctgct

SEQ ID NO: 1568151 - DNA, 14 bp, Homo sapiens
acactgaaagtttt

SEQ ID NO: 1568152 - DNA, 17 bp, Homo sapiens
acactgaaagttttgta

SEQ ID NO: 1568153 - DNA, 18 bp, Homo sapiens
acactgaaagttttgtaa

SEQ ID NO: 1568154 - DNA, 20 bp, Homo sapiens
acactgaaagttttgtaaaa

SEQ ID NO: 1568155 - DNA, 18 bp, Homo sapiens
acactgaatatttatatt

SEQ ID NO: 1568156 - DNA, 21 bp, Homo sapiens
acactgaatctcccctcctca

SEQ ID NO: 1568157 - DNA, 23 bp, Homo sapiens
acactgaccttggagagacacag

SEQ ID NO: 1568158 - DNA, 22 bp, Homo sapiens
acactgagaatgtaagaactac

SEQ ID NO: 1568159 - DNA, 19 bp, Homo sapiens
acactgatgagtttcactg

SEQ ID NO: 1568160 - DNA, 15 bp, Homo sapiens
acactgatggctcaa

SEQ ID NO: 1568161 - DNA, 11 bp, Homo sapiens
acactgcagcc

SEQ ID NO: 1568162 - DNA, 17 bp, Homo sapiens
acactgcataggaattt

SEQ ID NO: 1568163 - DNA, 15 bp, Homo sapiens
acactgccagaagag

SEQ ID NO: 1568164 - DNA, 23 bp, Homo sapiens
acactgccagaagagaattcagt

SEQ ID NO: 1568165 - DNA, 19 bp, Homo sapiens
acactgccatattgtgtaa

SEQ ID NO: 1568166 - DNA, 15 bp, Homo sapiens
acactgccctcttgt

SEQ ID NO: 1568167 - DNA, 15 bp, Homo sapiens
acactgcctgggctg

SEQ ID NO: 1568168 - DNA, 16 bp, Homo sapiens
acactgcgcaggtctc

SEQ ID NO: 1568169 - DNA, 16 bp, Homo sapiens
acactgcggaagccaa

SEQ ID NO: 1568170 - DNA, 18 bp, Homo sapiens
acactgcggaagccaaag

SEQ ID NO: 1568171 - DNA, 23 bp, Homo sapiens
acactgcggaagccaaaggcagc

SEQ ID NO: 1568172 - DNA, 13 bp, Homo sapiens
acactgctcacag

SEQ ID NO: 1568173 - DNA, 13 bp, Homo sapiens
acactgctctaac

SEQ ID NO: 1568174 - DNA, 11 bp, Homo sapiens
acactgctgca

SEQ ID NO: 1568175 - DNA, 13 bp, Homo sapiens
acactgctgcacc

SEQ ID NO: 1568176 - DNA, 19 bp, Homo sapiens
acactgctgcaccagagtg

SEQ ID NO: 1568177 - DNA, 14 bp, Homo sapiens
acactgctgtccac

SEQ ID NO: 1568178 - DNA, 15 bp, Homo sapiens
acactgctgtccaca

SEQ ID NO: 1568179 - DNA, 16 bp, Homo sapiens
acactggacctttggg

SEQ ID NO: 1568180 - DNA, 13 bp, Homo sapiens
acactggcccctc

SEQ ID NO: 1568181 - DNA, 15 bp, Homo sapiens
acactgggggagggg

SEQ ID NO: 1568182 - DNA, 16 bp, Homo sapiens
acactgggggagggga

SEQ ID NO: 1568183 - DNA, 15 bp, Homo sapiens
acactgggtgcgtct

SEQ ID NO: 1568184 - DNA, 16 bp, Homo sapiens
acactggtaaatgtta

SEQ ID NO: 1568185 - DNA, 16 bp, Homo sapiens
acactggttaaattaa

SEQ ID NO: 1568186 - DNA, 17 bp, Homo sapiens
acactggtttgccaggc

SEQ ID NO: 1568187 - DNA, 18 bp, Homo sapiens
acactgtagtttttgaaa

SEQ ID NO: 1568188 - DNA, 19 bp, Homo sapiens
acactgtagtttttgaaaa

SEQ ID NO: 1568189 - DNA, 20 bp, Homo sapiens
acactgtagtttttgaaaat

SEQ ID NO: 1568190 - DNA, 14 bp, Homo sapiens
acactgtattttaa

SEQ ID NO: 1568191 - DNA, 18 bp, Homo sapiens
acactgtattttaatgta

SEQ ID NO: 1568192 - DNA, 17 bp, Homo sapiens
acactgtcatgcttcat

SEQ ID NO: 1568193 - DNA, 18 bp, Homo sapiens
acactgtccttccctgcc

SEQ ID NO: 1568194 - DNA, 20 bp, Homo sapiens
acactgtccttccctgccac

SEQ ID NO: 1568195 - DNA, 21 bp, Homo sapiens
acactgtccttccctgccact

SEQ ID NO: 1568196 - DNA, 14 bp, Homo sapiens
acactgtcttcccg

SEQ ID NO: 1568197 - DNA, 19 bp, Homo sapiens
acactgtcttcccgatgag

SEQ ID NO: 1568198 - DNA, 16 bp, Homo sapiens
acactgtgaccaggct

SEQ ID NO: 1568199 - DNA, 12 bp, Homo sapiens
acactgtgtaag

SEQ ID NO: 1568200 - DNA, 11 bp, Homo sapiens
acactgtgtcc

SEQ ID NO: 1568201 - DNA, 10 bp, Homo sapiens
acactgttat

SEQ ID NO: 1568202 - DNA, 11 bp, Homo sapiens
acacttaacag

SEQ ID NO: 1568203 - DNA, 18 bp, Homo sapiens
acacttacactttatgca

SEQ ID NO: 1568204 - DNA, 21 bp, Homo sapiens
acacttatattttatgaacat

SEQ ID NO: 1568205 - DNA, 14 bp, Homo sapiens
acacttatcttctg

SEQ ID NO: 1568206 - DNA, 17 bp, Homo sapiens
acacttattttctgaat

SEQ ID NO: 1568207 - DNA, 22 bp, Homo sapiens
acacttcaggctcttctccttt

SEQ ID NO: 1568208 - DNA, 19 bp, Homo sapiens
acacttcatggaccaagaa

SEQ ID NO: 1568209 - DNA, 21 bp, Homo sapiens
acacttcatggaccaagaatg

SEQ ID NO: 1568210 - DNA, 17 bp, Homo sapiens
acacttccaccagcctg

SEQ ID NO: 1568211 - DNA, 11 bp, Homo sapiens
acacttcccca

SEQ ID NO: 1568212 - DNA, 14 bp, Homo sapiens
acacttcctgccta

SEQ ID NO: 1568213 - DNA, 14 bp, Homo sapiens
acacttctcatcat

SEQ ID NO: 1568214 - DNA, 14 bp, Homo sapiens
acacttctgctttc

SEQ ID NO: 1568215 - DNA, 20 bp, Homo sapiens
acacttcttacgcaatgctt

SEQ ID NO: 1568216 - DNA, 14 bp, Homo sapiens
acacttgaaacctt

SEQ ID NO: 1568217 - DNA, 16 bp, Homo sapiens
acacttgctcccaacc

SEQ ID NO: 1568218 - DNA, 17 bp, Homo sapiens
acacttggcatacaaaa

SEQ ID NO: 1568219 - DNA, 17 bp, Homo sapiens
acacttggttgggtcct

SEQ ID NO: 1568220 - DNA, 20 bp, Homo sapiens
acacttggttgggtcctcac

SEQ ID NO: 1568221 - DNA, 21 bp, Homo sapiens
acacttgtgacttttgcttta

SEQ ID NO: 1568222 - DNA, 23 bp, Homo sapiens
acacttgtgtgtgggctgtgagt

SEQ ID NO: 1568223 - DNA, 20 bp, Homo sapiens
acacttgttccagctctttg

SEQ ID NO: 1568224 - DNA, 22 bp, Homo sapiens
acactttaattaccaacctgtt

SEQ ID NO: 1568225 - DNA, 21 bp, Homo sapiens
acactttatgccggatgtgct

SEQ ID NO: 1568226 - DNA, 14 bp, Homo sapiens
acactttctggcaa

SEQ ID NO: 1568227 - DNA, 15 bp, Homo sapiens
acactttctggcaaa

SEQ ID NO: 1568228 - DNA, 18 bp, Homo sapiens
acactttgaaatgtgttt

SEQ ID NO: 1568229 - DNA, 20 bp, Homo sapiens
acactttgctttctgaattg

SEQ ID NO: 1568230 - DNA, 14 bp, Homo sapiens
acactttgtattac

SEQ ID NO: 1568231 - DNA, 18 bp, Homo sapiens
acactttgtctagtgtat

SEQ ID NO: 1568232 - DNA, 23 bp, Homo sapiens
acactttgttgcaagatgtgaat

SEQ ID NO: 1568233 - DNA, 16 bp, Homo sapiens
acagaaaaagcatgat

SEQ ID NO: 1568234 - DNA, 17 bp, Homo sapiens
acagaaaaagcatgatg

SEQ ID NO: 1568235 - DNA, 19 bp, Homo sapiens
acagaaaacaaaagagaga

SEQ ID NO: 1568236 - DNA, 22 bp, Homo sapiens
acagaaaacattctgatttgga

SEQ ID NO: 1568237 - DNA, 14 bp, Homo sapiens
acagaaaagtgcct

SEQ ID NO: 1568238 - DNA, 12 bp, Homo sapiens
acagaaacaaaa

SEQ ID NO: 1568239 - DNA, 14 bp, Homo sapiens
acagaaacactgcc

SEQ ID NO: 1568240 - DNA, 19 bp, Homo sapiens
acagaaacactgccttttt

SEQ ID NO: 1568241 - DNA, 18 bp, Homo sapiens
acagaaacctctactaaa

SEQ ID NO: 1568242 - DNA, 16 bp, Homo sapiens
acagaaaccttttatt

SEQ ID NO: 1568243 - DNA, 18 bp, Homo sapiens
acagaaacgcatccagca

SEQ ID NO: 1568244 - DNA, 22 bp, Homo sapiens
acagaaagaaaaatgcattatt

SEQ ID NO: 1568245 - DNA, 12 bp, Homo sapiens
acagaaagcctc

SEQ ID NO: 1568246 - DNA, 16 bp, Homo sapiens
acagaaaggttttctt

SEQ ID NO: 1568247 - DNA, 18 bp, Homo sapiens
acagaaatactgctctga

SEQ ID NO: 1568248 - DNA, 21 bp, Homo sapiens
acagaaatattggttgaaagt

SEQ ID NO: 1568249 - DNA, 20 bp, Homo sapiens
acagaaatcagaggagagac

SEQ ID NO: 1568250 - DNA, 19 bp, Homo sapiens
acagaaatgctgctggcca

SEQ ID NO: 1568251 - DNA, 20 bp, Homo sapiens
acagaaatgctgctggccaa

SEQ ID NO: 1568252 - DNA, 15 bp, Homo sapiens
acagaaatgtttaaa

SEQ ID NO: 1568253 - DNA, 17 bp, Homo sapiens
acagaaattagccgggc

SEQ ID NO: 1568254 - DNA, 14 bp, Homo sapiens
acagaaattgtata

SEQ ID NO: 1568255 - DNA, 15 bp, Homo sapiens
acagaaattgtatat

SEQ ID NO: 1568256 - DNA, 19 bp, Homo sapiens
acagaacaaatgtttgttt

SEQ ID NO: 1568257 - DNA, 21 bp, Homo sapiens
acagaacatatgttgcaagac

SEQ ID NO: 1568258 - DNA, 13 bp, Homo sapiens
acagaagcttcca

SEQ ID NO: 1568259 - DNA, 19 bp, Homo sapiens
acagaaggaatctgtgcag

SEQ ID NO: 1568260 - DNA, 24 bp, Homo sapiens
acagaaggcaaagtttacagatgt

SEQ ID NO: 1568261 - DNA, 16 bp, Homo sapiens
acagaagtcatgaagc

SEQ ID NO: 1568262 - DNA, 17 bp, Homo sapiens
acagaatatgtttcaaa

SEQ ID NO: 1568263 - DNA, 21 bp, Homo sapiens
acagaatatttctattgaatt

SEQ ID NO: 1568264 - DNA, 14 bp, Homo sapiens
acagaatcttgtat

SEQ ID NO: 1568265 - DNA, 19 bp, Homo sapiens
acagaatcttgttttgaaa

SEQ ID NO: 1568266 - DNA, 22 bp, Homo sapiens
acagaatgcaaccaagtcacac

SEQ ID NO: 1568267 - DNA, 16 bp, Homo sapiens
acagaatgctatttca

SEQ ID NO: 1568268 - DNA, 19 bp, Homo sapiens
acagaattctcccagcgtt

SEQ ID NO: 1568269 - DNA, 14 bp, Homo sapiens
acagaattggatac

SEQ ID NO: 1568270 - DNA, 20 bp, Homo sapiens
acagacaaaaacagcctcac

SEQ ID NO: 1568271 - DNA, 13 bp, Homo sapiens
acagacaagcagc

SEQ ID NO: 1568272 - DNA, 14 bp, Homo sapiens
acagacaagcagcc

SEQ ID NO: 1568273 - DNA, 12 bp, Homo sapiens
acagacacacac

SEQ ID NO: 1568274 - DNA, 11 bp, Homo sapiens
acagacaggag

SEQ ID NO: 1568275 - DNA, 13 bp, Homo sapiens
acagacaggagaa

SEQ ID NO: 1568276 - DNA, 15 bp, Homo sapiens
acagacaggctctta

SEQ ID NO: 1568277 - DNA, 14 bp, Homo sapiens
acagacatatatat

SEQ ID NO: 1568278 - DNA, 21 bp, Homo sapiens
acagaccacatctttatctgt

SEQ ID NO: 1568279 - DNA, 20 bp, Homo sapiens
acagaccacctgcttctgaa

SEQ ID NO: 1568280 - DNA, 23 bp, Homo sapiens
acagaccacctgcttctgaactc

SEQ ID NO: 1568281 - DNA, 19 bp, Homo sapiens
acagaccacctttcacaaa

SEQ ID NO: 1568282 - DNA, 13 bp, Homo sapiens
acagacctggaca

SEQ ID NO: 1568283 - DNA, 17 bp, Homo sapiens
acagacctggagcccct

SEQ ID NO: 1568284 - DNA, 19 bp, Homo sapiens
acagacctggagcccctgg

SEQ ID NO: 1568285 - DNA, 21 bp, Homo sapiens
acagacctggagcccctgggt

SEQ ID NO: 1568286 - DNA, 22 bp, Homo sapiens
acagacctggagcccctgggtg

SEQ ID NO: 1568287 - DNA, 14 bp, Homo sapiens
acagacctggctct

SEQ ID NO: 1568288 - DNA, 23 bp, Homo sapiens
acagacgttaggcatttcctgct

SEQ ID NO: 1568289 - DNA, 14 bp, Homo sapiens
acagactatttgct

SEQ ID NO: 1568290 - DNA, 22 bp, Homo sapiens
acagactatttgctaatgtata

SEQ ID NO: 1568291 - DNA, 23 bp, Homo sapiens
acagactatttttagattttctt

SEQ ID NO: 1568292 - DNA, 15 bp, Homo sapiens
acagactccatctct

SEQ ID NO: 1568293 - DNA, 12 bp, Homo sapiens
acagactgtttt

SEQ ID NO: 1568294 - DNA, 18 bp, Homo sapiens
acagactgttttactgtt

SEQ ID NO: 1568295 - DNA, 16 bp, Homo sapiens
acagacttcacagcgt

SEQ ID NO: 1568296 - DNA, 16 bp, Homo sapiens
acagacttctggaagg

SEQ ID NO: 1568297 - DNA, 18 bp, Homo sapiens
acagacttctggaaggct

SEQ ID NO: 1568298 - DNA, 21 bp, Homo sapiens
acagacttctggaaggctggc

SEQ ID NO: 1568299 - DNA, 15 bp, Homo sapiens
acagacttgagaact

SEQ ID NO: 1568300 - DNA, 15 bp, Homo sapiens
acagagaagctcctg

SEQ ID NO: 1568301 - DNA, 14 bp, Homo sapiens
acagagaaggcagg

SEQ ID NO: 1568302 - DNA, 15 bp, Homo sapiens
acagagaaggcagga

SEQ ID NO: 1568303 - DNA, 20 bp, Homo sapiens
acagagaagtttgtagccag

SEQ ID NO: 1568304 - DNA, 11 bp, Homo sapiens
acagagaccta

SEQ ID NO: 1568305 - DNA, 18 bp, Homo sapiens
acagagacgcaggaatgg

SEQ ID NO: 1568306 - DNA, 13 bp, Homo sapiens
acagagagaatga

SEQ ID NO: 1568307 - DNA, 13 bp, Homo sapiens
acagagaggacca

SEQ ID NO: 1568308 - DNA, 19 bp, Homo sapiens
acagagaggatacatttaa

SEQ ID NO: 1568309 - DNA, 15 bp, Homo sapiens
acagagcaagactct

SEQ ID NO: 1568310 - DNA, 19 bp, Homo sapiens
acagagcacatttgtcagt

SEQ ID NO: 1568311 - DNA, 23 bp, Homo sapiens
acagagcagctaactccgagagc

SEQ ID NO: 1568312 - DNA, 14 bp, Homo sapiens
acagagcaggaagc

SEQ ID NO: 1568313 - DNA, 17 bp, Homo sapiens
acagagcatacaacaga

SEQ ID NO: 1568314 - DNA, 19 bp, Homo sapiens
acagagcatcaaaaacatc

SEQ ID NO: 1568315 - DNA, 18 bp, Homo sapiens
acagagccaagcactgct

SEQ ID NO: 1568316 - DNA, 20 bp, Homo sapiens
acagagccaagcactgctca

SEQ ID NO: 1568317 - DNA, 13 bp, Homo sapiens
acagagccaggag

SEQ ID NO: 1568318 - DNA, 16 bp, Homo sapiens
acagagccaggagaag

SEQ ID NO: 1568319 - DNA, 22 bp, Homo sapiens
acagagccaggagaagctcagc

SEQ ID NO: 1568320 - DNA, 11 bp, Homo sapiens
acagagccagt

SEQ ID NO: 1568321 - DNA, 16 bp, Homo sapiens
acagagccccacgctg

SEQ ID NO: 1568322 - DNA, 22 bp, Homo sapiens
acagagccttgagagacccagc

SEQ ID NO: 1568323 - DNA, 20 bp, Homo sapiens
acagagcgagactccatctc

SEQ ID NO: 1568324 - DNA, 20 bp, Homo sapiens
acagagcgtccttccccctg

SEQ ID NO: 1568325 - DNA, 16 bp, Homo sapiens
acagagctactgagac

SEQ ID NO: 1568326 - DNA, 17 bp, Homo sapiens
acagaggaagagcaggc

SEQ ID NO: 1568327 - DNA, 18 bp, Homo sapiens
acagaggaagagcaggca

SEQ ID NO: 1568328 - DNA, 22 bp, Homo sapiens
acagaggacccttacgtgagaa

SEQ ID NO: 1568329 - DNA, 15 bp, Homo sapiens
acagaggccccagcc

SEQ ID NO: 1568330 - DNA, 14 bp, Homo sapiens
acagaggccggggt

SEQ ID NO: 1568331 - DNA, 14 bp, Homo sapiens
acagagggagttta

SEQ ID NO: 1568332 - DNA, 23 bp, Homo sapiens
acagaggttgtagtgagccaaga

SEQ ID NO: 1568333 - DNA, 19 bp, Homo sapiens
acagagtcttcctctgtct

SEQ ID NO: 1568334 - DNA, 17 bp, Homo sapiens
acagagtgagactccat

SEQ ID NO: 1568335 - DNA, 21 bp, Homo sapiens
acagagtggactcttccctct

SEQ ID NO: 1568336 - DNA, 18 bp, Homo sapiens
acagagtggtctttctgg

SEQ ID NO: 1568337 - DNA, 20 bp, Homo sapiens
acagagttaaatatgcatct

SEQ ID NO: 1568338 - DNA, 17 bp, Homo sapiens
acagataaagattgtgt

SEQ ID NO: 1568339 - DNA, 18 bp, Homo sapiens
acagataactgctttgca

SEQ ID NO: 1568340 - DNA, 21 bp, Homo sapiens
acagataagcaagagagatgt

SEQ ID NO: 1568341 - DNA, 22 bp, Homo sapiens
acagataagtgttcttcagtgt

SEQ ID NO: 1568342 - DNA, 17 bp, Homo sapiens
acagataattcatttgt

SEQ ID NO: 1568343 - DNA, 15 bp, Homo sapiens
acagatacacacaca

SEQ ID NO: 1568344 - DNA, 14 bp, Homo sapiens
acagataccataaa

SEQ ID NO: 1568345 - DNA, 21 bp, Homo sapiens
acagatactggaagttttgca

SEQ ID NO: 1568346 - DNA, 22 bp, Homo sapiens
acagatattacagcttattttt

SEQ ID NO: 1568347 - DNA, 18 bp, Homo sapiens
acagatatttccatttct

SEQ ID NO: 1568348 - DNA, 14 bp, Homo sapiens
acagatcaagaaaa

SEQ ID NO: 1568349 - DNA, 22 bp, Homo sapiens
acagatcatcttggaactgcat

SEQ ID NO: 1568350 - DNA, 20 bp, Homo sapiens
acagatccagaatttattag

SEQ ID NO: 1568351 - DNA, 14 bp, Homo sapiens
acagatctggaacc

SEQ ID NO: 1568352 - DNA, 20 bp, Homo sapiens
acagatctggaacctcagcc

SEQ ID NO: 1568353 - DNA, 22 bp, Homo sapiens
acagatctggaacctcagcctg

SEQ ID NO: 1568354 - DNA, 12 bp, Homo sapiens
acagatgatact

SEQ ID NO: 1568355 - DNA, 20 bp, Homo sapiens
acagatgcaatgtgctactg

SEQ ID NO: 1568356 - DNA, 17 bp, Homo sapiens
acagatgccccagagct

SEQ ID NO: 1568357 - DNA, 18 bp, Homo sapiens
acagatgccccagagctg

SEQ ID NO: 1568358 - DNA, 19 bp, Homo sapiens
acagatgccccagagctgt

SEQ ID NO: 1568359 - DNA, 22 bp, Homo sapiens
acagatgccccagagctgttta

SEQ ID NO: 1568360 - DNA, 19 bp, Homo sapiens
acagatggaaaaactgagg

SEQ ID NO: 1568361 - DNA, 23 bp, Homo sapiens
acagatggggtctgtgactggat

SEQ ID NO: 1568362 - DNA, 20 bp, Homo sapiens
acagatgggtattaaacttg

SEQ ID NO: 1568363 - DNA, 19 bp, Homo sapiens
acagatgtaaattaactca

SEQ ID NO: 1568364 - DNA, 16 bp, Homo sapiens
acagattatgttcctg

SEQ ID NO: 1568365 - DNA, 21 bp, Homo sapiens
acagattatgttcctgctgta

SEQ ID NO: 1568366 - DNA, 18 bp, Homo sapiens
acagattcaggccagccc

SEQ ID NO: 1568367 - DNA, 15 bp, Homo sapiens
acagattctttcagt

SEQ ID NO: 1568368 - DNA, 13 bp, Homo sapiens
acagattgacagg

SEQ ID NO: 1568369 - DNA, 16 bp, Homo sapiens
acagatttcatacctc

SEQ ID NO: 1568370 - DNA, 21 bp, Homo sapiens
acagattttatttgtaatttt

SEQ ID NO: 1568371 - DNA, 15 bp, Homo sapiens
acagatttttacaaa

SEQ ID NO: 1568372 - DNA, 15 bp, Homo sapiens
acagcaaacaggtgc

SEQ ID NO: 1568373 - DNA, 22 bp, Homo sapiens
acagcaaacaggtgctaatttg

SEQ ID NO: 1568374 - DNA, 14 bp, Homo sapiens
acagcaatttctaa

SEQ ID NO: 1568375 - DNA, 14 bp, Homo sapiens
acagcacaaacaca

SEQ ID NO: 1568376 - DNA, 16 bp, Homo sapiens
acagcacaagggcaca

SEQ ID NO: 1568377 - DNA, 17 bp, Homo sapiens
acagcacaccagccgct

SEQ ID NO: 1568378 - DNA, 20 bp, Homo sapiens
acagcacaccagccgctgca

SEQ ID NO: 1568379 - DNA, 13 bp, Homo sapiens
acagcacacctgt

SEQ ID NO: 1568380 - DNA, 18 bp, Homo sapiens
acagcacacctgtgtcca

SEQ ID NO: 1568381 - DNA, 19 bp, Homo sapiens
acagcacacctgtgtccaa

SEQ ID NO: 1568382 - DNA, 16 bp, Homo sapiens
acagcaccgggggaga

SEQ ID NO: 1568383 - DNA, 17 bp, Homo sapiens
acagcaccgggggagag

SEQ ID NO: 1568384 - DNA, 17 bp, Homo sapiens
acagcactactctgtgc

SEQ ID NO: 1568385 - DNA, 14 bp, Homo sapiens
acagcactggggag

SEQ ID NO: 1568386 - DNA, 16 bp, Homo sapiens
acagcactttggtttt

SEQ ID NO: 1568387 - DNA, 17 bp, Homo sapiens
acagcactttggttttg

SEQ ID NO: 1568388 - DNA, 17 bp, Homo sapiens
acagcagcctgtatgtg

SEQ ID NO: 1568389 - DNA, 13 bp, Homo sapiens
acagcagctcata

SEQ ID NO: 1568390 - DNA, 16 bp, Homo sapiens
acagcagctcatagaa

SEQ ID NO: 1568391 - DNA, 22 bp, Homo sapiens
acagcagctcatagaattttga

SEQ ID NO: 1568392 - DNA, 23 bp, Homo sapiens
acagcagctgcaggggcctctgt

SEQ ID NO: 1568393 - DNA, 24 bp, Homo sapiens
acagcagctggtgccccacctgcc

SEQ ID NO: 1568394 - DNA, 12 bp, Homo sapiens
acagcagcttca

SEQ ID NO: 1568395 - DNA, 17 bp, Homo sapiens
acagcagcttcaccaga

SEQ ID NO: 1568396 - DNA, 18 bp, Homo sapiens
acagcagcttcaccagag

SEQ ID NO: 1568397 - DNA, 22 bp, Homo sapiens
acagcaggatcgaagggttttt

SEQ ID NO: 1568398 - DNA, 21 bp, Homo sapiens
acagcagtgatctcagggcag

SEQ ID NO: 1568399 - DNA, 16 bp, Homo sapiens
acagcagtgtcatcag

SEQ ID NO: 1568400 - DNA, 14 bp, Homo sapiens
acagcagtgtcccc

SEQ ID NO: 1568401 - DNA, 22 bp, Homo sapiens
acagcagtgtcccctgccccag

SEQ ID NO: 1568402 - DNA, 22 bp, Homo sapiens
acagcagttgaaaagactccaa

SEQ ID NO: 1568403 - DNA, 17 bp, Homo sapiens
acagcatgctgctttgc

SEQ ID NO: 1568404 - DNA, 11 bp, Homo sapiens
acagcattgct

SEQ ID NO: 1568405 - DNA, 13 bp, Homo sapiens
acagcattgcttt

SEQ ID NO: 1568406 - DNA, 14 bp, Homo sapiens
acagcattgtcttt

SEQ ID NO: 1568407 - DNA, 15 bp, Homo sapiens
acagcattgtctttg

SEQ ID NO: 1568408 - DNA, 20 bp, Homo sapiens
acagcattgtctttgctgta

SEQ ID NO: 1568409 - DNA, 13 bp, Homo sapiens
acagcatttgctt

SEQ ID NO: 1568410 - DNA, 15 bp, Homo sapiens
acagccaaatttaaa

SEQ ID NO: 1568411 - DNA, 21 bp, Homo sapiens
acagccaactagcccctgggg

SEQ ID NO: 1568412 - DNA, 16 bp, Homo sapiens
acagccactccccggc

SEQ ID NO: 1568413 - DNA, 23 bp, Homo sapiens
acagccagacttgcttcctgcat

SEQ ID NO: 1568414 - DNA, 12 bp, Homo sapiens
acagccagagcc

SEQ ID NO: 1568415 - DNA, 15 bp, Homo sapiens
acagccagagcctgt

SEQ ID NO: 1568416 - DNA, 14 bp, Homo sapiens
acagccagggggat

SEQ ID NO: 1568417 - DNA, 22 bp, Homo sapiens
acagccattttacatagcacat

SEQ ID NO: 1568418 - DNA, 19 bp, Homo sapiens
acagcccaagaggactgag

SEQ ID NO: 1568419 - DNA, 10 bp, Homo sapiens
acagcccaga

SEQ ID NO: 1568420 - DNA, 15 bp, Homo sapiens
acagcccagagcctg

SEQ ID NO: 1568421 - DNA, 16 bp, Homo sapiens
acagcccagccacgga

SEQ ID NO: 1568422 - DNA, 14 bp, Homo sapiens
acagccccaacctc

SEQ ID NO: 1568423 - DNA, 12 bp, Homo sapiens
acagccccaccc

SEQ ID NO: 1568424 - DNA, 14 bp, Homo sapiens
acagccccaccctg

SEQ ID NO: 1568425 - DNA, 15 bp, Homo sapiens
acagccccaccctgg

SEQ ID NO: 1568426 - DNA, 11 bp, Homo sapiens
acagccccctt

SEQ ID NO: 1568427 - DNA, 19 bp, Homo sapiens
acagcccctcaaagacttt

SEQ ID NO: 1568428 - DNA, 16 bp, Homo sapiens
acagcccgctctctgg

SEQ ID NO: 1568429 - DNA, 18 bp, Homo sapiens
acagccctccactccagc

SEQ ID NO: 1568430 - DNA, 18 bp, Homo sapiens
acagccctgagtgtccca

SEQ ID NO: 1568431 - DNA, 12 bp, Homo sapiens
acagccctggga

SEQ ID NO: 1568432 - DNA, 15 bp, Homo sapiens
acagcccttttgtga

SEQ ID NO: 1568433 - DNA, 20 bp, Homo sapiens
acagcccttttgtgaacctt

SEQ ID NO: 1568434 - DNA, 22 bp, Homo sapiens
acagccgcagcctccctctgac

SEQ ID NO: 1568435 - DNA, 23 bp, Homo sapiens
acagccgcagcctccctctgacc

SEQ ID NO: 1568436 - DNA, 14 bp, Homo sapiens
acagccgctcctgt

SEQ ID NO: 1568437 - DNA, 17 bp, Homo sapiens
acagccgtcagccaaat

SEQ ID NO: 1568438 - DNA, 12 bp, Homo sapiens
acagcctagggt

SEQ ID NO: 1568439 - DNA, 14 bp, Homo sapiens
acagcctcacagaa

SEQ ID NO: 1568440 - DNA, 14 bp, Homo sapiens
acagcctctacagc

SEQ ID NO: 1568441 - DNA, 14 bp, Homo sapiens
acagcctcttactt

SEQ ID NO: 1568442 - DNA, 13 bp, Homo sapiens
acagcctcttttt

SEQ ID NO: 1568443 - DNA, 15 bp, Homo sapiens
acagcctgcacacac

SEQ ID NO: 1568444 - DNA, 23 bp, Homo sapiens
acagcctgcacacacctgcctgc

SEQ ID NO: 1568445 - DNA, 15 bp, Homo sapiens
acagcctggcacagg

SEQ ID NO: 1568446 - DNA, 12 bp, Homo sapiens
acagcctgggcc

SEQ ID NO: 1568447 - DNA, 20 bp, Homo sapiens
acagcctgtggcggtgcctg

SEQ ID NO: 1568448 - DNA, 14 bp, Homo sapiens
acagcctttctgag

SEQ ID NO: 1568449 - DNA, 18 bp, Homo sapiens
acagcgagactccgtctc

SEQ ID NO: 1568450 - DNA, 16 bp, Homo sapiens
acagcgctgagcatgg

SEQ ID NO: 1568451 - DNA, 15 bp, Homo sapiens
acagcggaggagacc

SEQ ID NO: 1568452 - DNA, 12 bp, Homo sapiens
acagcggccttg

SEQ ID NO: 1568453 - DNA, 21 bp, Homo sapiens
acagcgtccctagcagtgaac

SEQ ID NO: 1568454 - DNA, 23 bp, Homo sapiens
acagcgtccctagcagtgaacta

SEQ ID NO: 1568455 - DNA, 14 bp, Homo sapiens
acagcgtccctggc

SEQ ID NO: 1568456 - DNA, 23 bp, Homo sapiens
acagcgtccggggtggtggacag

SEQ ID NO: 1568457 - DNA, 12 bp, Homo sapiens
acagcgtctgct

SEQ ID NO: 1568458 - DNA, 22 bp, Homo sapiens
acagcgtctgctcataggacct

SEQ ID NO: 1568459 - DNA, 21 bp, Homo sapiens
acagctaattctactcacagt

SEQ ID NO: 1568460 - DNA, 20 bp, Homo sapiens
acagctacttctgggaaaaa

SEQ ID NO: 1568461 - DNA, 17 bp, Homo sapiens
acagctatatttgatta

SEQ ID NO: 1568462 - DNA, 22 bp, Homo sapiens
acagctatatttgattatgtat

SEQ ID NO: 1568463 - DNA, 17 bp, Homo sapiens
acagctatgggagcccc

SEQ ID NO: 1568464 - DNA, 12 bp, Homo sapiens
acagctcagctg

SEQ ID NO: 1568465 - DNA, 14 bp, Homo sapiens
acagctcagctgcc

SEQ ID NO: 1568466 - DNA, 14 bp, Homo sapiens
acagctcaggaggc

SEQ ID NO: 1568467 - DNA, 22 bp, Homo sapiens
acagctccgagctgtaggagag

SEQ ID NO: 1568468 - DNA, 23 bp, Homo sapiens
acagctcctcctcttggagctga

SEQ ID NO: 1568469 - DNA, 15 bp, Homo sapiens
acagctctggccaca

SEQ ID NO: 1568470 - DNA, 14 bp, Homo sapiens
acagctctgtagtt

SEQ ID NO: 1568471 - DNA, 14 bp, Homo sapiens
acagctcttcattc

SEQ ID NO: 1568472 - DNA, 22 bp, Homo sapiens
acagctgaggtctcttgaggga

SEQ ID NO: 1568473 - DNA, 16 bp, Homo sapiens
acagctgcattagaaa

SEQ ID NO: 1568474 - DNA, 12 bp, Homo sapiens
acagctgcccta

SEQ ID NO: 1568475 - DNA, 19 bp, Homo sapiens
acagctgccctagctgacc

SEQ ID NO: 1568476 - DNA, 14 bp, Homo sapiens
acagctgctggaga

SEQ ID NO: 1568477 - DNA, 13 bp, Homo sapiens
acagctgctggga

SEQ ID NO: 1568478 - DNA, 13 bp, Homo sapiens
acagctgcttgtg

SEQ ID NO: 1568479 - DNA, 13 bp, Homo sapiens
acagctggctctg

SEQ ID NO: 1568480 - DNA, 16 bp, Homo sapiens
acagctgggcagggtg

SEQ ID NO: 1568481 - DNA, 17 bp, Homo sapiens
acagctgggcagggtga

SEQ ID NO: 1568482 - DNA, 17 bp, Homo sapiens
acagctgtattgtctga

SEQ ID NO: 1568483 - DNA, 15 bp, Homo sapiens
acagctgtccctgtc

SEQ ID NO: 1568484 - DNA, 16 bp, Homo sapiens
acagctgtccctgtca

SEQ ID NO: 1568485 - DNA, 13 bp, Homo sapiens
acagctgtgtctg

SEQ ID NO: 1568486 - DNA, 22 bp, Homo sapiens
acagctgtgtctgccaaacaca

SEQ ID NO: 1568487 - DNA, 17 bp, Homo sapiens
acagcttcaccctgtca

SEQ ID NO: 1568488 - DNA, 15 bp, Homo sapiens
acagcttcagccagg

SEQ ID NO: 1568489 - DNA, 16 bp, Homo sapiens
acagcttcagtccatg

SEQ ID NO: 1568490 - DNA, 23 bp, Homo sapiens
acagcttcctcacacccctgtcc

SEQ ID NO: 1568491 - DNA, 13 bp, Homo sapiens
acagcttctggag

SEQ ID NO: 1568492 - DNA, 17 bp, Homo sapiens
acagcttgacctgaggc

SEQ ID NO: 1568493 - DNA, 14 bp, Homo sapiens
acagcttgccaggg

SEQ ID NO: 1568494 - DNA, 16 bp, Homo sapiens
acagcttgccagggat

SEQ ID NO: 1568495 - DNA, 19 bp, Homo sapiens
acagctttctgggatgtca

SEQ ID NO: 1568496 - DNA, 20 bp, Homo sapiens
acagctttctgggatgtcac

SEQ ID NO: 1568497 - DNA, 19 bp, Homo sapiens
acagctttgctccgctccc

SEQ ID NO: 1568498 - DNA, 21 bp, Homo sapiens
acagctttgctccgctcccac

SEQ ID NO: 1568499 - DNA, 21 bp, Homo sapiens
acagcttttgcaacttaatac

SEQ ID NO: 1568500 - DNA, 23 bp, Homo sapiens
acaggaaatgggaaaaaacttaa

SEQ ID NO: 1568501 - DNA, 15 bp, Homo sapiens
acaggaagctcagcc

SEQ ID NO: 1568502 - DNA, 17 bp, Homo sapiens
acaggaagctcagcctt

SEQ ID NO: 1568503 - DNA, 21 bp, Homo sapiens
acaggaagctggcagaacgga

SEQ ID NO: 1568504 - DNA, 22 bp, Homo sapiens
acaggaaggcaggaggggtgag

SEQ ID NO: 1568505 - DNA, 16 bp, Homo sapiens
acaggaagtagttcta

SEQ ID NO: 1568506 - DNA, 15 bp, Homo sapiens
acaggaatctcagag

SEQ ID NO: 1568507 - DNA, 19 bp, Homo sapiens
acaggaatctcagagacag

SEQ ID NO: 1568508 - DNA, 22 bp, Homo sapiens
acaggacagtgcttcagcctga

SEQ ID NO: 1568509 - DNA, 14 bp, Homo sapiens
acaggaccagattt

SEQ ID NO: 1568510 - DNA, 14 bp, Homo sapiens
acaggaccctcagg

SEQ ID NO: 1568511 - DNA, 20 bp, Homo sapiens
acaggactgtaaagatttgt

SEQ ID NO: 1568512 - DNA, 21 bp, Homo sapiens
acaggaggcaggcatggccct

SEQ ID NO: 1568513 - DNA, 13 bp, Homo sapiens
acaggaggcggcc

SEQ ID NO: 1568514 - DNA, 22 bp, Homo sapiens
acaggaggcggcccggccagcg

SEQ ID NO: 1568515 - DNA, 23 bp, Homo sapiens
acaggaggcggcccggccagcgg

SEQ ID NO: 1568516 - DNA, 14 bp, Homo sapiens
acaggagggccagc

SEQ ID NO: 1568517 - DNA, 23 bp, Homo sapiens
acaggaggttgtggatgctccag

SEQ ID NO: 1568518 - DNA, 21 bp, Homo sapiens
acaggagtcttcagacccaga

SEQ ID NO: 1568519 - DNA, 23 bp, Homo sapiens
acaggagtcttcagacccagaga

SEQ ID NO: 1568520 - DNA, 21 bp, Homo sapiens
acaggagtgtcctcttccctc

SEQ ID NO: 1568521 - DNA, 23 bp, Homo sapiens
acaggagtgtcctcttccctctc

SEQ ID NO: 1568522 - DNA, 19 bp, Homo sapiens
acaggataaagatatcaat

SEQ ID NO: 1568523 - DNA, 15 bp, Homo sapiens
acaggatattagaca

SEQ ID NO: 1568524 - DNA, 22 bp, Homo sapiens
acaggatctataggcagcttct

SEQ ID NO: 1568525 - DNA, 17 bp, Homo sapiens
acaggatgaggacagag

SEQ ID NO: 1568526 - DNA, 18 bp, Homo sapiens
acaggattgatcattctt

SEQ ID NO: 1568527 - DNA, 14 bp, Homo sapiens
acaggcaaatgcat

SEQ ID NO: 1568528 - DNA, 17 bp, Homo sapiens
acaggcacacagggccc

SEQ ID NO: 1568529 - DNA, 12 bp, Homo sapiens
acaggcactcca

SEQ ID NO: 1568530 - DNA, 20 bp, Homo sapiens
acaggcagcctcctttgtgt

SEQ ID NO: 1568531 - DNA, 22 bp, Homo sapiens
acaggcagcctcctttgtgtgt

SEQ ID NO: 1568532 - DNA, 13 bp, Homo sapiens
acaggcagtgcat

SEQ ID NO: 1568533 - DNA, 14 bp, Homo sapiens
acaggcagtgcatg

SEQ ID NO: 1568534 - DNA, 15 bp, Homo sapiens
acaggcagtgcatgt

SEQ ID NO: 1568535 - DNA, 16 bp, Homo sapiens
acaggcagtgcatgtg

SEQ ID NO: 1568536 - DNA, 17 bp, Homo sapiens
acaggcatctacacagc

SEQ ID NO: 1568537 - DNA, 19 bp, Homo sapiens
acaggcatgtgtcaccatg

SEQ ID NO: 1568538 - DNA, 18 bp, Homo sapiens
acaggcatttgttcactg

SEQ ID NO: 1568539 - DNA, 18 bp, Homo sapiens
acaggccatgtgagccac

SEQ ID NO: 1568540 - DNA, 13 bp, Homo sapiens
acaggcccagcat

SEQ ID NO: 1568541 - DNA, 15 bp, Homo sapiens
acaggcccagcattg

SEQ ID NO: 1568542 - DNA, 12 bp, Homo sapiens
acaggcccagcg

SEQ ID NO: 1568543 - DNA, 13 bp, Homo sapiens
acaggcccagcgc

SEQ ID NO: 1568544 - DNA, 20 bp, Homo sapiens
acaggcccagcgcggccagc

SEQ ID NO: 1568545 - DNA, 20 bp, Homo sapiens
acaggccccccgcagcaccc

SEQ ID NO: 1568546 - DNA, 12 bp, Homo sapiens
acaggccccctt

SEQ ID NO: 1568547 - DNA, 16 bp, Homo sapiens
acaggccccttttgtg

SEQ ID NO: 1568548 - DNA, 22 bp, Homo sapiens
acaggccctccctgttccccag

SEQ ID NO: 1568549 - DNA, 23 bp, Homo sapiens
acaggccctccctgttccccaga

SEQ ID NO: 1568550 - DNA, 15 bp, Homo sapiens
acaggcctctgcctg

SEQ ID NO: 1568551 - DNA, 16 bp, Homo sapiens
acaggcctctgcctgc

SEQ ID NO: 1568552 - DNA, 17 bp, Homo sapiens
acaggcctctgcctgct

SEQ ID NO: 1568553 - DNA, 21 bp, Homo sapiens
acaggcctctgcctgctgggg

SEQ ID NO: 1568554 - DNA, 17 bp, Homo sapiens
acaggcgggaggaggtg

SEQ ID NO: 1568555 - DNA, 21 bp, Homo sapiens
acaggcggggcccagcgctct

SEQ ID NO: 1568556 - DNA, 23 bp, Homo sapiens
acaggcggggcccagcgctctcc

SEQ ID NO: 1568557 - DNA, 21 bp, Homo sapiens
acaggctatcaacatgttatt

SEQ ID NO: 1568558 - DNA, 14 bp, Homo sapiens
acaggctctgaggg

SEQ ID NO: 1568559 - DNA, 15 bp, Homo sapiens
acaggctcttagcag

SEQ ID NO: 1568560 - DNA, 19 bp, Homo sapiens
acaggctgttctgcactga

SEQ ID NO: 1568561 - DNA, 20 bp, Homo sapiens
acagggacatgccctgtgtg

SEQ ID NO: 1568562 - DNA, 16 bp, Homo sapiens
acagggaccagggcca

SEQ ID NO: 1568563 - DNA, 18 bp, Homo sapiens
acagggacttgtttagag

SEQ ID NO: 1568564 - DNA, 22 bp, Homo sapiens
acagggacttgtttagagagcc

SEQ ID NO: 1568565 - DNA, 23 bp, Homo sapiens
acagggacttgtttagagagcct

SEQ ID NO: 1568566 - DNA, 23 bp, Homo sapiens
acagggagaaaatccaggtcatg

SEQ ID NO: 1568567 - DNA, 18 bp, Homo sapiens
acagggagaagtagctag

SEQ ID NO: 1568568 - DNA, 16 bp, Homo sapiens
acagggattgatttta

SEQ ID NO: 1568569 - DNA, 22 bp, Homo sapiens
acagggattgattttaaaatgt

SEQ ID NO: 1568570 - DNA, 15 bp, Homo sapiens
acagggcaaggacac

SEQ ID NO: 1568571 - DNA, 15 bp, Homo sapiens
acagggccacataga

SEQ ID NO: 1568572 - DNA, 18 bp, Homo sapiens
acagggcccgcagtgctg

SEQ ID NO: 1568573 - DNA, 19 bp, Homo sapiens
acagggcccgcagtgctgg

SEQ ID NO: 1568574 - DNA, 18 bp, Homo sapiens
acagggcccggccacacc

SEQ ID NO: 1568575 - DNA, 22 bp, Homo sapiens
acagggctctttgatggaccca

SEQ ID NO: 1568576 - DNA, 16 bp, Homo sapiens
acagggctgccttctg

SEQ ID NO: 1568577 - DNA, 20 bp, Homo sapiens
acaggggaaggtggcctctg

SEQ ID NO: 1568578 - DNA, 17 bp, Homo sapiens
acaggggcaggcctggg

SEQ ID NO: 1568579 - DNA, 19 bp, Homo sapiens
acaggggcggggcaggaat

SEQ ID NO: 1568580 - DNA, 15 bp, Homo sapiens
acagggtaggaaagg

SEQ ID NO: 1568581 - DNA, 14 bp, Homo sapiens
acagggtctgctct

SEQ ID NO: 1568582 - DNA, 15 bp, Homo sapiens
acagggtctgctctt

SEQ ID NO: 1568583 - DNA, 24 bp, Homo sapiens
acagggtctgctctttctctgcca

SEQ ID NO: 1568584 - DNA, 9 bp, Homo sapiens
acagggtgc

SEQ ID NO: 1568585 - DNA, 22 bp, Homo sapiens
acagggtggaccccctgagtca

SEQ ID NO: 1568586 - DNA, 16 bp, Homo sapiens
acagggttcaaaatgt

SEQ ID NO: 1568587 - DNA, 14 bp, Homo sapiens
acagggttttgtat

SEQ ID NO: 1568588 - DNA, 14 bp, Homo sapiens
acaggtaaaacagg

SEQ ID NO: 1568589 - DNA, 16 bp, Homo sapiens
acaggtaaaacagggc

SEQ ID NO: 1568590 - DNA, 18 bp, Homo sapiens
acaggtaaactatcttgg

SEQ ID NO: 1568591 - DNA, 19 bp, Homo sapiens
acaggtatttttttaaatc

SEQ ID NO: 1568592 - DNA, 19 bp, Homo sapiens
acaggtcatattaatatat

SEQ ID NO: 1568593 - DNA, 19 bp, Homo sapiens
acaggtcatcagatgcctg

SEQ ID NO: 1568594 - DNA, 13 bp, Homo sapiens
acaggtccctccc

SEQ ID NO: 1568595 - DNA, 15 bp, Homo sapiens
acaggtccctcccct

SEQ ID NO: 1568596 - DNA, 19 bp, Homo sapiens
acaggtggcctagcaggca

SEQ ID NO: 1568597 - DNA, 18 bp, Homo sapiens
acaggttacgaagacaaa

SEQ ID NO: 1568598 - DNA, 19 bp, Homo sapiens
acaggttcttaaaaaggaa

SEQ ID NO: 1568599 - DNA, 15 bp, Homo sapiens
acagtaaaccactga

SEQ ID NO: 1568600 - DNA, 17 bp, Homo sapiens
acagtaaaccactgaaa

SEQ ID NO: 1568601 - DNA, 21 bp, Homo sapiens
acagtaaaccactgaaaaaat

SEQ ID NO: 1568602 - DNA, 22 bp, Homo sapiens
acagtaacaaataaagtgcagt

SEQ ID NO: 1568603 - DNA, 18 bp, Homo sapiens
acagtaactttatgtgta

SEQ ID NO: 1568604 - DNA, 19 bp, Homo sapiens
acagtaactttatgtgtaa

SEQ ID NO: 1568605 - DNA, 18 bp, Homo sapiens
acagtaatacattccatt

SEQ ID NO: 1568606 - DNA, 21 bp, Homo sapiens
acagtaatctaggtgtggctg

SEQ ID NO: 1568607 - DNA, 12 bp, Homo sapiens
acagtacaataa

SEQ ID NO: 1568608 - DNA, 13 bp, Homo sapiens
acagtacaataat

SEQ ID NO: 1568609 - DNA, 18 bp, Homo sapiens
acagtacaataatgtact

SEQ ID NO: 1568610 - DNA, 19 bp, Homo sapiens
acagtacaataatgtactc

SEQ ID NO: 1568611 - DNA, 16 bp, Homo sapiens
acagtacacacaaaaa

SEQ ID NO: 1568612 - DNA, 16 bp, Homo sapiens
acagtacagaaggcaa

SEQ ID NO: 1568613 - DNA, 12 bp, Homo sapiens
acagtacatatg

SEQ ID NO: 1568614 - DNA, 17 bp, Homo sapiens
acagtacatatgtaatt

SEQ ID NO: 1568615 - DNA, 17 bp, Homo sapiens
acagtacctagctgtaa

SEQ ID NO: 1568616 - DNA, 17 bp, Homo sapiens
acagtacctgattgtat

SEQ ID NO: 1568617 - DNA, 19 bp, Homo sapiens
acagtacggatttgtccaa

SEQ ID NO: 1568618 - DNA, 16 bp, Homo sapiens
acagtactgttcccaa

SEQ ID NO: 1568619 - DNA, 20 bp, Homo sapiens
acagtactttccagcagtca

SEQ ID NO: 1568620 - DNA, 13 bp, Homo sapiens
acagtagagccag

SEQ ID NO: 1568621 - DNA, 15 bp, Homo sapiens
acagtagagccagct

SEQ ID NO: 1568622 - DNA, 14 bp, Homo sapiens
acagtaggattttt

SEQ ID NO: 1568623 - DNA, 13 bp, Homo sapiens
acagtaggtcccg

SEQ ID NO: 1568624 - DNA, 20 bp, Homo sapiens
acagtatccaatgtcttttg

SEQ ID NO: 1568625 - DNA, 15 bp, Homo sapiens
acagtatcccacatc

SEQ ID NO: 1568626 - DNA, 23 bp, Homo sapiens
acagtatgatgaaaataattttc

SEQ ID NO: 1568627 - DNA, 21 bp, Homo sapiens
acagtattatagacaaaagaa

SEQ ID NO: 1568628 - DNA, 23 bp, Homo sapiens
acagtattatgcctgagttataa

SEQ ID NO: 1568629 - DNA, 17 bp, Homo sapiens
acagtcaaaacagagat

SEQ ID NO: 1568630 - DNA, 22 bp, Homo sapiens
acagtcaaatatcatttactct

SEQ ID NO: 1568631 - DNA, 14 bp, Homo sapiens
acagtcactgctct

SEQ ID NO: 1568632 - DNA, 21 bp, Homo sapiens
acagtcagtggagcctgggtg

SEQ ID NO: 1568633 - DNA, 15 bp, Homo sapiens
acagtcataaatact

SEQ ID NO: 1568634 - DNA, 14 bp, Homo sapiens
acagtcatggcctg

SEQ ID NO: 1568635 - DNA, 19 bp, Homo sapiens
acagtcattctaggatgtg

SEQ ID NO: 1568636 - DNA, 13 bp, Homo sapiens
acagtcatttaaa

SEQ ID NO: 1568637 - DNA, 13 bp, Homo sapiens
acagtccacaggg

SEQ ID NO: 1568638 - DNA, 17 bp, Homo sapiens
acagtccacaggggcca

SEQ ID NO: 1568639 - DNA, 12 bp, Homo sapiens
acagtcctggga

SEQ ID NO: 1568640 - DNA, 22 bp, Homo sapiens
acagtcctgggagaacctcagg

SEQ ID NO: 1568641 - DNA, 15 bp, Homo sapiens
acagtccttgctttg

SEQ ID NO: 1568642 - DNA, 15 bp, Homo sapiens
acagtctcaggaaat

SEQ ID NO: 1568643 - DNA, 16 bp, Homo sapiens
acagtctcaggaaatc

SEQ ID NO: 1568644 - DNA, 14 bp, Homo sapiens
acagtctctttaat

SEQ ID NO: 1568645 - DNA, 20 bp, Homo sapiens
acagtctctttaatcttcag

SEQ ID NO: 1568646 - DNA, 13 bp, Homo sapiens
acagtctgtcatg

SEQ ID NO: 1568647 - DNA, 17 bp, Homo sapiens
acagtctgttatgcact

SEQ ID NO: 1568648 - DNA, 21 bp, Homo sapiens
acagtgaagcagcactgtgag

SEQ ID NO: 1568649 - DNA, 19 bp, Homo sapiens
acagtgaatgtgtctggac

SEQ ID NO: 1568650 - DNA, 14 bp, Homo sapiens
acagtgaattgtct

SEQ ID NO: 1568651 - DNA, 15 bp, Homo sapiens
acagtgaattgtctt

SEQ ID NO: 1568652 - DNA, 18 bp, Homo sapiens
acagtgaattgtctttta

SEQ ID NO: 1568653 - DNA, 16 bp, Homo sapiens
acagtgacccttccca

SEQ ID NO: 1568654 - DNA, 14 bp, Homo sapiens
acagtgacttctga

SEQ ID NO: 1568655 - DNA, 17 bp, Homo sapiens
acagtgacttggcccca

SEQ ID NO: 1568656 - DNA, 19 bp, Homo sapiens
acagtgacttggccccaga

SEQ ID NO: 1568657 - DNA, 23 bp, Homo sapiens
acagtgacttggccccagacgca

SEQ ID NO: 1568658 - DNA, 14 bp, Homo sapiens
acagtgaggagggt

SEQ ID NO: 1568659 - DNA, 17 bp, Homo sapiens
acagtgaggcaggagaa

SEQ ID NO: 1568660 - DNA, 19 bp, Homo sapiens
acagtgatctccatatgtt

SEQ ID NO: 1568661 - DNA, 10 bp, Homo sapiens
acagtgattt

SEQ ID NO: 1568662 - DNA, 14 bp, Homo sapiens
acagtgcagacagg

SEQ ID NO: 1568663 - DNA, 19 bp, Homo sapiens
acagtgcagagccttctca

SEQ ID NO: 1568664 - DNA, 20 bp, Homo sapiens
acagtgcagagccttctcag

SEQ ID NO: 1568665 - DNA, 21 bp, Homo sapiens
acagtgcagagccttctcaga

SEQ ID NO: 1568666 - DNA, 14 bp, Homo sapiens
acagtgcagaggct

SEQ ID NO: 1568667 - DNA, 18 bp, Homo sapiens
acagtgccaggaaagagt

SEQ ID NO: 1568668 - DNA, 19 bp, Homo sapiens
acagtgccaggaaagagtg

SEQ ID NO: 1568669 - DNA, 19 bp, Homo sapiens
acagtgccatccccacctt

SEQ ID NO: 1568670 - DNA, 17 bp, Homo sapiens
acagtgcctcttccagt

SEQ ID NO: 1568671 - DNA, 19 bp, Homo sapiens
acagtgcctcttccagtga

SEQ ID NO: 1568672 - DNA, 18 bp, Homo sapiens
acagtgcctgggaatgta

SEQ ID NO: 1568673 - DNA, 20 bp, Homo sapiens
acagtgcctgggaatgtatt

SEQ ID NO: 1568674 - DNA, 15 bp, Homo sapiens
acagtgctctaggct

SEQ ID NO: 1568675 - DNA, 15 bp, Homo sapiens
acagtgctcttttct

SEQ ID NO: 1568676 - DNA, 21 bp, Homo sapiens
acagtgctcttttctcctcac

SEQ ID NO: 1568677 - DNA, 12 bp, Homo sapiens
acagtgctgctt

SEQ ID NO: 1568678 - DNA, 13 bp, Homo sapiens
acagtgctgtgtg

SEQ ID NO: 1568679 - DNA, 21 bp, Homo sapiens
acagtgcttttaagtgaaaat

SEQ ID NO: 1568680 - DNA, 22 bp, Homo sapiens
acagtggaagtttttttttcct

SEQ ID NO: 1568681 - DNA, 18 bp, Homo sapiens
acagtggaatataaggaa

SEQ ID NO: 1568682 - DNA, 19 bp, Homo sapiens
acagtggactcagcagtga

SEQ ID NO: 1568683 - DNA, 21 bp, Homo sapiens
acagtggactcagcagtgacc

SEQ ID NO: 1568684 - DNA, 15 bp, Homo sapiens
acagtggatcacaaa

SEQ ID NO: 1568685 - DNA, 17 bp, Homo sapiens
acagtggatcacaaagt

SEQ ID NO: 1568686 - DNA, 17 bp, Homo sapiens
acagtggattgcatttc

SEQ ID NO: 1568687 - DNA, 22 bp, Homo sapiens
acagtggcacggagagaaggcc

SEQ ID NO: 1568688 - DNA, 16 bp, Homo sapiens
acagtggcgcatgcct

SEQ ID NO: 1568689 - DNA, 13 bp, Homo sapiens
acagtgggagcca

SEQ ID NO: 1568690 - DNA, 17 bp, Homo sapiens
acagtgggagctgagct

SEQ ID NO: 1568691 - DNA, 17 bp, Homo sapiens
acagtgggcaggaggcc

SEQ ID NO: 1568692 - DNA, 21 bp, Homo sapiens
acagtgggcaggaggccccag

SEQ ID NO: 1568693 - DNA, 19 bp, Homo sapiens
acagtgggcgttgggagcc

SEQ ID NO: 1568694 - DNA, 15 bp, Homo sapiens
acagtggttgcctgg

SEQ ID NO: 1568695 - DNA, 16 bp, Homo sapiens
acagtggttgcctggg

SEQ ID NO: 1568696 - DNA, 20 bp, Homo sapiens
acagtggttttatactgaag

SEQ ID NO: 1568697 - DNA, 22 bp, Homo sapiens
acagtggttttatactgaagga

SEQ ID NO: 1568698 - DNA, 16 bp, Homo sapiens
acagtgtacatgtaca

SEQ ID NO: 1568699 - DNA, 19 bp, Homo sapiens
acagtgtacatgtacatag

SEQ ID NO: 1568700 - DNA, 12 bp, Homo sapiens
acagtgtctgtt

SEQ ID NO: 1568701 - DNA, 18 bp, Homo sapiens
acagtgtctgttcagcaa

SEQ ID NO: 1568702 - DNA, 21 bp, Homo sapiens
acagtgtctgttcagcaaact

SEQ ID NO: 1568703 - DNA, 22 bp, Homo sapiens
acagtgtggtttgggaaagatg

SEQ ID NO: 1568704 - DNA, 21 bp, Homo sapiens
acagtgttagtgctggtcaga

SEQ ID NO: 1568705 - DNA, 15 bp, Homo sapiens
acagtgtttcccata

SEQ ID NO: 1568706 - DNA, 16 bp, Homo sapiens
acagtgtttcccataa

SEQ ID NO: 1568707 - DNA, 23 bp, Homo sapiens
acagtgtttcccataattttctt

SEQ ID NO: 1568708 - DNA, 14 bp, Homo sapiens
acagttacagttga

SEQ ID NO: 1568709 - DNA, 21 bp, Homo sapiens
acagttagggttttgcaataa

SEQ ID NO: 1568710 - DNA, 23 bp, Homo sapiens
acagttagggttttgcaataact

SEQ ID NO: 1568711 - DNA, 21 bp, Homo sapiens
acagttatgtgggtggcttct

SEQ ID NO: 1568712 - DNA, 21 bp, Homo sapiens
acagttatttcatcttttatt

SEQ ID NO: 1568713 - DNA, 12 bp, Homo sapiens
acagttcaagaa

SEQ ID NO: 1568714 - DNA, 15 bp, Homo sapiens
acagttctgaagaat

SEQ ID NO: 1568715 - DNA, 19 bp, Homo sapiens
acagttctgagctgtaatt

SEQ ID NO: 1568716 - DNA, 17 bp, Homo sapiens
acagttctttcctcttt

SEQ ID NO: 1568717 - DNA, 20 bp, Homo sapiens
acagttctttcctctttctg

SEQ ID NO: 1568718 - DNA, 21 bp, Homo sapiens
acagttctttcctctttctgc

SEQ ID NO: 1568719 - DNA, 22 bp, Homo sapiens
acagttctttcctctttctgct

SEQ ID NO: 1568720 - DNA, 18 bp, Homo sapiens
acagttctttgggccaga

SEQ ID NO: 1568721 - DNA, 21 bp, Homo sapiens
acagttctttgggccagacat

SEQ ID NO: 1568722 - DNA, 22 bp, Homo sapiens
acagttgaagggaggggctgtg

SEQ ID NO: 1568723 - DNA, 15 bp, Homo sapiens
acagttgaattttaa

SEQ ID NO: 1568724 - DNA, 13 bp, Homo sapiens
acagttgcatgta

SEQ ID NO: 1568725 - DNA, 13 bp, Homo sapiens
acagttgctgtga

SEQ ID NO: 1568726 - DNA, 23 bp, Homo sapiens
acagttgctgtgaactttcatgt

SEQ ID NO: 1568727 - DNA, 13 bp, Homo sapiens
acagttggcagag

SEQ ID NO: 1568728 - DNA, 16 bp, Homo sapiens
acagttggtaactttt

SEQ ID NO: 1568729 - DNA, 24 bp, Homo sapiens
acagttggtaacttttgtgaatta

SEQ ID NO: 1568730 - DNA, 22 bp, Homo sapiens
acagttgtatttaacagaaatt

SEQ ID NO: 1568731 - DNA, 20 bp, Homo sapiens
acagttgtctattctgagcc

SEQ ID NO: 1568732 - DNA, 19 bp, Homo sapiens
acagtttaccagttgcctt

SEQ ID NO: 1568733 - DNA, 19 bp, Homo sapiens
acagttttaactgtggata

SEQ ID NO: 1568734 - DNA, 19 bp, Homo sapiens
acagttttaataagaacag

SEQ ID NO: 1568735 - DNA, 23 bp, Homo sapiens
acagttttagaataaggaggagg

SEQ ID NO: 1568736 - DNA, 15 bp, Homo sapiens
acagttttctgagaa

SEQ ID NO: 1568737 - DNA, 16 bp, Homo sapiens
acagttttctgagaaa

SEQ ID NO: 1568738 - DNA, 17 bp, Homo sapiens
acagttttctgagaaag

SEQ ID NO: 1568739 - DNA, 19 bp, Homo sapiens
acagttttctgagaaagac

SEQ ID NO: 1568740 - DNA, 15 bp, Homo sapiens
acagttttgaaagaa

SEQ ID NO: 1568741 - DNA, 14 bp, Homo sapiens
acagtttttaaact

SEQ ID NO: 1568742 - DNA, 14 bp, Homo sapiens
acagtttttcctgg

SEQ ID NO: 1568743 - DNA, 16 bp, Homo sapiens
acagtttttgtaacca

SEQ ID NO: 1568744 - DNA, 20 bp, Homo sapiens
acataaaaagcagaatttta

SEQ ID NO: 1568745 - DNA, 12 bp, Homo sapiens
acataaaacaaa

SEQ ID NO: 1568746 - DNA, 17 bp, Homo sapiens
acataaaatttacattt

SEQ ID NO: 1568747 - DNA, 20 bp, Homo sapiens
acataaaatttacatttaat

SEQ ID NO: 1568748 - DNA, 21 bp, Homo sapiens
acataaagcaaatagacacag

SEQ ID NO: 1568749 - DNA, 13 bp, Homo sapiens
acataaatctgtc

SEQ ID NO: 1568750 - DNA, 16 bp, Homo sapiens
acataacataaatttt

SEQ ID NO: 1568751 - DNA, 14 bp, Homo sapiens
acataactgcttct

SEQ ID NO: 1568752 - DNA, 15 bp, Homo sapiens
acataactgcttctt

SEQ ID NO: 1568753 - DNA, 22 bp, Homo sapiens
acataacttgatatagaaagct

SEQ ID NO: 1568754 - DNA, 16 bp, Homo sapiens
acataagaaggcaatt

SEQ ID NO: 1568755 - DNA, 17 bp, Homo sapiens
acataagaaggcaattt

SEQ ID NO: 1568756 - DNA, 15 bp, Homo sapiens
acataagataaatgt

SEQ ID NO: 1568757 - DNA, 16 bp, Homo sapiens
acataaggatgacttt

SEQ ID NO: 1568758 - DNA, 15 bp, Homo sapiens
acataagtaattcaa

SEQ ID NO: 1568759 - DNA, 20 bp, Homo sapiens
acataagtaattcaagaaaa

SEQ ID NO: 1568760 - DNA, 23 bp, Homo sapiens
acataataaaaaattatgacaat

SEQ ID NO: 1568761 - DNA, 16 bp, Homo sapiens
acataatatatgactt

SEQ ID NO: 1568762 - DNA, 19 bp, Homo sapiens
acataatatatgacttcct

SEQ ID NO: 1568763 - DNA, 20 bp, Homo sapiens
acataatgtatcatgaagaa

SEQ ID NO: 1568764 - DNA, 19 bp, Homo sapiens
acataattaaattttgagt

SEQ ID NO: 1568765 - DNA, 21 bp, Homo sapiens
acataattctgttactttgct

SEQ ID NO: 1568766 - DNA, 21 bp, Homo sapiens
acatacaaaaattagccgggc

SEQ ID NO: 1568767 - DNA, 17 bp, Homo sapiens
acatacaacacaaagag

SEQ ID NO: 1568768 - DNA, 16 bp, Homo sapiens
acatacaattccaaac

SEQ ID NO: 1568769 - DNA, 18 bp, Homo sapiens
acatacagattttaccta

SEQ ID NO: 1568770 - DNA, 20 bp, Homo sapiens
acatacaggaaggtagaaat

SEQ ID NO: 1568771 - DNA, 17 bp, Homo sapiens
acatacataatacaatg

SEQ ID NO: 1568772 - DNA, 15 bp, Homo sapiens
acatacatgtcacat

SEQ ID NO: 1568773 - DNA, 20 bp, Homo sapiens
acataccaggcaacctccca

SEQ ID NO: 1568774 - DNA, 21 bp, Homo sapiens
acataccaggcaacctcccat

SEQ ID NO: 1568775 - DNA, 22 bp, Homo sapiens
acataccaggcaacctcccatc

SEQ ID NO: 1568776 - DNA, 20 bp, Homo sapiens
acataccctggccgccccct

SEQ ID NO: 1568777 - DNA, 17 bp, Homo sapiens
acatacgaaacacaaac

SEQ ID NO: 1568778 - DNA, 15 bp, Homo sapiens
acatacgtgcacagg

SEQ ID NO: 1568779 - DNA, 14 bp, Homo sapiens
acatactgcatgta

SEQ ID NO: 1568780 - DNA, 18 bp, Homo sapiens
acatactggcctggactg

SEQ ID NO: 1568781 - DNA, 19 bp, Homo sapiens
acatactggcctggactgt

SEQ ID NO: 1568782 - DNA, 17 bp, Homo sapiens
acatactgtgttccaat

SEQ ID NO: 1568783 - DNA, 18 bp, Homo sapiens
acatacttgaagggccag

SEQ ID NO: 1568784 - DNA, 22 bp, Homo sapiens
acatacttgaagggccagagcc

SEQ ID NO: 1568785 - DNA, 12 bp, Homo sapiens
acatagaaatgg

SEQ ID NO: 1568786 - DNA, 18 bp, Homo sapiens
acatagacttaggcatta

SEQ ID NO: 1568787 - DNA, 17 bp, Homo sapiens
acatagagctttttaat

SEQ ID NO: 1568788 - DNA, 18 bp, Homo sapiens
acatagattaatggcact

SEQ ID NO: 1568789 - DNA, 19 bp, Homo sapiens
acatagcatgacatttctt

SEQ ID NO: 1568790 - DNA, 21 bp, Homo sapiens
acatagcatgacatttctttg

SEQ ID NO: 1568791 - DNA, 22 bp, Homo sapiens
acatagcatgcttcctttctct

SEQ ID NO: 1568792 - DNA, 16 bp, Homo sapiens
acatagccctaactcc

SEQ ID NO: 1568793 - DNA, 21 bp, Homo sapiens
acatagcttacaagccagctg

SEQ ID NO: 1568794 - DNA, 14 bp, Homo sapiens
acatagtaaagtat

SEQ ID NO: 1568795 - DNA, 23 bp, Homo sapiens
acatagtgaaaattgtttagtga

SEQ ID NO: 1568796 - DNA, 13 bp, Homo sapiens
acatagtgacatg

SEQ ID NO: 1568797 - DNA, 20 bp, Homo sapiens
acatataaacatcacacaca

SEQ ID NO: 1568798 - DNA, 23 bp, Homo sapiens
acatataatgttgttatttaaag

SEQ ID NO: 1568799 - DNA, 15 bp, Homo sapiens
acatatacatatgag

SEQ ID NO: 1568800 - DNA, 15 bp, Homo sapiens
acatatatgtataat

SEQ ID NO: 1568801 - DNA, 17 bp, Homo sapiens
acatatatgtataatat

SEQ ID NO: 1568802 - DNA, 15 bp, Homo sapiens
acatatcccttccag

SEQ ID NO: 1568803 - DNA, 16 bp, Homo sapiens
acatatcccttccaga

SEQ ID NO: 1568804 - DNA, 14 bp, Homo sapiens
acatatctaaagtc

SEQ ID NO: 1568805 - DNA, 15 bp, Homo sapiens
acatatctaaagtca

SEQ ID NO: 1568806 - DNA, 15 bp, Homo sapiens
acatatgcaccttgt

SEQ ID NO: 1568807 - DNA, 20 bp, Homo sapiens
acatatgcaccttgtgtctg

SEQ ID NO: 1568808 - DNA, 12 bp, Homo sapiens
acatatgcagtg

SEQ ID NO: 1568809 - DNA, 22 bp, Homo sapiens
acatatgcagtgtgatccagtt

SEQ ID NO: 1568810 - DNA, 23 bp, Homo sapiens
acatatgctgatcttttaaaatc

SEQ ID NO: 1568811 - DNA, 13 bp, Homo sapiens
acatatggaattt

SEQ ID NO: 1568812 - DNA, 23 bp, Homo sapiens
acatatggactctgcacatgaat

SEQ ID NO: 1568813 - DNA, 14 bp, Homo sapiens
acatatgtaaaata

SEQ ID NO: 1568814 - DNA, 13 bp, Homo sapiens
acatatgtagata

SEQ ID NO: 1568815 - DNA, 23 bp, Homo sapiens
acatattcttgctttcacaaata

SEQ ID NO: 1568816 - DNA, 12 bp, Homo sapiens
acatattgttag

SEQ ID NO: 1568817 - DNA, 18 bp, Homo sapiens
acatatttttatacttta

SEQ ID NO: 1568818 - DNA, 22 bp, Homo sapiens
acatatttttatactttattga

SEQ ID NO: 1568819 - DNA, 14 bp, Homo sapiens
acatcaaagcctgg

SEQ ID NO: 1568820 - DNA, 15 bp, Homo sapiens
acatcaaagcctggc

SEQ ID NO: 1568821 - DNA, 20 bp, Homo sapiens
acatcaaagtggtaaatact

SEQ ID NO: 1568822 - DNA, 21 bp, Homo sapiens
acatcaaagtggtaaatactg

SEQ ID NO: 1568823 - DNA, 14 bp, Homo sapiens
acatcaaataagaa

SEQ ID NO: 1568824 - DNA, 16 bp, Homo sapiens
acatcaacatcttggt

SEQ ID NO: 1568825 - DNA, 12 bp, Homo sapiens
acatcaatgaaa

SEQ ID NO: 1568826 - DNA, 13 bp, Homo sapiens
acatcaatgaaac

SEQ ID NO: 1568827 - DNA, 15 bp, Homo sapiens
acatcacagggtggg

SEQ ID NO: 1568828 - DNA, 17 bp, Homo sapiens
acatcactaatttggct

SEQ ID NO: 1568829 - DNA, 15 bp, Homo sapiens
acatcagaaaggaat

SEQ ID NO: 1568830 - DNA, 20 bp, Homo sapiens
acatcagaaataataaaaaa

SEQ ID NO: 1568831 - DNA, 21 bp, Homo sapiens
acatcagacctgtcttccaag

SEQ ID NO: 1568832 - DNA, 14 bp, Homo sapiens
acatcaggagttca

SEQ ID NO: 1568833 - DNA, 20 bp, Homo sapiens
acatcagttactctgaaggg

SEQ ID NO: 1568834 - DNA, 19 bp, Homo sapiens
acatcataattacattcct

SEQ ID NO: 1568835 - DNA, 20 bp, Homo sapiens
acatcataattacattccta

SEQ ID NO: 1568836 - DNA, 21 bp, Homo sapiens
acatcataattacattcctaa

SEQ ID NO: 1568837 - DNA, 22 bp, Homo sapiens
acatcatcgctcccaaaggaaa

SEQ ID NO: 1568838 - DNA, 22 bp, Homo sapiens
acatcatggactgagctggggg

SEQ ID NO: 1568839 - DNA, 16 bp, Homo sapiens
acatcatgttatttta

SEQ ID NO: 1568840 - DNA, 12 bp, Homo sapiens
acatcatttctt

SEQ ID NO: 1568841 - DNA, 13 bp, Homo sapiens
acatccaaatcta

SEQ ID NO: 1568842 - DNA, 14 bp, Homo sapiens
acatccaaggagaa

SEQ ID NO: 1568843 - DNA, 21 bp, Homo sapiens
acatccagagctttgtcgtat

SEQ ID NO: 1568844 - DNA, 12 bp, Homo sapiens
acatccagcaga

SEQ ID NO: 1568845 - DNA, 20 bp, Homo sapiens
acatccatttcatctatttc

SEQ ID NO: 1568846 - DNA, 16 bp, Homo sapiens
acatcccagaccagcc

SEQ ID NO: 1568847 - DNA, 13 bp, Homo sapiens
acatcccagcctg

SEQ ID NO: 1568848 - DNA, 18 bp, Homo sapiens
acatcccagcctgtggtt

SEQ ID NO: 1568849 - DNA, 16 bp, Homo sapiens
acatccccagaatcca

SEQ ID NO: 1568850 - DNA, 13 bp, Homo sapiens
acatccctccccc

SEQ ID NO: 1568851 - DNA, 15 bp, Homo sapiens
acatcccttcctgga

SEQ ID NO: 1568852 - DNA, 16 bp, Homo sapiens
acatccgcgtgtgcct

SEQ ID NO: 1568853 - DNA, 21 bp, Homo sapiens
acatccgcgtgtgcctgtgtg

SEQ ID NO: 1568854 - DNA, 21 bp, Homo sapiens
acatcctagaggtagagaaac

SEQ ID NO: 1568855 - DNA, 17 bp, Homo sapiens
acatcctttctaaacaa

SEQ ID NO: 1568856 - DNA, 18 bp, Homo sapiens
acatcctttctaaacaag

SEQ ID NO: 1568857 - DNA, 20 bp, Homo sapiens
acatcctttcttttaatgat

SEQ ID NO: 1568858 - DNA, 22 bp, Homo sapiens
acatcgcaatagttttttactt

SEQ ID NO: 1568859 - DNA, 14 bp, Homo sapiens
acatctaattaaat

SEQ ID NO: 1568860 - DNA, 19 bp, Homo sapiens
acatctaattaaatgtaga

SEQ ID NO: 1568861 - DNA, 14 bp, Homo sapiens
acatctattctctc

SEQ ID NO: 1568862 - DNA, 20 bp, Homo sapiens
acatctcgagccccctggat

SEQ ID NO: 1568863 - DNA, 13 bp, Homo sapiens
acatctctggaaa

SEQ ID NO: 1568864 - DNA, 14 bp, Homo sapiens
acatctgaaaagaa

SEQ ID NO: 1568865 - DNA, 18 bp, Homo sapiens
acatctgaaaagaaatgc

SEQ ID NO: 1568866 - DNA, 20 bp, Homo sapiens
acatctgcaatatgaattca

SEQ ID NO: 1568867 - DNA, 16 bp, Homo sapiens
acatctgggtgccctg

SEQ ID NO: 1568868 - DNA, 17 bp, Homo sapiens
acatctgtgtttcaagt

SEQ ID NO: 1568869 - DNA, 18 bp, Homo sapiens
acatctgtttcaaactga

SEQ ID NO: 1568870 - DNA, 15 bp, Homo sapiens
acatcttaaattcat

SEQ ID NO: 1568871 - DNA, 16 bp, Homo sapiens
acatcttatttcctca

SEQ ID NO: 1568872 - DNA, 16 bp, Homo sapiens
acatcttcagcaaata

SEQ ID NO: 1568873 - DNA, 23 bp, Homo sapiens
acatcttgcattcaaaatcttca

SEQ ID NO: 1568874 - DNA, 19 bp, Homo sapiens
acatcttggtcagatttga

SEQ ID NO: 1568875 - DNA, 21 bp, Homo sapiens
acatctttaacatagtcctgt

SEQ ID NO: 1568876 - DNA, 15 bp, Homo sapiens
acatctttactcagg

SEQ ID NO: 1568877 - DNA, 19 bp, Homo sapiens
acatctttattgaaattct

SEQ ID NO: 1568878 - DNA, 12 bp, Homo sapiens
acatctttcaca

SEQ ID NO: 1568879 - DNA, 13 bp, Homo sapiens
acatctttcacat

SEQ ID NO: 1568880 - DNA, 13 bp, Homo sapiens
acatctttcttga

SEQ ID NO: 1568881 - DNA, 15 bp, Homo sapiens
acatcttttcctgat

SEQ ID NO: 1568882 - DNA, 12 bp, Homo sapiens
acatcttttcta

SEQ ID NO: 1568883 - DNA, 14 bp, Homo sapiens
acatcttttctaat

SEQ ID NO: 1568884 - DNA, 22 bp, Homo sapiens
acatcttttctaatcacagtgt

SEQ ID NO: 1568885 - DNA, 24 bp, Homo sapiens
acatcttttcttgcctctgtcccc

SEQ ID NO: 1568886 - DNA, 18 bp, Homo sapiens
acatcttttggaagtttt

SEQ ID NO: 1568887 - DNA, 23 bp, Homo sapiens
acatgaaaaaaggacaatttcaa

SEQ ID NO: 1568888 - DNA, 16 bp, Homo sapiens
acatgaaactgcctat

SEQ ID NO: 1568889 - DNA, 12 bp, Homo sapiens
acatgaaatgaa

SEQ ID NO: 1568890 - DNA, 14 bp, Homo sapiens
acatgaacagcttg

SEQ ID NO: 1568891 - DNA, 22 bp, Homo sapiens
acatgaagcaattagtctgaaa

SEQ ID NO: 1568892 - DNA, 13 bp, Homo sapiens
acatgaagctgtt

SEQ ID NO: 1568893 - DNA, 19 bp, Homo sapiens
acatgaagctgttgtgtga

SEQ ID NO: 1568894 - DNA, 15 bp, Homo sapiens
acatgaataatttca

SEQ ID NO: 1568895 - DNA, 12 bp, Homo sapiens
acatgacactga

SEQ ID NO: 1568896 - DNA, 20 bp, Homo sapiens
acatgacccagcctgaaaga

SEQ ID NO: 1568897 - DNA, 14 bp, Homo sapiens
acatgacctccatt

SEQ ID NO: 1568898 - DNA, 16 bp, Homo sapiens
acatgaccttaatgga

SEQ ID NO: 1568899 - DNA, 19 bp, Homo sapiens
acatgagatggagaggctg

SEQ ID NO: 1568900 - DNA, 23 bp, Homo sapiens
acatgagatgtgtggactgtggc

SEQ ID NO: 1568901 - DNA, 18 bp, Homo sapiens
acatgaggaagtagctgt

SEQ ID NO: 1568902 - DNA, 13 bp, Homo sapiens
acatgaggacaga

SEQ ID NO: 1568903 - DNA, 15 bp, Homo sapiens
acatgaggacagaag

SEQ ID NO: 1568904 - DNA, 18 bp, Homo sapiens
acatgaggacagaaggac

SEQ ID NO: 1568905 - DNA, 21 bp, Homo sapiens
acatgaggacatgatggagcg

SEQ ID NO: 1568906 - DNA, 21 bp, Homo sapiens
acatgaggccatctcaggaga

SEQ ID NO: 1568907 - DNA, 18 bp, Homo sapiens
acatgatgaaaaattata

SEQ ID NO: 1568908 - DNA, 15 bp, Homo sapiens
acatgcaaacaggtt

SEQ ID NO: 1568909 - DNA, 12 bp, Homo sapiens
acatgcaacaga

SEQ ID NO: 1568910 - DNA, 16 bp, Homo sapiens
acatgcaacagaagtg

SEQ ID NO: 1568911 - DNA, 16 bp, Homo sapiens
acatgcaataaaattt

SEQ ID NO: 1568912 - DNA, 21 bp, Homo sapiens
acatgcacacacttgcataca

SEQ ID NO: 1568913 - DNA, 15 bp, Homo sapiens
acatgcacatttata

SEQ ID NO: 1568914 - DNA, 18 bp, Homo sapiens
acatgcacatttatatat

SEQ ID NO: 1568915 - DNA, 19 bp, Homo sapiens
acatgcactgacccttcca

SEQ ID NO: 1568916 - DNA, 18 bp, Homo sapiens
acatgcagcccatgccca

SEQ ID NO: 1568917 - DNA, 12 bp, Homo sapiens
acatgcatttga

SEQ ID NO: 1568918 - DNA, 17 bp, Homo sapiens
acatgcatttgaggtca

SEQ ID NO: 1568919 - DNA, 14 bp, Homo sapiens
acatgccacaagga

SEQ ID NO: 1568920 - DNA, 15 bp, Homo sapiens
acatgccccaggctc

SEQ ID NO: 1568921 - DNA, 12 bp, Homo sapiens
acatgccccctg

SEQ ID NO: 1568922 - DNA, 18 bp, Homo sapiens
acatgccctcctggacaa

SEQ ID NO: 1568923 - DNA, 21 bp, Homo sapiens
acatgcctgccccaaacaaat

SEQ ID NO: 1568924 - DNA, 23 bp, Homo sapiens
acatgctatgttctgtcttccca

SEQ ID NO: 1568925 - DNA, 14 bp, Homo sapiens
acatgctggaaata

SEQ ID NO: 1568926 - DNA, 21 bp, Homo sapiens
acatgctggtgaatattttca

SEQ ID NO: 1568927 - DNA, 18 bp, Homo sapiens
acatgctgtgctctttga

SEQ ID NO: 1568928 - DNA, 20 bp, Homo sapiens
acatgctgtgctctttgaag

SEQ ID NO: 1568929 - DNA, 21 bp, Homo sapiens
acatgctgtgctctttgaaga

SEQ ID NO: 1568930 - DNA, 14 bp, Homo sapiens
acatgcttttactt

SEQ ID NO: 1568931 - DNA, 20 bp, Homo sapiens
acatgcttttctgccactcc

SEQ ID NO: 1568932 - DNA, 21 bp, Homo sapiens
acatgcttttctgccactcca

SEQ ID NO: 1568933 - DNA, 18 bp, Homo sapiens
acatggaataacatgtaa

SEQ ID NO: 1568934 - DNA, 23 bp, Homo sapiens
acatggacccaagataaaagaat

SEQ ID NO: 1568935 - DNA, 16 bp, Homo sapiens
acatggacccactacc

SEQ ID NO: 1568936 - DNA, 22 bp, Homo sapiens
acatggacccactacccttctc

SEQ ID NO: 1568937 - DNA, 14 bp, Homo sapiens
acatggagaaatct

SEQ ID NO: 1568938 - DNA, 15 bp, Homo sapiens
acatggagactcctg

SEQ ID NO: 1568939 - DNA, 16 bp, Homo sapiens
acatggagactcctgc

SEQ ID NO: 1568940 - DNA, 22 bp, Homo sapiens
acatggagactcctgccctgtt

SEQ ID NO: 1568941 - DNA, 14 bp, Homo sapiens
acatggaggttcta

SEQ ID NO: 1568942 - DNA, 15 bp, Homo sapiens
acatggaggttctaa

SEQ ID NO: 1568943 - DNA, 16 bp, Homo sapiens
acatggaggttctaag

SEQ ID NO: 1568944 - DNA, 19 bp, Homo sapiens
acatggagtatatgtcaag

SEQ ID NO: 1568945 - DNA, 13 bp, Homo sapiens
acatggctggcct

SEQ ID NO: 1568946 - DNA, 16 bp, Homo sapiens
acatggctggcctggt

SEQ ID NO: 1568947 - DNA, 13 bp, Homo sapiens
acatggcttttga

SEQ ID NO: 1568948 - DNA, 22 bp, Homo sapiens
acatggggcctggcccacgccc

SEQ ID NO: 1568949 - DNA, 16 bp, Homo sapiens
acatggggttcctggt

SEQ ID NO: 1568950 - DNA, 17 bp, Homo sapiens
acatggggttcctggtt

SEQ ID NO: 1568951 - DNA, 12 bp, Homo sapiens
acatgggtgggg

SEQ ID NO: 1568952 - DNA, 20 bp, Homo sapiens
acatggtgaaacccccatct

SEQ ID NO: 1568953 - DNA, 20 bp, Homo sapiens
acatggtgagcctagccctg

SEQ ID NO: 1568954 - DNA, 13 bp, Homo sapiens
acatggtgcctga

SEQ ID NO: 1568955 - DNA, 19 bp, Homo sapiens
acatggtgtggggggctgg

SEQ ID NO: 1568956 - DNA, 20 bp, Homo sapiens
acatggttgtgacctgagga

SEQ ID NO: 1568957 - DNA, 14 bp, Homo sapiens
acatggtttaaata

SEQ ID NO: 1568958 - DNA, 19 bp, Homo sapiens
acatggtttaaatatgaat

SEQ ID NO: 1568959 - DNA, 14 bp, Homo sapiens
acatgtaaaatatg

SEQ ID NO: 1568960 - DNA, 18 bp, Homo sapiens
acatgtaaaatatgtaaa

SEQ ID NO: 1568961 - DNA, 20 bp, Homo sapiens
acatgtaactatttcttcag

SEQ ID NO: 1568962 - DNA, 14 bp, Homo sapiens
acatgtaagaaaat

SEQ ID NO: 1568963 - DNA, 19 bp, Homo sapiens
acatgtaataaaaagtata

SEQ ID NO: 1568964 - DNA, 18 bp, Homo sapiens
acatgtaatatatttcag

SEQ ID NO: 1568965 - DNA, 13 bp, Homo sapiens
acatgtaatttga

SEQ ID NO: 1568966 - DNA, 18 bp, Homo sapiens
acatgtacatagtaaagt

SEQ ID NO: 1568967 - DNA, 13 bp, Homo sapiens
acatgtactacag

SEQ ID NO: 1568968 - DNA, 23 bp, Homo sapiens
acatgtactacagctatatttga

SEQ ID NO: 1568969 - DNA, 13 bp, Homo sapiens
acatgtactccag

SEQ ID NO: 1568970 - DNA, 15 bp, Homo sapiens
acatgtaggtgtttg

SEQ ID NO: 1568971 - DNA, 23 bp, Homo sapiens
acatgtaggtgtttgttcatctg

SEQ ID NO: 1568972 - DNA, 15 bp, Homo sapiens
acatgtatgaaattg

SEQ ID NO: 1568973 - DNA, 23 bp, Homo sapiens
acatgtatggacgtgtgtgaatg

SEQ ID NO: 1568974 - DNA, 19 bp, Homo sapiens
acatgtattaaattacatt

SEQ ID NO: 1568975 - DNA, 15 bp, Homo sapiens
acatgtcaatctgtc

SEQ ID NO: 1568976 - DNA, 12 bp, Homo sapiens
acatgtcatgta

SEQ ID NO: 1568977 - DNA, 17 bp, Homo sapiens
acatgtccagcaccttg

SEQ ID NO: 1568978 - DNA, 19 bp, Homo sapiens
acatgtcctaattcttctg

SEQ ID NO: 1568979 - DNA, 19 bp, Homo sapiens
acatgtctcctactgagga

SEQ ID NO: 1568980 - DNA, 12 bp, Homo sapiens
acatgtgacaca

SEQ ID NO: 1568981 - DNA, 19 bp, Homo sapiens
acatgtgaggaggaaaagg

SEQ ID NO: 1568982 - DNA, 17 bp, Homo sapiens
acatgtgatacattttt

SEQ ID NO: 1568983 - DNA, 14 bp, Homo sapiens
acatgtgccctcag

SEQ ID NO: 1568984 - DNA, 19 bp, Homo sapiens
acatgtggccatggcctct

SEQ ID NO: 1568985 - DNA, 21 bp, Homo sapiens
acatgtgggtggagaagggag

SEQ ID NO: 1568986 - DNA, 15 bp, Homo sapiens
acatgtggtgggaca

SEQ ID NO: 1568987 - DNA, 12 bp, Homo sapiens
acatgtgtacat

SEQ ID NO: 1568988 - DNA, 13 bp, Homo sapiens
acatgtgtacata

SEQ ID NO: 1568989 - DNA, 17 bp, Homo sapiens
acatgtgtagcctgtgc

SEQ ID NO: 1568990 - DNA, 18 bp, Homo sapiens
acatgtgtagcctgtgca

SEQ ID NO: 1568991 - DNA, 16 bp, Homo sapiens
acatgtgtatttatac

SEQ ID NO: 1568992 - DNA, 16 bp, Homo sapiens
acatgttaatgacaat

SEQ ID NO: 1568993 - DNA, 17 bp, Homo sapiens
acatgttactgaccagc

SEQ ID NO: 1568994 - DNA, 19 bp, Homo sapiens
acatgttactgaccagcaa

SEQ ID NO: 1568995 - DNA, 13 bp, Homo sapiens
acatgttctttgt

SEQ ID NO: 1568996 - DNA, 14 bp, Homo sapiens
acatgttgtacatt

SEQ ID NO: 1568997 - DNA, 15 bp, Homo sapiens
acatgtttacaggtt

SEQ ID NO: 1568998 - DNA, 11 bp, Homo sapiens
acatgtttcct

SEQ ID NO: 1568999 - DNA, 17 bp, Homo sapiens
acatgtttttatacaaa

SEQ ID NO: 1569000 - DNA, 18 bp, Homo sapiens
acatgtttttatatgtct

SEQ ID NO: 1569001 - DNA, 12 bp, Homo sapiens
acattaaacaca

SEQ ID NO: 1569002 - DNA, 16 bp, Homo sapiens
acattaaacactgtaa

SEQ ID NO: 1569003 - DNA, 18 bp, Homo sapiens
acattaaacactgtaatc

SEQ ID NO: 1569004 - DNA, 20 bp, Homo sapiens
acattaaacactgtaatctt

SEQ ID NO: 1569005 - DNA, 20 bp, Homo sapiens
acattaaacaggattttaca

SEQ ID NO: 1569006 - DNA, 14 bp, Homo sapiens
acattaaatcacag

SEQ ID NO: 1569007 - DNA, 14 bp, Homo sapiens
acattaacggtgct

SEQ ID NO: 1569008 - DNA, 16 bp, Homo sapiens
acattaactccctcca

SEQ ID NO: 1569009 - DNA, 17 bp, Homo sapiens
acattaatgataaactc

SEQ ID NO: 1569010 - DNA, 19 bp, Homo sapiens
acattaattttgtgcattc

SEQ ID NO: 1569011 - DNA, 20 bp, Homo sapiens
acattaattttgtgcattct

SEQ ID NO: 1569012 - DNA, 13 bp, Homo sapiens
acattacactaaa

SEQ ID NO: 1569013 - DNA, 22 bp, Homo sapiens
acattagcagtttgctttgtat

SEQ ID NO: 1569014 - DNA, 19 bp, Homo sapiens
acattataacaactattta

SEQ ID NO: 1569015 - DNA, 19 bp, Homo sapiens
acattatcgggagcagtgt

SEQ ID NO: 1569016 - DNA, 16 bp, Homo sapiens
acattatgatctaata

SEQ ID NO: 1569017 - DNA, 18 bp, Homo sapiens
acattatgatctaataaa

SEQ ID NO: 1569018 - DNA, 21 bp, Homo sapiens
acattatgatctaataaactt

SEQ ID NO: 1569019 - DNA, 22 bp, Homo sapiens
acattatgatctaataaacttt

SEQ ID NO: 1569020 - DNA, 23 bp, Homo sapiens
acattatgatctaataaacttta

SEQ ID NO: 1569021 - DNA, 22 bp, Homo sapiens
acattatgtggttttagatttt

SEQ ID NO: 1569022 - DNA, 18 bp, Homo sapiens
acattattatcaacaata

SEQ ID NO: 1569023 - DNA, 23 bp, Homo sapiens
acattcaaaaaactctctcccag

SEQ ID NO: 1569024 - DNA, 18 bp, Homo sapiens
acattcaacagagactga

SEQ ID NO: 1569025 - DNA, 11 bp, Homo sapiens
acattcaactc

SEQ ID NO: 1569026 - DNA, 15 bp, Homo sapiens
acattcaatgaatta

SEQ ID NO: 1569027 - DNA, 12 bp, Homo sapiens
acattcaatgtt

SEQ ID NO: 1569028 - DNA, 19 bp, Homo sapiens
acattcaggaattcttgga

SEQ ID NO: 1569029 - DNA, 16 bp, Homo sapiens
acattccaagactcta

SEQ ID NO: 1569030 - DNA, 13 bp, Homo sapiens
acattcccctccc

SEQ ID NO: 1569031 - DNA, 21 bp, Homo sapiens
acattcccctcccacctctcc

SEQ ID NO: 1569032 - DNA, 18 bp, Homo sapiens
acattcctaactagaatt

SEQ ID NO: 1569033 - DNA, 21 bp, Homo sapiens
acattcctcatgaatgtaaat

SEQ ID NO: 1569034 - DNA, 19 bp, Homo sapiens
acattcctggccccgggct

SEQ ID NO: 1569035 - DNA, 18 bp, Homo sapiens
acattccttgtcaccagc

SEQ ID NO: 1569036 - DNA, 16 bp, Homo sapiens
acattcgtgagctggg

SEQ ID NO: 1569037 - DNA, 17 bp, Homo sapiens
acattctctttgataac

SEQ ID NO: 1569038 - DNA, 18 bp, Homo sapiens
acattctctttgataaca

SEQ ID NO: 1569039 - DNA, 19 bp, Homo sapiens
acattctctttgataacaa

SEQ ID NO: 1569040 - DNA, 16 bp, Homo sapiens
acattctgatttggaa

SEQ ID NO: 1569041 - DNA, 22 bp, Homo sapiens
acattcttagctgtaacttaac

SEQ ID NO: 1569042 - DNA, 19 bp, Homo sapiens
acattcttccatcatcact

SEQ ID NO: 1569043 - DNA, 21 bp, Homo sapiens
acattcttccatcatcactgt

SEQ ID NO: 1569044 - DNA, 23 bp, Homo sapiens
acattcttccatcatcactgtaa

SEQ ID NO: 1569045 - DNA, 13 bp, Homo sapiens
acattctttgcta

SEQ ID NO: 1569046 - DNA, 23 bp, Homo sapiens
acattctttttgctctaaaatat

SEQ ID NO: 1569047 - DNA, 13 bp, Homo sapiens
acattgaaaacag

SEQ ID NO: 1569048 - DNA, 16 bp, Homo sapiens
acattgaaaacagata

SEQ ID NO: 1569049 - DNA, 19 bp, Homo sapiens
acattgaagtaatgaattt

SEQ ID NO: 1569050 - DNA, 17 bp, Homo sapiens
acattgaccaagaactg

SEQ ID NO: 1569051 - DNA, 18 bp, Homo sapiens
accactcagttaaggaag

SEQ ID NO: 1569052 - DNA, 17 bp, Homo sapiens
accactcctgtccctgt

SEQ ID NO: 1569053 - DNA, 14 bp, Homo sapiens
accactgaaaaaat

SEQ ID NO: 1569054 - DNA, 19 bp, Homo sapiens
accactgaaaaaatatatg

SEQ ID NO: 1569055 - DNA, 18 bp, Homo sapiens
accactgaattcactcca

SEQ ID NO: 1569056 - DNA, 17 bp, Homo sapiens
accactgccctgcctgc

SEQ ID NO: 1569057 - DNA, 22 bp, Homo sapiens
accactgccctgcctgcccact

SEQ ID NO: 1569058 - DNA, 13 bp, Homo sapiens
accactgcctgac

SEQ ID NO: 1569059 - DNA, 12 bp, Homo sapiens
accactggccac

SEQ ID NO: 1569060 - DNA, 20 bp, Homo sapiens
accactggccaccaggctgg

SEQ ID NO: 1569061 - DNA, 21 bp, Homo sapiens
accactggccaccaggctggc

SEQ ID NO: 1569062 - DNA, 23 bp, Homo sapiens
accactgggccataatgttgctt

SEQ ID NO: 1569063 - DNA, 23 bp, Homo sapiens
accactgtctccacccaccttga

SEQ ID NO: 1569064 - DNA, 17 bp, Homo sapiens
accactgtgccactgac

SEQ ID NO: 1569065 - DNA, 12 bp, Homo sapiens
accactgtggcg

SEQ ID NO: 1569066 - DNA, 20 bp, Homo sapiens
accactgtggcgttctgctg

SEQ ID NO: 1569067 - DNA, 14 bp, Homo sapiens
accacttccagggg

SEQ ID NO: 1569068 - DNA, 16 bp, Homo sapiens
accacttctccatgct

SEQ ID NO: 1569069 - DNA, 21 bp, Homo sapiens
accacttgaatttattgatat

SEQ ID NO: 1569070 - DNA, 20 bp, Homo sapiens
accacttgaggcctgatctg

SEQ ID NO: 1569071 - DNA, 21 bp, Homo sapiens
accactttcttattctgtatc

SEQ ID NO: 1569072 - DNA, 18 bp, Homo sapiens
accagaattcccttgaat

SEQ ID NO: 1569073 - DNA, 16 bp, Homo sapiens
accagaccatgggcca

SEQ ID NO: 1569074 - DNA, 23 bp, Homo sapiens
accagacctggaagaacaggcct

SEQ ID NO: 1569075 - DNA, 20 bp, Homo sapiens
accagacggttcaccagcct

SEQ ID NO: 1569076 - DNA, 15 bp, Homo sapiens
accagactcttgcct

SEQ ID NO: 1569077 - DNA, 12 bp, Homo sapiens
accagagccaga

SEQ ID NO: 1569078 - DNA, 14 bp, Homo sapiens
accagagcccatgc

SEQ ID NO: 1569079 - DNA, 16 bp, Homo sapiens
accagagcccatgctc

SEQ ID NO: 1569080 - DNA, 16 bp, Homo sapiens
accagagccgggagga

SEQ ID NO: 1569081 - DNA, 19 bp, Homo sapiens
accagagccttcaagtgcc

SEQ ID NO: 1569082 - DNA, 15 bp, Homo sapiens
accagagcttctctg

SEQ ID NO: 1569083 - DNA, 22 bp, Homo sapiens
accagagcttctctgggctgaa

SEQ ID NO: 1569084 - DNA, 15 bp, Homo sapiens
accagaggaagttat

SEQ ID NO: 1569085 - DNA, 22 bp, Homo sapiens
accagaggccgaaggtgcctca

SEQ ID NO: 1569086 - DNA, 15 bp, Homo sapiens
accagagtcacccag

SEQ ID NO: 1569087 - DNA, 22 bp, Homo sapiens
accagagtgctgaaggaatgga

SEQ ID NO: 1569088 - DNA, 14 bp, Homo sapiens
accagatctttctc

SEQ ID NO: 1569089 - DNA, 15 bp, Homo sapiens
accagatctttctct

SEQ ID NO: 1569090 - DNA, 16 bp, Homo sapiens
accagatctttctctt

SEQ ID NO: 1569091 - DNA, 22 bp, Homo sapiens
accagatctttctcttccctga

SEQ ID NO: 1569092 - DNA, 13 bp, Homo sapiens
accagatgtccgt

SEQ ID NO: 1569093 - DNA, 17 bp, Homo sapiens
accagcactcagcctca

SEQ ID NO: 1569094 - DNA, 15 bp, Homo sapiens
accagcactgtctca

SEQ ID NO: 1569095 - DNA, 16 bp, Homo sapiens
accagcactgtctcag

SEQ ID NO: 1569096 - DNA, 15 bp, Homo sapiens
accagcagcactgga

SEQ ID NO: 1569097 - DNA, 23 bp, Homo sapiens
accagcaggaggttctgggcctc

SEQ ID NO: 1569098 - DNA, 13 bp, Homo sapiens
accagcaggcagg

SEQ ID NO: 1569099 - DNA, 18 bp, Homo sapiens
accagccacagtacatat

SEQ ID NO: 1569100 - DNA, 21 bp, Homo sapiens
accagccacagtacatatgta

SEQ ID NO: 1569101 - DNA, 14 bp, Homo sapiens
accagccagcctca

SEQ ID NO: 1569102 - DNA, 21 bp, Homo sapiens
accagccagcgtcccttggtg

SEQ ID NO: 1569103 - DNA, 13 bp, Homo sapiens
accagccaggcag

SEQ ID NO: 1569104 - DNA, 17 bp, Homo sapiens
accagccccactgccag

SEQ ID NO: 1569105 - DNA, 18 bp, Homo sapiens
accagccccactgccagc

SEQ ID NO: 1569106 - DNA, 22 bp, Homo sapiens
accagccccactgccagcagca

SEQ ID NO: 1569107 - DNA, 15 bp, Homo sapiens
accagccccagcaag

SEQ ID NO: 1569108 - DNA, 17 bp, Homo sapiens
accagccccagcaagag

SEQ ID NO: 1569109 - DNA, 18 bp, Homo sapiens
accagccccagcaagagc

SEQ ID NO: 1569110 - DNA, 13 bp, Homo sapiens
accagccccctgg

SEQ ID NO: 1569111 - DNA, 17 bp, Homo sapiens
accagccccctggatgg

SEQ ID NO: 1569112 - DNA, 16 bp, Homo sapiens
accagcccggcctgct

SEQ ID NO: 1569113 - DNA, 22 bp, Homo sapiens
accagccctagctgtcccatgg

SEQ ID NO: 1569114 - DNA, 13 bp, Homo sapiens
accagcctcctgg

SEQ ID NO: 1569115 - DNA, 23 bp, Homo sapiens
accagcctctcttggtttccttc

SEQ ID NO: 1569116 - DNA, 15 bp, Homo sapiens
accagcctgctgaca

SEQ ID NO: 1569117 - DNA, 17 bp, Homo sapiens
accagcctgctgacaga

SEQ ID NO: 1569118 - DNA, 13 bp, Homo sapiens
accagcctggcca

SEQ ID NO: 1569119 - DNA, 14 bp, Homo sapiens
accagcctgggcag

SEQ ID NO: 1569120 - DNA, 20 bp, Homo sapiens
accagcctggtgcccatcct

SEQ ID NO: 1569121 - DNA, 20 bp, Homo sapiens
accagcctgtccaacatggt

SEQ ID NO: 1569122 - DNA, 17 bp, Homo sapiens
accagcctttctcccag

SEQ ID NO: 1569123 - DNA, 19 bp, Homo sapiens
accagcctttctcccaggc

SEQ ID NO: 1569124 - DNA, 13 bp, Homo sapiens
accagcgcccgct

SEQ ID NO: 1569125 - DNA, 14 bp, Homo sapiens
accagcggctgctc

SEQ ID NO: 1569126 - DNA, 21 bp, Homo sapiens
accagctcagaggcccaggaa

SEQ ID NO: 1569127 - DNA, 13 bp, Homo sapiens
accagctcaggac

SEQ ID NO: 1569128 - DNA, 15 bp, Homo sapiens
accagctcaggacag

SEQ ID NO: 1569129 - DNA, 16 bp, Homo sapiens
accagctcaggacaga

SEQ ID NO: 1569130 - DNA, 14 bp, Homo sapiens
accagctctgtggc

SEQ ID NO: 1569131 - DNA, 18 bp, Homo sapiens
accagctctgtggcctgt

SEQ ID NO: 1569132 - DNA, 20 bp, Homo sapiens
accagctctgtggcctgtgt

SEQ ID NO: 1569133 - DNA, 12 bp, Homo sapiens
accagctgaaag

SEQ ID NO: 1569134 - DNA, 16 bp, Homo sapiens
accagctgcgcttgct

SEQ ID NO: 1569135 - DNA, 20 bp, Homo sapiens
accagctgcgcttgcttttc

SEQ ID NO: 1569136 - DNA, 10 bp, Homo sapiens
accagctgct

SEQ ID NO: 1569137 - DNA, 11 bp, Homo sapiens
accagctgcta

SEQ ID NO: 1569138 - DNA, 18 bp, Homo sapiens
accagctgctactcataa

SEQ ID NO: 1569139 - DNA, 14 bp, Homo sapiens
accagctgctctgc

SEQ ID NO: 1569140 - DNA, 19 bp, Homo sapiens
accagctgctctgcccctt

SEQ ID NO: 1569141 - DNA, 13 bp, Homo sapiens
accagctgctgct

SEQ ID NO: 1569142 - DNA, 16 bp, Homo sapiens
accagctgctgtgccc

SEQ ID NO: 1569143 - DNA, 16 bp, Homo sapiens
accagcttagatttta

SEQ ID NO: 1569144 - DNA, 20 bp, Homo sapiens
accagcttagccaacatagt

SEQ ID NO: 1569145 - DNA, 17 bp, Homo sapiens
accaggacaggaccaga

SEQ ID NO: 1569146 - DNA, 14 bp, Homo sapiens
accaggactccctc

SEQ ID NO: 1569147 - DNA, 17 bp, Homo sapiens
accaggactccctcctc

SEQ ID NO: 1569148 - DNA, 18 bp, Homo sapiens
accaggactccctcctca

SEQ ID NO: 1569149 - DNA, 11 bp, Homo sapiens
accaggactta

SEQ ID NO: 1569150 - DNA, 20 bp, Homo sapiens
accaggagaaccactacatg

SEQ ID NO: 1569151 - DNA, 16 bp, Homo sapiens
accaggagcagcagcc

SEQ ID NO: 1569152 - DNA, 20 bp, Homo sapiens
accaggagcagcagccagca

SEQ ID NO: 1569153 - DNA, 15 bp, Homo sapiens
accaggagctagccc

SEQ ID NO: 1569154 - DNA, 22 bp, Homo sapiens
accaggagtccctggtaataag

SEQ ID NO: 1569155 - DNA, 16 bp, Homo sapiens
accaggcaacctccca

SEQ ID NO: 1569156 - DNA, 23 bp, Homo sapiens
accaggcacgaacccacctgctg

SEQ ID NO: 1569157 - DNA, 12 bp, Homo sapiens
accaggccacct

SEQ ID NO: 1569158 - DNA, 14 bp, Homo sapiens
accaggccacctcc

SEQ ID NO: 1569159 - DNA, 20 bp, Homo sapiens
accaggccgtcctcccgggc

SEQ ID NO: 1569160 - DNA, 11 bp, Homo sapiens
accaggcctgg

SEQ ID NO: 1569161 - DNA, 12 bp, Homo sapiens
accaggccttca

SEQ ID NO: 1569162 - DNA, 21 bp, Homo sapiens
accaggccttcatcctcctcc

SEQ ID NO: 1569163 - DNA, 14 bp, Homo sapiens
accaggctgcagcc

SEQ ID NO: 1569164 - DNA, 17 bp, Homo sapiens
accaggctgcctccctt

SEQ ID NO: 1569165 - DNA, 19 bp, Homo sapiens
accaggctgctcagggctg

SEQ ID NO: 1569166 - DNA, 22 bp, Homo sapiens
accaggctggacaccctctgcc

SEQ ID NO: 1569167 - DNA, 16 bp, Homo sapiens
accaggctggcgcagc

SEQ ID NO: 1569168 - DNA, 23 bp, Homo sapiens
accaggctggcgcagccaaggcc

SEQ ID NO: 1569169 - DNA, 13 bp, Homo sapiens
accaggctgggca

SEQ ID NO: 1569170 - DNA, 14 bp, Homo sapiens
accaggctgggcat

SEQ ID NO: 1569171 - DNA, 14 bp, Homo sapiens
accagggaggagag

SEQ ID NO: 1569172 - DNA, 15 bp, Homo sapiens
accagggatgctggg

SEQ ID NO: 1569173 - DNA, 18 bp, Homo sapiens
accagggatgctgggctg

SEQ ID NO: 1569174 - DNA, 19 bp, Homo sapiens
accagggatgctgggctgg

SEQ ID NO: 1569175 - DNA, 13 bp, Homo sapiens
accagggcctttt

SEQ ID NO: 1569176 - DNA, 21 bp, Homo sapiens
accagggccttttctggcacc

SEQ ID NO: 1569177 - DNA, 23 bp, Homo sapiens
accagggcgaacgacaatagctt

SEQ ID NO: 1569178 - DNA, 15 bp, Homo sapiens
accagggctccagcc

SEQ ID NO: 1569179 - DNA, 16 bp, Homo sapiens
accagggctccagccc

SEQ ID NO: 1569180 - DNA, 22 bp, Homo sapiens
accaggggaaggaaggagggca

SEQ ID NO: 1569181 - DNA, 16 bp, Homo sapiens
accaggggaggagcct

SEQ ID NO: 1569182 - DNA, 18 bp, Homo sapiens
accaggtcctgctccgct

SEQ ID NO: 1569183 - DNA, 14 bp, Homo sapiens
accaggtgggagcg

SEQ ID NO: 1569184 - DNA, 11 bp, Homo sapiens
accagtattta

SEQ ID NO: 1569185 - DNA, 17 bp, Homo sapiens
accagtccccccaccct

SEQ ID NO: 1569186 - DNA, 18 bp, Homo sapiens
accagtcctatttttcaa

SEQ ID NO: 1569187 - DNA, 12 bp, Homo sapiens
accagtctgtct

SEQ ID NO: 1569188 - DNA, 23 bp, Homo sapiens
accagtgaacttttttttttaat

SEQ ID NO: 1569189 - DNA, 16 bp, Homo sapiens
accagtggctggtctc

SEQ ID NO: 1569190 - DNA, 13 bp, Homo sapiens
accagtgtagcct

SEQ ID NO: 1569191 - DNA, 21 bp, Homo sapiens
accagtgtggtttgtgtttga

SEQ ID NO: 1569192 - DNA, 14 bp, Homo sapiens
accagtgttgggtt

SEQ ID NO: 1569193 - DNA, 24 bp, Homo sapiens
accagttgaataaaagtgcacacc

SEQ ID NO: 1569194 - DNA, 14 bp, Homo sapiens
accagttgcctttt

SEQ ID NO: 1569195 - DNA, 16 bp, Homo sapiens
accagttgccttttat

SEQ ID NO: 1569196 - DNA, 15 bp, Homo sapiens
accagttgggagcac

SEQ ID NO: 1569197 - DNA, 21 bp, Homo sapiens
accagttgggagcactggagt

SEQ ID NO: 1569198 - DNA, 18 bp, Homo sapiens
accataaatgaatcatca

SEQ ID NO: 1569199 - DNA, 14 bp, Homo sapiens
accataaattcaac

SEQ ID NO: 1569200 - DNA, 13 bp, Homo sapiens
accataatcttat

SEQ ID NO: 1569201 - DNA, 18 bp, Homo sapiens
accataatgttacattat

SEQ ID NO: 1569202 - DNA, 22 bp, Homo sapiens
accatacattatttcttcccag

SEQ ID NO: 1569203 - DNA, 15 bp, Homo sapiens
accatagaaaaatgt

SEQ ID NO: 1569204 - DNA, 20 bp, Homo sapiens
accatagaaaaatgtataaa

SEQ ID NO: 1569205 - DNA, 13 bp, Homo sapiens
accatatgaattg

SEQ ID NO: 1569206 - DNA, 15 bp, Homo sapiens
accatatgattgaaa

SEQ ID NO: 1569207 - DNA, 19 bp, Homo sapiens
accatatgattgaaaagaa

SEQ ID NO: 1569208 - DNA, 23 bp, Homo sapiens
accatatgattgaaaagaagaaa

SEQ ID NO: 1569209 - DNA, 17 bp, Homo sapiens
accatattacctggatt

SEQ ID NO: 1569210 - DNA, 19 bp, Homo sapiens
accatattcagtgctgtgg

SEQ ID NO: 1569211 - DNA, 22 bp, Homo sapiens
accatattgtgcttcacagtag

SEQ ID NO: 1569212 - DNA, 16 bp, Homo sapiens
accatcaaggcgggag

SEQ ID NO: 1569213 - DNA, 13 bp, Homo sapiens
accatcaataaag

SEQ ID NO: 1569214 - DNA, 13 bp, Homo sapiens
accatcaatcctg

SEQ ID NO: 1569215 - DNA, 15 bp, Homo sapiens
accatcaccaccgcc

SEQ ID NO: 1569216 - DNA, 22 bp, Homo sapiens
accatcaccagaattaatttta

SEQ ID NO: 1569217 - DNA, 14 bp, Homo sapiens
accatccaccttcc

SEQ ID NO: 1569218 - DNA, 23 bp, Homo sapiens
accatccactctaccctcccacc

SEQ ID NO: 1569219 - DNA, 14 bp, Homo sapiens
accatccccaactc

SEQ ID NO: 1569220 - DNA, 15 bp, Homo sapiens
accatccccagctgg

SEQ ID NO: 1569221 - DNA, 16 bp, Homo sapiens
accatcctgcagcctc

SEQ ID NO: 1569222 - DNA, 21 bp, Homo sapiens
accatcctggagggctttctg

SEQ ID NO: 1569223 - DNA, 19 bp, Homo sapiens
accatcctggccaacatga

SEQ ID NO: 1569224 - DNA, 13 bp, Homo sapiens
accatcctggctg

SEQ ID NO: 1569225 - DNA, 14 bp, Homo sapiens
accatcctggctgc

SEQ ID NO: 1569226 - DNA, 15 bp, Homo sapiens
accatctctccaact

SEQ ID NO: 1569227 - DNA, 14 bp, Homo sapiens
accatctctttacc

SEQ ID NO: 1569228 - DNA, 12 bp, Homo sapiens
accatctgcatg

SEQ ID NO: 1569229 - DNA, 15 bp, Homo sapiens
accatctgctgcccc

SEQ ID NO: 1569230 - DNA, 22 bp, Homo sapiens
accatctgtcttgccagccaga

SEQ ID NO: 1569231 - DNA, 23 bp, Homo sapiens
accatctgtgactataaagctgt

SEQ ID NO: 1569232 - DNA, 10 bp, Homo sapiens
accatctttg

SEQ ID NO: 1569233 - DNA, 20 bp, Homo sapiens
accatctttgccaacatggt

SEQ ID NO: 1569234 - DNA, 12 bp, Homo sapiens
accatgaacttg

SEQ ID NO: 1569235 - DNA, 14 bp, Homo sapiens
accatgaatattta

SEQ ID NO: 1569236 - DNA, 19 bp, Homo sapiens
accatgagaatttgcaaca

SEQ ID NO: 1569237 - DNA, 23 bp, Homo sapiens
accatgcactcacccctagccct

SEQ ID NO: 1569238 - DNA, 19 bp, Homo sapiens
accatgccttttttttaag

SEQ ID NO: 1569239 - DNA, 20 bp, Homo sapiens
accatgcgtcaggggcctag

SEQ ID NO: 1569240 - DNA, 22 bp, Homo sapiens
accatgcgtcaggggcctagag

SEQ ID NO: 1569241 - DNA, 14 bp, Homo sapiens
accatgctgctggg

SEQ ID NO: 1569242 - DNA, 16 bp, Homo sapiens
accatgctgctgggga

SEQ ID NO: 1569243 - DNA, 17 bp, Homo sapiens
accatgctgctggggaa

SEQ ID NO: 1569244 - DNA, 23 bp, Homo sapiens
accatgctgctggggaagacagt

SEQ ID NO: 1569245 - DNA, 23 bp, Homo sapiens
accatggccgaagccccttggag

SEQ ID NO: 1569246 - DNA, 22 bp, Homo sapiens
accatggtcatcaccacccttc

SEQ ID NO: 1569247 - DNA, 21 bp, Homo sapiens
accatggttaagagtccaaga

SEQ ID NO: 1569248 - DNA, 18 bp, Homo sapiens
accatgtaagcactctgg

SEQ ID NO: 1569249 - DNA, 21 bp, Homo sapiens
accatgtaagcactctggatg

SEQ ID NO: 1569250 - DNA, 11 bp, Homo sapiens
accatgtacat

SEQ ID NO: 1569251 - DNA, 14 bp, Homo sapiens
accatgtacatagc

SEQ ID NO: 1569252 - DNA, 17 bp, Homo sapiens
accatgtacatgaagaa

SEQ ID NO: 1569253 - DNA, 16 bp, Homo sapiens
accatgtattttgtaa

SEQ ID NO: 1569254 - DNA, 18 bp, Homo sapiens
accatgtcatttcagaag

SEQ ID NO: 1569255 - DNA, 23 bp, Homo sapiens
accatgtgcaataagattggtgt

SEQ ID NO: 1569256 - DNA, 12 bp, Homo sapiens
accatgtgccat

SEQ ID NO: 1569257 - DNA, 13 bp, Homo sapiens
accatgttcatta

SEQ ID NO: 1569258 - DNA, 18 bp, Homo sapiens
accattaaaactgctttt

SEQ ID NO: 1569259 - DNA, 16 bp, Homo sapiens
accattaattacatac

SEQ ID NO: 1569260 - DNA, 17 bp, Homo sapiens
accattaattacataca

SEQ ID NO: 1569261 - DNA, 14 bp, Homo sapiens
accattacctgtac

SEQ ID NO: 1569262 - DNA, 20 bp, Homo sapiens
accattagataaacacaggc

SEQ ID NO: 1569263 - DNA, 17 bp, Homo sapiens
accattattatcaagta

SEQ ID NO: 1569264 - DNA, 19 bp, Homo sapiens
accattcacaataaaagct

SEQ ID NO: 1569265 - DNA, 19 bp, Homo sapiens
accattccctgccttgctg

SEQ ID NO: 1569266 - DNA, 20 bp, Homo sapiens
accattctcaccctgtgaaa

SEQ ID NO: 1569267 - DNA, 16 bp, Homo sapiens
accattgaaggcttaa

SEQ ID NO: 1569268 - DNA, 16 bp, Homo sapiens
accattgagtccctgc

SEQ ID NO: 1569269 - DNA, 16 bp, Homo sapiens
accattgcaacaaaat

SEQ ID NO: 1569270 - DNA, 11 bp, Homo sapiens
accatttataa

SEQ ID NO: 1569271 - DNA, 11 bp, Homo sapiens
accatttcaga

SEQ ID NO: 1569272 - DNA, 14 bp, Homo sapiens
accatttcagagag

SEQ ID NO: 1569273 - DNA, 16 bp, Homo sapiens
accatttccaacagca

SEQ ID NO: 1569274 - DNA, 23 bp, Homo sapiens
accatttggatcctgtgtggaga

SEQ ID NO: 1569275 - DNA, 17 bp, Homo sapiens
accatttgggatggaga

SEQ ID NO: 1569276 - DNA, 16 bp, Homo sapiens
accatttgtaataaag

SEQ ID NO: 1569277 - DNA, 15 bp, Homo sapiens
accatttgtgttttg

SEQ ID NO: 1569278 - DNA, 20 bp, Homo sapiens
accattttttaaggaaacaa

SEQ ID NO: 1569279 - DNA, 23 bp, Homo sapiens
accattttttaatttacttgttt

SEQ ID NO: 1569280 - DNA, 20 bp, Homo sapiens
accattttttttttcttttt

SEQ ID NO: 1569281 - DNA, 14 bp, Homo sapiens
acccaaacacttct

SEQ ID NO: 1569282 - DNA, 16 bp, Homo sapiens
acccaaacacttctgc

SEQ ID NO: 1569283 - DNA, 18 bp, Homo sapiens
acccaaacacttctgctt

SEQ ID NO: 1569284 - DNA, 16 bp, Homo sapiens
acccaaagctgagcct

SEQ ID NO: 1569285 - DNA, 12 bp, Homo sapiens
acccaaccactc

SEQ ID NO: 1569286 - DNA, 16 bp, Homo sapiens
acccaacccaaaccat

SEQ ID NO: 1569287 - DNA, 18 bp, Homo sapiens
acccaacccaaaccatga

SEQ ID NO: 1569288 - DNA, 17 bp, Homo sapiens
acccaaccctatctcct

SEQ ID NO: 1569289 - DNA, 22 bp, Homo sapiens
acccaaccctatctcctgacag

SEQ ID NO: 1569290 - DNA, 21 bp, Homo sapiens
acccaaccctgccctgcccca

SEQ ID NO: 1569291 - DNA, 15 bp, Homo sapiens
acccaacggccctgc

SEQ ID NO: 1569292 - DNA, 23 bp, Homo sapiens
acccaacggccctgcagccagct

SEQ ID NO: 1569293 - DNA, 18 bp, Homo sapiens
acccaactgatcctgctc

SEQ ID NO: 1569294 - DNA, 23 bp, Homo sapiens
acccaactgatcctgctccagca

SEQ ID NO: 1569295 - DNA, 15 bp, Homo sapiens
acccaagcctgctgg

SEQ ID NO: 1569296 - DNA, 13 bp, Homo sapiens
acccaagctgtgg

SEQ ID NO: 1569297 - DNA, 15 bp, Homo sapiens
acccaagctgtggca

SEQ ID NO: 1569298 - DNA, 21 bp, Homo sapiens
acccaagctgtggcagccgtc

SEQ ID NO: 1569299 - DNA, 13 bp, Homo sapiens
acccaagcttggc

SEQ ID NO: 1569300 - DNA, 18 bp, Homo sapiens
acccaagcttggcagccg

SEQ ID NO: 1569301 - DNA, 16 bp, Homo sapiens
acccaagtccctgtca

SEQ ID NO: 1569302 - DNA, 14 bp, Homo sapiens
acccaattttaaaa

SEQ ID NO: 1569303 - DNA, 17 bp, Homo sapiens
acccaattttaaaaaat

SEQ ID NO: 1569304 - DNA, 22 bp, Homo sapiens
acccacaattgccttggagatc

SEQ ID NO: 1569305 - DNA, 15 bp, Homo sapiens
acccacacagctgcc

SEQ ID NO: 1569306 - DNA, 14 bp, Homo sapiens
acccacagccatag

SEQ ID NO: 1569307 - DNA, 12 bp, Homo sapiens
acccacagctca

SEQ ID NO: 1569308 - DNA, 16 bp, Homo sapiens
acccacagctcagctg

SEQ ID NO: 1569309 - DNA, 18 bp, Homo sapiens
acccacagctcagctgcc

SEQ ID NO: 1569310 - DNA, 21 bp, Homo sapiens
acccacataaaagccccagct

SEQ ID NO: 1569311 - DNA, 16 bp, Homo sapiens
acccacatgtgacaca

SEQ ID NO: 1569312 - DNA, 18 bp, Homo sapiens
acccacattactttttat

SEQ ID NO: 1569313 - DNA, 14 bp, Homo sapiens
acccaccagtcagg

SEQ ID NO: 1569314 - DNA, 15 bp, Homo sapiens
acccacccagaatga

SEQ ID NO: 1569315 - DNA, 14 bp, Homo sapiens
acccacccatcttc

SEQ ID NO: 1569316 - DNA, 17 bp, Homo sapiens
acccacccatcttcctg

SEQ ID NO: 1569317 - DNA, 20 bp, Homo sapiens
acccacccatcttcctgctg

SEQ ID NO: 1569318 - DNA, 23 bp, Homo sapiens
acccacccatcttcctgctgctg

SEQ ID NO: 1569319 - DNA, 14 bp, Homo sapiens
acccaccccaaact

SEQ ID NO: 1569320 - DNA, 12 bp, Homo sapiens
acccaccccaac

SEQ ID NO: 1569321 - DNA, 13 bp, Homo sapiens
acccaccccaact

SEQ ID NO: 1569322 - DNA, 19 bp, Homo sapiens
acccaccccaactctcccc

SEQ ID NO: 1569323 - DNA, 13 bp, Homo sapiens
acccacccccttt

SEQ ID NO: 1569324 - DNA, 15 bp, Homo sapiens
acccacccctgcaca

SEQ ID NO: 1569325 - DNA, 16 bp, Homo sapiens
acccacccctgcccag

SEQ ID NO: 1569326 - DNA, 17 bp, Homo sapiens
acccacccctgcccagg

SEQ ID NO: 1569327 - DNA, 16 bp, Homo sapiens
acccacccctgtgctc

SEQ ID NO: 1569328 - DNA, 17 bp, Homo sapiens
acccacccctgtgctcc

SEQ ID NO: 1569329 - DNA, 19 bp, Homo sapiens
acccaccgtccgccctgct

SEQ ID NO: 1569330 - DNA, 20 bp, Homo sapiens
acccaccgtccgccctgctc

SEQ ID NO: 1569331 - DNA, 16 bp, Homo sapiens
acccacctccccctcc

SEQ ID NO: 1569332 - DNA, 16 bp, Homo sapiens
acccacctctcctgcc

SEQ ID NO: 1569333 - DNA, 18 bp, Homo sapiens
acccacctctcctgccct

SEQ ID NO: 1569334 - DNA, 23 bp, Homo sapiens
acccacctggtactgacccagga

SEQ ID NO: 1569335 - DNA, 17 bp, Homo sapiens
acccacctgttttctga

SEQ ID NO: 1569336 - DNA, 23 bp, Homo sapiens
acccaccttgttggagcctgcag

SEQ ID NO: 1569337 - DNA, 21 bp, Homo sapiens
acccacgtgagagaatctgcc

SEQ ID NO: 1569338 - DNA, 21 bp, Homo sapiens
acccacgttctcacacccacc

SEQ ID NO: 1569339 - DNA, 15 bp, Homo sapiens
acccactacccttct

SEQ ID NO: 1569340 - DNA, 16 bp, Homo sapiens
acccactacccttctc

SEQ ID NO: 1569341 - DNA, 23 bp, Homo sapiens
acccactacccttctcctttcct

SEQ ID NO: 1569342 - DNA, 15 bp, Homo sapiens
acccactcaccaggg

SEQ ID NO: 1569343 - DNA, 17 bp, Homo sapiens
acccactttgtaatttt

SEQ ID NO: 1569344 - DNA, 19 bp, Homo sapiens
acccagaatgtagcatctg

SEQ ID NO: 1569345 - DNA, 21 bp, Homo sapiens
acccagacagctccctctgcc

SEQ ID NO: 1569346 - DNA, 15 bp, Homo sapiens
acccagactgtctcc

SEQ ID NO: 1569347 - DNA, 20 bp, Homo sapiens
acccagactgtctccacggc

SEQ ID NO: 1569348 - DNA, 23 bp, Homo sapiens
acccagagaaggacggtgccaag

SEQ ID NO: 1569349 - DNA, 21 bp, Homo sapiens
acccagagagaggggcctgca

SEQ ID NO: 1569350 - DNA, 22 bp, Homo sapiens
acccagagagaggggcctgcag

SEQ ID NO: 1569351 - DNA, 23 bp, Homo sapiens
acccagagagaggggcctgcagg

SEQ ID NO: 1569352 - DNA, 24 bp, Homo sapiens
acccagagcaccccctgctccacc

SEQ ID NO: 1569353 - DNA, 21 bp, Homo sapiens
acccagatggaaaaataacaa

SEQ ID NO: 1569354 - DNA, 18 bp, Homo sapiens
acccagattgtgtacata

SEQ ID NO: 1569355 - DNA, 17 bp, Homo sapiens
acccagcaacagaaaaa

SEQ ID NO: 1569356 - DNA, 16 bp, Homo sapiens
acccagcatctcccag

SEQ ID NO: 1569357 - DNA, 13 bp, Homo sapiens
acccagccatctg

SEQ ID NO: 1569358 - DNA, 20 bp, Homo sapiens
acccagccatctgcccaggg

SEQ ID NO: 1569359 - DNA, 14 bp, Homo sapiens
acccagcccattct

SEQ ID NO: 1569360 - DNA, 22 bp, Homo sapiens
acccagcccattctctctcctg

SEQ ID NO: 1569361 - DNA, 15 bp, Homo sapiens
acccagcgtggcctc

SEQ ID NO: 1569362 - DNA, 17 bp, Homo sapiens
acccagctactctgtcc

SEQ ID NO: 1569363 - DNA, 18 bp, Homo sapiens
acccagctactctgtcca

SEQ ID NO: 1569364 - DNA, 21 bp, Homo sapiens
acccagctactctgtccaggc

SEQ ID NO: 1569365 - DNA, 22 bp, Homo sapiens
acccagctactctgtccaggcc

SEQ ID NO: 1569366 - DNA, 11 bp, Homo sapiens
acccagctcct

SEQ ID NO: 1569367 - DNA, 14 bp, Homo sapiens
acccagctgatggg

SEQ ID NO: 1569368 - DNA, 16 bp, Homo sapiens
acccagctgcagacca

SEQ ID NO: 1569369 - DNA, 11 bp, Homo sapiens
acccaggaggt

SEQ ID NO: 1569370 - DNA, 14 bp, Homo sapiens
acccaggaggtgga

SEQ ID NO: 1569371 - DNA, 20 bp, Homo sapiens
acccaggatatctgaaaata

SEQ ID NO: 1569372 - DNA, 14 bp, Homo sapiens
acccaggccctcca

SEQ ID NO: 1569373 - DNA, 22 bp, Homo sapiens
acccaggccctccatgggctag

SEQ ID NO: 1569374 - DNA, 16 bp, Homo sapiens
acccaggcctccctgc

SEQ ID NO: 1569375 - DNA, 12 bp, Homo sapiens
acccaggctgca

SEQ ID NO: 1569376 - DNA, 19 bp, Homo sapiens
acccaggctgcactgcagt

SEQ ID NO: 1569377 - DNA, 19 bp, Homo sapiens
acccaggctggagtgcagt

SEQ ID NO: 1569378 - DNA, 21 bp, Homo sapiens
acccagggcccaggcaaatca

SEQ ID NO: 1569379 - DNA, 16 bp, Homo sapiens
acccagggctctgcag

SEQ ID NO: 1569380 - DNA, 15 bp, Homo sapiens
acccaggtggagggc

SEQ ID NO: 1569381 - DNA, 20 bp, Homo sapiens
acccaggttggagtgcagtg

SEQ ID NO: 1569382 - DNA, 18 bp, Homo sapiens
acccagtcacctctgtct

SEQ ID NO: 1569383 - DNA, 17 bp, Homo sapiens
acccagtccatgctcca

SEQ ID NO: 1569384 - DNA, 18 bp, Homo sapiens
acccagtccatgctccag

SEQ ID NO: 1569385 - DNA, 13 bp, Homo sapiens
acccagtccccac

SEQ ID NO: 1569386 - DNA, 16 bp, Homo sapiens
acccagtccccacccg

SEQ ID NO: 1569387 - DNA, 18 bp, Homo sapiens
acccagtccccacccgcc

SEQ ID NO: 1569388 - DNA, 20 bp, Homo sapiens
acccagtccccacccgcctg

SEQ ID NO: 1569389 - DNA, 15 bp, Homo sapiens
acccagtccctgggg

SEQ ID NO: 1569390 - DNA, 18 bp, Homo sapiens
acccagtctcctctccat

SEQ ID NO: 1569391 - DNA, 9 bp, Homo sapiens
acccagtgc

SEQ ID NO: 1569392 - DNA, 17 bp, Homo sapiens
acccagtgcagaatgta

SEQ ID NO: 1569393 - DNA, 21 bp, Homo sapiens
acccagtgctgccatgccact

SEQ ID NO: 1569394 - DNA, 22 bp, Homo sapiens
acccagttgctgatccctgctc

SEQ ID NO: 1569395 - DNA, 12 bp, Homo sapiens
acccataaacag

SEQ ID NO: 1569396 - DNA, 13 bp, Homo sapiens
acccataaacagc

SEQ ID NO: 1569397 - DNA, 24 bp, Homo sapiens
acccataataagagaatgttccta

SEQ ID NO: 1569398 - DNA, 13 bp, Homo sapiens
acccatacaatgt

SEQ ID NO: 1569399 - DNA, 15 bp, Homo sapiens
acccatacaatgtat

SEQ ID NO: 1569400 - DNA, 16 bp, Homo sapiens
acccatacaatgtatg

SEQ ID NO: 1569401 - DNA, 22 bp, Homo sapiens
acccatacaatgtatgtacaat

SEQ ID NO: 1569402 - DNA, 21 bp, Homo sapiens
acccatagatcttctgaaatg

SEQ ID NO: 1569403 - DNA, 18 bp, Homo sapiens
acccatcacgcctgtgca

SEQ ID NO: 1569404 - DNA, 18 bp, Homo sapiens
acccatcagaaggagaag

SEQ ID NO: 1569405 - DNA, 19 bp, Homo sapiens
acccatcagaaggagaagg

SEQ ID NO: 1569406 - DNA, 19 bp, Homo sapiens
acccatctagtacttgaaa

SEQ ID NO: 1569407 - DNA, 10 bp, Homo sapiens
acccatctgt

SEQ ID NO: 1569408 - DNA, 18 bp, Homo sapiens
acccatcttcctgctgct

SEQ ID NO: 1569409 - DNA, 19 bp, Homo sapiens
acccatgaagacaggacag

SEQ ID NO: 1569410 - DNA, 22 bp, Homo sapiens
acccatgatactccactcccag

SEQ ID NO: 1569411 - DNA, 19 bp, Homo sapiens
acccatggtcatctctgtt

SEQ ID NO: 1569412 - DNA, 22 bp, Homo sapiens
acccatgtaatccttttgttta

SEQ ID NO: 1569413 - DNA, 22 bp, Homo sapiens
acccattagcagtccctccaca

SEQ ID NO: 1569414 - DNA, 16 bp, Homo sapiens
acccattcactacagg

SEQ ID NO: 1569415 - DNA, 18 bp, Homo sapiens
acccattcactacaggtg

SEQ ID NO: 1569416 - DNA, 19 bp, Homo sapiens
acccattcccccatgtggc

SEQ ID NO: 1569417 - DNA, 23 bp, Homo sapiens
acccattctgttttcccccagca

SEQ ID NO: 1569418 - DNA, 18 bp, Homo sapiens
acccattgttcccttcct

SEQ ID NO: 1569419 - DNA, 19 bp, Homo sapiens
acccattgttcccttcctc

SEQ ID NO: 1569420 - DNA, 23 bp, Homo sapiens
acccattgttgtcaaggaagaag

SEQ ID NO: 1569421 - DNA, 23 bp, Homo sapiens
acccatttaaatttttttcctta

SEQ ID NO: 1569422 - DNA, 17 bp, Homo sapiens
acccatttttgagccaa

SEQ ID NO: 1569423 - DNA, 18 bp, Homo sapiens
acccatttttgagccaag

SEQ ID NO: 1569424 - DNA, 22 bp, Homo sapiens
acccatttttgagccaagcttc

SEQ ID NO: 1569425 - DNA, 20 bp, Homo sapiens
accccaaacaccttccagct

SEQ ID NO: 1569426 - DNA, 18 bp, Homo sapiens
accccaaagctttcctgc

SEQ ID NO: 1569427 - DNA, 15 bp, Homo sapiens
accccaacaaaccat

SEQ ID NO: 1569428 - DNA, 13 bp, Homo sapiens
accccaagagaac

SEQ ID NO: 1569429 - DNA, 21 bp, Homo sapiens
accccaagctgcctctgggcc

SEQ ID NO: 1569430 - DNA, 14 bp, Homo sapiens
accccacagaacct

SEQ ID NO: 1569431 - DNA, 19 bp, Homo sapiens
accccaccatatgaattgt

SEQ ID NO: 1569432 - DNA, 18 bp, Homo sapiens
accccacccccgccatgc

SEQ ID NO: 1569433 - DNA, 12 bp, Homo sapiens
accccaccccct

SEQ ID NO: 1569434 - DNA, 12 bp, Homo sapiens
accccaccctca

SEQ ID NO: 1569435 - DNA, 13 bp, Homo sapiens
accccaccctcag

SEQ ID NO: 1569436 - DNA, 17 bp, Homo sapiens
accccacctcacagcta

SEQ ID NO: 1569437 - DNA, 13 bp, Homo sapiens
accccactccagc

SEQ ID NO: 1569438 - DNA, 17 bp, Homo sapiens
accccactccagccctg

SEQ ID NO: 1569439 - DNA, 20 bp, Homo sapiens
accccactgggccagccctg

SEQ ID NO: 1569440 - DNA, 17 bp, Homo sapiens
accccagaaattctggc

SEQ ID NO: 1569441 - DNA, 19 bp, Homo sapiens
accccagaaattctggccc

SEQ ID NO: 1569442 - DNA, 19 bp, Homo sapiens
accccagactagatgtagt

SEQ ID NO: 1569443 - DNA, 17 bp, Homo sapiens
accccagaggcagaggt

SEQ ID NO: 1569444 - DNA, 13 bp, Homo sapiens
accccagagtgtg

SEQ ID NO: 1569445 - DNA, 18 bp, Homo sapiens
accccagcctggccacgc

SEQ ID NO: 1569446 - DNA, 17 bp, Homo sapiens
accccagctccctagga

SEQ ID NO: 1569447 - DNA, 20 bp, Homo sapiens
accccagctgggaggcaaga

SEQ ID NO: 1569448 - DNA, 22 bp, Homo sapiens
accccaggacctcttctggaga

SEQ ID NO: 1569449 - DNA, 23 bp, Homo sapiens
accccaggacctcttctggagat

SEQ ID NO: 1569450 - DNA, 15 bp, Homo sapiens
accccagtcccaggg

SEQ ID NO: 1569451 - DNA, 17 bp, Homo sapiens
accccatccagttcatg

SEQ ID NO: 1569452 - DNA, 15 bp, Homo sapiens
accccatcccacacc

SEQ ID NO: 1569453 - DNA, 21 bp, Homo sapiens
accccatggtgctaggaagag

SEQ ID NO: 1569454 - DNA, 14 bp, Homo sapiens
accccattcctgat

SEQ ID NO: 1569455 - DNA, 17 bp, Homo sapiens
acccccaaagacctgcc

SEQ ID NO: 1569456 - DNA, 19 bp, Homo sapiens
acccccaaagacctgcctg

SEQ ID NO: 1569457 - DNA, 20 bp, Homo sapiens
acccccaaagacctgcctgt

SEQ ID NO: 1569458 - DNA, 22 bp, Homo sapiens
acccccacaagctgtccctgca

SEQ ID NO: 1569459 - DNA, 15 bp, Homo sapiens
acccccaccccacac

SEQ ID NO: 1569460 - DNA, 16 bp, Homo sapiens
acccccaccccacact

SEQ ID NO: 1569461 - DNA, 14 bp, Homo sapiens
acccccacccccag

SEQ ID NO: 1569462 - DNA, 18 bp, Homo sapiens
acccccacccccagctca

SEQ ID NO: 1569463 - DNA, 13 bp, Homo sapiens
acccccagctcaa

SEQ ID NO: 1569464 - DNA, 20 bp, Homo sapiens
acccccagctcaatggactg

SEQ ID NO: 1569465 - DNA, 21 bp, Homo sapiens
acccccagctcaatggactgg

SEQ ID NO: 1569466 - DNA, 14 bp, Homo sapiens
acccccagctttgc

SEQ ID NO: 1569467 - DNA, 12 bp, Homo sapiens
acccccatccag

SEQ ID NO: 1569468 - DNA, 17 bp, Homo sapiens
acccccatccagcctcc

SEQ ID NO: 1569469 - DNA, 20 bp, Homo sapiens
acccccatccagcctccagg

SEQ ID NO: 1569470 - DNA, 17 bp, Homo sapiens
acccccatctccctagc

SEQ ID NO: 1569471 - DNA, 17 bp, Homo sapiens
acccccatctctccctc

SEQ ID NO: 1569472 - DNA, 19 bp, Homo sapiens
acccccatcttccacctgt

SEQ ID NO: 1569473 - DNA, 14 bp, Homo sapiens
accccccacccccg

SEQ ID NO: 1569474 - DNA, 13 bp, Homo sapiens
accccccacctgc

SEQ ID NO: 1569475 - DNA, 19 bp, Homo sapiens
accccccagaacctgtcct

SEQ ID NO: 1569476 - DNA, 13 bp, Homo sapiens
accccccagcact

SEQ ID NO: 1569477 - DNA, 14 bp, Homo sapiens
accccccagcactg

SEQ ID NO: 1569478 - DNA, 17 bp, Homo sapiens
accccccagcactgagg

SEQ ID NO: 1569479 - DNA, 19 bp, Homo sapiens
accccccagcactgaggaa

SEQ ID NO: 1569480 - DNA, 14 bp, Homo sapiens
acccccctccccaa

SEQ ID NO: 1569481 - DNA, 17 bp, Homo sapiens
acccccctccccaactc

SEQ ID NO: 1569482 - DNA, 11 bp, Homo sapiens
acccccctcct

SEQ ID NO: 1569483 - DNA, 13 bp, Homo sapiens
acccccctcctgc

SEQ ID NO: 1569484 - DNA, 17 bp, Homo sapiens
acccccctcctgctcct

SEQ ID NO: 1569485 - DNA, 20 bp, Homo sapiens
acccccctcctgctcctccc

SEQ ID NO: 1569486 - DNA, 21 bp, Homo sapiens
acccccctcctgctcctccct

SEQ ID NO: 1569487 - DNA, 17 bp, Homo sapiens
acccccctctctttctc

SEQ ID NO: 1569488 - DNA, 14 bp, Homo sapiens
acccccctctgctg

SEQ ID NO: 1569489 - DNA, 16 bp, Homo sapiens
acccccctctgctgcc

SEQ ID NO: 1569490 - DNA, 20 bp, Homo sapiens
acccccgccacggccaccct

SEQ ID NO: 1569491 - DNA, 20 bp, Homo sapiens
accccctcaccatccagtgg

SEQ ID NO: 1569492 - DNA, 22 bp, Homo sapiens
accccctccccaaagccactgg

SEQ ID NO: 1569493 - DNA, 23 bp, Homo sapiens
accccctccccaaagccactgga

SEQ ID NO: 1569494 - DNA, 13 bp, Homo sapiens
accccctccctgt

SEQ ID NO: 1569495 - DNA, 13 bp, Homo sapiens
accccctcctccc

SEQ ID NO: 1569496 - DNA, 11 bp, Homo sapiens
accccctcctt

SEQ ID NO: 1569497 - DNA, 16 bp, Homo sapiens
accccctccttcagac

SEQ ID NO: 1569498 - DNA, 14 bp, Homo sapiens
accccctctagaaa

SEQ ID NO: 1569499 - DNA, 16 bp, Homo sapiens
accccctctgctctgt

SEQ ID NO: 1569500 - DNA, 13 bp, Homo sapiens
accccctgccctg

SEQ ID NO: 1569501 - DNA, 15 bp, Homo sapiens
accccctgccctgca

SEQ ID NO: 1569502 - DNA, 18 bp, Homo sapiens
accccctgctccaccagc

SEQ ID NO: 1569503 - DNA, 21 bp, Homo sapiens
accccctgctccaccagcagc

SEQ ID NO: 1569504 - DNA, 15 bp, Homo sapiens
accccctggccctgc

SEQ ID NO: 1569505 - DNA, 16 bp, Homo sapiens
accccctggccctgcc

SEQ ID NO: 1569506 - DNA, 22 bp, Homo sapiens
accccctgtcccattctagatc

SEQ ID NO: 1569507 - DNA, 12 bp, Homo sapiens
acccccttcccc

SEQ ID NO: 1569508 - DNA, 16 bp, Homo sapiens
acccccttccctggga

SEQ ID NO: 1569509 - DNA, 17 bp, Homo sapiens
acccccttccctgggag

SEQ ID NO: 1569510 - DNA, 20 bp, Homo sapiens
acccccttctctgctccacc

SEQ ID NO: 1569511 - DNA, 19 bp, Homo sapiens
accccgagaaccctgagca

SEQ ID NO: 1569512 - DNA, 15 bp, Homo sapiens
accccgcacccggct

SEQ ID NO: 1569513 - DNA, 16 bp, Homo sapiens
accccgcacccggctc

SEQ ID NO: 1569514 - DNA, 15 bp, Homo sapiens
accccgcagacacct

SEQ ID NO: 1569515 - DNA, 18 bp, Homo sapiens
accccgcagacaccttgg

SEQ ID NO: 1569516 - DNA, 14 bp, Homo sapiens
accccgcctgccct

SEQ ID NO: 1569517 - DNA, 15 bp, Homo sapiens
accccgcctgcctcc

SEQ ID NO: 1569518 - DNA, 19 bp, Homo sapiens
accccgcctgcctcctggc

SEQ ID NO: 1569519 - DNA, 20 bp, Homo sapiens
accccgcctgcctcctggct

SEQ ID NO: 1569520 - DNA, 17 bp, Homo sapiens
accccgcggtgctctgg

SEQ ID NO: 1569521 - DNA, 19 bp, Homo sapiens
accccgcggtgctctggcg

SEQ ID NO: 1569522 - DNA, 21 bp, Homo sapiens
accccgcggtgctctggcggc

SEQ ID NO: 1569523 - DNA, 14 bp, Homo sapiens
accccggcctcagg

SEQ ID NO: 1569524 - DNA, 15 bp, Homo sapiens
accccggcctccact

SEQ ID NO: 1569525 - DNA, 16 bp, Homo sapiens
accccgggctctctgc

SEQ ID NO: 1569526 - DNA, 18 bp, Homo sapiens
accccggggaccctgtga

SEQ ID NO: 1569527 - DNA, 15 bp, Homo sapiens
acccctaagtgccca

SEQ ID NO: 1569528 - DNA, 17 bp, Homo sapiens
acccctaagtgcccaaa

SEQ ID NO: 1569529 - DNA, 15 bp, Homo sapiens
acccctacactgtga

SEQ ID NO: 1569530 - DNA, 17 bp, Homo sapiens
acccctacagcctgcac

SEQ ID NO: 1569531 - DNA, 14 bp, Homo sapiens
acccctagccctgg

SEQ ID NO: 1569532 - DNA, 15 bp, Homo sapiens
acccctagccctggt

SEQ ID NO: 1569533 - DNA, 17 bp, Homo sapiens
acccctatacctgagcc

SEQ ID NO: 1569534 - DNA, 19 bp, Homo sapiens
acccctcccattaggacaa

SEQ ID NO: 1569535 - DNA, 22 bp, Homo sapiens
acccctccccattcacagagcc

SEQ ID NO: 1569536 - DNA, 16 bp, Homo sapiens
acccctcctggctgtg

SEQ ID NO: 1569537 - DNA, 12 bp, Homo sapiens
acccctccttcc

SEQ ID NO: 1569538 - DNA, 16 bp, Homo sapiens
acccctccttccttga

SEQ ID NO: 1569539 - DNA, 20 bp, Homo sapiens
acccctccttccttgaccag

SEQ ID NO: 1569540 - DNA, 21 bp, Homo sapiens
acccctccttccttgaccagc

SEQ ID NO: 1569541 - DNA, 18 bp, Homo sapiens
acccctctggccaggatg

SEQ ID NO: 1569542 - DNA, 23 bp, Homo sapiens
acccctcttagcttacaggaagc

SEQ ID NO: 1569543 - DNA, 19 bp, Homo sapiens
acccctgacctaccccagc

SEQ ID NO: 1569544 - DNA, 22 bp, Homo sapiens
acccctgacctaccccagccag

SEQ ID NO: 1569545 - DNA, 20 bp, Homo sapiens
acccctgccagttctctgtg

SEQ ID NO: 1569546 - DNA, 10 bp, Homo sapiens
acccctgccc

SEQ ID NO: 1569547 - DNA, 12 bp, Homo sapiens
acccctgccccg

SEQ ID NO: 1569548 - DNA, 21 bp, Homo sapiens
acccctgccccgttgcttccc

SEQ ID NO: 1569549 - DNA, 12 bp, Homo sapiens
acccctgccctg

SEQ ID NO: 1569550 - DNA, 18 bp, Homo sapiens
acccctgcctgttggcag

SEQ ID NO: 1569551 - DNA, 18 bp, Homo sapiens
acccctggaagagcccag

SEQ ID NO: 1569552 - DNA, 18 bp, Homo sapiens
acccctggccagctctga

SEQ ID NO: 1569553 - DNA, 15 bp, Homo sapiens
acccctggctctggg

SEQ ID NO: 1569554 - DNA, 17 bp, Homo sapiens
acccctggcttttcact

SEQ ID NO: 1569555 - DNA, 18 bp, Homo sapiens
acccctggcttttcactg

SEQ ID NO: 1569556 - DNA, 19 bp, Homo sapiens
acccctggcttttcactgc

SEQ ID NO: 1569557 - DNA, 20 bp, Homo sapiens
acccctggcttttcactgct

SEQ ID NO: 1569558 - DNA, 21 bp, Homo sapiens
acccctggcttttcactgctg

SEQ ID NO: 1569559 - DNA, 20 bp, Homo sapiens
acccctggttctcatctttc

SEQ ID NO: 1569560 - DNA, 22 bp, Homo sapiens
acccctggttctcatctttctt

SEQ ID NO: 1569561 - DNA, 16 bp, Homo sapiens
acccctgtacccagct

SEQ ID NO: 1569562 - DNA, 17 bp, Homo sapiens
acccctgtacccagctc

SEQ ID NO: 1569563 - DNA, 18 bp, Homo sapiens
acccctgtacccagctcc

SEQ ID NO: 1569564 - DNA, 19 bp, Homo sapiens
acccctgtacccagctcct

SEQ ID NO: 1569565 - DNA, 22 bp, Homo sapiens
acccctgtgctccgtgcctcca

SEQ ID NO: 1569566 - DNA, 18 bp, Homo sapiens
accccttagcctccctga

SEQ ID NO: 1569567 - DNA, 22 bp, Homo sapiens
accccttcataccgcctcgtgc

SEQ ID NO: 1569568 - DNA, 15 bp, Homo sapiens
accccttccagatca

SEQ ID NO: 1569569 - DNA, 16 bp, Homo sapiens
accccttccagatcac

SEQ ID NO: 1569570 - DNA, 20 bp, Homo sapiens
accccttccagatcactgcc

SEQ ID NO: 1569571 - DNA, 18 bp, Homo sapiens
accccttccatgtggaga

SEQ ID NO: 1569572 - DNA, 23 bp, Homo sapiens
accccttccccaggcccaccatc

SEQ ID NO: 1569573 - DNA, 10 bp, Homo sapiens
accccttcct

SEQ ID NO: 1569574 - DNA, 12 bp, Homo sapiens
accccttcctcc

SEQ ID NO: 1569575 - DNA, 19 bp, Homo sapiens
accccttcctccccacact

SEQ ID NO: 1569576 - DNA, 15 bp, Homo sapiens
accccttctctcctc

SEQ ID NO: 1569577 - DNA, 17 bp, Homo sapiens
accccttctctcctccc

SEQ ID NO: 1569578 - DNA, 14 bp, Homo sapiens
accccttgattttc

SEQ ID NO: 1569579 - DNA, 23 bp, Homo sapiens
accccttggaaatgtctgctggt

SEQ ID NO: 1569580 - DNA, 22 bp, Homo sapiens
accccttggaggagagagaccc

SEQ ID NO: 1569581 - DNA, 18 bp, Homo sapiens
accccttgtttctgttgt

SEQ ID NO: 1569582 - DNA, 21 bp, Homo sapiens
acccgaccccccgtgggctcc

SEQ ID NO: 1569583 - DNA, 13 bp, Homo sapiens
acccgagcacata

SEQ ID NO: 1569584 - DNA, 23 bp, Homo sapiens
acccgagcccagctacattcctc

SEQ ID NO: 1569585 - DNA, 16 bp, Homo sapiens
acccgaggctgagaat

SEQ ID NO: 1569586 - DNA, 13 bp, Homo sapiens
acccgatgctgct

SEQ ID NO: 1569587 - DNA, 22 bp, Homo sapiens
acccgatgctgctttcccctgt

SEQ ID NO: 1569588 - DNA, 13 bp, Homo sapiens
acccgccagcccc

SEQ ID NO: 1569589 - DNA, 22 bp, Homo sapiens
acccgccgccactaggtgtccc

SEQ ID NO: 1569590 - DNA, 21 bp, Homo sapiens
acccgcctctcccgtcagggc

SEQ ID NO: 1569591 - DNA, 15 bp, Homo sapiens
acccggaggggcctg

SEQ ID NO: 1569592 - DNA, 16 bp, Homo sapiens
acccggccacagctgc

SEQ ID NO: 1569593 - DNA, 20 bp, Homo sapiens
acccggccacagctgctgga

SEQ ID NO: 1569594 - DNA, 16 bp, Homo sapiens
acccggcggccctgct

SEQ ID NO: 1569595 - DNA, 17 bp, Homo sapiens
acccggctcgtgtattt

SEQ ID NO: 1569596 - DNA, 22 bp, Homo sapiens
acccggctcgtgtatttattac

SEQ ID NO: 1569597 - DNA, 20 bp, Homo sapiens
acccgggaaggaaggctctc

SEQ ID NO: 1569598 - DNA, 19 bp, Homo sapiens
acccgggaccacagctgct

SEQ ID NO: 1569599 - DNA, 19 bp, Homo sapiens
acccggtgctccctctgtc

SEQ ID NO: 1569600 - DNA, 16 bp, Homo sapiens
acccgtgacagtggct

SEQ ID NO: 1569601 - DNA, 17 bp, Homo sapiens
acccgtgacagtggctg

SEQ ID NO: 1569602 - DNA, 19 bp, Homo sapiens
acccgtgacagtggctgac

SEQ ID NO: 1569603 - DNA, 23 bp, Homo sapiens
acccgttctgctggcctggatct

SEQ ID NO: 1569604 - DNA, 23 bp, Homo sapiens
acccgtttcccggttcaggacca

SEQ ID NO: 1569605 - DNA, 14 bp, Homo sapiens
accctaaaatttta

SEQ ID NO: 1569606 - DNA, 16 bp, Homo sapiens
accctaaatctgagga

SEQ ID NO: 1569607 - DNA, 15 bp, Homo sapiens
accctaaccaagttc

SEQ ID NO: 1569608 - DNA, 18 bp, Homo sapiens
accctaagaatgctttgc

SEQ ID NO: 1569609 - DNA, 21 bp, Homo sapiens
accctaatctttcacttgaaa

SEQ ID NO: 1569610 - DNA, 13 bp, Homo sapiens
accctaccctggc

SEQ ID NO: 1569611 - DNA, 14 bp, Homo sapiens
accctaccctggca

SEQ ID NO: 1569612 - DNA, 17 bp, Homo sapiens
accctaccctggcaggg

SEQ ID NO: 1569613 - DNA, 13 bp, Homo sapiens
accctacctgttc

SEQ ID NO: 1569614 - DNA, 16 bp, Homo sapiens
accctaccttccccag

SEQ ID NO: 1569615 - DNA, 19 bp, Homo sapiens
accctaccttccccagact

SEQ ID NO: 1569616 - DNA, 18 bp, Homo sapiens
accctacttcttttgctc

SEQ ID NO: 1569617 - DNA, 20 bp, Homo sapiens
accctactttgcttccgcca

SEQ ID NO: 1569618 - DNA, 21 bp, Homo sapiens
accctactttgcttccgccac

SEQ ID NO: 1569619 - DNA, 16 bp, Homo sapiens
accctagccaatgtct

SEQ ID NO: 1569620 - DNA, 15 bp, Homo sapiens
accctagttctacct

SEQ ID NO: 1569621 - DNA, 17 bp, Homo sapiens
accctatatgtagtata

SEQ ID NO: 1569622 - DNA, 23 bp, Homo sapiens
accctatattttgcatagtacca

SEQ ID NO: 1569623 - DNA, 23 bp, Homo sapiens
accctattctatccatctcctgg

SEQ ID NO: 1569624 - DNA, 9 bp, Homo sapiens
accctcact

SEQ ID NO: 1569625 - DNA, 17 bp, Homo sapiens
accctcactgctgggga

SEQ ID NO: 1569626 - DNA, 11 bp, Homo sapiens
accctcagagc

SEQ ID NO: 1569627 - DNA, 18 bp, Homo sapiens
accctcagcaccccttcc

SEQ ID NO: 1569628 - DNA, 11 bp, Homo sapiens
accctcaggaa

SEQ ID NO: 1569629 - DNA, 19 bp, Homo sapiens
accctcaggcataggcctg

SEQ ID NO: 1569630 - DNA, 22 bp, Homo sapiens
accctcaggcataggcctgggt

SEQ ID NO: 1569631 - DNA, 16 bp, Homo sapiens
accctcataccatctg

SEQ ID NO: 1569632 - DNA, 19 bp, Homo sapiens
accctcataccatctgctg

SEQ ID NO: 1569633 - DNA, 23 bp, Homo sapiens
accctcataccatctgctgcccc

SEQ ID NO: 1569634 - DNA, 21 bp, Homo sapiens
accctcatggcccccaggggc

SEQ ID NO: 1569635 - DNA, 23 bp, Homo sapiens
accctcatggcccccaggggcag

SEQ ID NO: 1569636 - DNA, 16 bp, Homo sapiens
accctcattgtgtttc

SEQ ID NO: 1569637 - DNA, 21 bp, Homo sapiens
accctccactcagctgtcctg

SEQ ID NO: 1569638 - DNA, 14 bp, Homo sapiens
accctccacttccc

SEQ ID NO: 1569639 - DNA, 20 bp, Homo sapiens
accctccatgctcctcacct

SEQ ID NO: 1569640 - DNA, 14 bp, Homo sapiens
accctcccaccccc

SEQ ID NO: 1569641 - DNA, 20 bp, Homo sapiens
accctcccacccccttctct

SEQ ID NO: 1569642 - DNA, 19 bp, Homo sapiens
accctcccagaaacatctc

SEQ ID NO: 1569643 - DNA, 22 bp, Homo sapiens
accctcccagaaacatctctgg

SEQ ID NO: 1569644 - DNA, 17 bp, Homo sapiens
accctcccatggcacct

SEQ ID NO: 1569645 - DNA, 23 bp, Homo sapiens
accctccccgcaccccccaagct

SEQ ID NO: 1569646 - DNA, 14 bp, Homo sapiens
accctcccctctct

SEQ ID NO: 1569647 - DNA, 18 bp, Homo sapiens
accctccggccagcgagt

SEQ ID NO: 1569648 - DNA, 15 bp, Homo sapiens
accctcctgggaagg

SEQ ID NO: 1569649 - DNA, 14 bp, Homo sapiens
accctcctgtaaat

SEQ ID NO: 1569650 - DNA, 17 bp, Homo sapiens
accctcctgtaaatggt

SEQ ID NO: 1569651 - DNA, 20 bp, Homo sapiens
accctcgggcccacctggcc

SEQ ID NO: 1569652 - DNA, 16 bp, Homo sapiens
accctctcagctccag

SEQ ID NO: 1569653 - DNA, 15 bp, Homo sapiens
accctctcccaggac

SEQ ID NO: 1569654 - DNA, 22 bp, Homo sapiens
accctctcttgattaagggcta

SEQ ID NO: 1569655 - DNA, 20 bp, Homo sapiens
accctctggattctgaatct

SEQ ID NO: 1569656 - DNA, 20 bp, Homo sapiens
accctctgggggtcctctct

SEQ ID NO: 1569657 - DNA, 22 bp, Homo sapiens
accctctgggggtcctctctga

SEQ ID NO: 1569658 - DNA, 13 bp, Homo sapiens
accctcttcatgg

SEQ ID NO: 1569659 - DNA, 17 bp, Homo sapiens
accctcttcctgtgatc

SEQ ID NO: 1569660 - DNA, 18 bp, Homo sapiens
accctcttgcccatcctg

SEQ ID NO: 1569661 - DNA, 20 bp, Homo sapiens
accctctttcttgtttgtca

SEQ ID NO: 1569662 - DNA, 22 bp, Homo sapiens
accctctttcttgtttgtcagc

SEQ ID NO: 1569663 - DNA, 16 bp, Homo sapiens
accctctttgctgcag

SEQ ID NO: 1569664 - DNA, 20 bp, Homo sapiens
accctctttgctgcagagaa

SEQ ID NO: 1569665 - DNA, 20 bp, Homo sapiens
accctgaaaggaacactggc

SEQ ID NO: 1569666 - DNA, 17 bp, Homo sapiens
accctgaagatttcaga

SEQ ID NO: 1569667 - DNA, 21 bp, Homo sapiens
accctgaatttggcctgcact

SEQ ID NO: 1569668 - DNA, 17 bp, Homo sapiens
accctgagactccagaa

SEQ ID NO: 1569669 - DNA, 22 bp, Homo sapiens
accctgagcagggtccacagct

SEQ ID NO: 1569670 - DNA, 23 bp, Homo sapiens
accctgagcagggtccacagctg

SEQ ID NO: 1569671 - DNA, 13 bp, Homo sapiens
accctgagcccac

SEQ ID NO: 1569672 - DNA, 19 bp, Homo sapiens
accctgaggtcactgctag

SEQ ID NO: 1569673 - DNA, 23 bp, Homo sapiens
accctgattcttgattcctggct

SEQ ID NO: 1569674 - DNA, 20 bp, Homo sapiens
accctgatttaggagaagcc

SEQ ID NO: 1569675 - DNA, 22 bp, Homo sapiens
accctgatttaggagaagccag

SEQ ID NO: 1569676 - DNA, 23 bp, Homo sapiens
accctgatttaggagaagccagg

SEQ ID NO: 1569677 - DNA, 20 bp, Homo sapiens
accctgcaagaccacggagg

SEQ ID NO: 1569678 - DNA, 13 bp, Homo sapiens
accctgcacctgc

SEQ ID NO: 1569679 - DNA, 17 bp, Homo sapiens
accctgcacctgctgcg

SEQ ID NO: 1569680 - DNA, 22 bp, Homo sapiens
accctgcacctgctgcgtcccc

SEQ ID NO: 1569681 - DNA, 23 bp, Homo sapiens
accctgcagagcacacaggtaca

SEQ ID NO: 1569682 - DNA, 16 bp, Homo sapiens
accctgcattttcctc

SEQ ID NO: 1569683 - DNA, 17 bp, Homo sapiens
accctgcattttcctct

SEQ ID NO: 1569684 - DNA, 22 bp, Homo sapiens
accctgccaagactcctcaggc

SEQ ID NO: 1569685 - DNA, 17 bp, Homo sapiens
accctgccccttgccat

SEQ ID NO: 1569686 - DNA, 16 bp, Homo sapiens
accctgcccgctccca

SEQ ID NO: 1569687 - DNA, 17 bp, Homo sapiens
accctgcccgctcccaa

SEQ ID NO: 1569688 - DNA, 13 bp, Homo sapiens
accctgccctcct

SEQ ID NO: 1569689 - DNA, 16 bp, Homo sapiens
accctgcctgagccca

SEQ ID NO: 1569690 - DNA, 20 bp, Homo sapiens
accctgcctgagcccaggag

SEQ ID NO: 1569691 - DNA, 23 bp, Homo sapiens
accctgcctgagcccaggagctg

SEQ ID NO: 1569692 - DNA, 14 bp, Homo sapiens
accctgccttatct

SEQ ID NO: 1569693 - DNA, 18 bp, Homo sapiens
accctgccttatcttgca

SEQ ID NO: 1569694 - DNA, 19 bp, Homo sapiens
accctgcgaaggggccctg

SEQ ID NO: 1569695 - DNA, 15 bp, Homo sapiens
accctgcgcctccag

SEQ ID NO: 1569696 - DNA, 18 bp, Homo sapiens
accctgcgcctccagagg

SEQ ID NO: 1569697 - DNA, 19 bp, Homo sapiens
accctgcgcctccagaggt

SEQ ID NO: 1569698 - DNA, 19 bp, Homo sapiens
accctgctgctggtgcaca

SEQ ID NO: 1569699 - DNA, 20 bp, Homo sapiens
accctgcttctgctgccctg

SEQ ID NO: 1569700 - DNA, 19 bp, Homo sapiens
accctggaaaggggagttg

SEQ ID NO: 1569701 - DNA, 22 bp, Homo sapiens
accctggaaccgggaagggtgg

SEQ ID NO: 1569702 - DNA, 18 bp, Homo sapiens
accctggaattcagcacc

SEQ ID NO: 1569703 - DNA, 18 bp, Homo sapiens
accctggagttcttggga

SEQ ID NO: 1569704 - DNA, 23 bp, Homo sapiens
accctggcactataatgtaagct

SEQ ID NO: 1569705 - DNA, 20 bp, Homo sapiens
accctggcagggacctgaga

SEQ ID NO: 1569706 - DNA, 21 bp, Homo sapiens
accctggcagggacctgagag

SEQ ID NO: 1569707 - DNA, 22 bp, Homo sapiens
accctggcccgcccctcgctgc

SEQ ID NO: 1569708 - DNA, 16 bp, Homo sapiens
accctggcctgaactg

SEQ ID NO: 1569709 - DNA, 16 bp, Homo sapiens
accctggcctgagaag

SEQ ID NO: 1569710 - DNA, 14 bp, Homo sapiens
accctggcctggtc

SEQ ID NO: 1569711 - DNA, 20 bp, Homo sapiens
accctgggcaaacagagcta

SEQ ID NO: 1569712 - DNA, 15 bp, Homo sapiens
accctgggccctggg

SEQ ID NO: 1569713 - DNA, 22 bp, Homo sapiens
accctgggccctgggctggaat

SEQ ID NO: 1569714 - DNA, 15 bp, Homo sapiens
accctgggctccaca

SEQ ID NO: 1569715 - DNA, 22 bp, Homo sapiens
accctgggctccacacagcagt

SEQ ID NO: 1569716 - DNA, 15 bp, Homo sapiens
accctgggctgggga

SEQ ID NO: 1569717 - DNA, 18 bp, Homo sapiens
accctgggctggggagga

SEQ ID NO: 1569718 - DNA, 22 bp, Homo sapiens
accctgggctggggaggaggag

SEQ ID NO: 1569719 - DNA, 23 bp, Homo sapiens
accctgggctggggaggaggaga

SEQ ID NO: 1569720 - DNA, 15 bp, Homo sapiens
accctggggaaggag

SEQ ID NO: 1569721 - DNA, 19 bp, Homo sapiens
accctggggaaggagccag

SEQ ID NO: 1569722 - DNA, 18 bp, Homo sapiens
accctggggcctgactgc

SEQ ID NO: 1569723 - DNA, 18 bp, Homo sapiens
accctggggcctggacct

SEQ ID NO: 1569724 - DNA, 21 bp, Homo sapiens
accctgggtgccattcccagc

SEQ ID NO: 1569725 - DNA, 22 bp, Homo sapiens
accctggtccagtcgggaggag

SEQ ID NO: 1569726 - DNA, 13 bp, Homo sapiens
accctggtcctga

SEQ ID NO: 1569727 - DNA, 19 bp, Homo sapiens
accctggtcctgacttccc

SEQ ID NO: 1569728 - DNA, 20 bp, Homo sapiens
accctggttcccaccattcc

SEQ ID NO: 1569729 - DNA, 20 bp, Homo sapiens
accctgtactgttctgtgtc

SEQ ID NO: 1569730 - DNA, 21 bp, Homo sapiens
accctgtcccccagctctggt

SEQ ID NO: 1569731 - DNA, 22 bp, Homo sapiens
accctgtcccccagctctggtg

SEQ ID NO: 1569732 - DNA, 16 bp, Homo sapiens
accctgtccggcccag

SEQ ID NO: 1569733 - DNA, 21 bp, Homo sapiens
accctgtccggcccagtgcca

SEQ ID NO: 1569734 - DNA, 11 bp, Homo sapiens
accctgtctct

SEQ ID NO: 1569735 - DNA, 21 bp, Homo sapiens
accctgtctgtcccttttctt

SEQ ID NO: 1569736 - DNA, 19 bp, Homo sapiens
accctgtgacatggtgcct

SEQ ID NO: 1569737 - DNA, 23 bp, Homo sapiens
accctgtgggcttatgtctctgc

SEQ ID NO: 1569738 - DNA, 14 bp, Homo sapiens
acccttataaaatc

SEQ ID NO: 1569739 - DNA, 15 bp, Homo sapiens
acccttataaaatcc

SEQ ID NO: 1569740 - DNA, 15 bp, Homo sapiens
acccttcagggccag

SEQ ID NO: 1569741 - DNA, 17 bp, Homo sapiens
acccttcatcttcctgt

SEQ ID NO: 1569742 - DNA, 19 bp, Homo sapiens
acccttcatcttcctgtgt

SEQ ID NO: 1569743 - DNA, 16 bp, Homo sapiens
acccttccagacatac

SEQ ID NO: 1569744 - DNA, 14 bp, Homo sapiens
acccttccatcagc

SEQ ID NO: 1569745 - DNA, 20 bp, Homo sapiens
acccttcccaatcagcactg

SEQ ID NO: 1569746 - DNA, 22 bp, Homo sapiens
acccttcccgcctccctctcag

SEQ ID NO: 1569747 - DNA, 15 bp, Homo sapiens
acccttccctcttcc

SEQ ID NO: 1569748 - DNA, 18 bp, Homo sapiens
acccttccctcttccctc

SEQ ID NO: 1569749 - DNA, 22 bp, Homo sapiens
acccttccctcttccctctccc

SEQ ID NO: 1569750 - DNA, 14 bp, Homo sapiens
acccttcctgctgc

SEQ ID NO: 1569751 - DNA, 23 bp, Homo sapiens
acccttcctgctgctgctactgc

SEQ ID NO: 1569752 - DNA, 15 bp, Homo sapiens
acccttctcctttcc

SEQ ID NO: 1569753 - DNA, 20 bp, Homo sapiens
acccttgagacctggaacca

SEQ ID NO: 1569754 - DNA, 21 bp, Homo sapiens
acccttgcaccgtcctcagca

SEQ ID NO: 1569755 - DNA, 18 bp, Homo sapiens
acccttgctttcctgggc

SEQ ID NO: 1569756 - DNA, 20 bp, Homo sapiens
acccttgctttcctgggcct

SEQ ID NO: 1569757 - DNA, 11 bp, Homo sapiens
acccttggcct

SEQ ID NO: 1569758 - DNA, 19 bp, Homo sapiens
acccttggcctccatttct

SEQ ID NO: 1569759 - DNA, 21 bp, Homo sapiens
acccttggcctccatttctgt

SEQ ID NO: 1569760 - DNA, 22 bp, Homo sapiens
acccttggcctccatttctgtc

SEQ ID NO: 1569761 - DNA, 13 bp, Homo sapiens
acccttggcctgt

SEQ ID NO: 1569762 - DNA, 17 bp, Homo sapiens
acccttggcctgtctca

SEQ ID NO: 1569763 - DNA, 17 bp, Homo sapiens
acccttggctcaatcct

SEQ ID NO: 1569764 - DNA, 21 bp, Homo sapiens
accctttccaggttctgaaag

SEQ ID NO: 1569765 - DNA, 14 bp, Homo sapiens
accctttccttcct

SEQ ID NO: 1569766 - DNA, 17 bp, Homo sapiens
accctttccttccttcc

SEQ ID NO: 1569767 - DNA, 19 bp, Homo sapiens
accctttccttccttccct

SEQ ID NO: 1569768 - DNA, 22 bp, Homo sapiens
accctttctgtttggacccatg

SEQ ID NO: 1569769 - DNA, 17 bp, Homo sapiens
accctttcttgacaaaa

SEQ ID NO: 1569770 - DNA, 12 bp, Homo sapiens
accctttggttt

SEQ ID NO: 1569771 - DNA, 11 bp, Homo sapiens
acccttttcat

SEQ ID NO: 1569772 - DNA, 17 bp, Homo sapiens
acccttttcatgatttt

SEQ ID NO: 1569773 - DNA, 17 bp, Homo sapiens
acccttttcccccttcc

SEQ ID NO: 1569774 - DNA, 19 bp, Homo sapiens
acccttttcccccttccca

SEQ ID NO: 1569775 - DNA, 21 bp, Homo sapiens
acccttttcccccttcccatt

SEQ ID NO: 1569776 - DNA, 16 bp, Homo sapiens
acccttttctcaggac

SEQ ID NO: 1569777 - DNA, 17 bp, Homo sapiens
accctttttctccagct

SEQ ID NO: 1569778 - DNA, 16 bp, Homo sapiens
acccttttttctaagt

SEQ ID NO: 1569779 - DNA, 17 bp, Homo sapiens
accgacagcggccttga

SEQ ID NO: 1569780 - DNA, 14 bp, Homo sapiens
accgactttcccca

SEQ ID NO: 1569781 - DNA, 11 bp, Homo sapiens
accgagccagc

SEQ ID NO: 1569782 - DNA, 15 bp, Homo sapiens
accgagccctggaga

SEQ ID NO: 1569783 - DNA, 17 bp, Homo sapiens
accgagccctggagagc

SEQ ID NO: 1569784 - DNA, 17 bp, Homo sapiens
accgagtctcttctcca

SEQ ID NO: 1569785 - DNA, 21 bp, Homo sapiens
accgagtctcttctccactgg

SEQ ID NO: 1569786 - DNA, 20 bp, Homo sapiens
accgatgcaaacattggaag

SEQ ID NO: 1569787 - DNA, 14 bp, Homo sapiens
accgatttctgcta

SEQ ID NO: 1569788 - DNA, 17 bp, Homo sapiens
accgcacatgcacacac

SEQ ID NO: 1569789 - DNA, 14 bp, Homo sapiens
accgcagcgtcccc

SEQ ID NO: 1569790 - DNA, 15 bp, Homo sapiens
accgcagcgtccccc

SEQ ID NO: 1569791 - DNA, 19 bp, Homo sapiens
accgcagcgtcccccgccg

SEQ ID NO: 1569792 - DNA, 13 bp, Homo sapiens
accgcaggcccgg

SEQ ID NO: 1569793 - DNA, 14 bp, Homo sapiens
accgcaggcccgga

SEQ ID NO: 1569794 - DNA, 15 bp, Homo sapiens
accgcaggcccggac

SEQ ID NO: 1569795 - DNA, 14 bp, Homo sapiens
accgccccagggct

SEQ ID NO: 1569796 - DNA, 12 bp, Homo sapiens
accgccccctcc

SEQ ID NO: 1569797 - DNA, 17 bp, Homo sapiens
accgcccggcagcccct

SEQ ID NO: 1569798 - DNA, 20 bp, Homo sapiens
accgcccggcagccccttct

SEQ ID NO: 1569799 - DNA, 15 bp, Homo sapiens
accgcctagtttact

SEQ ID NO: 1569800 - DNA, 20 bp, Homo sapiens
accgcctccccacctccagg

SEQ ID NO: 1569801 - DNA, 22 bp, Homo sapiens
accgcctcgtgccagcagcctc

SEQ ID NO: 1569802 - DNA, 22 bp, Homo sapiens
accgcctgccctcccgcacctt

SEQ ID NO: 1569803 - DNA, 15 bp, Homo sapiens
accgcgtctggtgac

SEQ ID NO: 1569804 - DNA, 21 bp, Homo sapiens
accgctgcctaagtggctgct

SEQ ID NO: 1569805 - DNA, 17 bp, Homo sapiens
accgctggtccctgccc

SEQ ID NO: 1569806 - DNA, 13 bp, Homo sapiens
accggagagagaa

SEQ ID NO: 1569807 - DNA, 12 bp, Homo sapiens
accggcaggtgc

SEQ ID NO: 1569808 - DNA, 13 bp, Homo sapiens
accggccaggccg

SEQ ID NO: 1569809 - DNA, 22 bp, Homo sapiens
accggccaggccgcgcccagca

SEQ ID NO: 1569810 - DNA, 19 bp, Homo sapiens
accggcctgtgggtctctg

SEQ ID NO: 1569811 - DNA, 14 bp, Homo sapiens
accggctctcacct

SEQ ID NO: 1569812 - DNA, 21 bp, Homo sapiens
accggctctcacctggccctg

SEQ ID NO: 1569813 - DNA, 14 bp, Homo sapiens
accgggaagggtgg

SEQ ID NO: 1569814 - DNA, 23 bp, Homo sapiens
accgggaagggtggcctgttccc

SEQ ID NO: 1569815 - DNA, 14 bp, Homo sapiens
accgggacagacct

SEQ ID NO: 1569816 - DNA, 18 bp, Homo sapiens
accgggagaaggcatgag

SEQ ID NO: 1569817 - DNA, 19 bp, Homo sapiens
accgggatgaacctatcct

SEQ ID NO: 1569818 - DNA, 15 bp, Homo sapiens
accgggcagggccgc

SEQ ID NO: 1569819 - DNA, 14 bp, Homo sapiens
accgggtgggcctg

SEQ ID NO: 1569820 - DNA, 14 bp, Homo sapiens
accggtccagctgg

SEQ ID NO: 1569821 - DNA, 15 bp, Homo sapiens
accggtgctgcagga

SEQ ID NO: 1569822 - DNA, 12 bp, Homo sapiens
accgtccagggg

SEQ ID NO: 1569823 - DNA, 22 bp, Homo sapiens
accgtccaggggagatggggag

SEQ ID NO: 1569824 - DNA, 14 bp, Homo sapiens
accgtcccagggct

SEQ ID NO: 1569825 - DNA, 22 bp, Homo sapiens
accgtcccagggctctgcaggc

SEQ ID NO: 1569826 - DNA, 14 bp, Homo sapiens
accgtccgccctgc

SEQ ID NO: 1569827 - DNA, 19 bp, Homo sapiens
accgtcctttcacacatct

SEQ ID NO: 1569828 - DNA, 18 bp, Homo sapiens
accgtggaggaggaaggc

SEQ ID NO: 1569829 - DNA, 15 bp, Homo sapiens
accgtggatttgtac

SEQ ID NO: 1569830 - DNA, 21 bp, Homo sapiens
accgtggccctgccctctcct

SEQ ID NO: 1569831 - DNA, 12 bp, Homo sapiens
accgtggctacc

SEQ ID NO: 1569832 - DNA, 18 bp, Homo sapiens
accgtgggcagtgccacc

SEQ ID NO: 1569833 - DNA, 16 bp, Homo sapiens
accgtggtatgtctgc

SEQ ID NO: 1569834 - DNA, 21 bp, Homo sapiens
accgtgtcccaaggagctgat

SEQ ID NO: 1569835 - DNA, 16 bp, Homo sapiens
accgtgttagccagga

SEQ ID NO: 1569836 - DNA, 19 bp, Homo sapiens
accgtttagaaaaaacaat

SEQ ID NO: 1569837 - DNA, 17 bp, Homo sapiens
acctaaaaattttgtga

SEQ ID NO: 1569838 - DNA, 13 bp, Homo sapiens
acctaaaagagat

SEQ ID NO: 1569839 - DNA, 21 bp, Homo sapiens
acctaaagcctaccctattct

SEQ ID NO: 1569840 - DNA, 20 bp, Homo sapiens
acctaaaggtgtatttaaac

SEQ ID NO: 1569841 - DNA, 11 bp, Homo sapiens
acctaacattc

SEQ ID NO: 1569842 - DNA, 19 bp, Homo sapiens
acctaacattcgatctcat

SEQ ID NO: 1569843 - DNA, 15 bp, Homo sapiens
acctaacccctttcc

SEQ ID NO: 1569844 - DNA, 16 bp, Homo sapiens
acctaacccctttcct

SEQ ID NO: 1569845 - DNA, 18 bp, Homo sapiens
acctaacccctttcctgc

SEQ ID NO: 1569846 - DNA, 17 bp, Homo sapiens
acctaactcttttctat

SEQ ID NO: 1569847 - DNA, 14 bp, Homo sapiens
acctaagccctgcc

SEQ ID NO: 1569848 - DNA, 15 bp, Homo sapiens
acctaagtcaggtaa

SEQ ID NO: 1569849 - DNA, 19 bp, Homo sapiens
acctaagtcaggtaatata

SEQ ID NO: 1569850 - DNA, 14 bp, Homo sapiens
acctaagtctctgt

SEQ ID NO: 1569851 - DNA, 19 bp, Homo sapiens
acctaatatcacttaaatc

SEQ ID NO: 1569852 - DNA, 17 bp, Homo sapiens
acctaatcactaatttt

SEQ ID NO: 1569853 - DNA, 11 bp, Homo sapiens
acctaatccaa

SEQ ID NO: 1569854 - DNA, 12 bp, Homo sapiens
acctaatgttta

SEQ ID NO: 1569855 - DNA, 19 bp, Homo sapiens
acctaatgtttatgagcca

SEQ ID NO: 1569856 - DNA, 16 bp, Homo sapiens
acctaattaaggaagt

SEQ ID NO: 1569857 - DNA, 15 bp, Homo sapiens
acctaattaatatat

SEQ ID NO: 1569858 - DNA, 17 bp, Homo sapiens
acctaatttttttcctg

SEQ ID NO: 1569859 - DNA, 22 bp, Homo sapiens
acctacaccattatcttggaaa

SEQ ID NO: 1569860 - DNA, 16 bp, Homo sapiens
acctacacccctgtgc

SEQ ID NO: 1569861 - DNA, 14 bp, Homo sapiens
acctacagacctgg

SEQ ID NO: 1569862 - DNA, 22 bp, Homo sapiens
acctacagactccatctcttct

SEQ ID NO: 1569863 - DNA, 20 bp, Homo sapiens
acctacatatgctgatcttt

SEQ ID NO: 1569864 - DNA, 14 bp, Homo sapiens
acctacatccccag

SEQ ID NO: 1569865 - DNA, 19 bp, Homo sapiens
acctacatccccaggtctc

SEQ ID NO: 1569866 - DNA, 14 bp, Homo sapiens
acctaccaaaaaat

SEQ ID NO: 1569867 - DNA, 16 bp, Homo sapiens
acctaccacagtgtct

SEQ ID NO: 1569868 - DNA, 14 bp, Homo sapiens
acctaccatgctgc

SEQ ID NO: 1569869 - DNA, 13 bp, Homo sapiens
acctaccccagcc

SEQ ID NO: 1569870 - DNA, 14 bp, Homo sapiens
acctaccccagcca

SEQ ID NO: 1569871 - DNA, 13 bp, Homo sapiens
acctacctcccac

SEQ ID NO: 1569872 - DNA, 20 bp, Homo sapiens
acctacgcacataccttcat

SEQ ID NO: 1569873 - DNA, 16 bp, Homo sapiens
acctactgcactttcc

SEQ ID NO: 1569874 - DNA, 14 bp, Homo sapiens
acctactgcccaca

SEQ ID NO: 1569875 - DNA, 17 bp, Homo sapiens
acctactgcccacattt

SEQ ID NO: 1569876 - DNA, 22 bp, Homo sapiens
acctactgcccacatttgggct

SEQ ID NO: 1569877 - DNA, 14 bp, Homo sapiens
acctactgtctaag

SEQ ID NO: 1569878 - DNA, 15 bp, Homo sapiens
acctactgtctaagc

SEQ ID NO: 1569879 - DNA, 20 bp, Homo sapiens
acctactgtgtcttggaatc

SEQ ID NO: 1569880 - DNA, 15 bp, Homo sapiens
acctagaagtaagaa

SEQ ID NO: 1569881 - DNA, 19 bp, Homo sapiens
acctagaagtctccctgca

SEQ ID NO: 1569882 - DNA, 14 bp, Homo sapiens
acctagcagcctca

SEQ ID NO: 1569883 - DNA, 18 bp, Homo sapiens
acctaggccactcctcca

SEQ ID NO: 1569884 - DNA, 21 bp, Homo sapiens
acctagtcccctttcctctaa

SEQ ID NO: 1569885 - DNA, 23 bp, Homo sapiens
acctatggaagtggttctatgtc

SEQ ID NO: 1569886 - DNA, 19 bp, Homo sapiens
acctatgtcctaaggacac

SEQ ID NO: 1569887 - DNA, 23 bp, Homo sapiens
acctattatccttctacttgtcc

SEQ ID NO: 1569888 - DNA, 17 bp, Homo sapiens
acctattttcatttgta

SEQ ID NO: 1569889 - DNA, 14 bp, Homo sapiens
acctcaaagggcag

SEQ ID NO: 1569890 - DNA, 20 bp, Homo sapiens
acctcaaagggcagttttga

SEQ ID NO: 1569891 - DNA, 21 bp, Homo sapiens
acctcaaagggcagttttgag

SEQ ID NO: 1569892 - DNA, 14 bp, Homo sapiens
acctcaaatatagt

SEQ ID NO: 1569893 - DNA, 21 bp, Homo sapiens
acctcaacccccatttctatt

SEQ ID NO: 1569894 - DNA, 22 bp, Homo sapiens
acctcaactgcctactccaaaa

SEQ ID NO: 1569895 - DNA, 14 bp, Homo sapiens
acctcaagccccat

SEQ ID NO: 1569896 - DNA, 19 bp, Homo sapiens
acctcaagccccatttcct

SEQ ID NO: 1569897 - DNA, 15 bp, Homo sapiens
acctcaagggggact

SEQ ID NO: 1569898 - DNA, 20 bp, Homo sapiens
acctcaagggggactgtctt

SEQ ID NO: 1569899 - DNA, 17 bp, Homo sapiens
acctcaatgccctgcca

SEQ ID NO: 1569900 - DNA, 23 bp, Homo sapiens
acctcacaaccgtacagtttctg

SEQ ID NO: 1569901 - DNA, 12 bp, Homo sapiens
acctcacagcta

SEQ ID NO: 1569902 - DNA, 18 bp, Homo sapiens
acctcacccttgcaccgt

SEQ ID NO: 1569903 - DNA, 23 bp, Homo sapiens
acctcacctgagacctccactcc

SEQ ID NO: 1569904 - DNA, 15 bp, Homo sapiens
acctcacctggtcct

SEQ ID NO: 1569905 - DNA, 16 bp, Homo sapiens
acctcacctggtcctc

SEQ ID NO: 1569906 - DNA, 22 bp, Homo sapiens
acctcactgagaggcctggagc

SEQ ID NO: 1569907 - DNA, 23 bp, Homo sapiens
acctcactggggtcctggggcct

SEQ ID NO: 1569908 - DNA, 14 bp, Homo sapiens
acctcactgtcctg

SEQ ID NO: 1569909 - DNA, 12 bp, Homo sapiens
acctcacttccc

SEQ ID NO: 1569910 - DNA, 16 bp, Homo sapiens
acctcagagcagggcc

SEQ ID NO: 1569911 - DNA, 17 bp, Homo sapiens
acctcagattcttcatt

SEQ ID NO: 1569912 - DNA, 22 bp, Homo sapiens
acctcagccatgaggagttgct

SEQ ID NO: 1569913 - DNA, 23 bp, Homo sapiens
acctcagccatgaggagttgctg

SEQ ID NO: 1569914 - DNA, 14 bp, Homo sapiens
acctcagccccact

SEQ ID NO: 1569915 - DNA, 17 bp, Homo sapiens
acctcagccccactgac

SEQ ID NO: 1569916 - DNA, 19 bp, Homo sapiens
acctcagccctggccctgc

SEQ ID NO: 1569917 - DNA, 16 bp, Homo sapiens
acctcagcctggccag

SEQ ID NO: 1569918 - DNA, 19 bp, Homo sapiens
acctcagcctggccagaca

SEQ ID NO: 1569919 - DNA, 21 bp, Homo sapiens
acctcagcctggccagacaca

SEQ ID NO: 1569920 - DNA, 12 bp, Homo sapiens
acctcaggcagg

SEQ ID NO: 1569921 - DNA, 18 bp, Homo sapiens
acctcaggcttccttggc

SEQ ID NO: 1569922 - DNA, 22 bp, Homo sapiens
acctcagggcacgcaggaccag

SEQ ID NO: 1569923 - DNA, 20 bp, Homo sapiens
acctcagggctcccaggggt

SEQ ID NO: 1569924 - DNA, 13 bp, Homo sapiens
acctcagtgggaa

SEQ ID NO: 1569925 - DNA, 19 bp, Homo sapiens
acctcagtgtcatttatga

SEQ ID NO: 1569926 - DNA, 21 bp, Homo sapiens
acctcagtgtcatttatgaaa

SEQ ID NO: 1569927 - DNA, 16 bp, Homo sapiens
acctcagttcccttgg

SEQ ID NO: 1569928 - DNA, 20 bp, Homo sapiens
acctcagttcccttggcctc

SEQ ID NO: 1569929 - DNA, 21 bp, Homo sapiens
acctcagttcccttggcctca

SEQ ID NO: 1569930 - DNA, 22 bp, Homo sapiens
acctcagttcccttggcctcag

SEQ ID NO: 1569931 - DNA, 18 bp, Homo sapiens
acctcagttttatcattt

SEQ ID NO: 1569932 - DNA, 15 bp, Homo sapiens
acctcatcactggac

SEQ ID NO: 1569933 - DNA, 11 bp, Homo sapiens
acctcatcctg

SEQ ID NO: 1569934 - DNA, 18 bp, Homo sapiens
acctcatctgtggagctg

SEQ ID NO: 1569935 - DNA, 19 bp, Homo sapiens
acctcatctttctccttca

SEQ ID NO: 1569936 - DNA, 16 bp, Homo sapiens
acctcatgacagccag

SEQ ID NO: 1569937 - DNA, 17 bp, Homo sapiens
acctcatgacagccaga

SEQ ID NO: 1569938 - DNA, 18 bp, Homo sapiens
acctcatgacagccagag

SEQ ID NO: 1569939 - DNA, 19 bp, Homo sapiens
acctcatgacagccagagc

SEQ ID NO: 1569940 - DNA, 20 bp, Homo sapiens
acctcattgctaccacagac

SEQ ID NO: 1569941 - DNA, 21 bp, Homo sapiens
acctccaagcaagtagctttc

SEQ ID NO: 1569942 - DNA, 12 bp, Homo sapiens
acctccaccctg

SEQ ID NO: 1569943 - DNA, 16 bp, Homo sapiens
acctccactccacatc

SEQ ID NO: 1569944 - DNA, 14 bp, Homo sapiens
acctccaggctttc

SEQ ID NO: 1569945 - DNA, 14 bp, Homo sapiens
acctccattaaatg

SEQ ID NO: 1569946 - DNA, 16 bp, Homo sapiens
acctcccacactccca

SEQ ID NO: 1569947 - DNA, 14 bp, Homo sapiens
acctcccaccccac

SEQ ID NO: 1569948 - DNA, 19 bp, Homo sapiens
acctcccaccccactccag

SEQ ID NO: 1569949 - DNA, 21 bp, Homo sapiens
acctcccaccccactccagcc

SEQ ID NO: 1569950 - DNA, 23 bp, Homo sapiens
acctcccaccccactccagccct

SEQ ID NO: 1569951 - DNA, 16 bp, Homo sapiens
acctcccactcctgct

SEQ ID NO: 1569952 - DNA, 22 bp, Homo sapiens
acctcccccaaaccctgcttct

SEQ ID NO: 1569953 - DNA, 13 bp, Homo sapiens
acctccccccact

SEQ ID NO: 1569954 - DNA, 14 bp, Homo sapiens
acctccccccactg

SEQ ID NO: 1569955 - DNA, 22 bp, Homo sapiens
acctccccccactgcaggcccc

SEQ ID NO: 1569956 - DNA, 12 bp, Homo sapiens
acctccccctcc

SEQ ID NO: 1569957 - DNA, 22 bp, Homo sapiens
acctccccctccccggccacat

SEQ ID NO: 1569958 - DNA, 18 bp, Homo sapiens
acctccccgctctccctg

SEQ ID NO: 1569959 - DNA, 14 bp, Homo sapiens
acctcccctatcca

SEQ ID NO: 1569960 - DNA, 18 bp, Homo sapiens
acctcccctatccaccca

SEQ ID NO: 1569961 - DNA, 19 bp, Homo sapiens
acctcccctatccacccag

SEQ ID NO: 1569962 - DNA, 11 bp, Homo sapiens
acctccctact

SEQ ID NO: 1569963 - DNA, 15 bp, Homo sapiens
acctccctgaaccat

SEQ ID NO: 1569964 - DNA, 17 bp, Homo sapiens
acctccctgacccgtct

SEQ ID NO: 1569965 - DNA, 21 bp, Homo sapiens
acctcccttaagcagcaacag

SEQ ID NO: 1569966 - DNA, 20 bp, Homo sapiens
acctcccttccctccctgag

SEQ ID NO: 1569967 - DNA, 23 bp, Homo sapiens
acctccgcccctgcccccgctcc

SEQ ID NO: 1569968 - DNA, 16 bp, Homo sapiens
acctccgcctcccagg

SEQ ID NO: 1569969 - DNA, 15 bp, Homo sapiens
acctcctagaggtgg

SEQ ID NO: 1569970 - DNA, 15 bp, Homo sapiens
acctcctcatggcag

SEQ ID NO: 1569971 - DNA, 10 bp, Homo sapiens
acctcctccc

SEQ ID NO: 1569972 - DNA, 21 bp, Homo sapiens
acctcctccctaatgctcacc

SEQ ID NO: 1569973 - DNA, 22 bp, Homo sapiens
acctcctcctttgtttaataaa

SEQ ID NO: 1569974 - DNA, 18 bp, Homo sapiens
acctcctcgaacccactc

SEQ ID NO: 1569975 - DNA, 12 bp, Homo sapiens
acctcctgccca

SEQ ID NO: 1569976 - DNA, 15 bp, Homo sapiens
acctcctgcccagga

SEQ ID NO: 1569977 - DNA, 18 bp, Homo sapiens
acctcctgcccaggagag

SEQ ID NO: 1569978 - DNA, 14 bp, Homo sapiens
acctcctgcctccc

SEQ ID NO: 1569979 - DNA, 14 bp, Homo sapiens
acctcctgctctgg

SEQ ID NO: 1569980 - DNA, 15 bp, Homo sapiens
acctcctgctctggg

SEQ ID NO: 1569981 - DNA, 16 bp, Homo sapiens
acctcctgctctggga

SEQ ID NO: 1569982 - DNA, 17 bp, Homo sapiens
acctccttagccctgtc

SEQ ID NO: 1569983 - DNA, 18 bp, Homo sapiens
acctccttagccctgtct

SEQ ID NO: 1569984 - DNA, 22 bp, Homo sapiens
acctcctttcatcacactgggt

SEQ ID NO: 1569985 - DNA, 21 bp, Homo sapiens
acctcggggacaccagagctg

SEQ ID NO: 1569986 - DNA, 14 bp, Homo sapiens
acctcgtcaagagc

SEQ ID NO: 1569987 - DNA, 15 bp, Homo sapiens
acctcgtcctccccc

SEQ ID NO: 1569988 - DNA, 22 bp, Homo sapiens
acctcgtgatccgcctgcctct

SEQ ID NO: 1569989 - DNA, 18 bp, Homo sapiens
acctctaataaacactgt

SEQ ID NO: 1569990 - DNA, 20 bp, Homo sapiens
acctctagaatcccagcagc

SEQ ID NO: 1569991 - DNA, 13 bp, Homo sapiens
acctctagaattt

SEQ ID NO: 1569992 - DNA, 15 bp, Homo sapiens
acctctagagctgga

SEQ ID NO: 1569993 - DNA, 14 bp, Homo sapiens
acctctaggaggag

SEQ ID NO: 1569994 - DNA, 19 bp, Homo sapiens
acctctcagcatagcctgc

SEQ ID NO: 1569995 - DNA, 23 bp, Homo sapiens
acctctcagcatagcctgcctga

SEQ ID NO: 1569996 - DNA, 12 bp, Homo sapiens
acctctccctcg

SEQ ID NO: 1569997 - DNA, 15 bp, Homo sapiens
acctctcctgccctg

SEQ ID NO: 1569998 - DNA, 20 bp, Homo sapiens
acctctcctttggccattcc

SEQ ID NO: 1569999 - DNA, 23 bp, Homo sapiens
acctctcgcttcctcagcctcca

SEQ ID NO: 1570000 - DNA, 23 bp, Homo sapiens
acctctctcctttgctgaggcct

SEQ ID NO: 1570001 - DNA, 22 bp, Homo sapiens
acctctctggaaggccccttcc

SEQ ID NO: 1570002 - DNA, 19 bp, Homo sapiens
acctctctgtcccttgctg

SEQ ID NO: 1570003 - DNA, 13 bp, Homo sapiens
acctctcttcagc

SEQ ID NO: 1570004 - DNA, 13 bp, Homo sapiens
acctctgaaggca

SEQ ID NO: 1570005 - DNA, 22 bp, Homo sapiens
acctctgaatttacttccttgc

SEQ ID NO: 1570006 - DNA, 14 bp, Homo sapiens
acctctgagaagac

SEQ ID NO: 1570007 - DNA, 12 bp, Homo sapiens
acctctgaggac

SEQ ID NO: 1570008 - DNA, 11 bp, Homo sapiens
acctctgcctc

SEQ ID NO: 1570009 - DNA, 13 bp, Homo sapiens
acctctgcctcaa

SEQ ID NO: 1570010 - DNA, 18 bp, Homo sapiens
acctctgcctcccaggtt

SEQ ID NO: 1570011 - DNA, 12 bp, Homo sapiens
acctctgctgat

SEQ ID NO: 1570012 - DNA, 16 bp, Homo sapiens
acctctggactggcta

SEQ ID NO: 1570013 - DNA, 19 bp, Homo sapiens
acctctggactggctagag

SEQ ID NO: 1570014 - DNA, 19 bp, Homo sapiens
acctctggtggctcctcct

SEQ ID NO: 1570015 - DNA, 21 bp, Homo sapiens
acctctgtgggcactggtggg

SEQ ID NO: 1570016 - DNA, 16 bp, Homo sapiens
acctctgttgtcctcc

SEQ ID NO: 1570017 - DNA, 17 bp, Homo sapiens
acctctgttgtcctccc

SEQ ID NO: 1570018 - DNA, 22 bp, Homo sapiens
acctctgttgtcctccccttgg

SEQ ID NO: 1570019 - DNA, 15 bp, Homo sapiens
acctcttactttgct

SEQ ID NO: 1570020 - DNA, 14 bp, Homo sapiens
acctcttccccaga

SEQ ID NO: 1570021 - DNA, 16 bp, Homo sapiens
acctcttccctctggg

SEQ ID NO: 1570022 - DNA, 12 bp, Homo sapiens
acctcttcctct

SEQ ID NO: 1570023 - DNA, 19 bp, Homo sapiens
acctcttcctctggttcct

SEQ ID NO: 1570024 - DNA, 15 bp, Homo sapiens
acctcttctatgcaa

SEQ ID NO: 1570025 - DNA, 22 bp, Homo sapiens
acctcttctatgcaagccttgc

SEQ ID NO: 1570026 - DNA, 13 bp, Homo sapiens
acctcttctggag

SEQ ID NO: 1570027 - DNA, 23 bp, Homo sapiens
acctcttgttactccctgttatt

SEQ ID NO: 1570028 - DNA, 18 bp, Homo sapiens
acctcttttctgcatcat

SEQ ID NO: 1570029 - DNA, 20 bp, Homo sapiens
acctcttttgagactttgcc

SEQ ID NO: 1570030 - DNA, 14 bp, Homo sapiens
acctcttttttcta

SEQ ID NO: 1570031 - DNA, 23 bp, Homo sapiens
acctcttttttctatctgccaaa

SEQ ID NO: 1570032 - DNA, 14 bp, Homo sapiens
acctgaaattccaa

SEQ ID NO: 1570033 - DNA, 15 bp, Homo sapiens
acctgaaattccaaa

SEQ ID NO: 1570034 - DNA, 19 bp, Homo sapiens
acctgaaattccaaagtct

SEQ ID NO: 1570035 - DNA, 20 bp, Homo sapiens
acctgaaattccaaagtctc

SEQ ID NO: 1570036 - DNA, 14 bp, Homo sapiens
acctgaacaggaat

SEQ ID NO: 1570037 - DNA, 19 bp, Homo sapiens
acctgaaccccagaggcag

SEQ ID NO: 1570038 - DNA, 14 bp, Homo sapiens
acctgaacttgcct

SEQ ID NO: 1570039 - DNA, 19 bp, Homo sapiens
acctgaagatgggagcctt

SEQ ID NO: 1570040 - DNA, 21 bp, Homo sapiens
acctgaaggtcccctggcagt

SEQ ID NO: 1570041 - DNA, 17 bp, Homo sapiens
acctgacaatggcagct

SEQ ID NO: 1570042 - DNA, 19 bp, Homo sapiens
acctgacacaccaggcgct

SEQ ID NO: 1570043 - DNA, 22 bp, Homo sapiens
acctgacaccgtccctcagtga

SEQ ID NO: 1570044 - DNA, 17 bp, Homo sapiens
acctgaccaacatggag

SEQ ID NO: 1570045 - DNA, 19 bp, Homo sapiens
acctgaccaacatggagaa

SEQ ID NO: 1570046 - DNA, 23 bp, Homo sapiens
acctgacctcctttatggttaat

SEQ ID NO: 1570047 - DNA, 15 bp, Homo sapiens
acctgactctgaaat

SEQ ID NO: 1570048 - DNA, 22 bp, Homo sapiens
acctgactctgaaatctgaaga

SEQ ID NO: 1570049 - DNA, 23 bp, Homo sapiens
acctgactctgaaatctgaagac

SEQ ID NO: 1570050 - DNA, 22 bp, Homo sapiens
acctgagagcatctcaggaggg

SEQ ID NO: 1570051 - DNA, 12 bp, Homo sapiens
acctgagctaaa

SEQ ID NO: 1570052 - DNA, 12 bp, Homo sapiens
acctgaggtggg

SEQ ID NO: 1570053 - DNA, 21 bp, Homo sapiens
acctgaggtgggcccaggacc

SEQ ID NO: 1570054 - DNA, 22 bp, Homo sapiens
acctgagtcggccccacatggg

SEQ ID NO: 1570055 - DNA, 20 bp, Homo sapiens
acctgatcctggaggcccag

SEQ ID NO: 1570056 - DNA, 19 bp, Homo sapiens
acctgatgtacctgatgct

SEQ ID NO: 1570057 - DNA, 16 bp, Homo sapiens
acctgattgatcacac

SEQ ID NO: 1570058 - DNA, 22 bp, Homo sapiens
acctgattgatcacacagtgtt

SEQ ID NO: 1570059 - DNA, 15 bp, Homo sapiens
acctgattgtatttt

SEQ ID NO: 1570060 - DNA, 18 bp, Homo sapiens
acctgatttattgaaatt

SEQ ID NO: 1570061 - DNA, 11 bp, Homo sapiens
acctgattttt

SEQ ID NO: 1570062 - DNA, 20 bp, Homo sapiens
acctgattttttttcctttt

SEQ ID NO: 1570063 - DNA, 13 bp, Homo sapiens
acctgcaaaaaat

SEQ ID NO: 1570064 - DNA, 15 bp, Homo sapiens
acctgcaaaaaatag

SEQ ID NO: 1570065 - DNA, 15 bp, Homo sapiens
acctgcaaagatctg

SEQ ID NO: 1570066 - DNA, 16 bp, Homo sapiens
acctgcaaagatctgt

SEQ ID NO: 1570067 - DNA, 10 bp, Homo sapiens
acctgcaaga

SEQ ID NO: 1570068 - DNA, 15 bp, Homo sapiens
acctgcaagatggac

SEQ ID NO: 1570069 - DNA, 16 bp, Homo sapiens
acctgcaagccccagg

SEQ ID NO: 1570070 - DNA, 18 bp, Homo sapiens
acctgcaagccccagggc

SEQ ID NO: 1570071 - DNA, 22 bp, Homo sapiens
acctgcaagccccagggcctgg

SEQ ID NO: 1570072 - DNA, 23 bp, Homo sapiens
acctgcaagccccagggcctggg

SEQ ID NO: 1570073 - DNA, 13 bp, Homo sapiens
acctgcacacagg

SEQ ID NO: 1570074 - DNA, 16 bp, Homo sapiens
acctgcacacaggaca

SEQ ID NO: 1570075 - DNA, 17 bp, Homo sapiens
acctgcacacaggacag

SEQ ID NO: 1570076 - DNA, 15 bp, Homo sapiens
acctgcacctccccc

SEQ ID NO: 1570077 - DNA, 16 bp, Homo sapiens
acctgcacctcccccc

SEQ ID NO: 1570078 - DNA, 17 bp, Homo sapiens
acctgcacctcccccca

SEQ ID NO: 1570079 - DNA, 19 bp, Homo sapiens
acctgcacctccccccact

SEQ ID NO: 1570080 - DNA, 22 bp, Homo sapiens
acctgcacctccccccactgca

SEQ ID NO: 1570081 - DNA, 15 bp, Homo sapiens
acctgcagcccctcc

SEQ ID NO: 1570082 - DNA, 18 bp, Homo sapiens
acctgcaggctccatgca

SEQ ID NO: 1570083 - DNA, 16 bp, Homo sapiens
acctgcagtgccagct

SEQ ID NO: 1570084 - DNA, 19 bp, Homo sapiens
acctgcatccgtagttccc

SEQ ID NO: 1570085 - DNA, 22 bp, Homo sapiens
acctgcatccgtagttccctga

SEQ ID NO: 1570086 - DNA, 16 bp, Homo sapiens
acctgcatctggggcc

SEQ ID NO: 1570087 - DNA, 23 bp, Homo sapiens
acctgccacccccttccctggga

SEQ ID NO: 1570088 - DNA, 18 bp, Homo sapiens
acctgccagcctggcttc

SEQ ID NO: 1570089 - DNA, 18 bp, Homo sapiens
acctgccaggcaggggtg

SEQ ID NO: 1570090 - DNA, 16 bp, Homo sapiens
acctgccccgcccagc

SEQ ID NO: 1570091 - DNA, 18 bp, Homo sapiens
acctgccctctatttatt

SEQ ID NO: 1570092 - DNA, 14 bp, Homo sapiens
acctgccctctctg

SEQ ID NO: 1570093 - DNA, 14 bp, Homo sapiens
acctgccctgcctg

SEQ ID NO: 1570094 - DNA, 17 bp, Homo sapiens
acctgccctgcctgagg

SEQ ID NO: 1570095 - DNA, 18 bp, Homo sapiens
acctgccctgcctgaggg

SEQ ID NO: 1570096 - DNA, 20 bp, Homo sapiens
acctgccctgcctgagggcc

SEQ ID NO: 1570097 - DNA, 17 bp, Homo sapiens
acctgccgacctcgtcc

SEQ ID NO: 1570098 - DNA, 17 bp, Homo sapiens
acctgccgcatgctccc

SEQ ID NO: 1570099 - DNA, 22 bp, Homo sapiens
acctgcctaaattaaattgggc

SEQ ID NO: 1570100 - DNA, 13 bp, Homo sapiens
acctgcctcctgc

SEQ ID NO: 1570101 - DNA, 22 bp, Homo sapiens
acctgcctggtgcattgctgtg

SEQ ID NO: 1570102 - DNA, 16 bp, Homo sapiens
acctgcgcacaggtgg

SEQ ID NO: 1570103 - DNA, 19 bp, Homo sapiens
acctgctcatcatattcca

SEQ ID NO: 1570104 - DNA, 13 bp, Homo sapiens
acctgctcccagt

SEQ ID NO: 1570105 - DNA, 18 bp, Homo sapiens
acctgctgccccagctga

SEQ ID NO: 1570106 - DNA, 17 bp, Homo sapiens
acctgctgcgtccccac

SEQ ID NO: 1570107 - DNA, 19 bp, Homo sapiens
acctgctgcgtccccactc

SEQ ID NO: 1570108 - DNA, 21 bp, Homo sapiens
acctgctgcgtccccactccc

SEQ ID NO: 1570109 - DNA, 20 bp, Homo sapiens
acctgctggttgttgccagg

SEQ ID NO: 1570110 - DNA, 21 bp, Homo sapiens
acctgctggttgttgccaggt

SEQ ID NO: 1570111 - DNA, 22 bp, Homo sapiens
acctgctggttgttgccaggtt

SEQ ID NO: 1570112 - DNA, 21 bp, Homo sapiens
acctgcttagctgccttgagc

SEQ ID NO: 1570113 - DNA, 17 bp, Homo sapiens
acctgcttccttcagtt

SEQ ID NO: 1570114 - DNA, 15 bp, Homo sapiens
acctgcttctgaact

SEQ ID NO: 1570115 - DNA, 15 bp, Homo sapiens
acctgctttcaagac

SEQ ID NO: 1570116 - DNA, 19 bp, Homo sapiens
acctggaaaaattccagaa

SEQ ID NO: 1570117 - DNA, 18 bp, Homo sapiens
acctggaaacagaccaat

SEQ ID NO: 1570118 - DNA, 14 bp, Homo sapiens
acctggaaatgatg

SEQ ID NO: 1570119 - DNA, 19 bp, Homo sapiens
acctggaaccagagccaca

SEQ ID NO: 1570120 - DNA, 15 bp, Homo sapiens
acctggacttcctgt

SEQ ID NO: 1570121 - DNA, 18 bp, Homo sapiens
acctggacttcctgtcat

SEQ ID NO: 1570122 - DNA, 16 bp, Homo sapiens
acctggagatgcagct

SEQ ID NO: 1570123 - DNA, 16 bp, Homo sapiens
acctggagcccctggg

SEQ ID NO: 1570124 - DNA, 18 bp, Homo sapiens
acctggagcccctgggtg

SEQ ID NO: 1570125 - DNA, 15 bp, Homo sapiens
acctggagtttaata

SEQ ID NO: 1570126 - DNA, 16 bp, Homo sapiens
acctggcaaaggaccc

SEQ ID NO: 1570127 - DNA, 10 bp, Homo sapiens
acctggcagt

SEQ ID NO: 1570128 - DNA, 13 bp, Homo sapiens
acctggccacctg

SEQ ID NO: 1570129 - DNA, 16 bp, Homo sapiens
acctggccacctgagg

SEQ ID NO: 1570130 - DNA, 20 bp, Homo sapiens
acctggccacctgaggtggg

SEQ ID NO: 1570131 - DNA, 18 bp, Homo sapiens
acctggccgcctccagga

SEQ ID NO: 1570132 - DNA, 20 bp, Homo sapiens
acctggccgcctccaggagc

SEQ ID NO: 1570133 - DNA, 13 bp, Homo sapiens
acctggcctgtgg

SEQ ID NO: 1570134 - DNA, 22 bp, Homo sapiens
acctggccttaaagagggacag

SEQ ID NO: 1570135 - DNA, 23 bp, Homo sapiens
acctggccttaaagagggacagg

SEQ ID NO: 1570136 - DNA, 19 bp, Homo sapiens
acctggctaattttttgta

SEQ ID NO: 1570137 - DNA, 14 bp, Homo sapiens
acctggctctcaga

SEQ ID NO: 1570138 - DNA, 22 bp, Homo sapiens
acctggctgaggttcctctgcc

SEQ ID NO: 1570139 - DNA, 14 bp, Homo sapiens
acctggcttattta

SEQ ID NO: 1570140 - DNA, 19 bp, Homo sapiens
acctggcttttactttatt

SEQ ID NO: 1570141 - DNA, 21 bp, Homo sapiens
acctggcttttactttattaa

SEQ ID NO: 1570142 - DNA, 15 bp, Homo sapiens
acctgggaaaggacc

SEQ ID NO: 1570143 - DNA, 22 bp, Homo sapiens
acctgggagaaggtctccaagg

SEQ ID NO: 1570144 - DNA, 19 bp, Homo sapiens
acctgggtatcccctgcct

SEQ ID NO: 1570145 - DNA, 23 bp, Homo sapiens
acctgggtatcccctgcctcctg

SEQ ID NO: 1570146 - DNA, 22 bp, Homo sapiens
acctgggttccctttccttcca

SEQ ID NO: 1570147 - DNA, 16 bp, Homo sapiens
acctggtaccctcctg

SEQ ID NO: 1570148 - DNA, 19 bp, Homo sapiens
acctggtaccctcctggct

SEQ ID NO: 1570149 - DNA, 17 bp, Homo sapiens
acctggtactccctctc

SEQ ID NO: 1570150 - DNA, 16 bp, Homo sapiens
acctggttggccgtgg

SEQ ID NO: 1570151 - DNA, 19 bp, Homo sapiens
acctgtaacctttcggcaa

SEQ ID NO: 1570152 - DNA, 15 bp, Homo sapiens
acctgtaacttttgt

SEQ ID NO: 1570153 - DNA, 20 bp, Homo sapiens
acctgtaacttttgtaaata

SEQ ID NO: 1570154 - DNA, 11 bp, Homo sapiens
acctgtaatca

SEQ ID NO: 1570155 - DNA, 12 bp, Homo sapiens
acctgtactcag

SEQ ID NO: 1570156 - DNA, 17 bp, Homo sapiens
acctgtagtcccagcta

SEQ ID NO: 1570157 - DNA, 16 bp, Homo sapiens
acctgtatacagtgca

SEQ ID NO: 1570158 - DNA, 20 bp, Homo sapiens
acctgtatatttgtaaagct

SEQ ID NO: 1570159 - DNA, 17 bp, Homo sapiens
acctgtcaccctgcagg

SEQ ID NO: 1570160 - DNA, 18 bp, Homo sapiens
acctgtcatgcccccctc

SEQ ID NO: 1570161 - DNA, 16 bp, Homo sapiens
acctgtcattttgcac

SEQ ID NO: 1570162 - DNA, 17 bp, Homo sapiens
acctgtcattttgcact

SEQ ID NO: 1570163 - DNA, 14 bp, Homo sapiens
acctgtccccaccc

SEQ ID NO: 1570164 - DNA, 13 bp, Homo sapiens
acctgtccctcca

SEQ ID NO: 1570165 - DNA, 22 bp, Homo sapiens
acctgtcctaaggaaccttcct

SEQ ID NO: 1570166 - DNA, 13 bp, Homo sapiens
acctgtctgctgc

SEQ ID NO: 1570167 - DNA, 15 bp, Homo sapiens
acctgtctgctgcca

SEQ ID NO: 1570168 - DNA, 21 bp, Homo sapiens
acctgtcttgaataagagtga

SEQ ID NO: 1570169 - DNA, 17 bp, Homo sapiens
acctgtcttggcctccc

SEQ ID NO: 1570170 - DNA, 18 bp, Homo sapiens
acctgtgacaaaggatga

SEQ ID NO: 1570171 - DNA, 23 bp, Homo sapiens
acctgtgaccagcactgtctcag

SEQ ID NO: 1570172 - DNA, 19 bp, Homo sapiens
acctgtgagtttaaagcaa

SEQ ID NO: 1570173 - DNA, 12 bp, Homo sapiens
acctgtgcacct

SEQ ID NO: 1570174 - DNA, 13 bp, Homo sapiens
acctgtgccaggc

SEQ ID NO: 1570175 - DNA, 16 bp, Homo sapiens
acctgtgccaggctga

SEQ ID NO: 1570176 - DNA, 15 bp, Homo sapiens
acctgtgccctcacc

SEQ ID NO: 1570177 - DNA, 16 bp, Homo sapiens
acctgtgccctcacca

SEQ ID NO: 1570178 - DNA, 21 bp, Homo sapiens
acctgtgctagttttacagat

SEQ ID NO: 1570179 - DNA, 12 bp, Homo sapiens
acctgtgctttc

SEQ ID NO: 1570180 - DNA, 13 bp, Homo sapiens
acctgtggatatt

SEQ ID NO: 1570181 - DNA, 13 bp, Homo sapiens
acctgtgtcacta

SEQ ID NO: 1570182 - DNA, 19 bp, Homo sapiens
acctgtgtccgatgctgga

SEQ ID NO: 1570183 - DNA, 18 bp, Homo sapiens
acctgtgtgcccagcacc

SEQ ID NO: 1570184 - DNA, 19 bp, Homo sapiens
acctgtgtgcccagcacct

SEQ ID NO: 1570185 - DNA, 22 bp, Homo sapiens
acctgtgtgcccagcacctgga

SEQ ID NO: 1570186 - DNA, 11 bp, Homo sapiens
acctgtgtgct

SEQ ID NO: 1570187 - DNA, 18 bp, Homo sapiens
acctgttacctactttga

SEQ ID NO: 1570188 - DNA, 14 bp, Homo sapiens
acctgttgaagatt

SEQ ID NO: 1570189 - DNA, 14 bp, Homo sapiens
acctgtttaaatat

SEQ ID NO: 1570190 - DNA, 13 bp, Homo sapiens
acctgtttaaatt

SEQ ID NO: 1570191 - DNA, 16 bp, Homo sapiens
acctgtttaaattgct

SEQ ID NO: 1570192 - DNA, 23 bp, Homo sapiens
acctgtttaaattgctcacagtt

SEQ ID NO: 1570193 - DNA, 18 bp, Homo sapiens
acctgtttcaccagtgtt

SEQ ID NO: 1570194 - DNA, 19 bp, Homo sapiens
acctgtttcaccagtgttt

SEQ ID NO: 1570195 - DNA, 15 bp, Homo sapiens
acctgtttctctgcc

SEQ ID NO: 1570196 - DNA, 14 bp, Homo sapiens
acctgttttctgaa

SEQ ID NO: 1570197 - DNA, 14 bp, Homo sapiens
acctgttttcttca

SEQ ID NO: 1570198 - DNA, 16 bp, Homo sapiens
acctgtttttaagctg

SEQ ID NO: 1570199 - DNA, 20 bp, Homo sapiens
acctgtttttaagctgtttc

SEQ ID NO: 1570200 - DNA, 22 bp, Homo sapiens
accttaaaattgatattatatt

SEQ ID NO: 1570201 - DNA, 19 bp, Homo sapiens
accttaaagctgaatttat

SEQ ID NO: 1570202 - DNA, 12 bp, Homo sapiens
accttaagacct

SEQ ID NO: 1570203 - DNA, 22 bp, Homo sapiens
accttagaaatcattgtagaaa

SEQ ID NO: 1570204 - DNA, 14 bp, Homo sapiens
accttagaatacag

SEQ ID NO: 1570205 - DNA, 17 bp, Homo sapiens
accttagcgttctggac

SEQ ID NO: 1570206 - DNA, 21 bp, Homo sapiens
accttagctggcattacagct

SEQ ID NO: 1570207 - DNA, 16 bp, Homo sapiens
accttaggccttcctc

SEQ ID NO: 1570208 - DNA, 20 bp, Homo sapiens
accttaggccttcctctctc

SEQ ID NO: 1570209 - DNA, 23 bp, Homo sapiens
accttaggctttgtatgacagtg

SEQ ID NO: 1570210 - DNA, 13 bp, Homo sapiens
accttatttattt

SEQ ID NO: 1570211 - DNA, 19 bp, Homo sapiens
accttcaaaatgttctatt

SEQ ID NO: 1570212 - DNA, 20 bp, Homo sapiens
accttcaaaatgttctattt

SEQ ID NO: 1570213 - DNA, 18 bp, Homo sapiens
accttcaattcctgggcc

SEQ ID NO: 1570214 - DNA, 14 bp, Homo sapiens
accttcagaataag

SEQ ID NO: 1570215 - DNA, 17 bp, Homo sapiens
accttcagactttgctt

SEQ ID NO: 1570216 - DNA, 22 bp, Homo sapiens
accttcatgattatagcaacta

SEQ ID NO: 1570217 - DNA, 12 bp, Homo sapiens
accttccaccca

SEQ ID NO: 1570218 - DNA, 12 bp, Homo sapiens
accttccagggc

SEQ ID NO: 1570219 - DNA, 16 bp, Homo sapiens
accttccattcacacc

SEQ ID NO: 1570220 - DNA, 17 bp, Homo sapiens
accttcccagctctccc

SEQ ID NO: 1570221 - DNA, 18 bp, Homo sapiens
accttcccagctctccct

SEQ ID NO: 1570222 - DNA, 19 bp, Homo sapiens
accttcccagctctccctc

SEQ ID NO: 1570223 - DNA, 13 bp, Homo sapiens
accttcccgcctc

SEQ ID NO: 1570224 - DNA, 14 bp, Homo sapiens
accttcctcctccc

SEQ ID NO: 1570225 - DNA, 12 bp, Homo sapiens
accttccttccc

SEQ ID NO: 1570226 - DNA, 23 bp, Homo sapiens
accttccttccctggctacttcc

SEQ ID NO: 1570227 - DNA, 22 bp, Homo sapiens
accttccttccctgggctgtgc

SEQ ID NO: 1570228 - DNA, 24 bp, Homo sapiens
accttccttccctgggctgtgcta

SEQ ID NO: 1570229 - DNA, 11 bp, Homo sapiens
accttcgagta

SEQ ID NO: 1570230 - DNA, 16 bp, Homo sapiens
accttcgggctgtgcc

SEQ ID NO: 1570231 - DNA, 17 bp, Homo sapiens
accttctccccattctg

SEQ ID NO: 1570232 - DNA, 19 bp, Homo sapiens
accttctctacccatctcc

SEQ ID NO: 1570233 - DNA, 20 bp, Homo sapiens
accttctctacccatctccc

SEQ ID NO: 1570234 - DNA, 17 bp, Homo sapiens
accttctgagtattctc

SEQ ID NO: 1570235 - DNA, 15 bp, Homo sapiens
accttctgtggctca

SEQ ID NO: 1570236 - DNA, 16 bp, Homo sapiens
accttctgtggctcac

SEQ ID NO: 1570237 - DNA, 15 bp, Homo sapiens
accttctgtggctgt

SEQ ID NO: 1570238 - DNA, 17 bp, Homo sapiens
accttctttattctgtg

SEQ ID NO: 1570239 - DNA, 16 bp, Homo sapiens
accttgaaaaaaaaca

SEQ ID NO: 1570240 - DNA, 15 bp, Homo sapiens
accttgaactgaagg

SEQ ID NO: 1570241 - DNA, 16 bp, Homo sapiens
accttgctctcctcat

SEQ ID NO: 1570242 - DNA, 18 bp, Homo sapiens
accttgctcttctttctg

SEQ ID NO: 1570243 - DNA, 19 bp, Homo sapiens
accttggacatcctcctcc

SEQ ID NO: 1570244 - DNA, 20 bp, Homo sapiens
accttggaccactcctgtcc

SEQ ID NO: 1570245 - DNA, 23 bp, Homo sapiens
accttggaggccttccctggcct

SEQ ID NO: 1570246 - DNA, 16 bp, Homo sapiens
accttggcaccagaca

SEQ ID NO: 1570247 - DNA, 16 bp, Homo sapiens
accttggcataagaca

SEQ ID NO: 1570248 - DNA, 13 bp, Homo sapiens
accttggcccagg

SEQ ID NO: 1570249 - DNA, 22 bp, Homo sapiens
accttggcccaggagctctgcg

SEQ ID NO: 1570250 - DNA, 11 bp, Homo sapiens
accttggcctc

SEQ ID NO: 1570251 - DNA, 15 bp, Homo sapiens
accttggttggaagg

SEQ ID NO: 1570252 - DNA, 10 bp, Homo sapiens
accttgtaaa

SEQ ID NO: 1570253 - DNA, 21 bp, Homo sapiens
accttgtaaaaaaagcaaaaa

SEQ ID NO: 1570254 - DNA, 16 bp, Homo sapiens
accttgtcatgtacca

SEQ ID NO: 1570255 - DNA, 22 bp, Homo sapiens
accttgtcatgtaccatcaata

SEQ ID NO: 1570256 - DNA, 21 bp, Homo sapiens
accttgtctgctaaataaaca

SEQ ID NO: 1570257 - DNA, 22 bp, Homo sapiens
accttgtctgctaaataaacat

SEQ ID NO: 1570258 - DNA, 12 bp, Homo sapiens
accttgtgtctg

SEQ ID NO: 1570259 - DNA, 13 bp, Homo sapiens
accttgtgtctgt

SEQ ID NO: 1570260 - DNA, 15 bp, Homo sapiens
accttgtgtctgtac

SEQ ID NO: 1570261 - DNA, 16 bp, Homo sapiens
accttgttcctgccct

SEQ ID NO: 1570262 - DNA, 16 bp, Homo sapiens
accttgttggagcctg

SEQ ID NO: 1570263 - DNA, 20 bp, Homo sapiens
acctttaaagtaaaggcctc

SEQ ID NO: 1570264 - DNA, 14 bp, Homo sapiens
acctttacagttag

SEQ ID NO: 1570265 - DNA, 14 bp, Homo sapiens
acctttagggcagc

SEQ ID NO: 1570266 - DNA, 20 bp, Homo sapiens
acctttcaccctcatgaaaa

SEQ ID NO: 1570267 - DNA, 19 bp, Homo sapiens
acctttcagtgcagtttct

SEQ ID NO: 1570268 - DNA, 23 bp, Homo sapiens
acctttcagtgcagtttcttttc

SEQ ID NO: 1570269 - DNA, 19 bp, Homo sapiens
acctttcctgatgcccctg

SEQ ID NO: 1570270 - DNA, 21 bp, Homo sapiens
acctttcctgatgcccctgac

SEQ ID NO: 1570271 - DNA, 22 bp, Homo sapiens
acctttcctgatgcccctgaca

SEQ ID NO: 1570272 - DNA, 15 bp, Homo sapiens
acctttctgtagcct

SEQ ID NO: 1570273 - DNA, 11 bp, Homo sapiens
acctttgctat

SEQ ID NO: 1570274 - DNA, 16 bp, Homo sapiens
acctttgctatgtaag

SEQ ID NO: 1570275 - DNA, 18 bp, Homo sapiens
acctttgctatgtaaggg

SEQ ID NO: 1570276 - DNA, 18 bp, Homo sapiens
acctttgggttctttctg

SEQ ID NO: 1570277 - DNA, 23 bp, Homo sapiens
acctttgtggggtttttggagaa

SEQ ID NO: 1570278 - DNA, 14 bp, Homo sapiens
accttttattacat

SEQ ID NO: 1570279 - DNA, 22 bp, Homo sapiens
accttttcaggaaaataactta

SEQ ID NO: 1570280 - DNA, 16 bp, Homo sapiens
accttttccccaggag

SEQ ID NO: 1570281 - DNA, 20 bp, Homo sapiens
accttttcccttgctgtacc

SEQ ID NO: 1570282 - DNA, 22 bp, Homo sapiens
accttttgtagttttatttgta

SEQ ID NO: 1570283 - DNA, 14 bp, Homo sapiens
accttttgttttct

SEQ ID NO: 1570284 - DNA, 23 bp, Homo sapiens
acctttttgcatgatatcttcaa

SEQ ID NO: 1570285 - DNA, 19 bp, Homo sapiens
acgaaacacaaaccacaac

SEQ ID NO: 1570286 - DNA, 15 bp, Homo sapiens
acgaaactccatctc

SEQ ID NO: 1570287 - DNA, 23 bp, Homo sapiens
acgaaactccatctcaaaacaaa

SEQ ID NO: 1570288 - DNA, 12 bp, Homo sapiens
acgaaatgttat

SEQ ID NO: 1570289 - DNA, 23 bp, Homo sapiens
acgaaatgttattttttaattat

SEQ ID NO: 1570290 - DNA, 14 bp, Homo sapiens
acgaacccacctgc

SEQ ID NO: 1570291 - DNA, 16 bp, Homo sapiens
acgaacccacctgctg

SEQ ID NO: 1570292 - DNA, 20 bp, Homo sapiens
acgaagcggagagagccaag

SEQ ID NO: 1570293 - DNA, 21 bp, Homo sapiens
acgaagcggagagagccaaga

SEQ ID NO: 1570294 - DNA, 22 bp, Homo sapiens
acgaaggggccccggggctggc

SEQ ID NO: 1570295 - DNA, 23 bp, Homo sapiens
acgaaggggccccggggctggca

SEQ ID NO: 1570296 - DNA, 12 bp, Homo sapiens
acgaataaaggt

SEQ ID NO: 1570297 - DNA, 16 bp, Homo sapiens
acgaattccatcttgt

SEQ ID NO: 1570298 - DNA, 20 bp, Homo sapiens
acgacaatagctttaccctc

SEQ ID NO: 1570299 - DNA, 13 bp, Homo sapiens
acgaccaaactca

SEQ ID NO: 1570300 - DNA, 13 bp, Homo sapiens
acgacctttacct

SEQ ID NO: 1570301 - DNA, 16 bp, Homo sapiens
acgacgtcagcctctt

SEQ ID NO: 1570302 - DNA, 19 bp, Homo sapiens
acgacgtgggaatttcaat

SEQ ID NO: 1570303 - DNA, 15 bp, Homo sapiens
acgagaaagatcatt

SEQ ID NO: 1570304 - DNA, 11 bp, Homo sapiens
acgagaccccc

SEQ ID NO: 1570305 - DNA, 17 bp, Homo sapiens
acgagacccccatccag

SEQ ID NO: 1570306 - DNA, 20 bp, Homo sapiens
acgagacccccatccagcct

SEQ ID NO: 1570307 - DNA, 22 bp, Homo sapiens
acgagacccccatccagcctcc

SEQ ID NO: 1570308 - DNA, 14 bp, Homo sapiens
acgagcactggcca

SEQ ID NO: 1570309 - DNA, 16 bp, Homo sapiens
acgagcagcccagggc

SEQ ID NO: 1570310 - DNA, 18 bp, Homo sapiens
acgagcagcccagggcct

SEQ ID NO: 1570311 - DNA, 23 bp, Homo sapiens
acgagcagcccagggcctagagg

SEQ ID NO: 1570312 - DNA, 19 bp, Homo sapiens
acgagcaggctactgtcag

SEQ ID NO: 1570313 - DNA, 14 bp, Homo sapiens
acgagccacaagct

SEQ ID NO: 1570314 - DNA, 18 bp, Homo sapiens
acgagccacaagctgcac

SEQ ID NO: 1570315 - DNA, 19 bp, Homo sapiens
acgagccacaagctgcact

SEQ ID NO: 1570316 - DNA, 21 bp, Homo sapiens
acgagccacaagctgcactgt

SEQ ID NO: 1570317 - DNA, 22 bp, Homo sapiens
acgagccacaagctgcactgtg

SEQ ID NO: 1570318 - DNA, 22 bp, Homo sapiens
acgagccttctcaccccaggat

SEQ ID NO: 1570319 - DNA, 20 bp, Homo sapiens
acgagctggaacccacgagg

SEQ ID NO: 1570320 - DNA, 14 bp, Homo sapiens
acgaggcaggggct

SEQ ID NO: 1570321 - DNA, 17 bp, Homo sapiens
acgaggcaggggctctg

SEQ ID NO: 1570322 - DNA, 18 bp, Homo sapiens
acgagggcaacagggagc

SEQ ID NO: 1570323 - DNA, 12 bp, Homo sapiens
acgagggctggc

SEQ ID NO: 1570324 - DNA, 20 bp, Homo sapiens
acgaggggcagggaaggaca

SEQ ID NO: 1570325 - DNA, 17 bp, Homo sapiens
acgagtcaatcccctca

SEQ ID NO: 1570326 - DNA, 12 bp, Homo sapiens
acgagtcacctg

SEQ ID NO: 1570327 - DNA, 16 bp, Homo sapiens
acgagtcacctgcaag

SEQ ID NO: 1570328 - DNA, 20 bp, Homo sapiens
acgagtcacctgcaagcccc

SEQ ID NO: 1570329 - DNA, 19 bp, Homo sapiens
acgatcaagttgttgactg

SEQ ID NO: 1570330 - DNA, 22 bp, Homo sapiens
acgatcggtttcatattttaaa

SEQ ID NO: 1570331 - DNA, 14 bp, Homo sapiens
acgatgaaaaactt

SEQ ID NO: 1570332 - DNA, 14 bp, Homo sapiens
acgatgacagtgtt

SEQ ID NO: 1570333 - DNA, 15 bp, Homo sapiens
acgatgatgtacaga

SEQ ID NO: 1570334 - DNA, 14 bp, Homo sapiens
acgatgcatttaat

SEQ ID NO: 1570335 - DNA, 19 bp, Homo sapiens
acgatgcatttaataaaga

SEQ ID NO: 1570336 - DNA, 19 bp, Homo sapiens
acgatgtgcaatacatttt

SEQ ID NO: 1570337 - DNA, 15 bp, Homo sapiens
acgcacatgcgaccc

SEQ ID NO: 1570338 - DNA, 13 bp, Homo sapiens
acgcaccactgct

SEQ ID NO: 1570339 - DNA, 19 bp, Homo sapiens
acgcaccactgcttcccac

SEQ ID NO: 1570340 - DNA, 17 bp, Homo sapiens
acgcacgacgtcagcct

SEQ ID NO: 1570341 - DNA, 19 bp, Homo sapiens
acgcacgacgtcagcctct

SEQ ID NO: 1570342 - DNA, 16 bp, Homo sapiens
acgcacgcacacacac

SEQ ID NO: 1570343 - DNA, 21 bp, Homo sapiens
acgcactgggccacggaggag

SEQ ID NO: 1570344 - DNA, 15 bp, Homo sapiens
acgcacttgcctgtt

SEQ ID NO: 1570345 - DNA, 16 bp, Homo sapiens
acgcacttgcctgttg

SEQ ID NO: 1570346 - DNA, 11 bp, Homo sapiens
acgcagcagct

SEQ ID NO: 1570347 - DNA, 12 bp, Homo sapiens
acgcagccagga

SEQ ID NO: 1570348 - DNA, 22 bp, Homo sapiens
acgcagccctgctttgggctgc

SEQ ID NO: 1570349 - DNA, 23 bp, Homo sapiens
acgcagccctgctttgggctgcc

SEQ ID NO: 1570350 - DNA, 23 bp, Homo sapiens
acgcatacacacatgccctcctg

SEQ ID NO: 1570351 - DNA, 21 bp, Homo sapiens
acgcatctcaaaacagagggc

SEQ ID NO: 1570352 - DNA, 15 bp, Homo sapiens
acgccacagcccagc

SEQ ID NO: 1570353 - DNA, 20 bp, Homo sapiens
acgccacagcccagccacgg

SEQ ID NO: 1570354 - DNA, 21 bp, Homo sapiens
acgccactgcactccagcctg

SEQ ID NO: 1570355 - DNA, 22 bp, Homo sapiens
acgccactgcactccagcctgg

SEQ ID NO: 1570356 - DNA, 22 bp, Homo sapiens
acgccattgtactccagcctgg

SEQ ID NO: 1570357 - DNA, 21 bp, Homo sapiens
acgcccagctccgcctgctgg

SEQ ID NO: 1570358 - DNA, 14 bp, Homo sapiens
acgcccaggacagc

SEQ ID NO: 1570359 - DNA, 17 bp, Homo sapiens
acgcccaggacagctgg

SEQ ID NO: 1570360 - DNA, 15 bp, Homo sapiens
acgcccatctcagga

SEQ ID NO: 1570361 - DNA, 22 bp, Homo sapiens
acgcccctccaaacctccagcc

SEQ ID NO: 1570362 - DNA, 15 bp, Homo sapiens
acgcccctcccaagc

SEQ ID NO: 1570363 - DNA, 14 bp, Homo sapiens
acgcccctgtggcc

SEQ ID NO: 1570364 - DNA, 22 bp, Homo sapiens
acgcccctgtggccaactgcaa

SEQ ID NO: 1570365 - DNA, 19 bp, Homo sapiens
acgcccgtcctgcctgtgg

SEQ ID NO: 1570366 - DNA, 19 bp, Homo sapiens
acgccctactccactgccc

SEQ ID NO: 1570367 - DNA, 21 bp, Homo sapiens
acgccctactccactgccctg

SEQ ID NO: 1570368 - DNA, 13 bp, Homo sapiens
acgccctatttct

SEQ ID NO: 1570369 - DNA, 17 bp, Homo sapiens
acgccctccctctccca

SEQ ID NO: 1570370 - DNA, 18 bp, Homo sapiens
acgccctccctctcccag

SEQ ID NO: 1570371 - DNA, 22 bp, Homo sapiens
acgccctgcgttggagccactc

SEQ ID NO: 1570372 - DNA, 18 bp, Homo sapiens
acgccctttcctcctcag

SEQ ID NO: 1570373 - DNA, 21 bp, Homo sapiens
acgccctttcctcctcaggca

SEQ ID NO: 1570374 - DNA, 14 bp, Homo sapiens
acgccgccttggcc

SEQ ID NO: 1570375 - DNA, 19 bp, Homo sapiens
acgccgggagaagccacct

SEQ ID NO: 1570376 - DNA, 14 bp, Homo sapiens
acgccgtaattctt

SEQ ID NO: 1570377 - DNA, 19 bp, Homo sapiens
acgccgtaattctttctgt

SEQ ID NO: 1570378 - DNA, 15 bp, Homo sapiens
acgcctcttgaccag

SEQ ID NO: 1570379 - DNA, 16 bp, Homo sapiens
acgcctcttgaccagg

SEQ ID NO: 1570380 - DNA, 21 bp, Homo sapiens
acgcctgatggtgctgctcag

SEQ ID NO: 1570381 - DNA, 12 bp, Homo sapiens
acgcctggaagg

SEQ ID NO: 1570382 - DNA, 17 bp, Homo sapiens
acgcctgtaatcccagc

SEQ ID NO: 1570383 - DNA, 20 bp, Homo sapiens
acgcctgtaatcccagcact

SEQ ID NO: 1570384 - DNA, 16 bp, Homo sapiens
acgcctgtagtcctag

SEQ ID NO: 1570385 - DNA, 17 bp, Homo sapiens
acgccttccaggtcagg

SEQ ID NO: 1570386 - DNA, 18 bp, Homo sapiens
acgccttccaggtcagga

SEQ ID NO: 1570387 - DNA, 17 bp, Homo sapiens
acgccttcccctcagcc

SEQ ID NO: 1570388 - DNA, 14 bp, Homo sapiens
acgccttgttcttg

SEQ ID NO: 1570389 - DNA, 18 bp, Homo sapiens
acgccttgttcttggcca

SEQ ID NO: 1570390 - DNA, 24 bp, Homo sapiens
acgcggctcccggggcagggcagc

SEQ ID NO: 1570391 - DNA, 13 bp, Homo sapiens
acgcgtcttcctg

SEQ ID NO: 1570392 - DNA, 21 bp, Homo sapiens
acgcgtgtgtacacgggactg

SEQ ID NO: 1570393 - DNA, 23 bp, Homo sapiens
acgcgtgtgtacacgggactgac

SEQ ID NO: 1570394 - DNA, 17 bp, Homo sapiens
acgctaaagagcccttg

SEQ ID NO: 1570395 - DNA, 19 bp, Homo sapiens
acgctcatgtcctgtcctg

SEQ ID NO: 1570396 - DNA, 11 bp, Homo sapiens
acgctccagct

SEQ ID NO: 1570397 - DNA, 14 bp, Homo sapiens
acgctcccccgcag

SEQ ID NO: 1570398 - DNA, 15 bp, Homo sapiens
acgctcgcgggcagc

SEQ ID NO: 1570399 - DNA, 21 bp, Homo sapiens
acgctcgcgggcagcgggcca

SEQ ID NO: 1570400 - DNA, 22 bp, Homo sapiens
acgctcttgaggaagcccaggc

SEQ ID NO: 1570401 - DNA, 13 bp, Homo sapiens
acgctgccctgca

SEQ ID NO: 1570402 - DNA, 20 bp, Homo sapiens
acgctgcctctcattggcac

SEQ ID NO: 1570403 - DNA, 19 bp, Homo sapiens
acgctgctgtcacaaccaa

SEQ ID NO: 1570404 - DNA, 18 bp, Homo sapiens
acgctggcaacacagagg

SEQ ID NO: 1570405 - DNA, 20 bp, Homo sapiens
acgcttgcttaggagattta

SEQ ID NO: 1570406 - DNA, 17 bp, Homo sapiens
acgcttgtgacagtgcc

SEQ ID NO: 1570407 - DNA, 23 bp, Homo sapiens
acgcttttaattctcatttgttc

SEQ ID NO: 1570408 - DNA, 16 bp, Homo sapiens
acggaaacatacagag

SEQ ID NO: 1570409 - DNA, 15 bp, Homo sapiens
acggacgctggctcc

SEQ ID NO: 1570410 - DNA, 20 bp, Homo sapiens
acggagcccagccctcccca

SEQ ID NO: 1570411 - DNA, 15 bp, Homo sapiens
acggaggaagcccac

SEQ ID NO: 1570412 - DNA, 18 bp, Homo sapiens
acggaggagggatgctgc

SEQ ID NO: 1570413 - DNA, 19 bp, Homo sapiens
acggaggagggatgctgct

SEQ ID NO: 1570414 - DNA, 15 bp, Homo sapiens
acggaggaggggaag

SEQ ID NO: 1570415 - DNA, 18 bp, Homo sapiens
acggaggcatcctaccct

SEQ ID NO: 1570416 - DNA, 21 bp, Homo sapiens
acggaggcctgcgaccctggg

SEQ ID NO: 1570417 - DNA, 23 bp, Homo sapiens
acggatgggccctatgtctcagg

SEQ ID NO: 1570418 - DNA, 16 bp, Homo sapiens
acggatttgtccaaat

SEQ ID NO: 1570419 - DNA, 23 bp, Homo sapiens
acggcacctcggggacaccagag

SEQ ID NO: 1570420 - DNA, 22 bp, Homo sapiens
acggcagacctcttagagtcct

SEQ ID NO: 1570421 - DNA, 20 bp, Homo sapiens
acggccaccctccttcccgc

SEQ ID NO: 1570422 - DNA, 20 bp, Homo sapiens
acggcctgatgctccctccc

SEQ ID NO: 1570423 - DNA, 21 bp, Homo sapiens
acggccttcaactgaaaagac

SEQ ID NO: 1570424 - DNA, 23 bp, Homo sapiens
acggccttgctgggggccgccct

SEQ ID NO: 1570425 - DNA, 12 bp, Homo sapiens
acggcggccagg

SEQ ID NO: 1570426 - DNA, 13 bp, Homo sapiens
acggcggccaggc

SEQ ID NO: 1570427 - DNA, 14 bp, Homo sapiens
acggcggccaggca

SEQ ID NO: 1570428 - DNA, 20 bp, Homo sapiens
acggcggccaggcacagggc

SEQ ID NO: 1570429 - DNA, 16 bp, Homo sapiens
acggctggtcactctg

SEQ ID NO: 1570430 - DNA, 19 bp, Homo sapiens
acggctggtcactctgccc

SEQ ID NO: 1570431 - DNA, 12 bp, Homo sapiens
acggctgtgacg

SEQ ID NO: 1570432 - DNA, 16 bp, Homo sapiens
acggcttcactgacca

SEQ ID NO: 1570433 - DNA, 18 bp, Homo sapiens
acgggaacatgccccctg

SEQ ID NO: 1570434 - DNA, 23 bp, Homo sapiens
acgggacatcacagggtgggcct

SEQ ID NO: 1570435 - DNA, 16 bp, Homo sapiens
acgggactgacgcaac

SEQ ID NO: 1570436 - DNA, 18 bp, Homo sapiens
acgggagcattggcccct

SEQ ID NO: 1570437 - DNA, 16 bp, Homo sapiens
acgggcacacagactg

SEQ ID NO: 1570438 - DNA, 10 bp, Homo sapiens
acgggcacag

SEQ ID NO: 1570439 - DNA, 22 bp, Homo sapiens
acgggcagcctggctcccagga

SEQ ID NO: 1570440 - DNA, 16 bp, Homo sapiens
acgggccacacgtggc

SEQ ID NO: 1570441 - DNA, 16 bp, Homo sapiens
acgggcgctgcagcct

SEQ ID NO: 1570442 - DNA, 23 bp, Homo sapiens
acgggcttgttgctgttgatgtt

SEQ ID NO: 1570443 - DNA, 18 bp, Homo sapiens
acggggctcttctcattt

SEQ ID NO: 1570444 - DNA, 15 bp, Homo sapiens
acgggggcagtgtga

SEQ ID NO: 1570445 - DNA, 15 bp, Homo sapiens
acgggggctgcttct

SEQ ID NO: 1570446 - DNA, 14 bp, Homo sapiens
acggggtccttcaa

SEQ ID NO: 1570447 - DNA, 20 bp, Homo sapiens
acgggtcagtattaaggttt

SEQ ID NO: 1570448 - DNA, 15 bp, Homo sapiens
acgggtgcctggtca

SEQ ID NO: 1570449 - DNA, 21 bp, Homo sapiens
acggtctggaggccgaggacc

SEQ ID NO: 1570450 - DNA, 19 bp, Homo sapiens
acggtgaaggtgacagcag

SEQ ID NO: 1570451 - DNA, 23 bp, Homo sapiens
acggtgcgcacaccgccagcagc

SEQ ID NO: 1570452 - DNA, 13 bp, Homo sapiens
acggtgctaaaaa

SEQ ID NO: 1570453 - DNA, 21 bp, Homo sapiens
acggtggggcgtagacttgac

SEQ ID NO: 1570454 - DNA, 23 bp, Homo sapiens
acggtgttaattttgctaactgg

SEQ ID NO: 1570455 - DNA, 12 bp, Homo sapiens
acggttcaatgg

SEQ ID NO: 1570456 - DNA, 19 bp, Homo sapiens
acggttcaccagcctctct

SEQ ID NO: 1570457 - DNA, 22 bp, Homo sapiens
acgtaactctttctatgcccgt

SEQ ID NO: 1570458 - DNA, 18 bp, Homo sapiens
acgtaatgcattgcctgt

SEQ ID NO: 1570459 - DNA, 15 bp, Homo sapiens
acgtaccttcatgtg

SEQ ID NO: 1570460 - DNA, 16 bp, Homo sapiens
acgtataaatatcagt

SEQ ID NO: 1570461 - DNA, 18 bp, Homo sapiens
acgtataaatatcagtat

SEQ ID NO: 1570462 - DNA, 19 bp, Homo sapiens
acgtatattgtatcatttg

SEQ ID NO: 1570463 - DNA, 14 bp, Homo sapiens
acgtattgctgtgt

SEQ ID NO: 1570464 - DNA, 17 bp, Homo sapiens
acgtatttcacagagca

SEQ ID NO: 1570465 - DNA, 12 bp, Homo sapiens
acgtcatctcag

SEQ ID NO: 1570466 - DNA, 16 bp, Homo sapiens
acgtccaatcatgggc

SEQ ID NO: 1570467 - DNA, 21 bp, Homo sapiens
acgtccaggttcaacccacag

SEQ ID NO: 1570468 - DNA, 20 bp, Homo sapiens
acgtccatcacgttagctgt

SEQ ID NO: 1570469 - DNA, 19 bp, Homo sapiens
acgtcccagcatccctgga

SEQ ID NO: 1570470 - DNA, 22 bp, Homo sapiens
acgtcccagcatccctggagca

SEQ ID NO: 1570471 - DNA, 23 bp, Homo sapiens
acgtcccctccgccgtgccggcg

SEQ ID NO: 1570472 - DNA, 13 bp, Homo sapiens
acgtccttgggcg

SEQ ID NO: 1570473 - DNA, 12 bp, Homo sapiens
acgtctctgccg

SEQ ID NO: 1570474 - DNA, 15 bp, Homo sapiens
acgtctgccaggccc

SEQ ID NO: 1570475 - DNA, 18 bp, Homo sapiens
acgtctgccaggcccatc

SEQ ID NO: 1570476 - DNA, 17 bp, Homo sapiens
acgtctggctccctgcc

SEQ ID NO: 1570477 - DNA, 21 bp, Homo sapiens
acgtctggctccctgcccctt

SEQ ID NO: 1570478 - DNA, 23 bp, Homo sapiens
acgtcttgctatttgagcatgca

SEQ ID NO: 1570479 - DNA, 13 bp, Homo sapiens
acgtgaaatattt

SEQ ID NO: 1570480 - DNA, 19 bp, Homo sapiens
acgtgacagtgcctgggaa

SEQ ID NO: 1570481 - DNA, 19 bp, Homo sapiens
acgtgagagaaagagagaa

SEQ ID NO: 1570482 - DNA, 21 bp, Homo sapiens
acgtgagagaaagagagaagc

SEQ ID NO: 1570483 - DNA, 18 bp, Homo sapiens
acgtgagggggagctgaa

SEQ ID NO: 1570484 - DNA, 22 bp, Homo sapiens
acgtgatctctgttacaaaaga

SEQ ID NO: 1570485 - DNA, 15 bp, Homo sapiens
acgtgatgtgccact

SEQ ID NO: 1570486 - DNA, 20 bp, Homo sapiens
acgtgcacctgtactcagga

SEQ ID NO: 1570487 - DNA, 15 bp, Homo sapiens
acgtgcactgtgaat

SEQ ID NO: 1570488 - DNA, 13 bp, Homo sapiens
acgtgcaggacag

SEQ ID NO: 1570489 - DNA, 17 bp, Homo sapiens
acgtgcaggacagctct

SEQ ID NO: 1570490 - DNA, 18 bp, Homo sapiens
acgtgcagtatctcaaga

SEQ ID NO: 1570491 - DNA, 19 bp, Homo sapiens
acgtgccagatataactgt

SEQ ID NO: 1570492 - DNA, 23 bp, Homo sapiens
acgtgccagatataactgtcttg

SEQ ID NO: 1570493 - DNA, 14 bp, Homo sapiens
acgtgccaggcccg

SEQ ID NO: 1570494 - DNA, 20 bp, Homo sapiens
acgtgcgtgtctctgccatg

SEQ ID NO: 1570495 - DNA, 21 bp, Homo sapiens
acgtgcttctttgtaatgacc

SEQ ID NO: 1570496 - DNA, 15 bp, Homo sapiens
acgtggacatgcctc

SEQ ID NO: 1570497 - DNA, 14 bp, Homo sapiens
acgtggacctgcct

SEQ ID NO: 1570498 - DNA, 17 bp, Homo sapiens
acgtggacgtttttaat

SEQ ID NO: 1570499 - DNA, 18 bp, Homo sapiens
acgtggactcctcttggt

SEQ ID NO: 1570500 - DNA, 22 bp, Homo sapiens
acgtggatgggcaaagcttgtc

SEQ ID NO: 1570501 - DNA, 15 bp, Homo sapiens
acgtggcatgtggcc

SEQ ID NO: 1570502 - DNA, 16 bp, Homo sapiens
acgtggcctcttgagc

SEQ ID NO: 1570503 - DNA, 12 bp, Homo sapiens
acgtgggaggct

SEQ ID NO: 1570504 - DNA, 22 bp, Homo sapiens
acgtggggtgagggatcactgc

SEQ ID NO: 1570505 - DNA, 17 bp, Homo sapiens
acgtgggtgccctctcc

SEQ ID NO: 1570506 - DNA, 12 bp, Homo sapiens
acgtggtgggac

SEQ ID NO: 1570507 - DNA, 17 bp, Homo sapiens
acgtgtccgtccaccct

SEQ ID NO: 1570508 - DNA, 18 bp, Homo sapiens
acgtgtgtggctgggacc

SEQ ID NO: 1570509 - DNA, 22 bp, Homo sapiens
acgtgttttattcctgtatgtt

SEQ ID NO: 1570510 - DNA, 20 bp, Homo sapiens
acgttaggcatttcctgctg

SEQ ID NO: 1570511 - DNA, 17 bp, Homo sapiens
acgttcatcacctgcta

SEQ ID NO: 1570512 - DNA, 14 bp, Homo sapiens
acgttcggggcatg

SEQ ID NO: 1570513 - DNA, 15 bp, Homo sapiens
acgttctcacaccca

SEQ ID NO: 1570514 - DNA, 20 bp, Homo sapiens
acgttgccaggggcttgaga

SEQ ID NO: 1570515 - DNA, 19 bp, Homo sapiens
acgttggagaagcccgtgt

SEQ ID NO: 1570516 - DNA, 17 bp, Homo sapiens
acgtttaatcccagcac

SEQ ID NO: 1570517 - DNA, 11 bp, Homo sapiens
acgtttataaa

SEQ ID NO: 1570518 - DNA, 19 bp, Homo sapiens
acgtttataaacagaaatg

SEQ ID NO: 1570519 - DNA, 21 bp, Homo sapiens
acgtttataaacagaaatgga

SEQ ID NO: 1570520 - DNA, 12 bp, Homo sapiens
acgtttccatca

SEQ ID NO: 1570521 - DNA, 22 bp, Homo sapiens
acgtttctcaaatctgcttcat

SEQ ID NO: 1570522 - DNA, 14 bp, Homo sapiens
acgtttctggaact

SEQ ID NO: 1570523 - DNA, 14 bp, Homo sapiens
acgtttgcaccgcc

SEQ ID NO: 1570524 - DNA, 18 bp, Homo sapiens
acgtttgcaccgcctgcc

SEQ ID NO: 1570525 - DNA, 14 bp, Homo sapiens
acgttttcttcttt

SEQ ID NO: 1570526 - DNA, 17 bp, Homo sapiens
acgttttcttctttccc

SEQ ID NO: 1570527 - DNA, 20 bp, Homo sapiens
acgttttcttctttccctgg

SEQ ID NO: 1570528 - DNA, 17 bp, Homo sapiens
acgttttgcacattttg

SEQ ID NO: 1570529 - DNA, 16 bp, Homo sapiens
actaaaaagaaggaaa

SEQ ID NO: 1570530 - DNA, 14 bp, Homo sapiens
actaaaaatacacc

SEQ ID NO: 1570531 - DNA, 13 bp, Homo sapiens
actaaaattcaac

SEQ ID NO: 1570532 - DNA, 17 bp, Homo sapiens
actaaaattcaacaaat

SEQ ID NO: 1570533 - DNA, 19 bp, Homo sapiens
actaaaattcaacaaatga

SEQ ID NO: 1570534 - DNA, 19 bp, Homo sapiens
actaaactttttttctgta

SEQ ID NO: 1570535 - DNA, 20 bp, Homo sapiens
actaaactttttttctgtac

SEQ ID NO: 1570536 - DNA, 21 bp, Homo sapiens
actaaagaaaatatctgaaat

SEQ ID NO: 1570537 - DNA, 15 bp, Homo sapiens
actaaagaaagatta

SEQ ID NO: 1570538 - DNA, 17 bp, Homo sapiens
actaaagaaagattact

SEQ ID NO: 1570539 - DNA, 17 bp, Homo sapiens
actaaagagtgaatgcc

SEQ ID NO: 1570540 - DNA, 19 bp, Homo sapiens
actaaagagtgaatgccat

SEQ ID NO: 1570541 - DNA, 19 bp, Homo sapiens
actaaagatatcagagctc

SEQ ID NO: 1570542 - DNA, 16 bp, Homo sapiens
actaaagatccaagaa

SEQ ID NO: 1570543 - DNA, 11 bp, Homo sapiens
actaaagcaaa

SEQ ID NO: 1570544 - DNA, 20 bp, Homo sapiens
actaaagcagtggacaccag

SEQ ID NO: 1570545 - DNA, 16 bp, Homo sapiens
actaaagcttcagact

SEQ ID NO: 1570546 - DNA, 19 bp, Homo sapiens
actaaataagaaaataaca

SEQ ID NO: 1570547 - DNA, 16 bp, Homo sapiens
actaaatgagctcctg

SEQ ID NO: 1570548 - DNA, 18 bp, Homo sapiens
actaaatgagctcctgcg

SEQ ID NO: 1570549 - DNA, 13 bp, Homo sapiens
actaaattttaaa

SEQ ID NO: 1570550 - DNA, 13 bp, Homo sapiens
actaacagataag

SEQ ID NO: 1570551 - DNA, 20 bp, Homo sapiens
actaacataaaatctgtgaa

SEQ ID NO: 1570552 - DNA, 22 bp, Homo sapiens
actaaccaagctgagtttccta

SEQ ID NO: 1570553 - DNA, 17 bp, Homo sapiens
actaaccatccccaact

SEQ ID NO: 1570554 - DNA, 21 bp, Homo sapiens
actaaccccaacgcacaggaa

SEQ ID NO: 1570555 - DNA, 18 bp, Homo sapiens
actaacgttgagcccctg

SEQ ID NO: 1570556 - DNA, 18 bp, Homo sapiens
actaactcaaatacacat

SEQ ID NO: 1570557 - DNA, 11 bp, Homo sapiens
actaacttgtt

SEQ ID NO: 1570558 - DNA, 13 bp, Homo sapiens
actaagaagaaaa

SEQ ID NO: 1570559 - DNA, 22 bp, Homo sapiens
actaagaatgtccttattcttg

SEQ ID NO: 1570560 - DNA, 20 bp, Homo sapiens
actaagaccctggtctgagg

SEQ ID NO: 1570561 - DNA, 19 bp, Homo sapiens
actaagagaaactgtgtat

SEQ ID NO: 1570562 - DNA, 16 bp, Homo sapiens
actaagagaagttgta

SEQ ID NO: 1570563 - DNA, 21 bp, Homo sapiens
actaagccctcgaaccaaggc

SEQ ID NO: 1570564 - DNA, 23 bp, Homo sapiens
actaagccctcgaaccaaggcag

SEQ ID NO: 1570565 - DNA, 16 bp, Homo sapiens
actaaggatttttcaa

SEQ ID NO: 1570566 - DNA, 15 bp, Homo sapiens
actaaggtgaagaat

SEQ ID NO: 1570567 - DNA, 13 bp, Homo sapiens
actaataaaataa

SEQ ID NO: 1570568 - DNA, 16 bp, Homo sapiens
actaatagaataaagg

SEQ ID NO: 1570569 - DNA, 11 bp, Homo sapiens
actaatatata

SEQ ID NO: 1570570 - DNA, 14 bp, Homo sapiens
actaatatatattt

SEQ ID NO: 1570571 - DNA, 23 bp, Homo sapiens
actaatatatattttaaggttgc

SEQ ID NO: 1570572 - DNA, 21 bp, Homo sapiens
actaatcaatacgtgatctct

SEQ ID NO: 1570573 - DNA, 21 bp, Homo sapiens
actaatcttaaccctgtgctg

SEQ ID NO: 1570574 - DNA, 19 bp, Homo sapiens
actaatgccttactcttct

SEQ ID NO: 1570575 - DNA, 16 bp, Homo sapiens
actaatgctaagaaat

SEQ ID NO: 1570576 - DNA, 21 bp, Homo sapiens
actaatgctttttagaaagca

SEQ ID NO: 1570577 - DNA, 23 bp, Homo sapiens
actaatgctttttagaaagcatt

SEQ ID NO: 1570578 - DNA, 20 bp, Homo sapiens
actaattattattttaaaat

SEQ ID NO: 1570579 - DNA, 13 bp, Homo sapiens
actaatttcttct

SEQ ID NO: 1570580 - DNA, 15 bp, Homo sapiens
actaatttgaataaa

SEQ ID NO: 1570581 - DNA, 19 bp, Homo sapiens
actaatttggctttcacat

SEQ ID NO: 1570582 - DNA, 23 bp, Homo sapiens
actaattttacacattagatttt

SEQ ID NO: 1570583 - DNA, 14 bp, Homo sapiens
actaattttgttga

SEQ ID NO: 1570584 - DNA, 18 bp, Homo sapiens
actaattttgttgaaaat

SEQ ID NO: 1570585 - DNA, 13 bp, Homo sapiens
actaatttttgta

SEQ ID NO: 1570586 - DNA, 19 bp, Homo sapiens
actaatttttgtattattt

SEQ ID NO: 1570587 - DNA, 23 bp, Homo sapiens
actacaaagcttctatcccagga

SEQ ID NO: 1570588 - DNA, 11 bp, Homo sapiens
actacaaagta

SEQ ID NO: 1570589 - DNA, 19 bp, Homo sapiens
actacaaccaagctctctg

SEQ ID NO: 1570590 - DNA, 12 bp, Homo sapiens
actacacaatac

SEQ ID NO: 1570591 - DNA, 15 bp, Homo sapiens
actacacaatacagt

SEQ ID NO: 1570592 - DNA, 16 bp, Homo sapiens
actacacaatacagta

SEQ ID NO: 1570593 - DNA, 12 bp, Homo sapiens
actacacatttg

SEQ ID NO: 1570594 - DNA, 17 bp, Homo sapiens
actacacccaagcctga

SEQ ID NO: 1570595 - DNA, 13 bp, Homo sapiens
actacacctggct

SEQ ID NO: 1570596 - DNA, 15 bp, Homo sapiens
actacactccagcct

SEQ ID NO: 1570597 - DNA, 18 bp, Homo sapiens
actacactccagcctgag

SEQ ID NO: 1570598 - DNA, 17 bp, Homo sapiens
actacagaataatgtgt

SEQ ID NO: 1570599 - DNA, 20 bp, Homo sapiens
actacagaataatgtgttaa

SEQ ID NO: 1570600 - DNA, 22 bp, Homo sapiens
actacataattaaattttaatg

SEQ ID NO: 1570601 - DNA, 16 bp, Homo sapiens
actaccaaacactcag

SEQ ID NO: 1570602 - DNA, 13 bp, Homo sapiens
actaccagccagc

SEQ ID NO: 1570603 - DNA, 19 bp, Homo sapiens
actaccatctgatgtttca

SEQ ID NO: 1570604 - DNA, 23 bp, Homo sapiens
actaccatctgatgtttcatatt

SEQ ID NO: 1570605 - DNA, 23 bp, Homo sapiens
actacccacgttctcacacccac

SEQ ID NO: 1570606 - DNA, 19 bp, Homo sapiens
actacccaggttaagaaaa

SEQ ID NO: 1570607 - DNA, 22 bp, Homo sapiens
actacccattgttcccttcctc

SEQ ID NO: 1570608 - DNA, 14 bp, Homo sapiens
actaccccttgatt

SEQ ID NO: 1570609 - DNA, 21 bp, Homo sapiens
actaccccttgattttccatc

SEQ ID NO: 1570610 - DNA, 16 bp, Homo sapiens
actacccgagcccagc

SEQ ID NO: 1570611 - DNA, 22 bp, Homo sapiens
actacccttctcctttccttcc

SEQ ID NO: 1570612 - DNA, 12 bp, Homo sapiens
actacctagaag

SEQ ID NO: 1570613 - DNA, 15 bp, Homo sapiens
actacctagaagtaa

SEQ ID NO: 1570614 - DNA, 15 bp, Homo sapiens
actacctctggacag

SEQ ID NO: 1570615 - DNA, 13 bp, Homo sapiens
actacctgtcaag

SEQ ID NO: 1570616 - DNA, 16 bp, Homo sapiens
actacgtcttaagtca

SEQ ID NO: 1570617 - DNA, 19 bp, Homo sapiens
actactaatagaataaagg

SEQ ID NO: 1570618 - DNA, 15 bp, Homo sapiens
actactactggtgat

SEQ ID NO: 1570619 - DNA, 21 bp, Homo sapiens
actactcctctgcagtgcctt

SEQ ID NO: 1570620 - DNA, 21 bp, Homo sapiens
actactcgagcccacccagca

SEQ ID NO: 1570621 - DNA, 19 bp, Homo sapiens
actactgaacacatgtgta

SEQ ID NO: 1570622 - DNA, 22 bp, Homo sapiens
actactgacggagtcctgtgtt

SEQ ID NO: 1570623 - DNA, 13 bp, Homo sapiens
actactgcagcac

SEQ ID NO: 1570624 - DNA, 15 bp, Homo sapiens
actactgcagcacct

SEQ ID NO: 1570625 - DNA, 19 bp, Homo sapiens
actactgctcctgtggcag

SEQ ID NO: 1570626 - DNA, 13 bp, Homo sapiens
actactgtacttt

SEQ ID NO: 1570627 - DNA, 21 bp, Homo sapiens
actactttgccttcttttgta

SEQ ID NO: 1570628 - DNA, 22 bp, Homo sapiens
actactttttatactccataca

SEQ ID NO: 1570629 - DNA, 16 bp, Homo sapiens
actagaaattgggcag

SEQ ID NO: 1570630 - DNA, 16 bp, Homo sapiens
actagaactctccatc

SEQ ID NO: 1570631 - DNA, 14 bp, Homo sapiens
actagaagaaaagc

SEQ ID NO: 1570632 - DNA, 15 bp, Homo sapiens
actagaagaaaagcc

SEQ ID NO: 1570633 - DNA, 19 bp, Homo sapiens
actagaagaaaagcccatt

SEQ ID NO: 1570634 - DNA, 23 bp, Homo sapiens
actagaattcaggtgctttgcta

SEQ ID NO: 1570635 - DNA, 17 bp, Homo sapiens
actagaattctagtgct

SEQ ID NO: 1570636 - DNA, 21 bp, Homo sapiens
actagaattctagtgctgctg

SEQ ID NO: 1570637 - DNA, 23 bp, Homo sapiens
actagaattctagtgctgctgaa

SEQ ID NO: 1570638 - DNA, 17 bp, Homo sapiens
actagacaccaaagttc

SEQ ID NO: 1570639 - DNA, 12 bp, Homo sapiens
actagagggccc

SEQ ID NO: 1570640 - DNA, 16 bp, Homo sapiens
actagagggcccatca

SEQ ID NO: 1570641 - DNA, 15 bp, Homo sapiens
actagatacagaata

SEQ ID NO: 1570642 - DNA, 18 bp, Homo sapiens
actagatggacctgcctg

SEQ ID NO: 1570643 - DNA, 16 bp, Homo sapiens
actagatgtagtattt

SEQ ID NO: 1570644 - DNA, 20 bp, Homo sapiens
actagattaagatctgtgtt

SEQ ID NO: 1570645 - DNA, 15 bp, Homo sapiens
actagatttgggaga

SEQ ID NO: 1570646 - DNA, 13 bp, Homo sapiens
actagatttgtcc

SEQ ID NO: 1570647 - DNA, 18 bp, Homo sapiens
actagatttgtcctttta

SEQ ID NO: 1570648 - DNA, 19 bp, Homo sapiens
actagatttgtccttttat

SEQ ID NO: 1570649 - DNA, 10 bp, Homo sapiens
actagcatta

SEQ ID NO: 1570650 - DNA, 16 bp, Homo sapiens
actagcattacattat

SEQ ID NO: 1570651 - DNA, 18 bp, Homo sapiens
actagcattacattatta

SEQ ID NO: 1570652 - DNA, 14 bp, Homo sapiens
actagccaaaccag

SEQ ID NO: 1570653 - DNA, 16 bp, Homo sapiens
actagcctggccaaca

SEQ ID NO: 1570654 - DNA, 23 bp, Homo sapiens
actagctagaagtgggccaggac

SEQ ID NO: 1570655 - DNA, 18 bp, Homo sapiens
actaggactcagaaacga

SEQ ID NO: 1570656 - DNA, 18 bp, Homo sapiens
actaggagaaccaaatct

SEQ ID NO: 1570657 - DNA, 23 bp, Homo sapiens
actaggattggagtatgatttac

SEQ ID NO: 1570658 - DNA, 23 bp, Homo sapiens
actaggcccccacttgcctcttc

SEQ ID NO: 1570659 - DNA, 14 bp, Homo sapiens
actaggctgagcaa

SEQ ID NO: 1570660 - DNA, 19 bp, Homo sapiens
actagggagccatttgaga

SEQ ID NO: 1570661 - DNA, 17 bp, Homo sapiens
actagggattcaggctg

SEQ ID NO: 1570662 - DNA, 18 bp, Homo sapiens
actaggtcaaaaatctgt

SEQ ID NO: 1570663 - DNA, 15 bp, Homo sapiens
actaggtgtccccaa

SEQ ID NO: 1570664 - DNA, 20 bp, Homo sapiens
actaggttggacagccccct

SEQ ID NO: 1570665 - DNA, 15 bp, Homo sapiens
actagtaaaggagga

SEQ ID NO: 1570666 - DNA, 23 bp, Homo sapiens
actagtaataccaaagactattt

SEQ ID NO: 1570667 - DNA, 22 bp, Homo sapiens
actagtacaagtggtaattttt

SEQ ID NO: 1570668 - DNA, 15 bp, Homo sapiens
actagtactatttct

SEQ ID NO: 1570669 - DNA, 18 bp, Homo sapiens
actagtactatttcttaa

SEQ ID NO: 1570670 - DNA, 23 bp, Homo sapiens
actagtgacaagctcctggtctt

SEQ ID NO: 1570671 - DNA, 16 bp, Homo sapiens
actagtgacagcttgt

SEQ ID NO: 1570672 - DNA, 13 bp, Homo sapiens
actagtgttctgt

SEQ ID NO: 1570673 - DNA, 15 bp, Homo sapiens
actagtgttgcttgg

SEQ ID NO: 1570674 - DNA, 18 bp, Homo sapiens
actagttacacatcttca

SEQ ID NO: 1570675 - DNA, 14 bp, Homo sapiens
actagtttccagtg

SEQ ID NO: 1570676 - DNA, 18 bp, Homo sapiens
actataaacttaagggca

SEQ ID NO: 1570677 - DNA, 20 bp, Homo sapiens
actataaagaagtaacaaaa

SEQ ID NO: 1570678 - DNA, 13 bp, Homo sapiens
actataaagctgt

SEQ ID NO: 1570679 - DNA, 16 bp, Homo sapiens
actataacaatcactg

SEQ ID NO: 1570680 - DNA, 15 bp, Homo sapiens
actataaggtgcctc

SEQ ID NO: 1570681 - DNA, 11 bp, Homo sapiens
actataatgta

SEQ ID NO: 1570682 - DNA, 13 bp, Homo sapiens
actataatgtaag

SEQ ID NO: 1570683 - DNA, 14 bp, Homo sapiens
actataatgtaagc

SEQ ID NO: 1570684 - DNA, 22 bp, Homo sapiens
actataggcatgcgccaccatg

SEQ ID NO: 1570685 - DNA, 12 bp, Homo sapiens
actatatgtgaa

SEQ ID NO: 1570686 - DNA, 21 bp, Homo sapiens
actatatgtgaaacatttttt

SEQ ID NO: 1570687 - DNA, 13 bp, Homo sapiens
actatatttgcta

SEQ ID NO: 1570688 - DNA, 19 bp, Homo sapiens
actatcaaactgaagccag

SEQ ID NO: 1570689 - DNA, 15 bp, Homo sapiens
actatcattaacatt

SEQ ID NO: 1570690 - DNA, 17 bp, Homo sapiens
actatcccaatcaaaga

SEQ ID NO: 1570691 - DNA, 18 bp, Homo sapiens
actatcctgattccaaat

SEQ ID NO: 1570692 - DNA, 19 bp, Homo sapiens
actatctccgttccatctg

SEQ ID NO: 1570693 - DNA, 11 bp, Homo sapiens
actatcttgtg

SEQ ID NO: 1570694 - DNA, 13 bp, Homo sapiens
actatgaatctat

SEQ ID NO: 1570695 - DNA, 12 bp, Homo sapiens
actatgacactg

SEQ ID NO: 1570696 - DNA, 14 bp, Homo sapiens
actatgatcacagt

SEQ ID NO: 1570697 - DNA, 17 bp, Homo sapiens
actatgatcacagtgac

SEQ ID NO: 1570698 - DNA, 14 bp, Homo sapiens
actatgatctcagg

SEQ ID NO: 1570699 - DNA, 15 bp, Homo sapiens
actatgatctcagga

SEQ ID NO: 1570700 - DNA, 14 bp, Homo sapiens
actatgatttctga

SEQ ID NO: 1570701 - DNA, 17 bp, Homo sapiens
actatgcagaggcctgg

SEQ ID NO: 1570702 - DNA, 19 bp, Homo sapiens
actatgccgtcttctgccc

SEQ ID NO: 1570703 - DNA, 14 bp, Homo sapiens
actatgctaatttt

SEQ ID NO: 1570704 - DNA, 21 bp, Homo sapiens
actatgctattaaaaaaaaag

SEQ ID NO: 1570705 - DNA, 23 bp, Homo sapiens
actatggagcctggcacaggact

SEQ ID NO: 1570706 - DNA, 22 bp, Homo sapiens
actatggtaacactttgctttc

SEQ ID NO: 1570707 - DNA, 16 bp, Homo sapiens
actatggtatttgagt

SEQ ID NO: 1570708 - DNA, 16 bp, Homo sapiens
actatgtctgaacata

SEQ ID NO: 1570709 - DNA, 17 bp, Homo sapiens
actatgtctgaacatag

SEQ ID NO: 1570710 - DNA, 23 bp, Homo sapiens
actatgtctgaacatagaaactc

SEQ ID NO: 1570711 - DNA, 20 bp, Homo sapiens
actatgtggctgaaaatgca

SEQ ID NO: 1570712 - DNA, 17 bp, Homo sapiens
actattagagtatttcc

SEQ ID NO: 1570713 - DNA, 17 bp, Homo sapiens
actattaggaggaatgt

SEQ ID NO: 1570714 - DNA, 17 bp, Homo sapiens
actattataatttaatg

SEQ ID NO: 1570715 - DNA, 15 bp, Homo sapiens
actattatttcctat

SEQ ID NO: 1570716 - DNA, 22 bp, Homo sapiens
actattcaggagagtagaacag

SEQ ID NO: 1570717 - DNA, 19 bp, Homo sapiens
actattccttttctgtata

SEQ ID NO: 1570718 - DNA, 22 bp, Homo sapiens
actattctcggggccctgtgta

SEQ ID NO: 1570719 - DNA, 20 bp, Homo sapiens
actattcttgatgtaaaatc

SEQ ID NO: 1570720 - DNA, 22 bp, Homo sapiens
actattcttgatgtaaaatctt

SEQ ID NO: 1570721 - DNA, 23 bp, Homo sapiens
actattcttgatgtaaaatcttg

SEQ ID NO: 1570722 - DNA, 21 bp, Homo sapiens
actattgctatcttttctgga

SEQ ID NO: 1570723 - DNA, 12 bp, Homo sapiens
actatttaactg

SEQ ID NO: 1570724 - DNA, 13 bp, Homo sapiens
actatttaactga

SEQ ID NO: 1570725 - DNA, 14 bp, Homo sapiens
actatttaactgac

SEQ ID NO: 1570726 - DNA, 14 bp, Homo sapiens
actatttaagatgt

SEQ ID NO: 1570727 - DNA, 18 bp, Homo sapiens
actatttaagatgtgaaa

SEQ ID NO: 1570728 - DNA, 20 bp, Homo sapiens
actatttaagatgtgaaaat

SEQ ID NO: 1570729 - DNA, 19 bp, Homo sapiens
actatttaagttatcaact

SEQ ID NO: 1570730 - DNA, 15 bp, Homo sapiens
actatttatatcaca

SEQ ID NO: 1570731 - DNA, 12 bp, Homo sapiens
actatttatctg

SEQ ID NO: 1570732 - DNA, 15 bp, Homo sapiens
actatttatctgtgt

SEQ ID NO: 1570733 - DNA, 22 bp, Homo sapiens
actatttattaaaaacatgacc

SEQ ID NO: 1570734 - DNA, 23 bp, Homo sapiens
actatttcacatgagtcaaaaca

SEQ ID NO: 1570735 - DNA, 13 bp, Homo sapiens
actatttcttaat

SEQ ID NO: 1570736 - DNA, 20 bp, Homo sapiens
actatttcttaatgtaacat

SEQ ID NO: 1570737 - DNA, 12 bp, Homo sapiens
actatttcttca

SEQ ID NO: 1570738 - DNA, 18 bp, Homo sapiens
actatttgctaatgtata

SEQ ID NO: 1570739 - DNA, 16 bp, Homo sapiens
actattttaaataaaa

SEQ ID NO: 1570740 - DNA, 18 bp, Homo sapiens
actatttttatttatatt

SEQ ID NO: 1570741 - DNA, 19 bp, Homo sapiens
actcaaaatatttgtacat

SEQ ID NO: 1570742 - DNA, 20 bp, Homo sapiens
actcaaaatatttgtacata

SEQ ID NO: 1570743 - DNA, 14 bp, Homo sapiens
actcaaactgagga

SEQ ID NO: 1570744 - DNA, 23 bp, Homo sapiens
actcaaactgaggaatttcacct

SEQ ID NO: 1570745 - DNA, 20 bp, Homo sapiens
actcaaagtttcagagacca

SEQ ID NO: 1570746 - DNA, 15 bp, Homo sapiens
actcaaatacacatt

SEQ ID NO: 1570747 - DNA, 16 bp, Homo sapiens
actcaaatacacattt

SEQ ID NO: 1570748 - DNA, 22 bp, Homo sapiens
actcaaatgagccccttcatcc

SEQ ID NO: 1570749 - DNA, 17 bp, Homo sapiens
actcaaatgagtaacat

SEQ ID NO: 1570750 - DNA, 20 bp, Homo sapiens
actcaaatggggccagatcc

SEQ ID NO: 1570751 - DNA, 16 bp, Homo sapiens
actcaaatgttctaag

SEQ ID NO: 1570752 - DNA, 17 bp, Homo sapiens
actcaaatgttctaagt

SEQ ID NO: 1570753 - DNA, 20 bp, Homo sapiens
actcaacaatggttgaatga

SEQ ID NO: 1570754 - DNA, 22 bp, Homo sapiens
actcaacatgttactgaccagc

SEQ ID NO: 1570755 - DNA, 15 bp, Homo sapiens
actcaaccagagtca

SEQ ID NO: 1570756 - DNA, 13 bp, Homo sapiens
actcaactaattt

SEQ ID NO: 1570757 - DNA, 17 bp, Homo sapiens
actcaactaatttttgt

SEQ ID NO: 1570758 - DNA, 16 bp, Homo sapiens
actcaactctgagccc

SEQ ID NO: 1570759 - DNA, 12 bp, Homo sapiens
actcaagaagga

SEQ ID NO: 1570760 - DNA, 17 bp, Homo sapiens
actcaagaggctgaggc

SEQ ID NO: 1570761 - DNA, 18 bp, Homo sapiens
actcaaggtttaacctta

SEQ ID NO: 1570762 - DNA, 23 bp, Homo sapiens
actcaagtaccaccaagggatct

SEQ ID NO: 1570763 - DNA, 17 bp, Homo sapiens
actcaatggtatcatta

SEQ ID NO: 1570764 - DNA, 13 bp, Homo sapiens
actcaatgtttct

SEQ ID NO: 1570765 - DNA, 14 bp, Homo sapiens
actcaatgtttctg

SEQ ID NO: 1570766 - DNA, 20 bp, Homo sapiens
actcaatgtttctggacatt

SEQ ID NO: 1570767 - DNA, 17 bp, Homo sapiens
actcaattatttgcata

SEQ ID NO: 1570768 - DNA, 17 bp, Homo sapiens
actcacaatttaaaata

SEQ ID NO: 1570769 - DNA, 20 bp, Homo sapiens
actcacaatttaaaatattt

SEQ ID NO: 1570770 - DNA, 14 bp, Homo sapiens
actcacagacctgg

SEQ ID NO: 1570771 - DNA, 13 bp, Homo sapiens
actcacagcttct

SEQ ID NO: 1570772 - DNA, 16 bp, Homo sapiens
actcacagcttctcca

SEQ ID NO: 1570773 - DNA, 17 bp, Homo sapiens
actcacagcttctccaa

SEQ ID NO: 1570774 - DNA, 16 bp, Homo sapiens
actcacatataacatg

SEQ ID NO: 1570775 - DNA, 19 bp, Homo sapiens
actcaccaacttttaatgg

SEQ ID NO: 1570776 - DNA, 23 bp, Homo sapiens
actcaccagccccactgccagca

SEQ ID NO: 1570777 - DNA, 14 bp, Homo sapiens
actcaccagggtcc

SEQ ID NO: 1570778 - DNA, 15 bp, Homo sapiens
actcaccctgggagc

SEQ ID NO: 1570779 - DNA, 20 bp, Homo sapiens
actcacctaatgtttatgag

SEQ ID NO: 1570780 - DNA, 11 bp, Homo sapiens
actcacctctg

SEQ ID NO: 1570781 - DNA, 15 bp, Homo sapiens
actcacctctgcctc

SEQ ID NO: 1570782 - DNA, 16 bp, Homo sapiens
actcacctctgcctca

SEQ ID NO: 1570783 - DNA, 22 bp, Homo sapiens
actcacctgcactaacagagtg

SEQ ID NO: 1570784 - DNA, 12 bp, Homo sapiens
actcaccttcta

SEQ ID NO: 1570785 - DNA, 14 bp, Homo sapiens
actcactaggcccc

SEQ ID NO: 1570786 - DNA, 22 bp, Homo sapiens
actcactaggcccccacttgcc

SEQ ID NO: 1570787 - DNA, 17 bp, Homo sapiens
actcacttgatgtttcc

SEQ ID NO: 1570788 - DNA, 21 bp, Homo sapiens
actcacttgatgtttcctgga

SEQ ID NO: 1570789 - DNA, 15 bp, Homo sapiens
actcactttcccttg

SEQ ID NO: 1570790 - DNA, 23 bp, Homo sapiens
actcactttcccttgtgtcaaga

SEQ ID NO: 1570791 - DNA, 15 bp, Homo sapiens
actcactttttccaa

SEQ ID NO: 1570792 - DNA, 13 bp, Homo sapiens
actcagaagcctg

SEQ ID NO: 1570793 - DNA, 15 bp, Homo sapiens
actcagaagcctgag

SEQ ID NO: 1570794 - DNA, 17 bp, Homo sapiens
actcagaagcctgaggc

SEQ ID NO: 1570795 - DNA, 22 bp, Homo sapiens
actcagaatataacatgtaaaa

SEQ ID NO: 1570796 - DNA, 21 bp, Homo sapiens
actcagacgtgtgacctccat

SEQ ID NO: 1570797 - DNA, 21 bp, Homo sapiens
actcagagaaaaatgctcccc

SEQ ID NO: 1570798 - DNA, 12 bp, Homo sapiens
actcagagcaga

SEQ ID NO: 1570799 - DNA, 14 bp, Homo sapiens
actcagagcagagc

SEQ ID NO: 1570800 - DNA, 14 bp, Homo sapiens
actcagagctctct

SEQ ID NO: 1570801 - DNA, 17 bp, Homo sapiens
actcagatccagggaca

SEQ ID NO: 1570802 - DNA, 19 bp, Homo sapiens
actcagatccagggacaga

SEQ ID NO: 1570803 - DNA, 13 bp, Homo sapiens
actcagatctgat

SEQ ID NO: 1570804 - DNA, 15 bp, Homo sapiens
actcagcagccctcc

SEQ ID NO: 1570805 - DNA, 20 bp, Homo sapiens
actcagcagccctcctcacc

SEQ ID NO: 1570806 - DNA, 21 bp, Homo sapiens
actcagcagccctcctcaccc

SEQ ID NO: 1570807 - DNA, 23 bp, Homo sapiens
actcagcatttgattaacatttg

SEQ ID NO: 1570808 - DNA, 18 bp, Homo sapiens
actcagccaccctgagtt

SEQ ID NO: 1570809 - DNA, 18 bp, Homo sapiens
actcagccatttccccct

SEQ ID NO: 1570810 - DNA, 16 bp, Homo sapiens
actcagccctgggccc

SEQ ID NO: 1570811 - DNA, 17 bp, Homo sapiens
actcagctgctatactt

SEQ ID NO: 1570812 - DNA, 17 bp, Homo sapiens
actcagctttagttttt

SEQ ID NO: 1570813 - DNA, 13 bp, Homo sapiens
actcaggaagaac

SEQ ID NO: 1570814 - DNA, 21 bp, Homo sapiens
actcaggaggctgagacagga

SEQ ID NO: 1570815 - DNA, 17 bp, Homo sapiens
actcaggaggctgaggc

SEQ ID NO: 1570816 - DNA, 18 bp, Homo sapiens
actcaggaggctgaggca

SEQ ID NO: 1570817 - DNA, 20 bp, Homo sapiens
actcaggaggctgaggcaga

SEQ ID NO: 1570818 - DNA, 21 bp, Homo sapiens
actcaggaggctgaggcagga

SEQ ID NO: 1570819 - DNA, 16 bp, Homo sapiens
actcaggagtctgcca

SEQ ID NO: 1570820 - DNA, 18 bp, Homo sapiens
actcaggcctctgcagaa

SEQ ID NO: 1570821 - DNA, 22 bp, Homo sapiens
actcagggaccggtgctgcagg

SEQ ID NO: 1570822 - DNA, 19 bp, Homo sapiens
actcaggtgggccctctga

SEQ ID NO: 1570823 - DNA, 22 bp, Homo sapiens
actcaggttccagaacagccct

SEQ ID NO: 1570824 - DNA, 23 bp, Homo sapiens
actcaggtttgagaaaaaggaaa

SEQ ID NO: 1570825 - DNA, 14 bp, Homo sapiens
actcagtcccccac

SEQ ID NO: 1570826 - DNA, 18 bp, Homo sapiens
actcagtcccccaccaca

SEQ ID NO: 1570827 - DNA, 23 bp, Homo sapiens
actcagtcccccaccacactgaa

SEQ ID NO: 1570828 - DNA, 17 bp, Homo sapiens
actcagtctctcttctc

SEQ ID NO: 1570829 - DNA, 12 bp, Homo sapiens
actcagtgcaga

SEQ ID NO: 1570830 - DNA, 18 bp, Homo sapiens
actcagtgttagagaaat

SEQ ID NO: 1570831 - DNA, 20 bp, Homo sapiens
actcagttaaatctttgaag

SEQ ID NO: 1570832 - DNA, 22 bp, Homo sapiens
actcagttcaaaccatttcagc

SEQ ID NO: 1570833 - DNA, 15 bp, Homo sapiens
actcagtttgtcaga

SEQ ID NO: 1570834 - DNA, 15 bp, Homo sapiens
actcagttttaacta

SEQ ID NO: 1570835 - DNA, 18 bp, Homo sapiens
actcatagacactgatct

SEQ ID NO: 1570836 - DNA, 20 bp, Homo sapiens
actcatcaatggggccagtc

SEQ ID NO: 1570837 - DNA, 14 bp, Homo sapiens
actcatcataaaat

SEQ ID NO: 1570838 - DNA, 17 bp, Homo sapiens
actcatcataaaataaa

SEQ ID NO: 1570839 - DNA, 22 bp, Homo sapiens
actcatccccacagctggctct

SEQ ID NO: 1570840 - DNA, 17 bp, Homo sapiens
actcatcctgattttta

SEQ ID NO: 1570841 - DNA, 15 bp, Homo sapiens
actcatctgttatcc

SEQ ID NO: 1570842 - DNA, 17 bp, Homo sapiens
actcatggaacactcat

SEQ ID NO: 1570843 - DNA, 21 bp, Homo sapiens
actcatggcagctgtttctca

SEQ ID NO: 1570844 - DNA, 15 bp, Homo sapiens
actcatgggtaataa

SEQ ID NO: 1570845 - DNA, 21 bp, Homo sapiens
actcattcaaaagttgaaatt

SEQ ID NO: 1570846 - DNA, 13 bp, Homo sapiens
actcattcagtcc

SEQ ID NO: 1570847 - DNA, 13 bp, Homo sapiens
actcattccttca

SEQ ID NO: 1570848 - DNA, 23 bp, Homo sapiens
actcattctcttcttgctatatg

SEQ ID NO: 1570849 - DNA, 20 bp, Homo sapiens
actcattgctgagcctctgc

SEQ ID NO: 1570850 - DNA, 16 bp, Homo sapiens
actcatttcctatgta

SEQ ID NO: 1570851 - DNA, 16 bp, Homo sapiens
actcatttttttttga

SEQ ID NO: 1570852 - DNA, 19 bp, Homo sapiens
actccaaacagacccctgt

SEQ ID NO: 1570853 - DNA, 18 bp, Homo sapiens
actccaaagaaatgtaag

SEQ ID NO: 1570854 - DNA, 21 bp, Homo sapiens
actccaaagaaatgtaaggga

SEQ ID NO: 1570855 - DNA, 20 bp, Homo sapiens
actccacacatctttcttga

SEQ ID NO: 1570856 - DNA, 16 bp, Homo sapiens
actccacatctgcatc

SEQ ID NO: 1570857 - DNA, 15 bp, Homo sapiens
actccaccaacccat

SEQ ID NO: 1570858 - DNA, 18 bp, Homo sapiens
actccaccgaccaactgc

SEQ ID NO: 1570859 - DNA, 15 bp, Homo sapiens
actccactcccagca

SEQ ID NO: 1570860 - DNA, 15 bp, Homo sapiens
actccactctgattc

SEQ ID NO: 1570861 - DNA, 16 bp, Homo sapiens
actccagaatctgctg

SEQ ID NO: 1570862 - DNA, 17 bp, Homo sapiens
actccagaatctgctgt

SEQ ID NO: 1570863 - DNA, 14 bp, Homo sapiens
actcgttacctgcc

SEQ ID NO: 1570864 - DNA, 21 bp, Homo sapiens
actctaaaagatcctttttaa

SEQ ID NO: 1570865 - DNA, 15 bp, Homo sapiens
actctaaaattataa

SEQ ID NO: 1570866 - DNA, 20 bp, Homo sapiens
actctaattcccattttgca

SEQ ID NO: 1570867 - DNA, 21 bp, Homo sapiens
actctaattcccattttgcaa

SEQ ID NO: 1570868 - DNA, 18 bp, Homo sapiens
actctacatgtaactatt

SEQ ID NO: 1570869 - DNA, 21 bp, Homo sapiens
actctacatgtaactatttct

SEQ ID NO: 1570870 - DNA, 19 bp, Homo sapiens
actctacccatattacaga

SEQ ID NO: 1570871 - DNA, 18 bp, Homo sapiens
actctacccctgctccca

SEQ ID NO: 1570872 - DNA, 16 bp, Homo sapiens
actctaccctcccacc

SEQ ID NO: 1570873 - DNA, 19 bp, Homo sapiens
actctaccctcccaccccc

SEQ ID NO: 1570874 - DNA, 13 bp, Homo sapiens
actctacctcata

SEQ ID NO: 1570875 - DNA, 22 bp, Homo sapiens
actctacctcatatcagtttgc

SEQ ID NO: 1570876 - DNA, 21 bp, Homo sapiens
actctactattaagtttgaaa

SEQ ID NO: 1570877 - DNA, 19 bp, Homo sapiens
actctacttaatccaatgg

SEQ ID NO: 1570878 - DNA, 21 bp, Homo sapiens
actctacttaatccaatgggt

SEQ ID NO: 1570879 - DNA, 23 bp, Homo sapiens
actctagaaaacgcgaccttggc

SEQ ID NO: 1570880 - DNA, 19 bp, Homo sapiens
actctagacaagatattgt

SEQ ID NO: 1570881 - DNA, 17 bp, Homo sapiens
actctagagagccttaa

SEQ ID NO: 1570882 - DNA, 18 bp, Homo sapiens
actctagagagccttaac

SEQ ID NO: 1570883 - DNA, 23 bp, Homo sapiens
actctagagagccttaacttctt

SEQ ID NO: 1570884 - DNA, 14 bp, Homo sapiens
actctagagtccaa

SEQ ID NO: 1570885 - DNA, 13 bp, Homo sapiens
actctagattcca

SEQ ID NO: 1570886 - DNA, 21 bp, Homo sapiens
actctaggggtcaggctccat

SEQ ID NO: 1570887 - DNA, 17 bp, Homo sapiens
actctagttctagatga

SEQ ID NO: 1570888 - DNA, 22 bp, Homo sapiens
actctataagcaaattgctttt

SEQ ID NO: 1570889 - DNA, 20 bp, Homo sapiens
actctatagtaggcatgtta

SEQ ID NO: 1570890 - DNA, 16 bp, Homo sapiens
actctatttaagattc

SEQ ID NO: 1570891 - DNA, 22 bp, Homo sapiens
actctattttttactacataat

SEQ ID NO: 1570892 - DNA, 22 bp, Homo sapiens
actctcaccatgatgtgaagag

SEQ ID NO: 1570893 - DNA, 22 bp, Homo sapiens
actctcacctgtactattgcag

SEQ ID NO: 1570894 - DNA, 19 bp, Homo sapiens
actctcaggatcaagaaag

SEQ ID NO: 1570895 - DNA, 11 bp, Homo sapiens
actctcaggga

SEQ ID NO: 1570896 - DNA, 15 bp, Homo sapiens
actctcagtgcttct

SEQ ID NO: 1570897 - DNA, 17 bp, Homo sapiens
actctcattccccaggt

SEQ ID NO: 1570898 - DNA, 21 bp, Homo sapiens
actctcattccccaggtggct

SEQ ID NO: 1570899 - DNA, 15 bp, Homo sapiens
actctcattctttga

SEQ ID NO: 1570900 - DNA, 13 bp, Homo sapiens
actctccatctta

SEQ ID NO: 1570901 - DNA, 14 bp, Homo sapiens
actctccattagaa

SEQ ID NO: 1570902 - DNA, 19 bp, Homo sapiens
actctcccaaagggcacac

SEQ ID NO: 1570903 - DNA, 12 bp, Homo sapiens
actctcccagat

SEQ ID NO: 1570904 - DNA, 20 bp, Homo sapiens
actctcccaggcctgcctgc

SEQ ID NO: 1570905 - DNA, 21 bp, Homo sapiens
actctcccaggcctgcctgca

SEQ ID NO: 1570906 - DNA, 14 bp, Homo sapiens
actctccccacact

SEQ ID NO: 1570907 - DNA, 19 bp, Homo sapiens
actctccccacgagggctg

SEQ ID NO: 1570908 - DNA, 12 bp, Homo sapiens
actctccccagt

SEQ ID NO: 1570909 - DNA, 14 bp, Homo sapiens
actctccccagtgc

SEQ ID NO: 1570910 - DNA, 15 bp, Homo sapiens
actctccccagtgcc

SEQ ID NO: 1570911 - DNA, 16 bp, Homo sapiens
actctccccagtgcct

SEQ ID NO: 1570912 - DNA, 20 bp, Homo sapiens
actctccccagtgcctgcca

SEQ ID NO: 1570913 - DNA, 14 bp, Homo sapiens
actctccccctttc

SEQ ID NO: 1570914 - DNA, 15 bp, Homo sapiens
actctccccctttca

SEQ ID NO: 1570915 - DNA, 19 bp, Homo sapiens
actctccccctttcaagga

SEQ ID NO: 1570916 - DNA, 14 bp, Homo sapiens
actctcccctttct

SEQ ID NO: 1570917 - DNA, 16 bp, Homo sapiens
actctccctctggtct

SEQ ID NO: 1570918 - DNA, 11 bp, Homo sapiens
actctcctccc

SEQ ID NO: 1570919 - DNA, 17 bp, Homo sapiens
actctcctcctcccctc

SEQ ID NO: 1570920 - DNA, 19 bp, Homo sapiens
actctcctcctcccctcct

SEQ ID NO: 1570921 - DNA, 19 bp, Homo sapiens
actctcctcggccccctcc

SEQ ID NO: 1570922 - DNA, 18 bp, Homo sapiens
actctcctggaaatatta

SEQ ID NO: 1570923 - DNA, 22 bp, Homo sapiens
actctccttcgtgtctctccca

SEQ ID NO: 1570924 - DNA, 17 bp, Homo sapiens
actctcggggcccttgg

SEQ ID NO: 1570925 - DNA, 19 bp, Homo sapiens
actctctaaatcttccttg

SEQ ID NO: 1570926 - DNA, 15 bp, Homo sapiens
actctctcccaggac

SEQ ID NO: 1570927 - DNA, 12 bp, Homo sapiens
actctctgggac

SEQ ID NO: 1570928 - DNA, 17 bp, Homo sapiens
actctctttccttgagc

SEQ ID NO: 1570929 - DNA, 15 bp, Homo sapiens
actctgaaaaacatt

SEQ ID NO: 1570930 - DNA, 14 bp, Homo sapiens
actctgaaatctga

SEQ ID NO: 1570931 - DNA, 17 bp, Homo sapiens
actctgaaggagaggag

SEQ ID NO: 1570932 - DNA, 18 bp, Homo sapiens
actctgacaagggctgac

SEQ ID NO: 1570933 - DNA, 19 bp, Homo sapiens
actctgacaagggctgacc

SEQ ID NO: 1570934 - DNA, 20 bp, Homo sapiens
actctgacaagggctgacct

SEQ ID NO: 1570935 - DNA, 11 bp, Homo sapiens
actctgagccc

SEQ ID NO: 1570936 - DNA, 15 bp, Homo sapiens
actctgagcccaggc

SEQ ID NO: 1570937 - DNA, 15 bp, Homo sapiens
actctgaggaagttg

SEQ ID NO: 1570938 - DNA, 16 bp, Homo sapiens
actctgagtttaccat

SEQ ID NO: 1570939 - DNA, 21 bp, Homo sapiens
actctgagtttaccatttgta

SEQ ID NO: 1570940 - DNA, 23 bp, Homo sapiens
actctgatggttcttcacctcct

SEQ ID NO: 1570941 - DNA, 21 bp, Homo sapiens
actctgattcacctcttcctc

SEQ ID NO: 1570942 - DNA, 23 bp, Homo sapiens
actctgattcacctcttcctctg

SEQ ID NO: 1570943 - DNA, 22 bp, Homo sapiens
actctgcacatgtcttgtacat

SEQ ID NO: 1570944 - DNA, 19 bp, Homo sapiens
actctgcactactcctctg

SEQ ID NO: 1570945 - DNA, 17 bp, Homo sapiens
actctgcactccatggc

SEQ ID NO: 1570946 - DNA, 20 bp, Homo sapiens
actctgcatgtagaggcttg

SEQ ID NO: 1570947 - DNA, 16 bp, Homo sapiens
actctgccagccacat

SEQ ID NO: 1570948 - DNA, 15 bp, Homo sapiens
actctgccctctgct

SEQ ID NO: 1570949 - DNA, 18 bp, Homo sapiens
actctgccctctgctgct

SEQ ID NO: 1570950 - DNA, 19 bp, Homo sapiens
actctgcctacagaacttc

SEQ ID NO: 1570951 - DNA, 11 bp, Homo sapiens
actctgcctct

SEQ ID NO: 1570952 - DNA, 15 bp, Homo sapiens
actctgcctttatga

SEQ ID NO: 1570953 - DNA, 17 bp, Homo sapiens
actctgctaatcatgtg

SEQ ID NO: 1570954 - DNA, 15 bp, Homo sapiens
actctgctagactcc

SEQ ID NO: 1570955 - DNA, 21 bp, Homo sapiens
actctgctagactcctcagga

SEQ ID NO: 1570956 - DNA, 16 bp, Homo sapiens
actctgctatttctct

SEQ ID NO: 1570957 - DNA, 14 bp, Homo sapiens
actctgctctgccc

SEQ ID NO: 1570958 - DNA, 12 bp, Homo sapiens
actctgcttctc

SEQ ID NO: 1570959 - DNA, 15 bp, Homo sapiens
actctgcttgatttt

SEQ ID NO: 1570960 - DNA, 19 bp, Homo sapiens
actctggaggtcatctggc

SEQ ID NO: 1570961 - DNA, 16 bp, Homo sapiens
actctggccctggccc

SEQ ID NO: 1570962 - DNA, 15 bp, Homo sapiens
actctggctccaggc

SEQ ID NO: 1570963 - DNA, 19 bp, Homo sapiens
actctgggaaataagagag

SEQ ID NO: 1570964 - DNA, 11 bp, Homo sapiens
actctgggcag

SEQ ID NO: 1570965 - DNA, 21 bp, Homo sapiens
actctgggtggaagtgcccag

SEQ ID NO: 1570966 - DNA, 22 bp, Homo sapiens
actctgggtggaagtgcccagc

SEQ ID NO: 1570967 - DNA, 23 bp, Homo sapiens
actctggtacgaatctcatccct

SEQ ID NO: 1570968 - DNA, 16 bp, Homo sapiens
actctggtgcctccag

SEQ ID NO: 1570969 - DNA, 23 bp, Homo sapiens
actctgtaattgcactttttaag

SEQ ID NO: 1570970 - DNA, 11 bp, Homo sapiens
actctgtccag

SEQ ID NO: 1570971 - DNA, 17 bp, Homo sapiens
actctgtccaggccact

SEQ ID NO: 1570972 - DNA, 18 bp, Homo sapiens
actctgtccaggccactg

SEQ ID NO: 1570973 - DNA, 23 bp, Homo sapiens
actctgtccaggccactgtggcc

SEQ ID NO: 1570974 - DNA, 12 bp, Homo sapiens
actctgtgcagg

SEQ ID NO: 1570975 - DNA, 15 bp, Homo sapiens
actctgtgcaggtgc

SEQ ID NO: 1570976 - DNA, 21 bp, Homo sapiens
actctgtgtaatctctgatta

SEQ ID NO: 1570977 - DNA, 14 bp, Homo sapiens
actctgttccttca

SEQ ID NO: 1570978 - DNA, 15 bp, Homo sapiens
actcttacagagcct

SEQ ID NO: 1570979 - DNA, 22 bp, Homo sapiens
actccagaatctgctgttgcca

SEQ ID NO: 1570980 - DNA, 13 bp, Homo sapiens
actccagacccct

SEQ ID NO: 1570981 - DNA, 21 bp, Homo sapiens
actccagacccctggcttttc

SEQ ID NO: 1570982 - DNA, 16 bp, Homo sapiens
actccagagggacagg

SEQ ID NO: 1570983 - DNA, 11 bp, Homo sapiens
actccagcctg

SEQ ID NO: 1570984 - DNA, 13 bp, Homo sapiens
actccagcctgag

SEQ ID NO: 1570985 - DNA, 19 bp, Homo sapiens
actccagcctgagcaacag

SEQ ID NO: 1570986 - DNA, 18 bp, Homo sapiens
actccagcctgagtgaca

SEQ ID NO: 1570987 - DNA, 16 bp, Homo sapiens
actccagcctgggcaa

SEQ ID NO: 1570988 - DNA, 23 bp, Homo sapiens
actccagcctgggcaacagagca

SEQ ID NO: 1570989 - DNA, 18 bp, Homo sapiens
actccagcctgggtcaca

SEQ ID NO: 1570990 - DNA, 13 bp, Homo sapiens
actccaggcccaa

SEQ ID NO: 1570991 - DNA, 16 bp, Homo sapiens
actccaggcccaaggc

SEQ ID NO: 1570992 - DNA, 21 bp, Homo sapiens
actccaggcccaaggctcccg

SEQ ID NO: 1570993 - DNA, 20 bp, Homo sapiens
actccaggcctgaccagggg

SEQ ID NO: 1570994 - DNA, 17 bp, Homo sapiens
actccagtcaacagatt

SEQ ID NO: 1570995 - DNA, 18 bp, Homo sapiens
actccagtcaacagattc

SEQ ID NO: 1570996 - DNA, 14 bp, Homo sapiens
actccagtgctcag

SEQ ID NO: 1570997 - DNA, 16 bp, Homo sapiens
actccagtgctcagct

SEQ ID NO: 1570998 - DNA, 15 bp, Homo sapiens
actccatacagcctc

SEQ ID NO: 1570999 - DNA, 22 bp, Homo sapiens
actccatacagcctctacagcc

SEQ ID NO: 1571000 - DNA, 16 bp, Homo sapiens
actccatcgccatctt

SEQ ID NO: 1571001 - DNA, 11 bp, Homo sapiens
actccatctct

SEQ ID NO: 1571002 - DNA, 16 bp, Homo sapiens
actccatctctcatcc

SEQ ID NO: 1571003 - DNA, 21 bp, Homo sapiens
actccatctctcatcctccag

SEQ ID NO: 1571004 - DNA, 15 bp, Homo sapiens
actccatctcttctg

SEQ ID NO: 1571005 - DNA, 21 bp, Homo sapiens
actccatgcttagtcactgcc

SEQ ID NO: 1571006 - DNA, 23 bp, Homo sapiens
actccatggccaccccgtgccac

SEQ ID NO: 1571007 - DNA, 20 bp, Homo sapiens
actccatgtttggtgtttgt

SEQ ID NO: 1571008 - DNA, 14 bp, Homo sapiens
actccattactgtg

SEQ ID NO: 1571009 - DNA, 22 bp, Homo sapiens
actcccaagggacagcaagtga

SEQ ID NO: 1571010 - DNA, 23 bp, Homo sapiens
actcccaagtatggggttcaaga

SEQ ID NO: 1571011 - DNA, 15 bp, Homo sapiens
actcccactctttga

SEQ ID NO: 1571012 - DNA, 17 bp, Homo sapiens
actcccactctttgaat

SEQ ID NO: 1571013 - DNA, 20 bp, Homo sapiens
actcccattcctgaagaacc

SEQ ID NO: 1571014 - DNA, 22 bp, Homo sapiens
actcccattcctgaagaaccag

SEQ ID NO: 1571015 - DNA, 14 bp, Homo sapiens
actccccagagctg

SEQ ID NO: 1571016 - DNA, 17 bp, Homo sapiens
actccccagagctgtgc

SEQ ID NO: 1571017 - DNA, 15 bp, Homo sapiens
actccccagccccac

SEQ ID NO: 1571018 - DNA, 11 bp, Homo sapiens
actccccaggg

SEQ ID NO: 1571019 - DNA, 13 bp, Homo sapiens
actcccccacctg

SEQ ID NO: 1571020 - DNA, 14 bp, Homo sapiens
actcccccacctga

SEQ ID NO: 1571021 - DNA, 22 bp, Homo sapiens
actcccctgcactggagtccag

SEQ ID NO: 1571022 - DNA, 21 bp, Homo sapiens
actcccggcctaggcacctcc

SEQ ID NO: 1571023 - DNA, 18 bp, Homo sapiens
actccctccaccagcctg

SEQ ID NO: 1571024 - DNA, 13 bp, Homo sapiens
actccctccatag

SEQ ID NO: 1571025 - DNA, 21 bp, Homo sapiens
actccctccatagcgacaccc

SEQ ID NO: 1571026 - DNA, 15 bp, Homo sapiens
actccctcctcacct

SEQ ID NO: 1571027 - DNA, 12 bp, Homo sapiens
actccctgagct

SEQ ID NO: 1571028 - DNA, 14 bp, Homo sapiens
actccctgcagatg

SEQ ID NO: 1571029 - DNA, 13 bp, Homo sapiens
actccctgctcta

SEQ ID NO: 1571030 - DNA, 15 bp, Homo sapiens
actccctggccttgc

SEQ ID NO: 1571031 - DNA, 18 bp, Homo sapiens
actccctggctctcagaa

SEQ ID NO: 1571032 - DNA, 23 bp, Homo sapiens
actccctgttatttttctgccct

SEQ ID NO: 1571033 - DNA, 20 bp, Homo sapiens
actccctgttttagtttctg

SEQ ID NO: 1571034 - DNA, 11 bp, Homo sapiens
actcccttcct

SEQ ID NO: 1571035 - DNA, 17 bp, Homo sapiens
actcccttcctggcctc

SEQ ID NO: 1571036 - DNA, 16 bp, Homo sapiens
actcccttgctggccc

SEQ ID NO: 1571037 - DNA, 17 bp, Homo sapiens
actccctttccaacctc

SEQ ID NO: 1571038 - DNA, 19 bp, Homo sapiens
actccgccctcctcgggcc

SEQ ID NO: 1571039 - DNA, 16 bp, Homo sapiens
actccgcgccgatgcc

SEQ ID NO: 1571040 - DNA, 21 bp, Homo sapiens
actccgcgccgatgccaccgg

SEQ ID NO: 1571041 - DNA, 17 bp, Homo sapiens
actccgctcactgaact

SEQ ID NO: 1571042 - DNA, 20 bp, Homo sapiens
actccgggaccattgacctc

SEQ ID NO: 1571043 - DNA, 19 bp, Homo sapiens
actccggtgtgcctgcagc

SEQ ID NO: 1571044 - DNA, 19 bp, Homo sapiens
actccgtaacagattttgt

SEQ ID NO: 1571045 - DNA, 16 bp, Homo sapiens
actccgtctcaaggaa

SEQ ID NO: 1571046 - DNA, 15 bp, Homo sapiens
actccgtgaggctgc

SEQ ID NO: 1571047 - DNA, 23 bp, Homo sapiens
actccgtgaggctgctgccatcc

SEQ ID NO: 1571048 - DNA, 20 bp, Homo sapiens
actccgtgcttaaccaaaga

SEQ ID NO: 1571049 - DNA, 15 bp, Homo sapiens
actccgttggccact

SEQ ID NO: 1571050 - DNA, 15 bp, Homo sapiens
actcctacctcagcc

SEQ ID NO: 1571051 - DNA, 16 bp, Homo sapiens
actcctacctcagcct

SEQ ID NO: 1571052 - DNA, 18 bp, Homo sapiens
actcctcagggcagcctc

SEQ ID NO: 1571053 - DNA, 21 bp, Homo sapiens
actcctcccctcttctctttt

SEQ ID NO: 1571054 - DNA, 23 bp, Homo sapiens
actcctcccctcttctcttttgc

SEQ ID NO: 1571055 - DNA, 15 bp, Homo sapiens
actcctctgcgtcta

SEQ ID NO: 1571056 - DNA, 23 bp, Homo sapiens
actcctcttggtgggtgtggcca

SEQ ID NO: 1571057 - DNA, 22 bp, Homo sapiens
actcctgaccataatcctagcc

SEQ ID NO: 1571058 - DNA, 15 bp, Homo sapiens
actcctgattttgta

SEQ ID NO: 1571059 - DNA, 20 bp, Homo sapiens
actcctgattttgtagttaa

SEQ ID NO: 1571060 - DNA, 18 bp, Homo sapiens
actcctgcaaaattttat

SEQ ID NO: 1571061 - DNA, 15 bp, Homo sapiens
actcctgccaggccg

SEQ ID NO: 1571062 - DNA, 23 bp, Homo sapiens
actcctgccagttgaaaatggat

SEQ ID NO: 1571063 - DNA, 22 bp, Homo sapiens
actcctgccctgttgtgtatag

SEQ ID NO: 1571064 - DNA, 19 bp, Homo sapiens
actcctgcctgagtttcca

SEQ ID NO: 1571065 - DNA, 21 bp, Homo sapiens
actcctgctggtacctgccct

SEQ ID NO: 1571066 - DNA, 13 bp, Homo sapiens
actcctgcttaat

SEQ ID NO: 1571067 - DNA, 13 bp, Homo sapiens
actcctggcctca

SEQ ID NO: 1571068 - DNA, 14 bp, Homo sapiens
actcctggcctcaa

SEQ ID NO: 1571069 - DNA, 16 bp, Homo sapiens
actcctgtacactgaa

SEQ ID NO: 1571070 - DNA, 14 bp, Homo sapiens
actcctgtcaccta

SEQ ID NO: 1571071 - DNA, 21 bp, Homo sapiens
actcctgtccctgtagctcag

SEQ ID NO: 1571072 - DNA, 18 bp, Homo sapiens
actcctgtcccttttccc

SEQ ID NO: 1571073 - DNA, 14 bp, Homo sapiens
actcctgtgctctg

SEQ ID NO: 1571074 - DNA, 20 bp, Homo sapiens
actcctgtgctctggaggct

SEQ ID NO: 1571075 - DNA, 18 bp, Homo sapiens
actcctgttgccatggat

SEQ ID NO: 1571076 - DNA, 15 bp, Homo sapiens
actccttattttgta

SEQ ID NO: 1571077 - DNA, 19 bp, Homo sapiens
actccttccccacttctgt

SEQ ID NO: 1571078 - DNA, 13 bp, Homo sapiens
actccttcctggc

SEQ ID NO: 1571079 - DNA, 20 bp, Homo sapiens
actccttcctggcctgagag

SEQ ID NO: 1571080 - DNA, 23 bp, Homo sapiens
actccttcctggcctgagagtca

SEQ ID NO: 1571081 - DNA, 16 bp, Homo sapiens
actccttctctcactg

SEQ ID NO: 1571082 - DNA, 14 bp, Homo sapiens
actccttgcttcct

SEQ ID NO: 1571083 - DNA, 21 bp, Homo sapiens
actccttgtggactggctgtg

SEQ ID NO: 1571084 - DNA, 21 bp, Homo sapiens
actcgagaccatcctggcccc

SEQ ID NO: 1571085 - DNA, 22 bp, Homo sapiens
actcgagaccatcctggcccct

SEQ ID NO: 1571086 - DNA, 18 bp, Homo sapiens
actcgagcccacccagca

SEQ ID NO: 1571087 - DNA, 18 bp, Homo sapiens
actcgagtcacactcaag

SEQ ID NO: 1571088 - DNA, 13 bp, Homo sapiens
actcgcagtcgca

SEQ ID NO: 1571089 - DNA, 22 bp, Homo sapiens
actcgcccgcccactgtcctgg

SEQ ID NO: 1571090 - DNA, 15 bp, Homo sapiens
actcgcgctcagtaa

SEQ ID NO: 1571091 - DNA, 16 bp, Homo sapiens
actcgcgctcagtaaa

SEQ ID NO: 1571092 - DNA, 22 bp, Homo sapiens
actcggcagcccttccaaactc

SEQ ID NO: 1571093 - DNA, 20 bp, Homo sapiens
actcgtaggggatgtggagt

SEQ ID NO: 1571094 - DNA, 16 bp, Homo sapiens
actcgtgtgcaacaga

SEQ ID NO: 1571095 - DNA, 13 bp, Homo sapiens
actcttcagaaca

SEQ ID NO: 1571096 - DNA, 15 bp, Homo sapiens
actcttcagagaaat

SEQ ID NO: 1571097 - DNA, 15 bp, Homo sapiens
actcttcagggtcta

SEQ ID NO: 1571098 - DNA, 22 bp, Homo sapiens
actcttccctctcgctcccctc

SEQ ID NO: 1571099 - DNA, 14 bp, Homo sapiens
actcttccctctct

SEQ ID NO: 1571100 - DNA, 16 bp, Homo sapiens
actcttccgatgtttg

SEQ ID NO: 1571101 - DNA, 17 bp, Homo sapiens
actcttccgatgtttgt

SEQ ID NO: 1571102 - DNA, 18 bp, Homo sapiens
actcttgaagtccaggac

SEQ ID NO: 1571103 - DNA, 17 bp, Homo sapiens
actcttgagagctcagg

SEQ ID NO: 1571104 - DNA, 19 bp, Homo sapiens
actcttgagagctcaggca

SEQ ID NO: 1571105 - DNA, 19 bp, Homo sapiens
actcttgatctctcttgtc

SEQ ID NO: 1571106 - DNA, 21 bp, Homo sapiens
actcttgatctctcttgtcct

SEQ ID NO: 1571107 - DNA, 10 bp, Homo sapiens
actcttgctg

SEQ ID NO: 1571108 - DNA, 16 bp, Homo sapiens
actcttgctgatggct

SEQ ID NO: 1571109 - DNA, 14 bp, Homo sapiens
actcttgtcatttt

SEQ ID NO: 1571110 - DNA, 20 bp, Homo sapiens
actctttatcaagcaacatt

SEQ ID NO: 1571111 - DNA, 19 bp, Homo sapiens
actctttctaactttcttt

SEQ ID NO: 1571112 - DNA, 21 bp, Homo sapiens
actctttctttccgttttttt

SEQ ID NO: 1571113 - DNA, 12 bp, Homo sapiens
actctttgagag

SEQ ID NO: 1571114 - DNA, 14 bp, Homo sapiens
actctttgtaagag

SEQ ID NO: 1571115 - DNA, 21 bp, Homo sapiens
actctttgtggggaagagggg

SEQ ID NO: 1571116 - DNA, 23 bp, Homo sapiens
actctttgtggggaagaggggct

SEQ ID NO: 1571117 - DNA, 14 bp, Homo sapiens
actcttttaagtgc

SEQ ID NO: 1571118 - DNA, 23 bp, Homo sapiens
actcttttaattgaaattaactt

SEQ ID NO: 1571119 - DNA, 17 bp, Homo sapiens
actcttttctattttgt

SEQ ID NO: 1571120 - DNA, 15 bp, Homo sapiens
actcttttgctgtgc

SEQ ID NO: 1571121 - DNA, 17 bp, Homo sapiens
actctttttcaataaat

SEQ ID NO: 1571122 - DNA, 19 bp, Homo sapiens
actcttttttaaaaattac

SEQ ID NO: 1571123 - DNA, 18 bp, Homo sapiens
actgaaaacttagccaga

SEQ ID NO: 1571124 - DNA, 20 bp, Homo sapiens
actgaaaaggaggggtctgg

SEQ ID NO: 1571125 - DNA, 23 bp, Homo sapiens
actgaaacatgcacattttgtac

SEQ ID NO: 1571126 - DNA, 14 bp, Homo sapiens
actgaaacctctgc

SEQ ID NO: 1571127 - DNA, 18 bp, Homo sapiens
actgaaacctctgccttc

SEQ ID NO: 1571128 - DNA, 16 bp, Homo sapiens
actgaaagcagcagct

SEQ ID NO: 1571129 - DNA, 19 bp, Homo sapiens
actgaaagcagcagctagg

SEQ ID NO: 1571130 - DNA, 15 bp, Homo sapiens
actgaaagttttgta

SEQ ID NO: 1571131 - DNA, 22 bp, Homo sapiens
actgaacaccattgaaggctta

SEQ ID NO: 1571132 - DNA, 12 bp, Homo sapiens
actgaacatgtt

SEQ ID NO: 1571133 - DNA, 12 bp, Homo sapiens
actgaaccactg

SEQ ID NO: 1571134 - DNA, 19 bp, Homo sapiens
actgaaccactgcttctct

SEQ ID NO: 1571135 - DNA, 19 bp, Homo sapiens
actgaaccggctttaccaa

SEQ ID NO: 1571136 - DNA, 13 bp, Homo sapiens
actgaagcacagc

SEQ ID NO: 1571137 - DNA, 15 bp, Homo sapiens
actgaagcacagcac

SEQ ID NO: 1571138 - DNA, 13 bp, Homo sapiens
actgaagcagcct

SEQ ID NO: 1571139 - DNA, 23 bp, Homo sapiens
actgaagccggacagctgcccag

SEQ ID NO: 1571140 - DNA, 12 bp, Homo sapiens
actgaagcctgc

SEQ ID NO: 1571141 - DNA, 13 bp, Homo sapiens
actgaaggaaaag

SEQ ID NO: 1571142 - DNA, 21 bp, Homo sapiens
actgaaggccacttgagttgg

SEQ ID NO: 1571143 - DNA, 13 bp, Homo sapiens
actgaaggggcac

SEQ ID NO: 1571144 - DNA, 16 bp, Homo sapiens
actgaaggggcacacc

SEQ ID NO: 1571145 - DNA, 15 bp, Homo sapiens
actgaaggggtgcac

SEQ ID NO: 1571146 - DNA, 19 bp, Homo sapiens
actgaaggtcaataaatta

SEQ ID NO: 1571147 - DNA, 17 bp, Homo sapiens
actgaagtgcttagtgt

SEQ ID NO: 1571148 - DNA, 13 bp, Homo sapiens
actgaagtggctg

SEQ ID NO: 1571149 - DNA, 22 bp, Homo sapiens
actgaagtggctggtagaaaaa

SEQ ID NO: 1571150 - DNA, 16 bp, Homo sapiens
actgaataatgctacc

SEQ ID NO: 1571151 - DNA, 21 bp, Homo sapiens
actgaatctcataattggaat

SEQ ID NO: 1571152 - DNA, 16 bp, Homo sapiens
actgaatgctctgtgc

SEQ ID NO: 1571153 - DNA, 17 bp, Homo sapiens
actgaatgctgttaata

SEQ ID NO: 1571154 - DNA, 17 bp, Homo sapiens
actgaatgtcaagaaaa

SEQ ID NO: 1571155 - DNA, 21 bp, Homo sapiens
actgaattaatcatctataaa

SEQ ID NO: 1571156 - DNA, 13 bp, Homo sapiens
actgaattcactc

SEQ ID NO: 1571157 - DNA, 16 bp, Homo sapiens
actgaattcactccag

SEQ ID NO: 1571158 - DNA, 12 bp, Homo sapiens
actgaattccaa

SEQ ID NO: 1571159 - DNA, 13 bp, Homo sapiens
actgaatttaact

SEQ ID NO: 1571160 - DNA, 15 bp, Homo sapiens
actgaattttgggac

SEQ ID NO: 1571161 - DNA, 19 bp, Homo sapiens
actgaattttgggacttct

SEQ ID NO: 1571162 - DNA, 15 bp, Homo sapiens
actgaatttttttgt

SEQ ID NO: 1571163 - DNA, 17 bp, Homo sapiens
actgaatttttttgtaa

SEQ ID NO: 1571164 - DNA, 23 bp, Homo sapiens
actgacacaaaaagtagattaag

SEQ ID NO: 1571165 - DNA, 13 bp, Homo sapiens
actgacagggagc

SEQ ID NO: 1571166 - DNA, 12 bp, Homo sapiens
actgacatgtgg

SEQ ID NO: 1571167 - DNA, 20 bp, Homo sapiens
actgaccaaagactgcagaa

SEQ ID NO: 1571168 - DNA, 13 bp, Homo sapiens
actgaccactggg

SEQ ID NO: 1571169 - DNA, 14 bp, Homo sapiens
actgaccagcggct

SEQ ID NO: 1571170 - DNA, 18 bp, Homo sapiens
actgacccaactgggggc

SEQ ID NO: 1571171 - DNA, 16 bp, Homo sapiens
actgaccccctcccct

SEQ ID NO: 1571172 - DNA, 15 bp, Homo sapiens
actgacccttgaacc

SEQ ID NO: 1571173 - DNA, 13 bp, Homo sapiens
actgacctacctc

SEQ ID NO: 1571174 - DNA, 22 bp, Homo sapiens
actgactattcttgatgtaaaa

SEQ ID NO: 1571175 - DNA, 23 bp, Homo sapiens
actgactattcttgatgtaaaat

SEQ ID NO: 1571176 - DNA, 24 bp, Homo sapiens
actgactattcttgatgtaaaatc

SEQ ID NO: 1571177 - DNA, 23 bp, Homo sapiens
actgactgaaggaaaagcaagaa

SEQ ID NO: 1571178 - DNA, 19 bp, Homo sapiens
actgactgagataagaaaa

SEQ ID NO: 1571179 - DNA, 22 bp, Homo sapiens
actgactgatagcttacactga

SEQ ID NO: 1571180 - DNA, 16 bp, Homo sapiens
actgacttcagtggga

SEQ ID NO: 1571181 - DNA, 13 bp, Homo sapiens
actgacttctaag

SEQ ID NO: 1571182 - DNA, 15 bp, Homo sapiens
actgacttctaagta

SEQ ID NO: 1571183 - DNA, 16 bp, Homo sapiens
actgacttctaagtaa

SEQ ID NO: 1571184 - DNA, 13 bp, Homo sapiens
actgacttgagac

SEQ ID NO: 1571185 - DNA, 20 bp, Homo sapiens
actgacttgtttgtcttcca

SEQ ID NO: 1571186 - DNA, 14 bp, Homo sapiens
actgactttaagta

SEQ ID NO: 1571187 - DNA, 17 bp, Homo sapiens
actgactttaagtaatc

SEQ ID NO: 1571188 - DNA, 15 bp, Homo sapiens
actgactttctgatt

SEQ ID NO: 1571189 - DNA, 18 bp, Homo sapiens
actgactttctgattact

SEQ ID NO: 1571190 - DNA, 17 bp, Homo sapiens
actgactttttcccccc

SEQ ID NO: 1571191 - DNA, 22 bp, Homo sapiens
actgagacagccacttggtttt

SEQ ID NO: 1571192 - DNA, 18 bp, Homo sapiens
actgagactttcccctct

SEQ ID NO: 1571193 - DNA, 19 bp, Homo sapiens
actgagactttcccctctc

SEQ ID NO: 1571194 - DNA, 15 bp, Homo sapiens
actgagagccttttt

SEQ ID NO: 1571195 - DNA, 18 bp, Homo sapiens
actgagagcctttttgaa

SEQ ID NO: 1571196 - DNA, 21 bp, Homo sapiens
actgagagggcaaggaagtgg

SEQ ID NO: 1571197 - DNA, 17 bp, Homo sapiens
actgagataagaaaagc

SEQ ID NO: 1571198 - DNA, 13 bp, Homo sapiens
actgagcaagatc

SEQ ID NO: 1571199 - DNA, 14 bp, Homo sapiens
actgagcaccctct

SEQ ID NO: 1571200 - DNA, 15 bp, Homo sapiens
actgagcagccgcca

SEQ ID NO: 1571201 - DNA, 15 bp, Homo sapiens
actgagcccccccaa

SEQ ID NO: 1571202 - DNA, 17 bp, Homo sapiens
actgagcctagctacct

SEQ ID NO: 1571203 - DNA, 17 bp, Homo sapiens
actgagctctccaggcc

SEQ ID NO: 1571204 - DNA, 19 bp, Homo sapiens
actgagctctccaggccag

SEQ ID NO: 1571205 - DNA, 18 bp, Homo sapiens
actgagcttctctgtgaa

SEQ ID NO: 1571206 - DNA, 13 bp, Homo sapiens
actgaggaagaac

SEQ ID NO: 1571207 - DNA, 22 bp, Homo sapiens
actgaggaagaacggggctctt

SEQ ID NO: 1571208 - DNA, 17 bp, Homo sapiens
actgaggaatttcacct

SEQ ID NO: 1571209 - DNA, 14 bp, Homo sapiens
actgaggagacaga

SEQ ID NO: 1571210 - DNA, 18 bp, Homo sapiens
actgaggagacagaaagc

SEQ ID NO: 1571211 - DNA, 22 bp, Homo sapiens
actgaggagacagaaagcctcc

SEQ ID NO: 1571212 - DNA, 18 bp, Homo sapiens
actgaggagatgaccagg

SEQ ID NO: 1571213 - DNA, 19 bp, Homo sapiens
actgaggcagacagcagct

SEQ ID NO: 1571214 - DNA, 23 bp, Homo sapiens
actgaggcagacagcagctcagg

SEQ ID NO: 1571215 - DNA, 19 bp, Homo sapiens
actgaggcagcgacctcaa

SEQ ID NO: 1571216 - DNA, 20 bp, Homo sapiens
actgaggcagcgacctcaag

SEQ ID NO: 1571217 - DNA, 21 bp, Homo sapiens
actgaggcctaaaagtaaaca

SEQ ID NO: 1571218 - DNA, 14 bp, Homo sapiens
actgaggcctgagc

SEQ ID NO: 1571219 - DNA, 23 bp, Homo sapiens
actgaggcctgcttccccctccc

SEQ ID NO: 1571220 - DNA, 15 bp, Homo sapiens
actgaggccttgtgt

SEQ ID NO: 1571221 - DNA, 20 bp, Homo sapiens
actgaggccttgtgtgtcag

SEQ ID NO: 1571222 - DNA, 21 bp, Homo sapiens
actgaggccttgtgtgtcagg

SEQ ID NO: 1571223 - DNA, 21 bp, Homo sapiens
actgagggaccaactgggccc

SEQ ID NO: 1571224 - DNA, 15 bp, Homo sapiens
actgagggcagtgcc

SEQ ID NO: 1571225 - DNA, 18 bp, Homo sapiens
actgagggcagtgccctt

SEQ ID NO: 1571226 - DNA, 12 bp, Homo sapiens
actgagggccac

SEQ ID NO: 1571227 - DNA, 17 bp, Homo sapiens
actgagggccagggacc

SEQ ID NO: 1571228 - DNA, 19 bp, Homo sapiens
actgagggccagggaccca

SEQ ID NO: 1571229 - DNA, 17 bp, Homo sapiens
actgagggctctgtttg

SEQ ID NO: 1571230 - DNA, 17 bp, Homo sapiens
actgaggtataaagaca

SEQ ID NO: 1571231 - DNA, 19 bp, Homo sapiens
actgagtattaatatctga

SEQ ID NO: 1571232 - DNA, 20 bp, Homo sapiens
actgagtcatcttgtgagtg

SEQ ID NO: 1571233 - DNA, 21 bp, Homo sapiens
actgagtcccctccaggaaga

SEQ ID NO: 1571234 - DNA, 19 bp, Homo sapiens
actgagtcttaacttttca

SEQ ID NO: 1571235 - DNA, 16 bp, Homo sapiens
actgagtgggaagccc

SEQ ID NO: 1571236 - DNA, 15 bp, Homo sapiens
actgataaacctaat

SEQ ID NO: 1571237 - DNA, 16 bp, Homo sapiens
actgatatttatagaa

SEQ ID NO: 1571238 - DNA, 21 bp, Homo sapiens
actgatctcaagtatatgtca

SEQ ID NO: 1571239 - DNA, 22 bp, Homo sapiens
actgatctctactaccacaagg

SEQ ID NO: 1571240 - DNA, 15 bp, Homo sapiens
actgatgattttcct

SEQ ID NO: 1571241 - DNA, 17 bp, Homo sapiens
actgatgattttccttt

SEQ ID NO: 1571242 - DNA, 19 bp, Homo sapiens
actgatgctgcccctcatc

SEQ ID NO: 1571243 - DNA, 20 bp, Homo sapiens
actgatgctgcccctcatct

SEQ ID NO: 1571244 - DNA, 17 bp, Homo sapiens
actgatggaaaatacca

SEQ ID NO: 1571245 - DNA, 23 bp, Homo sapiens
actgatggaccgggtgggcctgg

SEQ ID NO: 1571246 - DNA, 19 bp, Homo sapiens
actgatggctcaagacaag

SEQ ID NO: 1571247 - DNA, 13 bp, Homo sapiens
actgatgtcatct

SEQ ID NO: 1571248 - DNA, 14 bp, Homo sapiens
actgatgtcatctt

SEQ ID NO: 1571249 - DNA, 17 bp, Homo sapiens
actgattaaatatttga

SEQ ID NO: 1571250 - DNA, 15 bp, Homo sapiens
actgattacctgcca

SEQ ID NO: 1571251 - DNA, 20 bp, Homo sapiens
actgattcataataaatatc

SEQ ID NO: 1571252 - DNA, 13 bp, Homo sapiens
actgattgggagg

SEQ ID NO: 1571253 - DNA, 20 bp, Homo sapiens
actgattgttttagagacta

SEQ ID NO: 1571254 - DNA, 12 bp, Homo sapiens
actgatttcaga

SEQ ID NO: 1571255 - DNA, 15 bp, Homo sapiens
actgatttcagagtg

SEQ ID NO: 1571256 - DNA, 12 bp, Homo sapiens
actgatttgctc

SEQ ID NO: 1571257 - DNA, 16 bp, Homo sapiens
actgatttggagatat

SEQ ID NO: 1571258 - DNA, 14 bp, Homo sapiens
actgatttttgtaa

SEQ ID NO: 1571259 - DNA, 16 bp, Homo sapiens
actgcaaaaaaagcct

SEQ ID NO: 1571260 - DNA, 19 bp, Homo sapiens
actgcaaaaaaagcctcca

SEQ ID NO: 1571261 - DNA, 22 bp, Homo sapiens
actgcaaaaagaaaatctttat

SEQ ID NO: 1571262 - DNA, 21 bp, Homo sapiens
actgcaaatcaggcttttgtt

SEQ ID NO: 1571263 - DNA, 17 bp, Homo sapiens
actgcaacctccgcctc

SEQ ID NO: 1571264 - DNA, 15 bp, Homo sapiens
actgcaaccttcacc

SEQ ID NO: 1571265 - DNA, 20 bp, Homo sapiens
actgcaacttccgcctcctg

SEQ ID NO: 1571266 - DNA, 14 bp, Homo sapiens
actgcaacttctgc

SEQ ID NO: 1571267 - DNA, 16 bp, Homo sapiens
actgcaacttctgcct

SEQ ID NO: 1571268 - DNA, 16 bp, Homo sapiens
actgcaagagccttgg

SEQ ID NO: 1571269 - DNA, 17 bp, Homo sapiens
actgcaatagagactgt

SEQ ID NO: 1571270 - DNA, 21 bp, Homo sapiens
actgcaatagagactgtagat

SEQ ID NO: 1571271 - DNA, 21 bp, Homo sapiens
actgcaatcctgtctttctga

SEQ ID NO: 1571272 - DNA, 15 bp, Homo sapiens
actgcacacacagct

SEQ ID NO: 1571273 - DNA, 18 bp, Homo sapiens
actgcacacacagctcct

SEQ ID NO: 1571274 - DNA, 16 bp, Homo sapiens
actgcacaggaggagg

SEQ ID NO: 1571275 - DNA, 16 bp, Homo sapiens
actgcacagtgcatct

SEQ ID NO: 1571276 - DNA, 18 bp, Homo sapiens
actgcacagtgcatctca

SEQ ID NO: 1571277 - DNA, 15 bp, Homo sapiens
actgcacagtggcac

SEQ ID NO: 1571278 - DNA, 13 bp, Homo sapiens
actgcactcagat

SEQ ID NO: 1571279 - DNA, 17 bp, Homo sapiens
actgcactccagcctgg

SEQ ID NO: 1571280 - DNA, 18 bp, Homo sapiens
actgcactccagcctggg

SEQ ID NO: 1571281 - DNA, 20 bp, Homo sapiens
actgcactccagcctgggcg

SEQ ID NO: 1571282 - DNA, 19 bp, Homo sapiens
actgcactccagcctgggg

SEQ ID NO: 1571283 - DNA, 14 bp, Homo sapiens
actgcactttcccc

SEQ ID NO: 1571284 - DNA, 17 bp, Homo sapiens
actgcactttccccctt

SEQ ID NO: 1571285 - DNA, 19 bp, Homo sapiens
actgcactttcccccttcc

SEQ ID NO: 1571286 - DNA, 20 bp, Homo sapiens
actgcagaacccccaggtgg

SEQ ID NO: 1571287 - DNA, 21 bp, Homo sapiens
actgcagaccatgaagtaaat

SEQ ID NO: 1571288 - DNA, 21 bp, Homo sapiens
actgcagaggggaaagacttc

SEQ ID NO: 1571289 - DNA, 15 bp, Homo sapiens
actgcagccccctat

SEQ ID NO: 1571290 - DNA, 12 bp, Homo sapiens
actgcagctgct

SEQ ID NO: 1571291 - DNA, 12 bp, Homo sapiens
actgcaggcccc

SEQ ID NO: 1571292 - DNA, 15 bp, Homo sapiens
actgcaggccccgct

SEQ ID NO: 1571293 - DNA, 17 bp, Homo sapiens
actgcaggccctggcct

SEQ ID NO: 1571294 - DNA, 13 bp, Homo sapiens
actgcagtcagat

SEQ ID NO: 1571295 - DNA, 22 bp, Homo sapiens
actgcagtccgcagtctggcct

SEQ ID NO: 1571296 - DNA, 19 bp, Homo sapiens
actgcagtcggcatgccag

SEQ ID NO: 1571297 - DNA, 21 bp, Homo sapiens
actgcagtcggcatgccagga

SEQ ID NO: 1571298 - DNA, 13 bp, Homo sapiens
actgcatactttt

SEQ ID NO: 1571299 - DNA, 17 bp, Homo sapiens
actgcatactttttaaa

SEQ ID NO: 1571300 - DNA, 19 bp, Homo sapiens
actgcatatagataattat

SEQ ID NO: 1571301 - DNA, 23 bp, Homo sapiens
actgcatatcctggtgtctagtt

SEQ ID NO: 1571302 - DNA, 15 bp, Homo sapiens
actgcatcatatatt

SEQ ID NO: 1571303 - DNA, 16 bp, Homo sapiens
actgcatcatatattt

SEQ ID NO: 1571304 - DNA, 22 bp, Homo sapiens
actgcatggcttctgaaagcag

SEQ ID NO: 1571305 - DNA, 19 bp, Homo sapiens
actgcatggggaggcagca

SEQ ID NO: 1571306 - DNA, 17 bp, Homo sapiens
actgcattcctgtgccc

SEQ ID NO: 1571307 - DNA, 17 bp, Homo sapiens
actgcattctctcccat

SEQ ID NO: 1571308 - DNA, 23 bp, Homo sapiens
actgcatttaaatttgatttcca

SEQ ID NO: 1571309 - DNA, 17 bp, Homo sapiens
actgccaactgatctgt

SEQ ID NO: 1571310 - DNA, 13 bp, Homo sapiens
actgccaagccag

SEQ ID NO: 1571311 - DNA, 14 bp, Homo sapiens
actgccaagccaga

SEQ ID NO: 1571312 - DNA, 15 bp, Homo sapiens
actgccaagccagat

SEQ ID NO: 1571313 - DNA, 22 bp, Homo sapiens
actgccaagccagattctcttg

SEQ ID NO: 1571314 - DNA, 18 bp, Homo sapiens
actgccagcagcagcagg

SEQ ID NO: 1571315 - DNA, 16 bp, Homo sapiens
actgccaggcacctgg

SEQ ID NO: 1571316 - DNA, 20 bp, Homo sapiens
actgccaggcacctggcctg

SEQ ID NO: 1571317 - DNA, 22 bp, Homo sapiens
actgccaggcacctggcctgct

SEQ ID NO: 1571318 - DNA, 15 bp, Homo sapiens
actgccaggccagcc

SEQ ID NO: 1571319 - DNA, 16 bp, Homo sapiens
actgccaggctgcctc

SEQ ID NO: 1571320 - DNA, 21 bp, Homo sapiens
actgccaggctgcctcctgcc

SEQ ID NO: 1571321 - DNA, 13 bp, Homo sapiens
actgccaggctgt

SEQ ID NO: 1571322 - DNA, 13 bp, Homo sapiens
actgccaggtggt

SEQ ID NO: 1571323 - DNA, 14 bp, Homo sapiens
actgccatacataa

SEQ ID NO: 1571324 - DNA, 16 bp, Homo sapiens
actgccatattgtgta

SEQ ID NO: 1571325 - DNA, 19 bp, Homo sapiens
actgccatattgtgtaatt

SEQ ID NO: 1571326 - DNA, 18 bp, Homo sapiens
actgccatgatagctggg

SEQ ID NO: 1571327 - DNA, 22 bp, Homo sapiens
actgcccacatttgggctcagg

SEQ ID NO: 1571328 - DNA, 13 bp, Homo sapiens
actgcccaccccc

SEQ ID NO: 1571329 - DNA, 17 bp, Homo sapiens
actgcccaccccctcaa

SEQ ID NO: 1571330 - DNA, 21 bp, Homo sapiens
actgccccaactcctggaagc

SEQ ID NO: 1571331 - DNA, 19 bp, Homo sapiens
actgccccccatgaggaag

SEQ ID NO: 1571332 - DNA, 19 bp, Homo sapiens
actgccccccgaggctgct

SEQ ID NO: 1571333 - DNA, 19 bp, Homo sapiens
actgccccctgctgccatg

SEQ ID NO: 1571334 - DNA, 13 bp, Homo sapiens
actgccctaagcc

SEQ ID NO: 1571335 - DNA, 19 bp, Homo sapiens
actgccctaagcccccagg

SEQ ID NO: 1571336 - DNA, 14 bp, Homo sapiens
actgccctgcctgc

SEQ ID NO: 1571337 - DNA, 13 bp, Homo sapiens
actgccctggcag

SEQ ID NO: 1571338 - DNA, 16 bp, Homo sapiens
actgccctggcagcag

SEQ ID NO: 1571339 - DNA, 17 bp, Homo sapiens
actgccctggcagcagc

SEQ ID NO: 1571340 - DNA, 17 bp, Homo sapiens
actgccctgtttctgtt

SEQ ID NO: 1571341 - DNA, 13 bp, Homo sapiens
actgcccttccag

SEQ ID NO: 1571342 - DNA, 16 bp, Homo sapiens
actgccgtaatttaac

SEQ ID NO: 1571343 - DNA, 15 bp, Homo sapiens
actgcctaagccctc

SEQ ID NO: 1571344 - DNA, 16 bp, Homo sapiens
actgcctctccctggc

SEQ ID NO: 1571345 - DNA, 18 bp, Homo sapiens
actgcctctccctggccc

SEQ ID NO: 1571346 - DNA, 19 bp, Homo sapiens
actgcctctccctggccct

SEQ ID NO: 1571347 - DNA, 23 bp, Homo sapiens
actgcctgcagaggtctgtgctg

SEQ ID NO: 1571348 - DNA, 20 bp, Homo sapiens
actgcctgcctcccctccgc

SEQ ID NO: 1571349 - DNA, 17 bp, Homo sapiens
actgccttcgcttcttg

SEQ ID NO: 1571350 - DNA, 22 bp, Homo sapiens
actgccttcgcttcttgcctct

SEQ ID NO: 1571351 - DNA, 18 bp, Homo sapiens
actgccttggcttcaggg

SEQ ID NO: 1571352 - DNA, 19 bp, Homo sapiens
actgcgactttctgcctgg

SEQ ID NO: 1571353 - DNA, 17 bp, Homo sapiens
actgcgaggacatcaaa

SEQ ID NO: 1571354 - DNA, 13 bp, Homo sapiens
actgcgcaggtct

SEQ ID NO: 1571355 - DNA, 17 bp, Homo sapiens
actgcgcaggtctcttc

SEQ ID NO: 1571356 - DNA, 14 bp, Homo sapiens
actgcggaagccaa

SEQ ID NO: 1571357 - DNA, 16 bp, Homo sapiens
actgcggaagccaaag

SEQ ID NO: 1571358 - DNA, 14 bp, Homo sapiens
actgctacctctga

SEQ ID NO: 1571359 - DNA, 17 bp, Homo sapiens
actgctacctctgagaa

SEQ ID NO: 1571360 - DNA, 20 bp, Homo sapiens
actgctacctttcaaagctt

SEQ ID NO: 1571361 - DNA, 16 bp, Homo sapiens
actgctcacgtctctg

SEQ ID NO: 1571362 - DNA, 19 bp, Homo sapiens
actgctcacgtctctgccg

SEQ ID NO: 1571363 - DNA, 14 bp, Homo sapiens
actgctcagctctg

SEQ ID NO: 1571364 - DNA, 16 bp, Homo sapiens
actgctcagctctggt

SEQ ID NO: 1571365 - DNA, 23 bp, Homo sapiens
actgctcatcattccttgagaaa

SEQ ID NO: 1571366 - DNA, 18 bp, Homo sapiens
actgctcccatcattcct

SEQ ID NO: 1571367 - DNA, 19 bp, Homo sapiens
actgctcccatcattcctt

SEQ ID NO: 1571368 - DNA, 16 bp, Homo sapiens
actgctcctgtggcag

SEQ ID NO: 1571369 - DNA, 19 bp, Homo sapiens
actgctcctgtggcaggag

SEQ ID NO: 1571370 - DNA, 15 bp, Homo sapiens
actgctctcctccac

SEQ ID NO: 1571371 - DNA, 12 bp, Homo sapiens
actgctctgaat

SEQ ID NO: 1571372 - DNA, 13 bp, Homo sapiens
actgctctgagaa

SEQ ID NO: 1571373 - DNA, 14 bp, Homo sapiens
actgctgattcttg

SEQ ID NO: 1571374 - DNA, 19 bp, Homo sapiens
actgctgattcttgtaaat

SEQ ID NO: 1571375 - DNA, 13 bp, Homo sapiens
actgctgcaaagc

SEQ ID NO: 1571376 - DNA, 16 bp, Homo sapiens
actgctgcaaagcttt

SEQ ID NO: 1571377 - DNA, 12 bp, Homo sapiens
actgctgcacca

SEQ ID NO: 1571378 - DNA, 15 bp, Homo sapiens
actgctgcaccagag

SEQ ID NO: 1571379 - DNA, 13 bp, Homo sapiens
actgctgcatact

SEQ ID NO: 1571380 - DNA, 17 bp, Homo sapiens
actgctgctagagccag

SEQ ID NO: 1571381 - DNA, 18 bp, Homo sapiens
actgctgctgctgctgcc

SEQ ID NO: 1571382 - DNA, 16 bp, Homo sapiens
actgctggacatgaga

SEQ ID NO: 1571383 - DNA, 20 bp, Homo sapiens
actgctggactgtggagggt

SEQ ID NO: 1571384 - DNA, 15 bp, Homo sapiens
actgctggctgcagc

SEQ ID NO: 1571385 - DNA, 14 bp, Homo sapiens
actgctggctgcct

SEQ ID NO: 1571386 - DNA, 23 bp, Homo sapiens
actgctgtgaaccctggggcctg

SEQ ID NO: 1571387 - DNA, 12 bp, Homo sapiens
actgctgtttta

SEQ ID NO: 1571388 - DNA, 15 bp, Homo sapiens
actgcttcccactgg

SEQ ID NO: 1571389 - DNA, 15 bp, Homo sapiens
actgcttcccatcct

SEQ ID NO: 1571390 - DNA, 21 bp, Homo sapiens
actgcttcccttactttgctg

SEQ ID NO: 1571391 - DNA, 23 bp, Homo sapiens
actgcttgaactaggctgagcaa

SEQ ID NO: 1571392 - DNA, 23 bp, Homo sapiens
actgcttggatccatacaaaact

SEQ ID NO: 1571393 - DNA, 20 bp, Homo sapiens
actgctttccagcctgggca

SEQ ID NO: 1571394 - DNA, 23 bp, Homo sapiens
actgctttgattggttgtgcctt

SEQ ID NO: 1571395 - DNA, 15 bp, Homo sapiens
actgctttgcaaaga

SEQ ID NO: 1571396 - DNA, 17 bp, Homo sapiens
actgcttttaaatgacc

SEQ ID NO: 1571397 - DNA, 14 bp, Homo sapiens
actgcttttcatta

SEQ ID NO: 1571398 - DNA, 19 bp, Homo sapiens
actgcttttcattagcagt

SEQ ID NO: 1571399 - DNA, 16 bp, Homo sapiens
actggaaaacagaaca

SEQ ID NO: 1571400 - DNA, 15 bp, Homo sapiens
actggaaaggggaga

SEQ ID NO: 1571401 - DNA, 21 bp, Homo sapiens
actggaacatggctagccttt

SEQ ID NO: 1571402 - DNA, 18 bp, Homo sapiens
actggaacggtgaaggtg

SEQ ID NO: 1571403 - DNA, 13 bp, Homo sapiens
actggaagaaagc

SEQ ID NO: 1571404 - DNA, 16 bp, Homo sapiens
actggaagttttgcat

SEQ ID NO: 1571405 - DNA, 14 bp, Homo sapiens
actggacatgaagg

SEQ ID NO: 1571406 - DNA, 20 bp, Homo sapiens
actggaccactgggcaatga

SEQ ID NO: 1571407 - DNA, 21 bp, Homo sapiens
actggaccactgggcaatgat

SEQ ID NO: 1571408 - DNA, 14 bp, Homo sapiens
actggaccaggtcc

SEQ ID NO: 1571409 - DNA, 22 bp, Homo sapiens
actggacctttgggttctttct

SEQ ID NO: 1571410 - DNA, 16 bp, Homo sapiens
actggagcccaggagt

SEQ ID NO: 1571411 - DNA, 22 bp, Homo sapiens
actggagcttttaaaaatgttt

SEQ ID NO: 1571412 - DNA, 23 bp, Homo sapiens
actggagcttttaaaaatgtttg

SEQ ID NO: 1571413 - DNA, 16 bp, Homo sapiens
actggaggagcagctt

SEQ ID NO: 1571414 - DNA, 18 bp, Homo sapiens
actggaggcccctggagc

SEQ ID NO: 1571415 - DNA, 19 bp, Homo sapiens
actggaggttgaagccaag

SEQ ID NO: 1571416 - DNA, 19 bp, Homo sapiens
actggagtgaggcttccag

SEQ ID NO: 1571417 - DNA, 20 bp, Homo sapiens
actggagtgaggcttccagg

SEQ ID NO: 1571418 - DNA, 21 bp, Homo sapiens
actggagtgaggcttccaggc

SEQ ID NO: 1571419 - DNA, 21 bp, Homo sapiens
actggagtgatgttagcagac

SEQ ID NO: 1571420 - DNA, 17 bp, Homo sapiens
actggagttacattaat

SEQ ID NO: 1571421 - DNA, 21 bp, Homo sapiens
actggagttccttatccctct

SEQ ID NO: 1571422 - DNA, 19 bp, Homo sapiens
actggagttctatgctctc

SEQ ID NO: 1571423 - DNA, 20 bp, Homo sapiens
actggcacagttttctgaga

SEQ ID NO: 1571424 - DNA, 11 bp, Homo sapiens
actggcagctc

SEQ ID NO: 1571425 - DNA, 18 bp, Homo sapiens
actggcagggataacaaa

SEQ ID NO: 1571426 - DNA, 21 bp, Homo sapiens
actggcaggtgcagatgggct

SEQ ID NO: 1571427 - DNA, 21 bp, Homo sapiens
actggcatctgacacaaaaaa

SEQ ID NO: 1571428 - DNA, 23 bp, Homo sapiens
actggcatggatatagttttact

SEQ ID NO: 1571429 - DNA, 21 bp, Homo sapiens
actggccacaaggacgctggc

SEQ ID NO: 1571430 - DNA, 15 bp, Homo sapiens
actggccaccaggct

SEQ ID NO: 1571431 - DNA, 19 bp, Homo sapiens
actggccagagagggccca

SEQ ID NO: 1571432 - DNA, 20 bp, Homo sapiens
actggccagagagggcccag

SEQ ID NO: 1571433 - DNA, 22 bp, Homo sapiens
actggccagagagggcccagct

SEQ ID NO: 1571434 - DNA, 23 bp, Homo sapiens
actggccagagagggcccagctg

SEQ ID NO: 1571435 - DNA, 11 bp, Homo sapiens
actggccaggg

SEQ ID NO: 1571436 - DNA, 21 bp, Homo sapiens
actggcctaggggccagggct

SEQ ID NO: 1571437 - DNA, 23 bp, Homo sapiens
actggcctgggtctccctggtgg

SEQ ID NO: 1571438 - DNA, 15 bp, Homo sapiens
actggcgcctccgag

SEQ ID NO: 1571439 - DNA, 15 bp, Homo sapiens
actggcgccttctcg

SEQ ID NO: 1571440 - DNA, 13 bp, Homo sapiens
actggctacagta

SEQ ID NO: 1571441 - DNA, 14 bp, Homo sapiens
actggctacagtac

SEQ ID NO: 1571442 - DNA, 21 bp, Homo sapiens
actggctagagtcctcactcc

SEQ ID NO: 1571443 - DNA, 12 bp, Homo sapiens
actggctctcca

SEQ ID NO: 1571444 - DNA, 14 bp, Homo sapiens
actggctctccaag

SEQ ID NO: 1571445 - DNA, 20 bp, Homo sapiens
actggctctccaagtgccag

SEQ ID NO: 1571446 - DNA, 18 bp, Homo sapiens
actggctggcctgagcaa

SEQ ID NO: 1571447 - DNA, 16 bp, Homo sapiens
actggctggctgcagt

SEQ ID NO: 1571448 - DNA, 14 bp, Homo sapiens
actggctggggcag

SEQ ID NO: 1571449 - DNA, 15 bp, Homo sapiens
actggctggggcaga

SEQ ID NO: 1571450 - DNA, 21 bp, Homo sapiens
actggctgtgcccctgatgca

SEQ ID NO: 1571451 - DNA, 18 bp, Homo sapiens
actggcttacctcctcat

SEQ ID NO: 1571452 - DNA, 22 bp, Homo sapiens
actggcttctgtgcactagcct

SEQ ID NO: 1571453 - DNA, 21 bp, Homo sapiens
actggcttgaaggactgcaga

SEQ ID NO: 1571454 - DNA, 22 bp, Homo sapiens
actgggaaagttaggattcaga

SEQ ID NO: 1571455 - DNA, 22 bp, Homo sapiens
actgggaagataggctctgcac

SEQ ID NO: 1571456 - DNA, 23 bp, Homo sapiens
actgggaagataggctctgcaca

SEQ ID NO: 1571457 - DNA, 17 bp, Homo sapiens
actgggacagctggctg

SEQ ID NO: 1571458 - DNA, 20 bp, Homo sapiens
actgggagccacttctcccc

SEQ ID NO: 1571459 - DNA, 18 bp, Homo sapiens
actgggagggggtggggg

SEQ ID NO: 1571460 - DNA, 16 bp, Homo sapiens
actgggagtgtgggct

SEQ ID NO: 1571461 - DNA, 18 bp, Homo sapiens
actgggatgtagagaggc

SEQ ID NO: 1571462 - DNA, 18 bp, Homo sapiens
actgggcaatgatggcaa

SEQ ID NO: 1571463 - DNA, 11 bp, Homo sapiens
actgggcagca

SEQ ID NO: 1571464 - DNA, 16 bp, Homo sapiens
actgggcagcaaggct

SEQ ID NO: 1571465 - DNA, 14 bp, Homo sapiens
actgggcccaggca

SEQ ID NO: 1571466 - DNA, 19 bp, Homo sapiens
actgggcccaggcaggtct

SEQ ID NO: 1571467 - DNA, 12 bp, Homo sapiens
actgggccctga

SEQ ID NO: 1571468 - DNA, 14 bp, Homo sapiens
actgggctctggct

SEQ ID NO: 1571469 - DNA, 19 bp, Homo sapiens
actggggaggctgaggcag

SEQ ID NO: 1571470 - DNA, 21 bp, Homo sapiens
actggggcctacagctttgat

SEQ ID NO: 1571471 - DNA, 13 bp, Homo sapiens
actgggggagggg

SEQ ID NO: 1571472 - DNA, 18 bp, Homo sapiens
actgggtcatcatttgtc

SEQ ID NO: 1571473 - DNA, 18 bp, Homo sapiens
actgggtctgacctggtg

SEQ ID NO: 1571474 - DNA, 19 bp, Homo sapiens
actgggtgcgtctccagtc

SEQ ID NO: 1571475 - DNA, 12 bp, Homo sapiens
actgggttaaat

SEQ ID NO: 1571476 - DNA, 17 bp, Homo sapiens
actgggttaaatatttt

SEQ ID NO: 1571477 - DNA, 15 bp, Homo sapiens
actgggtttctagcc

SEQ ID NO: 1571478 - DNA, 20 bp, Homo sapiens
actgggtttggaccccagct

SEQ ID NO: 1571479 - DNA, 15 bp, Homo sapiens
actggtaattgtaca

SEQ ID NO: 1571480 - DNA, 17 bp, Homo sapiens
actggtacttcctttct

SEQ ID NO: 1571481 - DNA, 18 bp, Homo sapiens
actggtaggttgggacac

SEQ ID NO: 1571482 - DNA, 12 bp, Homo sapiens
actggtagtgtt

SEQ ID NO: 1571483 - DNA, 16 bp, Homo sapiens
actggtccagctctga

SEQ ID NO: 1571484 - DNA, 18 bp, Homo sapiens
actggtccagctctgaca

SEQ ID NO: 1571485 - DNA, 21 bp, Homo sapiens
actggtccagctctgacatcc

SEQ ID NO: 1571486 - DNA, 23 bp, Homo sapiens
actggtgcaagttgaggacttct

SEQ ID NO: 1571487 - DNA, 13 bp, Homo sapiens
actggtgccctcc

SEQ ID NO: 1571488 - DNA, 12 bp, Homo sapiens
actggtggcccg

SEQ ID NO: 1571489 - DNA, 20 bp, Homo sapiens
actggtggcccgacagcctg

SEQ ID NO: 1571490 - DNA, 23 bp, Homo sapiens
actggtggcccgacagcctggca

SEQ ID NO: 1571491 - DNA, 21 bp, Homo sapiens
actggttaaacattaatattt

SEQ ID NO: 1571492 - DNA, 19 bp, Homo sapiens
actggttatagttgatatg

SEQ ID NO: 1571493 - DNA, 22 bp, Homo sapiens
actggtttccccagggaaggaa

SEQ ID NO: 1571494 - DNA, 14 bp, Homo sapiens
actggtttctcaga

SEQ ID NO: 1571495 - DNA, 15 bp, Homo sapiens
actggtttctcagaa

SEQ ID NO: 1571496 - DNA, 23 bp, Homo sapiens
actggtttctcagaatccaaaga

SEQ ID NO: 1571497 - DNA, 16 bp, Homo sapiens
actggtttgccaggcc

SEQ ID NO: 1571498 - DNA, 21 bp, Homo sapiens
actgtaaaatgcaaaaaatct

SEQ ID NO: 1571499 - DNA, 24 bp, Homo sapiens
actgtaaaatgcaaaaaatcttaa

SEQ ID NO: 1571500 - DNA, 22 bp, Homo sapiens
actgtaaaatgtgggattatgg

SEQ ID NO: 1571501 - DNA, 17 bp, Homo sapiens
actgtaaacttctgcaa

SEQ ID NO: 1571502 - DNA, 18 bp, Homo sapiens
actgtaaagacaaataaa

SEQ ID NO: 1571503 - DNA, 21 bp, Homo sapiens
actgtaaagacaaataaatga

SEQ ID NO: 1571504 - DNA, 22 bp, Homo sapiens
actgtaaagacaaataaatgat

SEQ ID NO: 1571505 - DNA, 16 bp, Homo sapiens
actgtaaagatttgtt

SEQ ID NO: 1571506 - DNA, 18 bp, Homo sapiens
actgtaaagatttgttga

SEQ ID NO: 1571507 - DNA, 19 bp, Homo sapiens
actgtaaataaaatgtgta

SEQ ID NO: 1571508 - DNA, 19 bp, Homo sapiens
actgtaaatatgtttgtgc

SEQ ID NO: 1571509 - DNA, 22 bp, Homo sapiens
actgtaaatatttatttatgtg

SEQ ID NO: 1571510 - DNA, 20 bp, Homo sapiens
actgtaaatatttttttaac

SEQ ID NO: 1571511 - DNA, 23 bp, Homo sapiens
actgtaaattgctggcagatgct

SEQ ID NO: 1571512 - DNA, 14 bp, Homo sapiens
actgtaagtttatt

SEQ ID NO: 1571513 - DNA, 21 bp, Homo sapiens
actgtaatacgtagctctctt

SEQ ID NO: 1571514 - DNA, 18 bp, Homo sapiens
actgtaatataaagtatt

SEQ ID NO: 1571515 - DNA, 23 bp, Homo sapiens
actgtaattgacagagtaaaagt

SEQ ID NO: 1571516 - DNA, 12 bp, Homo sapiens
actgtacatgtg

SEQ ID NO: 1571517 - DNA, 13 bp, Homo sapiens
actgtacattgtg

SEQ ID NO: 1571518 - DNA, 14 bp, Homo sapiens
actgtacattgtga

SEQ ID NO: 1571519 - DNA, 15 bp, Homo sapiens
actgtacattgtgag

SEQ ID NO: 1571520 - DNA, 17 bp, Homo sapiens
actgtacccaaatggaa

SEQ ID NO: 1571521 - DNA, 20 bp, Homo sapiens
actgtactactcctaattat

SEQ ID NO: 1571522 - DNA, 20 bp, Homo sapiens
actgtactatcctgtaaata

SEQ ID NO: 1571523 - DNA, 13 bp, Homo sapiens
actgtactcctcc

SEQ ID NO: 1571524 - DNA, 12 bp, Homo sapiens
actgtactgcat

SEQ ID NO: 1571525 - DNA, 15 bp, Homo sapiens
actgtactgcatgtg

SEQ ID NO: 1571526 - DNA, 19 bp, Homo sapiens
actgtactgcatgtgactt

SEQ ID NO: 1571527 - DNA, 17 bp, Homo sapiens
actgtacttaataaatt

SEQ ID NO: 1571528 - DNA, 18 bp, Homo sapiens
actgtacttaataaattc

SEQ ID NO: 1571529 - DNA, 18 bp, Homo sapiens
actgtagaatgatttcat

SEQ ID NO: 1571530 - DNA, 13 bp, Homo sapiens
actgtagatgatg

SEQ ID NO: 1571531 - DNA, 18 bp, Homo sapiens
actgtagattgcttctgt

SEQ ID NO: 1571532 - DNA, 21 bp, Homo sapiens
actgtagattgcttctgtagt

SEQ ID NO: 1571533 - DNA, 15 bp, Homo sapiens
actgtagcaggggaa

SEQ ID NO: 1571534 - DNA, 17 bp, Homo sapiens
actgtagcctggatatt

SEQ ID NO: 1571535 - DNA, 19 bp, Homo sapiens
actgtagcttttaggaata

SEQ ID NO: 1571536 - DNA, 13 bp, Homo sapiens
actgtagtctcag

SEQ ID NO: 1571537 - DNA, 16 bp, Homo sapiens
actgtagtctcaggac

SEQ ID NO: 1571538 - DNA, 13 bp, Homo sapiens
actgtagttctaa

SEQ ID NO: 1571539 - DNA, 15 bp, Homo sapiens
actgtagttctaaga

SEQ ID NO: 1571540 - DNA, 17 bp, Homo sapiens
actgtagtttagttctg

SEQ ID NO: 1571541 - DNA, 18 bp, Homo sapiens
actgtagtttagttctgt

SEQ ID NO: 1571542 - DNA, 23 bp, Homo sapiens
actgtagtttagttctgttgacc

SEQ ID NO: 1571543 - DNA, 16 bp, Homo sapiens
actgtatataaacata

SEQ ID NO: 1571544 - DNA, 16 bp, Homo sapiens
actgtatcaaatctgt

SEQ ID NO: 1571545 - DNA, 19 bp, Homo sapiens
actgtatctaaaaaataac

SEQ ID NO: 1571546 - DNA, 15 bp, Homo sapiens
actgtatgatttata

SEQ ID NO: 1571547 - DNA, 20 bp, Homo sapiens
actgtatgtgccaaagcttt

SEQ ID NO: 1571548 - DNA, 15 bp, Homo sapiens
actgtattaaatctt

SEQ ID NO: 1571549 - DNA, 16 bp, Homo sapiens
actgtattaaatctta

SEQ ID NO: 1571550 - DNA, 18 bp, Homo sapiens
actgtattaaatcttaaa

SEQ ID NO: 1571551 - DNA, 20 bp, Homo sapiens
actgtattaaatcttaaaca

SEQ ID NO: 1571552 - DNA, 13 bp, Homo sapiens
actgtattaagag

SEQ ID NO: 1571553 - DNA, 20 bp, Homo sapiens
actgtattcgtgcatttttg

SEQ ID NO: 1571554 - DNA, 19 bp, Homo sapiens
actgtattgggccttttgg

SEQ ID NO: 1571555 - DNA, 23 bp, Homo sapiens
actgtatttgaaataagaattca

SEQ ID NO: 1571556 - DNA, 16 bp, Homo sapiens
actgtatttttttaac

SEQ ID NO: 1571557 - DNA, 19 bp, Homo sapiens
actgtcaaaataattttat

SEQ ID NO: 1571558 - DNA, 15 bp, Homo sapiens
actgtcactcattgc

SEQ ID NO: 1571559 - DNA, 24 bp, Homo sapiens
actgtcactcattgctgagcctct

SEQ ID NO: 1571560 - DNA, 15 bp, Homo sapiens
actgtcactgttcct

SEQ ID NO: 1571561 - DNA, 17 bp, Homo sapiens
actgtcagagaatatga

SEQ ID NO: 1571562 - DNA, 12 bp, Homo sapiens
actgtcaggaag

SEQ ID NO: 1571563 - DNA, 24 bp, Homo sapiens
actgtcatgcttcatcattccctc

SEQ ID NO: 1571564 - DNA, 17 bp, Homo sapiens
actgtcatgtggcttgg

SEQ ID NO: 1571565 - DNA, 16 bp, Homo sapiens
actgtcccagtagcca

SEQ ID NO: 1571566 - DNA, 23 bp, Homo sapiens
actgtccctctcagtgccttctc

SEQ ID NO: 1571567 - DNA, 16 bp, Homo sapiens
actgtcccttgcctca

SEQ ID NO: 1571568 - DNA, 13 bp, Homo sapiens
actgtcctctaca

SEQ ID NO: 1571569 - DNA, 19 bp, Homo sapiens
actgtcctgaggagccctg

SEQ ID NO: 1571570 - DNA, 17 bp, Homo sapiens
actgtcctgggcctgca

SEQ ID NO: 1571571 - DNA, 23 bp, Homo sapiens
actgtcctgggcgccctggaagc

SEQ ID NO: 1571572 - DNA, 15 bp, Homo sapiens
actgtcctgtcctgc

SEQ ID NO: 1571573 - DNA, 19 bp, Homo sapiens
actgtccttccctgccact

SEQ ID NO: 1571574 - DNA, 21 bp, Homo sapiens
actgtctatatcataactata

SEQ ID NO: 1571575 - DNA, 21 bp, Homo sapiens
actgtctattaaaattctgat

SEQ ID NO: 1571576 - DNA, 16 bp, Homo sapiens
actgtctcaaaaggat

SEQ ID NO: 1571577 - DNA, 19 bp, Homo sapiens
actgtctcactcgttctgt

SEQ ID NO: 1571578 - DNA, 21 bp, Homo sapiens
actgtctgggattaagggcaa

SEQ ID NO: 1571579 - DNA, 11 bp, Homo sapiens
actgtcttccc

SEQ ID NO: 1571580 - DNA, 18 bp, Homo sapiens
actgtcttgaattagtat

SEQ ID NO: 1571581 - DNA, 16 bp, Homo sapiens
actgtcttgtttcagt

SEQ ID NO: 1571582 - DNA, 19 bp, Homo sapiens
actgtctttaaaagagaga

SEQ ID NO: 1571583 - DNA, 18 bp, Homo sapiens
actgtctttattcttatt

SEQ ID NO: 1571584 - DNA, 13 bp, Homo sapiens
actgtctttccta

SEQ ID NO: 1571585 - DNA, 19 bp, Homo sapiens
actgtctttgactgtgatt

SEQ ID NO: 1571586 - DNA, 18 bp, Homo sapiens
actgtgaaaaatcagatg

SEQ ID NO: 1571587 - DNA, 23 bp, Homo sapiens
actgtgaaaaatcagatgaattg

SEQ ID NO: 1571588 - DNA, 18 bp, Homo sapiens
actgtgaaaatagtgtaa

SEQ ID NO: 1571589 - DNA, 23 bp, Homo sapiens
actgtgaagagaatgtattctgt

SEQ ID NO: 1571590 - DNA, 15 bp, Homo sapiens
actgtgaaggaccct

SEQ ID NO: 1571591 - DNA, 19 bp, Homo sapiens
actgtgaagggtacagatt

SEQ ID NO: 1571592 - DNA, 23 bp, Homo sapiens
actgtgaatgtaaaacagagcca

SEQ ID NO: 1571593 - DNA, 20 bp, Homo sapiens
actgtgaggcggcagctggg

SEQ ID NO: 1571594 - DNA, 22 bp, Homo sapiens
actgtgaggcggcagctggggc

SEQ ID NO: 1571595 - DNA, 23 bp, Homo sapiens
actgtgatcaggctatgtatgga

SEQ ID NO: 1571596 - DNA, 16 bp, Homo sapiens
actgtgattagatcac

SEQ ID NO: 1571597 - DNA, 20 bp, Homo sapiens
actgtgattagatcacatct

SEQ ID NO: 1571598 - DNA, 20 bp, Homo sapiens
actgtgattttatgtttaaa

SEQ ID NO: 1571599 - DNA, 13 bp, Homo sapiens
actgtgcacaccc

SEQ ID NO: 1571600 - DNA, 17 bp, Homo sapiens
actgtgcatcaaccagg

SEQ ID NO: 1571601 - DNA, 23 bp, Homo sapiens
actgtgccacaatgcagttctga

SEQ ID NO: 1571602 - DNA, 12 bp, Homo sapiens
actgtgccctgg

SEQ ID NO: 1571603 - DNA, 19 bp, Homo sapiens
actgtgcctcagagaccag

SEQ ID NO: 1571604 - DNA, 11 bp, Homo sapiens
actgtgctggg

SEQ ID NO: 1571605 - DNA, 12 bp, Homo sapiens
actgtggaaaga

SEQ ID NO: 1571606 - DNA, 13 bp, Homo sapiens
actgtggaaagac

SEQ ID NO: 1571607 - DNA, 19 bp, Homo sapiens
actgtggagactttctgtt

SEQ ID NO: 1571608 - DNA, 20 bp, Homo sapiens
actgtggcacttgcctgggt

SEQ ID NO: 1571609 - DNA, 17 bp, Homo sapiens
actgtggccacagcccc

SEQ ID NO: 1571610 - DNA, 16 bp, Homo sapiens
actgtggccagagctg

SEQ ID NO: 1571611 - DNA, 22 bp, Homo sapiens
actgtggccagagctggaaggc

SEQ ID NO: 1571612 - DNA, 17 bp, Homo sapiens
actgtggccgttatctg

SEQ ID NO: 1571613 - DNA, 19 bp, Homo sapiens
actgtggcgactctgcaga

SEQ ID NO: 1571614 - DNA, 12 bp, Homo sapiens
actgtggctgct

SEQ ID NO: 1571615 - DNA, 24 bp, Homo sapiens
actgtgggtccgagagggaagctg

SEQ ID NO: 1571616 - DNA, 20 bp, Homo sapiens
actgtggtgatctgtagact

SEQ ID NO: 1571617 - DNA, 15 bp, Homo sapiens
actgtggtttcagat

SEQ ID NO: 1571618 - DNA, 22 bp, Homo sapiens
actgtgtaagaagctgtgaata

SEQ ID NO: 1571619 - DNA, 18 bp, Homo sapiens
actgtgtatgtacatata

SEQ ID NO: 1571620 - DNA, 15 bp, Homo sapiens
actgtgtattccaag

SEQ ID NO: 1571621 - DNA, 23 bp, Homo sapiens
actgtgtgttttcccaaagcact

SEQ ID NO: 1571622 - DNA, 19 bp, Homo sapiens
actgtgttactgctttgca

SEQ ID NO: 1571623 - DNA, 21 bp, Homo sapiens
actgtgttgggcaagacctct

SEQ ID NO: 1571624 - DNA, 20 bp, Homo sapiens
actgtgtttccaaaggttcc

SEQ ID NO: 1571625 - DNA, 18 bp, Homo sapiens
actgtgttttataaaata

SEQ ID NO: 1571626 - DNA, 23 bp, Homo sapiens
actgttacaacttgtatttccaa

SEQ ID NO: 1571627 - DNA, 17 bp, Homo sapiens
actgttactccacagcg

SEQ ID NO: 1571628 - DNA, 15 bp, Homo sapiens
actgttactgggccc

SEQ ID NO: 1571629 - DNA, 21 bp, Homo sapiens
actgttactttggcaatttcc

SEQ ID NO: 1571630 - DNA, 20 bp, Homo sapiens
actgttagaaaatggacact

SEQ ID NO: 1571631 - DNA, 14 bp, Homo sapiens
actgttagaatgta

SEQ ID NO: 1571632 - DNA, 20 bp, Homo sapiens
actgttagcttttaccttaa

SEQ ID NO: 1571633 - DNA, 13 bp, Homo sapiens
actgttatcattt

SEQ ID NO: 1571634 - DNA, 15 bp, Homo sapiens
actgttattctttgc

SEQ ID NO: 1571635 - DNA, 19 bp, Homo sapiens
actgttattctttgcactt

SEQ ID NO: 1571636 - DNA, 14 bp, Homo sapiens
actgttatttaatt

SEQ ID NO: 1571637 - DNA, 15 bp, Homo sapiens
actgttatttaattg

SEQ ID NO: 1571638 - DNA, 14 bp, Homo sapiens
actgttcacggcag

SEQ ID NO: 1571639 - DNA, 18 bp, Homo sapiens
actgttcacggcagacca

SEQ ID NO: 1571640 - DNA, 16 bp, Homo sapiens
actgttccctctggct

SEQ ID NO: 1571641 - DNA, 17 bp, Homo sapiens
actgttctaaagctctg

SEQ ID NO: 1571642 - DNA, 16 bp, Homo sapiens
actgttctgtgtcttt

SEQ ID NO: 1571643 - DNA, 17 bp, Homo sapiens
actgttctgtgtctttc

SEQ ID NO: 1571644 - DNA, 15 bp, Homo sapiens
actgttcttggtaac

SEQ ID NO: 1571645 - DNA, 15 bp, Homo sapiens
actgttctttccagg

SEQ ID NO: 1571646 - DNA, 18 bp, Homo sapiens
actgttgagccccagtgc

SEQ ID NO: 1571647 - DNA, 21 bp, Homo sapiens
actgttgagccccagtgctgg

SEQ ID NO: 1571648 - DNA, 16 bp, Homo sapiens
actgttgcatttactt

SEQ ID NO: 1571649 - DNA, 15 bp, Homo sapiens
actgttgctttaata

SEQ ID NO: 1571650 - DNA, 19 bp, Homo sapiens
actgttgctttaatatgag

SEQ ID NO: 1571651 - DNA, 21 bp, Homo sapiens
actgttggaatggatttttct

SEQ ID NO: 1571652 - DNA, 14 bp, Homo sapiens
actgtttatacact

SEQ ID NO: 1571653 - DNA, 18 bp, Homo sapiens
actgtttatacactgtgt

SEQ ID NO: 1571654 - DNA, 20 bp, Homo sapiens
actgtttcactgaaatgttt

SEQ ID NO: 1571655 - DNA, 22 bp, Homo sapiens
actgtttcagtgtgagtcagaa

SEQ ID NO: 1571656 - DNA, 23 bp, Homo sapiens
actgtttctcttgagctggcctc

SEQ ID NO: 1571657 - DNA, 22 bp, Homo sapiens
actgtttggacttttattttgg

SEQ ID NO: 1571658 - DNA, 18 bp, Homo sapiens
actgtttgtaatatacag

SEQ ID NO: 1571659 - DNA, 20 bp, Homo sapiens
actgtttgtaatatacagtt

SEQ ID NO: 1571660 - DNA, 22 bp, Homo sapiens
actgtttgtttttatttaaatt

SEQ ID NO: 1571661 - DNA, 17 bp, Homo sapiens
actgttttatctctgtg

SEQ ID NO: 1571662 - DNA, 14 bp, Homo sapiens
actgttttatctgg

SEQ ID NO: 1571663 - DNA, 12 bp, Homo sapiens
actgttttgaat

SEQ ID NO: 1571664 - DNA, 22 bp, Homo sapiens
actgttttgccaagaatatagt

SEQ ID NO: 1571665 - DNA, 23 bp, Homo sapiens
actgtttttcagggaggtggctg

SEQ ID NO: 1571666 - DNA, 13 bp, Homo sapiens
actgttttttaag

SEQ ID NO: 1571667 - DNA, 23 bp, Homo sapiens
actgttttttttttttttaattt

SEQ ID NO: 1571668 - DNA, 13 bp, Homo sapiens
acttaaaaaaatg

SEQ ID NO: 1571669 - DNA, 15 bp, Homo sapiens
acttaaaaaaatgac

SEQ ID NO: 1571670 - DNA, 16 bp, Homo sapiens
acttaaaaaaatgaca

SEQ ID NO: 1571671 - DNA, 17 bp, Homo sapiens
acttaaaaaaatgacag

SEQ ID NO: 1571672 - DNA, 13 bp, Homo sapiens
acttaaaaaactt

SEQ ID NO: 1571673 - DNA, 23 bp, Homo sapiens
acttaaaaaacttgtaaatgctg

SEQ ID NO: 1571674 - DNA, 14 bp, Homo sapiens
acttaaaaaatgtc

SEQ ID NO: 1571675 - DNA, 16 bp, Homo sapiens
acttaaaaatgtaaat

SEQ ID NO: 1571676 - DNA, 23 bp, Homo sapiens
acttaaaaatgtaaatattctat

SEQ ID NO: 1571677 - DNA, 13 bp, Homo sapiens
acttaaaaattaa

SEQ ID NO: 1571678 - DNA, 15 bp, Homo sapiens
acttaaaaattagca

SEQ ID NO: 1571679 - DNA, 15 bp, Homo sapiens
acttaaaacatggtg

SEQ ID NO: 1571680 - DNA, 13 bp, Homo sapiens
acttaaaatattt

SEQ ID NO: 1571681 - DNA, 18 bp, Homo sapiens
acttaaaattagtctttt

SEQ ID NO: 1571682 - DNA, 17 bp, Homo sapiens
acttaaacaaaaaacta

SEQ ID NO: 1571683 - DNA, 15 bp, Homo sapiens
acttaaacagaagca

SEQ ID NO: 1571684 - DNA, 11 bp, Homo sapiens
acttaaagatt

SEQ ID NO: 1571685 - DNA, 13 bp, Homo sapiens
acttaaagattta

SEQ ID NO: 1571686 - DNA, 15 bp, Homo sapiens
acttaaagatttatc

SEQ ID NO: 1571687 - DNA, 19 bp, Homo sapiens
acttaaatggtaataagca

SEQ ID NO: 1571688 - DNA, 16 bp, Homo sapiens
acttaaatgttatgta

SEQ ID NO: 1571689 - DNA, 15 bp, Homo sapiens
acttaaatgttatta

SEQ ID NO: 1571690 - DNA, 19 bp, Homo sapiens
acttaaatttgttctttgt

SEQ ID NO: 1571691 - DNA, 21 bp, Homo sapiens
acttaacagatgcaatgtgct

SEQ ID NO: 1571692 - DNA, 15 bp, Homo sapiens
acttaacggctccag

SEQ ID NO: 1571693 - DNA, 19 bp, Homo sapiens
acttaacggctccaggatt

SEQ ID NO: 1571694 - DNA, 21 bp, Homo sapiens
acttaactgtccgtaagcagt

SEQ ID NO: 1571695 - DNA, 14 bp, Homo sapiens
acttaagacaaatg

SEQ ID NO: 1571696 - DNA, 15 bp, Homo sapiens
acttaagacaaatgg

SEQ ID NO: 1571697 - DNA, 15 bp, Homo sapiens
acttaagcaaaagaa

SEQ ID NO: 1571698 - DNA, 17 bp, Homo sapiens
acttaagtctcgaatgt

SEQ ID NO: 1571699 - DNA, 21 bp, Homo sapiens
acttaagtttgtaagacagtg

SEQ ID NO: 1571700 - DNA, 15 bp, Homo sapiens
acttaagtttttcca

SEQ ID NO: 1571701 - DNA, 17 bp, Homo sapiens
acttaagtttttccaaa

SEQ ID NO: 1571702 - DNA, 13 bp, Homo sapiens
acttaataactgt

SEQ ID NO: 1571703 - DNA, 23 bp, Homo sapiens
acttaatggctgttgagggccac

SEQ ID NO: 1571704 - DNA, 15 bp, Homo sapiens
acttaatgtatgtta

SEQ ID NO: 1571705 - DNA, 16 bp, Homo sapiens
acttaatgtatgttac

SEQ ID NO: 1571706 - DNA, 22 bp, Homo sapiens
acttaattcagtctcagctgct

SEQ ID NO: 1571707 - DNA, 14 bp, Homo sapiens
acttacaaaatgcc

SEQ ID NO: 1571708 - DNA, 14 bp, Homo sapiens
acttacccagatgt

SEQ ID NO: 1571709 - DNA, 20 bp, Homo sapiens
acttacccagatgttgcttt

SEQ ID NO: 1571710 - DNA, 17 bp, Homo sapiens
acttacctagatttaca

SEQ ID NO: 1571711 - DNA, 13 bp, Homo sapiens
acttacctgaaaa

SEQ ID NO: 1571712 - DNA, 13 bp, Homo sapiens
acttactataatt

SEQ ID NO: 1571713 - DNA, 15 bp, Homo sapiens
acttactatccattt

SEQ ID NO: 1571714 - DNA, 13 bp, Homo sapiens
acttactctaaga

SEQ ID NO: 1571715 - DNA, 15 bp, Homo sapiens
acttacttgcttatt

SEQ ID NO: 1571716 - DNA, 16 bp, Homo sapiens
acttagaaattgcatt

SEQ ID NO: 1571717 - DNA, 18 bp, Homo sapiens
acttagaacctttctgtg

SEQ ID NO: 1571718 - DNA, 22 bp, Homo sapiens
acttagaatccgaagggaatta

SEQ ID NO: 1571719 - DNA, 15 bp, Homo sapiens
acttagaggaaaagg

SEQ ID NO: 1571720 - DNA, 20 bp, Homo sapiens
acttagaggtggggagcaga

SEQ ID NO: 1571721 - DNA, 14 bp, Homo sapiens
acttagcaggcacc

SEQ ID NO: 1571722 - DNA, 18 bp, Homo sapiens
acttagccagttcaaagt

SEQ ID NO: 1571723 - DNA, 21 bp, Homo sapiens
acttagcccaagaggtctgag

SEQ ID NO: 1571724 - DNA, 23 bp, Homo sapiens
acttagccgcaccctgcacctgc

SEQ ID NO: 1571725 - DNA, 23 bp, Homo sapiens
acttagccgtccatggcaccagc

SEQ ID NO: 1571726 - DNA, 17 bp, Homo sapiens
acttagcgtcaagacat

SEQ ID NO: 1571727 - DNA, 19 bp, Homo sapiens
acttagcgtcaagacattt

SEQ ID NO: 1571728 - DNA, 17 bp, Homo sapiens
acttagctcaggtgcct

SEQ ID NO: 1571729 - DNA, 23 bp, Homo sapiens
acttaggaaggtggccttcctgc

SEQ ID NO: 1571730 - DNA, 21 bp, Homo sapiens
acttaggcatgcacagctgta

SEQ ID NO: 1571731 - DNA, 16 bp, Homo sapiens
acttagggcaccaggg

SEQ ID NO: 1571732 - DNA, 18 bp, Homo sapiens
acttaggttattttgctt

SEQ ID NO: 1571733 - DNA, 19 bp, Homo sapiens
acttaggttattttgcttt

SEQ ID NO: 1571734 - DNA, 17 bp, Homo sapiens
acttagtatattttctt

SEQ ID NO: 1571735 - DNA, 14 bp, Homo sapiens
acttagtatgcagt

SEQ ID NO: 1571736 - DNA, 17 bp, Homo sapiens
acttagtcaataagaaa

SEQ ID NO: 1571737 - DNA, 18 bp, Homo sapiens
acttagtgacaaaataga

SEQ ID NO: 1571738 - DNA, 16 bp, Homo sapiens
acttagtggtatgtct

SEQ ID NO: 1571739 - DNA, 20 bp, Homo sapiens
acttataaaataacttgcat

SEQ ID NO: 1571740 - DNA, 13 bp, Homo sapiens
acttatattgaag

SEQ ID NO: 1571741 - DNA, 20 bp, Homo sapiens
acttatattgaagacaattt

SEQ ID NO: 1571742 - DNA, 13 bp, Homo sapiens
acttatattttat

SEQ ID NO: 1571743 - DNA, 19 bp, Homo sapiens
acttatctctcaaaacaat

SEQ ID NO: 1571744 - DNA, 13 bp, Homo sapiens
acttatgatttca

SEQ ID NO: 1571745 - DNA, 19 bp, Homo sapiens
acttatgctagtttattgg

SEQ ID NO: 1571746 - DNA, 16 bp, Homo sapiens
acttatgtttttaaat

SEQ ID NO: 1571747 - DNA, 15 bp, Homo sapiens
acttattatgcataa

SEQ ID NO: 1571748 - DNA, 16 bp, Homo sapiens
acttattatgcataaa

SEQ ID NO: 1571749 - DNA, 13 bp, Homo sapiens
acttattccaagt

SEQ ID NO: 1571750 - DNA, 18 bp, Homo sapiens
acttattccaagtgcatt

SEQ ID NO: 1571751 - DNA, 15 bp, Homo sapiens
acttatttaaaaata

SEQ ID NO: 1571752 - DNA, 18 bp, Homo sapiens
acttatttaaaaatattt

SEQ ID NO: 1571753 - DNA, 15 bp, Homo sapiens
acttatttaaactct

SEQ ID NO: 1571754 - DNA, 12 bp, Homo sapiens
acttatttctgc

SEQ ID NO: 1571755 - DNA, 13 bp, Homo sapiens
acttatttctgct

SEQ ID NO: 1571756 - DNA, 14 bp, Homo sapiens
acttattttctgaa

SEQ ID NO: 1571757 - DNA, 14 bp, Homo sapiens
acttatttttcaag

SEQ ID NO: 1571758 - DNA, 19 bp, Homo sapiens
acttcaacatttacatgta

SEQ ID NO: 1571759 - DNA, 16 bp, Homo sapiens
acttcaacccccagct

SEQ ID NO: 1571760 - DNA, 16 bp, Homo sapiens
acttcaagttaaagtg

SEQ ID NO: 1571761 - DNA, 17 bp, Homo sapiens
acttcacacacaggcaa

SEQ ID NO: 1571762 - DNA, 14 bp, Homo sapiens
acttcaccaccccc

SEQ ID NO: 1571763 - DNA, 14 bp, Homo sapiens
acttcacccccaac

SEQ ID NO: 1571764 - DNA, 19 bp, Homo sapiens
acttcactgtcaggaagaa

SEQ ID NO: 1571765 - DNA, 19 bp, Homo sapiens
acttcagggcagggctctg

SEQ ID NO: 1571766 - DNA, 20 bp, Homo sapiens
acttcagggcagggctctga

SEQ ID NO: 1571767 - DNA, 12 bp, Homo sapiens
acttcagtctgt

SEQ ID NO: 1571768 - DNA, 15 bp, Homo sapiens
acttcataataaact

SEQ ID NO: 1571769 - DNA, 17 bp, Homo sapiens
acttcatagaaacctct

SEQ ID NO: 1571770 - DNA, 18 bp, Homo sapiens
acttcatatatgaggact

SEQ ID NO: 1571771 - DNA, 18 bp, Homo sapiens
acttcatcgacttagcct

SEQ ID NO: 1571772 - DNA, 19 bp, Homo sapiens
acttcatgacaagcatttt

SEQ ID NO: 1571773 - DNA, 23 bp, Homo sapiens
acttcatgtaattttattttaaa

SEQ ID NO: 1571774 - DNA, 22 bp, Homo sapiens
acttcattctaaaccaaaacag

SEQ ID NO: 1571775 - DNA, 23 bp, Homo sapiens
acttcattctaaaccaaaacaga

SEQ ID NO: 1571776 - DNA, 17 bp, Homo sapiens
acttcattgtaaatcac

SEQ ID NO: 1571777 - DNA, 19 bp, Homo sapiens
acttcattgtaaatcactt

SEQ ID NO: 1571778 - DNA, 15 bp, Homo sapiens
acttccaaagaaagt

SEQ ID NO: 1571779 - DNA, 15 bp, Homo sapiens
acttccaaatcctgg

SEQ ID NO: 1571780 - DNA, 20 bp, Homo sapiens
acttccaagtgataatttta

SEQ ID NO: 1571781 - DNA, 18 bp, Homo sapiens
acttccacagcagcagaa

SEQ ID NO: 1571782 - DNA, 16 bp, Homo sapiens
acttccaccagcctgc

SEQ ID NO: 1571783 - DNA, 20 bp, Homo sapiens
acttccacttgtgtatattt

SEQ ID NO: 1571784 - DNA, 18 bp, Homo sapiens
acttccaggggaacctgc

SEQ ID NO: 1571785 - DNA, 21 bp, Homo sapiens
acttccaggttccatccacca

SEQ ID NO: 1571786 - DNA, 20 bp, Homo sapiens
acttccatgccttaaaccta

SEQ ID NO: 1571787 - DNA, 20 bp, Homo sapiens
acttccatttgtattcaaat

SEQ ID NO: 1571788 - DNA, 14 bp, Homo sapiens
acttcccaccctgc

SEQ ID NO: 1571789 - DNA, 17 bp, Homo sapiens
acttcccaccctgcccc

SEQ ID NO: 1571790 - DNA, 19 bp, Homo sapiens
acttcccaccctgcccctc

SEQ ID NO: 1571791 - DNA, 16 bp, Homo sapiens
acttcccagaggcaga

SEQ ID NO: 1571792 - DNA, 11 bp, Homo sapiens
acttcccagct

SEQ ID NO: 1571793 - DNA, 24 bp, Homo sapiens
acttcccaggatctgctccaacag

SEQ ID NO: 1571794 - DNA, 22 bp, Homo sapiens
acttcccagttcaggagtccca

SEQ ID NO: 1571795 - DNA, 24 bp, Homo sapiens
acttcccagttcaggagtcccaag

SEQ ID NO: 1571796 - DNA, 15 bp, Homo sapiens
acttcccatctggct

SEQ ID NO: 1571797 - DNA, 16 bp, Homo sapiens
acttcccatctggctc

SEQ ID NO: 1571798 - DNA, 17 bp, Homo sapiens
acttcccatctggctca

SEQ ID NO: 1571799 - DNA, 19 bp, Homo sapiens
acttcccattttggaagtt

SEQ ID NO: 1571800 - DNA, 21 bp, Homo sapiens
acttccccaatatcttgcttg

SEQ ID NO: 1571801 - DNA, 14 bp, Homo sapiens
acttccccagctct

SEQ ID NO: 1571802 - DNA, 19 bp, Homo sapiens
acttccccctcttcttctg

SEQ ID NO: 1571803 - DNA, 21 bp, Homo sapiens
acttccccctcttcttctgaa

SEQ ID NO: 1571804 - DNA, 22 bp, Homo sapiens
acttccccctcttcttctgaag

SEQ ID NO: 1571805 - DNA, 15 bp, Homo sapiens
acttcccctgggcaa

SEQ ID NO: 1571806 - DNA, 22 bp, Homo sapiens
acttcccgtcccatatcctgcc

SEQ ID NO: 1571807 - DNA, 13 bp, Homo sapiens
acttcccttcctc

SEQ ID NO: 1571808 - DNA, 22 bp, Homo sapiens
acttccctttctgcttgtgtta

SEQ ID NO: 1571809 - DNA, 15 bp, Homo sapiens
acttccgcctcctgt

SEQ ID NO: 1571810 - DNA, 13 bp, Homo sapiens
acttccgctgagg

SEQ ID NO: 1571811 - DNA, 16 bp, Homo sapiens
acttcctgaggcctca

SEQ ID NO: 1571812 - DNA, 12 bp, Homo sapiens
acttcctgccta

SEQ ID NO: 1571813 - DNA, 12 bp, Homo sapiens
acttcctgctgc

SEQ ID NO: 1571814 - DNA, 19 bp, Homo sapiens
acttcctggggatgtcata

SEQ ID NO: 1571815 - DNA, 11 bp, Homo sapiens
acttcctgtgt

SEQ ID NO: 1571816 - DNA, 16 bp, Homo sapiens
acttcctgtgtactct

SEQ ID NO: 1571817 - DNA, 14 bp, Homo sapiens
acttccttttaact

SEQ ID NO: 1571818 - DNA, 18 bp, Homo sapiens
acttcgtcttctaatttc

SEQ ID NO: 1571819 - DNA, 17 bp, Homo sapiens
acttctaaatgcatatc

SEQ ID NO: 1571820 - DNA, 21 bp, Homo sapiens
acttctaagtaaaaccacagc

SEQ ID NO: 1571821 - DNA, 18 bp, Homo sapiens
acttctacccagatggaa

SEQ ID NO: 1571822 - DNA, 19 bp, Homo sapiens
acttctacccagatggaaa

SEQ ID NO: 1571823 - DNA, 17 bp, Homo sapiens
acttctacctgccctca

SEQ ID NO: 1571824 - DNA, 17 bp, Homo sapiens
acttctagatctcagcc

SEQ ID NO: 1571825 - DNA, 17 bp, Homo sapiens
acttctatattttaata

SEQ ID NO: 1571826 - DNA, 22 bp, Homo sapiens
acttctccagacccaccacacc

SEQ ID NO: 1571827 - DNA, 14 bp, Homo sapiens
acttctccatgctg

SEQ ID NO: 1571828 - DNA, 12 bp, Homo sapiens
acttctccccag

SEQ ID NO: 1571829 - DNA, 15 bp, Homo sapiens
acttctgacaaaggt

SEQ ID NO: 1571830 - DNA, 16 bp, Homo sapiens
acttctgcaacaagca

SEQ ID NO: 1571831 - DNA, 12 bp, Homo sapiens
acttctgcctgg

SEQ ID NO: 1571832 - DNA, 13 bp, Homo sapiens
acttctggaaggc

SEQ ID NO: 1571833 - DNA, 20 bp, Homo sapiens
acttctggaaggctggctga

SEQ ID NO: 1571834 - DNA, 14 bp, Homo sapiens
acttctgggaaaaa

SEQ ID NO: 1571835 - DNA, 18 bp, Homo sapiens
acttctggtataattgtg

SEQ ID NO: 1571836 - DNA, 15 bp, Homo sapiens
acttctgtaattgtg

SEQ ID NO: 1571837 - DNA, 23 bp, Homo sapiens
acttctgtgagacccccacacct

SEQ ID NO: 1571838 - DNA, 13 bp, Homo sapiens
acttctgtgttca

SEQ ID NO: 1571839 - DNA, 14 bp, Homo sapiens
acttctgtgttcat

SEQ ID NO: 1571840 - DNA, 17 bp, Homo sapiens
acttcttacttgtctgt

SEQ ID NO: 1571841 - DNA, 18 bp, Homo sapiens
acttcttagggattaaat

SEQ ID NO: 1571842 - DNA, 23 bp, Homo sapiens
acttcttagggattaaatataga

SEQ ID NO: 1571843 - DNA, 18 bp, Homo sapiens
acttcttatacatttgat

SEQ ID NO: 1571844 - DNA, 12 bp, Homo sapiens
acttcttatttt

SEQ ID NO: 1571845 - DNA, 15 bp, Homo sapiens
acttcttatttttct

SEQ ID NO: 1571846 - DNA, 18 bp, Homo sapiens
acttcttcacctcttcca

SEQ ID NO: 1571847 - DNA, 13 bp, Homo sapiens
acttcttctctta

SEQ ID NO: 1571848 - DNA, 20 bp, Homo sapiens
acttcttgaaggtgctgacg

SEQ ID NO: 1571849 - DNA, 15 bp, Homo sapiens
acttctttttaatct

SEQ ID NO: 1571850 - DNA, 21 bp, Homo sapiens
acttcttttttcaaaagaaag

SEQ ID NO: 1571851 - DNA, 23 bp, Homo sapiens
acttcttttttcaaaagaaagtc

SEQ ID NO: 1571852 - DNA, 12 bp, Homo sapiens
acttgaaagatt

SEQ ID NO: 1571853 - DNA, 14 bp, Homo sapiens
acttgaaagatttt

SEQ ID NO: 1571854 - DNA, 23 bp, Homo sapiens
acttgaaatgttagtcattgtta

SEQ ID NO: 1571855 - DNA, 21 bp, Homo sapiens
acttgaagggccagagccagg

SEQ ID NO: 1571856 - DNA, 13 bp, Homo sapiens
acttgaatatgta

SEQ ID NO: 1571857 - DNA, 20 bp, Homo sapiens
acttgaatattcctggactt

SEQ ID NO: 1571858 - DNA, 14 bp, Homo sapiens
acttgaatccattg

SEQ ID NO: 1571859 - DNA, 19 bp, Homo sapiens
acttgaatccattgaaagt

SEQ ID NO: 1571860 - DNA, 15 bp, Homo sapiens
acttgaatgtgtcag

SEQ ID NO: 1571861 - DNA, 22 bp, Homo sapiens
acttgaatttggtctgtatagt

SEQ ID NO: 1571862 - DNA, 22 bp, Homo sapiens
acttgactcatttaaagctaaa

SEQ ID NO: 1571863 - DNA, 18 bp, Homo sapiens
acttgactccatttcatc

SEQ ID NO: 1571864 - DNA, 11 bp, Homo sapiens
acttgagccta

SEQ ID NO: 1571865 - DNA, 18 bp, Homo sapiens
acttgagtaaaatactct

SEQ ID NO: 1571866 - DNA, 15 bp, Homo sapiens
acttgagtgttcctt

SEQ ID NO: 1571867 - DNA, 24 bp, Homo sapiens
acttgagttggagtactatattta

SEQ ID NO: 1571868 - DNA, 23 bp, Homo sapiens
acttgataagggactgatgtttg

SEQ ID NO: 1571869 - DNA, 16 bp, Homo sapiens
acttgatggctgcgaa

SEQ ID NO: 1571870 - DNA, 16 bp, Homo sapiens
acttgcactcttctac

SEQ ID NO: 1571871 - DNA, 23 bp, Homo sapiens
acttgcactgaagccggacagct

SEQ ID NO: 1571872 - DNA, 21 bp, Homo sapiens
acttgcatgaattactgtata

SEQ ID NO: 1571873 - DNA, 22 bp, Homo sapiens
acttgcatgaattactgtatat

SEQ ID NO: 1571874 - DNA, 15 bp, Homo sapiens
acttgcatggagcag

SEQ ID NO: 1571875 - DNA, 11 bp, Homo sapiens
acttgcatttc

SEQ ID NO: 1571876 - DNA, 22 bp, Homo sapiens
acttgccaagcagtgcacattt

SEQ ID NO: 1571877 - DNA, 23 bp, Homo sapiens
acttgccatgcaggaagaggccc

SEQ ID NO: 1571878 - DNA, 22 bp, Homo sapiens
acttgcctaactaactggcagg

SEQ ID NO: 1571879 - DNA, 20 bp, Homo sapiens
acttgccttcttcacccagc

SEQ ID NO: 1571880 - DNA, 15 bp, Homo sapiens
acttgcctttgaaga

SEQ ID NO: 1571881 - DNA, 16 bp, Homo sapiens
acttgcctttgaagag

SEQ ID NO: 1571882 - DNA, 14 bp, Homo sapiens
acttgcgcagaaaa

SEQ ID NO: 1571883 - DNA, 15 bp, Homo sapiens
acttgcgtcctgcag

SEQ ID NO: 1571884 - DNA, 20 bp, Homo sapiens
acttgctccttttgctcttt

SEQ ID NO: 1571885 - DNA, 13 bp, Homo sapiens
acttgctgctgtc

SEQ ID NO: 1571886 - DNA, 14 bp, Homo sapiens
acttgctgtccagg

SEQ ID NO: 1571887 - DNA, 16 bp, Homo sapiens
acttgctgtccaggca

SEQ ID NO: 1571888 - DNA, 17 bp, Homo sapiens
acttgctgtccaggcag

SEQ ID NO: 1571889 - DNA, 18 bp, Homo sapiens
acttgctgtccaggcagc

SEQ ID NO: 1571890 - DNA, 15 bp, Homo sapiens
acttgctgtgtgacc

SEQ ID NO: 1571891 - DNA, 13 bp, Homo sapiens
acttgcttcagtg

SEQ ID NO: 1571892 - DNA, 22 bp, Homo sapiens
acttgctttatgccttcttatt

SEQ ID NO: 1571893 - DNA, 16 bp, Homo sapiens
acttggagactcctgg

SEQ ID NO: 1571894 - DNA, 21 bp, Homo sapiens
acttggagactcctggtctgt

SEQ ID NO: 1571895 - DNA, 11 bp, Homo sapiens
acttggagcca

SEQ ID NO: 1571896 - DNA, 14 bp, Homo sapiens
acttggagccccag

SEQ ID NO: 1571897 - DNA, 14 bp, Homo sapiens
acttggagcccgtg

SEQ ID NO: 1571898 - DNA, 12 bp, Homo sapiens
acttggagctgt

SEQ ID NO: 1571899 - DNA, 16 bp, Homo sapiens
acttggaggacctggc

SEQ ID NO: 1571900 - DNA, 14 bp, Homo sapiens
acttggatgagttt

SEQ ID NO: 1571901 - DNA, 14 bp, Homo sapiens
acttggcatacaaa

SEQ ID NO: 1571902 - DNA, 19 bp, Homo sapiens
acttggctcgaatctctgt

SEQ ID NO: 1571903 - DNA, 23 bp, Homo sapiens
acttggctcgaatctctgtgcct

SEQ ID NO: 1571904 - DNA, 22 bp, Homo sapiens
acttgggaggctgaggcaggag

SEQ ID NO: 1571905 - DNA, 20 bp, Homo sapiens
acttggggagatggagttct

SEQ ID NO: 1571906 - DNA, 21 bp, Homo sapiens
acttggggagttaagacctgg

SEQ ID NO: 1571907 - DNA, 23 bp, Homo sapiens
acttggttagacgccttccaggt

SEQ ID NO: 1571908 - DNA, 12 bp, Homo sapiens
acttggtttgtg

SEQ ID NO: 1571909 - DNA, 13 bp, Homo sapiens
acttggttttatg

SEQ ID NO: 1571910 - DNA, 17 bp, Homo sapiens
acttggttttatggtta

SEQ ID NO: 1571911 - DNA, 20 bp, Homo sapiens
acttggtttttggctctttc

SEQ ID NO: 1571912 - DNA, 21 bp, Homo sapiens
acttggtttttttttttctta

SEQ ID NO: 1571913 - DNA, 13 bp, Homo sapiens
acttgtaaataca

SEQ ID NO: 1571914 - DNA, 14 bp, Homo sapiens
acttgtaaatgctg

SEQ ID NO: 1571915 - DNA, 14 bp, Homo sapiens
acttgtaagttgct

SEQ ID NO: 1571916 - DNA, 16 bp, Homo sapiens
acttgtaatatgtata

SEQ ID NO: 1571917 - DNA, 23 bp, Homo sapiens
acttgtaattcccctaaccataa

SEQ ID NO: 1571918 - DNA, 17 bp, Homo sapiens
acttgtagggatgcctt

SEQ ID NO: 1571919 - DNA, 15 bp, Homo sapiens
acttgtatacttatt

SEQ ID NO: 1571920 - DNA, 16 bp, Homo sapiens
acttgtatatttgtac

SEQ ID NO: 1571921 - DNA, 17 bp, Homo sapiens
acttgtatatttgtaca

SEQ ID NO: 1571922 - DNA, 18 bp, Homo sapiens
acttgtatatttgtacaa

SEQ ID NO: 1571923 - DNA, 13 bp, Homo sapiens
acttgtattgact

SEQ ID NO: 1571924 - DNA, 16 bp, Homo sapiens
acttgtattgacttta

SEQ ID NO: 1571925 - DNA, 17 bp, Homo sapiens
acttgtattgactttat

SEQ ID NO: 1571926 - DNA, 18 bp, Homo sapiens
acttgtattgactttatg

SEQ ID NO: 1571927 - DNA, 14 bp, Homo sapiens
acttgtatttccaa

SEQ ID NO: 1571928 - DNA, 22 bp, Homo sapiens
acttgtatttccaaacctggtt

SEQ ID NO: 1571929 - DNA, 19 bp, Homo sapiens
acttgtctgggaattgtgt

SEQ ID NO: 1571930 - DNA, 15 bp, Homo sapiens
acttgtctgtcaaat

SEQ ID NO: 1571931 - DNA, 15 bp, Homo sapiens
acttgtctttttctg

SEQ ID NO: 1571932 - DNA, 17 bp, Homo sapiens
acttgtctttttctgga

SEQ ID NO: 1571933 - DNA, 18 bp, Homo sapiens
acttgtgaaacacagctg

SEQ ID NO: 1571934 - DNA, 14 bp, Homo sapiens
acttgtgacttttg

SEQ ID NO: 1571935 - DNA, 13 bp, Homo sapiens
acttgtgattggc

SEQ ID NO: 1571936 - DNA, 14 bp, Homo sapiens
acttgtgattggct

SEQ ID NO: 1571937 - DNA, 15 bp, Homo sapiens
acttgtgattggctg

SEQ ID NO: 1571938 - DNA, 16 bp, Homo sapiens
acttgtgattggctgc

SEQ ID NO: 1571939 - DNA, 21 bp, Homo sapiens
acttgtgctttcagttagcct

SEQ ID NO: 1571940 - DNA, 17 bp, Homo sapiens
acttgtggtgtgaccat

SEQ ID NO: 1571941 - DNA, 23 bp, Homo sapiens
acttgtgtcccatgatccctgtg

SEQ ID NO: 1571942 - DNA, 20 bp, Homo sapiens
acttgtgtgtgggctgtgag

SEQ ID NO: 1571943 - DNA, 16 bp, Homo sapiens
acttgttccagctctt

SEQ ID NO: 1571944 - DNA, 17 bp, Homo sapiens
acttgttccagctcttt

SEQ ID NO: 1571945 - DNA, 12 bp, Homo sapiens
acttgttctaga

SEQ ID NO: 1571946 - DNA, 13 bp, Homo sapiens
acttgttctagag

SEQ ID NO: 1571947 - DNA, 21 bp, Homo sapiens
acttgttgttttactaaagaa

SEQ ID NO: 1571948 - DNA, 21 bp, Homo sapiens
acttgtttagagagcctgtca

SEQ ID NO: 1571949 - DNA, 23 bp, Homo sapiens
acttgtttagagagcctgtcacc

SEQ ID NO: 1571950 - DNA, 20 bp, Homo sapiens
acttgtttttgtaaagaaaa

SEQ ID NO: 1571951 - DNA, 21 bp, Homo sapiens
acttgtttttgtaaagaaaaa

SEQ ID NO: 1571952 - DNA, 16 bp, Homo sapiens
actttaaaaatttact

SEQ ID NO: 1571953 - DNA, 17 bp, Homo sapiens
actttaaactttccctt

SEQ ID NO: 1571954 - DNA, 12 bp, Homo sapiens
actttaaatctt

SEQ ID NO: 1571955 - DNA, 14 bp, Homo sapiens
actttaagctcctt

SEQ ID NO: 1571956 - DNA, 22 bp, Homo sapiens
actttaattaccaacctgttac

SEQ ID NO: 1571957 - DNA, 24 bp, Homo sapiens
actttacaggaaaaaaaattctgt

SEQ ID NO: 1571958 - DNA, 21 bp, Homo sapiens
actttacaggaggttgtggat

SEQ ID NO: 1571959 - DNA, 21 bp, Homo sapiens
actttacttgtggtgtgacca

SEQ ID NO: 1571960 - DNA, 22 bp, Homo sapiens
actttacttgtggtgtgaccat

SEQ ID NO: 1571961 - DNA, 12 bp, Homo sapiens
actttagaaata

SEQ ID NO: 1571962 - DNA, 15 bp, Homo sapiens
actttagaagcctgc

SEQ ID NO: 1571963 - DNA, 16 bp, Homo sapiens
actttagaagcctgca

SEQ ID NO: 1571964 - DNA, 19 bp, Homo sapiens
actttagactaattgtgtt

SEQ ID NO: 1571965 - DNA, 19 bp, Homo sapiens
actttagacttcccactgt

SEQ ID NO: 1571966 - DNA, 13 bp, Homo sapiens
actttagatgctg

SEQ ID NO: 1571967 - DNA, 14 bp, Homo sapiens
actttagatgctga

SEQ ID NO: 1571968 - DNA, 16 bp, Homo sapiens
actttagctagtatct

SEQ ID NO: 1571969 - DNA, 20 bp, Homo sapiens
actttagctagtatcttcaa

SEQ ID NO: 1571970 - DNA, 22 bp, Homo sapiens
actttagctgcatcctccaaga

SEQ ID NO: 1571971 - DNA, 16 bp, Homo sapiens
actttagcttttcctt

SEQ ID NO: 1571972 - DNA, 14 bp, Homo sapiens
actttagttagcat

SEQ ID NO: 1571973 - DNA, 16 bp, Homo sapiens
actttatacacttgga

SEQ ID NO: 1571974 - DNA, 13 bp, Homo sapiens
actttatcacatt

SEQ ID NO: 1571975 - DNA, 16 bp, Homo sapiens
actttatcatgaatgc

SEQ ID NO: 1571976 - DNA, 18 bp, Homo sapiens
actttatcatgaatgctt

SEQ ID NO: 1571977 - DNA, 23 bp, Homo sapiens
actttatctaatacctctgtgtg

SEQ ID NO: 1571978 - DNA, 20 bp, Homo sapiens
actttatgccggatgtgctt

SEQ ID NO: 1571979 - DNA, 23 bp, Homo sapiens
actttatgccggatgtgcttttc

SEQ ID NO: 1571980 - DNA, 22 bp, Homo sapiens
actttatgttgtatgattccaa

SEQ ID NO: 1571981 - DNA, 18 bp, Homo sapiens
actttatgtttgtctttt

SEQ ID NO: 1571982 - DNA, 17 bp, Homo sapiens
actttattaagtaaaat

SEQ ID NO: 1571983 - DNA, 18 bp, Homo sapiens
actttattaagtaaaatc

SEQ ID NO: 1571984 - DNA, 14 bp, Homo sapiens
actttattaatatg

SEQ ID NO: 1571985 - DNA, 14 bp, Homo sapiens
actttattgtacag

SEQ ID NO: 1571986 - DNA, 16 bp, Homo sapiens
actttattgtacagac

SEQ ID NO: 1571987 - DNA, 20 bp, Homo sapiens
actttattgtacagactgtt

SEQ ID NO: 1571988 - DNA, 20 bp, Homo sapiens
actttattttttaaaaatga

SEQ ID NO: 1571989 - DNA, 20 bp, Homo sapiens
actttcacatagatgtccct

SEQ ID NO: 1571990 - DNA, 21 bp, Homo sapiens
actttcacatagatgtccctt

SEQ ID NO: 1571991 - DNA, 16 bp, Homo sapiens
actttcacttcttcct

SEQ ID NO: 1571992 - DNA, 18 bp, Homo sapiens
actttcacttcttcctat

SEQ ID NO: 1571993 - DNA, 16 bp, Homo sapiens
actttcactttgaaaa

SEQ ID NO: 1571994 - DNA, 13 bp, Homo sapiens
actttcagagccc

SEQ ID NO: 1571995 - DNA, 21 bp, Homo sapiens
actttcagagcccccagccct

SEQ ID NO: 1571996 - DNA, 22 bp, Homo sapiens
actttcagagcccccagccctg

SEQ ID NO: 1571997 - DNA, 23 bp, Homo sapiens
actttcagagcccccagccctgg

SEQ ID NO: 1571998 - DNA, 19 bp, Homo sapiens
actttcataccacttgaat

SEQ ID NO: 1571999 - DNA, 13 bp, Homo sapiens
actttcatcttaa

SEQ ID NO: 1572000 - DNA, 14 bp, Homo sapiens
actttcatcttaaa

SEQ ID NO: 1572001 - DNA, 23 bp, Homo sapiens
actttcatttttttccaggctgg

SEQ ID NO: 1572002 - DNA, 17 bp, Homo sapiens
actttccagcagtcagt

SEQ ID NO: 1572003 - DNA, 18 bp, Homo sapiens
actttcccccttcccgcc

SEQ ID NO: 1572004 - DNA, 16 bp, Homo sapiens
actttcccttggctgt

SEQ ID NO: 1572005 - DNA, 17 bp, Homo sapiens
actttcccttggctgtt

SEQ ID NO: 1572006 - DNA, 16 bp, Homo sapiens
actttcctgagctgtc

SEQ ID NO: 1572007 - DNA, 14 bp, Homo sapiens
actttcctgcaact

SEQ ID NO: 1572008 - DNA, 14 bp, Homo sapiens
actttctcagtttt

SEQ ID NO: 1572009 - DNA, 13 bp, Homo sapiens
actttctcttaag

SEQ ID NO: 1572010 - DNA, 12 bp, Homo sapiens
actttctgattg

SEQ ID NO: 1572011 - DNA, 13 bp, Homo sapiens
actttctgcctgg

SEQ ID NO: 1572012 - DNA, 14 bp, Homo sapiens
actttctgcctgga

SEQ ID NO: 1572013 - DNA, 13 bp, Homo sapiens
actttctggcaaa

SEQ ID NO: 1572014 - DNA, 19 bp, Homo sapiens
actttctggtcccttcagt

SEQ ID NO: 1572015 - DNA, 17 bp, Homo sapiens
actttctgtgacgcaga

SEQ ID NO: 1572016 - DNA, 19 bp, Homo sapiens
actttctgttgccacaacc

SEQ ID NO: 1572017 - DNA, 15 bp, Homo sapiens
actttcttttctgga

SEQ ID NO: 1572018 - DNA, 19 bp, Homo sapiens
actttcttttctggaatgt

SEQ ID NO: 1572019 - DNA, 19 bp, Homo sapiens
actttgaaatgtgtttctg

SEQ ID NO: 1572020 - DNA, 19 bp, Homo sapiens
actttgaagggcaagaaat

SEQ ID NO: 1572021 - DNA, 22 bp, Homo sapiens
actttgacctaaattatttact

SEQ ID NO: 1572022 - DNA, 20 bp, Homo sapiens
actttgactttttgcattta

SEQ ID NO: 1572023 - DNA, 21 bp, Homo sapiens
actttgactttttgcatttaa

SEQ ID NO: 1572024 - DNA, 15 bp, Homo sapiens
actttgagaggctga

SEQ ID NO: 1572025 - DNA, 23 bp, Homo sapiens
actttgcagccggcacagggtct

SEQ ID NO: 1572026 - DNA, 14 bp, Homo sapiens
actttgccattttt

SEQ ID NO: 1572027 - DNA, 16 bp, Homo sapiens
actttgccatttttct

SEQ ID NO: 1572028 - DNA, 15 bp, Homo sapiens
actttgctgatttcc

SEQ ID NO: 1572029 - DNA, 20 bp, Homo sapiens
actttgctgatttcccctct

SEQ ID NO: 1572030 - DNA, 20 bp, Homo sapiens
actttgctggtgtagtcttt

SEQ ID NO: 1572031 - DNA, 12 bp, Homo sapiens
actttgcttgag

SEQ ID NO: 1572032 - DNA, 11 bp, Homo sapiens
actttgcttgc

SEQ ID NO: 1572033 - DNA, 19 bp, Homo sapiens
actttgctttctgaattgg

SEQ ID NO: 1572034 - DNA, 16 bp, Homo sapiens
actttggaaccagact

SEQ ID NO: 1572035 - DNA, 21 bp, Homo sapiens
actttggaagtttgtgttctg

SEQ ID NO: 1572036 - DNA, 18 bp, Homo sapiens
actttggaatacatttct

SEQ ID NO: 1572037 - DNA, 15 bp, Homo sapiens
actttggaatttgca

SEQ ID NO: 1572038 - DNA, 17 bp, Homo sapiens
actttggaatttgcacc

SEQ ID NO: 1572039 - DNA, 18 bp, Homo sapiens
actttggagtcccctcac

SEQ ID NO: 1572040 - DNA, 23 bp, Homo sapiens
actttggagtcccctcacctcct

SEQ ID NO: 1572041 - DNA, 16 bp, Homo sapiens
actttgggaggccaag

SEQ ID NO: 1572042 - DNA, 21 bp, Homo sapiens
actttgggaggccgaggcggg

SEQ ID NO: 1572043 - DNA, 14 bp, Homo sapiens
actttgggaggctg

SEQ ID NO: 1572044 - DNA, 17 bp, Homo sapiens
actttggggctaattta

SEQ ID NO: 1572045 - DNA, 22 bp, Homo sapiens
actttggtagctgggaaagcat

SEQ ID NO: 1572046 - DNA, 19 bp, Homo sapiens
actttggttctctccagga

SEQ ID NO: 1572047 - DNA, 21 bp, Homo sapiens
actttggtttatgcggtgctg

SEQ ID NO: 1572048 - DNA, 18 bp, Homo sapiens
actttggtttctgtctgt

SEQ ID NO: 1572049 - DNA, 17 bp, Homo sapiens
actttgtaaaaatcttt

SEQ ID NO: 1572050 - DNA, 17 bp, Homo sapiens
actttgtaatttttgct

SEQ ID NO: 1572051 - DNA, 22 bp, Homo sapiens
actttgtatgtcatttccttca

SEQ ID NO: 1572052 - DNA, 14 bp, Homo sapiens
actttgtattttga

SEQ ID NO: 1572053 - DNA, 15 bp, Homo sapiens
actttgtcagaggca

SEQ ID NO: 1572054 - DNA, 15 bp, Homo sapiens
actttgtctgaaaaa

SEQ ID NO: 1572055 - DNA, 13 bp, Homo sapiens
actttgtcttttc

SEQ ID NO: 1572056 - DNA, 23 bp, Homo sapiens
actttgtggagagaatgtgtgtg

SEQ ID NO: 1572057 - DNA, 18 bp, Homo sapiens
actttgttctgttgtctg

SEQ ID NO: 1572058 - DNA, 17 bp, Homo sapiens
actttgttgcaagatgt

SEQ ID NO: 1572059 - DNA, 22 bp, Homo sapiens
actttgttgcaagatgtgaatt

SEQ ID NO: 1572060 - DNA, 21 bp, Homo sapiens
actttgttggtagccatttgg

SEQ ID NO: 1572061 - DNA, 24 bp, Homo sapiens
actttgttggtagccatttggtag

SEQ ID NO: 1572062 - DNA, 16 bp, Homo sapiens
actttgttttcaagat

SEQ ID NO: 1572063 - DNA, 23 bp, Homo sapiens
acttttaaagttttgtcagaaaa

SEQ ID NO: 1572064 - DNA, 13 bp, Homo sapiens
acttttaaatgtt

SEQ ID NO: 1572065 - DNA, 11 bp, Homo sapiens
acttttaataa

SEQ ID NO: 1572066 - DNA, 22 bp, Homo sapiens
acttttaatatcactaatttct

SEQ ID NO: 1572067 - DNA, 16 bp, Homo sapiens
acttttaccactattt

SEQ ID NO: 1572068 - DNA, 17 bp, Homo sapiens
acttttagaaatgcata

SEQ ID NO: 1572069 - DNA, 17 bp, Homo sapiens
acttttataaagcatgt

SEQ ID NO: 1572070 - DNA, 19 bp, Homo sapiens
acttttatgatgtatattt

SEQ ID NO: 1572071 - DNA, 22 bp, Homo sapiens
acttttattttacacagaaaca

SEQ ID NO: 1572072 - DNA, 15 bp, Homo sapiens
acttttcacactgtc

SEQ ID NO: 1572073 - DNA, 18 bp, Homo sapiens
acttttcatccttcccca

SEQ ID NO: 1572074 - DNA, 14 bp, Homo sapiens
acttttcattctct

SEQ ID NO: 1572075 - DNA, 20 bp, Homo sapiens
acttttccaatatgtgattt

SEQ ID NO: 1572076 - DNA, 22 bp, Homo sapiens
acttttcgttaacattgaccaa

SEQ ID NO: 1572077 - DNA, 18 bp, Homo sapiens
acttttctaagaaaagca

SEQ ID NO: 1572078 - DNA, 11 bp, Homo sapiens
acttttctgta

SEQ ID NO: 1572079 - DNA, 22 bp, Homo sapiens
acttttgaaaagaccaagactt

SEQ ID NO: 1572080 - DNA, 16 bp, Homo sapiens
acttttgagtgtgtgt

SEQ ID NO: 1572081 - DNA, 12 bp, Homo sapiens
acttttgcttta

SEQ ID NO: 1572082 - DNA, 17 bp, Homo sapiens
acttttggattttatgg

SEQ ID NO: 1572083 - DNA, 17 bp, Homo sapiens
acttttgtaagacaaag

SEQ ID NO: 1572084 - DNA, 17 bp, Homo sapiens
acttttgtactgaattt

SEQ ID NO: 1572085 - DNA, 18 bp, Homo sapiens
acttttgtactgaatttt

SEQ ID NO: 1572086 - DNA, 22 bp, Homo sapiens
acttttgtgaattaggctgtaa

SEQ ID NO: 1572087 - DNA, 18 bp, Homo sapiens
acttttgtgtaatgaaaa

SEQ ID NO: 1572088 - DNA, 20 bp, Homo sapiens
acttttgtgtattctgtgga

SEQ ID NO: 1572089 - DNA, 16 bp, Homo sapiens
actttttaagtttgaa

SEQ ID NO: 1572090 - DNA, 11 bp, Homo sapiens
actttttacat

SEQ ID NO: 1572091 - DNA, 12 bp, Homo sapiens
actttttatact

SEQ ID NO: 1572092 - DNA, 21 bp, Homo sapiens
actttttatactccatacata

SEQ ID NO: 1572093 - DNA, 15 bp, Homo sapiens
actttttatgtgcta

SEQ ID NO: 1572094 - DNA, 11 bp, Homo sapiens
actttttctga

SEQ ID NO: 1572095 - DNA, 15 bp, Homo sapiens
acttttttaaatata

SEQ ID NO: 1572096 - DNA, 16 bp, Homo sapiens
acttttttaaatataa

SEQ ID NO: 1572097 - DNA, 19 bp, Homo sapiens
acttttttaaatattttct

SEQ ID NO: 1572098 - DNA, 13 bp, Homo sapiens
acttttttatgaa

SEQ ID NO: 1572099 - DNA, 20 bp, Homo sapiens
acttttttatgaagaaaaag

SEQ ID NO: 1572100 - DNA, 22 bp, Homo sapiens
acttttttatgaagaaaaagta

SEQ ID NO: 1572101 - DNA, 22 bp, Homo sapiens
acttttttattttttaaatctt

SEQ ID NO: 1572102 - DNA, 18 bp, Homo sapiens
acttttttcttaaggcat

SEQ ID NO: 1572103 - DNA, 21 bp, Homo sapiens
acttttttgaaataataaatc

SEQ ID NO: 1572104 - DNA, 14 bp, Homo sapiens
acttttttgtgtat

SEQ ID NO: 1572105 - DNA, 20 bp, Homo sapiens
actttttttctgtaccagtt

SEQ ID NO: 1572106 - DNA, 14 bp, Homo sapiens
actttttttgtatg

SEQ ID NO: 1572107 - DNA, 20 bp, Homo sapiens
actttttttttttctgcctg

SEQ ID NO: 1572108 - DNA, 17 bp, Homo sapiens
actttttttttttttcc

SEQ ID NO: 1572109 - DNA, 12 bp, Homo sapiens
agaaaaaaacaa

SEQ ID NO: 1572110 - DNA, 17 bp, Homo sapiens
agaaaaaaagatttatt

SEQ ID NO: 1572111 - DNA, 21 bp, Homo sapiens
agaaaaaaagtttgccagaag

SEQ ID NO: 1572112 - DNA, 19 bp, Homo sapiens
agaaaaaaattactaattt

SEQ ID NO: 1572113 - DNA, 13 bp, Homo sapiens
agaaaaaagcaat

SEQ ID NO: 1572114 - DNA, 14 bp, Homo sapiens
agaaaaaagcaatt

SEQ ID NO: 1572115 - DNA, 16 bp, Homo sapiens
agaaaaacaatcttat

SEQ ID NO: 1572116 - DNA, 14 bp, Homo sapiens
agaaaaacatgtca

SEQ ID NO: 1572117 - DNA, 20 bp, Homo sapiens
agaaaaagcaataacctcaa

SEQ ID NO: 1572118 - DNA, 16 bp, Homo sapiens
agaaaaagggctgccg

SEQ ID NO: 1572119 - DNA, 14 bp, Homo sapiens
agaaaaagtacaat

SEQ ID NO: 1572120 - DNA, 23 bp, Homo sapiens
agaaaaataagctcgagtgaatt

SEQ ID NO: 1572121 - DNA, 12 bp, Homo sapiens
agaaaaatattt

SEQ ID NO: 1572122 - DNA, 17 bp, Homo sapiens
agaaaaatgcctgtctc

SEQ ID NO: 1572123 - DNA, 20 bp, Homo sapiens
agaaaacaaaaaaacctcta

SEQ ID NO: 1572124 - DNA, 15 bp, Homo sapiens
agaaaacaaagttct

SEQ ID NO: 1572125 - DNA, 21 bp, Homo sapiens
agaaaacaagcaagttctgag

SEQ ID NO: 1572126 - DNA, 22 bp, Homo sapiens
agaaaacaagcaagttctgaga

SEQ ID NO: 1572127 - DNA, 14 bp, Homo sapiens
agaaaacactgtta

SEQ ID NO: 1572128 - DNA, 21 bp, Homo sapiens
agaaaacactgttatcatttt

SEQ ID NO: 1572129 - DNA, 16 bp, Homo sapiens
agaaaacagaaaacaa

SEQ ID NO: 1572130 - DNA, 13 bp, Homo sapiens
agaaaacccctcc

SEQ ID NO: 1572131 - DNA, 16 bp, Homo sapiens
agaaaacccctcccac

SEQ ID NO: 1572132 - DNA, 21 bp, Homo sapiens
agaaaacctaattaaggaagt

SEQ ID NO: 1572133 - DNA, 16 bp, Homo sapiens
agaaaacctccagtag

SEQ ID NO: 1572134 - DNA, 16 bp, Homo sapiens
agaaaactgtgatttc

SEQ ID NO: 1572135 - DNA, 13 bp, Homo sapiens
agaaaagaaaaat

SEQ ID NO: 1572136 - DNA, 13 bp, Homo sapiens
agaaaagaccctg

SEQ ID NO: 1572137 - DNA, 14 bp, Homo sapiens
agaaaagaccctga

SEQ ID NO: 1572138 - DNA, 23 bp, Homo sapiens
agaaaagcagtcccattcatatt

SEQ ID NO: 1572139 - DNA, 17 bp, Homo sapiens
agaaaagcattttcagt

SEQ ID NO: 1572140 - DNA, 13 bp, Homo sapiens
agaaaagcccatt

SEQ ID NO: 1572141 - DNA, 12 bp, Homo sapiens
agaaaagtgaat

SEQ ID NO: 1572142 - DNA, 15 bp, Homo sapiens
agaaaagtgaattga

SEQ ID NO: 1572143 - DNA, 18 bp, Homo sapiens
agaaaagttcaatactct

SEQ ID NO: 1572144 - DNA, 21 bp, Homo sapiens
agaaaataaaactaagctctt

SEQ ID NO: 1572145 - DNA, 23 bp, Homo sapiens
agaaaataaaatattcactctcc

SEQ ID NO: 1572146 - DNA, 14 bp, Homo sapiens
agaaaatatgtatt

SEQ ID NO: 1572147 - DNA, 20 bp, Homo sapiens
agaaaatatttaatatcaaa

SEQ ID NO: 1572148 - DNA, 16 bp, Homo sapiens
agaaaatcatgttgaa

SEQ ID NO: 1572149 - DNA, 13 bp, Homo sapiens
agaaaatgaaatc

SEQ ID NO: 1572150 - DNA, 18 bp, Homo sapiens
agaaaatgcaaaatgaaa

SEQ ID NO: 1572151 - DNA, 22 bp, Homo sapiens
agaaaatggctaataaactgta

SEQ ID NO: 1572152 - DNA, 18 bp, Homo sapiens
agaaaatgtaaaggaggg

SEQ ID NO: 1572153 - DNA, 19 bp, Homo sapiens
agaaaatgtaaataaagga

SEQ ID NO: 1572154 - DNA, 20 bp, Homo sapiens
agaaaatgtaaggcaatgct

SEQ ID NO: 1572155 - DNA, 23 bp, Homo sapiens
agaaaattgaggtttggaagagt

SEQ ID NO: 1572156 - DNA, 22 bp, Homo sapiens
agaaaattgagttgcacttatt

SEQ ID NO: 1572157 - DNA, 14 bp, Homo sapiens
agaaaattgctgtg

SEQ ID NO: 1572158 - DNA, 23 bp, Homo sapiens
agaaaattgtctgggttccaaaa

SEQ ID NO: 1572159 - DNA, 17 bp, Homo sapiens
agaaaattttgtaaaac

SEQ ID NO: 1572160 - DNA, 22 bp, Homo sapiens
agaaaattttgtaaaacaatgc

SEQ ID NO: 1572161 - DNA, 16 bp, Homo sapiens
agaaacaaaaagcccc

SEQ ID NO: 1572162 - DNA, 15 bp, Homo sapiens
agaaacacagttttg

SEQ ID NO: 1572163 - DNA, 16 bp, Homo sapiens
agaaacacagttttga

SEQ ID NO: 1572164 - DNA, 20 bp, Homo sapiens
agaaacacccctctgtctag

SEQ ID NO: 1572165 - DNA, 20 bp, Homo sapiens
agaaacactaagctctctgg

SEQ ID NO: 1572166 - DNA, 11 bp, Homo sapiens
agaaacactga

SEQ ID NO: 1572167 - DNA, 19 bp, Homo sapiens
agaaacactgaaaagaagg

SEQ ID NO: 1572168 - DNA, 11 bp, Homo sapiens
agaaacactgc

SEQ ID NO: 1572169 - DNA, 12 bp, Homo sapiens
agaaacactgcc

SEQ ID NO: 1572170 - DNA, 14 bp, Homo sapiens
agaaacagagacag

SEQ ID NO: 1572171 - DNA, 19 bp, Homo sapiens
agaaacagagacaggccca

SEQ ID NO: 1572172 - DNA, 21 bp, Homo sapiens
agaaacagagtggcctccctg

SEQ ID NO: 1572173 - DNA, 23 bp, Homo sapiens
agaaacagagtggcctccctgct

SEQ ID NO: 1572174 - DNA, 15 bp, Homo sapiens
agaaacagccagcaa

SEQ ID NO: 1572175 - DNA, 14 bp, Homo sapiens
agaaacagctcagc

SEQ ID NO: 1572176 - DNA, 19 bp, Homo sapiens
agaaacagctttcaagtgc

SEQ ID NO: 1572177 - DNA, 13 bp, Homo sapiens
agaaacagttaac

SEQ ID NO: 1572178 - DNA, 20 bp, Homo sapiens
agaaacagttaactttcaga

SEQ ID NO: 1572179 - DNA, 19 bp, Homo sapiens
agaaacagtttcttgcttg

SEQ ID NO: 1572180 - DNA, 21 bp, Homo sapiens
agaaacatcagttactctgaa

SEQ ID NO: 1572181 - DNA, 20 bp, Homo sapiens
agaaacatctctggcccaga

SEQ ID NO: 1572182 - DNA, 18 bp, Homo sapiens
agaaacatgacactgacc

SEQ ID NO: 1572183 - DNA, 15 bp, Homo sapiens
agaaaccagaaaagc

SEQ ID NO: 1572184 - DNA, 17 bp, Homo sapiens
agaaacccaccagccta

SEQ ID NO: 1572185 - DNA, 22 bp, Homo sapiens
agaaacccaccagcctaagaag

SEQ ID NO: 1572186 - DNA, 21 bp, Homo sapiens
agaaaccctcattgtgtttct

SEQ ID NO: 1572187 - DNA, 13 bp, Homo sapiens
agaaaccctgtct

SEQ ID NO: 1572188 - DNA, 22 bp, Homo sapiens
agaaacctgactcaattatttg

SEQ ID NO: 1572189 - DNA, 18 bp, Homo sapiens
agaaaccttattgtacct

SEQ ID NO: 1572190 - DNA, 14 bp, Homo sapiens
agaaaccttgctct

SEQ ID NO: 1572191 - DNA, 23 bp, Homo sapiens
agaaaccttttatttttatttct

SEQ ID NO: 1572192 - DNA, 20 bp, Homo sapiens
agaaacgaagccatctttct

SEQ ID NO: 1572193 - DNA, 15 bp, Homo sapiens
agaaacgcatccagc

SEQ ID NO: 1572194 - DNA, 16 bp, Homo sapiens
agaaacgtaaactatg

SEQ ID NO: 1572195 - DNA, 16 bp, Homo sapiens
agaaactgaggaattt

SEQ ID NO: 1572196 - DNA, 18 bp, Homo sapiens
agaaactgaggaattttc

SEQ ID NO: 1572197 - DNA, 23 bp, Homo sapiens
agaaactgctgcagattagttct

SEQ ID NO: 1572198 - DNA, 17 bp, Homo sapiens
agaaactggaaatacta

SEQ ID NO: 1572199 - DNA, 20 bp, Homo sapiens
agaaactgtagtctcaggac

SEQ ID NO: 1572200 - DNA, 17 bp, Homo sapiens
agaaacttaaatgttat

SEQ ID NO: 1572201 - DNA, 23 bp, Homo sapiens
agaaacttaaggttacctttgtt

SEQ ID NO: 1572202 - DNA, 12 bp, Homo sapiens
agaaacttagag

SEQ ID NO: 1572203 - DNA, 21 bp, Homo sapiens
agaaacttatttctcatatca

SEQ ID NO: 1572204 - DNA, 18 bp, Homo sapiens
agaaactttctggtgctg

SEQ ID NO: 1572205 - DNA, 16 bp, Homo sapiens
agaaacttttttattt

SEQ ID NO: 1572206 - DNA, 23 bp, Homo sapiens
agaaagaaaaatgcattattgac

SEQ ID NO: 1572207 - DNA, 23 bp, Homo sapiens
agaaagaaaccaagtgcgctttg

SEQ ID NO: 1572208 - DNA, 17 bp, Homo sapiens
agaaagaaatggctttt

SEQ ID NO: 1572209 - DNA, 24 bp, Homo sapiens
agaaagaactttaaagctcaggag

SEQ ID NO: 1572210 - DNA, 22 bp, Homo sapiens
agaaagaatttagtattatcaa

SEQ ID NO: 1572211 - DNA, 20 bp, Homo sapiens
agaaagactatctaaatgtt

SEQ ID NO: 1572212 - DNA, 18 bp, Homo sapiens
agaaagactattcaaaca

SEQ ID NO: 1572213 - DNA, 12 bp, Homo sapiens
agaaagactgag

SEQ ID NO: 1572214 - DNA, 16 bp, Homo sapiens
agaaagagagaagcca

SEQ ID NO: 1572215 - DNA, 18 bp, Homo sapiens
agaaagagagaagccagc

SEQ ID NO: 1572216 - DNA, 17 bp, Homo sapiens
agaaagagctgcctgga

SEQ ID NO: 1572217 - DNA, 18 bp, Homo sapiens
agaaagagctgcctggat

SEQ ID NO: 1572218 - DNA, 22 bp, Homo sapiens
agaaagaggcaccaggaagccg

SEQ ID NO: 1572219 - DNA, 18 bp, Homo sapiens
agaaagatacagacattc

SEQ ID NO: 1572220 - DNA, 19 bp, Homo sapiens
agaaagatggatgtgcttt

SEQ ID NO: 1572221 - DNA, 20 bp, Homo sapiens
agaaagattacttagaggaa

SEQ ID NO: 1572222 - DNA, 19 bp, Homo sapiens
agaaagcatccctcaccca

SEQ ID NO: 1572223 - DNA, 20 bp, Homo sapiens
agaaagcctccgctgggctt

SEQ ID NO: 1572224 - DNA, 20 bp, Homo sapiens
agaaagcctttcattttgct

SEQ ID NO: 1572225 - DNA, 22 bp, Homo sapiens
agaaagcctttcattttgcttt

SEQ ID NO: 1572226 - DNA, 19 bp, Homo sapiens
agaaagctggactgaccaa

SEQ ID NO: 1572227 - DNA, 20 bp, Homo sapiens
agaaagctggactgaccaaa

SEQ ID NO: 1572228 - DNA, 23 bp, Homo sapiens
agaaagcttcttcagagtgaaga

SEQ ID NO: 1572229 - DNA, 18 bp, Homo sapiens
agaaaggaagcattgtaa

SEQ ID NO: 1572230 - DNA, 22 bp, Homo sapiens
agaaaggaagcattgtaaaata

SEQ ID NO: 1572231 - DNA, 18 bp, Homo sapiens
agaaaggacagagccagc

SEQ ID NO: 1572232 - DNA, 18 bp, Homo sapiens
agaaaggatatttaagaa

SEQ ID NO: 1572233 - DNA, 19 bp, Homo sapiens
agaaaggatatttaagaaa

SEQ ID NO: 1572234 - DNA, 21 bp, Homo sapiens
agaaaggcagccctcacctct

SEQ ID NO: 1572235 - DNA, 15 bp, Homo sapiens
agaaaggctgttaaa

SEQ ID NO: 1572236 - DNA, 21 bp, Homo sapiens
agaaaggctgttaaatacagg

SEQ ID NO: 1572237 - DNA, 16 bp, Homo sapiens
agaaagggattgctga

SEQ ID NO: 1572238 - DNA, 18 bp, Homo sapiens
agaaaggggcattttgta

SEQ ID NO: 1572239 - DNA, 23 bp, Homo sapiens
agaaaggtgagtttgagctgcct

SEQ ID NO: 1572240 - DNA, 14 bp, Homo sapiens
agaaagtgacattt

SEQ ID NO: 1572241 - DNA, 15 bp, Homo sapiens
agaaagtgcctgaca

SEQ ID NO: 1572242 - DNA, 22 bp, Homo sapiens
agaaagtgcctgacacactaac

SEQ ID NO: 1572243 - DNA, 13 bp, Homo sapiens
agaaagtgtattt

SEQ ID NO: 1572244 - DNA, 16 bp, Homo sapiens
agaaagtgtatttgga

SEQ ID NO: 1572245 - DNA, 16 bp, Homo sapiens
agaaagtgtgagcaaa

SEQ ID NO: 1572246 - DNA, 17 bp, Homo sapiens
agaaagtgtgagcaaac

SEQ ID NO: 1572247 - DNA, 23 bp, Homo sapiens
agaaagtgtgagcaaactaactt

SEQ ID NO: 1572248 - DNA, 21 bp, Homo sapiens
agaaagtgtgggtttggttag

SEQ ID NO: 1572249 - DNA, 11 bp, Homo sapiens
agaaagttatt

SEQ ID NO: 1572250 - DNA, 16 bp, Homo sapiens
agaaagttggaaagga

SEQ ID NO: 1572251 - DNA, 19 bp, Homo sapiens
agaaataaagttggtgaca

SEQ ID NO: 1572252 - DNA, 21 bp, Homo sapiens
agaaataaatccacccatgtt

SEQ ID NO: 1572253 - DNA, 20 bp, Homo sapiens
agaaataatgctacaatttt

SEQ ID NO: 1572254 - DNA, 15 bp, Homo sapiens
agaaataatggtctt

SEQ ID NO: 1572255 - DNA, 12 bp, Homo sapiens
agaaatacaaaa

SEQ ID NO: 1572256 - DNA, 20 bp, Homo sapiens
agaaatacagataaatgatt

SEQ ID NO: 1572257 - DNA, 18 bp, Homo sapiens
agaaatacataaaaaagt

SEQ ID NO: 1572258 - DNA, 14 bp, Homo sapiens
agaaatactcatgt

SEQ ID NO: 1572259 - DNA, 19 bp, Homo sapiens
agaaatactgctctgaata

SEQ ID NO: 1572260 - DNA, 23 bp, Homo sapiens
agaaatactgctctgaatatttt

SEQ ID NO: 1572261 - DNA, 16 bp, Homo sapiens
agaaatacttgtgatt

SEQ ID NO: 1572262 - DNA, 23 bp, Homo sapiens
agaaatagctgaaaagggcactc

SEQ ID NO: 1572263 - DNA, 15 bp, Homo sapiens
agaaatagttctgtg

SEQ ID NO: 1572264 - DNA, 19 bp, Homo sapiens
agaaatataacacattttt

SEQ ID NO: 1572265 - DNA, 14 bp, Homo sapiens
agaaatataattga

SEQ ID NO: 1572266 - DNA, 18 bp, Homo sapiens
agaaatatagtgcaatag

SEQ ID NO: 1572267 - DNA, 19 bp, Homo sapiens
agaaatatctgaaaatgta

SEQ ID NO: 1572268 - DNA, 15 bp, Homo sapiens
agaaatatgatttta

SEQ ID NO: 1572269 - DNA, 15 bp, Homo sapiens
agaaatattttaaaa

SEQ ID NO: 1572270 - DNA, 21 bp, Homo sapiens
agaaatattttaaaatcagct

SEQ ID NO: 1572271 - DNA, 15 bp, Homo sapiens
agaaatcaatagttg

SEQ ID NO: 1572272 - DNA, 15 bp, Homo sapiens
agaaatcgagagtgt

SEQ ID NO: 1572273 - DNA, 15 bp, Homo sapiens
agaaatctaagctgt

SEQ ID NO: 1572274 - DNA, 18 bp, Homo sapiens
agaaatctcctaacaaaa

SEQ ID NO: 1572275 - DNA, 14 bp, Homo sapiens
agaaatctggccca

SEQ ID NO: 1572276 - DNA, 17 bp, Homo sapiens
agaaatctggcccaggg

SEQ ID NO: 1572277 - DNA, 16 bp, Homo sapiens
agaaatgcaaaaatct

SEQ ID NO: 1572278 - DNA, 19 bp, Homo sapiens
agaaatgcaataactctgg

SEQ ID NO: 1572279 - DNA, 12 bp, Homo sapiens
agaaatgcagaa

SEQ ID NO: 1572280 - DNA, 21 bp, Homo sapiens
agaaatgctaatgtaatcatt

SEQ ID NO: 1572281 - DNA, 23 bp, Homo sapiens
agaaatgctgcctgcctgtctgt

SEQ ID NO: 1572282 - DNA, 18 bp, Homo sapiens
agaaatggcgtctgctct

SEQ ID NO: 1572283 - DNA, 20 bp, Homo sapiens
agaaatggcgtctgctctgg

SEQ ID NO: 1572284 - DNA, 22 bp, Homo sapiens
agaaatggcgtctgctctggtg

SEQ ID NO: 1572285 - DNA, 19 bp, Homo sapiens
agaaatggtttcctctgga

SEQ ID NO: 1572286 - DNA, 19 bp, Homo sapiens
agaaattaacaataaagaa

SEQ ID NO: 1572287 - DNA, 19 bp, Homo sapiens
agaaattacctgtggatat

SEQ ID NO: 1572288 - DNA, 20 bp, Homo sapiens
agaaattacctgtggatatt

SEQ ID NO: 1572289 - DNA, 16 bp, Homo sapiens
agaaattagatttgtg

SEQ ID NO: 1572290 - DNA, 18 bp, Homo sapiens
agaaattagatttgtgca

SEQ ID NO: 1572291 - DNA, 15 bp, Homo sapiens
agaaattagccgggc

SEQ ID NO: 1572292 - DNA, 23 bp, Homo sapiens
agaaattccatacttctctcaga

SEQ ID NO: 1572293 - DNA, 19 bp, Homo sapiens
agaaattcgaaaacataaa

SEQ ID NO: 1572294 - DNA, 21 bp, Homo sapiens
agaaattctgcaagtttctgt

SEQ ID NO: 1572295 - DNA, 23 bp, Homo sapiens
agaaattctgtcatagaaagtgc

SEQ ID NO: 1572296 - DNA, 21 bp, Homo sapiens
agaaattctgtttttaaaaat

SEQ ID NO: 1572297 - DNA, 19 bp, Homo sapiens
agaaattggaacagaatgt

SEQ ID NO: 1572298 - DNA, 14 bp, Homo sapiens
agaaattggctgga

SEQ ID NO: 1572299 - DNA, 14 bp, Homo sapiens
agaaattgtatatt

SEQ ID NO: 1572300 - DNA, 17 bp, Homo sapiens
agaaattgtatattgta

SEQ ID NO: 1572301 - DNA, 14 bp, Homo sapiens
agaaattttgtaag

SEQ ID NO: 1572302 - DNA, 16 bp, Homo sapiens
agaaattttgtaagaa

SEQ ID NO: 1572303 - DNA, 17 bp, Homo sapiens
agaaatttttcagatgc

SEQ ID NO: 1572304 - DNA, 22 bp, Homo sapiens
agaaatttttcagatgcttctg

SEQ ID NO: 1572305 - DNA, 22 bp, Homo sapiens
agaacaaaggacagagtatgaa

SEQ ID NO: 1572306 - DNA, 15 bp, Homo sapiens
agaacaaatgtgttt

SEQ ID NO: 1572307 - DNA, 20 bp, Homo sapiens
agaacaaatgtgtttttcta

SEQ ID NO: 1572308 - DNA, 18 bp, Homo sapiens
agaacaacatatacaaca

SEQ ID NO: 1572309 - DNA, 14 bp, Homo sapiens
agaacaagaaatgg

SEQ ID NO: 1572310 - DNA, 18 bp, Homo sapiens
agaacaagtcacagctgc

SEQ ID NO: 1572311 - DNA, 22 bp, Homo sapiens
agaacaagtcacagctgcagct

SEQ ID NO: 1572312 - DNA, 19 bp, Homo sapiens
agaacaagttgttaaaaca

SEQ ID NO: 1572313 - DNA, 15 bp, Homo sapiens
agaacaataatgaga

SEQ ID NO: 1572314 - DNA, 22 bp, Homo sapiens
agaacaataatgagagcaaatg

SEQ ID NO: 1572315 - DNA, 19 bp, Homo sapiens
agaacaataggtaaagcta

SEQ ID NO: 1572316 - DNA, 17 bp, Homo sapiens
agaacaatgggaggctg

SEQ ID NO: 1572317 - DNA, 15 bp, Homo sapiens
agaacacaaagcggg

SEQ ID NO: 1572318 - DNA, 22 bp, Homo sapiens
agaacacaaagcggggggaggg

SEQ ID NO: 1572319 - DNA, 23 bp, Homo sapiens
agaacacaagggatataaaatga

SEQ ID NO: 1572320 - DNA, 20 bp, Homo sapiens
agaacacagcatgtgccaag

SEQ ID NO: 1572321 - DNA, 21 bp, Homo sapiens
agaacaccccgctctggcagt

SEQ ID NO: 1572322 - DNA, 16 bp, Homo sapiens
agaacacgttgccagg

SEQ ID NO: 1572323 - DNA, 20 bp, Homo sapiens
agaacacgttgccaggggct

SEQ ID NO: 1572324 - DNA, 15 bp, Homo sapiens
agaacactaattcat

SEQ ID NO: 1572325 - DNA, 13 bp, Homo sapiens
agaacactgccaa

SEQ ID NO: 1572326 - DNA, 14 bp, Homo sapiens
agaacagaaaacaa

SEQ ID NO: 1572327 - DNA, 16 bp, Homo sapiens
agaacagataaagatt

SEQ ID NO: 1572328 - DNA, 15 bp, Homo sapiens
agaacagatggggtc

SEQ ID NO: 1572329 - DNA, 18 bp, Homo sapiens
agaacagcagaggttctt

SEQ ID NO: 1572330 - DNA, 20 bp, Homo sapiens
agaacagccgctcctgtctg

SEQ ID NO: 1572331 - DNA, 19 bp, Homo sapiens
agaacagggaaaataggca

SEQ ID NO: 1572332 - DNA, 20 bp, Homo sapiens
agaacagggaaaataggcag

SEQ ID NO: 1572333 - DNA, 19 bp, Homo sapiens
agaacagtggttgcctggg

SEQ ID NO: 1572334 - DNA, 16 bp, Homo sapiens
agaacataaagcaaat

SEQ ID NO: 1572335 - DNA, 17 bp, Homo sapiens
agaacataaagcaaata

SEQ ID NO: 1572336 - DNA, 14 bp, Homo sapiens
agaacatactgatt

SEQ ID NO: 1572337 - DNA, 11 bp, Homo sapiens
agaacatagaa

SEQ ID NO: 1572338 - DNA, 20 bp, Homo sapiens
agaacatagtttaagttgat

SEQ ID NO: 1572339 - DNA, 14 bp, Homo sapiens
agaacatcattaga

SEQ ID NO: 1572340 - DNA, 12 bp, Homo sapiens
agaacatgttaa

SEQ ID NO: 1572341 - DNA, 15 bp, Homo sapiens
agaacattcagctct

SEQ ID NO: 1572342 - DNA, 21 bp, Homo sapiens
agaacattcagctctggagaa

SEQ ID NO: 1572343 - DNA, 17 bp, Homo sapiens
agaacattccatttgaa

SEQ ID NO: 1572344 - DNA, 17 bp, Homo sapiens
agaaccaaagctcaaat

SEQ ID NO: 1572345 - DNA, 16 bp, Homo sapiens
agaaccaccactgcct

SEQ ID NO: 1572346 - DNA, 17 bp, Homo sapiens
agaaccaccactgcctg

SEQ ID NO: 1572347 - DNA, 22 bp, Homo sapiens
agaaccaccccggccccctgcc

SEQ ID NO: 1572348 - DNA, 13 bp, Homo sapiens
agaaccactatga

SEQ ID NO: 1572349 - DNA, 17 bp, Homo sapiens
agaaccagccgtatttt

SEQ ID NO: 1572350 - DNA, 18 bp, Homo sapiens
agaaccagccgtatttta

SEQ ID NO: 1572351 - DNA, 22 bp, Homo sapiens
agaaccatccctattttgtatt

SEQ ID NO: 1572352 - DNA, 13 bp, Homo sapiens
agaaccatctttg

SEQ ID NO: 1572353 - DNA, 14 bp, Homo sapiens
agaacccaagtgcc

SEQ ID NO: 1572354 - DNA, 16 bp, Homo sapiens
agaacccaagtgcctc

SEQ ID NO: 1572355 - DNA, 23 bp, Homo sapiens
agaacccacataaaagccccagc

SEQ ID NO: 1572356 - DNA, 17 bp, Homo sapiens
agaacccctacatgaaa

SEQ ID NO: 1572357 - DNA, 19 bp, Homo sapiens
agaacccctacatgaaaca

SEQ ID NO: 1572358 - DNA, 19 bp, Homo sapiens
agaaccctgagcagggtcc

SEQ ID NO: 1572359 - DNA, 22 bp, Homo sapiens
agaacctacagactccatctct

SEQ ID NO: 1572360 - DNA, 23 bp, Homo sapiens
agaacctacagactccatctctt

SEQ ID NO: 1572361 - DNA, 12 bp, Homo sapiens
agaacctcaggc

SEQ ID NO: 1572362 - DNA, 19 bp, Homo sapiens
agaacctcaggcttccttg

SEQ ID NO: 1572363 - DNA, 21 bp, Homo sapiens
agaacctcaggtacggagaag

SEQ ID NO: 1572364 - DNA, 22 bp, Homo sapiens
agaacctcaggtacggagaaga

SEQ ID NO: 1572365 - DNA, 15 bp, Homo sapiens
agaacctcttcccca

SEQ ID NO: 1572366 - DNA, 20 bp, Homo sapiens
agaacctggaacttggggag

SEQ ID NO: 1572367 - DNA, 12 bp, Homo sapiens
agaacctgtcct

SEQ ID NO: 1572368 - DNA, 13 bp, Homo sapiens
agaacctgtcctt

SEQ ID NO: 1572369 - DNA, 19 bp, Homo sapiens
agaaccttgcctgaacatc

SEQ ID NO: 1572370 - DNA, 22 bp, Homo sapiens
agaaccttgcctgaacatcctt

SEQ ID NO: 1572371 - DNA, 18 bp, Homo sapiens
agaacggaggaggctgca

SEQ ID NO: 1572372 - DNA, 17 bp, Homo sapiens
agaacggggctcttctc

SEQ ID NO: 1572373 - DNA, 19 bp, Homo sapiens
agaacggggctcttctcat

SEQ ID NO: 1572374 - DNA, 15 bp, Homo sapiens
agaacgttaaactat

SEQ ID NO: 1572375 - DNA, 20 bp, Homo sapiens
agaacgttttttcctcagtg

SEQ ID NO: 1572376 - DNA, 16 bp, Homo sapiens
agaactaagaggccca

SEQ ID NO: 1572377 - DNA, 15 bp, Homo sapiens
agaactcactctggg

SEQ ID NO: 1572378 - DNA, 19 bp, Homo sapiens
agaactcactctgggctgt

SEQ ID NO: 1572379 - DNA, 17 bp, Homo sapiens
agaactccaggccctcc

SEQ ID NO: 1572380 - DNA, 23 bp, Homo sapiens
agaactctccatcttattttcat

SEQ ID NO: 1572381 - DNA, 20 bp, Homo sapiens
agaactctgggctgctaccc

SEQ ID NO: 1572382 - DNA, 15 bp, Homo sapiens
agaactgcaggccct

SEQ ID NO: 1572383 - DNA, 18 bp, Homo sapiens
agaactgcaggccctggc

SEQ ID NO: 1572384 - DNA, 19 bp, Homo sapiens
agaactgcatatgtttcgc

SEQ ID NO: 1572385 - DNA, 16 bp, Homo sapiens
agaactgcatggacct

SEQ ID NO: 1572386 - DNA, 23 bp, Homo sapiens
agaactgcatggacctaacattc

SEQ ID NO: 1572387 - DNA, 13 bp, Homo sapiens
agaactgccattg

SEQ ID NO: 1572388 - DNA, 22 bp, Homo sapiens
agaactggggttcaagcccagg

SEQ ID NO: 1572389 - DNA, 23 bp, Homo sapiens
agaactggggttcaagcccaggc

SEQ ID NO: 1572390 - DNA, 16 bp, Homo sapiens
agaactgtacattgtg

SEQ ID NO: 1572391 - DNA, 17 bp, Homo sapiens
agaactgtcccacaaaa

SEQ ID NO: 1572392 - DNA, 14 bp, Homo sapiens
agaactgtgataaa

SEQ ID NO: 1572393 - DNA, 13 bp, Homo sapiens
agaactgtgccac

SEQ ID NO: 1572394 - DNA, 17 bp, Homo sapiens
agaactgttcatttcca

SEQ ID NO: 1572395 - DNA, 18 bp, Homo sapiens
agaacttgaatgtgtcag

SEQ ID NO: 1572396 - DNA, 16 bp, Homo sapiens
agaacttgaatttctg

SEQ ID NO: 1572397 - DNA, 14 bp, Homo sapiens
agaacttgctgctg

SEQ ID NO: 1572398 - DNA, 17 bp, Homo sapiens
agaacttgctgctgcct

SEQ ID NO: 1572399 - DNA, 16 bp, Homo sapiens
agaacttgctgctgtc

SEQ ID NO: 1572400 - DNA, 22 bp, Homo sapiens
agaactttaaagctcaggaggg

SEQ ID NO: 1572401 - DNA, 16 bp, Homo sapiens
agaactttcatttttt

SEQ ID NO: 1572402 - DNA, 18 bp, Homo sapiens
agaactttcatttttttc

SEQ ID NO: 1572403 - DNA, 18 bp, Homo sapiens
agaagaaaaatggaaaaa

SEQ ID NO: 1572404 - DNA, 12 bp, Homo sapiens
agaagaaaacaa

SEQ ID NO: 1572405 - DNA, 11 bp, Homo sapiens
agaagaaaagc

SEQ ID NO: 1572406 - DNA, 16 bp, Homo sapiens
agaagaaaattgctgt

SEQ ID NO: 1572407 - DNA, 15 bp, Homo sapiens
agaagaaactttgcc

SEQ ID NO: 1572408 - DNA, 21 bp, Homo sapiens
agaagaaactttgcctcaaga

SEQ ID NO: 1572409 - DNA, 23 bp, Homo sapiens
agaagaaactttgcctcaagact

SEQ ID NO: 1572410 - DNA, 22 bp, Homo sapiens
agaagaaagcaaaagcaaggga

SEQ ID NO: 1572411 - DNA, 23 bp, Homo sapiens
agaagaaagcaaaagcaagggac

SEQ ID NO: 1572412 - DNA, 20 bp, Homo sapiens
agaagaaaggccaaggtgct

SEQ ID NO: 1572413 - DNA, 16 bp, Homo sapiens
agaagaaagtctatgc

SEQ ID NO: 1572414 - DNA, 14 bp, Homo sapiens
agaagaaatgaata

SEQ ID NO: 1572415 - DNA, 18 bp, Homo sapiens
agaagaaattctgtcata

SEQ ID NO: 1572416 - DNA, 16 bp, Homo sapiens
agaagaacaagaaatg

SEQ ID NO: 1572417 - DNA, 19 bp, Homo sapiens
agaagaaccaaatacctca

SEQ ID NO: 1572418 - DNA, 16 bp, Homo sapiens
agaagaagagaagctg

SEQ ID NO: 1572419 - DNA, 11 bp, Homo sapiens
agaagaagagg

SEQ ID NO: 1572420 - DNA, 15 bp, Homo sapiens
agaagaagaggaaga

SEQ ID NO: 1572421 - DNA, 19 bp, Homo sapiens
agaagaaggagagcaagaa

SEQ ID NO: 1572422 - DNA, 14 bp, Homo sapiens
agaagaatattcag

SEQ ID NO: 1572423 - DNA, 15 bp, Homo sapiens
agaagaatattcagg

SEQ ID NO: 1572424 - DNA, 23 bp, Homo sapiens
agaagaatggctttcaataccct

SEQ ID NO: 1572425 - DNA, 20 bp, Homo sapiens
agaagacaaagtctaaggaa

SEQ ID NO: 1572426 - DNA, 14 bp, Homo sapiens
agaagacaacagaa

SEQ ID NO: 1572427 - DNA, 22 bp, Homo sapiens
agaagacatggagactcctgcc

SEQ ID NO: 1572428 - DNA, 10 bp, Homo sapiens
agaagacatt

SEQ ID NO: 1572429 - DNA, 12 bp, Homo sapiens
agaagacatttt

SEQ ID NO: 1572430 - DNA, 22 bp, Homo sapiens
agaagaccaaagcattgcctgc

SEQ ID NO: 1572431 - DNA, 12 bp, Homo sapiens
agaagagaaaat

SEQ ID NO: 1572432 - DNA, 13 bp, Homo sapiens
agaagagaagctg

SEQ ID NO: 1572433 - DNA, 20 bp, Homo sapiens
agaagagatgggcttgtttt

SEQ ID NO: 1572434 - DNA, 22 bp, Homo sapiens
agaagagatgggcttgttttct

SEQ ID NO: 1572435 - DNA, 22 bp, Homo sapiens
agaagagatgtggcaaagtgct

SEQ ID NO: 1572436 - DNA, 11 bp, Homo sapiens
agaagagccat

SEQ ID NO: 1572437 - DNA, 14 bp, Homo sapiens
agaagagccatctt

SEQ ID NO: 1572438 - DNA, 20 bp, Homo sapiens
agaagagctgttcacagcca

SEQ ID NO: 1572439 - DNA, 13 bp, Homo sapiens
agaagaggaagaa

SEQ ID NO: 1572440 - DNA, 15 bp, Homo sapiens
agaagaggagcctca

SEQ ID NO: 1572441 - DNA, 16 bp, Homo sapiens
agaagaggagcctcag

SEQ ID NO: 1572442 - DNA, 19 bp, Homo sapiens
agaagagggcccagcccag

SEQ ID NO: 1572443 - DNA, 13 bp, Homo sapiens
agaagagtggcag

SEQ ID NO: 1572444 - DNA, 14 bp, Homo sapiens
agaagatgaataca

SEQ ID NO: 1572445 - DNA, 16 bp, Homo sapiens
agaagatgaatggtct

SEQ ID NO: 1572446 - DNA, 20 bp, Homo sapiens
agaagatgccagcttctctc

SEQ ID NO: 1572447 - DNA, 23 bp, Homo sapiens
agaagatgctccagcaacacagc

SEQ ID NO: 1572448 - DNA, 14 bp, Homo sapiens
agaagatgtgaaat

SEQ ID NO: 1572449 - DNA, 14 bp, Homo sapiens
agaagatgtgtaaa

SEQ ID NO: 1572450 - DNA, 18 bp, Homo sapiens
agaagatgtgtaaacagg

SEQ ID NO: 1572451 - DNA, 16 bp, Homo sapiens
agaagattagaaacta

SEQ ID NO: 1572452 - DNA, 17 bp, Homo sapiens
agaagattttataagaa

SEQ ID NO: 1572453 - DNA, 15 bp, Homo sapiens
agaagcaagggcaag

SEQ ID NO: 1572454 - DNA, 13 bp, Homo sapiens
agaagcaagtaaa

SEQ ID NO: 1572455 - DNA, 17 bp, Homo sapiens
agaagcaatctttgaaa

SEQ ID NO: 1572456 - DNA, 15 bp, Homo sapiens
agaagcacagctcct

SEQ ID NO: 1572457 - DNA, 13 bp, Homo sapiens
agaagcaggaagg

SEQ ID NO: 1572458 - DNA, 23 bp, Homo sapiens
agaagcagttgtaccaagtgaaa

SEQ ID NO: 1572459 - DNA, 16 bp, Homo sapiens
agaagcatattttgct

SEQ ID NO: 1572460 - DNA, 17 bp, Homo sapiens
agaagcatattttgctg

SEQ ID NO: 1572461 - DNA, 13 bp, Homo sapiens
agaagcatgaaaa

SEQ ID NO: 1572462 - DNA, 15 bp, Homo sapiens
agaagcatgaaaaag

SEQ ID NO: 1572463 - DNA, 18 bp, Homo sapiens
agaagcattgcctggact

SEQ ID NO: 1572464 - DNA, 17 bp, Homo sapiens
agaagccaaaagattgg

SEQ ID NO: 1572465 - DNA, 18 bp, Homo sapiens
agaagccaactatgatta

SEQ ID NO: 1572466 - DNA, 23 bp, Homo sapiens
agaagccaactatgattattaac

SEQ ID NO: 1572467 - DNA, 22 bp, Homo sapiens
agaagccaagcgctcatgttga

SEQ ID NO: 1572468 - DNA, 18 bp, Homo sapiens
agaagccaagggaaaggg

SEQ ID NO: 1572469 - DNA, 13 bp, Homo sapiens
agaagccacagaa

SEQ ID NO: 1572470 - DNA, 18 bp, Homo sapiens
agaagccacaggcctgag

SEQ ID NO: 1572471 - DNA, 21 bp, Homo sapiens
agaagccacaggcctgagatt

SEQ ID NO: 1572472 - DNA, 16 bp, Homo sapiens
agaagccaccttccca

SEQ ID NO: 1572473 - DNA, 10 bp, Homo sapiens
agaagccagc

SEQ ID NO: 1572474 - DNA, 14 bp, Homo sapiens
agaagccagccaca

SEQ ID NO: 1572475 - DNA, 12 bp, Homo sapiens
agaagcccccag

SEQ ID NO: 1572476 - DNA, 17 bp, Homo sapiens
agaagcccccagctaag

SEQ ID NO: 1572477 - DNA, 23 bp, Homo sapiens
agaagcccccagctaagaacctg

SEQ ID NO: 1572478 - DNA, 21 bp, Homo sapiens
agaagccgagagccttttgtg

SEQ ID NO: 1572479 - DNA, 16 bp, Homo sapiens
agaagccgggaacaga

SEQ ID NO: 1572480 - DNA, 21 bp, Homo sapiens
agaagcctccaagcctgcctc

SEQ ID NO: 1572481 - DNA, 16 bp, Homo sapiens
agaagcctctgcctcc

SEQ ID NO: 1572482 - DNA, 12 bp, Homo sapiens
agaagcctctgg

SEQ ID NO: 1572483 - DNA, 13 bp, Homo sapiens
agaagcctctggc

SEQ ID NO: 1572484 - DNA, 23 bp, Homo sapiens
agaagcctctggctagaggccag

SEQ ID NO: 1572485 - DNA, 17 bp, Homo sapiens
agaagcctgaggctggg

SEQ ID NO: 1572486 - DNA, 17 bp, Homo sapiens
agaagcctgcaggagaa

SEQ ID NO: 1572487 - DNA, 19 bp, Homo sapiens
agaagcctgtaacactcct

SEQ ID NO: 1572488 - DNA, 20 bp, Homo sapiens
agaagccttaatttgcacag

SEQ ID NO: 1572489 - DNA, 13 bp, Homo sapiens
agaagccttcagc

SEQ ID NO: 1572490 - DNA, 17 bp, Homo sapiens
agaagccttcagctcca

SEQ ID NO: 1572491 - DNA, 15 bp, Homo sapiens
agaatactggtctca

SEQ ID NO: 1572492 - DNA, 10 bp, Homo sapiens
agaatagaaa

SEQ ID NO: 1572493 - DNA, 19 bp, Homo sapiens
agaatagaacaacatatac

SEQ ID NO: 1572494 - DNA, 13 bp, Homo sapiens
agaatagactgga

SEQ ID NO: 1572495 - DNA, 17 bp, Homo sapiens
agaatagagctgccact

SEQ ID NO: 1572496 - DNA, 16 bp, Homo sapiens
agaatagatgctgact

SEQ ID NO: 1572497 - DNA, 19 bp, Homo sapiens
agaatagcacagccagact

SEQ ID NO: 1572498 - DNA, 13 bp, Homo sapiens
agaatagcagaga

SEQ ID NO: 1572499 - DNA, 17 bp, Homo sapiens
agaatagcagagagcca

SEQ ID NO: 1572500 - DNA, 12 bp, Homo sapiens
agaataggaaaa

SEQ ID NO: 1572501 - DNA, 14 bp, Homo sapiens
agaatataattatc

SEQ ID NO: 1572502 - DNA, 15 bp, Homo sapiens
agaatatatgctttt

SEQ ID NO: 1572503 - DNA, 16 bp, Homo sapiens
agaatatgacaatcta

SEQ ID NO: 1572504 - DNA, 21 bp, Homo sapiens
agaatatgacctaaatccatt

SEQ ID NO: 1572505 - DNA, 13 bp, Homo sapiens
agaatatgataaa

SEQ ID NO: 1572506 - DNA, 19 bp, Homo sapiens
agaatattagctttactgt

SEQ ID NO: 1572507 - DNA, 21 bp, Homo sapiens
agaatattagctttactgttt

SEQ ID NO: 1572508 - DNA, 15 bp, Homo sapiens
agaatattcaggact

SEQ ID NO: 1572509 - DNA, 13 bp, Homo sapiens
agaatatttacta

SEQ ID NO: 1572510 - DNA, 21 bp, Homo sapiens
agaatatttactaactaaata

SEQ ID NO: 1572511 - DNA, 11 bp, Homo sapiens
agaatatttat

SEQ ID NO: 1572512 - DNA, 17 bp, Homo sapiens
agaatatttctattgaa

SEQ ID NO: 1572513 - DNA, 14 bp, Homo sapiens
agaatcaaaactct

SEQ ID NO: 1572514 - DNA, 13 bp, Homo sapiens
agaatcaaatact

SEQ ID NO: 1572515 - DNA, 22 bp, Homo sapiens
agaatcacctgaaccccagagg

SEQ ID NO: 1572516 - DNA, 14 bp, Homo sapiens
agaatcatacttag

SEQ ID NO: 1572517 - DNA, 22 bp, Homo sapiens
agaatcatatgattctgctttt

SEQ ID NO: 1572518 - DNA, 21 bp, Homo sapiens
agaatcatgtttctttgatca

SEQ ID NO: 1572519 - DNA, 13 bp, Homo sapiens
agaatccaaagat

SEQ ID NO: 1572520 - DNA, 14 bp, Homo sapiens
agaatccagcaggt

SEQ ID NO: 1572521 - DNA, 18 bp, Homo sapiens
agaatcccactttctata

SEQ ID NO: 1572522 - DNA, 22 bp, Homo sapiens
agaatcccttaacagttgtatt

SEQ ID NO: 1572523 - DNA, 23 bp, Homo sapiens
agaatccctttgcacctgagacc

SEQ ID NO: 1572524 - DNA, 20 bp, Homo sapiens
agaatcctcccttcccagga

SEQ ID NO: 1572525 - DNA, 20 bp, Homo sapiens
agaatccttatctataaaag

SEQ ID NO: 1572526 - DNA, 15 bp, Homo sapiens
agaatcctttacatt

SEQ ID NO: 1572527 - DNA, 15 bp, Homo sapiens
agaatctagaaatgt

SEQ ID NO: 1572528 - DNA, 20 bp, Homo sapiens
agaatctctatgtatattct

SEQ ID NO: 1572529 - DNA, 18 bp, Homo sapiens
agaatcttgactttctga

SEQ ID NO: 1572530 - DNA, 15 bp, Homo sapiens
agaatgaaatgtatg

SEQ ID NO: 1572531 - DNA, 22 bp, Homo sapiens
agaatgaaggtttttgtaaaga

SEQ ID NO: 1572532 - DNA, 13 bp, Homo sapiens
agaatgaatttat

SEQ ID NO: 1572533 - DNA, 15 bp, Homo sapiens
agaatgaatttatct

SEQ ID NO: 1572534 - DNA, 20 bp, Homo sapiens
agaatgaatttatctttacc

SEQ ID NO: 1572535 - DNA, 15 bp, Homo sapiens
agaatgagctggttt

SEQ ID NO: 1572536 - DNA, 20 bp, Homo sapiens
agaatgagtccttgatttca

SEQ ID NO: 1572537 - DNA, 21 bp, Homo sapiens
agaatgagtccttgatttcaa

SEQ ID NO: 1572538 - DNA, 15 bp, Homo sapiens
agaatgagtgcaggt

SEQ ID NO: 1572539 - DNA, 20 bp, Homo sapiens
agaatgagtgggaatccggg

SEQ ID NO: 1572540 - DNA, 19 bp, Homo sapiens
agaatgatcaaggatctgg

SEQ ID NO: 1572541 - DNA, 13 bp, Homo sapiens
agaatgatggttt

SEQ ID NO: 1572542 - DNA, 20 bp, Homo sapiens
agaatgcacaagaatggatc

SEQ ID NO: 1572543 - DNA, 21 bp, Homo sapiens
agaatgcacctcttgttactc

SEQ ID NO: 1572544 - DNA, 19 bp, Homo sapiens
agaatgcagattcctgggc

SEQ ID NO: 1572545 - DNA, 21 bp, Homo sapiens
agaatgcagattcctgggcct

SEQ ID NO: 1572546 - DNA, 22 bp, Homo sapiens
agaatgcagattcctgggcctg

SEQ ID NO: 1572547 - DNA, 21 bp, Homo sapiens
agaatgcattccctgaatctg

SEQ ID NO: 1572548 - DNA, 18 bp, Homo sapiens
agaatgctagcaggctgt

SEQ ID NO: 1572549 - DNA, 12 bp, Homo sapiens
agaatgctcagg

SEQ ID NO: 1572550 - DNA, 18 bp, Homo sapiens
agaatgctctttacttca

SEQ ID NO: 1572551 - DNA, 12 bp, Homo sapiens
agaatgctgaac

SEQ ID NO: 1572552 - DNA, 22 bp, Homo sapiens
agaatgctgcaggacttgagaa

SEQ ID NO: 1572553 - DNA, 14 bp, Homo sapiens
agaatggaatagaa

SEQ ID NO: 1572554 - DNA, 17 bp, Homo sapiens
agaatggcagtcctgga

SEQ ID NO: 1572555 - DNA, 19 bp, Homo sapiens
agaatggcagtcctggagg

SEQ ID NO: 1572556 - DNA, 20 bp, Homo sapiens
agaatggcagtcctggaggc

SEQ ID NO: 1572557 - DNA, 19 bp, Homo sapiens
agaatggctgggtcagggc

SEQ ID NO: 1572558 - DNA, 21 bp, Homo sapiens
agaatggtgccaccactcaag

SEQ ID NO: 1572559 - DNA, 22 bp, Homo sapiens
agaatggtgctgtttaaagtca

SEQ ID NO: 1572560 - DNA, 16 bp, Homo sapiens
agaatgtaaaagaact

SEQ ID NO: 1572561 - DNA, 16 bp, Homo sapiens
agaatgtaagaactac

SEQ ID NO: 1572562 - DNA, 16 bp, Homo sapiens
agaatgtatttgctga

SEQ ID NO: 1572563 - DNA, 16 bp, Homo sapiens
agaatgtcagatttct

SEQ ID NO: 1572564 - DNA, 17 bp, Homo sapiens
agaatgtcagatttctg

SEQ ID NO: 1572565 - DNA, 22 bp, Homo sapiens
agaatgtcagatttctggttga

SEQ ID NO: 1572566 - DNA, 13 bp, Homo sapiens
agaatgtcagtat

SEQ ID NO: 1572567 - DNA, 17 bp, Homo sapiens
agaatgtcagtatgtgg

SEQ ID NO: 1572568 - DNA, 16 bp, Homo sapiens
agaatgtccttattct

SEQ ID NO: 1572569 - DNA, 11 bp, Homo sapiens
agaatgtgaaa

SEQ ID NO: 1572570 - DNA, 16 bp, Homo sapiens
agaatgtgaaaaagga

SEQ ID NO: 1572571 - DNA, 16 bp, Homo sapiens
agaatgtgattccttt

SEQ ID NO: 1572572 - DNA, 18 bp, Homo sapiens
agaatgtgctcatgcatt

SEQ ID NO: 1572573 - DNA, 17 bp, Homo sapiens
agaatgtgtgtgtgtgg

SEQ ID NO: 1572574 - DNA, 22 bp, Homo sapiens
agaatgtgttcttttctccttt

SEQ ID NO: 1572575 - DNA, 14 bp, Homo sapiens
agaattaaactttt

SEQ ID NO: 1572576 - DNA, 15 bp, Homo sapiens
agaattaaactttta

SEQ ID NO: 1572577 - DNA, 18 bp, Homo sapiens
agaattaaacttttaatt

SEQ ID NO: 1572578 - DNA, 22 bp, Homo sapiens
agaattaaacttttaattcatt

SEQ ID NO: 1572579 - DNA, 14 bp, Homo sapiens
agaattaagcagaa

SEQ ID NO: 1572580 - DNA, 20 bp, Homo sapiens
agaattaagttttaaataaa

SEQ ID NO: 1572581 - DNA, 15 bp, Homo sapiens
agaattacagactct

SEQ ID NO: 1572582 - DNA, 16 bp, Homo sapiens
agaattaccattaatt

SEQ ID NO: 1572583 - DNA, 23 bp, Homo sapiens
agaattacttgtgttacttgcca

SEQ ID NO: 1572584 - DNA, 15 bp, Homo sapiens
agaattagtatgtct

SEQ ID NO: 1572585 - DNA, 19 bp, Homo sapiens
agaattagtgccagaattt

SEQ ID NO: 1572586 - DNA, 21 bp, Homo sapiens
agaattagtgccagaatttta

SEQ ID NO: 1572587 - DNA, 15 bp, Homo sapiens
agaattatctaattt

SEQ ID NO: 1572588 - DNA, 17 bp, Homo sapiens
agaattatctaatttat

SEQ ID NO: 1572589 - DNA, 18 bp, Homo sapiens
agaattatctaatttata

SEQ ID NO: 1572590 - DNA, 14 bp, Homo sapiens
agaattatgtaata

SEQ ID NO: 1572591 - DNA, 23 bp, Homo sapiens
agaattatgtaatatattgtaca

SEQ ID NO: 1572592 - DNA, 14 bp, Homo sapiens
agaattatttttgt

SEQ ID NO: 1572593 - DNA, 21 bp, Homo sapiens
agaattcccttgaattgtgta

SEQ ID NO: 1572594 - DNA, 21 bp, Homo sapiens
agaattccttaggtaatctat

SEQ ID NO: 1572595 - DNA, 20 bp, Homo sapiens
agaattccttcgaaaggcct

SEQ ID NO: 1572596 - DNA, 14 bp, Homo sapiens
agaattcgaaggct

SEQ ID NO: 1572597 - DNA, 16 bp, Homo sapiens
agaattcggtgtgctg

SEQ ID NO: 1572598 - DNA, 19 bp, Homo sapiens
agaattcggtgtgctgcca

SEQ ID NO: 1572599 - DNA, 14 bp, Homo sapiens
agaattctagtgct

SEQ ID NO: 1572600 - DNA, 20 bp, Homo sapiens
agaattctgctacctcactg

SEQ ID NO: 1572601 - DNA, 22 bp, Homo sapiens
agaattctgctacctcactggg

SEQ ID NO: 1572602 - DNA, 17 bp, Homo sapiens
agaattcttacatgttt

SEQ ID NO: 1572603 - DNA, 19 bp, Homo sapiens
agaattcttacatgttttc

SEQ ID NO: 1572604 - DNA, 20 bp, Homo sapiens
agaattcttacatgttttct

SEQ ID NO: 1572605 - DNA, 17 bp, Homo sapiens
agaattcttcaggtgga

SEQ ID NO: 1572606 - DNA, 14 bp, Homo sapiens
agaattgaaaatgc

SEQ ID NO: 1572607 - DNA, 15 bp, Homo sapiens
agaattgaaaatgca

SEQ ID NO: 1572608 - DNA, 12 bp, Homo sapiens
agaattgaaact

SEQ ID NO: 1572609 - DNA, 15 bp, Homo sapiens
agaattgactgaagc

SEQ ID NO: 1572610 - DNA, 22 bp, Homo sapiens
agaattgactgaagcacagcac

SEQ ID NO: 1572611 - DNA, 18 bp, Homo sapiens
agaattgagtaatggtgt

SEQ ID NO: 1572612 - DNA, 21 bp, Homo sapiens
agaattgatcattttcccccc

SEQ ID NO: 1572613 - DNA, 20 bp, Homo sapiens
agaattgctggatgcatttt

SEQ ID NO: 1572614 - DNA, 19 bp, Homo sapiens
agaattgcttgagcttggg

SEQ ID NO: 1572615 - DNA, 23 bp, Homo sapiens
agaattgtatctcatactgtctg

SEQ ID NO: 1572616 - DNA, 17 bp, Homo sapiens
agaattgttgagatact

SEQ ID NO: 1572617 - DNA, 15 bp, Homo sapiens
agaattgtttagatt

SEQ ID NO: 1572618 - DNA, 19 bp, Homo sapiens
agaatttaccatcatctct

SEQ ID NO: 1572619 - DNA, 18 bp, Homo sapiens
agaatttattagtttaaa

SEQ ID NO: 1572620 - DNA, 18 bp, Homo sapiens
agaatttctgctaaatat

SEQ ID NO: 1572621 - DNA, 22 bp, Homo sapiens
agaatttcttggtaagaagccg

SEQ ID NO: 1572622 - DNA, 21 bp, Homo sapiens
agaatttctttgtcattcaag

SEQ ID NO: 1572623 - DNA, 13 bp, Homo sapiens
agaattttaaatt

SEQ ID NO: 1572624 - DNA, 16 bp, Homo sapiens
agaattttaagccttt

SEQ ID NO: 1572625 - DNA, 22 bp, Homo sapiens
agaattttaagtgctttgtaat

SEQ ID NO: 1572626 - DNA, 18 bp, Homo sapiens
agaattttaatgtgaaga

SEQ ID NO: 1572627 - DNA, 19 bp, Homo sapiens
agaattttatttttctgtg

SEQ ID NO: 1572628 - DNA, 22 bp, Homo sapiens
agaattttgagtattccatgag

SEQ ID NO: 1572629 - DNA, 22 bp, Homo sapiens
agaattttgtatattgtaggaa

SEQ ID NO: 1572630 - DNA, 13 bp, Homo sapiens
agacaaaaacaag

SEQ ID NO: 1572631 - DNA, 21 bp, Homo sapiens
agacaaaaacaagtaaatata

SEQ ID NO: 1572632 - DNA, 16 bp, Homo sapiens
agacaaaaacagcctc

SEQ ID NO: 1572633 - DNA, 22 bp, Homo sapiens
agacaaaaacagcctcacagaa

SEQ ID NO: 1572634 - DNA, 19 bp, Homo sapiens
agacaaaaagtatattaaa

SEQ ID NO: 1572635 - DNA, 23 bp, Homo sapiens
agacaaaaatcaaagaacagatg

SEQ ID NO: 1572636 - DNA, 13 bp, Homo sapiens
agacaaaatcaaa

SEQ ID NO: 1572637 - DNA, 16 bp, Homo sapiens
agacaaaatttgagaa

SEQ ID NO: 1572638 - DNA, 23 bp, Homo sapiens
agacaaaatttgagaatacataa

SEQ ID NO: 1572639 - DNA, 19 bp, Homo sapiens
agacaaacacctcccagga

SEQ ID NO: 1572640 - DNA, 18 bp, Homo sapiens
agacaaaggttttcctct

SEQ ID NO: 1572641 - DNA, 23 bp, Homo sapiens
agacaaagtcccagaattgtatc

SEQ ID NO: 1572642 - DNA, 19 bp, Homo sapiens
agacaaatagaaaatggtc

SEQ ID NO: 1572643 - DNA, 12 bp, Homo sapiens
agacaaatattt

SEQ ID NO: 1572644 - DNA, 15 bp, Homo sapiens
agacaaatatttgga

SEQ ID NO: 1572645 - DNA, 17 bp, Homo sapiens
agacaaattctgtttct

SEQ ID NO: 1572646 - DNA, 15 bp, Homo sapiens
agacaacagaagtca

SEQ ID NO: 1572647 - DNA, 23 bp, Homo sapiens
agacaacaggtaaaacagggcca

SEQ ID NO: 1572648 - DNA, 20 bp, Homo sapiens
agacaacattatgatctaat

SEQ ID NO: 1572649 - DNA, 22 bp, Homo sapiens
agacaacattatgatctaataa

SEQ ID NO: 1572650 - DNA, 15 bp, Homo sapiens
agacaacctttctgt

SEQ ID NO: 1572651 - DNA, 16 bp, Homo sapiens
agacaacctttctgta

SEQ ID NO: 1572652 - DNA, 12 bp, Homo sapiens
agacaactagat

SEQ ID NO: 1572653 - DNA, 17 bp, Homo sapiens
agacaactagatttgtc

SEQ ID NO: 1572654 - DNA, 24 bp, Homo sapiens
agacaagagatctacacatgttgc

SEQ ID NO: 1572655 - DNA, 15 bp, Homo sapiens
agacaagagatggga

SEQ ID NO: 1572656 - DNA, 16 bp, Homo sapiens
agacaagagctgctgt

SEQ ID NO: 1572657 - DNA, 17 bp, Homo sapiens
agacaagagctgctgtc

SEQ ID NO: 1572658 - DNA, 19 bp, Homo sapiens
agacaagatattgtacata

SEQ ID NO: 1572659 - DNA, 20 bp, Homo sapiens
agacaagatattgtacataa

SEQ ID NO: 1572660 - DNA, 13 bp, Homo sapiens
agacaagcagccc

SEQ ID NO: 1572661 - DNA, 14 bp, Homo sapiens
agacaagcagccct

SEQ ID NO: 1572662 - DNA, 15 bp, Homo sapiens
agacaagcagccctt

SEQ ID NO: 1572663 - DNA, 12 bp, Homo sapiens
agacaagccctg

SEQ ID NO: 1572664 - DNA, 18 bp, Homo sapiens
agacaagccctggcaaca

SEQ ID NO: 1572665 - DNA, 15 bp, Homo sapiens
agacaaggtgctaac

SEQ ID NO: 1572666 - DNA, 22 bp, Homo sapiens
agacaagtaatttcagtgtaaa

SEQ ID NO: 1572667 - DNA, 19 bp, Homo sapiens
agacaagtatgaatattac

SEQ ID NO: 1572668 - DNA, 23 bp, Homo sapiens
agacaagtgactgtatctgtgta

SEQ ID NO: 1572669 - DNA, 14 bp, Homo sapiens
agacaataattcta

SEQ ID NO: 1572670 - DNA, 14 bp, Homo sapiens
agacaatacagtaa

SEQ ID NO: 1572671 - DNA, 22 bp, Homo sapiens
agacaatttgatacataataaa

SEQ ID NO: 1572672 - DNA, 19 bp, Homo sapiens
agacacaactatttttcca

SEQ ID NO: 1572673 - DNA, 20 bp, Homo sapiens
agacacaatttcatttccag

SEQ ID NO: 1572674 - DNA, 12 bp, Homo sapiens
agacacacacac

SEQ ID NO: 1572675 - DNA, 13 bp, Homo sapiens
agacacacacaca

SEQ ID NO: 1572676 - DNA, 20 bp, Homo sapiens
agacacacacacgcacgcac

SEQ ID NO: 1572677 - DNA, 22 bp, Homo sapiens
agacacacacacgcacgcacac

SEQ ID NO: 1572678 - DNA, 23 bp, Homo sapiens
agacacacacacgcacgcacaca

SEQ ID NO: 1572679 - DNA, 21 bp, Homo sapiens
agacacagggatgattcccac

SEQ ID NO: 1572680 - DNA, 23 bp, Homo sapiens
agacacaggtgcctcacgcctgt

SEQ ID NO: 1572681 - DNA, 12 bp, Homo sapiens
agacacatgaag

SEQ ID NO: 1572682 - DNA, 19 bp, Homo sapiens
agacacatgaaggtaaata

SEQ ID NO: 1572683 - DNA, 20 bp, Homo sapiens
agacacatgaaggtaaataa

SEQ ID NO: 1572684 - DNA, 14 bp, Homo sapiens
agacacattgcctt

SEQ ID NO: 1572685 - DNA, 21 bp, Homo sapiens
agacacattgccttctggagc

SEQ ID NO: 1572686 - DNA, 12 bp, Homo sapiens
agacaccaaagt

SEQ ID NO: 1572687 - DNA, 16 bp, Homo sapiens
agacaccatcctgagc

SEQ ID NO: 1572688 - DNA, 17 bp, Homo sapiens
agacaccatcctgagcc

SEQ ID NO: 1572689 - DNA, 13 bp, Homo sapiens
agacacccaggac

SEQ ID NO: 1572690 - DNA, 14 bp, Homo sapiens
agacacccaggact

SEQ ID NO: 1572691 - DNA, 15 bp, Homo sapiens
agacaccctctgggg

SEQ ID NO: 1572692 - DNA, 16 bp, Homo sapiens
agacaccctctggggg

SEQ ID NO: 1572693 - DNA, 17 bp, Homo sapiens
agacaccctctgggggt

SEQ ID NO: 1572694 - DNA, 17 bp, Homo sapiens
agacacctgcacctccc

SEQ ID NO: 1572695 - DNA, 17 bp, Homo sapiens
agacacctgttcacaga

SEQ ID NO: 1572696 - DNA, 22 bp, Homo sapiens
agacacgacagcacacacagtg

SEQ ID NO: 1572697 - DNA, 18 bp, Homo sapiens
agacacgccttcccctca

SEQ ID NO: 1572698 - DNA, 22 bp, Homo sapiens
agacacgccttcccctcagcca

SEQ ID NO: 1572699 - DNA, 19 bp, Homo sapiens
agacacgtggcctcgtgag

SEQ ID NO: 1572700 - DNA, 14 bp, Homo sapiens
agacactaactttg

SEQ ID NO: 1572701 - DNA, 12 bp, Homo sapiens
agacactctgct

SEQ ID NO: 1572702 - DNA, 15 bp, Homo sapiens
agacactctgctctg

SEQ ID NO: 1572703 - DNA, 17 bp, Homo sapiens
agacactctgctctgcc

SEQ ID NO: 1572704 - DNA, 18 bp, Homo sapiens
agacactctgctctgccc

SEQ ID NO: 1572705 - DNA, 11 bp, Homo sapiens
agacactgcct

SEQ ID NO: 1572706 - DNA, 18 bp, Homo sapiens
agacactggtttacactt

SEQ ID NO: 1572707 - DNA, 13 bp, Homo sapiens
agacacttcatgg

SEQ ID NO: 1572708 - DNA, 22 bp, Homo sapiens
agacacttcatggaccaagaat

SEQ ID NO: 1572709 - DNA, 13 bp, Homo sapiens
agacacttgcctt

SEQ ID NO: 1572710 - DNA, 15 bp, Homo sapiens
agacactttggaagt

SEQ ID NO: 1572711 - DNA, 17 bp, Homo sapiens
agacagaccacttgcca

SEQ ID NO: 1572712 - DNA, 20 bp, Homo sapiens
agacagagaggactgtaggg

SEQ ID NO: 1572713 - DNA, 13 bp, Homo sapiens
agacagagccaag

SEQ ID NO: 1572714 - DNA, 21 bp, Homo sapiens
agacagagccaagcactgctc

SEQ ID NO: 1572715 - DNA, 22 bp, Homo sapiens
agacagagccaagcactgctca

SEQ ID NO: 1572716 - DNA, 13 bp, Homo sapiens
agacagagccagg

SEQ ID NO: 1572717 - DNA, 11 bp, Homo sapiens
agacagagtct

SEQ ID NO: 1572718 - DNA, 14 bp, Homo sapiens
agacagatgcccca

SEQ ID NO: 1572719 - DNA, 16 bp, Homo sapiens
agacagcagctcaggc

SEQ ID NO: 1572720 - DNA, 22 bp, Homo sapiens
agacagcccaggatactggcac

SEQ ID NO: 1572721 - DNA, 23 bp, Homo sapiens
agacagcccaggatactggcaca

SEQ ID NO: 1572722 - DNA, 19 bp, Homo sapiens
agacagctccctctgcctg

SEQ ID NO: 1572723 - DNA, 18 bp, Homo sapiens
agacagcttttctcaact

SEQ ID NO: 1572724 - DNA, 15 bp, Homo sapiens
agaagctagatgccc

SEQ ID NO: 1572725 - DNA, 21 bp, Homo sapiens
agaagctagatgcccctgcag

SEQ ID NO: 1572726 - DNA, 18 bp, Homo sapiens
agaagctcagctgcattc

SEQ ID NO: 1572727 - DNA, 14 bp, Homo sapiens
agaagctcctctcc

SEQ ID NO: 1572728 - DNA, 18 bp, Homo sapiens
agaagctcctctccccag

SEQ ID NO: 1572729 - DNA, 20 bp, Homo sapiens
agaagctcctctccccagcc

SEQ ID NO: 1572730 - DNA, 23 bp, Homo sapiens
agaagctcctctccccagcccag

SEQ ID NO: 1572731 - DNA, 14 bp, Homo sapiens
agaagctcctgcta

SEQ ID NO: 1572732 - DNA, 19 bp, Homo sapiens
agaagctctgaagaactct

SEQ ID NO: 1572733 - DNA, 16 bp, Homo sapiens
agaagctgatccagtt

SEQ ID NO: 1572734 - DNA, 13 bp, Homo sapiens
agaagctgctgac

SEQ ID NO: 1572735 - DNA, 22 bp, Homo sapiens
agaagcttccacaaaattagaa

SEQ ID NO: 1572736 - DNA, 18 bp, Homo sapiens
agaagcttccattccaag

SEQ ID NO: 1572737 - DNA, 21 bp, Homo sapiens
agaagcttgtggtgttcctga

SEQ ID NO: 1572738 - DNA, 19 bp, Homo sapiens
agaaggaaagatggttaaa

SEQ ID NO: 1572739 - DNA, 18 bp, Homo sapiens
agaaggaacattgcagag

SEQ ID NO: 1572740 - DNA, 22 bp, Homo sapiens
agaaggaaggagactcacctct

SEQ ID NO: 1572741 - DNA, 22 bp, Homo sapiens
agaaggaattctaggcatccca

SEQ ID NO: 1572742 - DNA, 16 bp, Homo sapiens
agaaggaatttgtact

SEQ ID NO: 1572743 - DNA, 15 bp, Homo sapiens
agaaggactgaactc

SEQ ID NO: 1572744 - DNA, 22 bp, Homo sapiens
agaaggaggaatgctggactgg

SEQ ID NO: 1572745 - DNA, 17 bp, Homo sapiens
agaaggagggcagagcc

SEQ ID NO: 1572746 - DNA, 16 bp, Homo sapiens
agaaggatcttcatct

SEQ ID NO: 1572747 - DNA, 14 bp, Homo sapiens
agaaggatgaatga

SEQ ID NO: 1572748 - DNA, 16 bp, Homo sapiens
agaaggatgtacattt

SEQ ID NO: 1572749 - DNA, 22 bp, Homo sapiens
agaaggcaagtttctagctaga

SEQ ID NO: 1572750 - DNA, 21 bp, Homo sapiens
agaaggcaattttagtgtatt

SEQ ID NO: 1572751 - DNA, 15 bp, Homo sapiens
agaaggcacacagag

SEQ ID NO: 1572752 - DNA, 13 bp, Homo sapiens
agaaggcagcagg

SEQ ID NO: 1572753 - DNA, 15 bp, Homo sapiens
agaaggcatgagaaa

SEQ ID NO: 1572754 - DNA, 13 bp, Homo sapiens
agaaggccaagag

SEQ ID NO: 1572755 - DNA, 16 bp, Homo sapiens
agaaggccagccctcc

SEQ ID NO: 1572756 - DNA, 20 bp, Homo sapiens
agaaggcccataccttctgg

SEQ ID NO: 1572757 - DNA, 22 bp, Homo sapiens
agaaggccgctgccccagcccc

SEQ ID NO: 1572758 - DNA, 22 bp, Homo sapiens
agaaggcctcttgtgctcacgc

SEQ ID NO: 1572759 - DNA, 19 bp, Homo sapiens
agaaggccttacagaaaat

SEQ ID NO: 1572760 - DNA, 23 bp, Homo sapiens
agaaggccttcatggccccagca

SEQ ID NO: 1572761 - DNA, 17 bp, Homo sapiens
agaaggcgaggagagtg

SEQ ID NO: 1572762 - DNA, 19 bp, Homo sapiens
agaaggctaggagttcata

SEQ ID NO: 1572763 - DNA, 22 bp, Homo sapiens
agaaggctaggagttcatagaa

SEQ ID NO: 1572764 - DNA, 22 bp, Homo sapiens
agaaggctatgtaaacaaacca

SEQ ID NO: 1572765 - DNA, 14 bp, Homo sapiens
agaaggcttctctc

SEQ ID NO: 1572766 - DNA, 18 bp, Homo sapiens
agaaggcttctctccaca

SEQ ID NO: 1572767 - DNA, 15 bp, Homo sapiens
agaagggagaagaaa

SEQ ID NO: 1572768 - DNA, 11 bp, Homo sapiens
agaagggaggg

SEQ ID NO: 1572769 - DNA, 12 bp, Homo sapiens
agaagggagggt

SEQ ID NO: 1572770 - DNA, 14 bp, Homo sapiens
agaagggagggtgg

SEQ ID NO: 1572771 - DNA, 20 bp, Homo sapiens
agaagggccagtcctgcctg

SEQ ID NO: 1572772 - DNA, 15 bp, Homo sapiens
agaagggctgcatga

SEQ ID NO: 1572773 - DNA, 13 bp, Homo sapiens
agaagggggccct

SEQ ID NO: 1572774 - DNA, 14 bp, Homo sapiens
agaagggggccctg

SEQ ID NO: 1572775 - DNA, 16 bp, Homo sapiens
agaagggggccctgct

SEQ ID NO: 1572776 - DNA, 18 bp, Homo sapiens
agaagggggccctgctac

SEQ ID NO: 1572777 - DNA, 16 bp, Homo sapiens
agaagggggctctgcc

SEQ ID NO: 1572778 - DNA, 17 bp, Homo sapiens
agaagggggctctgccc

SEQ ID NO: 1572779 - DNA, 21 bp, Homo sapiens
agaagggggctctgccccagg

SEQ ID NO: 1572780 - DNA, 19 bp, Homo sapiens
agaagggggtctctgttaa

SEQ ID NO: 1572781 - DNA, 20 bp, Homo sapiens
agaagggggtggtgtctcca

SEQ ID NO: 1572782 - DNA, 17 bp, Homo sapiens
agaagggttctgccctg

SEQ ID NO: 1572783 - DNA, 21 bp, Homo sapiens
agaagggttctgccctgcctg

SEQ ID NO: 1572784 - DNA, 21 bp, Homo sapiens
agaaggtattagcaaagcaaa

SEQ ID NO: 1572785 - DNA, 21 bp, Homo sapiens
agaaggtattccttttgtgta

SEQ ID NO: 1572786 - DNA, 14 bp, Homo sapiens
agaaggtccttaat

SEQ ID NO: 1572787 - DNA, 20 bp, Homo sapiens
agaaggtgccgtgagcaggc

SEQ ID NO: 1572788 - DNA, 22 bp, Homo sapiens
agaaggtgccgtgagcaggctt

SEQ ID NO: 1572789 - DNA, 16 bp, Homo sapiens
agaaggttgctctaga

SEQ ID NO: 1572790 - DNA, 14 bp, Homo sapiens
agaaggttggtggg

SEQ ID NO: 1572791 - DNA, 15 bp, Homo sapiens
agaagtaagaagagg

SEQ ID NO: 1572792 - DNA, 21 bp, Homo sapiens
agaagtaagaggctacctctt

SEQ ID NO: 1572793 - DNA, 13 bp, Homo sapiens
agaagtagattaa

SEQ ID NO: 1572794 - DNA, 20 bp, Homo sapiens
agaagtagattaagagccat

SEQ ID NO: 1572795 - DNA, 14 bp, Homo sapiens
agaagtaggaggaa

SEQ ID NO: 1572796 - DNA, 22 bp, Homo sapiens
agaagtaggaggaaacagttct

SEQ ID NO: 1572797 - DNA, 19 bp, Homo sapiens
agaagtattcctgttgctg

SEQ ID NO: 1572798 - DNA, 23 bp, Homo sapiens
agaagtattcctgttgctgtctt

SEQ ID NO: 1572799 - DNA, 23 bp, Homo sapiens
agaagtattcttttcaattatat

SEQ ID NO: 1572800 - DNA, 19 bp, Homo sapiens
agaagtcactgaacaaaac

SEQ ID NO: 1572801 - DNA, 20 bp, Homo sapiens
agaagtcatgaagcccaagt

SEQ ID NO: 1572802 - DNA, 20 bp, Homo sapiens
agaagtcatggcccaaatcc

SEQ ID NO: 1572803 - DNA, 24 bp, Homo sapiens
agaagtcctccctcctgcaggctg

SEQ ID NO: 1572804 - DNA, 22 bp, Homo sapiens
agaagtcctgctggatcttgcc

SEQ ID NO: 1572805 - DNA, 23 bp, Homo sapiens
agaagtcggaatgtcatagtctt

SEQ ID NO: 1572806 - DNA, 17 bp, Homo sapiens
agaagtctccctgcaca

SEQ ID NO: 1572807 - DNA, 23 bp, Homo sapiens
agaagtctccctgcacagcctct

SEQ ID NO: 1572808 - DNA, 18 bp, Homo sapiens
agaagtctggctttgctc

SEQ ID NO: 1572809 - DNA, 17 bp, Homo sapiens
agaagtgaatgctggga

SEQ ID NO: 1572810 - DNA, 18 bp, Homo sapiens
agaagtgagcagtgttgg

SEQ ID NO: 1572811 - DNA, 18 bp, Homo sapiens
agaagtgatatggtgaag

SEQ ID NO: 1572812 - DNA, 21 bp, Homo sapiens
agaagtgatatggtgaaggga

SEQ ID NO: 1572813 - DNA, 18 bp, Homo sapiens
agaagtgctccctggagg

SEQ ID NO: 1572814 - DNA, 14 bp, Homo sapiens
agaagtgctcttgg

SEQ ID NO: 1572815 - DNA, 15 bp, Homo sapiens
agaagtggagacagt

SEQ ID NO: 1572816 - DNA, 19 bp, Homo sapiens
agaagtgtccgagaactaa

SEQ ID NO: 1572817 - DNA, 15 bp, Homo sapiens
agaagttactgaatg

SEQ ID NO: 1572818 - DNA, 15 bp, Homo sapiens
agaagttagtttgta

SEQ ID NO: 1572819 - DNA, 18 bp, Homo sapiens
agaagttagtttgtatat

SEQ ID NO: 1572820 - DNA, 15 bp, Homo sapiens
agaagttctttgatt

SEQ ID NO: 1572821 - DNA, 16 bp, Homo sapiens
agaagtttgtagccag

SEQ ID NO: 1572822 - DNA, 15 bp, Homo sapiens
agaataaaagaaatt

SEQ ID NO: 1572823 - DNA, 14 bp, Homo sapiens
agaataaaagctat

SEQ ID NO: 1572824 - DNA, 18 bp, Homo sapiens
agaataaaattcctatct

SEQ ID NO: 1572825 - DNA, 15 bp, Homo sapiens
agaataaaggcagtt

SEQ ID NO: 1572826 - DNA, 21 bp, Homo sapiens
agaataaaggcagttttctaa

SEQ ID NO: 1572827 - DNA, 12 bp, Homo sapiens
agaataaataaa

SEQ ID NO: 1572828 - DNA, 15 bp, Homo sapiens
agaataactacctcc

SEQ ID NO: 1572829 - DNA, 14 bp, Homo sapiens
agaataagagaaag

SEQ ID NO: 1572830 - DNA, 15 bp, Homo sapiens
agaataaggaggagg

SEQ ID NO: 1572831 - DNA, 21 bp, Homo sapiens
agaataaggaggaggagggag

SEQ ID NO: 1572832 - DNA, 22 bp, Homo sapiens
agaataaggaggaggagggaga

SEQ ID NO: 1572833 - DNA, 17 bp, Homo sapiens
agaataaggcacaaaat

SEQ ID NO: 1572834 - DNA, 20 bp, Homo sapiens
agaataatcacgctttcctg

SEQ ID NO: 1572835 - DNA, 16 bp, Homo sapiens
agaatacataaacaac

SEQ ID NO: 1572836 - DNA, 22 bp, Homo sapiens
agaatacatcagaaaataaaat

SEQ ID NO: 1572837 - DNA, 15 bp, Homo sapiens
agaatacatgtaagt

SEQ ID NO: 1572838 - DNA, 16 bp, Homo sapiens
agaataccacatcaaa

SEQ ID NO: 1572839 - DNA, 17 bp, Homo sapiens
agaataccacatcaaat

SEQ ID NO: 1572840 - DNA, 15 bp, Homo sapiens
agacaggaacccttg

SEQ ID NO: 1572841 - DNA, 14 bp, Homo sapiens
agacaggacagaat

SEQ ID NO: 1572842 - DNA, 16 bp, Homo sapiens
agacaggacagaatgt

SEQ ID NO: 1572843 - DNA, 19 bp, Homo sapiens
agacaggacagaatgtgtt

SEQ ID NO: 1572844 - DNA, 21 bp, Homo sapiens
agacaggacagtgcttcagcc

SEQ ID NO: 1572845 - DNA, 15 bp, Homo sapiens
agacaggagcctagc

SEQ ID NO: 1572846 - DNA, 16 bp, Homo sapiens
agacaggcccaagaga

SEQ ID NO: 1572847 - DNA, 21 bp, Homo sapiens
agacaggcggggcccagcgct

SEQ ID NO: 1572848 - DNA, 21 bp, Homo sapiens
agacaggctctgaggggcacg

SEQ ID NO: 1572849 - DNA, 16 bp, Homo sapiens
agacaggtggcctagc

SEQ ID NO: 1572850 - DNA, 20 bp, Homo sapiens
agacagtctgttatgcactg

SEQ ID NO: 1572851 - DNA, 12 bp, Homo sapiens
agacagtcttgc

SEQ ID NO: 1572852 - DNA, 17 bp, Homo sapiens
agacagtgatctccata

SEQ ID NO: 1572853 - DNA, 21 bp, Homo sapiens
agacagtgatctccatatgtt

SEQ ID NO: 1572854 - DNA, 17 bp, Homo sapiens
agacagtgatgcctgcc

SEQ ID NO: 1572855 - DNA, 16 bp, Homo sapiens
agacagtgccctgaga

SEQ ID NO: 1572856 - DNA, 18 bp, Homo sapiens
agacagtggatatgaccc

SEQ ID NO: 1572857 - DNA, 18 bp, Homo sapiens
agacatacgaaacacaaa

SEQ ID NO: 1572858 - DNA, 22 bp, Homo sapiens
agacatactccttccatcaaat

SEQ ID NO: 1572859 - DNA, 17 bp, Homo sapiens
agacatacttgaagggc

SEQ ID NO: 1572860 - DNA, 23 bp, Homo sapiens
agacatacttgaagggccagagc

SEQ ID NO: 1572861 - DNA, 12 bp, Homo sapiens
agacatcaatga

SEQ ID NO: 1572862 - DNA, 13 bp, Homo sapiens
agacatcaatgaa

SEQ ID NO: 1572863 - DNA, 15 bp, Homo sapiens
agacatcaatgaaac

SEQ ID NO: 1572864 - DNA, 12 bp, Homo sapiens
agacatctttaa

SEQ ID NO: 1572865 - DNA, 17 bp, Homo sapiens
agacatgaatgcacact

SEQ ID NO: 1572866 - DNA, 17 bp, Homo sapiens
agacatgctttccattt

SEQ ID NO: 1572867 - DNA, 18 bp, Homo sapiens
agacatggagactcctgc

SEQ ID NO: 1572868 - DNA, 15 bp, Homo sapiens
agacatggaggttct

SEQ ID NO: 1572869 - DNA, 21 bp, Homo sapiens
agacatggaggttctaaggcc

SEQ ID NO: 1572870 - DNA, 18 bp, Homo sapiens
agacatgggcctcccact

SEQ ID NO: 1572871 - DNA, 18 bp, Homo sapiens
agacatgtctgttctaca

SEQ ID NO: 1572872 - DNA, 20 bp, Homo sapiens
agacatgtgaggaggaaaag

SEQ ID NO: 1572873 - DNA, 21 bp, Homo sapiens
agacatgtgaggaggaaaagg

SEQ ID NO: 1572874 - DNA, 18 bp, Homo sapiens
agacatgttttccgtgaa

SEQ ID NO: 1572875 - DNA, 12 bp, Homo sapiens
agacattaaatc

SEQ ID NO: 1572876 - DNA, 15 bp, Homo sapiens
agacattaaatctat

SEQ ID NO: 1572877 - DNA, 15 bp, Homo sapiens
agacattcaatgaat

SEQ ID NO: 1572878 - DNA, 21 bp, Homo sapiens
agacattgctctatgtctgcc

SEQ ID NO: 1572879 - DNA, 22 bp, Homo sapiens
agacattgctctatgtctgcct

SEQ ID NO: 1572880 - DNA, 23 bp, Homo sapiens
agacattgctctatgtctgcctt

SEQ ID NO: 1572881 - DNA, 15 bp, Homo sapiens
agacatttatactct

SEQ ID NO: 1572882 - DNA, 17 bp, Homo sapiens
agacatttatactcttt

SEQ ID NO: 1572883 - DNA, 22 bp, Homo sapiens
agacatttgctgaactcagcac

SEQ ID NO: 1572884 - DNA, 23 bp, Homo sapiens
agacatttgctgaactcagcaca

SEQ ID NO: 1572885 - DNA, 22 bp, Homo sapiens
agacatttgtaaatgtaaaact

SEQ ID NO: 1572886 - DNA, 14 bp, Homo sapiens
agacatttgtatat

SEQ ID NO: 1572887 - DNA, 14 bp, Homo sapiens
agacattttaagtt

SEQ ID NO: 1572888 - DNA, 19 bp, Homo sapiens
agacattttcactggaaga

SEQ ID NO: 1572889 - DNA, 15 bp, Homo sapiens
agacattttgtgtga

SEQ ID NO: 1572890 - DNA, 17 bp, Homo sapiens
agacatttttatttagt

SEQ ID NO: 1572891 - DNA, 23 bp, Homo sapiens
agacattttttgctataatcatt

SEQ ID NO: 1572892 - DNA, 17 bp, Homo sapiens
agaccaaaatgacaatg

SEQ ID NO: 1572893 - DNA, 18 bp, Homo sapiens
agaccaaaatgacaatga

SEQ ID NO: 1572894 - DNA, 11 bp, Homo sapiens
agaccaaagca

SEQ ID NO: 1572895 - DNA, 19 bp, Homo sapiens
agaccaaagcaaagaaaat

SEQ ID NO: 1572896 - DNA, 17 bp, Homo sapiens
agaccaaaggaaggaac

SEQ ID NO: 1572897 - DNA, 24 bp, Homo sapiens
agaccaaatctcagttgtttgctt

SEQ ID NO: 1572898 - DNA, 13 bp, Homo sapiens
agaccaagcttgt

SEQ ID NO: 1572899 - DNA, 17 bp, Homo sapiens
agaccaaggcgggagca

SEQ ID NO: 1572900 - DNA, 22 bp, Homo sapiens
agaccaataaatttgtaacttt

SEQ ID NO: 1572901 - DNA, 23 bp, Homo sapiens
agaccacatctttatctgttctt

SEQ ID NO: 1572902 - DNA, 17 bp, Homo sapiens
agaccacctgcttctga

SEQ ID NO: 1572903 - DNA, 22 bp, Homo sapiens
agaccacctgcttctgaactca

SEQ ID NO: 1572904 - DNA, 20 bp, Homo sapiens
agaccacgcccgtcctgcct

SEQ ID NO: 1572905 - DNA, 23 bp, Homo sapiens
agaccactgtctccacccacctt

SEQ ID NO: 1572906 - DNA, 12 bp, Homo sapiens
agaccagaaatt

SEQ ID NO: 1572907 - DNA, 15 bp, Homo sapiens
agaccagagctgtct

SEQ ID NO: 1572908 - DNA, 15 bp, Homo sapiens
agaccagcctggcca

SEQ ID NO: 1572909 - DNA, 15 bp, Homo sapiens
agaccagctcagagg

SEQ ID NO: 1572910 - DNA, 16 bp, Homo sapiens
agaccaggctgcagcc

SEQ ID NO: 1572911 - DNA, 20 bp, Homo sapiens
agaccaggctgcagcctcca

SEQ ID NO: 1572912 - DNA, 18 bp, Homo sapiens
agaccagggctccagccc

SEQ ID NO: 1572913 - DNA, 18 bp, Homo sapiens
agaccagggcttttccca

SEQ ID NO: 1572914 - DNA, 18 bp, Homo sapiens
agaccagttgggagcact

SEQ ID NO: 1572915 - DNA, 13 bp, Homo sapiens
agaccatcctggc

SEQ ID NO: 1572916 - DNA, 14 bp, Homo sapiens
agaccatcctggcc

SEQ ID NO: 1572917 - DNA, 18 bp, Homo sapiens
agaccatcctggcccctc

SEQ ID NO: 1572918 - DNA, 20 bp, Homo sapiens
agaccatcctggcccctcca

SEQ ID NO: 1572919 - DNA, 14 bp, Homo sapiens
agaccatcctggct

SEQ ID NO: 1572920 - DNA, 15 bp, Homo sapiens
agaccatcctggcta

SEQ ID NO: 1572921 - DNA, 16 bp, Homo sapiens
agaccatgaagtaaat

SEQ ID NO: 1572922 - DNA, 15 bp, Homo sapiens
agacccaaaccccca

SEQ ID NO: 1572923 - DNA, 22 bp, Homo sapiens
agacccaaagcggtccctgtcc

SEQ ID NO: 1572924 - DNA, 14 bp, Homo sapiens
agacccaaggagga

SEQ ID NO: 1572925 - DNA, 16 bp, Homo sapiens
agacccaaggaggaaa

SEQ ID NO: 1572926 - DNA, 21 bp, Homo sapiens
agacccactgaaatgaccaag

SEQ ID NO: 1572927 - DNA, 17 bp, Homo sapiens
agacccagatctcatgg

SEQ ID NO: 1572928 - DNA, 13 bp, Homo sapiens
agacccagcagga

SEQ ID NO: 1572929 - DNA, 16 bp, Homo sapiens
agacccagcaggaagc

SEQ ID NO: 1572930 - DNA, 16 bp, Homo sapiens
agacccagtgcactcc

SEQ ID NO: 1572931 - DNA, 15 bp, Homo sapiens
agacccatagcagct

SEQ ID NO: 1572932 - DNA, 12 bp, Homo sapiens
agaccccaccca

SEQ ID NO: 1572933 - DNA, 15 bp, Homo sapiens
agacccccacacctc

SEQ ID NO: 1572934 - DNA, 12 bp, Homo sapiens
agacccccaggc

SEQ ID NO: 1572935 - DNA, 13 bp, Homo sapiens
agacccccaggcc

SEQ ID NO: 1572936 - DNA, 13 bp, Homo sapiens
agacccccatcca

SEQ ID NO: 1572937 - DNA, 13 bp, Homo sapiens
agacccccccatt

SEQ ID NO: 1572938 - DNA, 20 bp, Homo sapiens
agacccccccatttcccgca

SEQ ID NO: 1572939 - DNA, 17 bp, Homo sapiens
agaccccgcacccggct

SEQ ID NO: 1572940 - DNA, 21 bp, Homo sapiens
agaccccggcttcctttccca

SEQ ID NO: 1572941 - DNA, 22 bp, Homo sapiens
agaccccgggtctccttggctg

SEQ ID NO: 1572942 - DNA, 13 bp, Homo sapiens
agacccctcccct

SEQ ID NO: 1572943 - DNA, 14 bp, Homo sapiens
agacccctctggcc

SEQ ID NO: 1572944 - DNA, 21 bp, Homo sapiens
agacccctctggccaggatgg

SEQ ID NO: 1572945 - DNA, 22 bp, Homo sapiens
agacccctctggccaggatgga

SEQ ID NO: 1572946 - DNA, 13 bp, Homo sapiens
agacccctgcctg

SEQ ID NO: 1572947 - DNA, 21 bp, Homo sapiens
agacccctggcttttcactgc

SEQ ID NO: 1572948 - DNA, 13 bp, Homo sapiens
agacccctgggag

SEQ ID NO: 1572949 - DNA, 14 bp, Homo sapiens
agacccctgtctcc

SEQ ID NO: 1572950 - DNA, 14 bp, Homo sapiens
agacccgccaggtc

SEQ ID NO: 1572951 - DNA, 21 bp, Homo sapiens
agacccgggaaggaaggctct

SEQ ID NO: 1572952 - DNA, 22 bp, Homo sapiens
agacccgggaaggaaggctctc

SEQ ID NO: 1572953 - DNA, 17 bp, Homo sapiens
agaccctaaacatccat

SEQ ID NO: 1572954 - DNA, 18 bp, Homo sapiens
agaccctaccccaccacg

SEQ ID NO: 1572955 - DNA, 15 bp, Homo sapiens
agaccctccccacag

SEQ ID NO: 1572956 - DNA, 14 bp, Homo sapiens
agaccctcgtggcc

SEQ ID NO: 1572957 - DNA, 15 bp, Homo sapiens
agaccctcttgccca

SEQ ID NO: 1572958 - DNA, 17 bp, Homo sapiens
agaccctctttcttgtt

SEQ ID NO: 1572959 - DNA, 18 bp, Homo sapiens
agaccctctttcttgttt

SEQ ID NO: 1572960 - DNA, 13 bp, Homo sapiens
agaccctgcctga

SEQ ID NO: 1572961 - DNA, 20 bp, Homo sapiens
agaccctggaattcagcacc

SEQ ID NO: 1572962 - DNA, 20 bp, Homo sapiens
agaccctgggcaaacagagc

SEQ ID NO: 1572963 - DNA, 19 bp, Homo sapiens
agaccctgggtgggctctg

SEQ ID NO: 1572964 - DNA, 20 bp, Homo sapiens
agaccctgggtgggctctgt

SEQ ID NO: 1572965 - DNA, 12 bp, Homo sapiens
agaccctgtctc

SEQ ID NO: 1572966 - DNA, 13 bp, Homo sapiens
agaccctgtctca

SEQ ID NO: 1572967 - DNA, 22 bp, Homo sapiens
agacccttattgctgtcctgga

SEQ ID NO: 1572968 - DNA, 12 bp, Homo sapiens
agaccgccccag

SEQ ID NO: 1572969 - DNA, 16 bp, Homo sapiens
agaccgccccagggct

SEQ ID NO: 1572970 - DNA, 21 bp, Homo sapiens
agaccgcttcacccctgcact

SEQ ID NO: 1572971 - DNA, 18 bp, Homo sapiens
agacctacagacctggct

SEQ ID NO: 1572972 - DNA, 16 bp, Homo sapiens
agacctactgttctaa

SEQ ID NO: 1572973 - DNA, 18 bp, Homo sapiens
agacctactgttctaaag

SEQ ID NO: 1572974 - DNA, 21 bp, Homo sapiens
agacctactgttctaaagctc

SEQ ID NO: 1572975 - DNA, 22 bp, Homo sapiens
agacctactgttctaaagctct

SEQ ID NO: 1572976 - DNA, 16 bp, Homo sapiens
agacctatgtaagaat

SEQ ID NO: 1572977 - DNA, 14 bp, Homo sapiens
agacctcagccatg

SEQ ID NO: 1572978 - DNA, 17 bp, Homo sapiens
agacctcagcctgtgct

SEQ ID NO: 1572979 - DNA, 20 bp, Homo sapiens
agacctcatgcccagctctc

SEQ ID NO: 1572980 - DNA, 22 bp, Homo sapiens
agacctcatgcccagctctctg

SEQ ID NO: 1572981 - DNA, 16 bp, Homo sapiens
agacctcgagcagatg

SEQ ID NO: 1572982 - DNA, 20 bp, Homo sapiens
agacctctggttaatttata

SEQ ID NO: 1572983 - DNA, 16 bp, Homo sapiens
agacctgatcctggag

SEQ ID NO: 1572984 - DNA, 21 bp, Homo sapiens
agacctgatcctggaggccca

SEQ ID NO: 1572985 - DNA, 22 bp, Homo sapiens
agacctgatcctggaggcccag

SEQ ID NO: 1572986 - DNA, 16 bp, Homo sapiens
agacctgccctctctg

SEQ ID NO: 1572987 - DNA, 15 bp, Homo sapiens
agacctgcctgtgtg

SEQ ID NO: 1572988 - DNA, 23 bp, Homo sapiens
agacctgctctccggcgcagaca

SEQ ID NO: 1572989 - DNA, 20 bp, Homo sapiens
agacctgctgagggaccagc

SEQ ID NO: 1572990 - DNA, 20 bp, Homo sapiens
agacctggaagaacaggcct

SEQ ID NO: 1572991 - DNA, 21 bp, Homo sapiens
agacctggaagaacaggcctc

SEQ ID NO: 1572992 - DNA, 17 bp, Homo sapiens
agacctggcagctctgg

SEQ ID NO: 1572993 - DNA, 23 bp, Homo sapiens
agacctggcagctctggacagcc

SEQ ID NO: 1572994 - DNA, 17 bp, Homo sapiens
agacctggctctcagag

SEQ ID NO: 1572995 - DNA, 20 bp, Homo sapiens
agacctggctctcagaggaa

SEQ ID NO: 1572996 - DNA, 13 bp, Homo sapiens
agacctgtaatca

SEQ ID NO: 1572997 - DNA, 15 bp, Homo sapiens
agacctgtcaccctg

SEQ ID NO: 1572998 - DNA, 12 bp, Homo sapiens
agacctgtgcta

SEQ ID NO: 1572999 - DNA, 22 bp, Homo sapiens
agacctgtgctagttttacaga

SEQ ID NO: 1573000 - DNA, 22 bp, Homo sapiens
agaccttccataatgctactgt

SEQ ID NO: 1573001 - DNA, 16 bp, Homo sapiens
agaccttctccaaatg

SEQ ID NO: 1573002 - DNA, 19 bp, Homo sapiens
agaccttgttacttctgag

SEQ ID NO: 1573003 - DNA, 12 bp, Homo sapiens
agacgaggggca

SEQ ID NO: 1573004 - DNA, 15 bp, Homo sapiens
agacgcaccatgtgg

SEQ ID NO: 1573005 - DNA, 19 bp, Homo sapiens
agacgcatagactgaggta

SEQ ID NO: 1573006 - DNA, 13 bp, Homo sapiens
agacgcccctccc

SEQ ID NO: 1573007 - DNA, 16 bp, Homo sapiens
agacggaagtaaatta

SEQ ID NO: 1573008 - DNA, 18 bp, Homo sapiens
agacggaagtaaattatg

SEQ ID NO: 1573009 - DNA, 17 bp, Homo sapiens
agacggaggaggggaag

SEQ ID NO: 1573010 - DNA, 23 bp, Homo sapiens
agacggagtcttgctctgtagcc

SEQ ID NO: 1573011 - DNA, 14 bp, Homo sapiens
agacggattgcatt

SEQ ID NO: 1573012 - DNA, 14 bp, Homo sapiens
agacggcggccagg

SEQ ID NO: 1573013 - DNA, 20 bp, Homo sapiens
agacggcggccaggcacagg

SEQ ID NO: 1573014 - DNA, 22 bp, Homo sapiens
agacggcggccaggcacagggc

SEQ ID NO: 1573015 - DNA, 13 bp, Homo sapiens
agacgggcacaga

SEQ ID NO: 1573016 - DNA, 16 bp, Homo sapiens
agacggggcctcacta

SEQ ID NO: 1573017 - DNA, 21 bp, Homo sapiens
agacggtgttttgccatgttg

SEQ ID NO: 1573018 - DNA, 16 bp, Homo sapiens
agacggtttccaggga

SEQ ID NO: 1573019 - DNA, 18 bp, Homo sapiens
agacgtggactcctcttg

SEQ ID NO: 1573020 - DNA, 21 bp, Homo sapiens
agacgtttataaacagaaatg

SEQ ID NO: 1573021 - DNA, 16 bp, Homo sapiens
agactaaaaatacacc

SEQ ID NO: 1573022 - DNA, 13 bp, Homo sapiens
agactaagccctg

SEQ ID NO: 1573023 - DNA, 14 bp, Homo sapiens
agactagaattcta

SEQ ID NO: 1573024 - DNA, 23 bp, Homo sapiens
agactagaattctagtgctgctg

SEQ ID NO: 1573025 - DNA, 14 bp, Homo sapiens
agactagatgtagt

SEQ ID NO: 1573026 - DNA, 23 bp, Homo sapiens
agactagatgtagtattttttgt

SEQ ID NO: 1573027 - DNA, 17 bp, Homo sapiens
agactagcaatctcttc

SEQ ID NO: 1573028 - DNA, 21 bp, Homo sapiens
agactagtgccgtagggagta

SEQ ID NO: 1573029 - DNA, 22 bp, Homo sapiens
agactagtttttattccttgtg

SEQ ID NO: 1573030 - DNA, 21 bp, Homo sapiens
agactatatatataaatgtat

SEQ ID NO: 1573031 - DNA, 15 bp, Homo sapiens
agactatctaaatgt

SEQ ID NO: 1573032 - DNA, 19 bp, Homo sapiens
agactatctaaatgttgaa

SEQ ID NO: 1573033 - DNA, 16 bp, Homo sapiens
agactatggagcctgg

SEQ ID NO: 1573034 - DNA, 20 bp, Homo sapiens
agactatggagcctggcaca

SEQ ID NO: 1573035 - DNA, 15 bp, Homo sapiens
agactattcaaacag

SEQ ID NO: 1573036 - DNA, 19 bp, Homo sapiens
agactattccttttctgta

SEQ ID NO: 1573037 - DNA, 17 bp, Homo sapiens
agactatttcaaaatgt

SEQ ID NO: 1573038 - DNA, 19 bp, Homo sapiens
agactatttcaaaatgtcc

SEQ ID NO: 1573039 - DNA, 23 bp, Homo sapiens
agactatttcaaaatgtccagat

SEQ ID NO: 1573040 - DNA, 15 bp, Homo sapiens
agactatttgctaat

SEQ ID NO: 1573041 - DNA, 14 bp, Homo sapiens
agactatttgctta

SEQ ID NO: 1573042 - DNA, 21 bp, Homo sapiens
agactatttttagattttctt

SEQ ID NO: 1573043 - DNA, 15 bp, Homo sapiens
agactcaaaacctgg

SEQ ID NO: 1573044 - DNA, 19 bp, Homo sapiens
agactcaaaacctggagat

SEQ ID NO: 1573045 - DNA, 19 bp, Homo sapiens
agactcaaacggaggaagc

SEQ ID NO: 1573046 - DNA, 17 bp, Homo sapiens
agactcaaatgttctaa

SEQ ID NO: 1573047 - DNA, 23 bp, Homo sapiens
agactcaaatgttctaagtttct

SEQ ID NO: 1573048 - DNA, 23 bp, Homo sapiens
agactcaagtacccattctgttt

SEQ ID NO: 1573049 - DNA, 12 bp, Homo sapiens
agactcacctct

SEQ ID NO: 1573050 - DNA, 18 bp, Homo sapiens
agactcacctctgcctca

SEQ ID NO: 1573051 - DNA, 17 bp, Homo sapiens
agactcagagctctctc

SEQ ID NO: 1573052 - DNA, 18 bp, Homo sapiens
agactcagagctctctct

SEQ ID NO: 1573053 - DNA, 18 bp, Homo sapiens
agactcaggagtctgcca

SEQ ID NO: 1573054 - DNA, 12 bp, Homo sapiens
agactcagggcc

SEQ ID NO: 1573055 - DNA, 17 bp, Homo sapiens
agactcagggccccagc

SEQ ID NO: 1573056 - DNA, 13 bp, Homo sapiens
agactcaggttcc

SEQ ID NO: 1573057 - DNA, 17 bp, Homo sapiens
agactcaggttccagaa

SEQ ID NO: 1573058 - DNA, 12 bp, Homo sapiens
agactcagtgtt

SEQ ID NO: 1573059 - DNA, 16 bp, Homo sapiens
agactcagtttgtcag

SEQ ID NO: 1573060 - DNA, 16 bp, Homo sapiens
agactcatcttactgt

SEQ ID NO: 1573061 - DNA, 18 bp, Homo sapiens
agactcatcttactgtac

SEQ ID NO: 1573062 - DNA, 19 bp, Homo sapiens
agactccaaagaaatgtaa

SEQ ID NO: 1573063 - DNA, 22 bp, Homo sapiens
agactccaaagaaatgtaaggg

SEQ ID NO: 1573064 - DNA, 20 bp, Homo sapiens
agactccaatggggccagca

SEQ ID NO: 1573065 - DNA, 19 bp, Homo sapiens
agactcccattcctgaaga

SEQ ID NO: 1573066 - DNA, 23 bp, Homo sapiens
agactcccattcctgaagaacca

SEQ ID NO: 1573067 - DNA, 14 bp, Homo sapiens
agactccctccata

SEQ ID NO: 1573068 - DNA, 19 bp, Homo sapiens
agactccctgatcccagac

SEQ ID NO: 1573069 - DNA, 16 bp, Homo sapiens
agactccgccctcctc

SEQ ID NO: 1573070 - DNA, 18 bp, Homo sapiens
agactccttcgtccccag

SEQ ID NO: 1573071 - DNA, 18 bp, Homo sapiens
agactccttgtggactgg

SEQ ID NO: 1573072 - DNA, 14 bp, Homo sapiens
agactcgagaactt

SEQ ID NO: 1573073 - DNA, 13 bp, Homo sapiens
agactctagaaaa

SEQ ID NO: 1573074 - DNA, 22 bp, Homo sapiens
agactctagaaaaaagggctga

SEQ ID NO: 1573075 - DNA, 15 bp, Homo sapiens
agactctagtattta

SEQ ID NO: 1573076 - DNA, 13 bp, Homo sapiens
agactctctctgg

SEQ ID NO: 1573077 - DNA, 16 bp, Homo sapiens
agactctgaaatctca

SEQ ID NO: 1573078 - DNA, 13 bp, Homo sapiens
agactctggaggt

SEQ ID NO: 1573079 - DNA, 18 bp, Homo sapiens
agactcttgcctgtttcc

SEQ ID NO: 1573080 - DNA, 22 bp, Homo sapiens
agactctttgggtccattcaga

SEQ ID NO: 1573081 - DNA, 21 bp, Homo sapiens
agactctttttttgagtgaca

SEQ ID NO: 1573082 - DNA, 16 bp, Homo sapiens
agactgaacatgttta

SEQ ID NO: 1573083 - DNA, 16 bp, Homo sapiens
agactgaactgtgtga

SEQ ID NO: 1573084 - DNA, 17 bp, Homo sapiens
agactgagcagccgcca

SEQ ID NO: 1573085 - DNA, 13 bp, Homo sapiens
agactgagctctc

SEQ ID NO: 1573086 - DNA, 15 bp, Homo sapiens
agactgagctctcca

SEQ ID NO: 1573087 - DNA, 19 bp, Homo sapiens
agactgaggtataaagaca

SEQ ID NO: 1573088 - DNA, 18 bp, Homo sapiens
agactgagtcagatgggt

SEQ ID NO: 1573089 - DNA, 23 bp, Homo sapiens
agactgataacaaccttttacat

SEQ ID NO: 1573090 - DNA, 11 bp, Homo sapiens
agactgatctc

SEQ ID NO: 1573091 - DNA, 20 bp, Homo sapiens
agactgattggaattctttc

SEQ ID NO: 1573092 - DNA, 21 bp, Homo sapiens
agactgcagaggggaaagact

SEQ ID NO: 1573093 - DNA, 14 bp, Homo sapiens
agactgcagctgct

SEQ ID NO: 1573094 - DNA, 15 bp, Homo sapiens
agactgcagctgctg

SEQ ID NO: 1573095 - DNA, 16 bp, Homo sapiens
agactgcagctgctga

SEQ ID NO: 1573096 - DNA, 12 bp, Homo sapiens
agactgcatctc

SEQ ID NO: 1573097 - DNA, 17 bp, Homo sapiens
agactgcatctcaaaaa

SEQ ID NO: 1573098 - DNA, 14 bp, Homo sapiens
agactgccaggtgg

SEQ ID NO: 1573099 - DNA, 14 bp, Homo sapiens
agactgccatacat

SEQ ID NO: 1573100 - DNA, 21 bp, Homo sapiens
agactgccccacggccctgtc

SEQ ID NO: 1573101 - DNA, 22 bp, Homo sapiens
agactgcgggatggtcctgggg

SEQ ID NO: 1573102 - DNA, 20 bp, Homo sapiens
agactgctgggactggccag

SEQ ID NO: 1573103 - DNA, 14 bp, Homo sapiens
agactgcttcccat

SEQ ID NO: 1573104 - DNA, 20 bp, Homo sapiens
agactggaccgctgactgca

SEQ ID NO: 1573105 - DNA, 14 bp, Homo sapiens
agactggagtgagg

SEQ ID NO: 1573106 - DNA, 16 bp, Homo sapiens
agactggagtgaggct

SEQ ID NO: 1573107 - DNA, 21 bp, Homo sapiens
agactggagtgaggcttccag

SEQ ID NO: 1573108 - DNA, 14 bp, Homo sapiens
agactggcacagtt

SEQ ID NO: 1573109 - DNA, 20 bp, Homo sapiens
agactggcacagttttctga

SEQ ID NO: 1573110 - DNA, 21 bp, Homo sapiens
agactgggaagataggctctg

SEQ ID NO: 1573111 - DNA, 22 bp, Homo sapiens
agactgggaagataggctctgc

SEQ ID NO: 1573112 - DNA, 16 bp, Homo sapiens
agactgggcccaggca

SEQ ID NO: 1573113 - DNA, 23 bp, Homo sapiens
agactgggcccaggcaggtctgc

SEQ ID NO: 1573114 - DNA, 22 bp, Homo sapiens
agactgggtaggaaagaggaag

SEQ ID NO: 1573115 - DNA, 22 bp, Homo sapiens
agactggtctcgaactcctggc

SEQ ID NO: 1573116 - DNA, 22 bp, Homo sapiens
agactggtttatccacccacaa

SEQ ID NO: 1573117 - DNA, 14 bp, Homo sapiens
agactgtacaaagt

SEQ ID NO: 1573118 - DNA, 15 bp, Homo sapiens
agactgtacaaagta

SEQ ID NO: 1573119 - DNA, 17 bp, Homo sapiens
agactgtcattgcccct

SEQ ID NO: 1573120 - DNA, 19 bp, Homo sapiens
agactgtcattgcccctcc

SEQ ID NO: 1573121 - DNA, 19 bp, Homo sapiens
agactgtgaggcggcagct

SEQ ID NO: 1573122 - DNA, 20 bp, Homo sapiens
agactgtgaggcggcagctg

SEQ ID NO: 1573123 - DNA, 22 bp, Homo sapiens
agactgtgaggcggcagctggg

SEQ ID NO: 1573124 - DNA, 14 bp, Homo sapiens
agactgtggctgct

SEQ ID NO: 1573125 - DNA, 17 bp, Homo sapiens
agactgtggtaggggca

SEQ ID NO: 1573126 - DNA, 20 bp, Homo sapiens
agactgtggtaggggcaggg

SEQ ID NO: 1573127 - DNA, 17 bp, Homo sapiens
agactgtgtttggtcct

SEQ ID NO: 1573128 - DNA, 15 bp, Homo sapiens
agactgttactttgg

SEQ ID NO: 1573129 - DNA, 21 bp, Homo sapiens
agactgttttactgttttaat

SEQ ID NO: 1573130 - DNA, 16 bp, Homo sapiens
agacttaaaacatggt

SEQ ID NO: 1573131 - DNA, 17 bp, Homo sapiens
agacttaaaacatggtg

SEQ ID NO: 1573132 - DNA, 15 bp, Homo sapiens
agacttaattctgat

SEQ ID NO: 1573133 - DNA, 17 bp, Homo sapiens
agacttagggcaccagg

SEQ ID NO: 1573134 - DNA, 20 bp, Homo sapiens
agacttatagtcctcctgga

SEQ ID NO: 1573135 - DNA, 17 bp, Homo sapiens
agacttcccactgttct

SEQ ID NO: 1573136 - DNA, 14 bp, Homo sapiens
agacttcccagcta

SEQ ID NO: 1573137 - DNA, 14 bp, Homo sapiens
agacttcccagctt

SEQ ID NO: 1573138 - DNA, 18 bp, Homo sapiens
agacttcccagcttctgc

SEQ ID NO: 1573139 - DNA, 15 bp, Homo sapiens
agacttccccatccc

SEQ ID NO: 1573140 - DNA, 20 bp, Homo sapiens
agacttccccatcccgaagc

SEQ ID NO: 1573141 - DNA, 19 bp, Homo sapiens
agacttccctgaatgtatt

SEQ ID NO: 1573142 - DNA, 14 bp, Homo sapiens
agacttccttgaga

SEQ ID NO: 1573143 - DNA, 16 bp, Homo sapiens
agacttccttgagaca

SEQ ID NO: 1573144 - DNA, 22 bp, Homo sapiens
agacttcctttataatatttca

SEQ ID NO: 1573145 - DNA, 16 bp, Homo sapiens
agacttcgactcagga

SEQ ID NO: 1573146 - DNA, 18 bp, Homo sapiens
agacttctggaaggctgg

SEQ ID NO: 1573147 - DNA, 16 bp, Homo sapiens
agacttgcactgaagc

SEQ ID NO: 1573148 - DNA, 16 bp, Homo sapiens
agacttgccagagccg

SEQ ID NO: 1573149 - DNA, 14 bp, Homo sapiens
agacttgccaggct

SEQ ID NO: 1573150 - DNA, 16 bp, Homo sapiens
agacttgcttcctgca

SEQ ID NO: 1573151 - DNA, 13 bp, Homo sapiens
agacttggagctg

SEQ ID NO: 1573152 - DNA, 17 bp, Homo sapiens
agacttgtgctcaagga

SEQ ID NO: 1573153 - DNA, 12 bp, Homo sapiens
agactttagaaa

SEQ ID NO: 1573154 - DNA, 18 bp, Homo sapiens
agactttagaaataaatg

SEQ ID NO: 1573155 - DNA, 16 bp, Homo sapiens
agactttataattcct

SEQ ID NO: 1573156 - DNA, 16 bp, Homo sapiens
agactttatgtagttt

SEQ ID NO: 1573157 - DNA, 16 bp, Homo sapiens
agactttcccctctcg

SEQ ID NO: 1573158 - DNA, 16 bp, Homo sapiens
agactttctgttacta

SEQ ID NO: 1573159 - DNA, 17 bp, Homo sapiens
agacttttattaataaa

SEQ ID NO: 1573160 - DNA, 18 bp, Homo sapiens
agacttttattaataaaa

SEQ ID NO: 1573161 - DNA, 19 bp, Homo sapiens
agacttttccaatatgtga

SEQ ID NO: 1573162 - DNA, 21 bp, Homo sapiens
agacttttccaatatgtgatt

SEQ ID NO: 1573163 - DNA, 23 bp, Homo sapiens
agacttttgaaaaaaaagttttt

SEQ ID NO: 1573164 - DNA, 17 bp, Homo sapiens
agacttttggtagagaa

SEQ ID NO: 1573165 - DNA, 21 bp, Homo sapiens
agagaaaaaaaggaaaagaag

SEQ ID NO: 1573166 - DNA, 17 bp, Homo sapiens
agagaaaaaagaagtgt

SEQ ID NO: 1573167 - DNA, 14 bp, Homo sapiens
agagaaaaagaaat

SEQ ID NO: 1573168 - DNA, 20 bp, Homo sapiens
agagaaaatgagaaaggaca

SEQ ID NO: 1573169 - DNA, 20 bp, Homo sapiens
agagaaaatgtaaaggaggg

SEQ ID NO: 1573170 - DNA, 16 bp, Homo sapiens
agagaaacttcaaagt

SEQ ID NO: 1573171 - DNA, 15 bp, Homo sapiens
agagaaagagagaag

SEQ ID NO: 1573172 - DNA, 17 bp, Homo sapiens
agagaaagagagaagcc

SEQ ID NO: 1573173 - DNA, 20 bp, Homo sapiens
agagaaagagagaagccagc

SEQ ID NO: 1573174 - DNA, 14 bp, Homo sapiens
agagaaagaggcca

SEQ ID NO: 1573175 - DNA, 18 bp, Homo sapiens
agagaaatattttaattt

SEQ ID NO: 1573176 - DNA, 18 bp, Homo sapiens
agagaaatcagctgctat

SEQ ID NO: 1573177 - DNA, 13 bp, Homo sapiens
agagaaattagaa

SEQ ID NO: 1573178 - DNA, 20 bp, Homo sapiens
agagaaccaccactgcctga

SEQ ID NO: 1573179 - DNA, 17 bp, Homo sapiens
agagaaccgagcaaaga

SEQ ID NO: 1573180 - DNA, 20 bp, Homo sapiens
agagaaccgagcaaagatca

SEQ ID NO: 1573181 - DNA, 23 bp, Homo sapiens
agagaacctcaggtacggagaag

SEQ ID NO: 1573182 - DNA, 22 bp, Homo sapiens
agagaactcgcgctcagtaaac

SEQ ID NO: 1573183 - DNA, 14 bp, Homo sapiens
agagaactgtggcc

SEQ ID NO: 1573184 - DNA, 12 bp, Homo sapiens
agagaagccagc

SEQ ID NO: 1573185 - DNA, 13 bp, Homo sapiens
agagaagccagcc

SEQ ID NO: 1573186 - DNA, 14 bp, Homo sapiens
agagaagccagcca

SEQ ID NO: 1573187 - DNA, 15 bp, Homo sapiens
agagaagccagccac

SEQ ID NO: 1573188 - DNA, 15 bp, Homo sapiens
agagaagctcctgct

SEQ ID NO: 1573189 - DNA, 12 bp, Homo sapiens
agagaagctgct

SEQ ID NO: 1573190 - DNA, 16 bp, Homo sapiens
agagaaggaaaagact

SEQ ID NO: 1573191 - DNA, 13 bp, Homo sapiens
agagaaggcacac

SEQ ID NO: 1573192 - DNA, 14 bp, Homo sapiens
agagaaggcagcag

SEQ ID NO: 1573193 - DNA, 22 bp, Homo sapiens
agagaaggcccataccttctgg

SEQ ID NO: 1573194 - DNA, 20 bp, Homo sapiens
agagaaggcctcttgtgctc

SEQ ID NO: 1573195 - DNA, 19 bp, Homo sapiens
agagaaggcctttaataaa

SEQ ID NO: 1573196 - DNA, 15 bp, Homo sapiens
agagaagtctcattc

SEQ ID NO: 1573197 - DNA, 20 bp, Homo sapiens
agagaagtttgtagccaggt

SEQ ID NO: 1573198 - DNA, 23 bp, Homo sapiens
agagaagtttgtagccaggtact

SEQ ID NO: 1573199 - DNA, 21 bp, Homo sapiens
agagaatagagctgccactgg

SEQ ID NO: 1573200 - DNA, 13 bp, Homo sapiens
agagaatctgcct

SEQ ID NO: 1573201 - DNA, 17 bp, Homo sapiens
agagaatgagagcgaca

SEQ ID NO: 1573202 - DNA, 19 bp, Homo sapiens
agagaatgagagcgacaca

SEQ ID NO: 1573203 - DNA, 16 bp, Homo sapiens
agagaatgtattctgt

SEQ ID NO: 1573204 - DNA, 18 bp, Homo sapiens
agagaatgtgtttcaaaa

SEQ ID NO: 1573205 - DNA, 17 bp, Homo sapiens
agagaattagacaaatt

SEQ ID NO: 1573206 - DNA, 19 bp, Homo sapiens
agagaattgtttgaacccg

SEQ ID NO: 1573207 - DNA, 15 bp, Homo sapiens
agagacaaagatttc

SEQ ID NO: 1573208 - DNA, 22 bp, Homo sapiens
agagacaagaaaggcagacaca

SEQ ID NO: 1573209 - DNA, 19 bp, Homo sapiens
agagacaagtaatttcagt

SEQ ID NO: 1573210 - DNA, 15 bp, Homo sapiens
agagacacaaaagat

SEQ ID NO: 1573211 - DNA, 22 bp, Homo sapiens
agagacacatacagagtgggcc

SEQ ID NO: 1573212 - DNA, 18 bp, Homo sapiens
agagacaccaaactgcca

SEQ ID NO: 1573213 - DNA, 16 bp, Homo sapiens
agagacacctgcacct

SEQ ID NO: 1573214 - DNA, 19 bp, Homo sapiens
agagacagacttgagaact

SEQ ID NO: 1573215 - DNA, 15 bp, Homo sapiens
agagacagcccagga

SEQ ID NO: 1573216 - DNA, 21 bp, Homo sapiens
agagacagctacacagagctt

SEQ ID NO: 1573217 - DNA, 13 bp, Homo sapiens
agagacaggaaaa

SEQ ID NO: 1573218 - DNA, 15 bp, Homo sapiens
agagacaggcccaag

SEQ ID NO: 1573219 - DNA, 16 bp, Homo sapiens
agagacagtgatgcct

SEQ ID NO: 1573220 - DNA, 15 bp, Homo sapiens
agagacatgggcctc

SEQ ID NO: 1573221 - DNA, 17 bp, Homo sapiens
agagacatgggcctccc

SEQ ID NO: 1573222 - DNA, 15 bp, Homo sapiens
agagaccacatgggg

SEQ ID NO: 1573223 - DNA, 15 bp, Homo sapiens
agagaccagcactca

SEQ ID NO: 1573224 - DNA, 19 bp, Homo sapiens
agagaccagggctccagcc

SEQ ID NO: 1573225 - DNA, 13 bp, Homo sapiens
agagacccaagga

SEQ ID NO: 1573226 - DNA, 14 bp, Homo sapiens
agagacccaaggag

SEQ ID NO: 1573227 - DNA, 13 bp, Homo sapiens
agagacccagctg

SEQ ID NO: 1573228 - DNA, 15 bp, Homo sapiens
agagacccccaggcc

SEQ ID NO: 1573229 - DNA, 15 bp, Homo sapiens
agagaccccgcaccc

SEQ ID NO: 1573230 - DNA, 23 bp, Homo sapiens
agagacccctcccctcccaccca

SEQ ID NO: 1573231 - DNA, 21 bp, Homo sapiens
agagaccgtcgggggctgagg

SEQ ID NO: 1573232 - DNA, 16 bp, Homo sapiens
agagacctcatcctgc

SEQ ID NO: 1573233 - DNA, 22 bp, Homo sapiens
agagacgccctatttctatgtc

SEQ ID NO: 1573234 - DNA, 19 bp, Homo sapiens
agagacggcagcctgacct

SEQ ID NO: 1573235 - DNA, 15 bp, Homo sapiens
agagacggtgttttg

SEQ ID NO: 1573236 - DNA, 18 bp, Homo sapiens
agagactatggagcctgg

SEQ ID NO: 1573237 - DNA, 22 bp, Homo sapiens
agagactatggagcctggcaca

SEQ ID NO: 1573238 - DNA, 16 bp, Homo sapiens
agagactgaaagcagc

SEQ ID NO: 1573239 - DNA, 17 bp, Homo sapiens
agagactgagcagccgc

SEQ ID NO: 1573240 - DNA, 13 bp, Homo sapiens
agagactgggaag

SEQ ID NO: 1573241 - DNA, 15 bp, Homo sapiens
agagactgtagattg

SEQ ID NO: 1573242 - DNA, 21 bp, Homo sapiens
agagactgtgaggcggcagct

SEQ ID NO: 1573243 - DNA, 16 bp, Homo sapiens
agagacttgttttgga

SEQ ID NO: 1573244 - DNA, 12 bp, Homo sapiens
agagagaaagaa

SEQ ID NO: 1573245 - DNA, 20 bp, Homo sapiens
agagagaacaactactgtga

SEQ ID NO: 1573246 - DNA, 13 bp, Homo sapiens
agagagaagcagg

SEQ ID NO: 1573247 - DNA, 17 bp, Homo sapiens
agagagaagcaggcaga

SEQ ID NO: 1573248 - DNA, 17 bp, Homo sapiens
agagagaagccagccac

SEQ ID NO: 1573249 - DNA, 18 bp, Homo sapiens
agagagaagccagccaca

SEQ ID NO: 1573250 - DNA, 12 bp, Homo sapiens
agagagaataaa

SEQ ID NO: 1573251 - DNA, 16 bp, Homo sapiens
agagagaatagagctg

SEQ ID NO: 1573252 - DNA, 21 bp, Homo sapiens
agagagaatagagctgccact

SEQ ID NO: 1573253 - DNA, 22 bp, Homo sapiens
agagagaatagagctgccactg

SEQ ID NO: 1573254 - DNA, 14 bp, Homo sapiens
agagagaatgagag

SEQ ID NO: 1573255 - DNA, 15 bp, Homo sapiens
agagagaatgagagc

SEQ ID NO: 1573256 - DNA, 19 bp, Homo sapiens
agagagaccccgcacccgg

SEQ ID NO: 1573257 - DNA, 23 bp, Homo sapiens
agagagaccctcactgctgggga

SEQ ID NO: 1573258 - DNA, 13 bp, Homo sapiens
agagagacctcat

SEQ ID NO: 1573259 - DNA, 18 bp, Homo sapiens
agagagacctcatcctgc

SEQ ID NO: 1573260 - DNA, 20 bp, Homo sapiens
agagagacctcatcctgctc

SEQ ID NO: 1573261 - DNA, 12 bp, Homo sapiens
agagagagaaaa

SEQ ID NO: 1573262 - DNA, 13 bp, Homo sapiens
agagagagaaaga

SEQ ID NO: 1573263 - DNA, 14 bp, Homo sapiens
agagagagaccctc

SEQ ID NO: 1573264 - DNA, 13 bp, Homo sapiens
agagagagagaaa

SEQ ID NO: 1573265 - DNA, 15 bp, Homo sapiens
agagagagagagagg

SEQ ID NO: 1573266 - DNA, 15 bp, Homo sapiens
agagagagaggacag

SEQ ID NO: 1573267 - DNA, 15 bp, Homo sapiens
agagagaggctgcct

SEQ ID NO: 1573268 - DNA, 16 bp, Homo sapiens
agagagccaaatctga

SEQ ID NO: 1573269 - DNA, 13 bp, Homo sapiens
agagagccaagac

SEQ ID NO: 1573270 - DNA, 21 bp, Homo sapiens
agagagccaagacggaggagg

SEQ ID NO: 1573271 - DNA, 14 bp, Homo sapiens
agagagcctgtcac

SEQ ID NO: 1573272 - DNA, 21 bp, Homo sapiens
agagagcctgtcaccagagct

SEQ ID NO: 1573273 - DNA, 14 bp, Homo sapiens
agagagccttaact

SEQ ID NO: 1573274 - DNA, 18 bp, Homo sapiens
agagagcgagcgctaccc

SEQ ID NO: 1573275 - DNA, 19 bp, Homo sapiens
agagagctctggccccgct

SEQ ID NO: 1573276 - DNA, 13 bp, Homo sapiens
agagaggacagct

SEQ ID NO: 1573277 - DNA, 18 bp, Homo sapiens
agagaggatacatttaat

SEQ ID NO: 1573278 - DNA, 20 bp, Homo sapiens
agagaggatacatttaataa

SEQ ID NO: 1573279 - DNA, 22 bp, Homo sapiens
agagaggatacatttaataaaa

SEQ ID NO: 1573280 - DNA, 20 bp, Homo sapiens
agagaggccttttggaatgt

SEQ ID NO: 1573281 - DNA, 16 bp, Homo sapiens
agagagggacaggcac

SEQ ID NO: 1573282 - DNA, 22 bp, Homo sapiens
agagagggactcaagggaaagg

SEQ ID NO: 1573283 - DNA, 12 bp, Homo sapiens
agagagggccca

SEQ ID NO: 1573284 - DNA, 13 bp, Homo sapiens
agagagggcccag

SEQ ID NO: 1573285 - DNA, 12 bp, Homo sapiens
agagagggggct

SEQ ID NO: 1573286 - DNA, 16 bp, Homo sapiens
agagagtggctcctcc

SEQ ID NO: 1573287 - DNA, 15 bp, Homo sapiens
agagagtgtacatca

SEQ ID NO: 1573288 - DNA, 21 bp, Homo sapiens
agagagttaataggagtattt

SEQ ID NO: 1573289 - DNA, 16 bp, Homo sapiens
agagataggaaactga

SEQ ID NO: 1573290 - DNA, 16 bp, Homo sapiens
agagatcatgaattat

SEQ ID NO: 1573291 - DNA, 16 bp, Homo sapiens
agagatcgagaccatc

SEQ ID NO: 1573292 - DNA, 14 bp, Homo sapiens
agagatctacacat

SEQ ID NO: 1573293 - DNA, 13 bp, Homo sapiens
agagatctgtgtg

SEQ ID NO: 1573294 - DNA, 14 bp, Homo sapiens
agagatctgtgtgg

SEQ ID NO: 1573295 - DNA, 16 bp, Homo sapiens
agagatctgtgtggct

SEQ ID NO: 1573296 - DNA, 22 bp, Homo sapiens
agagatctgtgtggctcctggg

SEQ ID NO: 1573297 - DNA, 19 bp, Homo sapiens
agagatctttctttccaaa

SEQ ID NO: 1573298 - DNA, 19 bp, Homo sapiens
agagatgaagagtgagagg

SEQ ID NO: 1573299 - DNA, 12 bp, Homo sapiens
agagatgaatta

SEQ ID NO: 1573300 - DNA, 17 bp, Homo sapiens
agagatgagtgtctgga

SEQ ID NO: 1573301 - DNA, 12 bp, Homo sapiens
agagatgcctcc

SEQ ID NO: 1573302 - DNA, 17 bp, Homo sapiens
agagatgcctccaccgc

SEQ ID NO: 1573303 - DNA, 14 bp, Homo sapiens
agagatgcttggag

SEQ ID NO: 1573304 - DNA, 20 bp, Homo sapiens
agagatggcttacaaaaaga

SEQ ID NO: 1573305 - DNA, 13 bp, Homo sapiens
agagatgtaccaa

SEQ ID NO: 1573306 - DNA, 19 bp, Homo sapiens
agagatgtggcaaagtgct

SEQ ID NO: 1573307 - DNA, 14 bp, Homo sapiens
agagattctggatc

SEQ ID NO: 1573308 - DNA, 23 bp, Homo sapiens
agagattctgtgatcttttaaag

SEQ ID NO: 1573309 - DNA, 17 bp, Homo sapiens
agagattgtttttagag

SEQ ID NO: 1573310 - DNA, 16 bp, Homo sapiens
agagatttaattaatc

SEQ ID NO: 1573311 - DNA, 12 bp, Homo sapiens
agagatttcaag

SEQ ID NO: 1573312 - DNA, 12 bp, Homo sapiens
agagatttctca

SEQ ID NO: 1573313 - DNA, 14 bp, Homo sapiens
agagatttgtctaa

SEQ ID NO: 1573314 - DNA, 14 bp, Homo sapiens
agagattttacaaa

SEQ ID NO: 1573315 - DNA, 19 bp, Homo sapiens
agagcaaaactccgtctca

SEQ ID NO: 1573316 - DNA, 18 bp, Homo sapiens
agagcaaatgagggaggg

SEQ ID NO: 1573317 - DNA, 12 bp, Homo sapiens
agagcaagaagg

SEQ ID NO: 1573318 - DNA, 15 bp, Homo sapiens
agagcaagaaggaaa

SEQ ID NO: 1573319 - DNA, 12 bp, Homo sapiens
agagcaaggaag

SEQ ID NO: 1573320 - DNA, 17 bp, Homo sapiens
agagcaaggaaggtaaa

SEQ ID NO: 1573321 - DNA, 23 bp, Homo sapiens
agagcaaggaaggtaaaaagtta

SEQ ID NO: 1573322 - DNA, 16 bp, Homo sapiens
agagcaattccaggct

SEQ ID NO: 1573323 - DNA, 22 bp, Homo sapiens
agagcacaagaggaagagagag

SEQ ID NO: 1573324 - DNA, 15 bp, Homo sapiens
agagcacgcctgcca

SEQ ID NO: 1573325 - DNA, 22 bp, Homo sapiens
agagcacgcctgccatcttctc

SEQ ID NO: 1573326 - DNA, 22 bp, Homo sapiens
agagcagaaattctgtttttaa

SEQ ID NO: 1573327 - DNA, 16 bp, Homo sapiens
agagcagcagcaccaa

SEQ ID NO: 1573328 - DNA, 14 bp, Homo sapiens
agagcagccagcac

SEQ ID NO: 1573329 - DNA, 11 bp, Homo sapiens
agagcagcctg

SEQ ID NO: 1573330 - DNA, 16 bp, Homo sapiens
agagcagcctgatggc

SEQ ID NO: 1573331 - DNA, 18 bp, Homo sapiens
agagcagcctgatggcca

SEQ ID NO: 1573332 - DNA, 22 bp, Homo sapiens
agagcaggactccaggcccaag

SEQ ID NO: 1573333 - DNA, 23 bp, Homo sapiens
agagcaggaggcccctggcccag

SEQ ID NO: 1573334 - DNA, 13 bp, Homo sapiens
agagcaggcacat

SEQ ID NO: 1573335 - DNA, 18 bp, Homo sapiens
agagcaggcacatggagg

SEQ ID NO: 1573336 - DNA, 16 bp, Homo sapiens
agagcaggccagcccg

SEQ ID NO: 1573337 - DNA, 24 bp, Homo sapiens
agagcagggattaacctctgcact

SEQ ID NO: 1573338 - DNA, 15 bp, Homo sapiens
agagcagtgggcagg

SEQ ID NO: 1573339 - DNA, 18 bp, Homo sapiens
agagcagtgggcaggtgg

SEQ ID NO: 1573340 - DNA, 12 bp, Homo sapiens
agagcatatttg

SEQ ID NO: 1573341 - DNA, 16 bp, Homo sapiens
agagcatcgtgaccct

SEQ ID NO: 1573342 - DNA, 19 bp, Homo sapiens
agagcatctcaggaggggc

SEQ ID NO: 1573343 - DNA, 21 bp, Homo sapiens
agagcatctcaggaggggcag

SEQ ID NO: 1573344 - DNA, 15 bp, Homo sapiens
agagcattagctggc

SEQ ID NO: 1573345 - DNA, 14 bp, Homo sapiens
agagccaaatctga

SEQ ID NO: 1573346 - DNA, 19 bp, Homo sapiens
agagccaacctggacttcc

SEQ ID NO: 1573347 - DNA, 17 bp, Homo sapiens
agagccaagacggagga

SEQ ID NO: 1573348 - DNA, 21 bp, Homo sapiens
agagccaagacggaggagggg

SEQ ID NO: 1573349 - DNA, 16 bp, Homo sapiens
agagccaagttccaaa

SEQ ID NO: 1573350 - DNA, 15 bp, Homo sapiens
agagccacctgcaag

SEQ ID NO: 1573351 - DNA, 19 bp, Homo sapiens
agagccacctgcaagatgg

SEQ ID NO: 1573352 - DNA, 20 bp, Homo sapiens
agagccacctgcaagatgga

SEQ ID NO: 1573353 - DNA, 23 bp, Homo sapiens
agagccagatgcctccccaagac

SEQ ID NO: 1573354 - DNA, 13 bp, Homo sapiens
agagccagcagca

SEQ ID NO: 1573355 - DNA, 13 bp, Homo sapiens
agagccagccctc

SEQ ID NO: 1573356 - DNA, 12 bp, Homo sapiens
agagccagcctg

SEQ ID NO: 1573357 - DNA, 14 bp, Homo sapiens
agagccagcctggc

SEQ ID NO: 1573358 - DNA, 17 bp, Homo sapiens
agagccagcctggctct

SEQ ID NO: 1573359 - DNA, 20 bp, Homo sapiens
agagccagcctggctctgcc

SEQ ID NO: 1573360 - DNA, 21 bp, Homo sapiens
agagccagcctggctctgccc

SEQ ID NO: 1573361 - DNA, 22 bp, Homo sapiens
agagccagcctggctctgcccc

SEQ ID NO: 1573362 - DNA, 14 bp, Homo sapiens
agagccagcctggg

SEQ ID NO: 1573363 - DNA, 16 bp, Homo sapiens
agagccagcctgggac

SEQ ID NO: 1573364 - DNA, 19 bp, Homo sapiens
agagccagcggctccaact

SEQ ID NO: 1573365 - DNA, 20 bp, Homo sapiens
agagccatataagtttgaag

SEQ ID NO: 1573366 - DNA, 14 bp, Homo sapiens
agagccatgggcct

SEQ ID NO: 1573367 - DNA, 18 bp, Homo sapiens
agagccatgggcctgggc

SEQ ID NO: 1573368 - DNA, 13 bp, Homo sapiens
agagcccagccca

SEQ ID NO: 1573369 - DNA, 13 bp, Homo sapiens
agagcccagctcc

SEQ ID NO: 1573370 - DNA, 15 bp, Homo sapiens
agagccccagctgac

SEQ ID NO: 1573371 - DNA, 17 bp, Homo sapiens
agagcccccagccctgg

SEQ ID NO: 1573372 - DNA, 22 bp, Homo sapiens
agagcccccagccctgggaacc

SEQ ID NO: 1573373 - DNA, 19 bp, Homo sapiens
agagcccctcctccagccc

SEQ ID NO: 1573374 - DNA, 22 bp, Homo sapiens
agagcccctcctccagcccctg

SEQ ID NO: 1573375 - DNA, 14 bp, Homo sapiens
agagcccgcagggc

SEQ ID NO: 1573376 - DNA, 16 bp, Homo sapiens
agagcccgcttttgtt

SEQ ID NO: 1573377 - DNA, 13 bp, Homo sapiens
agagccctcccta

SEQ ID NO: 1573378 - DNA, 20 bp, Homo sapiens
agagccctccctaaatatac

SEQ ID NO: 1573379 - DNA, 18 bp, Homo sapiens
agagccctgaggcctaga

SEQ ID NO: 1573380 - DNA, 22 bp, Homo sapiens
agagccctgaggcctagactct

SEQ ID NO: 1573381 - DNA, 14 bp, Homo sapiens
agagccctgctgtg

SEQ ID NO: 1573382 - DNA, 16 bp, Homo sapiens
agagccctgctgtggg

SEQ ID NO: 1573383 - DNA, 19 bp, Homo sapiens
agagcccttcactgccatg

SEQ ID NO: 1573384 - DNA, 14 bp, Homo sapiens
agagcccttgcctc

SEQ ID NO: 1573385 - DNA, 22 bp, Homo sapiens
agagccgggcacattgagctgt

SEQ ID NO: 1573386 - DNA, 15 bp, Homo sapiens
agagccggtggtgcc

SEQ ID NO: 1573387 - DNA, 18 bp, Homo sapiens
agagccggtggtgcccgt

SEQ ID NO: 1573388 - DNA, 14 bp, Homo sapiens
agagcctagccacc

SEQ ID NO: 1573389 - DNA, 16 bp, Homo sapiens
agagcctagccacctc

SEQ ID NO: 1573390 - DNA, 17 bp, Homo sapiens
agagcctagccacctcc

SEQ ID NO: 1573391 - DNA, 21 bp, Homo sapiens
agagcctagccacctcccacc

SEQ ID NO: 1573392 - DNA, 21 bp, Homo sapiens
agagcctcccaccagagccgg

SEQ ID NO: 1573393 - DNA, 23 bp, Homo sapiens
agagcctcccaccagagccggga

SEQ ID NO: 1573394 - DNA, 21 bp, Homo sapiens
agagcctcggccctagcattg

SEQ ID NO: 1573395 - DNA, 13 bp, Homo sapiens
agagcctctgctg

SEQ ID NO: 1573396 - DNA, 13 bp, Homo sapiens
agagcctgctccc

SEQ ID NO: 1573397 - DNA, 15 bp, Homo sapiens
agagcctgctccccc

SEQ ID NO: 1573398 - DNA, 18 bp, Homo sapiens
agagcctgctcccccacc

SEQ ID NO: 1573399 - DNA, 15 bp, Homo sapiens
agagcctgctgcatg

SEQ ID NO: 1573400 - DNA, 16 bp, Homo sapiens
agagcctgtaaacttt

SEQ ID NO: 1573401 - DNA, 13 bp, Homo sapiens
agagcctgtcacc

SEQ ID NO: 1573402 - DNA, 13 bp, Homo sapiens
agagcctgtcttt

SEQ ID NO: 1573403 - DNA, 14 bp, Homo sapiens
agagccttcaagtg

SEQ ID NO: 1573404 - DNA, 17 bp, Homo sapiens
agagccttcaagtgcca

SEQ ID NO: 1573405 - DNA, 19 bp, Homo sapiens
agagccttgagagacccag

SEQ ID NO: 1573406 - DNA, 17 bp, Homo sapiens
agagccttggtgtccac

SEQ ID NO: 1573407 - DNA, 20 bp, Homo sapiens
agagccttggtgtccacctg

SEQ ID NO: 1573408 - DNA, 15 bp, Homo sapiens
agagcctttccaaag

SEQ ID NO: 1573409 - DNA, 15 bp, Homo sapiens
agagccttttgtgca

SEQ ID NO: 1573410 - DNA, 19 bp, Homo sapiens
agagcgagagatcaaagat

SEQ ID NO: 1573411 - DNA, 17 bp, Homo sapiens
agagcgagagtctgtct

SEQ ID NO: 1573412 - DNA, 14 bp, Homo sapiens
agagcgcacaggga

SEQ ID NO: 1573413 - DNA, 19 bp, Homo sapiens
agagcgggactctgtccaa

SEQ ID NO: 1573414 - DNA, 17 bp, Homo sapiens
agagcgtccttccccct

SEQ ID NO: 1573415 - DNA, 20 bp, Homo sapiens
agagctaaactccttcctgg

SEQ ID NO: 1573416 - DNA, 14 bp, Homo sapiens
agagctaataaatc

SEQ ID NO: 1573417 - DNA, 23 bp, Homo sapiens
agagctactgagacttggaacct

SEQ ID NO: 1573418 - DNA, 14 bp, Homo sapiens
agagctagcgctgc

SEQ ID NO: 1573419 - DNA, 16 bp, Homo sapiens
agagctagctgccact

SEQ ID NO: 1573420 - DNA, 23 bp, Homo sapiens
agagctaggcccccaaattgcct

SEQ ID NO: 1573421 - DNA, 22 bp, Homo sapiens
agagctcatcccccctgctgcc

SEQ ID NO: 1573422 - DNA, 21 bp, Homo sapiens
agagctcccctccacagctgc

SEQ ID NO: 1573423 - DNA, 13 bp, Homo sapiens
agagctctctcta

SEQ ID NO: 1573424 - DNA, 22 bp, Homo sapiens
agagctctctctacagagagga

SEQ ID NO: 1573425 - DNA, 20 bp, Homo sapiens
agagggacggccaagaatgt

SEQ ID NO: 1573426 - DNA, 14 bp, Homo sapiens
agagggactcaagg

SEQ ID NO: 1573427 - DNA, 23 bp, Homo sapiens
agagggagtttaatacaggaaat

SEQ ID NO: 1573428 - DNA, 17 bp, Homo sapiens
agagggcagtacctggg

SEQ ID NO: 1573429 - DNA, 18 bp, Homo sapiens
agagggcagtacctggga

SEQ ID NO: 1573430 - DNA, 23 bp, Homo sapiens
agagggcatgcgcacaaggctga

SEQ ID NO: 1573431 - DNA, 16 bp, Homo sapiens
agagggcccagcccag

SEQ ID NO: 1573432 - DNA, 23 bp, Homo sapiens
agagggcccagctgtagccatgg

SEQ ID NO: 1573433 - DNA, 16 bp, Homo sapiens
agagggcccaggcagg

SEQ ID NO: 1573434 - DNA, 17 bp, Homo sapiens
agagggcccaggcaggc

SEQ ID NO: 1573435 - DNA, 21 bp, Homo sapiens
agagggcccaggcaggccacc

SEQ ID NO: 1573436 - DNA, 16 bp, Homo sapiens
agagggcccatcaggc

SEQ ID NO: 1573437 - DNA, 19 bp, Homo sapiens
agagggcccatcaggcagt

SEQ ID NO: 1573438 - DNA, 15 bp, Homo sapiens
agagggcctctgcct

SEQ ID NO: 1573439 - DNA, 16 bp, Homo sapiens
agagggcctctgcctg

SEQ ID NO: 1573440 - DNA, 18 bp, Homo sapiens
agagggcctctgcctggg

SEQ ID NO: 1573441 - DNA, 14 bp, Homo sapiens
agagggcctggacc

SEQ ID NO: 1573442 - DNA, 16 bp, Homo sapiens
agagggcctgtgggag

SEQ ID NO: 1573443 - DNA, 21 bp, Homo sapiens
agagggctctgatctaacaaa

SEQ ID NO: 1573444 - DNA, 11 bp, Homo sapiens
agagggctgga

SEQ ID NO: 1573445 - DNA, 17 bp, Homo sapiens
agagggctggaggccca

SEQ ID NO: 1573446 - DNA, 19 bp, Homo sapiens
agagggctggaggcccagg

SEQ ID NO: 1573447 - DNA, 12 bp, Homo sapiens
agagggcttcct

SEQ ID NO: 1573448 - DNA, 13 bp, Homo sapiens
agagggcttcctc

SEQ ID NO: 1573449 - DNA, 20 bp, Homo sapiens
agaggggaataatagaagaa

SEQ ID NO: 1573450 - DNA, 20 bp, Homo sapiens
agaggggacaaaacccacct

SEQ ID NO: 1573451 - DNA, 15 bp, Homo sapiens
agaggggcagaacag

SEQ ID NO: 1573452 - DNA, 16 bp, Homo sapiens
agaggggcagaacagc

SEQ ID NO: 1573453 - DNA, 16 bp, Homo sapiens
agaggggcagcccttg

SEQ ID NO: 1573454 - DNA, 19 bp, Homo sapiens
agaggggcagcccttgctt

SEQ ID NO: 1573455 - DNA, 23 bp, Homo sapiens
agaggggcagccgctaggagaga

SEQ ID NO: 1573456 - DNA, 13 bp, Homo sapiens
agaggggcctgca

SEQ ID NO: 1573457 - DNA, 18 bp, Homo sapiens
agaggggcctgcaggtga

SEQ ID NO: 1573458 - DNA, 12 bp, Homo sapiens
agaggggctggg

SEQ ID NO: 1573459 - DNA, 21 bp, Homo sapiens
agagggggcacccggggagga

SEQ ID NO: 1573460 - DNA, 23 bp, Homo sapiens
agaggggtgcacccactcaccag

SEQ ID NO: 1573461 - DNA, 19 bp, Homo sapiens
agaggggtggagactgctt

SEQ ID NO: 1573462 - DNA, 16 bp, Homo sapiens
agagggtatttttgta

SEQ ID NO: 1573463 - DNA, 22 bp, Homo sapiens
agagggtgggagcctaaggaag

SEQ ID NO: 1573464 - DNA, 19 bp, Homo sapiens
agagggttcacacagccca

SEQ ID NO: 1573465 - DNA, 20 bp, Homo sapiens
agagggttcacacagcccag

SEQ ID NO: 1573466 - DNA, 21 bp, Homo sapiens
agagggttcacacagcccagt

SEQ ID NO: 1573467 - DNA, 20 bp, Homo sapiens
agaggtactgtaatgggtaa

SEQ ID NO: 1573468 - DNA, 17 bp, Homo sapiens
agaggtattaaaactaa

SEQ ID NO: 1573469 - DNA, 16 bp, Homo sapiens
agaggtcaccagctgc

SEQ ID NO: 1573470 - DNA, 15 bp, Homo sapiens
agaggtctgagccct

SEQ ID NO: 1573471 - DNA, 21 bp, Homo sapiens
agaggtctgagccctggtgtg

SEQ ID NO: 1573472 - DNA, 19 bp, Homo sapiens
agaggtctgattggctgct

SEQ ID NO: 1573473 - DNA, 16 bp, Homo sapiens
agaggtctgtgctgag

SEQ ID NO: 1573474 - DNA, 18 bp, Homo sapiens
agaggtctgtgctgaggc

SEQ ID NO: 1573475 - DNA, 16 bp, Homo sapiens
agaggtgcttcaccct

SEQ ID NO: 1573476 - DNA, 20 bp, Homo sapiens
agaggtggatgttatgaaca

SEQ ID NO: 1573477 - DNA, 12 bp, Homo sapiens
agaggtgggcag

SEQ ID NO: 1573478 - DNA, 14 bp, Homo sapiens
agaggtgggcagct

SEQ ID NO: 1573479 - DNA, 15 bp, Homo sapiens
agaggtgggcagctg

SEQ ID NO: 1573480 - DNA, 19 bp, Homo sapiens
agaggtgggcagctgggcc

SEQ ID NO: 1573481 - DNA, 17 bp, Homo sapiens
agaggtgggcaggtggt

SEQ ID NO: 1573482 - DNA, 21 bp, Homo sapiens
agaggtgggccagtctgtgga

SEQ ID NO: 1573483 - DNA, 16 bp, Homo sapiens
agaggtggggagcaga

SEQ ID NO: 1573484 - DNA, 14 bp, Homo sapiens
agaggttaggagta

SEQ ID NO: 1573485 - DNA, 18 bp, Homo sapiens
agaggttatctgcctggc

SEQ ID NO: 1573486 - DNA, 20 bp, Homo sapiens
agaggttatctgcctggcct

SEQ ID NO: 1573487 - DNA, 19 bp, Homo sapiens
agaggttctaaaatcatga

SEQ ID NO: 1573488 - DNA, 15 bp, Homo sapiens
agaggttgcagtgag

SEQ ID NO: 1573489 - DNA, 21 bp, Homo sapiens
agaggttgtagtgagccaaga

SEQ ID NO: 1573490 - DNA, 14 bp, Homo sapiens
agaggtttcttgaa

SEQ ID NO: 1573491 - DNA, 19 bp, Homo sapiens
agaggttttaatgtctgtt

SEQ ID NO: 1573492 - DNA, 12 bp, Homo sapiens
agagtaactatc

SEQ ID NO: 1573493 - DNA, 14 bp, Homo sapiens
agagtaagcagtgt

SEQ ID NO: 1573494 - DNA, 19 bp, Homo sapiens
agagtaagcagtgttactt

SEQ ID NO: 1573495 - DNA, 13 bp, Homo sapiens
agagtatatgcac

SEQ ID NO: 1573496 - DNA, 14 bp, Homo sapiens
agagtatttccctt

SEQ ID NO: 1573497 - DNA, 14 bp, Homo sapiens
agagtatttttgac

SEQ ID NO: 1573498 - DNA, 13 bp, Homo sapiens
agagtcaaagctg

SEQ ID NO: 1573499 - DNA, 21 bp, Homo sapiens
agagtcaactacacaaagcag

SEQ ID NO: 1573500 - DNA, 22 bp, Homo sapiens
agagtcaactacacaaagcagg

SEQ ID NO: 1573501 - DNA, 14 bp, Homo sapiens
agagtcactcacac

SEQ ID NO: 1573502 - DNA, 16 bp, Homo sapiens
agagtcagaggagaag

SEQ ID NO: 1573503 - DNA, 13 bp, Homo sapiens
agagtcatctcca

SEQ ID NO: 1573504 - DNA, 21 bp, Homo sapiens
agagtcatctccatcagctgt

SEQ ID NO: 1573505 - DNA, 22 bp, Homo sapiens
agagtcattgtaatgttgtgaa

SEQ ID NO: 1573506 - DNA, 17 bp, Homo sapiens
agagtccatttcccaca

SEQ ID NO: 1573507 - DNA, 22 bp, Homo sapiens
agagtcccaggaccttgagtgt

SEQ ID NO: 1573508 - DNA, 16 bp, Homo sapiens
agagtccgtggttgcc

SEQ ID NO: 1573509 - DNA, 13 bp, Homo sapiens
agagtcctcactc

SEQ ID NO: 1573510 - DNA, 22 bp, Homo sapiens
agagtccttaagacggaagtaa

SEQ ID NO: 1573511 - DNA, 16 bp, Homo sapiens
agagtcggtctgcttt

SEQ ID NO: 1573512 - DNA, 19 bp, Homo sapiens
agagtcggtctgctttgga

SEQ ID NO: 1573513 - DNA, 12 bp, Homo sapiens
agagtctaaaga

SEQ ID NO: 1573514 - DNA, 21 bp, Homo sapiens
agagtctaatagtctttgcca

SEQ ID NO: 1573515 - DNA, 15 bp, Homo sapiens
agagtctagattcaa

SEQ ID NO: 1573516 - DNA, 19 bp, Homo sapiens
agagtctagattcaaaggt

SEQ ID NO: 1573517 - DNA, 22 bp, Homo sapiens
agagtctagattcaaaggttct

SEQ ID NO: 1573518 - DNA, 18 bp, Homo sapiens
agagtctcgctcttgtca

SEQ ID NO: 1573519 - DNA, 12 bp, Homo sapiens
agagtctgaaca

SEQ ID NO: 1573520 - DNA, 13 bp, Homo sapiens
agagtctgaacag

SEQ ID NO: 1573521 - DNA, 16 bp, Homo sapiens
agagtctgaacagctg

SEQ ID NO: 1573522 - DNA, 12 bp, Homo sapiens
agagtctgagcc

SEQ ID NO: 1573523 - DNA, 23 bp, Homo sapiens
agagtgaattgaatattgtaagt

SEQ ID NO: 1573524 - DNA, 14 bp, Homo sapiens
agagtgacagtcat

SEQ ID NO: 1573525 - DNA, 23 bp, Homo sapiens
agagtgacagtcataaatactgt

SEQ ID NO: 1573526 - DNA, 14 bp, Homo sapiens
agagtgagaccctg

SEQ ID NO: 1573527 - DNA, 21 bp, Homo sapiens
agagtgagagggcatgcgcac

SEQ ID NO: 1573528 - DNA, 17 bp, Homo sapiens
agagtgagctctggtgg

SEQ ID NO: 1573529 - DNA, 18 bp, Homo sapiens
agagtgagctctggtgga

SEQ ID NO: 1573530 - DNA, 20 bp, Homo sapiens
agagtgatagtcttttgctt

SEQ ID NO: 1573531 - DNA, 22 bp, Homo sapiens
agagtgatagtcttttgctttt

SEQ ID NO: 1573532 - DNA, 19 bp, Homo sapiens
agagtgattctagttggga

SEQ ID NO: 1573533 - DNA, 16 bp, Homo sapiens
agagtgcacagctgtc

SEQ ID NO: 1573534 - DNA, 14 bp, Homo sapiens
agagtgccactgcg

SEQ ID NO: 1573535 - DNA, 18 bp, Homo sapiens
agagtgccactgcgggag

SEQ ID NO: 1573536 - DNA, 13 bp, Homo sapiens
agagtgcccagaa

SEQ ID NO: 1573537 - DNA, 22 bp, Homo sapiens
agagtggaatgcttcctagaag

SEQ ID NO: 1573538 - DNA, 18 bp, Homo sapiens
agagtggactcttccctc

SEQ ID NO: 1573539 - DNA, 16 bp, Homo sapiens
agagtggactgcattt

SEQ ID NO: 1573540 - DNA, 15 bp, Homo sapiens
agagtggaggcgggc

SEQ ID NO: 1573541 - DNA, 14 bp, Homo sapiens
agagtggcaggtgg

SEQ ID NO: 1573542 - DNA, 19 bp, Homo sapiens
agagctgaaccttgagggg

SEQ ID NO: 1573543 - DNA, 16 bp, Homo sapiens
agagctgagccagttg

SEQ ID NO: 1573544 - DNA, 18 bp, Homo sapiens
agagctgagccagttgtc

SEQ ID NO: 1573545 - DNA, 17 bp, Homo sapiens
agagctgagggccctgt

SEQ ID NO: 1573546 - DNA, 19 bp, Homo sapiens
agagctgatccagagcaca

SEQ ID NO: 1573547 - DNA, 14 bp, Homo sapiens
agagctgccactgg

SEQ ID NO: 1573548 - DNA, 16 bp, Homo sapiens
agagctgccatcgctg

SEQ ID NO: 1573549 - DNA, 12 bp, Homo sapiens
agagctgcctgg

SEQ ID NO: 1573550 - DNA, 16 bp, Homo sapiens
agagctgcctggatga

SEQ ID NO: 1573551 - DNA, 11 bp, Homo sapiens
agagctgctga

SEQ ID NO: 1573552 - DNA, 13 bp, Homo sapiens
agagctgctgtcc

SEQ ID NO: 1573553 - DNA, 15 bp, Homo sapiens
agagctgctgtcctt

SEQ ID NO: 1573554 - DNA, 16 bp, Homo sapiens
agagctggaaggcagg

SEQ ID NO: 1573555 - DNA, 12 bp, Homo sapiens
agagctggaggc

SEQ ID NO: 1573556 - DNA, 16 bp, Homo sapiens
agagctggtgcccgga

SEQ ID NO: 1573557 - DNA, 12 bp, Homo sapiens
agagctgtgcca

SEQ ID NO: 1573558 - DNA, 17 bp, Homo sapiens
agagctgtgccagcagg

SEQ ID NO: 1573559 - DNA, 20 bp, Homo sapiens
agagctgtgcctgctcagca

SEQ ID NO: 1573560 - DNA, 23 bp, Homo sapiens
agagctgtgcctgctcagcagcc

SEQ ID NO: 1573561 - DNA, 20 bp, Homo sapiens
agagctgtggaggattgcta

SEQ ID NO: 1573562 - DNA, 21 bp, Homo sapiens
agagctgtttatggcctcagc

SEQ ID NO: 1573563 - DNA, 12 bp, Homo sapiens
agagcttagaaa

SEQ ID NO: 1573564 - DNA, 16 bp, Homo sapiens
agagcttattggccac

SEQ ID NO: 1573565 - DNA, 18 bp, Homo sapiens
agagcttattggccactg

SEQ ID NO: 1573566 - DNA, 19 bp, Homo sapiens
agagcttattggccactgg

SEQ ID NO: 1573567 - DNA, 15 bp, Homo sapiens
agagcttgcacagcc

SEQ ID NO: 1573568 - DNA, 14 bp, Homo sapiens
agagcttgctccag

SEQ ID NO: 1573569 - DNA, 15 bp, Homo sapiens
agagcttgctccaga

SEQ ID NO: 1573570 - DNA, 22 bp, Homo sapiens
agagcttgctccagattctgat

SEQ ID NO: 1573571 - DNA, 23 bp, Homo sapiens
agagcttgctccagattctgatg

SEQ ID NO: 1573572 - DNA, 15 bp, Homo sapiens
agagcttggactaca

SEQ ID NO: 1573573 - DNA, 20 bp, Homo sapiens
agagcttggactacacaata

SEQ ID NO: 1573574 - DNA, 11 bp, Homo sapiens
agagctttccg

SEQ ID NO: 1573575 - DNA, 20 bp, Homo sapiens
agagctttttaatagcacta

SEQ ID NO: 1573576 - DNA, 17 bp, Homo sapiens
agaggaaaaaaatgact

SEQ ID NO: 1573577 - DNA, 13 bp, Homo sapiens
agaggaaagacag

SEQ ID NO: 1573578 - DNA, 17 bp, Homo sapiens
agaggaaataacagaga

SEQ ID NO: 1573579 - DNA, 14 bp, Homo sapiens
agaggaaataagaa

SEQ ID NO: 1573580 - DNA, 12 bp, Homo sapiens
agaggaagaaat

SEQ ID NO: 1573581 - DNA, 20 bp, Homo sapiens
agaggaagaaattcaggtac

SEQ ID NO: 1573582 - DNA, 19 bp, Homo sapiens
agaggaagagagagaccct

SEQ ID NO: 1573583 - DNA, 13 bp, Homo sapiens
agaggaagagcag

SEQ ID NO: 1573584 - DNA, 23 bp, Homo sapiens
agaggaatcagacttcacactgc

SEQ ID NO: 1573585 - DNA, 17 bp, Homo sapiens
agaggaatcctggcagc

SEQ ID NO: 1573586 - DNA, 23 bp, Homo sapiens
agaggacagataactgctttgca

SEQ ID NO: 1573587 - DNA, 20 bp, Homo sapiens
agaggacagtatttgtgggg

SEQ ID NO: 1573588 - DNA, 17 bp, Homo sapiens
agaggacagtctggaga

SEQ ID NO: 1573589 - DNA, 14 bp, Homo sapiens
agaggaccacagtg

SEQ ID NO: 1573590 - DNA, 19 bp, Homo sapiens
agaggaccacagtgggtgg

SEQ ID NO: 1573591 - DNA, 21 bp, Homo sapiens
agaggactcccaaccctggct

SEQ ID NO: 1573592 - DNA, 19 bp, Homo sapiens
agaggagaaatgcaataac

SEQ ID NO: 1573593 - DNA, 14 bp, Homo sapiens
agaggagaccctgg

SEQ ID NO: 1573594 - DNA, 16 bp, Homo sapiens
agaggagaccctggaa

SEQ ID NO: 1573595 - DNA, 13 bp, Homo sapiens
agaggagagtggc

SEQ ID NO: 1573596 - DNA, 13 bp, Homo sapiens
agaggagcagagg

SEQ ID NO: 1573597 - DNA, 17 bp, Homo sapiens
agaggagccaccagttc

SEQ ID NO: 1573598 - DNA, 16 bp, Homo sapiens
agaggagcctcagaag

SEQ ID NO: 1573599 - DNA, 19 bp, Homo sapiens
agaggagcctcagaagaaa

SEQ ID NO: 1573600 - DNA, 19 bp, Homo sapiens
agaggagggcgtgactcac

SEQ ID NO: 1573601 - DNA, 16 bp, Homo sapiens
agaggagtctgtggct

SEQ ID NO: 1573602 - DNA, 17 bp, Homo sapiens
agaggagtttcttaatg

SEQ ID NO: 1573603 - DNA, 15 bp, Homo sapiens
agaggatacatttaa

SEQ ID NO: 1573604 - DNA, 20 bp, Homo sapiens
agaggatacatttaataaaa

SEQ ID NO: 1573605 - DNA, 16 bp, Homo sapiens
agaggatgagcagagg

SEQ ID NO: 1573606 - DNA, 12 bp, Homo sapiens
agaggatgcctt

SEQ ID NO: 1573607 - DNA, 13 bp, Homo sapiens
agaggatgccttt

SEQ ID NO: 1573608 - DNA, 20 bp, Homo sapiens
agaggatgccttttctgtga

SEQ ID NO: 1573609 - DNA, 21 bp, Homo sapiens
agaggcaacactggaacatgg

SEQ ID NO: 1573610 - DNA, 24 bp, Homo sapiens
agaggcaccactaaaagatcgcag

SEQ ID NO: 1573611 - DNA, 17 bp, Homo sapiens
agaggcagaagaaccct

SEQ ID NO: 1573612 - DNA, 19 bp, Homo sapiens
agaggcagcatgcttgggc

SEQ ID NO: 1573613 - DNA, 21 bp, Homo sapiens
agaggcagcttctagacagag

SEQ ID NO: 1573614 - DNA, 22 bp, Homo sapiens
agaggcaggggcttgctttgca

SEQ ID NO: 1573615 - DNA, 10 bp, Homo sapiens
agaggcattg

SEQ ID NO: 1573616 - DNA, 18 bp, Homo sapiens
agaggccagacatggtgt

SEQ ID NO: 1573617 - DNA, 13 bp, Homo sapiens
agaggccagaggc

SEQ ID NO: 1573618 - DNA, 18 bp, Homo sapiens
agaggccagccccaccca

SEQ ID NO: 1573619 - DNA, 15 bp, Homo sapiens
agaggccagcctggc

SEQ ID NO: 1573620 - DNA, 19 bp, Homo sapiens
agaggccagggcagcaagg

SEQ ID NO: 1573621 - DNA, 14 bp, Homo sapiens
agaggccagtagga

SEQ ID NO: 1573622 - DNA, 14 bp, Homo sapiens
agaggccatggcag

SEQ ID NO: 1573623 - DNA, 20 bp, Homo sapiens
agaggccatggcagaataat

SEQ ID NO: 1573624 - DNA, 23 bp, Homo sapiens
agaggccatggcagaataatctt

SEQ ID NO: 1573625 - DNA, 19 bp, Homo sapiens
agaggcccactagagggcc

SEQ ID NO: 1573626 - DNA, 20 bp, Homo sapiens
agaggcccactagagggccc

SEQ ID NO: 1573627 - DNA, 12 bp, Homo sapiens
agaggcccaggc

SEQ ID NO: 1573628 - DNA, 21 bp, Homo sapiens
agaggcccaggcaccaccagg

SEQ ID NO: 1573629 - DNA, 15 bp, Homo sapiens
agaggccccagcctc

SEQ ID NO: 1573630 - DNA, 17 bp, Homo sapiens
agaggcccgcccgccca

SEQ ID NO: 1573631 - DNA, 12 bp, Homo sapiens
agaggccctgga

SEQ ID NO: 1573632 - DNA, 14 bp, Homo sapiens
agaggccctggagg

SEQ ID NO: 1573633 - DNA, 22 bp, Homo sapiens
agaggccctggaggtctccagg

SEQ ID NO: 1573634 - DNA, 23 bp, Homo sapiens
agaggccctggaggtctccaggg

SEQ ID NO: 1573635 - DNA, 20 bp, Homo sapiens
agaggccgaaggtgcctcag

SEQ ID NO: 1573636 - DNA, 20 bp, Homo sapiens
agaggcctgcctccagggct

SEQ ID NO: 1573637 - DNA, 22 bp, Homo sapiens
agaggcctgcctccagggctgg

SEQ ID NO: 1573638 - DNA, 23 bp, Homo sapiens
agaggcctgctgccagtgcagcc

SEQ ID NO: 1573639 - DNA, 19 bp, Homo sapiens
agaggcctgggctgggaaa

SEQ ID NO: 1573640 - DNA, 13 bp, Homo sapiens
agaggcgggccag

SEQ ID NO: 1573641 - DNA, 19 bp, Homo sapiens
agaggctattattttcact

SEQ ID NO: 1573642 - DNA, 16 bp, Homo sapiens
agaggctcttgatggt

SEQ ID NO: 1573643 - DNA, 17 bp, Homo sapiens
agaggctgacttttcca

SEQ ID NO: 1573644 - DNA, 13 bp, Homo sapiens
agaggctgaggga

SEQ ID NO: 1573645 - DNA, 14 bp, Homo sapiens
agaggctgcccctc

SEQ ID NO: 1573646 - DNA, 12 bp, Homo sapiens
agaggctgcctc

SEQ ID NO: 1573647 - DNA, 19 bp, Homo sapiens
agaggctgcctcagccagt

SEQ ID NO: 1573648 - DNA, 17 bp, Homo sapiens
agaggctggaggcaggg

SEQ ID NO: 1573649 - DNA, 22 bp, Homo sapiens
agaggctggaggcagggccttg

SEQ ID NO: 1573650 - DNA, 19 bp, Homo sapiens
agaggcttctccgccagcc

SEQ ID NO: 1573651 - DNA, 20 bp, Homo sapiens
agaggcttctccgccagcct

SEQ ID NO: 1573652 - DNA, 23 bp, Homo sapiens
agaggcttctccgccagcctcct

SEQ ID NO: 1573653 - DNA, 14 bp, Homo sapiens
agaggcttcttcag

SEQ ID NO: 1573654 - DNA, 21 bp, Homo sapiens
agaggcttcttcagatcagtg

SEQ ID NO: 1573655 - DNA, 18 bp, Homo sapiens
agagggaatgttccctgc

SEQ ID NO: 1573656 - DNA, 19 bp, Homo sapiens
agagggaatgttccctgca

SEQ ID NO: 1573657 - DNA, 17 bp, Homo sapiens
agagggacaggcactcc

SEQ ID NO: 1573658 - DNA, 18 bp, Homo sapiens
agagggacaggctgaaga

SEQ ID NO: 1573659 - DNA, 20 bp, Homo sapiens
agagtggcaggtgggctgcc

SEQ ID NO: 1573660 - DNA, 16 bp, Homo sapiens
agagtggcctccctgc

SEQ ID NO: 1573661 - DNA, 17 bp, Homo sapiens
agagtggcctccctgct

SEQ ID NO: 1573662 - DNA, 20 bp, Homo sapiens
agagtggcctccctgctgtg

SEQ ID NO: 1573663 - DNA, 14 bp, Homo sapiens
agagtggcctggcc

SEQ ID NO: 1573664 - DNA, 19 bp, Homo sapiens
agagtggctcctcccggtg

SEQ ID NO: 1573665 - DNA, 23 bp, Homo sapiens
agagtgggccccgggctggagaa

SEQ ID NO: 1573666 - DNA, 16 bp, Homo sapiens
agagtggggcctgccc

SEQ ID NO: 1573667 - DNA, 17 bp, Homo sapiens
agagtggggttttcttg

SEQ ID NO: 1573668 - DNA, 18 bp, Homo sapiens
agagtggtctttctggag

SEQ ID NO: 1573669 - DNA, 16 bp, Homo sapiens
agagtggttgttgcca

SEQ ID NO: 1573670 - DNA, 16 bp, Homo sapiens
agagtgtacatcatgt

SEQ ID NO: 1573671 - DNA, 20 bp, Homo sapiens
agagtgtagcctaaagggca

SEQ ID NO: 1573672 - DNA, 22 bp, Homo sapiens
agagtgtagctgtaagggcagt

SEQ ID NO: 1573673 - DNA, 23 bp, Homo sapiens
agagtgtgagagagactgatggg

SEQ ID NO: 1573674 - DNA, 19 bp, Homo sapiens
agagtgtgggaagggagag

SEQ ID NO: 1573675 - DNA, 14 bp, Homo sapiens
agagtgtgtgggca

SEQ ID NO: 1573676 - DNA, 18 bp, Homo sapiens
agagtgtgtgggcagggt

SEQ ID NO: 1573677 - DNA, 15 bp, Homo sapiens
agagttaaaagcagc

SEQ ID NO: 1573678 - DNA, 23 bp, Homo sapiens
agagttaaatagagtatatgcac

SEQ ID NO: 1573679 - DNA, 12 bp, Homo sapiens
agagttaagaat

SEQ ID NO: 1573680 - DNA, 20 bp, Homo sapiens
agagttaatatatagaaggg

SEQ ID NO: 1573681 - DNA, 14 bp, Homo sapiens
agagttacaataaa

SEQ ID NO: 1573682 - DNA, 22 bp, Homo sapiens
agagttacagttctgtggtttc

SEQ ID NO: 1573683 - DNA, 13 bp, Homo sapiens
agagttagcatgt

SEQ ID NO: 1573684 - DNA, 19 bp, Homo sapiens
agagttattgaatcttaat

SEQ ID NO: 1573685 - DNA, 16 bp, Homo sapiens
agagttcactataaat

SEQ ID NO: 1573686 - DNA, 22 bp, Homo sapiens
agagttcctgcggagtgaagag

SEQ ID NO: 1573687 - DNA, 12 bp, Homo sapiens
agagttccttct

SEQ ID NO: 1573688 - DNA, 20 bp, Homo sapiens
agagttctatccccaagctg

SEQ ID NO: 1573689 - DNA, 14 bp, Homo sapiens
agagttctgctcta

SEQ ID NO: 1573690 - DNA, 16 bp, Homo sapiens
agagttgctgggagct

SEQ ID NO: 1573691 - DNA, 17 bp, Homo sapiens
agagttgctttaaagta

SEQ ID NO: 1573692 - DNA, 20 bp, Homo sapiens
agagttgctttgccagagca

SEQ ID NO: 1573693 - DNA, 17 bp, Homo sapiens
agagttggcatgactct

SEQ ID NO: 1573694 - DNA, 15 bp, Homo sapiens
agagttggctcaggc

SEQ ID NO: 1573695 - DNA, 19 bp, Homo sapiens
agagttgggacaattgctt

SEQ ID NO: 1573696 - DNA, 22 bp, Homo sapiens
agagttgggtgtctccttaagc

SEQ ID NO: 1573697 - DNA, 19 bp, Homo sapiens
agagtttatacagtgtaca

SEQ ID NO: 1573698 - DNA, 20 bp, Homo sapiens
agagtttatacagtgtacat

SEQ ID NO: 1573699 - DNA, 23 bp, Homo sapiens
agagtttatacagtgtacatgta

SEQ ID NO: 1573700 - DNA, 20 bp, Homo sapiens
agagtttcagtttgttggaa

SEQ ID NO: 1573701 - DNA, 13 bp, Homo sapiens
agagtttcctgaa

SEQ ID NO: 1573702 - DNA, 13 bp, Homo sapiens
agagtttgtcatt

SEQ ID NO: 1573703 - DNA, 16 bp, Homo sapiens
agagtttgtgtgttgt

SEQ ID NO: 1573704 - DNA, 19 bp, Homo sapiens
agagttttgtcttgaatgt

SEQ ID NO: 1573705 - DNA, 19 bp, Homo sapiens
agagtttttaaagccttct

SEQ ID NO: 1573706 - DNA, 14 bp, Homo sapiens
agataaaaagatgg

SEQ ID NO: 1573707 - DNA, 13 bp, Homo sapiens
agataaagatgat

SEQ ID NO: 1573708 - DNA, 15 bp, Homo sapiens
agataaagatgatct

SEQ ID NO: 1573709 - DNA, 16 bp, Homo sapiens
agataaagatgatcta

SEQ ID NO: 1573710 - DNA, 13 bp, Homo sapiens
agataaagattgt

SEQ ID NO: 1573711 - DNA, 17 bp, Homo sapiens
agataaagatttcttga

SEQ ID NO: 1573712 - DNA, 18 bp, Homo sapiens
agataaagatttcttgag

SEQ ID NO: 1573713 - DNA, 13 bp, Homo sapiens
agataaagtcaaa

SEQ ID NO: 1573714 - DNA, 16 bp, Homo sapiens
agataaatgagctttc

SEQ ID NO: 1573715 - DNA, 17 bp, Homo sapiens
agataacccttattcca

SEQ ID NO: 1573716 - DNA, 18 bp, Homo sapiens
agataacccttattccat

SEQ ID NO: 1573717 - DNA, 22 bp, Homo sapiens
agataacgaagtgcacttacac

SEQ ID NO: 1573718 - DNA, 20 bp, Homo sapiens
agataacttactgtatatgt

SEQ ID NO: 1573719 - DNA, 21 bp, Homo sapiens
agataacttactgtatatgta

SEQ ID NO: 1573720 - DNA, 22 bp, Homo sapiens
agataacttactgtatatgtat

SEQ ID NO: 1573721 - DNA, 22 bp, Homo sapiens
agataagcaagagagatgtttt

SEQ ID NO: 1573722 - DNA, 12 bp, Homo sapiens
agataaggtttt

SEQ ID NO: 1573723 - DNA, 15 bp, Homo sapiens
agataaggttttaag

SEQ ID NO: 1573724 - DNA, 16 bp, Homo sapiens
agataataatatatgt

SEQ ID NO: 1573725 - DNA, 17 bp, Homo sapiens
agataatatctgtgagg

SEQ ID NO: 1573726 - DNA, 19 bp, Homo sapiens
agataatatctgtgaggtg

SEQ ID NO: 1573727 - DNA, 21 bp, Homo sapiens
agataatatctgtgaggtgct

SEQ ID NO: 1573728 - DNA, 17 bp, Homo sapiens
agataatatgagaatca

SEQ ID NO: 1573729 - DNA, 15 bp, Homo sapiens
agataatatttttgt

SEQ ID NO: 1573730 - DNA, 21 bp, Homo sapiens
agataatatttttgtatttct

SEQ ID NO: 1573731 - DNA, 21 bp, Homo sapiens
agataatgttagaggttttaa

SEQ ID NO: 1573732 - DNA, 17 bp, Homo sapiens
agataattactgccttg

SEQ ID NO: 1573733 - DNA, 17 bp, Homo sapiens
agataattgcttgccag

SEQ ID NO: 1573734 - DNA, 20 bp, Homo sapiens
agataatttacaagatatta

SEQ ID NO: 1573735 - DNA, 13 bp, Homo sapiens
agatacaatgtat

SEQ ID NO: 1573736 - DNA, 15 bp, Homo sapiens
agatacaatgtattt

SEQ ID NO: 1573737 - DNA, 22 bp, Homo sapiens
agatacacagctccgagctgta

SEQ ID NO: 1573738 - DNA, 17 bp, Homo sapiens
agatacagaataatgga

SEQ ID NO: 1573739 - DNA, 14 bp, Homo sapiens
agatacagacattc

SEQ ID NO: 1573740 - DNA, 19 bp, Homo sapiens
agatacctaaaagagattt

SEQ ID NO: 1573741 - DNA, 19 bp, Homo sapiens
agataccttatcttacaat

SEQ ID NO: 1573742 - DNA, 22 bp, Homo sapiens
agataccttatcttacaatatt

SEQ ID NO: 1573743 - DNA, 19 bp, Homo sapiens
agataccttgaaaggaaga

SEQ ID NO: 1573744 - DNA, 13 bp, Homo sapiens
agatacgaaatca

SEQ ID NO: 1573745 - DNA, 12 bp, Homo sapiens
agatactggaaa

SEQ ID NO: 1573746 - DNA, 19 bp, Homo sapiens
agatactggaagttttgca

SEQ ID NO: 1573747 - DNA, 21 bp, Homo sapiens
agatactggaagttttgcatt

SEQ ID NO: 1573748 - DNA, 17 bp, Homo sapiens
agatacttcccaaagcc

SEQ ID NO: 1573749 - DNA, 23 bp, Homo sapiens
agatacttctgaaataaatgttc

SEQ ID NO: 1573750 - DNA, 17 bp, Homo sapiens
agatactttgctagccg

SEQ ID NO: 1573751 - DNA, 15 bp, Homo sapiens
agatagaaagcatta

SEQ ID NO: 1573752 - DNA, 13 bp, Homo sapiens
agatagaaagctg

SEQ ID NO: 1573753 - DNA, 22 bp, Homo sapiens
agatagaacacaaaacttgaaa

SEQ ID NO: 1573754 - DNA, 15 bp, Homo sapiens
agatagacaggtcct

SEQ ID NO: 1573755 - DNA, 21 bp, Homo sapiens
agatagacgggttgaaagaca

SEQ ID NO: 1573756 - DNA, 13 bp, Homo sapiens
agatagagaaata

SEQ ID NO: 1573757 - DNA, 16 bp, Homo sapiens
agatagatttggaata

SEQ ID NO: 1573758 - DNA, 18 bp, Homo sapiens
agatagcgcatatatttg

SEQ ID NO: 1573759 - DNA, 15 bp, Homo sapiens
agataggaaactgaa

SEQ ID NO: 1573760 - DNA, 16 bp, Homo sapiens
agataggaaactgaag

SEQ ID NO: 1573761 - DNA, 12 bp, Homo sapiens
agataggcctgt

SEQ ID NO: 1573762 - DNA, 14 bp, Homo sapiens
agataggctctgca

SEQ ID NO: 1573763 - DNA, 21 bp, Homo sapiens
agataggctctgcacagatgg

SEQ ID NO: 1573764 - DNA, 19 bp, Homo sapiens
agataggcttaacaaatgg

SEQ ID NO: 1573765 - DNA, 18 bp, Homo sapiens
agatagggggaagacaga

SEQ ID NO: 1573766 - DNA, 14 bp, Homo sapiens
agatagttaaaaga

SEQ ID NO: 1573767 - DNA, 22 bp, Homo sapiens
agatagttaaaagactgcagct

SEQ ID NO: 1573768 - DNA, 15 bp, Homo sapiens
agatataaatggctg

SEQ ID NO: 1573769 - DNA, 15 bp, Homo sapiens
agatataactgtctt

SEQ ID NO: 1573770 - DNA, 21 bp, Homo sapiens
agatataagagaagtctcatt

SEQ ID NO: 1573771 - DNA, 22 bp, Homo sapiens
agatataagagaagtctcattc

SEQ ID NO: 1573772 - DNA, 20 bp, Homo sapiens
agatataaggggaaagataa

SEQ ID NO: 1573773 - DNA, 15 bp, Homo sapiens
agatatacttgtttt

SEQ ID NO: 1573774 - DNA, 20 bp, Homo sapiens
agatatacttgtttttgtaa

SEQ ID NO: 1573775 - DNA, 15 bp, Homo sapiens
agatgatgatgttaa

SEQ ID NO: 1573776 - DNA, 12 bp, Homo sapiens
agatgatgtatt

SEQ ID NO: 1573777 - DNA, 19 bp, Homo sapiens
agatgatttcagttcatca

SEQ ID NO: 1573778 - DNA, 15 bp, Homo sapiens
agatgattttttgaa

SEQ ID NO: 1573779 - DNA, 20 bp, Homo sapiens
agatgattttttgaaagtta

SEQ ID NO: 1573780 - DNA, 13 bp, Homo sapiens
agatgcaagatat

SEQ ID NO: 1573781 - DNA, 17 bp, Homo sapiens
agatgcaaggaccagga

SEQ ID NO: 1573782 - DNA, 18 bp, Homo sapiens
agatgcaaggaccaggac

SEQ ID NO: 1573783 - DNA, 20 bp, Homo sapiens
agatgcaaggaccaggactc

SEQ ID NO: 1573784 - DNA, 13 bp, Homo sapiens
agatgcaatcaga

SEQ ID NO: 1573785 - DNA, 21 bp, Homo sapiens
agatgcacgtggggcccactg

SEQ ID NO: 1573786 - DNA, 14 bp, Homo sapiens
agatgcagagtaag

SEQ ID NO: 1573787 - DNA, 16 bp, Homo sapiens
agatgcaggaggctca

SEQ ID NO: 1573788 - DNA, 14 bp, Homo sapiens
agatgcatggcctc

SEQ ID NO: 1573789 - DNA, 19 bp, Homo sapiens
agatgcattttgagtgttt

SEQ ID NO: 1573790 - DNA, 22 bp, Homo sapiens
agatgccaaaccacaagactct

SEQ ID NO: 1573791 - DNA, 16 bp, Homo sapiens
agatgccacacctgct

SEQ ID NO: 1573792 - DNA, 15 bp, Homo sapiens
agatgccaccctagc

SEQ ID NO: 1573793 - DNA, 20 bp, Homo sapiens
agatgccacttctaagaaaa

SEQ ID NO: 1573794 - DNA, 14 bp, Homo sapiens
agatgccccaaagt

SEQ ID NO: 1573795 - DNA, 12 bp, Homo sapiens
agatgccccaga

SEQ ID NO: 1573796 - DNA, 16 bp, Homo sapiens
agatgccccctccagg

SEQ ID NO: 1573797 - DNA, 16 bp, Homo sapiens
agatgccgcatttgga

SEQ ID NO: 1573798 - DNA, 15 bp, Homo sapiens
agatgcctccaccgc

SEQ ID NO: 1573799 - DNA, 17 bp, Homo sapiens
agatgcctccccaagac

SEQ ID NO: 1573800 - DNA, 15 bp, Homo sapiens
agatgcgtcccaaga

SEQ ID NO: 1573801 - DNA, 23 bp, Homo sapiens
agatgcgtcccaagatgttgatt

SEQ ID NO: 1573802 - DNA, 16 bp, Homo sapiens
agatgctagaaaaatg

SEQ ID NO: 1573803 - DNA, 23 bp, Homo sapiens
agatgctaggctgtctgcgaaga

SEQ ID NO: 1573804 - DNA, 13 bp, Homo sapiens
agatgctccaaga

SEQ ID NO: 1573805 - DNA, 21 bp, Homo sapiens
agatgctccaagattctagat

SEQ ID NO: 1573806 - DNA, 15 bp, Homo sapiens
agatgctcttctgtg

SEQ ID NO: 1573807 - DNA, 13 bp, Homo sapiens
agatgctctttta

SEQ ID NO: 1573808 - DNA, 15 bp, Homo sapiens
agatgctgactggca

SEQ ID NO: 1573809 - DNA, 13 bp, Homo sapiens
agatgctgaggcc

SEQ ID NO: 1573810 - DNA, 21 bp, Homo sapiens
agatgctggatgtctgccaat

SEQ ID NO: 1573811 - DNA, 15 bp, Homo sapiens
agatgctggcccagg

SEQ ID NO: 1573812 - DNA, 22 bp, Homo sapiens
agatgctggcccagggcccaga

SEQ ID NO: 1573813 - DNA, 15 bp, Homo sapiens
agatgctggttttct

SEQ ID NO: 1573814 - DNA, 14 bp, Homo sapiens
agatgctgtaaata

SEQ ID NO: 1573815 - DNA, 23 bp, Homo sapiens
agatgctgtcattagtctatatg

SEQ ID NO: 1573816 - DNA, 21 bp, Homo sapiens
agatgcttggttgtgttgagg

SEQ ID NO: 1573817 - DNA, 16 bp, Homo sapiens
agatggaaaaataaca

SEQ ID NO: 1573818 - DNA, 17 bp, Homo sapiens
agatggaaaaataacaa

SEQ ID NO: 1573819 - DNA, 14 bp, Homo sapiens
agatggaaatacag

SEQ ID NO: 1573820 - DNA, 15 bp, Homo sapiens
agatggaaggccttt

SEQ ID NO: 1573821 - DNA, 13 bp, Homo sapiens
agatggaatgctg

SEQ ID NO: 1573822 - DNA, 18 bp, Homo sapiens
agatggaatgctgtgtta

SEQ ID NO: 1573823 - DNA, 14 bp, Homo sapiens
agatggagcccata

SEQ ID NO: 1573824 - DNA, 19 bp, Homo sapiens
agatggagggcttggccca

SEQ ID NO: 1573825 - DNA, 19 bp, Homo sapiens
agatggagttcttgtgcca

SEQ ID NO: 1573826 - DNA, 14 bp, Homo sapiens
agatggagtttcta

SEQ ID NO: 1573827 - DNA, 17 bp, Homo sapiens
agatggagtttctaagg

SEQ ID NO: 1573828 - DNA, 19 bp, Homo sapiens
agatggataaactgagcct

SEQ ID NO: 1573829 - DNA, 20 bp, Homo sapiens
agatggatttgcctgtgcca

SEQ ID NO: 1573830 - DNA, 16 bp, Homo sapiens
agatggcaaatgacca

SEQ ID NO: 1573831 - DNA, 13 bp, Homo sapiens
agatggcgatgtg

SEQ ID NO: 1573832 - DNA, 16 bp, Homo sapiens
agatggcgatgtgtta

SEQ ID NO: 1573833 - DNA, 17 bp, Homo sapiens
agatggcgatgtgttat

SEQ ID NO: 1573834 - DNA, 17 bp, Homo sapiens
agatggctttcagggca

SEQ ID NO: 1573835 - DNA, 17 bp, Homo sapiens
agatgggcttgttttct

SEQ ID NO: 1573836 - DNA, 12 bp, Homo sapiens
agatggggcacc

SEQ ID NO: 1573837 - DNA, 13 bp, Homo sapiens
agatggggcacca

SEQ ID NO: 1573838 - DNA, 21 bp, Homo sapiens
agatggggtctgtgactggat

SEQ ID NO: 1573839 - DNA, 17 bp, Homo sapiens
agatgggtattaaactt

SEQ ID NO: 1573840 - DNA, 21 bp, Homo sapiens
agatgggtctgatattaatca

SEQ ID NO: 1573841 - DNA, 23 bp, Homo sapiens
agatggtcagtgtggagaggggt

SEQ ID NO: 1573842 - DNA, 18 bp, Homo sapiens
agatggtccatttgttcc

SEQ ID NO: 1573843 - DNA, 14 bp, Homo sapiens
agatggtccgtgcc

SEQ ID NO: 1573844 - DNA, 19 bp, Homo sapiens
agatggtccgtgcccaggc

SEQ ID NO: 1573845 - DNA, 23 bp, Homo sapiens
agatggtccgtgcccaggccctt

SEQ ID NO: 1573846 - DNA, 17 bp, Homo sapiens
agatggttaaaaaggcc

SEQ ID NO: 1573847 - DNA, 18 bp, Homo sapiens
agatggttaaaaaggcca

SEQ ID NO: 1573848 - DNA, 19 bp, Homo sapiens
agatggttaaaaaggccaa

SEQ ID NO: 1573849 - DNA, 18 bp, Homo sapiens
agatggttaaacattttc

SEQ ID NO: 1573850 - DNA, 14 bp, Homo sapiens
agatggttctagca

SEQ ID NO: 1573851 - DNA, 15 bp, Homo sapiens
agatgtatgaaggct

SEQ ID NO: 1573852 - DNA, 17 bp, Homo sapiens
agatgtatgaaggcttt

SEQ ID NO: 1573853 - DNA, 21 bp, Homo sapiens
agatgtatttttgatgtatat

SEQ ID NO: 1573854 - DNA, 22 bp, Homo sapiens
agatgtatttttgatgtatata

SEQ ID NO: 1573855 - DNA, 16 bp, Homo sapiens
agatgtcttctgcctg

SEQ ID NO: 1573856 - DNA, 13 bp, Homo sapiens
agatgtgaaaact

SEQ ID NO: 1573857 - DNA, 13 bp, Homo sapiens
agatgtgaaaatt

SEQ ID NO: 1573858 - DNA, 17 bp, Homo sapiens
agatgtgaacacatcag

SEQ ID NO: 1573859 - DNA, 20 bp, Homo sapiens
agatgtgatattctaagact

SEQ ID NO: 1573860 - DNA, 21 bp, Homo sapiens
agatgtgattaaagctaagga

SEQ ID NO: 1573861 - DNA, 16 bp, Homo sapiens
agatgtgcaaaatcac

SEQ ID NO: 1573862 - DNA, 18 bp, Homo sapiens
agatgtgcaataatttgt

SEQ ID NO: 1573863 - DNA, 19 bp, Homo sapiens
agatgtgcatttcacctgt

SEQ ID NO: 1573864 - DNA, 13 bp, Homo sapiens
agatgtgctttgc

SEQ ID NO: 1573865 - DNA, 23 bp, Homo sapiens
agatgtggcaaagtgctgtaccc

SEQ ID NO: 1573866 - DNA, 13 bp, Homo sapiens
agatgtgtaaaca

SEQ ID NO: 1573867 - DNA, 18 bp, Homo sapiens
agatgtgtaaacaggtat

SEQ ID NO: 1573868 - DNA, 16 bp, Homo sapiens
agatgtgtctatggct

SEQ ID NO: 1573869 - DNA, 16 bp, Homo sapiens
agatgtgttcttattt

SEQ ID NO: 1573870 - DNA, 19 bp, Homo sapiens
agatgttcttttctattta

SEQ ID NO: 1573871 - DNA, 22 bp, Homo sapiens
agatgttgatttttactgtgtt

SEQ ID NO: 1573872 - DNA, 22 bp, Homo sapiens
agatgttgcttttgaaaagttg

SEQ ID NO: 1573873 - DNA, 15 bp, Homo sapiens
agatgttgtgtggca

SEQ ID NO: 1573874 - DNA, 18 bp, Homo sapiens
agatgtttaacaaatcta

SEQ ID NO: 1573875 - DNA, 18 bp, Homo sapiens
agatgtttattcttctag

SEQ ID NO: 1573876 - DNA, 22 bp, Homo sapiens
agatgtttattcttctagagtt

SEQ ID NO: 1573877 - DNA, 23 bp, Homo sapiens
agatgtttcacaccggaaggttt

SEQ ID NO: 1573878 - DNA, 14 bp, Homo sapiens
agatgtttcacgaa

SEQ ID NO: 1573879 - DNA, 14 bp, Homo sapiens
agatgtttgcctca

SEQ ID NO: 1573880 - DNA, 19 bp, Homo sapiens
agatgtttggaaaccacag

SEQ ID NO: 1573881 - DNA, 19 bp, Homo sapiens
agatgtttgtcagatatga

SEQ ID NO: 1573882 - DNA, 21 bp, Homo sapiens
agatgtttttaattctagtat

SEQ ID NO: 1573883 - DNA, 16 bp, Homo sapiens
agattaagagccatat

SEQ ID NO: 1573884 - DNA, 17 bp, Homo sapiens
agattaatggcactgat

SEQ ID NO: 1573885 - DNA, 22 bp, Homo sapiens
agattacccaaaaactgtcttt

SEQ ID NO: 1573886 - DNA, 16 bp, Homo sapiens
agattacttagaggaa

SEQ ID NO: 1573887 - DNA, 16 bp, Homo sapiens
agattaggcacacaga

SEQ ID NO: 1573888 - DNA, 19 bp, Homo sapiens
agattagttctttttgcca

SEQ ID NO: 1573889 - DNA, 13 bp, Homo sapiens
agattataacttg

SEQ ID NO: 1573890 - DNA, 14 bp, Homo sapiens
agattataacttgt

SEQ ID NO: 1573891 - DNA, 18 bp, Homo sapiens
agattataacttgtctaa

SEQ ID NO: 1573892 - DNA, 19 bp, Homo sapiens
agatatagaaactctcatt

SEQ ID NO: 1573893 - DNA, 14 bp, Homo sapiens
agatatatgccttc

SEQ ID NO: 1573894 - DNA, 17 bp, Homo sapiens
agatatatttttaagat

SEQ ID NO: 1573895 - DNA, 20 bp, Homo sapiens
agatatatttttaagataat

SEQ ID NO: 1573896 - DNA, 18 bp, Homo sapiens
agatatcagagctcttaa

SEQ ID NO: 1573897 - DNA, 14 bp, Homo sapiens
agatatccatcttt

SEQ ID NO: 1573898 - DNA, 17 bp, Homo sapiens
agatatctgagggagga

SEQ ID NO: 1573899 - DNA, 13 bp, Homo sapiens
agatatctgcatg

SEQ ID NO: 1573900 - DNA, 16 bp, Homo sapiens
agatatgatatgtaaa

SEQ ID NO: 1573901 - DNA, 13 bp, Homo sapiens
agatatgcaaaag

SEQ ID NO: 1573902 - DNA, 22 bp, Homo sapiens
agatatggagtgagtcacctgc

SEQ ID NO: 1573903 - DNA, 22 bp, Homo sapiens
agatatgggtgtttttaataaa

SEQ ID NO: 1573904 - DNA, 14 bp, Homo sapiens
agatatgtattctt

SEQ ID NO: 1573905 - DNA, 18 bp, Homo sapiens
agatatgtgtgtgtttgg

SEQ ID NO: 1573906 - DNA, 17 bp, Homo sapiens
agatattcaggtggcca

SEQ ID NO: 1573907 - DNA, 20 bp, Homo sapiens
agatattcattggcagctca

SEQ ID NO: 1573908 - DNA, 13 bp, Homo sapiens
agatattcttatt

SEQ ID NO: 1573909 - DNA, 14 bp, Homo sapiens
agatattgtacata

SEQ ID NO: 1573910 - DNA, 15 bp, Homo sapiens
agatattgtacataa

SEQ ID NO: 1573911 - DNA, 16 bp, Homo sapiens
agatattgtacataaa

SEQ ID NO: 1573912 - DNA, 22 bp, Homo sapiens
agatattgtcagagttctgctc

SEQ ID NO: 1573913 - DNA, 18 bp, Homo sapiens
agatattgtgaagtacat

SEQ ID NO: 1573914 - DNA, 19 bp, Homo sapiens
agatattgtgaagtacata

SEQ ID NO: 1573915 - DNA, 22 bp, Homo sapiens
agatattgttttctgtaaataa

SEQ ID NO: 1573916 - DNA, 13 bp, Homo sapiens
agatatttatata

SEQ ID NO: 1573917 - DNA, 17 bp, Homo sapiens
agatatttcaaacatca

SEQ ID NO: 1573918 - DNA, 24 bp, Homo sapiens
agatatttcaaacatcagctgaat

SEQ ID NO: 1573919 - DNA, 21 bp, Homo sapiens
agatatttccatttcttcctc

SEQ ID NO: 1573920 - DNA, 14 bp, Homo sapiens
agatatttgtattt

SEQ ID NO: 1573921 - DNA, 19 bp, Homo sapiens
agatattttttcagaaata

SEQ ID NO: 1573922 - DNA, 21 bp, Homo sapiens
agatattttttcagaaatatg

SEQ ID NO: 1573923 - DNA, 12 bp, Homo sapiens
agatcaaaataa

SEQ ID NO: 1573924 - DNA, 14 bp, Homo sapiens
agatcaaaataaaa

SEQ ID NO: 1573925 - DNA, 17 bp, Homo sapiens
agatcaaaataaaaagt

SEQ ID NO: 1573926 - DNA, 12 bp, Homo sapiens
agatcaaagatg

SEQ ID NO: 1573927 - DNA, 18 bp, Homo sapiens
agatcaaggagcccagaa

SEQ ID NO: 1573928 - DNA, 14 bp, Homo sapiens
agatcaatttgtaa

SEQ ID NO: 1573929 - DNA, 21 bp, Homo sapiens
agatcaatttgtaattgctta

SEQ ID NO: 1573930 - DNA, 17 bp, Homo sapiens
agatcacatattctagt

SEQ ID NO: 1573931 - DNA, 16 bp, Homo sapiens
agatcaccttgtattc

SEQ ID NO: 1573932 - DNA, 13 bp, Homo sapiens
agatcacgaggtc

SEQ ID NO: 1573933 - DNA, 22 bp, Homo sapiens
agatcacgccattgtactccag

SEQ ID NO: 1573934 - DNA, 23 bp, Homo sapiens
agatcactgccctttttgaaatc

SEQ ID NO: 1573935 - DNA, 23 bp, Homo sapiens
agatcactgtagtttagttctgt

SEQ ID NO: 1573936 - DNA, 18 bp, Homo sapiens
agatcactttctcagttt

SEQ ID NO: 1573937 - DNA, 22 bp, Homo sapiens
agatcagaaagtgacatttgct

SEQ ID NO: 1573938 - DNA, 21 bp, Homo sapiens
agatcaggaattctaaataaa

SEQ ID NO: 1573939 - DNA, 14 bp, Homo sapiens
agatccagcctggg

SEQ ID NO: 1573940 - DNA, 19 bp, Homo sapiens
agatccagggacagaggcc

SEQ ID NO: 1573941 - DNA, 10 bp, Homo sapiens
agatccagtg

SEQ ID NO: 1573942 - DNA, 13 bp, Homo sapiens
agatcccagctca

SEQ ID NO: 1573943 - DNA, 14 bp, Homo sapiens
agatcccatgtcac

SEQ ID NO: 1573944 - DNA, 16 bp, Homo sapiens
agatccctgcagaacc

SEQ ID NO: 1573945 - DNA, 14 bp, Homo sapiens
agatcctaagggtc

SEQ ID NO: 1573946 - DNA, 21 bp, Homo sapiens
agatcctgcaccccagcattc

SEQ ID NO: 1573947 - DNA, 18 bp, Homo sapiens
agatcctgcgggtggggc

SEQ ID NO: 1573948 - DNA, 21 bp, Homo sapiens
agatcctgtctttaaggaaaa

SEQ ID NO: 1573949 - DNA, 20 bp, Homo sapiens
agatcctgttacttgcttca

SEQ ID NO: 1573950 - DNA, 19 bp, Homo sapiens
agatccttcgggtgctgga

SEQ ID NO: 1573951 - DNA, 15 bp, Homo sapiens
agatccttgtttcaa

SEQ ID NO: 1573952 - DNA, 16 bp, Homo sapiens
agatcgagaccatcct

SEQ ID NO: 1573953 - DNA, 16 bp, Homo sapiens
agatcgcttgagccca

SEQ ID NO: 1573954 - DNA, 19 bp, Homo sapiens
agatcgtgctactgcactc

SEQ ID NO: 1573955 - DNA, 20 bp, Homo sapiens
agatctaaaaataactgtaa

SEQ ID NO: 1573956 - DNA, 14 bp, Homo sapiens
agatctacacatgt

SEQ ID NO: 1573957 - DNA, 18 bp, Homo sapiens
agatctacacatgttgcc

SEQ ID NO: 1573958 - DNA, 13 bp, Homo sapiens
agatctcaggagc

SEQ ID NO: 1573959 - DNA, 16 bp, Homo sapiens
agatctcatgtcctct

SEQ ID NO: 1573960 - DNA, 12 bp, Homo sapiens
agatctccagcg

SEQ ID NO: 1573961 - DNA, 16 bp, Homo sapiens
agatctcggtttgcca

SEQ ID NO: 1573962 - DNA, 15 bp, Homo sapiens
agatctctagagttt

SEQ ID NO: 1573963 - DNA, 19 bp, Homo sapiens
agatctgaacacagtttag

SEQ ID NO: 1573964 - DNA, 15 bp, Homo sapiens
agatctgactgccaa

SEQ ID NO: 1573965 - DNA, 20 bp, Homo sapiens
agatctgatggtgagctggg

SEQ ID NO: 1573966 - DNA, 14 bp, Homo sapiens
agatctgcacagtc

SEQ ID NO: 1573967 - DNA, 19 bp, Homo sapiens
agatctgcaggctgcacct

SEQ ID NO: 1573968 - DNA, 21 bp, Homo sapiens
agatctgcagggggtgtgtct

SEQ ID NO: 1573969 - DNA, 19 bp, Homo sapiens
agatctgcctgggcctgtg

SEQ ID NO: 1573970 - DNA, 20 bp, Homo sapiens
agatctgcctgggcctgtgc

SEQ ID NO: 1573971 - DNA, 21 bp, Homo sapiens
agatctgcctgggcctgtgca

SEQ ID NO: 1573972 - DNA, 24 bp, Homo sapiens
agatctgcctgggcctgtgcagca

SEQ ID NO: 1573973 - DNA, 13 bp, Homo sapiens
agatctggggagg

SEQ ID NO: 1573974 - DNA, 15 bp, Homo sapiens
agatctggggaggca

SEQ ID NO: 1573975 - DNA, 15 bp, Homo sapiens
agatctgtcctcagc

SEQ ID NO: 1573976 - DNA, 17 bp, Homo sapiens
agatctgtcctcagcct

SEQ ID NO: 1573977 - DNA, 19 bp, Homo sapiens
agatctgtcctcagccttg

SEQ ID NO: 1573978 - DNA, 12 bp, Homo sapiens
agatctgtcttg

SEQ ID NO: 1573979 - DNA, 14 bp, Homo sapiens
agatctgtgcccca

SEQ ID NO: 1573980 - DNA, 16 bp, Homo sapiens
agatctgtgccccatg

SEQ ID NO: 1573981 - DNA, 23 bp, Homo sapiens
agatctgtgtggctcctgggccg

SEQ ID NO: 1573982 - DNA, 23 bp, Homo sapiens
agatctgttttgtggtttggaat

SEQ ID NO: 1573983 - DNA, 14 bp, Homo sapiens
agatcttagattct

SEQ ID NO: 1573984 - DNA, 15 bp, Homo sapiens
agatcttagattctc

SEQ ID NO: 1573985 - DNA, 23 bp, Homo sapiens
agatcttaggtatagaggaccct

SEQ ID NO: 1573986 - DNA, 20 bp, Homo sapiens
agatcttccgtggtcagagt

SEQ ID NO: 1573987 - DNA, 12 bp, Homo sapiens
agatctttcaga

SEQ ID NO: 1573988 - DNA, 14 bp, Homo sapiens
agatctttctcttc

SEQ ID NO: 1573989 - DNA, 20 bp, Homo sapiens
agatctttctcttccctgaa

SEQ ID NO: 1573990 - DNA, 14 bp, Homo sapiens
agatctttgtaaat

SEQ ID NO: 1573991 - DNA, 22 bp, Homo sapiens
agatcttttagaagtgagagaa

SEQ ID NO: 1573992 - DNA, 21 bp, Homo sapiens
agatgaactctttctggcctg

SEQ ID NO: 1573993 - DNA, 18 bp, Homo sapiens
agatgaatcaatgggaaa

SEQ ID NO: 1573994 - DNA, 13 bp, Homo sapiens
agatgacagctct

SEQ ID NO: 1573995 - DNA, 21 bp, Homo sapiens
agatgacagctcttctaagga

SEQ ID NO: 1573996 - DNA, 20 bp, Homo sapiens
agatgactatgcagaggcct

SEQ ID NO: 1573997 - DNA, 20 bp, Homo sapiens
agatgagaaatgatgaaaag

SEQ ID NO: 1573998 - DNA, 18 bp, Homo sapiens
agatgagatttgccagca

SEQ ID NO: 1573999 - DNA, 20 bp, Homo sapiens
agatgagatttgccagcaca

SEQ ID NO: 1574000 - DNA, 15 bp, Homo sapiens
agatgagcagtcaca

SEQ ID NO: 1574001 - DNA, 19 bp, Homo sapiens
agatgagcagtcacactgt

SEQ ID NO: 1574002 - DNA, 18 bp, Homo sapiens
agatgaggagtaaaattc

SEQ ID NO: 1574003 - DNA, 21 bp, Homo sapiens
agatgaggcaaacagcaagag

SEQ ID NO: 1574004 - DNA, 18 bp, Homo sapiens
agatgaggtcagttgtgt

SEQ ID NO: 1574005 - DNA, 21 bp, Homo sapiens
agatgaggtcagttgtgtttt

SEQ ID NO: 1574006 - DNA, 19 bp, Homo sapiens
agatgatcccagtcactcc

SEQ ID NO: 1574007 - DNA, 23 bp, Homo sapiens
agatgatcccagtcactcctctc

SEQ ID NO: 1574008 - DNA, 15 bp, Homo sapiens
agattatagattcta

SEQ ID NO: 1574009 - DNA, 16 bp, Homo sapiens
agattatagattctaa

SEQ ID NO: 1574010 - DNA, 21 bp, Homo sapiens
agattatagattctaaagatt

SEQ ID NO: 1574011 - DNA, 16 bp, Homo sapiens
agattatgttcctgct

SEQ ID NO: 1574012 - DNA, 17 bp, Homo sapiens
agattattataaactat

SEQ ID NO: 1574013 - DNA, 18 bp, Homo sapiens
agattattataaactata

SEQ ID NO: 1574014 - DNA, 19 bp, Homo sapiens
agattattataaactataa

SEQ ID NO: 1574015 - DNA, 15 bp, Homo sapiens
agattcaaaggttct

SEQ ID NO: 1574016 - DNA, 19 bp, Homo sapiens
agattcaaaggttctaggt

SEQ ID NO: 1574017 - DNA, 17 bp, Homo sapiens
agattcagaatgagaat

SEQ ID NO: 1574018 - DNA, 18 bp, Homo sapiens
agattcaggtatgttgcc

SEQ ID NO: 1574019 - DNA, 22 bp, Homo sapiens
agattcatatttacttcttata

SEQ ID NO: 1574020 - DNA, 18 bp, Homo sapiens
agattcatgatttataaa

SEQ ID NO: 1574021 - DNA, 12 bp, Homo sapiens
agattcattttt

SEQ ID NO: 1574022 - DNA, 17 bp, Homo sapiens
agattcatttttaatca

SEQ ID NO: 1574023 - DNA, 18 bp, Homo sapiens
agattccagagagtggct

SEQ ID NO: 1574024 - DNA, 16 bp, Homo sapiens
agattcccctgtgtca

SEQ ID NO: 1574025 - DNA, 18 bp, Homo sapiens
agattccggatcctaagc

SEQ ID NO: 1574026 - DNA, 14 bp, Homo sapiens
agattcctgggcct

SEQ ID NO: 1574027 - DNA, 16 bp, Homo sapiens
agattcctgggcctgt

SEQ ID NO: 1574028 - DNA, 15 bp, Homo sapiens
agattcgctgtcccc

SEQ ID NO: 1574029 - DNA, 18 bp, Homo sapiens
agattcgctgtcccctca

SEQ ID NO: 1574030 - DNA, 12 bp, Homo sapiens
agattctaaaga

SEQ ID NO: 1574031 - DNA, 14 bp, Homo sapiens
agattctaaagatt

SEQ ID NO: 1574032 - DNA, 15 bp, Homo sapiens
agattctaaagattc

SEQ ID NO: 1574033 - DNA, 16 bp, Homo sapiens
agattctaaagattct

SEQ ID NO: 1574034 - DNA, 23 bp, Homo sapiens
agattctaaaggtccacaggtct

SEQ ID NO: 1574035 - DNA, 12 bp, Homo sapiens
agattctaacgg

SEQ ID NO: 1574036 - DNA, 20 bp, Homo sapiens
agattctaagagaaggcctt

SEQ ID NO: 1574037 - DNA, 13 bp, Homo sapiens
agattctaatgat

SEQ ID NO: 1574038 - DNA, 14 bp, Homo sapiens
agattctactcttg

SEQ ID NO: 1574039 - DNA, 16 bp, Homo sapiens
agattctatagttcta

SEQ ID NO: 1574040 - DNA, 18 bp, Homo sapiens
agattctatagttctaga

SEQ ID NO: 1574041 - DNA, 15 bp, Homo sapiens
agattctcctgtgct

SEQ ID NO: 1574042 - DNA, 17 bp, Homo sapiens
agattctctgtgtctaa

SEQ ID NO: 1574043 - DNA, 22 bp, Homo sapiens
agattctctgtgtctaagattc

SEQ ID NO: 1574044 - DNA, 23 bp, Homo sapiens
agattctctgtgtctaagattct

SEQ ID NO: 1574045 - DNA, 13 bp, Homo sapiens
agattctcttgaa

SEQ ID NO: 1574046 - DNA, 13 bp, Homo sapiens
agattctctttaa

SEQ ID NO: 1574047 - DNA, 16 bp, Homo sapiens
agattctctttaaaaa

SEQ ID NO: 1574048 - DNA, 14 bp, Homo sapiens
agattctgatttta

SEQ ID NO: 1574049 - DNA, 20 bp, Homo sapiens
agattctgcctatgtaaaat

SEQ ID NO: 1574050 - DNA, 19 bp, Homo sapiens
agattctgtgatcttttaa

SEQ ID NO: 1574051 - DNA, 21 bp, Homo sapiens
agattctgtgatcttttaaag

SEQ ID NO: 1574052 - DNA, 23 bp, Homo sapiens
agattctgtgtcagagcccagcc

SEQ ID NO: 1574053 - DNA, 17 bp, Homo sapiens
agattcttacaaggccc

SEQ ID NO: 1574054 - DNA, 15 bp, Homo sapiens
agattctttaaggag

SEQ ID NO: 1574055 - DNA, 16 bp, Homo sapiens
agattctttaaggaga

SEQ ID NO: 1574056 - DNA, 19 bp, Homo sapiens
agattgaaaacttttctca

SEQ ID NO: 1574057 - DNA, 17 bp, Homo sapiens
agattgactaactcaaa

SEQ ID NO: 1574058 - DNA, 19 bp, Homo sapiens
agattgactaactcaaata

SEQ ID NO: 1574059 - DNA, 12 bp, Homo sapiens
agattgagaaat

SEQ ID NO: 1574060 - DNA, 17 bp, Homo sapiens
agattgagaaatgtgta

SEQ ID NO: 1574061 - DNA, 15 bp, Homo sapiens
agattgagaagccat

SEQ ID NO: 1574062 - DNA, 17 bp, Homo sapiens
agattgagaagccatgt

SEQ ID NO: 1574063 - DNA, 18 bp, Homo sapiens
agattgatatctataaaa

SEQ ID NO: 1574064 - DNA, 15 bp, Homo sapiens
agattgcttaaaata

SEQ ID NO: 1574065 - DNA, 16 bp, Homo sapiens
agattgcttaaaatag

SEQ ID NO: 1574066 - DNA, 15 bp, Homo sapiens
agattgcttctgtag

SEQ ID NO: 1574067 - DNA, 17 bp, Homo sapiens
agattgcttctgtagta

SEQ ID NO: 1574068 - DNA, 15 bp, Homo sapiens
agattggcatggctt

SEQ ID NO: 1574069 - DNA, 14 bp, Homo sapiens
agattggctcacac

SEQ ID NO: 1574070 - DNA, 23 bp, Homo sapiens
agattggctcacactgagaatgt

SEQ ID NO: 1574071 - DNA, 18 bp, Homo sapiens
agattggctttgccttta

SEQ ID NO: 1574072 - DNA, 14 bp, Homo sapiens
agattgggataagg

SEQ ID NO: 1574073 - DNA, 15 bp, Homo sapiens
agattggtgttcgtt

SEQ ID NO: 1574074 - DNA, 12 bp, Homo sapiens
agattgtactta

SEQ ID NO: 1574075 - DNA, 16 bp, Homo sapiens
agattgtacttagcca

SEQ ID NO: 1574076 - DNA, 14 bp, Homo sapiens
agattgtgtacata

SEQ ID NO: 1574077 - DNA, 23 bp, Homo sapiens
agattgtgtacatagagcaatgt

SEQ ID NO: 1574078 - DNA, 14 bp, Homo sapiens
agattgttggtgaa

SEQ ID NO: 1574079 - DNA, 22 bp, Homo sapiens
agattgttgtttgccatacttt

SEQ ID NO: 1574080 - DNA, 23 bp, Homo sapiens
agattgttgtttgccatactttg

SEQ ID NO: 1574081 - DNA, 23 bp, Homo sapiens
agatttaagtgaatacattaacg

SEQ ID NO: 1574082 - DNA, 22 bp, Homo sapiens
agatttaattaatcatgaatgt

SEQ ID NO: 1574083 - DNA, 16 bp, Homo sapiens
agatttactaaatcaa

SEQ ID NO: 1574084 - DNA, 13 bp, Homo sapiens
agatttagtttac

SEQ ID NO: 1574085 - DNA, 13 bp, Homo sapiens
agatttcaagaga

SEQ ID NO: 1574086 - DNA, 19 bp, Homo sapiens
agatttcagaggctgcagg

SEQ ID NO: 1574087 - DNA, 18 bp, Homo sapiens
agatttccctaaaaattc

SEQ ID NO: 1574088 - DNA, 19 bp, Homo sapiens
agatttcctcctcccagtg

SEQ ID NO: 1574089 - DNA, 17 bp, Homo sapiens
agatttctcactatata

SEQ ID NO: 1574090 - DNA, 18 bp, Homo sapiens
agatttctggcatatgtt

SEQ ID NO: 1574091 - DNA, 14 bp, Homo sapiens
agatttctggttga

SEQ ID NO: 1574092 - DNA, 22 bp, Homo sapiens
agatttcttaaataatgcttca

SEQ ID NO: 1574093 - DNA, 19 bp, Homo sapiens
agatttcttgagttttgtt

SEQ ID NO: 1574094 - DNA, 13 bp, Homo sapiens
agatttgccagca

SEQ ID NO: 1574095 - DNA, 12 bp, Homo sapiens
agatttggaata

SEQ ID NO: 1574096 - DNA, 15 bp, Homo sapiens
agatttgggagctga

SEQ ID NO: 1574097 - DNA, 15 bp, Homo sapiens
agatttgtctaattg

SEQ ID NO: 1574098 - DNA, 18 bp, Homo sapiens
agatttgtgaactggaag

SEQ ID NO: 1574099 - DNA, 19 bp, Homo sapiens
agatttgtgaactggaaga

SEQ ID NO: 1574100 - DNA, 23 bp, Homo sapiens
agatttgttgacagcaaaatgtt

SEQ ID NO: 1574101 - DNA, 17 bp, Homo sapiens
agatttgtttttgtaga

SEQ ID NO: 1574102 - DNA, 12 bp, Homo sapiens
agattttaaaga

SEQ ID NO: 1574103 - DNA, 18 bp, Homo sapiens
agattttaatttatttgt

SEQ ID NO: 1574104 - DNA, 15 bp, Homo sapiens
agattttattgtata

SEQ ID NO: 1574105 - DNA, 18 bp, Homo sapiens
agattttatttgtaattt

SEQ ID NO: 1574106 - DNA, 12 bp, Homo sapiens
agattttcagaa

SEQ ID NO: 1574107 - DNA, 14 bp, Homo sapiens
agattttcatgcaa

SEQ ID NO: 1574108 - DNA, 18 bp, Homo sapiens
agattttcctccattttt

SEQ ID NO: 1574109 - DNA, 16 bp, Homo sapiens
agattttctggttcta

SEQ ID NO: 1574110 - DNA, 23 bp, Homo sapiens
agattttgtgtttattcttgatg

SEQ ID NO: 1574111 - DNA, 21 bp, Homo sapiens
agatttttaaaaaatattttc

SEQ ID NO: 1574112 - DNA, 20 bp, Homo sapiens
agatttttactaatatatat

SEQ ID NO: 1574113 - DNA, 23 bp, Homo sapiens
agatttttactaatatatatttt

SEQ ID NO: 1574114 - DNA, 19 bp, Homo sapiens
agatttttaggagtgatta

SEQ ID NO: 1574115 - DNA, 14 bp, Homo sapiens
agatttttgaatca

SEQ ID NO: 1574116 - DNA, 13 bp, Homo sapiens
agatttttttcct

SEQ ID NO: 1574117 - DNA, 14 bp, Homo sapiens
agcaaaaaagagtt

SEQ ID NO: 1574118 - DNA, 15 bp, Homo sapiens
agcaaaaaaggaaaa

SEQ ID NO: 1574119 - DNA, 16 bp, Homo sapiens
agcaaaaactacattt

SEQ ID NO: 1574120 - DNA, 22 bp, Homo sapiens
agcaaaaactacattttgcaac

SEQ ID NO: 1574121 - DNA, 16 bp, Homo sapiens
agcaaaacatctctgc

SEQ ID NO: 1574122 - DNA, 20 bp, Homo sapiens
agcaaaacatcttttcctga

SEQ ID NO: 1574123 - DNA, 14 bp, Homo sapiens
agcaaaaccaaaga

SEQ ID NO: 1574124 - DNA, 17 bp, Homo sapiens
agcaaaagaccaaatct

SEQ ID NO: 1574125 - DNA, 14 bp, Homo sapiens
agcaaaagagaaat

SEQ ID NO: 1574126 - DNA, 19 bp, Homo sapiens
agcaaaattgatgtgttta

SEQ ID NO: 1574127 - DNA, 14 bp, Homo sapiens
agcaaacccagagg

SEQ ID NO: 1574128 - DNA, 16 bp, Homo sapiens
agcaaacgttgggcat

SEQ ID NO: 1574129 - DNA, 23 bp, Homo sapiens
agcaaactaaccagcattcccta

SEQ ID NO: 1574130 - DNA, 12 bp, Homo sapiens
agcaaagatcaa

SEQ ID NO: 1574131 - DNA, 13 bp, Homo sapiens
agcaaagatcaaa

SEQ ID NO: 1574132 - DNA, 14 bp, Homo sapiens
agcaaagatcaaaa

SEQ ID NO: 1574133 - DNA, 15 bp, Homo sapiens
agcaaagatcaaaat

SEQ ID NO: 1574134 - DNA, 12 bp, Homo sapiens
agcaaagatgca

SEQ ID NO: 1574135 - DNA, 23 bp, Homo sapiens
agcaaagattaaatgtgtcattg

SEQ ID NO: 1574136 - DNA, 20 bp, Homo sapiens
agcaaagcaaaaggctgaga

SEQ ID NO: 1574137 - DNA, 19 bp, Homo sapiens
agcaaagcgcccacccagg

SEQ ID NO: 1574138 - DNA, 12 bp, Homo sapiens
agcaaaggctcc

SEQ ID NO: 1574139 - DNA, 18 bp, Homo sapiens
agcaaaggctccctcgcc

SEQ ID NO: 1574140 - DNA, 17 bp, Homo sapiens
agcaaaggggacagctg

SEQ ID NO: 1574141 - DNA, 17 bp, Homo sapiens
agcaaatacaattcaca

SEQ ID NO: 1574142 - DNA, 20 bp, Homo sapiens
agcaaatacaattcacagca

SEQ ID NO: 1574143 - DNA, 22 bp, Homo sapiens
agcaaatcatctgcattcctga

SEQ ID NO: 1574144 - DNA, 14 bp, Homo sapiens
agcaaatgcaaaaa

SEQ ID NO: 1574145 - DNA, 22 bp, Homo sapiens
agcaaatgcaaaaactctttga

SEQ ID NO: 1574146 - DNA, 17 bp, Homo sapiens
agcaaatgcaaaaataa

SEQ ID NO: 1574147 - DNA, 13 bp, Homo sapiens
agcaaatggcgtt

SEQ ID NO: 1574148 - DNA, 24 bp, Homo sapiens
agcaaatgggtgcccgtatccaga

SEQ ID NO: 1574149 - DNA, 14 bp, Homo sapiens
agcaacaaaatcat

SEQ ID NO: 1574150 - DNA, 12 bp, Homo sapiens
agcaacaagact

SEQ ID NO: 1574151 - DNA, 15 bp, Homo sapiens
agcaacaatttatga

SEQ ID NO: 1574152 - DNA, 15 bp, Homo sapiens
agcaacacagcctgg

SEQ ID NO: 1574153 - DNA, 20 bp, Homo sapiens
agcaacagagtgagaccctg

SEQ ID NO: 1574154 - DNA, 22 bp, Homo sapiens
agcaacagagtgagaccctgtc

SEQ ID NO: 1574155 - DNA, 17 bp, Homo sapiens
agcaacagcttcagaaa

SEQ ID NO: 1574156 - DNA, 22 bp, Homo sapiens
agcaacccctgtacccagctcc

SEQ ID NO: 1574157 - DNA, 20 bp, Homo sapiens
agcaacctgtaactcacatt

SEQ ID NO: 1574158 - DNA, 14 bp, Homo sapiens
agcaacgcaggccc

SEQ ID NO: 1574159 - DNA, 14 bp, Homo sapiens
agcaacgcccctcc

SEQ ID NO: 1574160 - DNA, 23 bp, Homo sapiens
agcaacgcttgtagaactcactc

SEQ ID NO: 1574161 - DNA, 16 bp, Homo sapiens
agcaactaatgtttga

SEQ ID NO: 1574162 - DNA, 21 bp, Homo sapiens
agcaactaatgtttgaacaaa

SEQ ID NO: 1574163 - DNA, 22 bp, Homo sapiens
agcaactgaacaaaagctcagg

SEQ ID NO: 1574164 - DNA, 16 bp, Homo sapiens
agcaactgcccttcca

SEQ ID NO: 1574165 - DNA, 20 bp, Homo sapiens
agcaactgcgacaaaacatt

SEQ ID NO: 1574166 - DNA, 13 bp, Homo sapiens
agcaactgctggt

SEQ ID NO: 1574167 - DNA, 23 bp, Homo sapiens
agcaacttgtctttttctggact

SEQ ID NO: 1574168 - DNA, 15 bp, Homo sapiens
agcaacttttgtgta

SEQ ID NO: 1574169 - DNA, 17 bp, Homo sapiens
agcaagaccccatctca

SEQ ID NO: 1574170 - DNA, 16 bp, Homo sapiens
agcaagactgttgctc

SEQ ID NO: 1574171 - DNA, 17 bp, Homo sapiens
agcaagaggaggacaga

SEQ ID NO: 1574172 - DNA, 21 bp, Homo sapiens
agcaagatcctgtctttaagg

SEQ ID NO: 1574173 - DNA, 19 bp, Homo sapiens
agcaagatgttttgtataa

SEQ ID NO: 1574174 - DNA, 23 bp, Homo sapiens
agcaagatgttttgtataaaatc

SEQ ID NO: 1574175 - DNA, 18 bp, Homo sapiens
agcaagcagtagcatttg

SEQ ID NO: 1574176 - DNA, 14 bp, Homo sapiens
agcaagccatcatc

SEQ ID NO: 1574177 - DNA, 20 bp, Homo sapiens
agcaagccctacagagctgt

SEQ ID NO: 1574178 - DNA, 22 bp, Homo sapiens
agcaaggaaggtaaaaagttaa

SEQ ID NO: 1574179 - DNA, 9 bp, Homo sapiens
agcaaggcc

SEQ ID NO: 1574180 - DNA, 24 bp, Homo sapiens
agcaaggccttggtggagcagcca

SEQ ID NO: 1574181 - DNA, 19 bp, Homo sapiens
agcaaggcgcctgccttgg

SEQ ID NO: 1574182 - DNA, 20 bp, Homo sapiens
agcaaggcgcctgccttggg

SEQ ID NO: 1574183 - DNA, 23 bp, Homo sapiens
agcaagggaccttcatgcccttc

SEQ ID NO: 1574184 - DNA, 14 bp, Homo sapiens
agcaagggagaaaa

SEQ ID NO: 1574185 - DNA, 14 bp, Homo sapiens
agcaagggctccag

SEQ ID NO: 1574186 - DNA, 16 bp, Homo sapiens
agcaaggggctctgcc

SEQ ID NO: 1574187 - DNA, 18 bp, Homo sapiens
agcaagggggtgatgtag

SEQ ID NO: 1574188 - DNA, 16 bp, Homo sapiens
agcaagggtgatggga

SEQ ID NO: 1574189 - DNA, 17 bp, Homo sapiens
agcaaggtgtccctgcc

SEQ ID NO: 1574190 - DNA, 13 bp, Homo sapiens
agcaagtaaaaag

SEQ ID NO: 1574191 - DNA, 14 bp, Homo sapiens
agcaagtgaatttt

SEQ ID NO: 1574192 - DNA, 15 bp, Homo sapiens
agcaagttttcttcc

SEQ ID NO: 1574193 - DNA, 22 bp, Homo sapiens
agcaatacgtttgtgcagaatc

SEQ ID NO: 1574194 - DNA, 16 bp, Homo sapiens
agcaatatattaccag

SEQ ID NO: 1574195 - DNA, 22 bp, Homo sapiens
agcaatcaaggttataattttt

SEQ ID NO: 1574196 - DNA, 15 bp, Homo sapiens
agcaatcctcccact

SEQ ID NO: 1574197 - DNA, 20 bp, Homo sapiens
agcaatctgcattttaacaa

SEQ ID NO: 1574198 - DNA, 21 bp, Homo sapiens
agcaatctgcattttaacaag

SEQ ID NO: 1574199 - DNA, 18 bp, Homo sapiens
agcaatgatgtccagaag

SEQ ID NO: 1574200 - DNA, 19 bp, Homo sapiens
agcaatgatgtccagaaga

SEQ ID NO: 1574201 - DNA, 15 bp, Homo sapiens
agcaatgtctgtgct

SEQ ID NO: 1574202 - DNA, 21 bp, Homo sapiens
agcaatgtgagtcccagagcc

SEQ ID NO: 1574203 - DNA, 22 bp, Homo sapiens
agcaatgtgagtcccagagccc

SEQ ID NO: 1574204 - DNA, 15 bp, Homo sapiens
agcaatgttggtttt

SEQ ID NO: 1574205 - DNA, 21 bp, Homo sapiens
agcaatgttggttttttataa

SEQ ID NO: 1574206 - DNA, 22 bp, Homo sapiens
agcaatgttggttttttataaa

SEQ ID NO: 1574207 - DNA, 16 bp, Homo sapiens
agcaattccaggctga

SEQ ID NO: 1574208 - DNA, 22 bp, Homo sapiens
agcaattccaggctgagccatg

SEQ ID NO: 1574209 - DNA, 20 bp, Homo sapiens
agcaattccatgctataaaa

SEQ ID NO: 1574210 - DNA, 18 bp, Homo sapiens
agcaattctcctgcctca

SEQ ID NO: 1574211 - DNA, 14 bp, Homo sapiens
agcaattgccctgt

SEQ ID NO: 1574212 - DNA, 14 bp, Homo sapiens
agcaattttctttg

SEQ ID NO: 1574213 - DNA, 11 bp, Homo sapiens
agcacaaaatt

SEQ ID NO: 1574214 - DNA, 19 bp, Homo sapiens
agcacaaacacacctctgc

SEQ ID NO: 1574215 - DNA, 17 bp, Homo sapiens
agcacaagggcacattg

SEQ ID NO: 1574216 - DNA, 21 bp, Homo sapiens
agcacaagggcacattgccca

SEQ ID NO: 1574217 - DNA, 16 bp, Homo sapiens
agcacaagtacttttg

SEQ ID NO: 1574218 - DNA, 22 bp, Homo sapiens
agcacaatctgtaaatttttaa

SEQ ID NO: 1574219 - DNA, 22 bp, Homo sapiens
agcacaatggtcttacattgga

SEQ ID NO: 1574220 - DNA, 12 bp, Homo sapiens
agcacacacagt

SEQ ID NO: 1574221 - DNA, 16 bp, Homo sapiens
agcacaccaagtggct

SEQ ID NO: 1574222 - DNA, 17 bp, Homo sapiens
agcacaccagccgctgc

SEQ ID NO: 1574223 - DNA, 20 bp, Homo sapiens
agcacacctcagccccactg

SEQ ID NO: 1574224 - DNA, 23 bp, Homo sapiens
agcacactttacacaagaatcta

SEQ ID NO: 1574225 - DNA, 12 bp, Homo sapiens
agcacagcctag

SEQ ID NO: 1574226 - DNA, 14 bp, Homo sapiens
agcacagctgggca

SEQ ID NO: 1574227 - DNA, 14 bp, Homo sapiens
agcacagcttgacc

SEQ ID NO: 1574228 - DNA, 23 bp, Homo sapiens
agcacaggaattctcaagacctg

SEQ ID NO: 1574229 - DNA, 13 bp, Homo sapiens
agcacaggcagct

SEQ ID NO: 1574230 - DNA, 21 bp, Homo sapiens
agcacaggggccccagatctg

SEQ ID NO: 1574231 - DNA, 19 bp, Homo sapiens
agcacagtctgatgacaca

SEQ ID NO: 1574232 - DNA, 17 bp, Homo sapiens
agcacagtttgaacaaa

SEQ ID NO: 1574233 - DNA, 18 bp, Homo sapiens
agcacatactgtgttcca

SEQ ID NO: 1574234 - DNA, 17 bp, Homo sapiens
agcacatagagcttttt

SEQ ID NO: 1574235 - DNA, 18 bp, Homo sapiens
agcacatagagcttttta

SEQ ID NO: 1574236 - DNA, 20 bp, Homo sapiens
agcacatagagctttttaat

SEQ ID NO: 1574237 - DNA, 16 bp, Homo sapiens
agcacatatggaattt

SEQ ID NO: 1574238 - DNA, 13 bp, Homo sapiens
agcacatcacctc

SEQ ID NO: 1574239 - DNA, 18 bp, Homo sapiens
agcacatcacctctttgc

SEQ ID NO: 1574240 - DNA, 23 bp, Homo sapiens
agcacatcacctctttgcccccg

SEQ ID NO: 1574241 - DNA, 17 bp, Homo sapiens
agcacatggccatagag

SEQ ID NO: 1574242 - DNA, 22 bp, Homo sapiens
agcacatggccatagaggccca

SEQ ID NO: 1574243 - DNA, 23 bp, Homo sapiens
agcacatggccatagaggcccag

SEQ ID NO: 1574244 - DNA, 21 bp, Homo sapiens
agcacatgtaataaattcaaa

SEQ ID NO: 1574245 - DNA, 13 bp, Homo sapiens
agcacattcggga

SEQ ID NO: 1574246 - DNA, 21 bp, Homo sapiens
agcacattcgggaccaatata

SEQ ID NO: 1574247 - DNA, 23 bp, Homo sapiens
agcacattcgggaccaatatata

SEQ ID NO: 1574248 - DNA, 19 bp, Homo sapiens
agcaccacctacacaggag

SEQ ID NO: 1574249 - DNA, 21 bp, Homo sapiens
agcaccccctgctccaccagc

SEQ ID NO: 1574250 - DNA, 14 bp, Homo sapiens
agcaccccttccat

SEQ ID NO: 1574251 - DNA, 17 bp, Homo sapiens
agcaccctcgagaaggg

SEQ ID NO: 1574252 - DNA, 13 bp, Homo sapiens
agcaccctctgga

SEQ ID NO: 1574253 - DNA, 20 bp, Homo sapiens
agcaccctgcagagcacaca

SEQ ID NO: 1574254 - DNA, 13 bp, Homo sapiens
agcaccctgggtg

SEQ ID NO: 1574255 - DNA, 21 bp, Homo sapiens
agcaccgcttttgttctcgca

SEQ ID NO: 1574256 - DNA, 15 bp, Homo sapiens
agcaccgggggagag

SEQ ID NO: 1574257 - DNA, 19 bp, Homo sapiens
agcaccgtgtcaagctgct

SEQ ID NO: 1574258 - DNA, 20 bp, Homo sapiens
agcaccgtgtcaagctgctc

SEQ ID NO: 1574259 - DNA, 21 bp, Homo sapiens
agcaccgtgtcaagctgctct

SEQ ID NO: 1574260 - DNA, 20 bp, Homo sapiens
agcacctcacctgagacctc

SEQ ID NO: 1574261 - DNA, 14 bp, Homo sapiens
agcacctcagcctg

SEQ ID NO: 1574262 - DNA, 22 bp, Homo sapiens
agcacctccaaccaaataagac

SEQ ID NO: 1574263 - DNA, 13 bp, Homo sapiens
agcacctcccagc

SEQ ID NO: 1574264 - DNA, 16 bp, Homo sapiens
agcacctcccagcccc

SEQ ID NO: 1574265 - DNA, 14 bp, Homo sapiens
agcacctccccgct

SEQ ID NO: 1574266 - DNA, 20 bp, Homo sapiens
agcacctgccagaggatgct

SEQ ID NO: 1574267 - DNA, 19 bp, Homo sapiens
agcacctgccgacctcgtc

SEQ ID NO: 1574268 - DNA, 12 bp, Homo sapiens
agcacctgtctg

SEQ ID NO: 1574269 - DNA, 13 bp, Homo sapiens
agcacctgtctgg

SEQ ID NO: 1574270 - DNA, 21 bp, Homo sapiens
agcaccttatctatgatgttt

SEQ ID NO: 1574271 - DNA, 16 bp, Homo sapiens
agcaccttggcccagg

SEQ ID NO: 1574272 - DNA, 20 bp, Homo sapiens
agcaccttggcccaggagct

SEQ ID NO: 1574273 - DNA, 17 bp, Homo sapiens
agcacgcctgccatctt

SEQ ID NO: 1574274 - DNA, 17 bp, Homo sapiens
agcacggactgtcagtt

SEQ ID NO: 1574275 - DNA, 14 bp, Homo sapiens
agcactaaagcagt

SEQ ID NO: 1574276 - DNA, 17 bp, Homo sapiens
agcactaaagcagtgga

SEQ ID NO: 1574277 - DNA, 16 bp, Homo sapiens
agcactaacgtaaata

SEQ ID NO: 1574278 - DNA, 22 bp, Homo sapiens
agcactagtaaaggaggaatag

SEQ ID NO: 1574279 - DNA, 17 bp, Homo sapiens
agcactattttatattt

SEQ ID NO: 1574280 - DNA, 22 bp, Homo sapiens
agcactattttatatttaaaaa

SEQ ID NO: 1574281 - DNA, 14 bp, Homo sapiens
agcactcagcctca

SEQ ID NO: 1574282 - DNA, 23 bp, Homo sapiens
agcactccccagagctgtgccag

SEQ ID NO: 1574283 - DNA, 21 bp, Homo sapiens
agcactcgagaccatcctggc

SEQ ID NO: 1574284 - DNA, 14 bp, Homo sapiens
agcactctctaaat

SEQ ID NO: 1574285 - DNA, 15 bp, Homo sapiens
agcactctctaaatc

SEQ ID NO: 1574286 - DNA, 20 bp, Homo sapiens
agcactctctaaatcttcct

SEQ ID NO: 1574287 - DNA, 19 bp, Homo sapiens
agcactctgagtttaccat

SEQ ID NO: 1574288 - DNA, 11 bp, Homo sapiens
agcactgaaaa

SEQ ID NO: 1574289 - DNA, 16 bp, Homo sapiens
agcactgaacctggga

SEQ ID NO: 1574290 - DNA, 17 bp, Homo sapiens
agcactgacttctaagt

SEQ ID NO: 1574291 - DNA, 12 bp, Homo sapiens
agcactgagcaa

SEQ ID NO: 1574292 - DNA, 17 bp, Homo sapiens
agcactgatttcacaac

SEQ ID NO: 1574293 - DNA, 19 bp, Homo sapiens
agcactgccattagactga

SEQ ID NO: 1574294 - DNA, 18 bp, Homo sapiens
agcactgctcacgtctct

SEQ ID NO: 1574295 - DNA, 20 bp, Homo sapiens
agcactgctcacgtctctgc

SEQ ID NO: 1574296 - DNA, 21 bp, Homo sapiens
agcactgctcacgtctctgcc

SEQ ID NO: 1574297 - DNA, 22 bp, Homo sapiens
agcactggaggggcccacccac

SEQ ID NO: 1574298 - DNA, 12 bp, Homo sapiens
agcactggccag

SEQ ID NO: 1574299 - DNA, 15 bp, Homo sapiens
agcactggccagaga

SEQ ID NO: 1574300 - DNA, 16 bp, Homo sapiens
agcactggccagagag

SEQ ID NO: 1574301 - DNA, 19 bp, Homo sapiens
agcactggccagagagggc

SEQ ID NO: 1574302 - DNA, 15 bp, Homo sapiens
agcactggggtgggg

SEQ ID NO: 1574303 - DNA, 17 bp, Homo sapiens
agcactgggttgacttt

SEQ ID NO: 1574304 - DNA, 23 bp, Homo sapiens
agcactggtgaactgagctgggc

SEQ ID NO: 1574305 - DNA, 13 bp, Homo sapiens
agcactgtccctt

SEQ ID NO: 1574306 - DNA, 16 bp, Homo sapiens
agcactgtcccttgcc

SEQ ID NO: 1574307 - DNA, 20 bp, Homo sapiens
agcactgtgaagacccagca

SEQ ID NO: 1574308 - DNA, 16 bp, Homo sapiens
agcacttaaacagaag

SEQ ID NO: 1574309 - DNA, 15 bp, Homo sapiens
agcacttgcgtcctg

SEQ ID NO: 1574310 - DNA, 17 bp, Homo sapiens
agcacttgcgtcctgca

SEQ ID NO: 1574311 - DNA, 19 bp, Homo sapiens
agcacttgcgtcctgcaga

SEQ ID NO: 1574312 - DNA, 14 bp, Homo sapiens
agcacttggagcca

SEQ ID NO: 1574313 - DNA, 15 bp, Homo sapiens
agcactttgcactta

SEQ ID NO: 1574314 - DNA, 16 bp, Homo sapiens
agcactttgcacttaa

SEQ ID NO: 1574315 - DNA, 14 bp, Homo sapiens
agcactttgggagg

SEQ ID NO: 1574316 - DNA, 21 bp, Homo sapiens
agcactttgggaggccgaggc

SEQ ID NO: 1574317 - DNA, 22 bp, Homo sapiens
agcactttgggaggctgaggtg

SEQ ID NO: 1574318 - DNA, 14 bp, Homo sapiens
agcacttttaaaaa

SEQ ID NO: 1574319 - DNA, 16 bp, Homo sapiens
agcacttttaaaaaaa

SEQ ID NO: 1574320 - DNA, 19 bp, Homo sapiens
agcagaaaaaaaagtgtct

SEQ ID NO: 1574321 - DNA, 18 bp, Homo sapiens
agcagaaaataaaggaag

SEQ ID NO: 1574322 - DNA, 14 bp, Homo sapiens
agcagaaattctgt

SEQ ID NO: 1574323 - DNA, 20 bp, Homo sapiens
agcagaaattctgtttttaa

SEQ ID NO: 1574324 - DNA, 22 bp, Homo sapiens
agcagaacaagtgcctcctgga

SEQ ID NO: 1574325 - DNA, 20 bp, Homo sapiens
agcagaacagatcttttact

SEQ ID NO: 1574326 - DNA, 22 bp, Homo sapiens
agcagaacaggtagtattacac

SEQ ID NO: 1574327 - DNA, 16 bp, Homo sapiens
agcagaacctgcacac

SEQ ID NO: 1574328 - DNA, 16 bp, Homo sapiens
agcagaatactggtct

SEQ ID NO: 1574329 - DNA, 19 bp, Homo sapiens
agcagaatgttgtacttga

SEQ ID NO: 1574330 - DNA, 14 bp, Homo sapiens
agcagaattttaat

SEQ ID NO: 1574331 - DNA, 15 bp, Homo sapiens
agcagaattttaatg

SEQ ID NO: 1574332 - DNA, 19 bp, Homo sapiens
agcagaattttaatgtgaa

SEQ ID NO: 1574333 - DNA, 17 bp, Homo sapiens
agcagacctacctgcag

SEQ ID NO: 1574334 - DNA, 23 bp, Homo sapiens
agcagacgcagcagctgggaccc

SEQ ID NO: 1574335 - DNA, 18 bp, Homo sapiens
agcagacgtatattgtat

SEQ ID NO: 1574336 - DNA, 14 bp, Homo sapiens
agcagactcagctg

SEQ ID NO: 1574337 - DNA, 14 bp, Homo sapiens
agcagagaattctc

SEQ ID NO: 1574338 - DNA, 19 bp, Homo sapiens
agcagagagagaggacaga

SEQ ID NO: 1574339 - DNA, 15 bp, Homo sapiens
agcagagagccaaat

SEQ ID NO: 1574340 - DNA, 16 bp, Homo sapiens
agcagagagccaaatc

SEQ ID NO: 1574341 - DNA, 22 bp, Homo sapiens
agcagagcgggactctgtccaa

SEQ ID NO: 1574342 - DNA, 13 bp, Homo sapiens
agcagaggcagcg

SEQ ID NO: 1574343 - DNA, 21 bp, Homo sapiens
agcagaggcgtactacccagc

SEQ ID NO: 1574344 - DNA, 22 bp, Homo sapiens
agcagaggcgtactacccagct

SEQ ID NO: 1574345 - DNA, 14 bp, Homo sapiens
agcagagggggagt

SEQ ID NO: 1574346 - DNA, 17 bp, Homo sapiens
agcagagtgaggatgtg

SEQ ID NO: 1574347 - DNA, 17 bp, Homo sapiens
agcagagtggactgcat

SEQ ID NO: 1574348 - DNA, 20 bp, Homo sapiens
agcagagtggactgcattta

SEQ ID NO: 1574349 - DNA, 12 bp, Homo sapiens
agcagagttaaa

SEQ ID NO: 1574350 - DNA, 15 bp, Homo sapiens
agcagagttttcatt

SEQ ID NO: 1574351 - DNA, 18 bp, Homo sapiens
agcagatctgttttgtgg

SEQ ID NO: 1574352 - DNA, 14 bp, Homo sapiens
agcagatgccattt

SEQ ID NO: 1574353 - DNA, 22 bp, Homo sapiens
agcagattgtttcctcttccaa

SEQ ID NO: 1574354 - DNA, 18 bp, Homo sapiens
agcagatttaacaattcc

SEQ ID NO: 1574355 - DNA, 22 bp, Homo sapiens
agcagattttaattttgaataa

SEQ ID NO: 1574356 - DNA, 16 bp, Homo sapiens
agcagcacacctcagc

SEQ ID NO: 1574357 - DNA, 16 bp, Homo sapiens
agcagcagagaaccat

SEQ ID NO: 1574358 - DNA, 13 bp, Homo sapiens
agcagcagcacca

SEQ ID NO: 1574359 - DNA, 13 bp, Homo sapiens
agcagcagcaggt

SEQ ID NO: 1574360 - DNA, 13 bp, Homo sapiens
agcagcagccagc

SEQ ID NO: 1574361 - DNA, 14 bp, Homo sapiens
agcagcagcccaag

SEQ ID NO: 1574362 - DNA, 13 bp, Homo sapiens
agcagcaggctca

SEQ ID NO: 1574363 - DNA, 14 bp, Homo sapiens
agcagcaggctcag

SEQ ID NO: 1574364 - DNA, 15 bp, Homo sapiens
agcagcaggctcagg

SEQ ID NO: 1574365 - DNA, 12 bp, Homo sapiens
agcagcaggtga

SEQ ID NO: 1574366 - DNA, 14 bp, Homo sapiens
agcagcatggaaaa

SEQ ID NO: 1574367 - DNA, 19 bp, Homo sapiens
agcagcatggaaaaatggt

SEQ ID NO: 1574368 - DNA, 21 bp, Homo sapiens
agcagccactgcacaggagga

SEQ ID NO: 1574369 - DNA, 12 bp, Homo sapiens
agcagccagagc

SEQ ID NO: 1574370 - DNA, 14 bp, Homo sapiens
agcagccagagctg

SEQ ID NO: 1574371 - DNA, 13 bp, Homo sapiens
agcagccagccag

SEQ ID NO: 1574372 - DNA, 14 bp, Homo sapiens
agcagccagccagt

SEQ ID NO: 1574373 - DNA, 15 bp, Homo sapiens
agcagccagccagtc

SEQ ID NO: 1574374 - DNA, 16 bp, Homo sapiens
agcagccagccagtct

SEQ ID NO: 1574375 - DNA, 18 bp, Homo sapiens
agcagccagctctcagcc

SEQ ID NO: 1574376 - DNA, 23 bp, Homo sapiens
agcagccagctctcagccaacga

SEQ ID NO: 1574377 - DNA, 22 bp, Homo sapiens
agcagccagggacccccagaac

SEQ ID NO: 1574378 - DNA, 19 bp, Homo sapiens
agcagccatcataggaagg

SEQ ID NO: 1574379 - DNA, 20 bp, Homo sapiens
agcagccatcataggaaggg

SEQ ID NO: 1574380 - DNA, 19 bp, Homo sapiens
agcagcccaagcttccctc

SEQ ID NO: 1574381 - DNA, 12 bp, Homo sapiens
agcagcccaccc

SEQ ID NO: 1574382 - DNA, 14 bp, Homo sapiens
agcagcccaccctg

SEQ ID NO: 1574383 - DNA, 16 bp, Homo sapiens
agcagcccaccctgct

SEQ ID NO: 1574384 - DNA, 13 bp, Homo sapiens
agcagcccagctt

SEQ ID NO: 1574385 - DNA, 14 bp, Homo sapiens
agcagcccagggcc

SEQ ID NO: 1574386 - DNA, 18 bp, Homo sapiens
agcagcccatggcctctg

SEQ ID NO: 1574387 - DNA, 19 bp, Homo sapiens
agcagcccccgggccgctg

SEQ ID NO: 1574388 - DNA, 22 bp, Homo sapiens
agcagcccccgggccgctggct

SEQ ID NO: 1574389 - DNA, 15 bp, Homo sapiens
agcagcccggggagg

SEQ ID NO: 1574390 - DNA, 18 bp, Homo sapiens
agcagcccggggaggaac

SEQ ID NO: 1574391 - DNA, 14 bp, Homo sapiens
agcagccctaagga

SEQ ID NO: 1574392 - DNA, 18 bp, Homo sapiens
agcagccctaaggatctc

SEQ ID NO: 1574393 - DNA, 17 bp, Homo sapiens
agcagccctcctcaccc

SEQ ID NO: 1574394 - DNA, 18 bp, Homo sapiens
agcagccctcctcacccc

SEQ ID NO: 1574395 - DNA, 21 bp, Homo sapiens
agcagccgccttaagctgatc

SEQ ID NO: 1574396 - DNA, 17 bp, Homo sapiens
agcagcctccactgtgt

SEQ ID NO: 1574397 - DNA, 19 bp, Homo sapiens
agcagcctccactgtgtcc

SEQ ID NO: 1574398 - DNA, 21 bp, Homo sapiens
agcagcctccactgtgtccag

SEQ ID NO: 1574399 - DNA, 16 bp, Homo sapiens
agcagcctccctgtca

SEQ ID NO: 1574400 - DNA, 12 bp, Homo sapiens
agcagcctcgca

SEQ ID NO: 1574401 - DNA, 20 bp, Homo sapiens
agcagcctcgcacaggccct

SEQ ID NO: 1574402 - DNA, 14 bp, Homo sapiens
agcagcctctgcca

SEQ ID NO: 1574403 - DNA, 20 bp, Homo sapiens
agcagcctctgccaggcctg

SEQ ID NO: 1574404 - DNA, 14 bp, Homo sapiens
agcagcctgatggc

SEQ ID NO: 1574405 - DNA, 22 bp, Homo sapiens
agcagcctttctctctttatac

SEQ ID NO: 1574406 - DNA, 22 bp, Homo sapiens
agcagcggattgctctggagca

SEQ ID NO: 1574407 - DNA, 17 bp, Homo sapiens
agcagcggtttggggag

SEQ ID NO: 1574408 - DNA, 23 bp, Homo sapiens
agcagcggtttggggagcagaga

SEQ ID NO: 1574409 - DNA, 20 bp, Homo sapiens
agcagctaaaccaaggactg

SEQ ID NO: 1574410 - DNA, 19 bp, Homo sapiens
agcagctaactccgagagc

SEQ ID NO: 1574411 - DNA, 13 bp, Homo sapiens
agcagctcaggca

SEQ ID NO: 1574412 - DNA, 21 bp, Homo sapiens
agcagctcatagaattttgag

SEQ ID NO: 1574413 - DNA, 22 bp, Homo sapiens
agcagctccttcctagccttgc

SEQ ID NO: 1574414 - DNA, 16 bp, Homo sapiens
agcagctgcgggtctg

SEQ ID NO: 1574415 - DNA, 10 bp, Homo sapiens
agcagctgga

SEQ ID NO: 1574416 - DNA, 21 bp, Homo sapiens
agcagctgggacccctcccaa

SEQ ID NO: 1574417 - DNA, 21 bp, Homo sapiens
agcagctggtcagtctttgct

SEQ ID NO: 1574418 - DNA, 16 bp, Homo sapiens
agcagctggtgcccca

SEQ ID NO: 1574419 - DNA, 19 bp, Homo sapiens
agcagctggtgccccacct

SEQ ID NO: 1574420 - DNA, 23 bp, Homo sapiens
agcagctggtgccccacctgcct

SEQ ID NO: 1574421 - DNA, 16 bp, Homo sapiens
agcagcttccagattg

SEQ ID NO: 1574422 - DNA, 16 bp, Homo sapiens
agcagctttgtctctg

SEQ ID NO: 1574423 - DNA, 21 bp, Homo sapiens
agcagcttttggtctccttgg

SEQ ID NO: 1574424 - DNA, 22 bp, Homo sapiens
agcagcttttggtctccttggg

SEQ ID NO: 1574425 - DNA, 24 bp, Homo sapiens
agcaggaaggaacaaagacaggca

SEQ ID NO: 1574426 - DNA, 21 bp, Homo sapiens
agcaggaatatatgtgtgcct

SEQ ID NO: 1574427 - DNA, 21 bp, Homo sapiens
agcaggacctactaggagagg

SEQ ID NO: 1574428 - DNA, 14 bp, Homo sapiens
agcaggactccagg

SEQ ID NO: 1574429 - DNA, 19 bp, Homo sapiens
agcaggactccaggcccaa

SEQ ID NO: 1574430 - DNA, 23 bp, Homo sapiens
agcaggactccaggcccaaggct

SEQ ID NO: 1574431 - DNA, 15 bp, Homo sapiens
agcaggagcagctgt

SEQ ID NO: 1574432 - DNA, 15 bp, Homo sapiens
agcaggaggcccctg

SEQ ID NO: 1574433 - DNA, 23 bp, Homo sapiens
agcaggaggcccctggcccagcg

SEQ ID NO: 1574434 - DNA, 14 bp, Homo sapiens
agcaggcacaggac

SEQ ID NO: 1574435 - DNA, 14 bp, Homo sapiens
agcaggcacatgga

SEQ ID NO: 1574436 - DNA, 16 bp, Homo sapiens
agcaggcacatggagg

SEQ ID NO: 1574437 - DNA, 19 bp, Homo sapiens
agcaggcacgggtggtccc

SEQ ID NO: 1574438 - DNA, 21 bp, Homo sapiens
agcaggcagataagttggagc

SEQ ID NO: 1574439 - DNA, 14 bp, Homo sapiens
agcaggcagggctg

SEQ ID NO: 1574440 - DNA, 13 bp, Homo sapiens
agcaggcaggtgg

SEQ ID NO: 1574441 - DNA, 12 bp, Homo sapiens
agcaggcccagc

SEQ ID NO: 1574442 - DNA, 16 bp, Homo sapiens
agcaggcccagcatgc

SEQ ID NO: 1574443 - DNA, 17 bp, Homo sapiens
agcaggcccagcatgca

SEQ ID NO: 1574444 - DNA, 16 bp, Homo sapiens
agcaggctcaggcaca

SEQ ID NO: 1574445 - DNA, 16 bp, Homo sapiens
agcaggctcctggctg

SEQ ID NO: 1574446 - DNA, 17 bp, Homo sapiens
agcaggctcctggctgt

SEQ ID NO: 1574447 - DNA, 16 bp, Homo sapiens
agcagggaaagctcca

SEQ ID NO: 1574448 - DNA, 14 bp, Homo sapiens
agcagggaaggcct

SEQ ID NO: 1574449 - DNA, 16 bp, Homo sapiens
agcagggaaggcctga

SEQ ID NO: 1574450 - DNA, 17 bp, Homo sapiens
agcagggaaggcctgac

SEQ ID NO: 1574451 - DNA, 16 bp, Homo sapiens
agcagggaagggatga

SEQ ID NO: 1574452 - DNA, 19 bp, Homo sapiens
agcagggcatggctgggaa

SEQ ID NO: 1574453 - DNA, 18 bp, Homo sapiens
agcaggggaacaaaataa

SEQ ID NO: 1574454 - DNA, 23 bp, Homo sapiens
agcaggggaattccctccccctc

SEQ ID NO: 1574455 - DNA, 19 bp, Homo sapiens
agcaggggggctgtgccaa

SEQ ID NO: 1574456 - DNA, 18 bp, Homo sapiens
agcagggtccacagctgg

SEQ ID NO: 1574457 - DNA, 19 bp, Homo sapiens
agcagggtccacagctgga

SEQ ID NO: 1574458 - DNA, 14 bp, Homo sapiens
agcaggtaccactg

SEQ ID NO: 1574459 - DNA, 14 bp, Homo sapiens
agcaggtgtggtgg

SEQ ID NO: 1574460 - DNA, 18 bp, Homo sapiens
agcaggtgtggtggctca

SEQ ID NO: 1574461 - DNA, 19 bp, Homo sapiens
agcaggtgtggtggctcat

SEQ ID NO: 1574462 - DNA, 15 bp, Homo sapiens
agcaggttccccaag

SEQ ID NO: 1574463 - DNA, 18 bp, Homo sapiens
agcaggttccccaagggc

SEQ ID NO: 1574464 - DNA, 23 bp, Homo sapiens
agcaggttccccaagggccctgg

SEQ ID NO: 1574465 - DNA, 14 bp, Homo sapiens
agcaggttcttgat

SEQ ID NO: 1574466 - DNA, 13 bp, Homo sapiens
agcaggtttgttt

SEQ ID NO: 1574467 - DNA, 20 bp, Homo sapiens
agcaggtttgttttcagcac

SEQ ID NO: 1574468 - DNA, 15 bp, Homo sapiens
agcagtaaaaactgt

SEQ ID NO: 1574469 - DNA, 17 bp, Homo sapiens
agcagtaaatttgctag

SEQ ID NO: 1574470 - DNA, 20 bp, Homo sapiens
agcagtaaatttgctagcag

SEQ ID NO: 1574471 - DNA, 19 bp, Homo sapiens
agcagtacgtggcttcaga

SEQ ID NO: 1574472 - DNA, 21 bp, Homo sapiens
agcagtagaaataatatgcat

SEQ ID NO: 1574473 - DNA, 22 bp, Homo sapiens
agcagtagaaataatatgcatt

SEQ ID NO: 1574474 - DNA, 15 bp, Homo sapiens
agcagtatattagta

SEQ ID NO: 1574475 - DNA, 16 bp, Homo sapiens
agcagtatattagtat

SEQ ID NO: 1574476 - DNA, 11 bp, Homo sapiens
agcagtatttt

SEQ ID NO: 1574477 - DNA, 13 bp, Homo sapiens
agcagtattttgg

SEQ ID NO: 1574478 - DNA, 15 bp, Homo sapiens
agcagtcccattcat

SEQ ID NO: 1574479 - DNA, 19 bp, Homo sapiens
agcagtcctcttattccta

SEQ ID NO: 1574480 - DNA, 16 bp, Homo sapiens
agcagtcgtgcctgtg

SEQ ID NO: 1574481 - DNA, 19 bp, Homo sapiens
agcagtctccttcagcacg

SEQ ID NO: 1574482 - DNA, 17 bp, Homo sapiens
agcagtctgataaactg

SEQ ID NO: 1574483 - DNA, 15 bp, Homo sapiens
agcagtcttgctctg

SEQ ID NO: 1574484 - DNA, 18 bp, Homo sapiens
agcagtgaatgctagaca

SEQ ID NO: 1574485 - DNA, 20 bp, Homo sapiens
agcagtgaatgctagacaga

SEQ ID NO: 1574486 - DNA, 22 bp, Homo sapiens
agcagtgagccgcatcttctcc

SEQ ID NO: 1574487 - DNA, 16 bp, Homo sapiens
agcagtgatctcaggg

SEQ ID NO: 1574488 - DNA, 23 bp, Homo sapiens
agcagtgccaatcgggcagaagt

SEQ ID NO: 1574489 - DNA, 21 bp, Homo sapiens
agcagtgcctcgaggcaccgg

SEQ ID NO: 1574490 - DNA, 22 bp, Homo sapiens
agcagtgcctcgaggcaccggc

SEQ ID NO: 1574491 - DNA, 17 bp, Homo sapiens
agcagtgccttccataa

SEQ ID NO: 1574492 - DNA, 19 bp, Homo sapiens
agcagtggacaccaggagt

SEQ ID NO: 1574493 - DNA, 11 bp, Homo sapiens
agcagtggctg

SEQ ID NO: 1574494 - DNA, 13 bp, Homo sapiens
agcagtggctggt

SEQ ID NO: 1574495 - DNA, 17 bp, Homo sapiens
agcagtggctggtccag

SEQ ID NO: 1574496 - DNA, 15 bp, Homo sapiens
agcagtgggcaggtg

SEQ ID NO: 1574497 - DNA, 14 bp, Homo sapiens
agcagtgtcccctg

SEQ ID NO: 1574498 - DNA, 20 bp, Homo sapiens
agcagtgtcccctgccccag

SEQ ID NO: 1574499 - DNA, 17 bp, Homo sapiens
agcagtgtctgtacctc

SEQ ID NO: 1574500 - DNA, 17 bp, Homo sapiens
agcagtgtcttccataa

SEQ ID NO: 1574501 - DNA, 13 bp, Homo sapiens
agcagttacagct

SEQ ID NO: 1574502 - DNA, 21 bp, Homo sapiens
agcagttatggtgatgactta

SEQ ID NO: 1574503 - DNA, 13 bp, Homo sapiens
agcagttcatgtc

SEQ ID NO: 1574504 - DNA, 21 bp, Homo sapiens
agcagttgacatccaaatcta

SEQ ID NO: 1574505 - DNA, 17 bp, Homo sapiens
agcagttgctcacatgt

SEQ ID NO: 1574506 - DNA, 13 bp, Homo sapiens
agcagttgttcca

SEQ ID NO: 1574507 - DNA, 16 bp, Homo sapiens
agcagtttctgtccta

SEQ ID NO: 1574508 - DNA, 18 bp, Homo sapiens
agcagttttcccctggcc

SEQ ID NO: 1574509 - DNA, 14 bp, Homo sapiens
agcagttttgtaaa

SEQ ID NO: 1574510 - DNA, 16 bp, Homo sapiens
agcagttttgtaaatg

SEQ ID NO: 1574511 - DNA, 18 bp, Homo sapiens
agcataaaactttggcaa

SEQ ID NO: 1574512 - DNA, 21 bp, Homo sapiens
agcataaaagatcaccttgta

SEQ ID NO: 1574513 - DNA, 18 bp, Homo sapiens
agcataaagctcaaatga

SEQ ID NO: 1574514 - DNA, 23 bp, Homo sapiens
agcataaagctcaaatgaaatgt

SEQ ID NO: 1574515 - DNA, 24 bp, Homo sapiens
agcataaggccggacgcatctcaa

SEQ ID NO: 1574516 - DNA, 23 bp, Homo sapiens
agcataagtttctgggacctcag

SEQ ID NO: 1574517 - DNA, 13 bp, Homo sapiens
agcataccaacac

SEQ ID NO: 1574518 - DNA, 22 bp, Homo sapiens
agcataccaacacgagcaggct

SEQ ID NO: 1574519 - DNA, 22 bp, Homo sapiens
agcataccaattacccataaac

SEQ ID NO: 1574520 - DNA, 22 bp, Homo sapiens
agcatactccgtgaggctgctg

SEQ ID NO: 1574521 - DNA, 16 bp, Homo sapiens
agcatagccagcattc

SEQ ID NO: 1574522 - DNA, 22 bp, Homo sapiens
agcatagccagcattcagcaca

SEQ ID NO: 1574523 - DNA, 15 bp, Homo sapiens
agcatagcctgcctg

SEQ ID NO: 1574524 - DNA, 17 bp, Homo sapiens
agcatagcctgcctgat

SEQ ID NO: 1574525 - DNA, 17 bp, Homo sapiens
agcatatgacaaatgtt

SEQ ID NO: 1574526 - DNA, 19 bp, Homo sapiens
agcatatgacaaatgtttc

SEQ ID NO: 1574527 - DNA, 23 bp, Homo sapiens
agcatatgggtgggattttgcaa

SEQ ID NO: 1574528 - DNA, 19 bp, Homo sapiens
agcatatttgccaataaag

SEQ ID NO: 1574529 - DNA, 14 bp, Homo sapiens
agcatattttgctg

SEQ ID NO: 1574530 - DNA, 20 bp, Homo sapiens
agcatcaagttctccccagg

SEQ ID NO: 1574531 - DNA, 13 bp, Homo sapiens
agcatcaatcttg

SEQ ID NO: 1574532 - DNA, 16 bp, Homo sapiens
agcatcaatcttgtta

SEQ ID NO: 1574533 - DNA, 16 bp, Homo sapiens
agcatcacctcaggcc

SEQ ID NO: 1574534 - DNA, 23 bp, Homo sapiens
agcatcagaggtttgcttcctca

SEQ ID NO: 1574535 - DNA, 23 bp, Homo sapiens
agcatcaggctaagaccctgtgt

SEQ ID NO: 1574536 - DNA, 13 bp, Homo sapiens
agcatccagcctg

SEQ ID NO: 1574537 - DNA, 12 bp, Homo sapiens
agcatcccccaa

SEQ ID NO: 1574538 - DNA, 20 bp, Homo sapiens
agcatccctgaggagccagg

SEQ ID NO: 1574539 - DNA, 22 bp, Homo sapiens
agcatcccttctgcccccgttc

SEQ ID NO: 1574540 - DNA, 21 bp, Homo sapiens
agcatccgcaggtgctggtcc

SEQ ID NO: 1574541 - DNA, 19 bp, Homo sapiens
agcatcgggagcacccaga

SEQ ID NO: 1574542 - DNA, 20 bp, Homo sapiens
agcatctaagttataagact

SEQ ID NO: 1574543 - DNA, 22 bp, Homo sapiens
agcatctaagttataagactct

SEQ ID NO: 1574544 - DNA, 16 bp, Homo sapiens
agcatctaatgaatgt

SEQ ID NO: 1574545 - DNA, 20 bp, Homo sapiens
agcatctactctaaagaaaa

SEQ ID NO: 1574546 - DNA, 13 bp, Homo sapiens
agcatctcccagt

SEQ ID NO: 1574547 - DNA, 13 bp, Homo sapiens
agcatctgaccat

SEQ ID NO: 1574548 - DNA, 14 bp, Homo sapiens
agcatctgaccatc

SEQ ID NO: 1574549 - DNA, 20 bp, Homo sapiens
agcatctgagaaggccctgt

SEQ ID NO: 1574550 - DNA, 13 bp, Homo sapiens
agcatctggctct

SEQ ID NO: 1574551 - DNA, 16 bp, Homo sapiens
agcatctggctctaat

SEQ ID NO: 1574552 - DNA, 13 bp, Homo sapiens
agcatctggctgt

SEQ ID NO: 1574553 - DNA, 18 bp, Homo sapiens
agcatcttcacttctaaa

SEQ ID NO: 1574554 - DNA, 20 bp, Homo sapiens
agcatcttcacttctaaatg

SEQ ID NO: 1574555 - DNA, 19 bp, Homo sapiens
agcatcttgggggggtggc

SEQ ID NO: 1574556 - DNA, 21 bp, Homo sapiens
agcatcttgggggggtggccg

SEQ ID NO: 1574557 - DNA, 23 bp, Homo sapiens
agcatcttgggggggtggccgct

SEQ ID NO: 1574558 - DNA, 14 bp, Homo sapiens
agcatgaaaaagca

SEQ ID NO: 1574559 - DNA, 17 bp, Homo sapiens
agcatgaaatgtgaatt

SEQ ID NO: 1574560 - DNA, 19 bp, Homo sapiens
agcatgaataaaacactca

SEQ ID NO: 1574561 - DNA, 20 bp, Homo sapiens
agcatgaataaaacactcat

SEQ ID NO: 1574562 - DNA, 21 bp, Homo sapiens
agcatgacaacttttaaagaa

SEQ ID NO: 1574563 - DNA, 17 bp, Homo sapiens
agcatgatctgaaaaat

SEQ ID NO: 1574564 - DNA, 20 bp, Homo sapiens
agcatgatcttgttactgtg

SEQ ID NO: 1574565 - DNA, 14 bp, Homo sapiens
agcatgatgggaaa

SEQ ID NO: 1574566 - DNA, 17 bp, Homo sapiens
agcatgatgggaaaata

SEQ ID NO: 1574567 - DNA, 19 bp, Homo sapiens
agcatgatgggaaaatatt

SEQ ID NO: 1574568 - DNA, 20 bp, Homo sapiens
agcatgatttatactcattt

SEQ ID NO: 1574569 - DNA, 15 bp, Homo sapiens
agcatgcgcagaggc

SEQ ID NO: 1574570 - DNA, 18 bp, Homo sapiens
agcatgcgcagaggccag

SEQ ID NO: 1574571 - DNA, 21 bp, Homo sapiens
agcatgctgctttttgtactt

SEQ ID NO: 1574572 - DNA, 19 bp, Homo sapiens
agcatgcttcctttctctc

SEQ ID NO: 1574573 - DNA, 20 bp, Homo sapiens
agcatgcttcctttctctcc

SEQ ID NO: 1574574 - DNA, 21 bp, Homo sapiens
agcatgcttcctttctctcct

SEQ ID NO: 1574575 - DNA, 23 bp, Homo sapiens
agcatgcttcctttctctcctgg

SEQ ID NO: 1574576 - DNA, 14 bp, Homo sapiens
agcatgcttgggct

SEQ ID NO: 1574577 - DNA, 17 bp, Homo sapiens
agcatgcttgggctgac

SEQ ID NO: 1574578 - DNA, 18 bp, Homo sapiens
agcatgcttgggctgacc

SEQ ID NO: 1574579 - DNA, 23 bp, Homo sapiens
agcatgcttgggctgacccagca

SEQ ID NO: 1574580 - DNA, 23 bp, Homo sapiens
agcatgcttgtgaaaatgtgttc

SEQ ID NO: 1574581 - DNA, 19 bp, Homo sapiens
agcatgctttgctgctatg

SEQ ID NO: 1574582 - DNA, 22 bp, Homo sapiens
agcatggcatatttttcacata

SEQ ID NO: 1574583 - DNA, 18 bp, Homo sapiens
agcatggctcaaagtgca

SEQ ID NO: 1574584 - DNA, 13 bp, Homo sapiens
agcatggggcgct

SEQ ID NO: 1574585 - DNA, 16 bp, Homo sapiens
agcatgggggctgcca

SEQ ID NO: 1574586 - DNA, 21 bp, Homo sapiens
agcatggtcacaagcacaaag

SEQ ID NO: 1574587 - DNA, 18 bp, Homo sapiens
agcatggttgcagataaa

SEQ ID NO: 1574588 - DNA, 23 bp, Homo sapiens
agcatggttgcagataaactgat

SEQ ID NO: 1574589 - DNA, 14 bp, Homo sapiens
agcatgtgccaaga

SEQ ID NO: 1574590 - DNA, 22 bp, Homo sapiens
agcatgtgccaagattctactc

SEQ ID NO: 1574591 - DNA, 17 bp, Homo sapiens
agcatgttgctgaggag

SEQ ID NO: 1574592 - DNA, 17 bp, Homo sapiens
agcattaagaacacttt

SEQ ID NO: 1574593 - DNA, 14 bp, Homo sapiens
agcattacattatt

SEQ ID NO: 1574594 - DNA, 21 bp, Homo sapiens
agcattacattattaaacgat

SEQ ID NO: 1574595 - DNA, 19 bp, Homo sapiens
agcattactctttttcaat

SEQ ID NO: 1574596 - DNA, 13 bp, Homo sapiens
agcattcaaaata

SEQ ID NO: 1574597 - DNA, 15 bp, Homo sapiens
agcattcaaaatagt

SEQ ID NO: 1574598 - DNA, 21 bp, Homo sapiens
agcattcaaaatagttctatt

SEQ ID NO: 1574599 - DNA, 22 bp, Homo sapiens
agcattcaaaatagttctattt

SEQ ID NO: 1574600 - DNA, 15 bp, Homo sapiens
agcattcagcacaca

SEQ ID NO: 1574601 - DNA, 13 bp, Homo sapiens
agcattccagctc

SEQ ID NO: 1574602 - DNA, 18 bp, Homo sapiens
agcattccagctctgccc

SEQ ID NO: 1574603 - DNA, 12 bp, Homo sapiens
agcattccagta

SEQ ID NO: 1574604 - DNA, 13 bp, Homo sapiens
agcattccagtaa

SEQ ID NO: 1574605 - DNA, 16 bp, Homo sapiens
agcattccagtaactt

SEQ ID NO: 1574606 - DNA, 22 bp, Homo sapiens
agcattccagtaacttttttgt

SEQ ID NO: 1574607 - DNA, 16 bp, Homo sapiens
agcattcttgtcacaa

SEQ ID NO: 1574608 - DNA, 22 bp, Homo sapiens
agcattcttgtcacaataaatg

SEQ ID NO: 1574609 - DNA, 22 bp, Homo sapiens
agcattgcctggactgaccaca

SEQ ID NO: 1574610 - DNA, 12 bp, Homo sapiens
agcattgctttc

SEQ ID NO: 1574611 - DNA, 17 bp, Homo sapiens
agcattgctttctgaaa

SEQ ID NO: 1574612 - DNA, 21 bp, Homo sapiens
agcattgcttttgtttcttaa

SEQ ID NO: 1574613 - DNA, 16 bp, Homo sapiens
agcattggcccctgag

SEQ ID NO: 1574614 - DNA, 17 bp, Homo sapiens
agcattggcccctgagc

SEQ ID NO: 1574615 - DNA, 16 bp, Homo sapiens
agcattgtaaaataat

SEQ ID NO: 1574616 - DNA, 20 bp, Homo sapiens
agcattgtaaaataattctg

SEQ ID NO: 1574617 - DNA, 22 bp, Homo sapiens
agcattgtaaaattatttcatg

SEQ ID NO: 1574618 - DNA, 16 bp, Homo sapiens
agcattgtctttgctg

SEQ ID NO: 1574619 - DNA, 17 bp, Homo sapiens
agcattgtctttgctgt

SEQ ID NO: 1574620 - DNA, 19 bp, Homo sapiens
agcattgtctttgctgtac

SEQ ID NO: 1574621 - DNA, 22 bp, Homo sapiens
agcatttaatggcagctagtgc

SEQ ID NO: 1574622 - DNA, 16 bp, Homo sapiens
agcatttactatgcac

SEQ ID NO: 1574623 - DNA, 14 bp, Homo sapiens
agcatttaggagaa

SEQ ID NO: 1574624 - DNA, 21 bp, Homo sapiens
agcatttaggagaatagcaga

SEQ ID NO: 1574625 - DNA, 22 bp, Homo sapiens
agcatttagttacaacctgaag

SEQ ID NO: 1574626 - DNA, 19 bp, Homo sapiens
agcatttcaaagccctgcc

SEQ ID NO: 1574627 - DNA, 14 bp, Homo sapiens
agcatttcatgaaa

SEQ ID NO: 1574628 - DNA, 21 bp, Homo sapiens
agcatttccaacaccacagac

SEQ ID NO: 1574629 - DNA, 23 bp, Homo sapiens
agcatttccaacaccacagacac

SEQ ID NO: 1574630 - DNA, 22 bp, Homo sapiens
agcatttggttttacacaggaa

SEQ ID NO: 1574631 - DNA, 12 bp, Homo sapiens
agcattttaagg

SEQ ID NO: 1574632 - DNA, 18 bp, Homo sapiens
agcattttaaggttctca

SEQ ID NO: 1574633 - DNA, 23 bp, Homo sapiens
agcattttagcaatttatacaat

SEQ ID NO: 1574634 - DNA, 18 bp, Homo sapiens
agcattttgaaacaaagt

SEQ ID NO: 1574635 - DNA, 14 bp, Homo sapiens
agcatttttatgca

SEQ ID NO: 1574636 - DNA, 18 bp, Homo sapiens
agcatttttatgcagaca

SEQ ID NO: 1574637 - DNA, 13 bp, Homo sapiens
agcatttttcaat

SEQ ID NO: 1574638 - DNA, 16 bp, Homo sapiens
agcatttttcaatata

SEQ ID NO: 1574639 - DNA, 22 bp, Homo sapiens
agcatttttcaatatattgaac

SEQ ID NO: 1574640 - DNA, 23 bp, Homo sapiens
agcatttttttaaaagaagcttt

SEQ ID NO: 1574641 - DNA, 23 bp, Homo sapiens
agccaaaaaggcaaataatggaa

SEQ ID NO: 1574642 - DNA, 22 bp, Homo sapiens
agccaaaatgtaggcttagttt

SEQ ID NO: 1574643 - DNA, 18 bp, Homo sapiens
agccaaacattcttattt

SEQ ID NO: 1574644 - DNA, 17 bp, Homo sapiens
agccaaactcaggccca

SEQ ID NO: 1574645 - DNA, 20 bp, Homo sapiens
agccaaactgtagatgaaga

SEQ ID NO: 1574646 - DNA, 15 bp, Homo sapiens
agccaaagaaacaag

SEQ ID NO: 1574647 - DNA, 10 bp, Homo sapiens
agccaaagtt

SEQ ID NO: 1574648 - DNA, 19 bp, Homo sapiens
agccaaatgaccgagccct

SEQ ID NO: 1574649 - DNA, 22 bp, Homo sapiens
agccaaatgaccgagccctgga

SEQ ID NO: 1574650 - DNA, 23 bp, Homo sapiens
agccaaatgaccgagccctggag

SEQ ID NO: 1574651 - DNA, 20 bp, Homo sapiens
agccaaatgcagggagggga

SEQ ID NO: 1574652 - DNA, 19 bp, Homo sapiens
agccaaatttaaaactgtt

SEQ ID NO: 1574653 - DNA, 23 bp, Homo sapiens
agccaacaactctgcctttatga

SEQ ID NO: 1574654 - DNA, 15 bp, Homo sapiens
agccaacctggactt

SEQ ID NO: 1574655 - DNA, 18 bp, Homo sapiens
agccaacctggacttcct

SEQ ID NO: 1574656 - DNA, 19 bp, Homo sapiens
agccaacctggacttcctg

SEQ ID NO: 1574657 - DNA, 21 bp, Homo sapiens
agccaacctggacttcctgtc

SEQ ID NO: 1574658 - DNA, 21 bp, Homo sapiens
agccaacgacaaagccaaact

SEQ ID NO: 1574659 - DNA, 21 bp, Homo sapiens
agccaacgagacacattgcct

SEQ ID NO: 1574660 - DNA, 13 bp, Homo sapiens
agccaactctggg

SEQ ID NO: 1574661 - DNA, 18 bp, Homo sapiens
agccaactgtttccctgc

SEQ ID NO: 1574662 - DNA, 20 bp, Homo sapiens
agccaactgtttccctgctg

SEQ ID NO: 1574663 - DNA, 21 bp, Homo sapiens
agccaactgtttccctgctga

SEQ ID NO: 1574664 - DNA, 15 bp, Homo sapiens
agccaacttgtaaat

SEQ ID NO: 1574665 - DNA, 19 bp, Homo sapiens
agccaacttgtaaatacac

SEQ ID NO: 1574666 - DNA, 20 bp, Homo sapiens
agccaacttgtaaatacacc

SEQ ID NO: 1574667 - DNA, 19 bp, Homo sapiens
agccaagagcgcaccattg

SEQ ID NO: 1574668 - DNA, 14 bp, Homo sapiens
agccaagatcgcac

SEQ ID NO: 1574669 - DNA, 18 bp, Homo sapiens
agccaagatcgcaccact

SEQ ID NO: 1574670 - DNA, 13 bp, Homo sapiens
agccaagcactgc

SEQ ID NO: 1574671 - DNA, 20 bp, Homo sapiens
agccaagcttcaaccctcag

SEQ ID NO: 1574672 - DNA, 20 bp, Homo sapiens
agccaagctttaaattatgt

SEQ ID NO: 1574673 - DNA, 16 bp, Homo sapiens
agccaaggacagggct

SEQ ID NO: 1574674 - DNA, 15 bp, Homo sapiens
agccaaggcagcgac

SEQ ID NO: 1574675 - DNA, 23 bp, Homo sapiens
agccaaggccctgagttggcagt

SEQ ID NO: 1574676 - DNA, 20 bp, Homo sapiens
agccaaggccgaagctctgg

SEQ ID NO: 1574677 - DNA, 22 bp, Homo sapiens
agccaaggccgaagctctggct

SEQ ID NO: 1574678 - DNA, 18 bp, Homo sapiens
agccaaggccgccagcgt

SEQ ID NO: 1574679 - DNA, 20 bp, Homo sapiens
agccaagggaaaggggtgct

SEQ ID NO: 1574680 - DNA, 19 bp, Homo sapiens
agccaagggaacctgtgtc

SEQ ID NO: 1574681 - DNA, 22 bp, Homo sapiens
agccaagggttcagagactcag

SEQ ID NO: 1574682 - DNA, 14 bp, Homo sapiens
agccaatcccctcc

SEQ ID NO: 1574683 - DNA, 21 bp, Homo sapiens
agccaatcccctccttgggca

SEQ ID NO: 1574684 - DNA, 22 bp, Homo sapiens
agccaatcccctccttgggcac

SEQ ID NO: 1574685 - DNA, 17 bp, Homo sapiens
agccacaaccacataca

SEQ ID NO: 1574686 - DNA, 12 bp, Homo sapiens
agccacaagctg

SEQ ID NO: 1574687 - DNA, 14 bp, Homo sapiens
agccacaagctgca

SEQ ID NO: 1574688 - DNA, 19 bp, Homo sapiens
agccacaagctgcactgtg

SEQ ID NO: 1574689 - DNA, 21 bp, Homo sapiens
agccacaagctgcactgtgaa

SEQ ID NO: 1574690 - DNA, 15 bp, Homo sapiens
agccacaagtcttcc

SEQ ID NO: 1574691 - DNA, 17 bp, Homo sapiens
agccacaattatataaa

SEQ ID NO: 1574692 - DNA, 17 bp, Homo sapiens
agccacacaaacgttta

SEQ ID NO: 1574693 - DNA, 13 bp, Homo sapiens
agccacactgggc

SEQ ID NO: 1574694 - DNA, 14 bp, Homo sapiens
agccacactgggcc

SEQ ID NO: 1574695 - DNA, 16 bp, Homo sapiens
agccacactgggcctg

SEQ ID NO: 1574696 - DNA, 20 bp, Homo sapiens
agccacagacccctgggagc

SEQ ID NO: 1574697 - DNA, 22 bp, Homo sapiens
agccacagacccctgggagctt

SEQ ID NO: 1574698 - DNA, 21 bp, Homo sapiens
agccacaggccccttttgtgg

SEQ ID NO: 1574699 - DNA, 21 bp, Homo sapiens
agccacaggcctgagatttca

SEQ ID NO: 1574700 - DNA, 23 bp, Homo sapiens
agccacaggcctgagatttcatc

SEQ ID NO: 1574701 - DNA, 17 bp, Homo sapiens
agccacagtcactggat

SEQ ID NO: 1574702 - DNA, 14 bp, Homo sapiens
agccacatgcccca

SEQ ID NO: 1574703 - DNA, 18 bp, Homo sapiens
agccacatgccccaggct

SEQ ID NO: 1574704 - DNA, 20 bp, Homo sapiens
agccacatgccccaggctct

SEQ ID NO: 1574705 - DNA, 16 bp, Homo sapiens
agccaccatgcctggc

SEQ ID NO: 1574706 - DNA, 14 bp, Homo sapiens
agccacccaagcct

SEQ ID NO: 1574707 - DNA, 17 bp, Homo sapiens
agccacccaagcctgct

SEQ ID NO: 1574708 - DNA, 20 bp, Homo sapiens
agccacccaagcctgctggc

SEQ ID NO: 1574709 - DNA, 21 bp, Homo sapiens
agccaccccgggctctctgct

SEQ ID NO: 1574710 - DNA, 19 bp, Homo sapiens
agccacccgtggggtgctg

SEQ ID NO: 1574711 - DNA, 21 bp, Homo sapiens
agccacccgtggggtgctgcc

SEQ ID NO: 1574712 - DNA, 21 bp, Homo sapiens
agccaccgaagccgcctgtgg

SEQ ID NO: 1574713 - DNA, 12 bp, Homo sapiens
agccacctccca

SEQ ID NO: 1574714 - DNA, 15 bp, Homo sapiens
agccacctcccaccc

SEQ ID NO: 1574715 - DNA, 16 bp, Homo sapiens
agccacctcccacccc

SEQ ID NO: 1574716 - DNA, 13 bp, Homo sapiens
agccacctgcaag

SEQ ID NO: 1574717 - DNA, 16 bp, Homo sapiens
agccaccttcccaccc

SEQ ID NO: 1574718 - DNA, 22 bp, Homo sapiens
agccacgcagggccatccactg

SEQ ID NO: 1574719 - DNA, 14 bp, Homo sapiens
agccacgtgaatgg

SEQ ID NO: 1574720 - DNA, 21 bp, Homo sapiens
agccacgttccttactgcaga

SEQ ID NO: 1574721 - DNA, 16 bp, Homo sapiens
agccactaaaacacaa

SEQ ID NO: 1574722 - DNA, 12 bp, Homo sapiens
agccactccagg

SEQ ID NO: 1574723 - DNA, 17 bp, Homo sapiens
agccactccccggcatg

SEQ ID NO: 1574724 - DNA, 14 bp, Homo sapiens
agccactcctgtcc

SEQ ID NO: 1574725 - DNA, 13 bp, Homo sapiens
agccactgaagct

SEQ ID NO: 1574726 - DNA, 16 bp, Homo sapiens
agccactgagcctggc

SEQ ID NO: 1574727 - DNA, 17 bp, Homo sapiens
agccactgagcctggcc

SEQ ID NO: 1574728 - DNA, 13 bp, Homo sapiens
agccactggaagg

SEQ ID NO: 1574729 - DNA, 17 bp, Homo sapiens
agccactggaaggagca

SEQ ID NO: 1574730 - DNA, 13 bp, Homo sapiens
agccactggcata

SEQ ID NO: 1574731 - DNA, 18 bp, Homo sapiens
agccactggtttctcaga

SEQ ID NO: 1574732 - DNA, 23 bp, Homo sapiens
agccactgtgcccagcccggata

SEQ ID NO: 1574733 - DNA, 17 bp, Homo sapiens
agccacttccccctctt

SEQ ID NO: 1574734 - DNA, 17 bp, Homo sapiens
agccacttctccccaga

SEQ ID NO: 1574735 - DNA, 13 bp, Homo sapiens
agccacttctggc

SEQ ID NO: 1574736 - DNA, 21 bp, Homo sapiens
agccagaaagcactacaatca

SEQ ID NO: 1574737 - DNA, 14 bp, Homo sapiens
agccagacactctg

SEQ ID NO: 1574738 - DNA, 22 bp, Homo sapiens
agccagacactctgctctgccc

SEQ ID NO: 1574739 - DNA, 19 bp, Homo sapiens
agccagactggcacagttt

SEQ ID NO: 1574740 - DNA, 15 bp, Homo sapiens
agccagagaggagca

SEQ ID NO: 1574741 - DNA, 15 bp, Homo sapiens
agccagagcccttca

SEQ ID NO: 1574742 - DNA, 19 bp, Homo sapiens
agccagagctgtgcctgct

SEQ ID NO: 1574743 - DNA, 11 bp, Homo sapiens
agccagaggct

SEQ ID NO: 1574744 - DNA, 16 bp, Homo sapiens
agccagagggagctgt

SEQ ID NO: 1574745 - DNA, 23 bp, Homo sapiens
agccagagtttttaaagccttct

SEQ ID NO: 1574746 - DNA, 18 bp, Homo sapiens
agccagatgcaggacagg

SEQ ID NO: 1574747 - DNA, 17 bp, Homo sapiens
agccagatgcctcccca

SEQ ID NO: 1574748 - DNA, 23 bp, Homo sapiens
agccagatgcctccccaagactg

SEQ ID NO: 1574749 - DNA, 21 bp, Homo sapiens
agccagatgctaggctgtctg

SEQ ID NO: 1574750 - DNA, 20 bp, Homo sapiens
agccagattctcttgaataa

SEQ ID NO: 1574751 - DNA, 22 bp, Homo sapiens
agccagcaatgatgtccagaag

SEQ ID NO: 1574752 - DNA, 23 bp, Homo sapiens
agccagcaatgatgtccagaaga

SEQ ID NO: 1574753 - DNA, 23 bp, Homo sapiens
agccagcacctggcatcgcacca

SEQ ID NO: 1574754 - DNA, 15 bp, Homo sapiens
agccagcacttgtat

SEQ ID NO: 1574755 - DNA, 22 bp, Homo sapiens
agccagcagagggggagtagcc

SEQ ID NO: 1574756 - DNA, 15 bp, Homo sapiens
agccagcattcagca

SEQ ID NO: 1574757 - DNA, 18 bp, Homo sapiens
agccagcattcagcacac

SEQ ID NO: 1574758 - DNA, 19 bp, Homo sapiens
agccagcattcagcacaca

SEQ ID NO: 1574759 - DNA, 20 bp, Homo sapiens
agccagccacagacccctgg

SEQ ID NO: 1574760 - DNA, 15 bp, Homo sapiens
agccagccaggtgca

SEQ ID NO: 1574761 - DNA, 15 bp, Homo sapiens
agccagcccagccca

SEQ ID NO: 1574762 - DNA, 17 bp, Homo sapiens
agccagcccagcccagc

SEQ ID NO: 1574763 - DNA, 19 bp, Homo sapiens
agccagcccatggccccca

SEQ ID NO: 1574764 - DNA, 20 bp, Homo sapiens
agccagcccatggcccccaa

SEQ ID NO: 1574765 - DNA, 17 bp, Homo sapiens
agccagccccctccagc

SEQ ID NO: 1574766 - DNA, 17 bp, Homo sapiens
agccagcccctcttccc

SEQ ID NO: 1574767 - DNA, 12 bp, Homo sapiens
agccagccctcc

SEQ ID NO: 1574768 - DNA, 20 bp, Homo sapiens
agccagccctccctgtcctc

SEQ ID NO: 1574769 - DNA, 18 bp, Homo sapiens
agccagccggtgcctggc

SEQ ID NO: 1574770 - DNA, 17 bp, Homo sapiens
agccagcctcagaaggc

SEQ ID NO: 1574771 - DNA, 12 bp, Homo sapiens
agccagcctggc

SEQ ID NO: 1574772 - DNA, 15 bp, Homo sapiens
agccagcctgggact

SEQ ID NO: 1574773 - DNA, 20 bp, Homo sapiens
agccagcctgggactcccag

SEQ ID NO: 1574774 - DNA, 23 bp, Homo sapiens
agccagctcacagtgctgtgtgc

SEQ ID NO: 1574775 - DNA, 13 bp, Homo sapiens
agccagctcctgg

SEQ ID NO: 1574776 - DNA, 13 bp, Homo sapiens
agccagctctcag

SEQ ID NO: 1574777 - DNA, 16 bp, Homo sapiens
agccagctgccgacca

SEQ ID NO: 1574778 - DNA, 12 bp, Homo sapiens
agccagctgctt

SEQ ID NO: 1574779 - DNA, 15 bp, Homo sapiens
agccagctgcttttt

SEQ ID NO: 1574780 - DNA, 14 bp, Homo sapiens
agccagcttaaacc

SEQ ID NO: 1574781 - DNA, 19 bp, Homo sapiens
agccaggaatttcccagga

SEQ ID NO: 1574782 - DNA, 20 bp, Homo sapiens
agccaggagacctgctctcc

SEQ ID NO: 1574783 - DNA, 13 bp, Homo sapiens
agccaggagcaga

SEQ ID NO: 1574784 - DNA, 18 bp, Homo sapiens
agccaggagctgggcaga

SEQ ID NO: 1574785 - DNA, 17 bp, Homo sapiens
agccaggagtctgtgct

SEQ ID NO: 1574786 - DNA, 16 bp, Homo sapiens
agccaggatgcccaga

SEQ ID NO: 1574787 - DNA, 11 bp, Homo sapiens
agccaggcaga

SEQ ID NO: 1574788 - DNA, 23 bp, Homo sapiens
agccaggcagaggttttaatgtc

SEQ ID NO: 1574789 - DNA, 12 bp, Homo sapiens
agccaggcctga

SEQ ID NO: 1574790 - DNA, 19 bp, Homo sapiens
agccaggcgggctcaagga

SEQ ID NO: 1574791 - DNA, 13 bp, Homo sapiens
agccaggctccta

SEQ ID NO: 1574792 - DNA, 23 bp, Homo sapiens
agccaggctcctacctgtctgct

SEQ ID NO: 1574793 - DNA, 18 bp, Homo sapiens
agccagggaacagcccca

SEQ ID NO: 1574794 - DNA, 19 bp, Homo sapiens
agccagggaacagccccag

SEQ ID NO: 1574795 - DNA, 16 bp, Homo sapiens
agccagggacccccag

SEQ ID NO: 1574796 - DNA, 18 bp, Homo sapiens
agccagggacccccagaa

SEQ ID NO: 1574797 - DNA, 21 bp, Homo sapiens
agccagggtgtggccctgcca

SEQ ID NO: 1574798 - DNA, 22 bp, Homo sapiens
agccaggttctcattaggtttt

SEQ ID NO: 1574799 - DNA, 14 bp, Homo sapiens
agccagtcccaggg

SEQ ID NO: 1574800 - DNA, 15 bp, Homo sapiens
agccagtctcagaga

SEQ ID NO: 1574801 - DNA, 22 bp, Homo sapiens
agccagtctcagagaccagcac

SEQ ID NO: 1574802 - DNA, 17 bp, Homo sapiens
agccagtcttgcctagg

SEQ ID NO: 1574803 - DNA, 14 bp, Homo sapiens
agccagtgactttt

SEQ ID NO: 1574804 - DNA, 16 bp, Homo sapiens
agccagtggcacagga

SEQ ID NO: 1574805 - DNA, 21 bp, Homo sapiens
agccagtgggccagccacaga

SEQ ID NO: 1574806 - DNA, 21 bp, Homo sapiens
agccagtttgccggatacaaa

SEQ ID NO: 1574807 - DNA, 22 bp, Homo sapiens
agccagtttgggtaaaatactt

SEQ ID NO: 1574808 - DNA, 23 bp, Homo sapiens
agccagtttgggtaaaatacttt

SEQ ID NO: 1574809 - DNA, 19 bp, Homo sapiens
agccatagacctacagacc

SEQ ID NO: 1574810 - DNA, 21 bp, Homo sapiens
agccatagacctacagacctg

SEQ ID NO: 1574811 - DNA, 10 bp, Homo sapiens
agccatagtg

SEQ ID NO: 1574812 - DNA, 13 bp, Homo sapiens
agccatcaagcac

SEQ ID NO: 1574813 - DNA, 15 bp, Homo sapiens
agccatcaagcactt

SEQ ID NO: 1574814 - DNA, 19 bp, Homo sapiens
agccatcaagcacttccca

SEQ ID NO: 1574815 - DNA, 18 bp, Homo sapiens
agccatcactagaagaaa

SEQ ID NO: 1574816 - DNA, 21 bp, Homo sapiens
agccatcactagaagaaaagc

SEQ ID NO: 1574817 - DNA, 17 bp, Homo sapiens
agccatcacttctcccc

SEQ ID NO: 1574818 - DNA, 19 bp, Homo sapiens
agccatcacttctccccgc

SEQ ID NO: 1574819 - DNA, 20 bp, Homo sapiens
agccatccctttttttacat

SEQ ID NO: 1574820 - DNA, 14 bp, Homo sapiens
agccatcttggcag

SEQ ID NO: 1574821 - DNA, 13 bp, Homo sapiens
agccatgaggagc

SEQ ID NO: 1574822 - DNA, 19 bp, Homo sapiens
agccatgaggagcgtggac

SEQ ID NO: 1574823 - DNA, 20 bp, Homo sapiens
agccatgaggagttgctgtt

SEQ ID NO: 1574824 - DNA, 17 bp, Homo sapiens
agccatgatttgtccca

SEQ ID NO: 1574825 - DNA, 15 bp, Homo sapiens
agccatgcccgcatt

SEQ ID NO: 1574826 - DNA, 14 bp, Homo sapiens
agccatgcctcatg

SEQ ID NO: 1574827 - DNA, 16 bp, Homo sapiens
agccatgcctcatgcc

SEQ ID NO: 1574828 - DNA, 13 bp, Homo sapiens
agccatggctggg

SEQ ID NO: 1574829 - DNA, 14 bp, Homo sapiens
agccatgggcctgg

SEQ ID NO: 1574830 - DNA, 17 bp, Homo sapiens
agccatgggcctgggcc

SEQ ID NO: 1574831 - DNA, 18 bp, Homo sapiens
agccatgggcctgggcct

SEQ ID NO: 1574832 - DNA, 20 bp, Homo sapiens
agccatgggcctgggcctgc

SEQ ID NO: 1574833 - DNA, 12 bp, Homo sapiens
agccattaatga

SEQ ID NO: 1574834 - DNA, 20 bp, Homo sapiens
agccattaccatggagacaa

SEQ ID NO: 1574835 - DNA, 18 bp, Homo sapiens
agccatttccccctcctc

SEQ ID NO: 1574836 - DNA, 14 bp, Homo sapiens
agccattttggttt

SEQ ID NO: 1574837 - DNA, 16 bp, Homo sapiens
agccatttttaatgat

SEQ ID NO: 1574838 - DNA, 14 bp, Homo sapiens
agcccaagaggact

SEQ ID NO: 1574839 - DNA, 18 bp, Homo sapiens
agcccaagaggtctgagc

SEQ ID NO: 1574840 - DNA, 21 bp, Homo sapiens
agcccaagaggtctgagccct

SEQ ID NO: 1574841 - DNA, 23 bp, Homo sapiens
agcccaaggtgctgatgtcaaag

SEQ ID NO: 1574842 - DNA, 24 bp, Homo sapiens
agcccaaggtgctgatgtcaaagt

SEQ ID NO: 1574843 - DNA, 10 bp, Homo sapiens
agcccaataa

SEQ ID NO: 1574844 - DNA, 16 bp, Homo sapiens
agcccaataaacctct

SEQ ID NO: 1574845 - DNA, 12 bp, Homo sapiens
agcccaataaag

SEQ ID NO: 1574846 - DNA, 13 bp, Homo sapiens
agcccaataaagg

SEQ ID NO: 1574847 - DNA, 14 bp, Homo sapiens
agcccacatattct

SEQ ID NO: 1574848 - DNA, 14 bp, Homo sapiens
agcccaccaccctg

SEQ ID NO: 1574849 - DNA, 22 bp, Homo sapiens
agcccacccccctccccaactc

SEQ ID NO: 1574850 - DNA, 14 bp, Homo sapiens
agcccaccctgctg

SEQ ID NO: 1574851 - DNA, 18 bp, Homo sapiens
agcccacggtctggaggc

SEQ ID NO: 1574852 - DNA, 20 bp, Homo sapiens
agcccacggtctggaggccg

SEQ ID NO: 1574853 - DNA, 12 bp, Homo sapiens
agcccactccct

SEQ ID NO: 1574854 - DNA, 15 bp, Homo sapiens
agcccactccctgcc

SEQ ID NO: 1574855 - DNA, 14 bp, Homo sapiens
agcccactgtcctg

SEQ ID NO: 1574856 - DNA, 15 bp, Homo sapiens
agcccactgtcctgg

SEQ ID NO: 1574857 - DNA, 19 bp, Homo sapiens
agcccactgtcctgggcct

SEQ ID NO: 1574858 - DNA, 19 bp, Homo sapiens
agcccagaaaacctccagt

SEQ ID NO: 1574859 - DNA, 12 bp, Homo sapiens
agcccagagaca

SEQ ID NO: 1574860 - DNA, 21 bp, Homo sapiens
agcccagagacatacttgaag

SEQ ID NO: 1574861 - DNA, 13 bp, Homo sapiens
agcccagagccac

SEQ ID NO: 1574862 - DNA, 14 bp, Homo sapiens
agcccagagcctgg

SEQ ID NO: 1574863 - DNA, 17 bp, Homo sapiens
agcccagagcctggctg

SEQ ID NO: 1574864 - DNA, 11 bp, Homo sapiens
agcccagcacc

SEQ ID NO: 1574865 - DNA, 17 bp, Homo sapiens
agcccagcacctgctcc

SEQ ID NO: 1574866 - DNA, 13 bp, Homo sapiens
agcccagcactgt

SEQ ID NO: 1574867 - DNA, 24 bp, Homo sapiens
agcccagcactgtgaagacccagc

SEQ ID NO: 1574868 - DNA, 20 bp, Homo sapiens
agcccagcagggcctcaaag

SEQ ID NO: 1574869 - DNA, 12 bp, Homo sapiens
agcccagccagg

SEQ ID NO: 1574870 - DNA, 15 bp, Homo sapiens
agcccagccaggcca

SEQ ID NO: 1574871 - DNA, 21 bp, Homo sapiens
agcccagccattaccatggag

SEQ ID NO: 1574872 - DNA, 23 bp, Homo sapiens
agcccagccattaccatggagac

SEQ ID NO: 1574873 - DNA, 16 bp, Homo sapiens
agcccagcccagctgg

SEQ ID NO: 1574874 - DNA, 15 bp, Homo sapiens
agcccagcccaggag

SEQ ID NO: 1574875 - DNA, 16 bp, Homo sapiens
agcccagctacattcc

SEQ ID NO: 1574876 - DNA, 18 bp, Homo sapiens
agcccagctacattcctc

SEQ ID NO: 1574877 - DNA, 20 bp, Homo sapiens
agcccagctacattcctcag

SEQ ID NO: 1574878 - DNA, 17 bp, Homo sapiens
agcccagctccagggcc

SEQ ID NO: 1574879 - DNA, 19 bp, Homo sapiens
agcccagctcctgaataaa

SEQ ID NO: 1574880 - DNA, 19 bp, Homo sapiens
agcccagctcttgctctct

SEQ ID NO: 1574881 - DNA, 12 bp, Homo sapiens
agcccagctggc

SEQ ID NO: 1574882 - DNA, 14 bp, Homo sapiens
agcccagctggcca

SEQ ID NO: 1574883 - DNA, 13 bp, Homo sapiens
agcccagctggtg

SEQ ID NO: 1574884 - DNA, 24 bp, Homo sapiens
agcccaggaatttgaagctgcagt

SEQ ID NO: 1574885 - DNA, 21 bp, Homo sapiens
agcccaggatactggcacaga

SEQ ID NO: 1574886 - DNA, 23 bp, Homo sapiens
agcccaggatactggcacagagg

SEQ ID NO: 1574887 - DNA, 13 bp, Homo sapiens
agcccaggccaga

SEQ ID NO: 1574888 - DNA, 21 bp, Homo sapiens
agcccaggccgttccccttgg

SEQ ID NO: 1574889 - DNA, 22 bp, Homo sapiens
agcccaggctcggaggaccctg

SEQ ID NO: 1574890 - DNA, 21 bp, Homo sapiens
agcccagttcccgtgacgagg

SEQ ID NO: 1574891 - DNA, 19 bp, Homo sapiens
agcccataggccaccccct

SEQ ID NO: 1574892 - DNA, 19 bp, Homo sapiens
agcccatatctacagtact

SEQ ID NO: 1574893 - DNA, 21 bp, Homo sapiens
agcccatccattaggccagca

SEQ ID NO: 1574894 - DNA, 16 bp, Homo sapiens
agcccatcctgaccag

SEQ ID NO: 1574895 - DNA, 17 bp, Homo sapiens
agcccatcctgaccagc

SEQ ID NO: 1574896 - DNA, 18 bp, Homo sapiens
agcccatccttccctttg

SEQ ID NO: 1574897 - DNA, 17 bp, Homo sapiens
agcccatggcccccaat

SEQ ID NO: 1574898 - DNA, 20 bp, Homo sapiens
agcccatggcccccaataaa

SEQ ID NO: 1574899 - DNA, 21 bp, Homo sapiens
agcccatggcccccaataaag

SEQ ID NO: 1574900 - DNA, 22 bp, Homo sapiens
agcccatggcccccaataaagg

SEQ ID NO: 1574901 - DNA, 16 bp, Homo sapiens
agcccattctctctcc

SEQ ID NO: 1574902 - DNA, 22 bp, Homo sapiens
agcccattctctctcctgtcca

SEQ ID NO: 1574903 - DNA, 15 bp, Homo sapiens
agccccaagctgggc

SEQ ID NO: 1574904 - DNA, 14 bp, Homo sapiens
agccccaagtcctg

SEQ ID NO: 1574905 - DNA, 19 bp, Homo sapiens
agccccaagtcctgaagag

SEQ ID NO: 1574906 - DNA, 12 bp, Homo sapiens
agccccacccag

SEQ ID NO: 1574907 - DNA, 11 bp, Homo sapiens
agccccacccc

SEQ ID NO: 1574908 - DNA, 16 bp, Homo sapiens
agccccaccctggcct

SEQ ID NO: 1574909 - DNA, 17 bp, Homo sapiens
agccccacgtggagctc

SEQ ID NO: 1574910 - DNA, 16 bp, Homo sapiens
agccccactgccagca

SEQ ID NO: 1574911 - DNA, 20 bp, Homo sapiens
agccccacttcacccccaac

SEQ ID NO: 1574912 - DNA, 19 bp, Homo sapiens
agccccagactgggcccag

SEQ ID NO: 1574913 - DNA, 12 bp, Homo sapiens
agccccagcaag

SEQ ID NO: 1574914 - DNA, 12 bp, Homo sapiens
agccccagcact

SEQ ID NO: 1574915 - DNA, 16 bp, Homo sapiens
agccccagccccttcc

SEQ ID NO: 1574916 - DNA, 14 bp, Homo sapiens
agccccagcttggc

SEQ ID NO: 1574917 - DNA, 18 bp, Homo sapiens
agccccagggatcactgg

SEQ ID NO: 1574918 - DNA, 13 bp, Homo sapiens
agccccagggcct

SEQ ID NO: 1574919 - DNA, 14 bp, Homo sapiens
agccccagggcctg

SEQ ID NO: 1574920 - DNA, 20 bp, Homo sapiens
agccccagggcctgggggca

SEQ ID NO: 1574921 - DNA, 23 bp, Homo sapiens
agccccagtgccaagcacagtgc

SEQ ID NO: 1574922 - DNA, 16 bp, Homo sapiens
agccccatcctgtgtt

SEQ ID NO: 1574923 - DNA, 17 bp, Homo sapiens
agccccatcggccaaga

SEQ ID NO: 1574924 - DNA, 17 bp, Homo sapiens
agccccatctcatcctg

SEQ ID NO: 1574925 - DNA, 21 bp, Homo sapiens
agccccatctcatcctggcac

SEQ ID NO: 1574926 - DNA, 18 bp, Homo sapiens
agcccccaccaggggaag

SEQ ID NO: 1574927 - DNA, 20 bp, Homo sapiens
agcccccagctaagaacctg

SEQ ID NO: 1574928 - DNA, 13 bp, Homo sapiens
agcccccagggcc

SEQ ID NO: 1574929 - DNA, 18 bp, Homo sapiens
agcccccccaacactgtg

SEQ ID NO: 1574930 - DNA, 20 bp, Homo sapiens
agcccccccaacactgtgcc

SEQ ID NO: 1574931 - DNA, 23 bp, Homo sapiens
agcccccccaacactgtgccctg

SEQ ID NO: 1574932 - DNA, 20 bp, Homo sapiens
agcccccgggccgctggctg

SEQ ID NO: 1574933 - DNA, 14 bp, Homo sapiens
agccccctcttcct

SEQ ID NO: 1574934 - DNA, 12 bp, Homo sapiens
agccccctgcac

SEQ ID NO: 1574935 - DNA, 21 bp, Homo sapiens
agccccctgcacccacccctg

SEQ ID NO: 1574936 - DNA, 19 bp, Homo sapiens
agccccctggatgtcccct

SEQ ID NO: 1574937 - DNA, 23 bp, Homo sapiens
agccccctggatgtcccctgtcc

SEQ ID NO: 1574938 - DNA, 17 bp, Homo sapiens
agccccctggcctctgt

SEQ ID NO: 1574939 - DNA, 15 bp, Homo sapiens
agccccgacttcctg

SEQ ID NO: 1574940 - DNA, 13 bp, Homo sapiens
agccccgctccca

SEQ ID NO: 1574941 - DNA, 19 bp, Homo sapiens
agccccggtggctgggcag

SEQ ID NO: 1574942 - DNA, 15 bp, Homo sapiens
agcccctactgctgt

SEQ ID NO: 1574943 - DNA, 23 bp, Homo sapiens
agcccctactgctgtgaaccctg

SEQ ID NO: 1574944 - DNA, 13 bp, Homo sapiens
agcccctcaaaga

SEQ ID NO: 1574945 - DNA, 15 bp, Homo sapiens
agcccctcaaaggga

SEQ ID NO: 1574946 - DNA, 13 bp, Homo sapiens
agcccctcagccc

SEQ ID NO: 1574947 - DNA, 16 bp, Homo sapiens
agcccctcagcccttg

SEQ ID NO: 1574948 - DNA, 20 bp, Homo sapiens
agcccctcctccagcccctg

SEQ ID NO: 1574949 - DNA, 23 bp, Homo sapiens
agcccctcctccagcccctgtcc

SEQ ID NO: 1574950 - DNA, 17 bp, Homo sapiens
agcccctcctctgagca

SEQ ID NO: 1574951 - DNA, 16 bp, Homo sapiens
agcccctcctctgcca

SEQ ID NO: 1574952 - DNA, 17 bp, Homo sapiens
agcccctcctctgccac

SEQ ID NO: 1574953 - DNA, 20 bp, Homo sapiens
agcccctcctctgccacctc

SEQ ID NO: 1574954 - DNA, 15 bp, Homo sapiens
agcccctccttctcc

SEQ ID NO: 1574955 - DNA, 18 bp, Homo sapiens
agcccctccttctcccct

SEQ ID NO: 1574956 - DNA, 20 bp, Homo sapiens
agcccctccttctcccctgc

SEQ ID NO: 1574957 - DNA, 14 bp, Homo sapiens
agcccctcggctct

SEQ ID NO: 1574958 - DNA, 18 bp, Homo sapiens
agcccctcggctctggag

SEQ ID NO: 1574959 - DNA, 14 bp, Homo sapiens
agcccctgggccca

SEQ ID NO: 1574960 - DNA, 21 bp, Homo sapiens
agcccctggggctgtatttat

SEQ ID NO: 1574961 - DNA, 21 bp, Homo sapiens
agcccctggggtggccaccag

SEQ ID NO: 1574962 - DNA, 12 bp, Homo sapiens
agcccctgggtg

SEQ ID NO: 1574963 - DNA, 13 bp, Homo sapiens
agcccctgtccca

SEQ ID NO: 1574964 - DNA, 13 bp, Homo sapiens
agccccttggaga

SEQ ID NO: 1574965 - DNA, 15 bp, Homo sapiens
agccccttggagaga

SEQ ID NO: 1574966 - DNA, 22 bp, Homo sapiens
agccccttggagagagaggctg

SEQ ID NO: 1574967 - DNA, 19 bp, Homo sapiens
agccccttggattcctgca

SEQ ID NO: 1574968 - DNA, 16 bp, Homo sapiens
agccccttttctttgg

SEQ ID NO: 1574969 - DNA, 21 bp, Homo sapiens
agcccgaacaccattgaggga

SEQ ID NO: 1574970 - DNA, 13 bp, Homo sapiens
agcccgacagtgc

SEQ ID NO: 1574971 - DNA, 16 bp, Homo sapiens
agcccgacagtgccat

SEQ ID NO: 1574972 - DNA, 17 bp, Homo sapiens
agcccgacagtgccatc

SEQ ID NO: 1574973 - DNA, 17 bp, Homo sapiens
agcccgatattctccct

SEQ ID NO: 1574974 - DNA, 18 bp, Homo sapiens
agcccgatattctccctg

SEQ ID NO: 1574975 - DNA, 19 bp, Homo sapiens
agcccgcagggccatgcag

SEQ ID NO: 1574976 - DNA, 13 bp, Homo sapiens
agcccgcgtgctg

SEQ ID NO: 1574977 - DNA, 15 bp, Homo sapiens
agcccgctctctggc

SEQ ID NO: 1574978 - DNA, 13 bp, Homo sapiens
agcccgcttttgt

SEQ ID NO: 1574979 - DNA, 14 bp, Homo sapiens
agcccgcttttgtt

SEQ ID NO: 1574980 - DNA, 20 bp, Homo sapiens
agcccggaccttggcagccc

SEQ ID NO: 1574981 - DNA, 14 bp, Homo sapiens
agcccggccgctcc

SEQ ID NO: 1574982 - DNA, 11 bp, Homo sapiens
agcccggcctg

SEQ ID NO: 1574983 - DNA, 20 bp, Homo sapiens
agcccggcctgctcccagca

SEQ ID NO: 1574984 - DNA, 22 bp, Homo sapiens
agcccggcgcccctgccacctc

SEQ ID NO: 1574985 - DNA, 13 bp, Homo sapiens
agcccggctggtt

SEQ ID NO: 1574986 - DNA, 12 bp, Homo sapiens
agcccgggctgc

SEQ ID NO: 1574987 - DNA, 18 bp, Homo sapiens
agcccgggctgcctgggc

SEQ ID NO: 1574988 - DNA, 20 bp, Homo sapiens
agcccgtgaagcagtgcctc

SEQ ID NO: 1574989 - DNA, 16 bp, Homo sapiens
agcccgttagccccag

SEQ ID NO: 1574990 - DNA, 19 bp, Homo sapiens
agccctaaggtcctaaggc

SEQ ID NO: 1574991 - DNA, 18 bp, Homo sapiens
agccctaagtggctgcct

SEQ ID NO: 1574992 - DNA, 20 bp, Homo sapiens
agccctactccctgcagatg

SEQ ID NO: 1574993 - DNA, 18 bp, Homo sapiens
agccctagtagctggcgc

SEQ ID NO: 1574994 - DNA, 23 bp, Homo sapiens
agccctcacccctggttctcatc

SEQ ID NO: 1574995 - DNA, 11 bp, Homo sapiens
agccctcacct

SEQ ID NO: 1574996 - DNA, 14 bp, Homo sapiens
agccctcacctctg

SEQ ID NO: 1574997 - DNA, 15 bp, Homo sapiens
agccctcacctctga

SEQ ID NO: 1574998 - DNA, 20 bp, Homo sapiens
agccctcacctctgaggaca

SEQ ID NO: 1574999 - DNA, 23 bp, Homo sapiens
agccctcacctctgaggacagag

SEQ ID NO: 1575000 - DNA, 17 bp, Homo sapiens
agccctcagtcagttcc

SEQ ID NO: 1575001 - DNA, 18 bp, Homo sapiens
agccctccaggcctgcag

SEQ ID NO: 1575002 - DNA, 20 bp, Homo sapiens
agccctccaggcctgcaggg

SEQ ID NO: 1575003 - DNA, 20 bp, Homo sapiens
agccctccccatggagccag

SEQ ID NO: 1575004 - DNA, 15 bp, Homo sapiens
agccctccctgtcct

SEQ ID NO: 1575005 - DNA, 22 bp, Homo sapiens
agccctccctgtcctcctcgga

SEQ ID NO: 1575006 - DNA, 14 bp, Homo sapiens
agccctcctcaccc

SEQ ID NO: 1575007 - DNA, 17 bp, Homo sapiens
agccctcctctgcactc

SEQ ID NO: 1575008 - DNA, 22 bp, Homo sapiens
agccctcgaaccaaggcagcct

SEQ ID NO: 1575009 - DNA, 20 bp, Homo sapiens
agccctcggcctccgaggct

SEQ ID NO: 1575010 - DNA, 16 bp, Homo sapiens
agccctctccaccctc

SEQ ID NO: 1575011 - DNA, 21 bp, Homo sapiens
agccctgaggacctctcagca

SEQ ID NO: 1575012 - DNA, 16 bp, Homo sapiens
agccctgagtgtccca

SEQ ID NO: 1575013 - DNA, 23 bp, Homo sapiens
agccctgatgtgtcctcagggag

SEQ ID NO: 1575014 - DNA, 17 bp, Homo sapiens
agccctgattgtgccag

SEQ ID NO: 1575015 - DNA, 13 bp, Homo sapiens
agccctgcaccat

SEQ ID NO: 1575016 - DNA, 14 bp, Homo sapiens
agccctgcaccatg

SEQ ID NO: 1575017 - DNA, 12 bp, Homo sapiens
agccctgccctc

SEQ ID NO: 1575018 - DNA, 19 bp, Homo sapiens
agccctgctttgggctgcc

SEQ ID NO: 1575019 - DNA, 12 bp, Homo sapiens
agccctggagag

SEQ ID NO: 1575020 - DNA, 12 bp, Homo sapiens
agccctggcagg

SEQ ID NO: 1575021 - DNA, 13 bp, Homo sapiens
agccctggccctg

SEQ ID NO: 1575022 - DNA, 16 bp, Homo sapiens
agccctggccctgccc

SEQ ID NO: 1575023 - DNA, 19 bp, Homo sapiens
agccctggccctgcccagc

SEQ ID NO: 1575024 - DNA, 12 bp, Homo sapiens
agccctggctgt

SEQ ID NO: 1575025 - DNA, 14 bp, Homo sapiens
agccctgggaacca

SEQ ID NO: 1575026 - DNA, 17 bp, Homo sapiens
agccctgggccccacca

SEQ ID NO: 1575027 - DNA, 19 bp, Homo sapiens
agccctgggccccaccacc

SEQ ID NO: 1575028 - DNA, 23 bp, Homo sapiens
agccctgggccccaccacctagg

SEQ ID NO: 1575029 - DNA, 16 bp, Homo sapiens
agccctggtgtgtttc

SEQ ID NO: 1575030 - DNA, 18 bp, Homo sapiens
agccctggttagctgaca

SEQ ID NO: 1575031 - DNA, 20 bp, Homo sapiens
agccctggttagctgacagt

SEQ ID NO: 1575032 - DNA, 12 bp, Homo sapiens
agccctgtcctt

SEQ ID NO: 1575033 - DNA, 18 bp, Homo sapiens
agccctgtcgagacactt

SEQ ID NO: 1575034 - DNA, 23 bp, Homo sapiens
agccctgtcgagacacttgcctt

SEQ ID NO: 1575035 - DNA, 16 bp, Homo sapiens
agccctgtggccgcca

SEQ ID NO: 1575036 - DNA, 20 bp, Homo sapiens
agccctgtggccgccacctg

SEQ ID NO: 1575037 - DNA, 17 bp, Homo sapiens
agccctgttctcctgtc

SEQ ID NO: 1575038 - DNA, 21 bp, Homo sapiens
agcccttatgcggttaatttt

SEQ ID NO: 1575039 - DNA, 17 bp, Homo sapiens
agcccttcactgccatg

SEQ ID NO: 1575040 - DNA, 19 bp, Homo sapiens
agcccttctatacccaccc

SEQ ID NO: 1575041 - DNA, 22 bp, Homo sapiens
agcccttctatacccacccaga

SEQ ID NO: 1575042 - DNA, 23 bp, Homo sapiens
agcccttctatacccacccagaa

SEQ ID NO: 1575043 - DNA, 17 bp, Homo sapiens
agcccttctgcctttct

SEQ ID NO: 1575044 - DNA, 14 bp, Homo sapiens
agcccttgccccca

SEQ ID NO: 1575045 - DNA, 20 bp, Homo sapiens
agcccttgcccccatccctc

SEQ ID NO: 1575046 - DNA, 23 bp, Homo sapiens
agcccttgcctccccatttccca

SEQ ID NO: 1575047 - DNA, 23 bp, Homo sapiens
agcccttggaacaccctggatgc

SEQ ID NO: 1575048 - DNA, 12 bp, Homo sapiens
agcccttgggtt

SEQ ID NO: 1575049 - DNA, 12 bp, Homo sapiens
agccgacctcag

SEQ ID NO: 1575050 - DNA, 14 bp, Homo sapiens
agccgacctcagcc

SEQ ID NO: 1575051 - DNA, 15 bp, Homo sapiens
agccgaccttccctc

SEQ ID NO: 1575052 - DNA, 17 bp, Homo sapiens
agccgactctggccctg

SEQ ID NO: 1575053 - DNA, 21 bp, Homo sapiens
agccgactctggccctggccc

SEQ ID NO: 1575054 - DNA, 22 bp, Homo sapiens
agccgagactcgactctgtgcc

SEQ ID NO: 1575055 - DNA, 13 bp, Homo sapiens
agccgagagcctg

SEQ ID NO: 1575056 - DNA, 16 bp, Homo sapiens
agccgagagcctgctc

SEQ ID NO: 1575057 - DNA, 17 bp, Homo sapiens
agccgagagcctgctcc

SEQ ID NO: 1575058 - DNA, 19 bp, Homo sapiens
agccgagattgcgccactg

SEQ ID NO: 1575059 - DNA, 17 bp, Homo sapiens
agccgagccgggcctgg

SEQ ID NO: 1575060 - DNA, 18 bp, Homo sapiens
agccgagccgggcctggg

SEQ ID NO: 1575061 - DNA, 12 bp, Homo sapiens
agccgaggcctg

SEQ ID NO: 1575062 - DNA, 19 bp, Homo sapiens
agccgcaccctgcacctgc

SEQ ID NO: 1575063 - DNA, 23 bp, Homo sapiens
agccgcaccctgcacctgctgcg

SEQ ID NO: 1575064 - DNA, 23 bp, Homo sapiens
agccgccagctgggagcactggt

SEQ ID NO: 1575065 - DNA, 18 bp, Homo sapiens
agccgccattgccaccag

SEQ ID NO: 1575066 - DNA, 13 bp, Homo sapiens
agccgccctgaga

SEQ ID NO: 1575067 - DNA, 14 bp, Homo sapiens
agccgccctgagag

SEQ ID NO: 1575068 - DNA, 21 bp, Homo sapiens
agccgcctgaaagccacaatg

SEQ ID NO: 1575069 - DNA, 17 bp, Homo sapiens
agccgccttaagctgat

SEQ ID NO: 1575070 - DNA, 16 bp, Homo sapiens
agccgctcctgtctgc

SEQ ID NO: 1575071 - DNA, 17 bp, Homo sapiens
agccgctcctgtctgcc

SEQ ID NO: 1575072 - DNA, 21 bp, Homo sapiens
agccgctcctgtctgccagcc

SEQ ID NO: 1575073 - DNA, 15 bp, Homo sapiens
agccggacacggctt

SEQ ID NO: 1575074 - DNA, 17 bp, Homo sapiens
agccggacacggcttca

SEQ ID NO: 1575075 - DNA, 19 bp, Homo sapiens
agccggacagctgcccaga

SEQ ID NO: 1575076 - DNA, 18 bp, Homo sapiens
agccggcggcccaagccc

SEQ ID NO: 1575077 - DNA, 23 bp, Homo sapiens
agccgggaggaaaaggcccctgc

SEQ ID NO: 1575078 - DNA, 13 bp, Homo sapiens
agccgggcaagtc

SEQ ID NO: 1575079 - DNA, 15 bp, Homo sapiens
agccgggcatggtgg

SEQ ID NO: 1575080 - DNA, 22 bp, Homo sapiens
agccggggtgtaacttcctgct

SEQ ID NO: 1575081 - DNA, 23 bp, Homo sapiens
agccggggtgtaacttcctgctg

SEQ ID NO: 1575082 - DNA, 17 bp, Homo sapiens
agccggtaactgtcctg

SEQ ID NO: 1575083 - DNA, 18 bp, Homo sapiens
agccggtaactgtcctgt

SEQ ID NO: 1575084 - DNA, 20 bp, Homo sapiens
agccggtaactgtcctgtcc

SEQ ID NO: 1575085 - DNA, 14 bp, Homo sapiens
agccggtgcctggc

SEQ ID NO: 1575086 - DNA, 18 bp, Homo sapiens
agccgtagggtggcactg

SEQ ID NO: 1575087 - DNA, 18 bp, Homo sapiens
agccgtccatggcaccag

SEQ ID NO: 1575088 - DNA, 17 bp, Homo sapiens
agccgtcccaggccacc

SEQ ID NO: 1575089 - DNA, 12 bp, Homo sapiens
agccgtcctggc

SEQ ID NO: 1575090 - DNA, 17 bp, Homo sapiens
agccgtctgactccaga

SEQ ID NO: 1575091 - DNA, 18 bp, Homo sapiens
agccgtctgactccagag

SEQ ID NO: 1575092 - DNA, 19 bp, Homo sapiens
agccgtctgactccagagt

SEQ ID NO: 1575093 - DNA, 18 bp, Homo sapiens
agccgtgatgctcaggct

SEQ ID NO: 1575094 - DNA, 14 bp, Homo sapiens
agccgtggcttccc

SEQ ID NO: 1575095 - DNA, 22 bp, Homo sapiens
agccgtggcttcccgctcagcc

SEQ ID NO: 1575096 - DNA, 20 bp, Homo sapiens
agcctaaagattttgatctc

SEQ ID NO: 1575097 - DNA, 23 bp, Homo sapiens
agcctaaagggcagggcccacgt

SEQ ID NO: 1575098 - DNA, 21 bp, Homo sapiens
agcctaaagtatacaactgcc

SEQ ID NO: 1575099 - DNA, 13 bp, Homo sapiens
agcctaagaagct

SEQ ID NO: 1575100 - DNA, 12 bp, Homo sapiens
agcctaagggat

SEQ ID NO: 1575101 - DNA, 16 bp, Homo sapiens
agcctacagatgaact

SEQ ID NO: 1575102 - DNA, 23 bp, Homo sapiens
agcctacattctccagttgatta

SEQ ID NO: 1575103 - DNA, 14 bp, Homo sapiens
agcctaccccctga

SEQ ID NO: 1575104 - DNA, 18 bp, Homo sapiens
agcctaccgctggccctg

SEQ ID NO: 1575105 - DNA, 19 bp, Homo sapiens
agcctaccgctggccctgc

SEQ ID NO: 1575106 - DNA, 21 bp, Homo sapiens
agcctaccgctggccctgccg

SEQ ID NO: 1575107 - DNA, 20 bp, Homo sapiens
agcctagacaacctttctgt

SEQ ID NO: 1575108 - DNA, 15 bp, Homo sapiens
agcctagaccctcct

SEQ ID NO: 1575109 - DNA, 18 bp, Homo sapiens
agcctagaccctcctcct

SEQ ID NO: 1575110 - DNA, 12 bp, Homo sapiens
agcctagccacc

SEQ ID NO: 1575111 - DNA, 17 bp, Homo sapiens
agcctagccacctccca

SEQ ID NO: 1575112 - DNA, 20 bp, Homo sapiens
agcctagccacctcccaccc

SEQ ID NO: 1575113 - DNA, 17 bp, Homo sapiens
agcctagccgacctcag

SEQ ID NO: 1575114 - DNA, 22 bp, Homo sapiens
agcctagcggagcccagcctgg

SEQ ID NO: 1575115 - DNA, 22 bp, Homo sapiens
agcctagctaccttctctaccc

SEQ ID NO: 1575116 - DNA, 21 bp, Homo sapiens
agcctagctcctgccacatgg

SEQ ID NO: 1575117 - DNA, 14 bp, Homo sapiens
agcctaggccgccc

SEQ ID NO: 1575118 - DNA, 14 bp, Homo sapiens
agcctagttcatcc

SEQ ID NO: 1575119 - DNA, 22 bp, Homo sapiens
agcctagttcatccaatcctca

SEQ ID NO: 1575120 - DNA, 16 bp, Homo sapiens
agcctcaaaacgggtc

SEQ ID NO: 1575121 - DNA, 15 bp, Homo sapiens
agcctcaaactcaac

SEQ ID NO: 1575122 - DNA, 15 bp, Homo sapiens
agcctcaaccttctg

SEQ ID NO: 1575123 - DNA, 14 bp, Homo sapiens
agcctcaccaaggt

SEQ ID NO: 1575124 - DNA, 16 bp, Homo sapiens
agcctcacttgccctc

SEQ ID NO: 1575125 - DNA, 20 bp, Homo sapiens
agcctcagaaggccccagag

SEQ ID NO: 1575126 - DNA, 19 bp, Homo sapiens
agcctcatccgaggcaggg

SEQ ID NO: 1575127 - DNA, 12 bp, Homo sapiens
agcctcatctct

SEQ ID NO: 1575128 - DNA, 13 bp, Homo sapiens
agcctcattcagc

SEQ ID NO: 1575129 - DNA, 20 bp, Homo sapiens
agcctccaaagtggagctgg

SEQ ID NO: 1575130 - DNA, 22 bp, Homo sapiens
agcctccaaagtggagctggga

SEQ ID NO: 1575131 - DNA, 13 bp, Homo sapiens
agcctccaagcct

SEQ ID NO: 1575132 - DNA, 18 bp, Homo sapiens
agcctccaagcctgcctc

SEQ ID NO: 1575133 - DNA, 21 bp, Homo sapiens
agcctccaatgcattggcctc

SEQ ID NO: 1575134 - DNA, 23 bp, Homo sapiens
agcctccaatgcattggcctctg

SEQ ID NO: 1575135 - DNA, 12 bp, Homo sapiens
agcctccacagc

SEQ ID NO: 1575136 - DNA, 13 bp, Homo sapiens
agcctccacagcg

SEQ ID NO: 1575137 - DNA, 22 bp, Homo sapiens
agcctccaccccacaacccaaa

SEQ ID NO: 1575138 - DNA, 18 bp, Homo sapiens
agcctccaccttgctctt

SEQ ID NO: 1575139 - DNA, 16 bp, Homo sapiens
agcctccacttccctc

SEQ ID NO: 1575140 - DNA, 18 bp, Homo sapiens
agcctccagagccagcct

SEQ ID NO: 1575141 - DNA, 20 bp, Homo sapiens
agcctccagagccagcctgg

SEQ ID NO: 1575142 - DNA, 21 bp, Homo sapiens
agcctccagagccagcctggg

SEQ ID NO: 1575143 - DNA, 24 bp, Homo sapiens
agcctccagagccagcctgggact

SEQ ID NO: 1575144 - DNA, 13 bp, Homo sapiens
agcctccagggca

SEQ ID NO: 1575145 - DNA, 22 bp, Homo sapiens
agcctcccctgggttaacaaat

SEQ ID NO: 1575146 - DNA, 23 bp, Homo sapiens
agcctcccctgggttaacaaatg

SEQ ID NO: 1575147 - DNA, 22 bp, Homo sapiens
agcctccctctgacctgcaggc

SEQ ID NO: 1575148 - DNA, 12 bp, Homo sapiens
agcctccctgtc

SEQ ID NO: 1575149 - DNA, 17 bp, Homo sapiens
agcctccctgtctccag

SEQ ID NO: 1575150 - DNA, 20 bp, Homo sapiens
agcctccctgtctccagctg

SEQ ID NO: 1575151 - DNA, 23 bp, Homo sapiens
agcctccctgtctccagctgcct

SEQ ID NO: 1575152 - DNA, 23 bp, Homo sapiens
agcctcccttccatgccccagga

SEQ ID NO: 1575153 - DNA, 14 bp, Homo sapiens
agcctccgagaggg

SEQ ID NO: 1575154 - DNA, 15 bp, Homo sapiens
agcctccgctgggct

SEQ ID NO: 1575155 - DNA, 17 bp, Homo sapiens
agcctccgctgggcttc

SEQ ID NO: 1575156 - DNA, 23 bp, Homo sapiens
agcctccggagtagctgggacca

SEQ ID NO: 1575157 - DNA, 23 bp, Homo sapiens
agcctccgtttatgggccttgct

SEQ ID NO: 1575158 - DNA, 20 bp, Homo sapiens
agcctcctcatcccgtgttc

SEQ ID NO: 1575159 - DNA, 14 bp, Homo sapiens
agcctcctctggac

SEQ ID NO: 1575160 - DNA, 19 bp, Homo sapiens
agcctcctctggacggcag

SEQ ID NO: 1575161 - DNA, 11 bp, Homo sapiens
agcctcctgag

SEQ ID NO: 1575162 - DNA, 12 bp, Homo sapiens
agcctcctgagt

SEQ ID NO: 1575163 - DNA, 19 bp, Homo sapiens
agcctcctgagtagctgga

SEQ ID NO: 1575164 - DNA, 20 bp, Homo sapiens
agcctcctgagtagctggga

SEQ ID NO: 1575165 - DNA, 17 bp, Homo sapiens
agcctcctgctgccaca

SEQ ID NO: 1575166 - DNA, 17 bp, Homo sapiens
agcctccttagaaaaaa

SEQ ID NO: 1575167 - DNA, 13 bp, Homo sapiens
agcctccttgtgc

SEQ ID NO: 1575168 - DNA, 15 bp, Homo sapiens
agcctccttgtgcaa

SEQ ID NO: 1575169 - DNA, 16 bp, Homo sapiens
agcctccttgtgcaat

SEQ ID NO: 1575170 - DNA, 14 bp, Homo sapiens
agcctcctttgtgt

SEQ ID NO: 1575171 - DNA, 19 bp, Homo sapiens
agcctcgcacaggccctag

SEQ ID NO: 1575172 - DNA, 20 bp, Homo sapiens
agcctcgcacaggccctagc

SEQ ID NO: 1575173 - DNA, 20 bp, Homo sapiens
agcctcgttggagagcagca

SEQ ID NO: 1575174 - DNA, 14 bp, Homo sapiens
agcctctccaggaa

SEQ ID NO: 1575175 - DNA, 12 bp, Homo sapiens
agcctctcccac

SEQ ID NO: 1575176 - DNA, 13 bp, Homo sapiens
agcctctcccacc

SEQ ID NO: 1575177 - DNA, 13 bp, Homo sapiens
agcctctcccggc

SEQ ID NO: 1575178 - DNA, 21 bp, Homo sapiens
agcctctcccggctgcctgcc

SEQ ID NO: 1575179 - DNA, 14 bp, Homo sapiens
agcctctccgactc

SEQ ID NO: 1575180 - DNA, 19 bp, Homo sapiens
agcctctccgactctgcac

SEQ ID NO: 1575181 - DNA, 20 bp, Homo sapiens
agcctctctccttggccaca

SEQ ID NO: 1575182 - DNA, 15 bp, Homo sapiens
agcctctctctccct

SEQ ID NO: 1575183 - DNA, 14 bp, Homo sapiens
agcctctgccaggc

SEQ ID NO: 1575184 - DNA, 17 bp, Homo sapiens
agcctctgccaggcctg

SEQ ID NO: 1575185 - DNA, 13 bp, Homo sapiens
agcctctgctccc

SEQ ID NO: 1575186 - DNA, 16 bp, Homo sapiens
agcctctgctccccag

SEQ ID NO: 1575187 - DNA, 23 bp, Homo sapiens
agcctctggcattagaattattt

SEQ ID NO: 1575188 - DNA, 12 bp, Homo sapiens
agcctctggcta

SEQ ID NO: 1575189 - DNA, 20 bp, Homo sapiens
agcctctggctagaggccag

SEQ ID NO: 1575190 - DNA, 16 bp, Homo sapiens
agcctcttaccttccc

SEQ ID NO: 1575191 - DNA, 13 bp, Homo sapiens
agcctcttctgaa

SEQ ID NO: 1575192 - DNA, 17 bp, Homo sapiens
agcctcttctgaagatg

SEQ ID NO: 1575193 - DNA, 19 bp, Homo sapiens
agcctcttgtgtaactaat

SEQ ID NO: 1575194 - DNA, 17 bp, Homo sapiens
agcctgaaagatacagg

SEQ ID NO: 1575195 - DNA, 18 bp, Homo sapiens
agcctgaactgaggcctt

SEQ ID NO: 1575196 - DNA, 18 bp, Homo sapiens
agcctgaagcctggattc

SEQ ID NO: 1575197 - DNA, 20 bp, Homo sapiens
agcctgaattttgttgctgt

SEQ ID NO: 1575198 - DNA, 21 bp, Homo sapiens
agcctgaattttgttgctgtt

SEQ ID NO: 1575199 - DNA, 19 bp, Homo sapiens
agcctgacatggacccact

SEQ ID NO: 1575200 - DNA, 13 bp, Homo sapiens
agcctgaggcctt

SEQ ID NO: 1575201 - DNA, 19 bp, Homo sapiens
agcctgagtcacctgcaga

SEQ ID NO: 1575202 - DNA, 15 bp, Homo sapiens
agcctgagtctcctg

SEQ ID NO: 1575203 - DNA, 17 bp, Homo sapiens
agcctgagtctcctgtg

SEQ ID NO: 1575204 - DNA, 15 bp, Homo sapiens
agcctgagtgacaga

SEQ ID NO: 1575205 - DNA, 20 bp, Homo sapiens
agcctgatcaggcttcctgg

SEQ ID NO: 1575206 - DNA, 17 bp, Homo sapiens
agcctgatccagccttt

SEQ ID NO: 1575207 - DNA, 18 bp, Homo sapiens
agcctgatctttctagag

SEQ ID NO: 1575208 - DNA, 23 bp, Homo sapiens
agcctgatctttctagagccagc

SEQ ID NO: 1575209 - DNA, 13 bp, Homo sapiens
agcctgatggcca

SEQ ID NO: 1575210 - DNA, 15 bp, Homo sapiens
agcctgatggccaag

SEQ ID NO: 1575211 - DNA, 16 bp, Homo sapiens
agcctgatggccaagg

SEQ ID NO: 1575212 - DNA, 19 bp, Homo sapiens
agcctgatggccaaggggg

SEQ ID NO: 1575213 - DNA, 23 bp, Homo sapiens
agcctgatggccaagggggtgga

SEQ ID NO: 1575214 - DNA, 11 bp, Homo sapiens
agcctgatgtc

SEQ ID NO: 1575215 - DNA, 12 bp, Homo sapiens
agcctgcacaca

SEQ ID NO: 1575216 - DNA, 18 bp, Homo sapiens
agcctgcacacacctgcc

SEQ ID NO: 1575217 - DNA, 14 bp, Homo sapiens
agcctgcagcagga

SEQ ID NO: 1575218 - DNA, 12 bp, Homo sapiens
agcctgcagggt

SEQ ID NO: 1575219 - DNA, 19 bp, Homo sapiens
agcctgcagggtggtgctg

SEQ ID NO: 1575220 - DNA, 21 bp, Homo sapiens
agcctgcagggtggtgctggg

SEQ ID NO: 1575221 - DNA, 22 bp, Homo sapiens
agcctgcagggtggtgctggga

SEQ ID NO: 1575222 - DNA, 23 bp, Homo sapiens
agcctgcagggtggtgctgggac

SEQ ID NO: 1575223 - DNA, 22 bp, Homo sapiens
agcctgcattgagcttgcatgc

SEQ ID NO: 1575224 - DNA, 23 bp, Homo sapiens
agcctgccctcactccctctgca

SEQ ID NO: 1575225 - DNA, 11 bp, Homo sapiens
agcctgctccc

SEQ ID NO: 1575226 - DNA, 15 bp, Homo sapiens
agcctgctcccccac

SEQ ID NO: 1575227 - DNA, 21 bp, Homo sapiens
agcctgctcccccaccccctc

SEQ ID NO: 1575228 - DNA, 14 bp, Homo sapiens
agcctgctctggag

SEQ ID NO: 1575229 - DNA, 11 bp, Homo sapiens
agcctgctgac

SEQ ID NO: 1575230 - DNA, 13 bp, Homo sapiens
agcctgctgacag

SEQ ID NO: 1575231 - DNA, 10 bp, Homo sapiens
agcctgctgg

SEQ ID NO: 1575232 - DNA, 11 bp, Homo sapiens
agcctgctgga

SEQ ID NO: 1575233 - DNA, 12 bp, Homo sapiens
agcctgctggaa

SEQ ID NO: 1575234 - DNA, 11 bp, Homo sapiens
agcctgctggc

SEQ ID NO: 1575235 - DNA, 21 bp, Homo sapiens
agcctggactaaaggcatcct

SEQ ID NO: 1575236 - DNA, 13 bp, Homo sapiens
agcctggcacagg

SEQ ID NO: 1575237 - DNA, 17 bp, Homo sapiens
agcctggcacagggcag

SEQ ID NO: 1575238 - DNA, 14 bp, Homo sapiens
agcctggccaacat

SEQ ID NO: 1575239 - DNA, 14 bp, Homo sapiens
agcctggccagaca

SEQ ID NO: 1575240 - DNA, 15 bp, Homo sapiens
agcctggccagacac

SEQ ID NO: 1575241 - DNA, 16 bp, Homo sapiens
agcctggccagacaca

SEQ ID NO: 1575242 - DNA, 16 bp, Homo sapiens
agcctggcccatagaa

SEQ ID NO: 1575243 - DNA, 19 bp, Homo sapiens
agcctggctcccaggacac

SEQ ID NO: 1575244 - DNA, 23 bp, Homo sapiens
agcctggctctgccccctccccc

SEQ ID NO: 1575245 - DNA, 14 bp, Homo sapiens
agcctggcttctgg

SEQ ID NO: 1575246 - DNA, 19 bp, Homo sapiens
agcctggcttctggagccc

SEQ ID NO: 1575247 - DNA, 20 bp, Homo sapiens
agcctggcttctggagccct

SEQ ID NO: 1575248 - DNA, 15 bp, Homo sapiens
agcctgggaaataag

SEQ ID NO: 1575249 - DNA, 21 bp, Homo sapiens
agcctgggaaataagccccct

SEQ ID NO: 1575250 - DNA, 16 bp, Homo sapiens
agcctgggactcccag

SEQ ID NO: 1575251 - DNA, 17 bp, Homo sapiens
agcctgggactcccagt

SEQ ID NO: 1575252 - DNA, 18 bp, Homo sapiens
agcctgggactcccagtg

SEQ ID NO: 1575253 - DNA, 16 bp, Homo sapiens
agcctgggagcccaga

SEQ ID NO: 1575254 - DNA, 19 bp, Homo sapiens
agcctgggagcccagaggg

SEQ ID NO: 1575255 - DNA, 13 bp, Homo sapiens
agcctgggcaaca

SEQ ID NO: 1575256 - DNA, 17 bp, Homo sapiens
agcctgggcagccaggc

SEQ ID NO: 1575257 - DNA, 18 bp, Homo sapiens
agcctgggcagccaggct

SEQ ID NO: 1575258 - DNA, 21 bp, Homo sapiens
agcctgggcagccaggctgcc

SEQ ID NO: 1575259 - DNA, 16 bp, Homo sapiens
agcctgggccagagaa

SEQ ID NO: 1575260 - DNA, 17 bp, Homo sapiens
agcctgggcgacaaaaa

SEQ ID NO: 1575261 - DNA, 11 bp, Homo sapiens
agcctgggctc

SEQ ID NO: 1575262 - DNA, 12 bp, Homo sapiens
agcctggggctc

SEQ ID NO: 1575263 - DNA, 14 bp, Homo sapiens
agcctggggctccc

SEQ ID NO: 1575264 - DNA, 16 bp, Homo sapiens
agcctggggctccctc

SEQ ID NO: 1575265 - DNA, 16 bp, Homo sapiens
agcctggggtgttctc

SEQ ID NO: 1575266 - DNA, 16 bp, Homo sapiens
agcctggtgggcctcc

SEQ ID NO: 1575267 - DNA, 18 bp, Homo sapiens
agcctggtgggcctcctc

SEQ ID NO: 1575268 - DNA, 22 bp, Homo sapiens
agcctgtaaactttatcactta

SEQ ID NO: 1575269 - DNA, 20 bp, Homo sapiens
agcctgtaacactcctctgc

SEQ ID NO: 1575270 - DNA, 14 bp, Homo sapiens
agcctgtagggaac

SEQ ID NO: 1575271 - DNA, 16 bp, Homo sapiens
agcctgtagggaactt

SEQ ID NO: 1575272 - DNA, 15 bp, Homo sapiens
agcctgtatgtggtg

SEQ ID NO: 1575273 - DNA, 15 bp, Homo sapiens
agcctgtcaccagag

SEQ ID NO: 1575274 - DNA, 21 bp, Homo sapiens
agcctgtcataggttttaaat

SEQ ID NO: 1575275 - DNA, 18 bp, Homo sapiens
agcctgtccaacatggtg

SEQ ID NO: 1575276 - DNA, 23 bp, Homo sapiens
agcctgtgaataaaaaccctgta

SEQ ID NO: 1575277 - DNA, 22 bp, Homo sapiens
agcctgtgattaacttgcttag

SEQ ID NO: 1575278 - DNA, 15 bp, Homo sapiens
agcctgtgccagcac

SEQ ID NO: 1575279 - DNA, 19 bp, Homo sapiens
agcctgtgcctctgggact

SEQ ID NO: 1575280 - DNA, 19 bp, Homo sapiens
agcctgtgcgtcccagctg

SEQ ID NO: 1575281 - DNA, 23 bp, Homo sapiens
agcctgtgcgtcccagctgaagg

SEQ ID NO: 1575282 - DNA, 22 bp, Homo sapiens
agcctgtggcatctttgccttg

SEQ ID NO: 1575283 - DNA, 17 bp, Homo sapiens
agcctgtggcggtgcct

SEQ ID NO: 1575284 - DNA, 19 bp, Homo sapiens
agcctgtggcggtgcctgg

SEQ ID NO: 1575285 - DNA, 20 bp, Homo sapiens
agcctgtggcggtgcctggg

SEQ ID NO: 1575286 - DNA, 18 bp, Homo sapiens
agcctgtgggagtagaaa

SEQ ID NO: 1575287 - DNA, 17 bp, Homo sapiens
agccttaatttgcacag

SEQ ID NO: 1575288 - DNA, 13 bp, Homo sapiens
agccttatgtgga

SEQ ID NO: 1575289 - DNA, 19 bp, Homo sapiens
agccttattcaccttttta

SEQ ID NO: 1575290 - DNA, 21 bp, Homo sapiens
agccttattcacctttttaat

SEQ ID NO: 1575291 - DNA, 22 bp, Homo sapiens
agccttattcacctttttaata

SEQ ID NO: 1575292 - DNA, 19 bp, Homo sapiens
agccttatttctagaagca

SEQ ID NO: 1575293 - DNA, 20 bp, Homo sapiens
agccttcaaaactatagctt

SEQ ID NO: 1575294 - DNA, 21 bp, Homo sapiens
agccttcaaaactatagcttg

SEQ ID NO: 1575295 - DNA, 18 bp, Homo sapiens
agccttcaagaatcagaa

SEQ ID NO: 1575296 - DNA, 13 bp, Homo sapiens
agccttcaagtgc

SEQ ID NO: 1575297 - DNA, 18 bp, Homo sapiens
agccttcaagtgccaaac

SEQ ID NO: 1575298 - DNA, 24 bp, Homo sapiens
agccttcaagtgccaaacagagta

SEQ ID NO: 1575299 - DNA, 18 bp, Homo sapiens
agccttcagcagcagctc

SEQ ID NO: 1575300 - DNA, 23 bp, Homo sapiens
agccttcagtcttgaatttctaa

SEQ ID NO: 1575301 - DNA, 21 bp, Homo sapiens
agccttcctccacatcctttc

SEQ ID NO: 1575302 - DNA, 17 bp, Homo sapiens
agccttcctctgcagct

SEQ ID NO: 1575303 - DNA, 21 bp, Homo sapiens
agccttcctctgcagctgacc

SEQ ID NO: 1575304 - DNA, 18 bp, Homo sapiens
agccttcctttctcctgc

SEQ ID NO: 1575305 - DNA, 19 bp, Homo sapiens
agccttcctttctcctgcc

SEQ ID NO: 1575306 - DNA, 20 bp, Homo sapiens
agccttcctttctcctgccc

SEQ ID NO: 1575307 - DNA, 22 bp, Homo sapiens
agccttcctttctcctgcccca

SEQ ID NO: 1575308 - DNA, 12 bp, Homo sapiens
agccttcggaca

SEQ ID NO: 1575309 - DNA, 21 bp, Homo sapiens
agccttcggagcgttctctgt

SEQ ID NO: 1575310 - DNA, 15 bp, Homo sapiens
agccttctcacccca

SEQ ID NO: 1575311 - DNA, 18 bp, Homo sapiens
agccttctcaccccagga

SEQ ID NO: 1575312 - DNA, 19 bp, Homo sapiens
agccttctcaccccaggat

SEQ ID NO: 1575313 - DNA, 14 bp, Homo sapiens
agccttctcctccc

SEQ ID NO: 1575314 - DNA, 17 bp, Homo sapiens
agccttctcctcccaag

SEQ ID NO: 1575315 - DNA, 14 bp, Homo sapiens
agccttgaaaaaca

SEQ ID NO: 1575316 - DNA, 18 bp, Homo sapiens
agccttgaaaaacaagtc

SEQ ID NO: 1575317 - DNA, 23 bp, Homo sapiens
agccttgcagatatctgcatgtg

SEQ ID NO: 1575318 - DNA, 15 bp, Homo sapiens
agccttgccagagat

SEQ ID NO: 1575319 - DNA, 22 bp, Homo sapiens
agccttgcctaaatttaatgct

SEQ ID NO: 1575320 - DNA, 23 bp, Homo sapiens
agccttgcctaaatttaatgctg

SEQ ID NO: 1575321 - DNA, 15 bp, Homo sapiens
agccttgctgggcca

SEQ ID NO: 1575322 - DNA, 16 bp, Homo sapiens
agccttgctgggccag

SEQ ID NO: 1575323 - DNA, 22 bp, Homo sapiens
agccttggataatgctgttgcc

SEQ ID NO: 1575324 - DNA, 23 bp, Homo sapiens
agccttggataatgctgttgcct

SEQ ID NO: 1575325 - DNA, 17 bp, Homo sapiens
agccttggcccacactg

SEQ ID NO: 1575326 - DNA, 23 bp, Homo sapiens
agccttgggaacatgcgtgtgac

SEQ ID NO: 1575327 - DNA, 23 bp, Homo sapiens
agccttggggggtgggggctgtc

SEQ ID NO: 1575328 - DNA, 19 bp, Homo sapiens
agccttggtgtccacctgg

SEQ ID NO: 1575329 - DNA, 16 bp, Homo sapiens
agccttgtaattctaa

SEQ ID NO: 1575330 - DNA, 19 bp, Homo sapiens
agccttgtgccctgccccc

SEQ ID NO: 1575331 - DNA, 18 bp, Homo sapiens
agcctttcattttgcttt

SEQ ID NO: 1575332 - DNA, 21 bp, Homo sapiens
agcctttcattttgctttaat

SEQ ID NO: 1575333 - DNA, 16 bp, Homo sapiens
agcctttccaagtcac

SEQ ID NO: 1575334 - DNA, 19 bp, Homo sapiens
agcctttcgttctgctgac

SEQ ID NO: 1575335 - DNA, 16 bp, Homo sapiens
agcctttctcccaggc

SEQ ID NO: 1575336 - DNA, 23 bp, Homo sapiens
agcctttctctctttatacagct

SEQ ID NO: 1575337 - DNA, 17 bp, Homo sapiens
agcctttgggtcctggg

SEQ ID NO: 1575338 - DNA, 18 bp, Homo sapiens
agcctttggttctggcca

SEQ ID NO: 1575339 - DNA, 23 bp, Homo sapiens
agcctttgttgaactgttagaat

SEQ ID NO: 1575340 - DNA, 18 bp, Homo sapiens
agcctttgtttttctcca

SEQ ID NO: 1575341 - DNA, 22 bp, Homo sapiens
agccttttgtttcccttgcttt

SEQ ID NO: 1575342 - DNA, 19 bp, Homo sapiens
agcctttttaaaacacatg

SEQ ID NO: 1575343 - DNA, 12 bp, Homo sapiens
agcgaaactccg

SEQ ID NO: 1575344 - DNA, 17 bp, Homo sapiens
agcgaaggaacctctcg

SEQ ID NO: 1575345 - DNA, 17 bp, Homo sapiens
agcgacacttgaatgta

SEQ ID NO: 1575346 - DNA, 21 bp, Homo sapiens
agcgacagtaggatttttcaa

SEQ ID NO: 1575347 - DNA, 14 bp, Homo sapiens
agcgaccgccccct

SEQ ID NO: 1575348 - DNA, 21 bp, Homo sapiens
agcgactccgttggccactcc

SEQ ID NO: 1575349 - DNA, 13 bp, Homo sapiens
agcgagactccat

SEQ ID NO: 1575350 - DNA, 15 bp, Homo sapiens
agcgagactccatct

SEQ ID NO: 1575351 - DNA, 17 bp, Homo sapiens
agcgagactccatctct

SEQ ID NO: 1575352 - DNA, 13 bp, Homo sapiens
agcgagaggcagc

SEQ ID NO: 1575353 - DNA, 19 bp, Homo sapiens
agcgagcatcccccaaagt

SEQ ID NO: 1575354 - DNA, 23 bp, Homo sapiens
agcgaggcacccttactggctta

SEQ ID NO: 1575355 - DNA, 24 bp, Homo sapiens
agcgaggctgagcctacagatgaa

SEQ ID NO: 1575356 - DNA, 19 bp, Homo sapiens
agcgaggtcaacagagaag

SEQ ID NO: 1575357 - DNA, 22 bp, Homo sapiens
agcgaggtcaacagagaaggca

SEQ ID NO: 1575358 - DNA, 21 bp, Homo sapiens
agcgatggtgctgcccaggcc

SEQ ID NO: 1575359 - DNA, 14 bp, Homo sapiens
agcgatttgaaaca

SEQ ID NO: 1575360 - DNA, 12 bp, Homo sapiens
agcgcacctgcc

SEQ ID NO: 1575361 - DNA, 14 bp, Homo sapiens
agcgcacctgcccc

SEQ ID NO: 1575362 - DNA, 17 bp, Homo sapiens
agcgcacctgccccctg

SEQ ID NO: 1575363 - DNA, 21 bp, Homo sapiens
agcgcacctgccccctggtgg

SEQ ID NO: 1575364 - DNA, 12 bp, Homo sapiens
agcgccagctcc

SEQ ID NO: 1575365 - DNA, 13 bp, Homo sapiens
agcgcccacccag

SEQ ID NO: 1575366 - DNA, 16 bp, Homo sapiens
agcgcccgctgggctg

SEQ ID NO: 1575367 - DNA, 22 bp, Homo sapiens
agcgcctagtggggtctccctc

SEQ ID NO: 1575368 - DNA, 13 bp, Homo sapiens
agcgcggaggagg

SEQ ID NO: 1575369 - DNA, 16 bp, Homo sapiens
agcgcggccagcgtcc

SEQ ID NO: 1575370 - DNA, 18 bp, Homo sapiens
agcgctcatgttgagcca

SEQ ID NO: 1575371 - DNA, 17 bp, Homo sapiens
agcgctctcctggacgc

SEQ ID NO: 1575372 - DNA, 14 bp, Homo sapiens
agcgctctggtgct

SEQ ID NO: 1575373 - DNA, 18 bp, Homo sapiens
agcgctgccgcaccccag

SEQ ID NO: 1575374 - DNA, 16 bp, Homo sapiens
agcgctgtggactgtc

SEQ ID NO: 1575375 - DNA, 19 bp, Homo sapiens
agcgctgtggactgtcctg

SEQ ID NO: 1575376 - DNA, 15 bp, Homo sapiens
agcggaaaagttgtc

SEQ ID NO: 1575377 - DNA, 16 bp, Homo sapiens
agcggaaaagttgtct

SEQ ID NO: 1575378 - DNA, 17 bp, Homo sapiens
agcggaacaaggagtca

SEQ ID NO: 1575379 - DNA, 16 bp, Homo sapiens
agcggagagagccaag

SEQ ID NO: 1575380 - DNA, 17 bp, Homo sapiens
agcggagagagccaaga

SEQ ID NO: 1575381 - DNA, 13 bp, Homo sapiens
agcggagcccagc

SEQ ID NO: 1575382 - DNA, 21 bp, Homo sapiens
agcggagcccgatattctccc

SEQ ID NO: 1575383 - DNA, 23 bp, Homo sapiens
agcggagcccgatattctccctg

SEQ ID NO: 1575384 - DNA, 18 bp, Homo sapiens
agcggaggagaccagctc

SEQ ID NO: 1575385 - DNA, 21 bp, Homo sapiens
agcggaggagaccagctcaga

SEQ ID NO: 1575386 - DNA, 19 bp, Homo sapiens
agcggagttcctaacagga

SEQ ID NO: 1575387 - DNA, 12 bp, Homo sapiens
agcggcagagca

SEQ ID NO: 1575388 - DNA, 20 bp, Homo sapiens
agcggcagagcaattccagg

SEQ ID NO: 1575389 - DNA, 20 bp, Homo sapiens
agcggccccccgcacagcca

SEQ ID NO: 1575390 - DNA, 23 bp, Homo sapiens
agcggccccccgcacagccaccc

SEQ ID NO: 1575391 - DNA, 12 bp, Homo sapiens
agcggcccctcc

SEQ ID NO: 1575392 - DNA, 14 bp, Homo sapiens
agcggcccctccca

SEQ ID NO: 1575393 - DNA, 21 bp, Homo sapiens
agcggccttgaagacagagca

SEQ ID NO: 1575394 - DNA, 12 bp, Homo sapiens
agcggcgcagag

SEQ ID NO: 1575395 - DNA, 14 bp, Homo sapiens
agcggcgcagagcc

SEQ ID NO: 1575396 - DNA, 19 bp, Homo sapiens
agcggcgcagagccctcca

SEQ ID NO: 1575397 - DNA, 14 bp, Homo sapiens
agcggctggagaaa

SEQ ID NO: 1575398 - DNA, 18 bp, Homo sapiens
agcggctgtttactgctt

SEQ ID NO: 1575399 - DNA, 14 bp, Homo sapiens
agcgggcacagggc

SEQ ID NO: 1575400 - DNA, 23 bp, Homo sapiens
agcgggcacagggcaccagaggc

SEQ ID NO: 1575401 - DNA, 19 bp, Homo sapiens
agcgggcaggttctgcctg

SEQ ID NO: 1575402 - DNA, 12 bp, Homo sapiens
agcgggccaggc

SEQ ID NO: 1575403 - DNA, 19 bp, Homo sapiens
agcgggggccttgaagact

SEQ ID NO: 1575404 - DNA, 22 bp, Homo sapiens
agcggtccaacgccgccttggc

SEQ ID NO: 1575405 - DNA, 15 bp, Homo sapiens
agcggtggccccgag

SEQ ID NO: 1575406 - DNA, 20 bp, Homo sapiens
agcggtgggggaggagggtt

SEQ ID NO: 1575407 - DNA, 23 bp, Homo sapiens
agcgtcactccagtgctcagctg

SEQ ID NO: 1575408 - DNA, 17 bp, Homo sapiens
agcgtcccagggtaccc

SEQ ID NO: 1575409 - DNA, 16 bp, Homo sapiens
agcgtcccagtctctg

SEQ ID NO: 1575410 - DNA, 19 bp, Homo sapiens
agcgtcccagtctctggca

SEQ ID NO: 1575411 - DNA, 13 bp, Homo sapiens
agcgtccctggcg

SEQ ID NO: 1575412 - DNA, 13 bp, Homo sapiens
agcgtcctgccct

SEQ ID NO: 1575413 - DNA, 21 bp, Homo sapiens
agcgtcctgccctgccccctc

SEQ ID NO: 1575414 - DNA, 13 bp, Homo sapiens
agcgtctgctcat

SEQ ID NO: 1575415 - DNA, 14 bp, Homo sapiens
agcgtcttgctctg

SEQ ID NO: 1575416 - DNA, 15 bp, Homo sapiens
agcgtgcacatctgc

SEQ ID NO: 1575417 - DNA, 15 bp, Homo sapiens
agcgtggactctgct

SEQ ID NO: 1575418 - DNA, 16 bp, Homo sapiens
agcgtggggtagcaga

SEQ ID NO: 1575419 - DNA, 23 bp, Homo sapiens
agcgtgtctgtatttatgtgtga

SEQ ID NO: 1575420 - DNA, 12 bp, Homo sapiens
agcgtgtggagc

SEQ ID NO: 1575421 - DNA, 17 bp, Homo sapiens
agcgtgtggagcagagc

SEQ ID NO: 1575422 - DNA, 15 bp, Homo sapiens
agcgttagggctgct

SEQ ID NO: 1575423 - DNA, 19 bp, Homo sapiens
agcgttctggactctgccc

SEQ ID NO: 1575424 - DNA, 21 bp, Homo sapiens
agcgttctggactctgcccca

SEQ ID NO: 1575425 - DNA, 13 bp, Homo sapiens
agcgttttgcaag

SEQ ID NO: 1575426 - DNA, 14 bp, Homo sapiens
agctaaaaggaaaa

SEQ ID NO: 1575427 - DNA, 17 bp, Homo sapiens
agctaaaccaaggactg

SEQ ID NO: 1575428 - DNA, 19 bp, Homo sapiens
agctaaaccaaggactgag

SEQ ID NO: 1575429 - DNA, 13 bp, Homo sapiens
agctaaagaggct

SEQ ID NO: 1575430 - DNA, 15 bp, Homo sapiens
agctaaagaggctga

SEQ ID NO: 1575431 - DNA, 16 bp, Homo sapiens
agctaactgtaaatca

SEQ ID NO: 1575432 - DNA, 13 bp, Homo sapiens
agctaagaacctg

SEQ ID NO: 1575433 - DNA, 22 bp, Homo sapiens
agctaagatgtggtgcttttct

SEQ ID NO: 1575434 - DNA, 18 bp, Homo sapiens
agctaaggctctatgagt

SEQ ID NO: 1575435 - DNA, 12 bp, Homo sapiens
agctaataaacc

SEQ ID NO: 1575436 - DNA, 16 bp, Homo sapiens
agctaatcagcattct

SEQ ID NO: 1575437 - DNA, 17 bp, Homo sapiens
agctaatctgtagggct

SEQ ID NO: 1575438 - DNA, 23 bp, Homo sapiens
agctaatgtaataactgtgaagt

SEQ ID NO: 1575439 - DNA, 18 bp, Homo sapiens
agctaatgtgcagggata

SEQ ID NO: 1575440 - DNA, 22 bp, Homo sapiens
agctaattgtactaatctgaga

SEQ ID NO: 1575441 - DNA, 12 bp, Homo sapiens
agctaatttttg

SEQ ID NO: 1575442 - DNA, 20 bp, Homo sapiens
agctacacagtgcagaggct

SEQ ID NO: 1575443 - DNA, 14 bp, Homo sapiens
agctacaggaagca

SEQ ID NO: 1575444 - DNA, 15 bp, Homo sapiens
agctacatgttcttt

SEQ ID NO: 1575445 - DNA, 12 bp, Homo sapiens
agctacattcct

SEQ ID NO: 1575446 - DNA, 17 bp, Homo sapiens
agctacattcctcagct

SEQ ID NO: 1575447 - DNA, 22 bp, Homo sapiens
agctaccacccttaggggtaat

SEQ ID NO: 1575448 - DNA, 19 bp, Homo sapiens
agctaccagagctctatcc

SEQ ID NO: 1575449 - DNA, 17 bp, Homo sapiens
agctaccctcagcctcc

SEQ ID NO: 1575450 - DNA, 21 bp, Homo sapiens
agctaccctcagcctccaatg

SEQ ID NO: 1575451 - DNA, 16 bp, Homo sapiens
agctactaatgatgtt

SEQ ID NO: 1575452 - DNA, 18 bp, Homo sapiens
agctactcagaagcctga

SEQ ID NO: 1575453 - DNA, 19 bp, Homo sapiens
agctactctgtccaggcca

SEQ ID NO: 1575454 - DNA, 13 bp, Homo sapiens
agctactgatgaa

SEQ ID NO: 1575455 - DNA, 17 bp, Homo sapiens
agctactggggaggctg

SEQ ID NO: 1575456 - DNA, 20 bp, Homo sapiens
agctactggggaggctgagg

SEQ ID NO: 1575457 - DNA, 15 bp, Homo sapiens
agctacttcctcctc

SEQ ID NO: 1575458 - DNA, 14 bp, Homo sapiens
agctacttgggagg

SEQ ID NO: 1575459 - DNA, 16 bp, Homo sapiens
agctacttgggaggct

SEQ ID NO: 1575460 - DNA, 18 bp, Homo sapiens
agctacttgggaggctga

SEQ ID NO: 1575461 - DNA, 15 bp, Homo sapiens
agctactttggcatt

SEQ ID NO: 1575462 - DNA, 19 bp, Homo sapiens
agctagaagtgggccagga

SEQ ID NO: 1575463 - DNA, 21 bp, Homo sapiens
agctagaagtgggccaggaca

SEQ ID NO: 1575464 - DNA, 15 bp, Homo sapiens
agctagacacatgaa

SEQ ID NO: 1575465 - DNA, 21 bp, Homo sapiens
agctagatacgaaatcagttt

SEQ ID NO: 1575466 - DNA, 20 bp, Homo sapiens
agctagccagagggtgggag

SEQ ID NO: 1575467 - DNA, 18 bp, Homo sapiens
agctagcgctgccgcacc

SEQ ID NO: 1575468 - DNA, 20 bp, Homo sapiens
agctagcgctgccgcacccc

SEQ ID NO: 1575469 - DNA, 14 bp, Homo sapiens
agctagctgccact

SEQ ID NO: 1575470 - DNA, 18 bp, Homo sapiens
agctaggaagagcaggac

SEQ ID NO: 1575471 - DNA, 13 bp, Homo sapiens
agctaggactgag

SEQ ID NO: 1575472 - DNA, 19 bp, Homo sapiens
agctaggatggttctgtga

SEQ ID NO: 1575473 - DNA, 20 bp, Homo sapiens
agctaggatggttctgtgac

SEQ ID NO: 1575474 - DNA, 17 bp, Homo sapiens
agctaggccccagaggc

SEQ ID NO: 1575475 - DNA, 21 bp, Homo sapiens
agctaggccccagaggccctg

SEQ ID NO: 1575476 - DNA, 23 bp, Homo sapiens
agctaggccccagaggccctgga

SEQ ID NO: 1575477 - DNA, 13 bp, Homo sapiens
agctagtatcttc

SEQ ID NO: 1575478 - DNA, 16 bp, Homo sapiens
agctagtgtacctcct

SEQ ID NO: 1575479 - DNA, 19 bp, Homo sapiens
agctagtgtacctcctctc

SEQ ID NO: 1575480 - DNA, 21 bp, Homo sapiens
agctagtgtacctcctctcag

SEQ ID NO: 1575481 - DNA, 22 bp, Homo sapiens
agctagtgtacctcctctcagt

SEQ ID NO: 1575482 - DNA, 15 bp, Homo sapiens
agctagttggggagc

SEQ ID NO: 1575483 - DNA, 12 bp, Homo sapiens
agctagtttgct

SEQ ID NO: 1575484 - DNA, 12 bp, Homo sapiens
agctagttttct

SEQ ID NO: 1575485 - DNA, 15 bp, Homo sapiens
agctataaagtatat

SEQ ID NO: 1575486 - DNA, 18 bp, Homo sapiens
agctataacaactctatt

SEQ ID NO: 1575487 - DNA, 19 bp, Homo sapiens
agctatattagctgaaaca

SEQ ID NO: 1575488 - DNA, 20 bp, Homo sapiens
agctatatttgattatgtat

SEQ ID NO: 1575489 - DNA, 14 bp, Homo sapiens
agctatcaggaaca

SEQ ID NO: 1575490 - DNA, 17 bp, Homo sapiens
agctatcgaacttcaca

SEQ ID NO: 1575491 - DNA, 18 bp, Homo sapiens
agctatctatatggaatt

SEQ ID NO: 1575492 - DNA, 15 bp, Homo sapiens
agctatgagagatgt

SEQ ID NO: 1575493 - DNA, 18 bp, Homo sapiens
agctatgagagatgtgtc

SEQ ID NO: 1575494 - DNA, 18 bp, Homo sapiens
agctatgattatgccact

SEQ ID NO: 1575495 - DNA, 15 bp, Homo sapiens
agctattcacctcag

SEQ ID NO: 1575496 - DNA, 21 bp, Homo sapiens
agctattcacctcagtagaaa

SEQ ID NO: 1575497 - DNA, 12 bp, Homo sapiens
agctatttaata

SEQ ID NO: 1575498 - DNA, 21 bp, Homo sapiens
agctatttcatctatttttgg

SEQ ID NO: 1575499 - DNA, 14 bp, Homo sapiens
agctcaaaggtttg

SEQ ID NO: 1575500 - DNA, 23 bp, Homo sapiens
agctcaaaggtttggaaggagca

SEQ ID NO: 1575501 - DNA, 17 bp, Homo sapiens
agctcaaataaaaataa

SEQ ID NO: 1575502 - DNA, 16 bp, Homo sapiens
agctcaaatgaaatgt

SEQ ID NO: 1575503 - DNA, 17 bp, Homo sapiens
agctcaaatgaaatgta

SEQ ID NO: 1575504 - DNA, 18 bp, Homo sapiens
agctcaactcacagcttc

SEQ ID NO: 1575505 - DNA, 19 bp, Homo sapiens
agctcaactcacagcttct

SEQ ID NO: 1575506 - DNA, 18 bp, Homo sapiens
agctcaagtcttccctga

SEQ ID NO: 1575507 - DNA, 19 bp, Homo sapiens
agctcacactccagtggca

SEQ ID NO: 1575508 - DNA, 18 bp, Homo sapiens
agctcacagtgctgtgtg

SEQ ID NO: 1575509 - DNA, 14 bp, Homo sapiens
agctcaccaggcct

SEQ ID NO: 1575510 - DNA, 19 bp, Homo sapiens
agctcaccaggcctggcct

SEQ ID NO: 1575511 - DNA, 23 bp, Homo sapiens
agctcaccaggcctggcctctgg

SEQ ID NO: 1575512 - DNA, 14 bp, Homo sapiens
agctcaccctgccc

SEQ ID NO: 1575513 - DNA, 15 bp, Homo sapiens
agctcaccctgcccg

SEQ ID NO: 1575514 - DNA, 17 bp, Homo sapiens
agctcaccctgcccgct

SEQ ID NO: 1575515 - DNA, 18 bp, Homo sapiens
agctcaccctgcccgctc

SEQ ID NO: 1575516 - DNA, 15 bp, Homo sapiens
agctcacctctgaag

SEQ ID NO: 1575517 - DNA, 16 bp, Homo sapiens
agctcacgtaatgcat

SEQ ID NO: 1575518 - DNA, 14 bp, Homo sapiens
agctcactgcaagc

SEQ ID NO: 1575519 - DNA, 22 bp, Homo sapiens
agctgcgtttattaatgcctct

SEQ ID NO: 1575520 - DNA, 19 bp, Homo sapiens
agctgctatccccatctcc

SEQ ID NO: 1575521 - DNA, 20 bp, Homo sapiens
agctgctccccaggccaccc

SEQ ID NO: 1575522 - DNA, 21 bp, Homo sapiens
agctgctcctttaccctcttg

SEQ ID NO: 1575523 - DNA, 14 bp, Homo sapiens
agctgctctattgt

SEQ ID NO: 1575524 - DNA, 14 bp, Homo sapiens
agctgctctgcccc

SEQ ID NO: 1575525 - DNA, 21 bp, Homo sapiens
agctgctctgccccttgggca

SEQ ID NO: 1575526 - DNA, 16 bp, Homo sapiens
agctgctctgtcttct

SEQ ID NO: 1575527 - DNA, 22 bp, Homo sapiens
agctgctcttgcatctgggcca

SEQ ID NO: 1575528 - DNA, 15 bp, Homo sapiens
agctgctgaaacaac

SEQ ID NO: 1575529 - DNA, 20 bp, Homo sapiens
agctgctgaaacaacaaata

SEQ ID NO: 1575530 - DNA, 17 bp, Homo sapiens
agctgctgaccaattgt

SEQ ID NO: 1575531 - DNA, 13 bp, Homo sapiens
agctgctggagcc

SEQ ID NO: 1575532 - DNA, 14 bp, Homo sapiens
agctgctggccagg

SEQ ID NO: 1575533 - DNA, 19 bp, Homo sapiens
agctgctgggacccacctc

SEQ ID NO: 1575534 - DNA, 21 bp, Homo sapiens
agctgctgggacccacctccc

SEQ ID NO: 1575535 - DNA, 18 bp, Homo sapiens
agctgctgtcttctggac

SEQ ID NO: 1575536 - DNA, 14 bp, Homo sapiens
agctgcttttgcat

SEQ ID NO: 1575537 - DNA, 23 bp, Homo sapiens
agctgctttttttgaaactttga

SEQ ID NO: 1575538 - DNA, 19 bp, Homo sapiens
agctggaacatttgatatt

SEQ ID NO: 1575539 - DNA, 15 bp, Homo sapiens
agctggactacccac

SEQ ID NO: 1575540 - DNA, 14 bp, Homo sapiens
agctggactgacca

SEQ ID NO: 1575541 - DNA, 17 bp, Homo sapiens
agctggactgaccaaag

SEQ ID NO: 1575542 - DNA, 17 bp, Homo sapiens
agctggaggctgtggga

SEQ ID NO: 1575543 - DNA, 14 bp, Homo sapiens
agctggaggggtgg

SEQ ID NO: 1575544 - DNA, 19 bp, Homo sapiens
agctggaggggtggggagc

SEQ ID NO: 1575545 - DNA, 21 bp, Homo sapiens
agctggaggggtggggagcta

SEQ ID NO: 1575546 - DNA, 14 bp, Homo sapiens
agctggagtgcagt

SEQ ID NO: 1575547 - DNA, 16 bp, Homo sapiens
agctggatagacttgg

SEQ ID NO: 1575548 - DNA, 18 bp, Homo sapiens
agctggatagacttggga

SEQ ID NO: 1575549 - DNA, 14 bp, Homo sapiens
agctggcagaacgg

SEQ ID NO: 1575550 - DNA, 15 bp, Homo sapiens
agctggcaggacaca

SEQ ID NO: 1575551 - DNA, 22 bp, Homo sapiens
agctggccaaagagcctttcca

SEQ ID NO: 1575552 - DNA, 23 bp, Homo sapiens
agctggccacctagaagtctccc

SEQ ID NO: 1575553 - DNA, 11 bp, Homo sapiens
agctggcccag

SEQ ID NO: 1575554 - DNA, 20 bp, Homo sapiens
agctggccccgcttggtggc

SEQ ID NO: 1575555 - DNA, 23 bp, Homo sapiens
agctggccgagggtcctggctcc

SEQ ID NO: 1575556 - DNA, 22 bp, Homo sapiens
agctggccgcgccaaataatgt

SEQ ID NO: 1575557 - DNA, 15 bp, Homo sapiens
agctggcctgtggca

SEQ ID NO: 1575558 - DNA, 18 bp, Homo sapiens
agctggcctgtggcacag

SEQ ID NO: 1575559 - DNA, 23 bp, Homo sapiens
agctggcctgtggcacagccctg

SEQ ID NO: 1575560 - DNA, 14 bp, Homo sapiens
agctggctgggcct

SEQ ID NO: 1575561 - DNA, 14 bp, Homo sapiens
agctgggaaagcat

SEQ ID NO: 1575562 - DNA, 16 bp, Homo sapiens
agctgggaactgacat

SEQ ID NO: 1575563 - DNA, 18 bp, Homo sapiens
agctgggaggaaaagaaa

SEQ ID NO: 1575564 - DNA, 13 bp, Homo sapiens
agctgggaggcaa

SEQ ID NO: 1575565 - DNA, 16 bp, Homo sapiens
agctgggaggcaagag

SEQ ID NO: 1575566 - DNA, 23 bp, Homo sapiens
agctgggaggcaagaggggtgga

SEQ ID NO: 1575567 - DNA, 17 bp, Homo sapiens
agctgggccccacctac

SEQ ID NO: 1575568 - DNA, 20 bp, Homo sapiens
agctgggccccatgctctgc

SEQ ID NO: 1575569 - DNA, 22 bp, Homo sapiens
agctgggcccctgcacaggcac

SEQ ID NO: 1575570 - DNA, 14 bp, Homo sapiens
agctgggcctcctg

SEQ ID NO: 1575571 - DNA, 22 bp, Homo sapiens
agctgggctctgccaccctacc

SEQ ID NO: 1575572 - DNA, 19 bp, Homo sapiens
agctggggagcagctgaga

SEQ ID NO: 1575573 - DNA, 22 bp, Homo sapiens
agctggggatccctccccccca

SEQ ID NO: 1575574 - DNA, 18 bp, Homo sapiens
agctggggcgtggggagg

SEQ ID NO: 1575575 - DNA, 19 bp, Homo sapiens
agctgggggaaggcaggag

SEQ ID NO: 1575576 - DNA, 18 bp, Homo sapiens
agctggggggctgtcctg

SEQ ID NO: 1575577 - DNA, 14 bp, Homo sapiens
agctggggtacagg

SEQ ID NO: 1575578 - DNA, 20 bp, Homo sapiens
agctggggtgggagctcctc

SEQ ID NO: 1575579 - DNA, 19 bp, Homo sapiens
agctgggtactgactgaga

SEQ ID NO: 1575580 - DNA, 18 bp, Homo sapiens
agctggtcagtctttgct

SEQ ID NO: 1575581 - DNA, 21 bp, Homo sapiens
agctggtcagtctttgctcag

SEQ ID NO: 1575582 - DNA, 12 bp, Homo sapiens
agctggtgccaa

SEQ ID NO: 1575583 - DNA, 14 bp, Homo sapiens
agctggtgccccac

SEQ ID NO: 1575584 - DNA, 12 bp, Homo sapiens
agctggtggccc

SEQ ID NO: 1575585 - DNA, 18 bp, Homo sapiens
agctggtggccctgtgcc

SEQ ID NO: 1575586 - DNA, 21 bp, Homo sapiens
agctggtggccctgtgcctgg

SEQ ID NO: 1575587 - DNA, 22 bp, Homo sapiens
agctggtggccctgtgcctggg

SEQ ID NO: 1575588 - DNA, 13 bp, Homo sapiens
agctggtgggaag

SEQ ID NO: 1575589 - DNA, 15 bp, Homo sapiens
agctggttagaaatg

SEQ ID NO: 1575590 - DNA, 20 bp, Homo sapiens
agctggtttgtcaaacaaca

SEQ ID NO: 1575591 - DNA, 17 bp, Homo sapiens
agctgtaagaagagact

SEQ ID NO: 1575592 - DNA, 18 bp, Homo sapiens
agctgtaagaagagactg

SEQ ID NO: 1575593 - DNA, 23 bp, Homo sapiens
agctgtaagaagagactgggaag

SEQ ID NO: 1575594 - DNA, 14 bp, Homo sapiens
agctgtaagggcag

SEQ ID NO: 1575595 - DNA, 16 bp, Homo sapiens
agctgtaagggcagtg

SEQ ID NO: 1575596 - DNA, 18 bp, Homo sapiens
agctgtaagggcagtgcc

SEQ ID NO: 1575597 - DNA, 24 bp, Homo sapiens
agctgtaagggcagtgcccatgtg

SEQ ID NO: 1575598 - DNA, 15 bp, Homo sapiens
agctgtaatttcgcc

SEQ ID NO: 1575599 - DNA, 20 bp, Homo sapiens
agctgtactataagtagttg

SEQ ID NO: 1575600 - DNA, 14 bp, Homo sapiens
agctgtactcagag

SEQ ID NO: 1575601 - DNA, 17 bp, Homo sapiens
agctgtactcagagcag

SEQ ID NO: 1575602 - DNA, 18 bp, Homo sapiens
agctgtactcagagcaga

SEQ ID NO: 1575603 - DNA, 20 bp, Homo sapiens
agctgtactcagagcagagc

SEQ ID NO: 1575604 - DNA, 15 bp, Homo sapiens
agctgtacttttacc

SEQ ID NO: 1575605 - DNA, 15 bp, Homo sapiens
agctgtagccatggc

SEQ ID NO: 1575606 - DNA, 19 bp, Homo sapiens
agctgtagccatggctcag

SEQ ID NO: 1575607 - DNA, 20 bp, Homo sapiens
agctgtagccatggctcagg

SEQ ID NO: 1575608 - DNA, 22 bp, Homo sapiens
agctgtagccatggctcaggca

SEQ ID NO: 1575609 - DNA, 15 bp, Homo sapiens
agctgtaggagagtc

SEQ ID NO: 1575610 - DNA, 11 bp, Homo sapiens
agctgtagtgg

SEQ ID NO: 1575611 - DNA, 13 bp, Homo sapiens
agctgtatgattt

SEQ ID NO: 1575612 - DNA, 14 bp, Homo sapiens
agctgtatgatttg

SEQ ID NO: 1575613 - DNA, 17 bp, Homo sapiens
agctgtatgatttgttt

SEQ ID NO: 1575614 - DNA, 18 bp, Homo sapiens
agctgtcaccaaggaaac

SEQ ID NO: 1575615 - DNA, 22 bp, Homo sapiens
agctgtcataaaatgaaacttt

SEQ ID NO: 1575616 - DNA, 14 bp, Homo sapiens
agctgtccctgcag

SEQ ID NO: 1575617 - DNA, 16 bp, Homo sapiens
agctgtccctgcaggg

SEQ ID NO: 1575618 - DNA, 14 bp, Homo sapiens
agctgtccctgtca

SEQ ID NO: 1575619 - DNA, 14 bp, Homo sapiens
agctgtcccttgct

SEQ ID NO: 1575620 - DNA, 16 bp, Homo sapiens
agctgtcctctcagaa

SEQ ID NO: 1575621 - DNA, 16 bp, Homo sapiens
agctgtcctgcagcaa

SEQ ID NO: 1575622 - DNA, 14 bp, Homo sapiens
agctgtcgctgcct

SEQ ID NO: 1575623 - DNA, 15 bp, Homo sapiens
agctgtcgctgcctc

SEQ ID NO: 1575624 - DNA, 18 bp, Homo sapiens
agctgtctcttcggcagg

SEQ ID NO: 1575625 - DNA, 22 bp, Homo sapiens
agctgtctcttcggcagggagg

SEQ ID NO: 1575626 - DNA, 18 bp, Homo sapiens
agctgtgcctgctcagca

SEQ ID NO: 1575627 - DNA, 22 bp, Homo sapiens
agctgtgcctgctcagcagcca

SEQ ID NO: 1575628 - DNA, 23 bp, Homo sapiens
agctgtgcctgctcagcagccag

SEQ ID NO: 1575629 - DNA, 12 bp, Homo sapiens
agctgtggctcc

SEQ ID NO: 1575630 - DNA, 12 bp, Homo sapiens
agctgtggctgg

SEQ ID NO: 1575631 - DNA, 16 bp, Homo sapiens
agctgtggctggagga

SEQ ID NO: 1575632 - DNA, 20 bp, Homo sapiens
agctgtgtccttgcacctgc

SEQ ID NO: 1575633 - DNA, 22 bp, Homo sapiens
agctgtgtctgccaaacacatt

SEQ ID NO: 1575634 - DNA, 14 bp, Homo sapiens
agctgtgttattat

SEQ ID NO: 1575635 - DNA, 15 bp, Homo sapiens
agctgttaccattca

SEQ ID NO: 1575636 - DNA, 15 bp, Homo sapiens
agctgttagggctga

SEQ ID NO: 1575637 - DNA, 17 bp, Homo sapiens
agctgttatttcttccc

SEQ ID NO: 1575638 - DNA, 18 bp, Homo sapiens
agctgttatttcttccct

SEQ ID NO: 1575639 - DNA, 19 bp, Homo sapiens
agctgttatttcttccctg

SEQ ID NO: 1575640 - DNA, 21 bp, Homo sapiens
agctgttatttcttccctgct

SEQ ID NO: 1575641 - DNA, 16 bp, Homo sapiens
agctgttcctgttcag

SEQ ID NO: 1575642 - DNA, 19 bp, Homo sapiens
agctgttcctgttcagtaa

SEQ ID NO: 1575643 - DNA, 20 bp, Homo sapiens
agctgttccttggtcctagt

SEQ ID NO: 1575644 - DNA, 13 bp, Homo sapiens
agctgttggaaga

SEQ ID NO: 1575645 - DNA, 17 bp, Homo sapiens
agctgttgtgagctttg

SEQ ID NO: 1575646 - DNA, 20 bp, Homo sapiens
agctgtttatggcctcagct

SEQ ID NO: 1575647 - DNA, 19 bp, Homo sapiens
agctgtttatttattcact

SEQ ID NO: 1575648 - DNA, 15 bp, Homo sapiens
agctgtttcaaagtt

SEQ ID NO: 1575649 - DNA, 15 bp, Homo sapiens
agctgtttctcatga

SEQ ID NO: 1575650 - DNA, 18 bp, Homo sapiens
agctgtttctcatgaagc

SEQ ID NO: 1575651 - DNA, 13 bp, Homo sapiens
agctgtttgtcat

SEQ ID NO: 1575652 - DNA, 15 bp, Homo sapiens
agctgttttccctga

SEQ ID NO: 1575653 - DNA, 18 bp, Homo sapiens
agctgttttccctgacct

SEQ ID NO: 1575654 - DNA, 13 bp, Homo sapiens
agcttaaaacact

SEQ ID NO: 1575655 - DNA, 21 bp, Homo sapiens
agcttaaacccatacaatgta

SEQ ID NO: 1575656 - DNA, 22 bp, Homo sapiens
agcttaaacccatacaatgtat

SEQ ID NO: 1575657 - DNA, 24 bp, Homo sapiens
agcttaaattgcttttgttgtgac

SEQ ID NO: 1575658 - DNA, 16 bp, Homo sapiens
agcttaacattgactt

SEQ ID NO: 1575659 - DNA, 22 bp, Homo sapiens
agcttaacattgacttcttggt

SEQ ID NO: 1575660 - DNA, 15 bp, Homo sapiens
agcttaactaatttg

SEQ ID NO: 1575661 - DNA, 16 bp, Homo sapiens
agcttaactaatttga

SEQ ID NO: 1575662 - DNA, 12 bp, Homo sapiens
agcttaatagct

SEQ ID NO: 1575663 - DNA, 20 bp, Homo sapiens
agcttaatagctgtagtttt

SEQ ID NO: 1575664 - DNA, 17 bp, Homo sapiens
agcttacctgacacaag

SEQ ID NO: 1575665 - DNA, 23 bp, Homo sapiens
agcttactgagttatcaggtgca

SEQ ID NO: 1575666 - DNA, 10 bp, Homo sapiens
agcttagaac

SEQ ID NO: 1575667 - DNA, 20 bp, Homo sapiens
agcttagacctcagcctgtg

SEQ ID NO: 1575668 - DNA, 14 bp, Homo sapiens
agcttagagttctt

SEQ ID NO: 1575669 - DNA, 16 bp, Homo sapiens
agcttagagttcttct

SEQ ID NO: 1575670 - DNA, 13 bp, Homo sapiens
agcttagccttgt

SEQ ID NO: 1575671 - DNA, 16 bp, Homo sapiens
agcttagccttgtgcc

SEQ ID NO: 1575672 - DNA, 22 bp, Homo sapiens
agcttagccttgtgccctgccc

SEQ ID NO: 1575673 - DNA, 21 bp, Homo sapiens
agcttagttttttttaaaaaa

SEQ ID NO: 1575674 - DNA, 14 bp, Homo sapiens
agcttatagaataa

SEQ ID NO: 1575675 - DNA, 22 bp, Homo sapiens
agcttatctcttttatatttgt

SEQ ID NO: 1575676 - DNA, 23 bp, Homo sapiens
agcttatctcttttatatttgta

SEQ ID NO: 1575677 - DNA, 22 bp, Homo sapiens
agcttatgggatccttgtcttt

SEQ ID NO: 1575678 - DNA, 13 bp, Homo sapiens
agcttattggcca

SEQ ID NO: 1575679 - DNA, 23 bp, Homo sapiens
agcttattgtgtgcgctgcctgg

SEQ ID NO: 1575680 - DNA, 15 bp, Homo sapiens
agcttatttctaact

SEQ ID NO: 1575681 - DNA, 20 bp, Homo sapiens
agcttatttttttctacata

SEQ ID NO: 1575682 - DNA, 12 bp, Homo sapiens
agcttcaaagct

SEQ ID NO: 1575683 - DNA, 14 bp, Homo sapiens
agcttcaaatgcaa

SEQ ID NO: 1575684 - DNA, 15 bp, Homo sapiens
agcttcaacttttct

SEQ ID NO: 1575685 - DNA, 13 bp, Homo sapiens
agcttcaatataa

SEQ ID NO: 1575686 - DNA, 14 bp, Homo sapiens
agcttcaatataag

SEQ ID NO: 1575687 - DNA, 19 bp, Homo sapiens
agcttcaatataagaagca

SEQ ID NO: 1575688 - DNA, 21 bp, Homo sapiens
agcttcagactcaagtaccca

SEQ ID NO: 1575689 - DNA, 12 bp, Homo sapiens
agcttcagagcc

SEQ ID NO: 1575690 - DNA, 13 bp, Homo sapiens
agcttcagagcct

SEQ ID NO: 1575691 - DNA, 18 bp, Homo sapiens
agcttcagagcctagcca

SEQ ID NO: 1575692 - DNA, 21 bp, Homo sapiens
agcttcagagcctagccacct

SEQ ID NO: 1575693 - DNA, 21 bp, Homo sapiens
agcttcagatggtgaagcatt

SEQ ID NO: 1575694 - DNA, 18 bp, Homo sapiens
agcttcagctagctttta

SEQ ID NO: 1575695 - DNA, 19 bp, Homo sapiens
agcttcagttgcttgtctt

SEQ ID NO: 1575696 - DNA, 23 bp, Homo sapiens
agcttcagttgcttgtcttctgg

SEQ ID NO: 1575697 - DNA, 20 bp, Homo sapiens
agcttcatgcctttgtaagt

SEQ ID NO: 1575698 - DNA, 16 bp, Homo sapiens
agcttcattctccttg

SEQ ID NO: 1575699 - DNA, 11 bp, Homo sapiens
agcttccaaag

SEQ ID NO: 1575700 - DNA, 19 bp, Homo sapiens
agcttccaaatgtgtcaga

SEQ ID NO: 1575701 - DNA, 20 bp, Homo sapiens
agcttccacaaaattagaaa

SEQ ID NO: 1575702 - DNA, 18 bp, Homo sapiens
agcttcccacacctgcct

SEQ ID NO: 1575703 - DNA, 21 bp, Homo sapiens
agcttcccacacctgcctgcg

SEQ ID NO: 1575704 - DNA, 15 bp, Homo sapiens
agcttccctctcagc

SEQ ID NO: 1575705 - DNA, 14 bp, Homo sapiens
agcttccgctttga

SEQ ID NO: 1575706 - DNA, 22 bp, Homo sapiens
agcttccgctttgaaagaagca

SEQ ID NO: 1575707 - DNA, 15 bp, Homo sapiens
agcttcctcacaccc

SEQ ID NO: 1575708 - DNA, 18 bp, Homo sapiens
agcttcctcacacccctg

SEQ ID NO: 1575709 - DNA, 20 bp, Homo sapiens
agcttcctgctgctggggcc

SEQ ID NO: 1575710 - DNA, 14 bp, Homo sapiens
agcttcggagggcc

SEQ ID NO: 1575711 - DNA, 21 bp, Homo sapiens
agcttcggagggcccctgcgt

SEQ ID NO: 1575712 - DNA, 16 bp, Homo sapiens
agcttcggggcctcct

SEQ ID NO: 1575713 - DNA, 18 bp, Homo sapiens
agcttctcaaagtactgg

SEQ ID NO: 1575714 - DNA, 17 bp, Homo sapiens
agcttctcccagtgtga

SEQ ID NO: 1575715 - DNA, 16 bp, Homo sapiens
agcttctctctccagg

SEQ ID NO: 1575716 - DNA, 14 bp, Homo sapiens
agcttctctgtgaa

SEQ ID NO: 1575717 - DNA, 17 bp, Homo sapiens
agcttctgcttttctgc

SEQ ID NO: 1575718 - DNA, 21 bp, Homo sapiens
agcttctggaatttgttcaag

SEQ ID NO: 1575719 - DNA, 18 bp, Homo sapiens
agcttctgtgtgtgagct

SEQ ID NO: 1575720 - DNA, 13 bp, Homo sapiens
agcttcttcagag

SEQ ID NO: 1575721 - DNA, 19 bp, Homo sapiens
agcttcttcagagtgaaga

SEQ ID NO: 1575722 - DNA, 22 bp, Homo sapiens
agcttgaaagttttcagaacct

SEQ ID NO: 1575723 - DNA, 24 bp, Homo sapiens
agcttgagccgggcccctgggctt

SEQ ID NO: 1575724 - DNA, 12 bp, Homo sapiens
agcttgagcctc

SEQ ID NO: 1575725 - DNA, 13 bp, Homo sapiens
agcttgagcctcc

SEQ ID NO: 1575726 - DNA, 15 bp, Homo sapiens
agcttgaggccaaga

SEQ ID NO: 1575727 - DNA, 18 bp, Homo sapiens
agcttgataaagggccaa

SEQ ID NO: 1575728 - DNA, 13 bp, Homo sapiens
agcttgcaagaag

SEQ ID NO: 1575729 - DNA, 14 bp, Homo sapiens
agcttgcacagcca

SEQ ID NO: 1575730 - DNA, 14 bp, Homo sapiens
agcttgccagggat

SEQ ID NO: 1575731 - DNA, 14 bp, Homo sapiens
agcttgccccggcc

SEQ ID NO: 1575732 - DNA, 18 bp, Homo sapiens
agcttgccccggccccgg

SEQ ID NO: 1575733 - DNA, 19 bp, Homo sapiens
agcttgccctgttaaaaga

SEQ ID NO: 1575734 - DNA, 19 bp, Homo sapiens
agcttgctccagattctga

SEQ ID NO: 1575735 - DNA, 20 bp, Homo sapiens
agcttgctccagattctgat

SEQ ID NO: 1575736 - DNA, 19 bp, Homo sapiens
agcttgctcttcagtggga

SEQ ID NO: 1575737 - DNA, 22 bp, Homo sapiens
agcttgctcttcagtgggagaa

SEQ ID NO: 1575738 - DNA, 15 bp, Homo sapiens
agcttgctgtcactt

SEQ ID NO: 1575739 - DNA, 17 bp, Homo sapiens
agcttgctgtcacttct

SEQ ID NO: 1575740 - DNA, 18 bp, Homo sapiens
agcttggaaagggaagat

SEQ ID NO: 1575741 - DNA, 17 bp, Homo sapiens
agcttggcaattcatgg

SEQ ID NO: 1575742 - DNA, 12 bp, Homo sapiens
agcttggcagcc

SEQ ID NO: 1575743 - DNA, 17 bp, Homo sapiens
agcttggcagccgagct

SEQ ID NO: 1575744 - DNA, 11 bp, Homo sapiens
agcttggctca

SEQ ID NO: 1575745 - DNA, 20 bp, Homo sapiens
agcttggctcacaaggccca

SEQ ID NO: 1575746 - DNA, 22 bp, Homo sapiens
agcttggctcacaaggcccagg

SEQ ID NO: 1575747 - DNA, 19 bp, Homo sapiens
agcttgggcccagctgggc

SEQ ID NO: 1575748 - DNA, 21 bp, Homo sapiens
agcttgggcccagctgggctc

SEQ ID NO: 1575749 - DNA, 20 bp, Homo sapiens
agcttggggccaccaaagct

SEQ ID NO: 1575750 - DNA, 22 bp, Homo sapiens
agcttggggccaccaaagctgc

SEQ ID NO: 1575751 - DNA, 18 bp, Homo sapiens
agcttgggtccaccatgc

SEQ ID NO: 1575752 - DNA, 21 bp, Homo sapiens
agcttggtgtcttggcactgt

SEQ ID NO: 1575753 - DNA, 20 bp, Homo sapiens
agcttgtcaatgatttcaaa

SEQ ID NO: 1575754 - DNA, 19 bp, Homo sapiens
agcttgtgctcctcttgat

SEQ ID NO: 1575755 - DNA, 15 bp, Homo sapiens
agcttgtgtcctgtc

SEQ ID NO: 1575756 - DNA, 18 bp, Homo sapiens
agcttgtgtcctgtcctt

SEQ ID NO: 1575757 - DNA, 17 bp, Homo sapiens
agcttgttgaaaaccca

SEQ ID NO: 1575758 - DNA, 19 bp, Homo sapiens
agcttgtttctatactgtt

SEQ ID NO: 1575759 - DNA, 13 bp, Homo sapiens
agctttaaaaaaa

SEQ ID NO: 1575760 - DNA, 14 bp, Homo sapiens
agctttaccagctg

SEQ ID NO: 1575761 - DNA, 17 bp, Homo sapiens
agctttaccctcaggca

SEQ ID NO: 1575762 - DNA, 18 bp, Homo sapiens
agctttaccctcaggcat

SEQ ID NO: 1575763 - DNA, 13 bp, Homo sapiens
agctttactactg

SEQ ID NO: 1575764 - DNA, 17 bp, Homo sapiens
agctttagaccctgggt

SEQ ID NO: 1575765 - DNA, 19 bp, Homo sapiens
agctttagaccctgggtgg

SEQ ID NO: 1575766 - DNA, 22 bp, Homo sapiens
agctttagaccctgggtgggct

SEQ ID NO: 1575767 - DNA, 14 bp, Homo sapiens
agctttattcttca

SEQ ID NO: 1575768 - DNA, 19 bp, Homo sapiens
agctttattttttaagtat

SEQ ID NO: 1575769 - DNA, 12 bp, Homo sapiens
agctttcagagc

SEQ ID NO: 1575770 - DNA, 15 bp, Homo sapiens
agctttcagagccag

SEQ ID NO: 1575771 - DNA, 16 bp, Homo sapiens
agctttcagagccagt

SEQ ID NO: 1575772 - DNA, 20 bp, Homo sapiens
agctttccacatttgtcaca

SEQ ID NO: 1575773 - DNA, 19 bp, Homo sapiens
agctttccatgttgctgcc

SEQ ID NO: 1575774 - DNA, 20 bp, Homo sapiens
agctttccatgttgctgcca

SEQ ID NO: 1575775 - DNA, 20 bp, Homo sapiens
agctttcctcaaaaagcaga

SEQ ID NO: 1575776 - DNA, 13 bp, Homo sapiens
agctttcctgccc

SEQ ID NO: 1575777 - DNA, 23 bp, Homo sapiens
agctttccttctccaggaatact

SEQ ID NO: 1575778 - DNA, 23 bp, Homo sapiens
agctttcctttttcccaataaat

SEQ ID NO: 1575779 - DNA, 11 bp, Homo sapiens
agctttctcaa

SEQ ID NO: 1575780 - DNA, 17 bp, Homo sapiens
agctttctcaatgtctt

SEQ ID NO: 1575781 - DNA, 20 bp, Homo sapiens
agctttctcaatgtcttccc

SEQ ID NO: 1575782 - DNA, 16 bp, Homo sapiens
agctttctcagggggt

SEQ ID NO: 1575783 - DNA, 20 bp, Homo sapiens
agctttctgggatgtcacag

SEQ ID NO: 1575784 - DNA, 12 bp, Homo sapiens
agctttctgtat

SEQ ID NO: 1575785 - DNA, 20 bp, Homo sapiens
agctttctttcacaaaaaag

SEQ ID NO: 1575786 - DNA, 21 bp, Homo sapiens
agctttctttgcacttaaaaa

SEQ ID NO: 1575787 - DNA, 15 bp, Homo sapiens
agctttgataattgt

SEQ ID NO: 1575788 - DNA, 20 bp, Homo sapiens
agctttgctacaaatttatg

SEQ ID NO: 1575789 - DNA, 22 bp, Homo sapiens
agctttgctacaaatttatgca

SEQ ID NO: 1575790 - DNA, 10 bp, Homo sapiens
agctttgctc

SEQ ID NO: 1575791 - DNA, 22 bp, Homo sapiens
agctttgctcagcacactctcc

SEQ ID NO: 1575792 - DNA, 19 bp, Homo sapiens
agctttggaaagttactgt

SEQ ID NO: 1575793 - DNA, 18 bp, Homo sapiens
agctttggacctaatcca

SEQ ID NO: 1575794 - DNA, 19 bp, Homo sapiens
agctttgggtgaccagcca

SEQ ID NO: 1575795 - DNA, 17 bp, Homo sapiens
agctttggtctgtgtgt

SEQ ID NO: 1575796 - DNA, 19 bp, Homo sapiens
agctttgtcgtatttggca

SEQ ID NO: 1575797 - DNA, 13 bp, Homo sapiens
agctttgtttgtt

SEQ ID NO: 1575798 - DNA, 16 bp, Homo sapiens
agcttttaaaaatgtt

SEQ ID NO: 1575799 - DNA, 17 bp, Homo sapiens
agcttttaaaaatgttt

SEQ ID NO: 1575800 - DNA, 19 bp, Homo sapiens
agcttttacagatccagaa

SEQ ID NO: 1575801 - DNA, 18 bp, Homo sapiens
agcttttaccttaaatgc

SEQ ID NO: 1575802 - DNA, 19 bp, Homo sapiens
agcttttaccttaaatgct

SEQ ID NO: 1575803 - DNA, 16 bp, Homo sapiens
agcttttcatggaagt

SEQ ID NO: 1575804 - DNA, 17 bp, Homo sapiens
agcttttcatggaagtg

SEQ ID NO: 1575805 - DNA, 23 bp, Homo sapiens
agcttttcatggaagtggcagtg

SEQ ID NO: 1575806 - DNA, 18 bp, Homo sapiens
agcttttcctgttaaggc

SEQ ID NO: 1575807 - DNA, 18 bp, Homo sapiens
agcttttgccagtattat

SEQ ID NO: 1575808 - DNA, 15 bp, Homo sapiens
agcttttggttaata

SEQ ID NO: 1575809 - DNA, 13 bp, Homo sapiens
agcttttgttgtt

SEQ ID NO: 1575810 - DNA, 18 bp, Homo sapiens
agctttttaatagcacta

SEQ ID NO: 1575811 - DNA, 22 bp, Homo sapiens
agctttttattcctcctgctca

SEQ ID NO: 1575812 - DNA, 19 bp, Homo sapiens
aggaaaaaaaaacagccac

SEQ ID NO: 1575813 - DNA, 15 bp, Homo sapiens
aggaaaaaaagcatg

SEQ ID NO: 1575814 - DNA, 15 bp, Homo sapiens
aggaaaaaagaacca

SEQ ID NO: 1575815 - DNA, 19 bp, Homo sapiens
aggaaaaaagaaccaaaac

SEQ ID NO: 1575816 - DNA, 16 bp, Homo sapiens
aggaaaaaattgcttt

SEQ ID NO: 1575817 - DNA, 14 bp, Homo sapiens
aggaaaaagaaatg

SEQ ID NO: 1575818 - DNA, 20 bp, Homo sapiens
aggaaaaatgaggaatccaa

SEQ ID NO: 1575819 - DNA, 18 bp, Homo sapiens
aggaaaaatgggagccag

SEQ ID NO: 1575820 - DNA, 19 bp, Homo sapiens
aggaaaaatgggagccagg

SEQ ID NO: 1575821 - DNA, 20 bp, Homo sapiens
aggaaaaatgggagccagga

SEQ ID NO: 1575822 - DNA, 21 bp, Homo sapiens
aggaaaaatgggagccaggag

SEQ ID NO: 1575823 - DNA, 22 bp, Homo sapiens
aggaaaaatgggagccaggagt

SEQ ID NO: 1575824 - DNA, 22 bp, Homo sapiens
aggaaaaccaagccgtggcttc

SEQ ID NO: 1575825 - DNA, 23 bp, Homo sapiens
aggaaaaccaagccgtggcttcc

SEQ ID NO: 1575826 - DNA, 15 bp, Homo sapiens
aggaaaaggaggagg

SEQ ID NO: 1575827 - DNA, 17 bp, Homo sapiens
aggaaaaggcccctgca

SEQ ID NO: 1575828 - DNA, 21 bp, Homo sapiens
aggaaaaggcccctgcaatgt

SEQ ID NO: 1575829 - DNA, 15 bp, Homo sapiens
aggaaaagggagcta

SEQ ID NO: 1575830 - DNA, 16 bp, Homo sapiens
aggaaaagggagctat

SEQ ID NO: 1575831 - DNA, 16 bp, Homo sapiens
aggaaaagtacattta

SEQ ID NO: 1575832 - DNA, 19 bp, Homo sapiens
aggaaaagtacatttaata

SEQ ID NO: 1575833 - DNA, 14 bp, Homo sapiens
aggaaaatcctctg

SEQ ID NO: 1575834 - DNA, 15 bp, Homo sapiens
aggaaaatgatctga

SEQ ID NO: 1575835 - DNA, 15 bp, Homo sapiens
aggaaaattaaacca

SEQ ID NO: 1575836 - DNA, 21 bp, Homo sapiens
aggaaacagttgcatgtagta

SEQ ID NO: 1575837 - DNA, 11 bp, Homo sapiens
aggaaaccaag

SEQ ID NO: 1575838 - DNA, 15 bp, Homo sapiens
aggaaaccagctcgt

SEQ ID NO: 1575839 - DNA, 22 bp, Homo sapiens
aggaaaccgcctagtttactgt

SEQ ID NO: 1575840 - DNA, 19 bp, Homo sapiens
aggaaactccacatctgcc

SEQ ID NO: 1575841 - DNA, 19 bp, Homo sapiens
aggaaagaagggggccctg

SEQ ID NO: 1575842 - DNA, 20 bp, Homo sapiens
aggaaagaagggggccctgc

SEQ ID NO: 1575843 - DNA, 22 bp, Homo sapiens
aggaaagaagggggccctgcta

SEQ ID NO: 1575844 - DNA, 15 bp, Homo sapiens
aggaaaggattttac

SEQ ID NO: 1575845 - DNA, 19 bp, Homo sapiens
aggaaaggattttaccaaa

SEQ ID NO: 1575846 - DNA, 21 bp, Homo sapiens
aggaaaggctcatttaaaaca

SEQ ID NO: 1575847 - DNA, 20 bp, Homo sapiens
aggaaaggcttggctggtgt

SEQ ID NO: 1575848 - DNA, 14 bp, Homo sapiens
aggaaagggaggag

SEQ ID NO: 1575849 - DNA, 22 bp, Homo sapiens
aggaaagggaggagtggaggtg

SEQ ID NO: 1575850 - DNA, 13 bp, Homo sapiens
aggaaagggcctg

SEQ ID NO: 1575851 - DNA, 15 bp, Homo sapiens
aggaaagggcctggc

SEQ ID NO: 1575852 - DNA, 22 bp, Homo sapiens
aggaaagggcctggccagtcct

SEQ ID NO: 1575853 - DNA, 21 bp, Homo sapiens
aggaaagtcacccaaacactt

SEQ ID NO: 1575854 - DNA, 18 bp, Homo sapiens
aggaaagtgatatgcatt

SEQ ID NO: 1575855 - DNA, 21 bp, Homo sapiens
aggaaagtttacccatgaaga

SEQ ID NO: 1575856 - DNA, 16 bp, Homo sapiens
aggaaataacagagag

SEQ ID NO: 1575857 - DNA, 20 bp, Homo sapiens
aggaaataacagagagaatg

SEQ ID NO: 1575858 - DNA, 15 bp, Homo sapiens
aggaaatagaattga

SEQ ID NO: 1575859 - DNA, 19 bp, Homo sapiens
aggaaatcaaatatgcaaa

SEQ ID NO: 1575860 - DNA, 23 bp, Homo sapiens
aggaaatcaaatatgcaaagcac

SEQ ID NO: 1575861 - DNA, 23 bp, Homo sapiens
aggaaatgtcacagaagcagcta

SEQ ID NO: 1575862 - DNA, 15 bp, Homo sapiens
aggaaatgttggaac

SEQ ID NO: 1575863 - DNA, 17 bp, Homo sapiens
aggaaatttgtttgtat

SEQ ID NO: 1575864 - DNA, 20 bp, Homo sapiens
aggaaatttgtttgtatttt

SEQ ID NO: 1575865 - DNA, 14 bp, Homo sapiens
aggaacaaacaggg

SEQ ID NO: 1575866 - DNA, 15 bp, Homo sapiens
aggaacaaagacagg

SEQ ID NO: 1575867 - DNA, 20 bp, Homo sapiens
aggaacaagcatgtctctct

SEQ ID NO: 1575868 - DNA, 19 bp, Homo sapiens
aggaacaatctttgctgta

SEQ ID NO: 1575869 - DNA, 19 bp, Homo sapiens
aggaacactggcttgaagg

SEQ ID NO: 1575870 - DNA, 19 bp, Homo sapiens
aggaacatatgaaaataca

SEQ ID NO: 1575871 - DNA, 13 bp, Homo sapiens
aggaacatttttt

SEQ ID NO: 1575872 - DNA, 23 bp, Homo sapiens
aggaacccttgcatccattgttg

SEQ ID NO: 1575873 - DNA, 23 bp, Homo sapiens
aggaaccgtggtatgtctgccat

SEQ ID NO: 1575874 - DNA, 13 bp, Homo sapiens
aggaacctgtcct

SEQ ID NO: 1575875 - DNA, 14 bp, Homo sapiens
aggaaccttccttc

SEQ ID NO: 1575876 - DNA, 22 bp, Homo sapiens
aggaaccttccttcctgcttga

SEQ ID NO: 1575877 - DNA, 14 bp, Homo sapiens
aggaacgagcactg

SEQ ID NO: 1575878 - DNA, 16 bp, Homo sapiens
aggaacggtaaatttc

SEQ ID NO: 1575879 - DNA, 20 bp, Homo sapiens
aggaacggtaaatttctgtg

SEQ ID NO: 1575880 - DNA, 23 bp, Homo sapiens
aggaactagaaagaaggacccag

SEQ ID NO: 1575881 - DNA, 16 bp, Homo sapiens
aggaactgggctgggc

SEQ ID NO: 1575882 - DNA, 13 bp, Homo sapiens
aggaagaaatcac

SEQ ID NO: 1575883 - DNA, 17 bp, Homo sapiens
aggaagaaattcaggta

SEQ ID NO: 1575884 - DNA, 22 bp, Homo sapiens
aggaagaaattcaggtacagaa

SEQ ID NO: 1575885 - DNA, 16 bp, Homo sapiens
aggaagaacgtttttt

SEQ ID NO: 1575886 - DNA, 17 bp, Homo sapiens
aggaagagcaggcacat

SEQ ID NO: 1575887 - DNA, 23 bp, Homo sapiens
aggaagagcaggcacatggagga

SEQ ID NO: 1575888 - DNA, 13 bp, Homo sapiens
aggaagagccacc

SEQ ID NO: 1575889 - DNA, 21 bp, Homo sapiens
aggaagagccacctgcaagat

SEQ ID NO: 1575890 - DNA, 13 bp, Homo sapiens
aggaagaggccca

SEQ ID NO: 1575891 - DNA, 17 bp, Homo sapiens
aggaagaggcccactag

SEQ ID NO: 1575892 - DNA, 17 bp, Homo sapiens
aggaagatcctgaagca

SEQ ID NO: 1575893 - DNA, 18 bp, Homo sapiens
aggaagatcttgagagct

SEQ ID NO: 1575894 - DNA, 20 bp, Homo sapiens
aggaagatcttgagagctgc

SEQ ID NO: 1575895 - DNA, 19 bp, Homo sapiens
aggaagcaaatagaagaga

SEQ ID NO: 1575896 - DNA, 22 bp, Homo sapiens
aggaagcattgtaaaataattc

SEQ ID NO: 1575897 - DNA, 14 bp, Homo sapiens
aggaagccaggctg

SEQ ID NO: 1575898 - DNA, 15 bp, Homo sapiens
aggaagcccaggctc

SEQ ID NO: 1575899 - DNA, 14 bp, Homo sapiens
aggaagctcagcct

SEQ ID NO: 1575900 - DNA, 18 bp, Homo sapiens
aggaagctggcagaacgg

SEQ ID NO: 1575901 - DNA, 16 bp, Homo sapiens
aggaaggaacaaagac

SEQ ID NO: 1575902 - DNA, 17 bp, Homo sapiens
aggaaggaagcaagcat

SEQ ID NO: 1575903 - DNA, 14 bp, Homo sapiens
aggaaggaccctga

SEQ ID NO: 1575904 - DNA, 19 bp, Homo sapiens
aggaaggagactcacctct

SEQ ID NO: 1575905 - DNA, 15 bp, Homo sapiens
aggaaggagagcctg

SEQ ID NO: 1575906 - DNA, 18 bp, Homo sapiens
aggaaggagagcctgctg

SEQ ID NO: 1575907 - DNA, 13 bp, Homo sapiens
aggaaggcaagag

SEQ ID NO: 1575908 - DNA, 12 bp, Homo sapiens
aggaaggcagct

SEQ ID NO: 1575909 - DNA, 14 bp, Homo sapiens
aggaaggcagctgc

SEQ ID NO: 1575910 - DNA, 19 bp, Homo sapiens
aggaaggccaaaatcaaga

SEQ ID NO: 1575911 - DNA, 15 bp, Homo sapiens
aggaaggccacagtg

SEQ ID NO: 1575912 - DNA, 14 bp, Homo sapiens
aggaaggcctttct

SEQ ID NO: 1575913 - DNA, 15 bp, Homo sapiens
aggaaggcctttctt

SEQ ID NO: 1575914 - DNA, 16 bp, Homo sapiens
aggaaggcctttcttc

SEQ ID NO: 1575915 - DNA, 22 bp, Homo sapiens
aggaaggctctcgggtggggga

SEQ ID NO: 1575916 - DNA, 16 bp, Homo sapiens
aggaagggaccaaggc

SEQ ID NO: 1575917 - DNA, 17 bp, Homo sapiens
aggaagggaccaaggca

SEQ ID NO: 1575918 - DNA, 12 bp, Homo sapiens
aggaagggcaaa

SEQ ID NO: 1575919 - DNA, 12 bp, Homo sapiens
aggaagggcaga

SEQ ID NO: 1575920 - DNA, 20 bp, Homo sapiens
aggaaggggttggattgcaa

SEQ ID NO: 1575921 - DNA, 12 bp, Homo sapiens
aggaaggtagcc

SEQ ID NO: 1575922 - DNA, 16 bp, Homo sapiens
aggaaggtagcccagc

SEQ ID NO: 1575923 - DNA, 19 bp, Homo sapiens
aggaaggtgaatctgccct

SEQ ID NO: 1575924 - DNA, 21 bp, Homo sapiens
aggaaggtgctgagcttagcc

SEQ ID NO: 1575925 - DNA, 22 bp, Homo sapiens
aggaagtagtccagccttccag

SEQ ID NO: 1575926 - DNA, 15 bp, Homo sapiens
aggaagtttggtcag

SEQ ID NO: 1575927 - DNA, 13 bp, Homo sapiens
aggaataaataaa

SEQ ID NO: 1575928 - DNA, 19 bp, Homo sapiens
aggaataaataaaaatgga

SEQ ID NO: 1575929 - DNA, 21 bp, Homo sapiens
aggaataaataaaaatggata

SEQ ID NO: 1575930 - DNA, 18 bp, Homo sapiens
aggaatagcaaaattcct

SEQ ID NO: 1575931 - DNA, 19 bp, Homo sapiens
aggaatagcaaaattcctg

SEQ ID NO: 1575932 - DNA, 20 bp, Homo sapiens
aggaatatgacggaagaaca

SEQ ID NO: 1575933 - DNA, 16 bp, Homo sapiens
aggaatattttccaaa

SEQ ID NO: 1575934 - DNA, 16 bp, Homo sapiens
aggaatcctggcagcc

SEQ ID NO: 1575935 - DNA, 18 bp, Homo sapiens
aggaatcctggcagccca

SEQ ID NO: 1575936 - DNA, 23 bp, Homo sapiens
aggaatcctttgagaatgtgatt

SEQ ID NO: 1575937 - DNA, 16 bp, Homo sapiens
aggaatcggctgggga

SEQ ID NO: 1575938 - DNA, 18 bp, Homo sapiens
aggaatctcagagacagg

SEQ ID NO: 1575939 - DNA, 20 bp, Homo sapiens
aggaatctgtttctctgctg

SEQ ID NO: 1575940 - DNA, 23 bp, Homo sapiens
aggaatctgtttctctgctgtca

SEQ ID NO: 1575941 - DNA, 15 bp, Homo sapiens
aggaatgaagacctt

SEQ ID NO: 1575942 - DNA, 15 bp, Homo sapiens
aggaatgctggactg

SEQ ID NO: 1575943 - DNA, 16 bp, Homo sapiens
aggaatggacatttct

SEQ ID NO: 1575944 - DNA, 21 bp, Homo sapiens
aggaatgggggcctcttcaaa

SEQ ID NO: 1575945 - DNA, 22 bp, Homo sapiens
aggaatggggggcgggccaggg

SEQ ID NO: 1575946 - DNA, 23 bp, Homo sapiens
aggaatggggggcgggccagggt

SEQ ID NO: 1575947 - DNA, 19 bp, Homo sapiens
aggaatgtcagggccaggt

SEQ ID NO: 1575948 - DNA, 17 bp, Homo sapiens
aggaattaagttatctt

SEQ ID NO: 1575949 - DNA, 12 bp, Homo sapiens
aggaattatgtc

SEQ ID NO: 1575950 - DNA, 15 bp, Homo sapiens
aggaattcagtgcct

SEQ ID NO: 1575951 - DNA, 20 bp, Homo sapiens
aggaattctaaataaatttc

SEQ ID NO: 1575952 - DNA, 22 bp, Homo sapiens
aggaattctaggcatcccaggg

SEQ ID NO: 1575953 - DNA, 17 bp, Homo sapiens
aggaattctattgagtg

SEQ ID NO: 1575954 - DNA, 17 bp, Homo sapiens
aggaatttcccaggacc

SEQ ID NO: 1575955 - DNA, 20 bp, Homo sapiens
aggaatttcccaggaccctg

SEQ ID NO: 1575956 - DNA, 13 bp, Homo sapiens
aggaatttcttaa

SEQ ID NO: 1575957 - DNA, 15 bp, Homo sapiens
aggaatttcttaact

SEQ ID NO: 1575958 - DNA, 20 bp, Homo sapiens
aggaatttgtacttcttatt

SEQ ID NO: 1575959 - DNA, 19 bp, Homo sapiens
aggaattttattttgctga

SEQ ID NO: 1575960 - DNA, 16 bp, Homo sapiens
aggaattttctttgtg

SEQ ID NO: 1575961 - DNA, 18 bp, Homo sapiens
aggacaaagtctccagcc

SEQ ID NO: 1575962 - DNA, 20 bp, Homo sapiens
aggacaaatctgcaaagcat

SEQ ID NO: 1575963 - DNA, 21 bp, Homo sapiens
aggacaaatctgcaaagcatg

SEQ ID NO: 1575964 - DNA, 22 bp, Homo sapiens
aggacaacagttctgagctgta

SEQ ID NO: 1575965 - DNA, 16 bp, Homo sapiens
aggacaatactggggt

SEQ ID NO: 1575966 - DNA, 19 bp, Homo sapiens
aggacaatcagtcccctcc

SEQ ID NO: 1575967 - DNA, 16 bp, Homo sapiens
aggacaatttcaaaaa

SEQ ID NO: 1575968 - DNA, 13 bp, Homo sapiens
aggacacactaat

SEQ ID NO: 1575969 - DNA, 14 bp, Homo sapiens
aggacacagcacaa

SEQ ID NO: 1575970 - DNA, 18 bp, Homo sapiens
aggacacatcccggcctc

SEQ ID NO: 1575971 - DNA, 19 bp, Homo sapiens
aggacacatcccggcctct

SEQ ID NO: 1575972 - DNA, 23 bp, Homo sapiens
aggacacatcccggcctcttcca

SEQ ID NO: 1575973 - DNA, 17 bp, Homo sapiens
aggacaccagtgaaaga

SEQ ID NO: 1575974 - DNA, 14 bp, Homo sapiens
aggacacttcctgc

SEQ ID NO: 1575975 - DNA, 13 bp, Homo sapiens
aggacagaaggac

SEQ ID NO: 1575976 - DNA, 15 bp, Homo sapiens
aggacagaaggactg

SEQ ID NO: 1575977 - DNA, 17 bp, Homo sapiens
aggacagaattctccca

SEQ ID NO: 1575978 - DNA, 23 bp, Homo sapiens
aggacagaggccggggtccaggc

SEQ ID NO: 1575979 - DNA, 22 bp, Homo sapiens
aggacagaggggtaagatgagg

SEQ ID NO: 1575980 - DNA, 15 bp, Homo sapiens
aggacagctcttgat

SEQ ID NO: 1575981 - DNA, 20 bp, Homo sapiens
aggacaggcgggaggaggtg

SEQ ID NO: 1575982 - DNA, 17 bp, Homo sapiens
aggacaggctggtgcta

SEQ ID NO: 1575983 - DNA, 18 bp, Homo sapiens
aggacagggctggctcct

SEQ ID NO: 1575984 - DNA, 19 bp, Homo sapiens
aggacagtatttgtgggga

SEQ ID NO: 1575985 - DNA, 14 bp, Homo sapiens
aggacagtctggag

SEQ ID NO: 1575986 - DNA, 16 bp, Homo sapiens
aggacagtctggagaa

SEQ ID NO: 1575987 - DNA, 19 bp, Homo sapiens
aggacagtctggagaaggt

SEQ ID NO: 1575988 - DNA, 15 bp, Homo sapiens
aggacagtgcttcag

SEQ ID NO: 1575989 - DNA, 17 bp, Homo sapiens
aggacagtgcttcagcc

SEQ ID NO: 1575990 - DNA, 21 bp, Homo sapiens
aggacagtgcttcagcctgag

SEQ ID NO: 1575991 - DNA, 22 bp, Homo sapiens
aggacagtgcttcagcctgagg

SEQ ID NO: 1575992 - DNA, 11 bp, Homo sapiens
aggacatctta

SEQ ID NO: 1575993 - DNA, 20 bp, Homo sapiens
aggacatcttaaatctaaac

SEQ ID NO: 1575994 - DNA, 21 bp, Homo sapiens
aggacatgatggagcgcacct

SEQ ID NO: 1575995 - DNA, 20 bp, Homo sapiens
aggacatgcaataaaattta

SEQ ID NO: 1575996 - DNA, 21 bp, Homo sapiens
aggacatgcatgacacttcca

SEQ ID NO: 1575997 - DNA, 19 bp, Homo sapiens
aggacattgtatgcaggga

SEQ ID NO: 1575998 - DNA, 22 bp, Homo sapiens
aggacattgtatgcagggagca

SEQ ID NO: 1575999 - DNA, 18 bp, Homo sapiens
aggacatttatgattgtc

SEQ ID NO: 1576000 - DNA, 18 bp, Homo sapiens
aggaccaacatccagtcc

SEQ ID NO: 1576001 - DNA, 23 bp, Homo sapiens
aggaccaactggcttctgtgcac

SEQ ID NO: 1576002 - DNA, 19 bp, Homo sapiens
aggaccaagcatcttgggg

SEQ ID NO: 1576003 - DNA, 20 bp, Homo sapiens
aggaccaattgactctcaca

SEQ ID NO: 1576004 - DNA, 19 bp, Homo sapiens
aggaccacagtgggtggca

SEQ ID NO: 1576005 - DNA, 16 bp, Homo sapiens
aggaccaccagcaggc

SEQ ID NO: 1576006 - DNA, 17 bp, Homo sapiens
aggaccaccagcaggca

SEQ ID NO: 1576007 - DNA, 22 bp, Homo sapiens
aggaccagaaaatgtaaggcaa

SEQ ID NO: 1576008 - DNA, 23 bp, Homo sapiens
aggaccagctcaggacagatgcc

SEQ ID NO: 1576009 - DNA, 15 bp, Homo sapiens
aggaccagctggggc

SEQ ID NO: 1576010 - DNA, 16 bp, Homo sapiens
aggaccaggactccct

SEQ ID NO: 1576011 - DNA, 19 bp, Homo sapiens
aggaccaggactccctcct

SEQ ID NO: 1576012 - DNA, 13 bp, Homo sapiens
aggaccagggcct

SEQ ID NO: 1576013 - DNA, 22 bp, Homo sapiens
aggacccacccatcttcctgct

SEQ ID NO: 1576014 - DNA, 13 bp, Homo sapiens
aggacccaggccc

SEQ ID NO: 1576015 - DNA, 14 bp, Homo sapiens
aggacccaggccct

SEQ ID NO: 1576016 - DNA, 23 bp, Homo sapiens
aggaccccttaatcttgctttct

SEQ ID NO: 1576017 - DNA, 20 bp, Homo sapiens
aggaccctcaggaattcagt

SEQ ID NO: 1576018 - DNA, 22 bp, Homo sapiens
aggaccctgacctccgcccctg

SEQ ID NO: 1576019 - DNA, 20 bp, Homo sapiens
aggacccttcccttgagccc

SEQ ID NO: 1576020 - DNA, 19 bp, Homo sapiens
aggaccgccatggtgctgg

SEQ ID NO: 1576021 - DNA, 22 bp, Homo sapiens
aggacctctcagcatagcctgc

SEQ ID NO: 1576022 - DNA, 18 bp, Homo sapiens
aggacctctgtaggcagc

SEQ ID NO: 1576023 - DNA, 19 bp, Homo sapiens
aggacctctttactctctc

SEQ ID NO: 1576024 - DNA, 14 bp, Homo sapiens
aggacctgcatcct

SEQ ID NO: 1576025 - DNA, 19 bp, Homo sapiens
aggacctggcgtgctcaga

SEQ ID NO: 1576026 - DNA, 23 bp, Homo sapiens
aggacctggcgtgctcagaccca

SEQ ID NO: 1576027 - DNA, 18 bp, Homo sapiens
aggaccttcgggctgtgc

SEQ ID NO: 1576028 - DNA, 14 bp, Homo sapiens
aggacgagaccccc

SEQ ID NO: 1576029 - DNA, 17 bp, Homo sapiens
aggacgagacccccatc

SEQ ID NO: 1576030 - DNA, 15 bp, Homo sapiens
aggacgctggctact

SEQ ID NO: 1576031 - DNA, 13 bp, Homo sapiens
aggacgggccaca

SEQ ID NO: 1576032 - DNA, 14 bp, Homo sapiens
aggacgggccacac

SEQ ID NO: 1576033 - DNA, 23 bp, Homo sapiens
aggacgggccacacgtggctggc

SEQ ID NO: 1576034 - DNA, 18 bp, Homo sapiens
aggacggtgccaagggcc

SEQ ID NO: 1576035 - DNA, 20 bp, Homo sapiens
aggacggtgccaagggcccc

SEQ ID NO: 1576036 - DNA, 17 bp, Homo sapiens
aggactaccgcaggccc

SEQ ID NO: 1576037 - DNA, 20 bp, Homo sapiens
aggactaccgcaggcccgga

SEQ ID NO: 1576038 - DNA, 12 bp, Homo sapiens
aggactcaccct

SEQ ID NO: 1576039 - DNA, 20 bp, Homo sapiens
aggactccaggcccaaggct

SEQ ID NO: 1576040 - DNA, 20 bp, Homo sapiens
aggactcccaaccctggctt

SEQ ID NO: 1576041 - DNA, 13 bp, Homo sapiens
aggactccctcct

SEQ ID NO: 1576042 - DNA, 15 bp, Homo sapiens
aggactccctcctca

SEQ ID NO: 1576043 - DNA, 16 bp, Homo sapiens
aggactccctcctcac

SEQ ID NO: 1576044 - DNA, 18 bp, Homo sapiens
aggactccctcctcacct

SEQ ID NO: 1576045 - DNA, 18 bp, Homo sapiens
aggactccgggaccattg

SEQ ID NO: 1576046 - DNA, 12 bp, Homo sapiens
aggactctcctc

SEQ ID NO: 1576047 - DNA, 17 bp, Homo sapiens
aggactctgaggctctt

SEQ ID NO: 1576048 - DNA, 15 bp, Homo sapiens
aggactgaactccat

SEQ ID NO: 1576049 - DNA, 20 bp, Homo sapiens
aggactgagcaccctctgga

SEQ ID NO: 1576050 - DNA, 13 bp, Homo sapiens
aggactgagggca

SEQ ID NO: 1576051 - DNA, 15 bp, Homo sapiens
aggactgcagacagg

SEQ ID NO: 1576052 - DNA, 11 bp, Homo sapiens
aggactgggcc

SEQ ID NO: 1576053 - DNA, 12 bp, Homo sapiens
aggactgggcca

SEQ ID NO: 1576054 - DNA, 17 bp, Homo sapiens
aggactgggtctgacct

SEQ ID NO: 1576055 - DNA, 14 bp, Homo sapiens
aggactggtgcgac

SEQ ID NO: 1576056 - DNA, 23 bp, Homo sapiens
aggactggtgcgaccccccaccc

SEQ ID NO: 1576057 - DNA, 13 bp, Homo sapiens
aggactgtaaaca

SEQ ID NO: 1576058 - DNA, 20 bp, Homo sapiens
aggactgtgtttccaaaggt

SEQ ID NO: 1576059 - DNA, 11 bp, Homo sapiens
aggacttaaaa

SEQ ID NO: 1576060 - DNA, 20 bp, Homo sapiens
aggacttaaaattagtcttt

SEQ ID NO: 1576061 - DNA, 18 bp, Homo sapiens
aggacttaacggctccag

SEQ ID NO: 1576062 - DNA, 18 bp, Homo sapiens
aggacttaagacaaatgg

SEQ ID NO: 1576063 - DNA, 15 bp, Homo sapiens
aggacttctgcctga

SEQ ID NO: 1576064 - DNA, 24 bp, Homo sapiens
aggacttgctaaagcactttgcac

SEQ ID NO: 1576065 - DNA, 20 bp, Homo sapiens
aggacttggtctgatttcag

SEQ ID NO: 1576066 - DNA, 23 bp, Homo sapiens
aggacttggtctgatttcaggat

SEQ ID NO: 1576067 - DNA, 22 bp, Homo sapiens
aggactttgattgcacattgtt

SEQ ID NO: 1576068 - DNA, 13 bp, Homo sapiens
aggactttgtaca

SEQ ID NO: 1576069 - DNA, 14 bp, Homo sapiens
aggagaaacagaga

SEQ ID NO: 1576070 - DNA, 18 bp, Homo sapiens
aggagaaacagagacagg

SEQ ID NO: 1576071 - DNA, 16 bp, Homo sapiens
aggagaaatgcatcca

SEQ ID NO: 1576072 - DNA, 19 bp, Homo sapiens
aggagaaccaaatctggaa

SEQ ID NO: 1576073 - DNA, 13 bp, Homo sapiens
aggagaagagaca

SEQ ID NO: 1576074 - DNA, 15 bp, Homo sapiens
aggagaagagaggaa

SEQ ID NO: 1576075 - DNA, 11 bp, Homo sapiens
aggagaagcca

SEQ ID NO: 1576076 - DNA, 14 bp, Homo sapiens
aggagaagctcagc

SEQ ID NO: 1576077 - DNA, 15 bp, Homo sapiens
aggagaagggctggg

SEQ ID NO: 1576078 - DNA, 20 bp, Homo sapiens
aggagaagtattcctgttgc

SEQ ID NO: 1576079 - DNA, 16 bp, Homo sapiens
aggagaagtgctccct

SEQ ID NO: 1576080 - DNA, 17 bp, Homo sapiens
aggagaatcatgtttct

SEQ ID NO: 1576081 - DNA, 16 bp, Homo sapiens
aggagaatccaagcga

SEQ ID NO: 1576082 - DNA, 22 bp, Homo sapiens
aggagaatcgcttgaacctggg

SEQ ID NO: 1576083 - DNA, 13 bp, Homo sapiens
aggagaattgctt

SEQ ID NO: 1576084 - DNA, 20 bp, Homo sapiens
aggagaattgcttgaacctg

SEQ ID NO: 1576085 - DNA, 14 bp, Homo sapiens
aggagacagaaagc

SEQ ID NO: 1576086 - DNA, 16 bp, Homo sapiens
aggagacagaaagcct

SEQ ID NO: 1576087 - DNA, 14 bp, Homo sapiens
aggagacagagcca

SEQ ID NO: 1576088 - DNA, 22 bp, Homo sapiens
aggagacagagccaagcactgc

SEQ ID NO: 1576089 - DNA, 14 bp, Homo sapiens
aggagaccaaggcg

SEQ ID NO: 1576090 - DNA, 13 bp, Homo sapiens
aggagaccagctc

SEQ ID NO: 1576091 - DNA, 14 bp, Homo sapiens
aggagaccagctca

SEQ ID NO: 1576092 - DNA, 15 bp, Homo sapiens
aggagaccagctcag

SEQ ID NO: 1576093 - DNA, 23 bp, Homo sapiens
aggagaccagctcagaggcccag

SEQ ID NO: 1576094 - DNA, 12 bp, Homo sapiens
aggagaccctgg

SEQ ID NO: 1576095 - DNA, 13 bp, Homo sapiens
aggagaccctgga

SEQ ID NO: 1576096 - DNA, 15 bp, Homo sapiens
aggagacctccagct

SEQ ID NO: 1576097 - DNA, 15 bp, Homo sapiens
aggagacctgctctc

SEQ ID NO: 1576098 - DNA, 15 bp, Homo sapiens
aggagactcacctct

SEQ ID NO: 1576099 - DNA, 18 bp, Homo sapiens
aggagactcacctctgcc

SEQ ID NO: 1576100 - DNA, 23 bp, Homo sapiens
aggagagacccctcccctcccac

SEQ ID NO: 1576101 - DNA, 23 bp, Homo sapiens
aggagagacggtgttgggagccc

SEQ ID NO: 1576102 - DNA, 16 bp, Homo sapiens
aggagagactgaaagc

SEQ ID NO: 1576103 - DNA, 17 bp, Homo sapiens
aggagagactgaaagca

SEQ ID NO: 1576104 - DNA, 14 bp, Homo sapiens
aggagagagacccc

SEQ ID NO: 1576105 - DNA, 16 bp, Homo sapiens
aggagagagaccccgc

SEQ ID NO: 1576106 - DNA, 15 bp, Homo sapiens
aggagagagtcccag

SEQ ID NO: 1576107 - DNA, 18 bp, Homo sapiens
aggagagagtcccagagc

SEQ ID NO: 1576108 - DNA, 20 bp, Homo sapiens
aggagagcctgctgcatggg

SEQ ID NO: 1576109 - DNA, 16 bp, Homo sapiens
aggagaggcagcatgc

SEQ ID NO: 1576110 - DNA, 18 bp, Homo sapiens
aggagaggggcagaacag

SEQ ID NO: 1576111 - DNA, 20 bp, Homo sapiens
aggagagtcccagagcagga

SEQ ID NO: 1576112 - DNA, 18 bp, Homo sapiens
aggagagtcggtctgctt

SEQ ID NO: 1576113 - DNA, 19 bp, Homo sapiens
aggagagtctgaatatttt

SEQ ID NO: 1576114 - DNA, 19 bp, Homo sapiens
aggagagtgagtgcctttc

SEQ ID NO: 1576115 - DNA, 13 bp, Homo sapiens
aggagagtggcag

SEQ ID NO: 1576116 - DNA, 19 bp, Homo sapiens
aggagagtgtgtgggcagg

SEQ ID NO: 1576117 - DNA, 22 bp, Homo sapiens
aggagagttcaagcctgtggga

SEQ ID NO: 1576118 - DNA, 14 bp, Homo sapiens
aggagatatctgag

SEQ ID NO: 1576119 - DNA, 19 bp, Homo sapiens
aggagatatctgagggagg

SEQ ID NO: 1576120 - DNA, 17 bp, Homo sapiens
aggagatgaccagggat

SEQ ID NO: 1576121 - DNA, 18 bp, Homo sapiens
aggagatgaccagggatg

SEQ ID NO: 1576122 - DNA, 14 bp, Homo sapiens
aggagcacgaggtc

SEQ ID NO: 1576123 - DNA, 19 bp, Homo sapiens
aggagcacgaggtctggcc

SEQ ID NO: 1576124 - DNA, 20 bp, Homo sapiens
aggagcactggggtgggggt

SEQ ID NO: 1576125 - DNA, 19 bp, Homo sapiens
aggagcagcccggggagga

SEQ ID NO: 1576126 - DNA, 13 bp, Homo sapiens
aggagcagctgtg

SEQ ID NO: 1576127 - DNA, 16 bp, Homo sapiens
aggagcagctgtgctg

SEQ ID NO: 1576128 - DNA, 20 bp, Homo sapiens
aggagcagctgtgctgcacc

SEQ ID NO: 1576129 - DNA, 16 bp, Homo sapiens
aggagcaggcacgggt

SEQ ID NO: 1576130 - DNA, 16 bp, Homo sapiens
aggagcccagccagaa

SEQ ID NO: 1576131 - DNA, 14 bp, Homo sapiens
aggagccccagcta

SEQ ID NO: 1576132 - DNA, 21 bp, Homo sapiens
aggagccctgaggacctctca

SEQ ID NO: 1576133 - DNA, 16 bp, Homo sapiens
aggagccgggcctccc

SEQ ID NO: 1576134 - DNA, 22 bp, Homo sapiens
aggagcctagcggagcccagcc

SEQ ID NO: 1576135 - DNA, 14 bp, Homo sapiens
aggagcctcagaag

SEQ ID NO: 1576136 - DNA, 16 bp, Homo sapiens
aggagcctcagaagaa

SEQ ID NO: 1576137 - DNA, 13 bp, Homo sapiens
aggagcctgtgcg

SEQ ID NO: 1576138 - DNA, 20 bp, Homo sapiens
aggagcctgtgcgtcccagc

SEQ ID NO: 1576139 - DNA, 23 bp, Homo sapiens
aggagcctgtgcgtcccagctga

SEQ ID NO: 1576140 - DNA, 18 bp, Homo sapiens
aggagccttgctgggcca

SEQ ID NO: 1576141 - DNA, 19 bp, Homo sapiens
aggagccttgctgggccag

SEQ ID NO: 1576142 - DNA, 13 bp, Homo sapiens
aggagcgcaagat

SEQ ID NO: 1576143 - DNA, 17 bp, Homo sapiens
aggagcgcaagatagat

SEQ ID NO: 1576144 - DNA, 15 bp, Homo sapiens
aggagcgtggactct

SEQ ID NO: 1576145 - DNA, 21 bp, Homo sapiens
aggagcgtggactctgctaga

SEQ ID NO: 1576146 - DNA, 12 bp, Homo sapiens
aggagctaaggc

SEQ ID NO: 1576147 - DNA, 20 bp, Homo sapiens
aggagctaaggctctatgag

SEQ ID NO: 1576148 - DNA, 21 bp, Homo sapiens
aggagctaaggctctatgagt

SEQ ID NO: 1576149 - DNA, 19 bp, Homo sapiens
aggagctagcccagtccct

SEQ ID NO: 1576150 - DNA, 18 bp, Homo sapiens
aggagctagttctcagct

SEQ ID NO: 1576151 - DNA, 18 bp, Homo sapiens
aggagctcaccctgcccg

SEQ ID NO: 1576152 - DNA, 21 bp, Homo sapiens
aggagctctgcgccaggcaga

SEQ ID NO: 1576153 - DNA, 17 bp, Homo sapiens
aggagctcttcaggcct

SEQ ID NO: 1576154 - DNA, 18 bp, Homo sapiens
aggagctgagtcacctcc

SEQ ID NO: 1576155 - DNA, 12 bp, Homo sapiens
aggagctgatgg

SEQ ID NO: 1576156 - DNA, 18 bp, Homo sapiens
aggagctgatttccaggc

SEQ ID NO: 1576157 - DNA, 21 bp, Homo sapiens
aggagctgcccagagttgctg

SEQ ID NO: 1576158 - DNA, 18 bp, Homo sapiens
aggagctgccttggctca

SEQ ID NO: 1576159 - DNA, 21 bp, Homo sapiens
aggagctgccttggctcagac

SEQ ID NO: 1576160 - DNA, 12 bp, Homo sapiens
aggagctgctgg

SEQ ID NO: 1576161 - DNA, 16 bp, Homo sapiens
aggagctgctggcttg

SEQ ID NO: 1576162 - DNA, 21 bp, Homo sapiens
aggagctgctggcttgcagtg

SEQ ID NO: 1576163 - DNA, 14 bp, Homo sapiens
aggagctggagggg

SEQ ID NO: 1576164 - DNA, 16 bp, Homo sapiens
aggagctggaggggtg

SEQ ID NO: 1576165 - DNA, 18 bp, Homo sapiens
aggagctggaggggtggg

SEQ ID NO: 1576166 - DNA, 20 bp, Homo sapiens
aggagctggatttgggagct

SEQ ID NO: 1576167 - DNA, 21 bp, Homo sapiens
aggagctggcctgtggcacag

SEQ ID NO: 1576168 - DNA, 12 bp, Homo sapiens
aggagctggggg

SEQ ID NO: 1576169 - DNA, 21 bp, Homo sapiens
aggagctgtcaccaaggaaac

SEQ ID NO: 1576170 - DNA, 13 bp, Homo sapiens
aggagctgttact

SEQ ID NO: 1576171 - DNA, 21 bp, Homo sapiens
aggagcttacccaagctgtgg

SEQ ID NO: 1576172 - DNA, 23 bp, Homo sapiens
aggagcttacccaagctgtggca

SEQ ID NO: 1576173 - DNA, 18 bp, Homo sapiens
aggaggaagtagtccagc

SEQ ID NO: 1576174 - DNA, 19 bp, Homo sapiens
aggaggaatagtgcttgct

SEQ ID NO: 1576175 - DNA, 22 bp, Homo sapiens
aggaggaatgctggactggagg

SEQ ID NO: 1576176 - DNA, 19 bp, Homo sapiens
aggaggacacagcacaagg

SEQ ID NO: 1576177 - DNA, 13 bp, Homo sapiens
aggaggagagagt

SEQ ID NO: 1576178 - DNA, 21 bp, Homo sapiens
aggaggagccttgctgggcca

SEQ ID NO: 1576179 - DNA, 17 bp, Homo sapiens
aggaggagggagaagag

SEQ ID NO: 1576180 - DNA, 22 bp, Homo sapiens
aggaggagggagaagagaaaat

SEQ ID NO: 1576181 - DNA, 21 bp, Homo sapiens
aggaggattgcttgagcccag

SEQ ID NO: 1576182 - DNA, 19 bp, Homo sapiens
aggaggccaaccagcccga

SEQ ID NO: 1576183 - DNA, 12 bp, Homo sapiens
aggaggccacct

SEQ ID NO: 1576184 - DNA, 14 bp, Homo sapiens
aggaggccacctct

SEQ ID NO: 1576185 - DNA, 22 bp, Homo sapiens
aggaggccacctctccaagggc

SEQ ID NO: 1576186 - DNA, 15 bp, Homo sapiens
aggaggccccaggct

SEQ ID NO: 1576187 - DNA, 21 bp, Homo sapiens
aggaggccctggtcctggcct

SEQ ID NO: 1576188 - DNA, 20 bp, Homo sapiens
aggaggccctggtgtcaggc

SEQ ID NO: 1576189 - DNA, 22 bp, Homo sapiens
aggaggccctggtgtcaggcag

SEQ ID NO: 1576190 - DNA, 23 bp, Homo sapiens
aggaggcccttgtcgtgggatgg

SEQ ID NO: 1576191 - DNA, 20 bp, Homo sapiens
aggaggcgcccttggcttct

SEQ ID NO: 1576192 - DNA, 23 bp, Homo sapiens
aggaggcggcccggccagcgggc

SEQ ID NO: 1576193 - DNA, 13 bp, Homo sapiens
aggaggctgaggg

SEQ ID NO: 1576194 - DNA, 19 bp, Homo sapiens
aggaggctgcatgctctgg

SEQ ID NO: 1576195 - DNA, 13 bp, Homo sapiens
aggaggctggcag

SEQ ID NO: 1576196 - DNA, 23 bp, Homo sapiens
aggaggctggccaaggtgtccag

SEQ ID NO: 1576197 - DNA, 24 bp, Homo sapiens
aggaggctggccaaggtgtccagg

SEQ ID NO: 1576198 - DNA, 23 bp, Homo sapiens
aggagggaatgattggtagcaaa

SEQ ID NO: 1576199 - DNA, 13 bp, Homo sapiens
aggagggagaggg

SEQ ID NO: 1576200 - DNA, 19 bp, Homo sapiens
aggagggatgctgcctgag

SEQ ID NO: 1576201 - DNA, 15 bp, Homo sapiens
aggagggcagagcca

SEQ ID NO: 1576202 - DNA, 23 bp, Homo sapiens
aggagggcagagccatgggcctg

SEQ ID NO: 1576203 - DNA, 14 bp, Homo sapiens
aggagggcgcccat

SEQ ID NO: 1576204 - DNA, 22 bp, Homo sapiens
aggagggcgtgactcacccaag

SEQ ID NO: 1576205 - DNA, 16 bp, Homo sapiens
aggaggggaagaggcc

SEQ ID NO: 1576206 - DNA, 16 bp, Homo sapiens
aggaggggaaggggct

SEQ ID NO: 1576207 - DNA, 21 bp, Homo sapiens
aggaggggcagcgcatgtgtg

SEQ ID NO: 1576208 - DNA, 17 bp, Homo sapiens
aggagggggccgggcgc

SEQ ID NO: 1576209 - DNA, 14 bp, Homo sapiens
aggagggtggagga

SEQ ID NO: 1576210 - DNA, 18 bp, Homo sapiens
aggagggtggaggaaggt

SEQ ID NO: 1576211 - DNA, 13 bp, Homo sapiens
aggagggtggggg

SEQ ID NO: 1576212 - DNA, 21 bp, Homo sapiens
aggagggtgggggagggaggt

SEQ ID NO: 1576213 - DNA, 18 bp, Homo sapiens
aggagggttagggagggg

SEQ ID NO: 1576214 - DNA, 20 bp, Homo sapiens
aggaggtcaaggcttcagtg

SEQ ID NO: 1576215 - DNA, 17 bp, Homo sapiens
aggaggtggcagccctg

SEQ ID NO: 1576216 - DNA, 20 bp, Homo sapiens
aggaggtggcagccctgtag

SEQ ID NO: 1576217 - DNA, 24 bp, Homo sapiens
aggaggtgtctggggtgagggagt

SEQ ID NO: 1576218 - DNA, 20 bp, Homo sapiens
aggaggtgtgaggaggaggc

SEQ ID NO: 1576219 - DNA, 17 bp, Homo sapiens
aggaggttggtgactga

SEQ ID NO: 1576220 - DNA, 16 bp, Homo sapiens
aggaggtttgcctgtg

SEQ ID NO: 1576221 - DNA, 14 bp, Homo sapiens
aggaggtttggatg

SEQ ID NO: 1576222 - DNA, 22 bp, Homo sapiens
aggagtaccgccagcagctgtc

SEQ ID NO: 1576223 - DNA, 18 bp, Homo sapiens
aggagtcttcagacccag

SEQ ID NO: 1576224 - DNA, 19 bp, Homo sapiens
aggagtcttcagacccaga

SEQ ID NO: 1576225 - DNA, 23 bp, Homo sapiens
aggagtgaaacctttagggcagc

SEQ ID NO: 1576226 - DNA, 15 bp, Homo sapiens
aggagtgccaggacc

SEQ ID NO: 1576227 - DNA, 20 bp, Homo sapiens
aggagtgccaggaccagcct

SEQ ID NO: 1576228 - DNA, 18 bp, Homo sapiens
aggagtgtcctgcccatg

SEQ ID NO: 1576229 - DNA, 16 bp, Homo sapiens
aggagtgtgagaatca

SEQ ID NO: 1576230 - DNA, 20 bp, Homo sapiens
aggagttagaggccagcctg

SEQ ID NO: 1576231 - DNA, 17 bp, Homo sapiens
aggagttcaagaccagc

SEQ ID NO: 1576232 - DNA, 20 bp, Homo sapiens
aggagttcaagaccagcctg

SEQ ID NO: 1576233 - DNA, 20 bp, Homo sapiens
aggagttccttgatctgtat

SEQ ID NO: 1576234 - DNA, 16 bp, Homo sapiens
aggagttcgagaccag

SEQ ID NO: 1576235 - DNA, 22 bp, Homo sapiens
aggagttcgagaccagcctggc

SEQ ID NO: 1576236 - DNA, 16 bp, Homo sapiens
aggagttcgaggctgc

SEQ ID NO: 1576237 - DNA, 17 bp, Homo sapiens
aggagttcgaggctgca

SEQ ID NO: 1576238 - DNA, 20 bp, Homo sapiens
aggagttgagtacagtgagg

SEQ ID NO: 1576239 - DNA, 14 bp, Homo sapiens
aggagttgcctgac

SEQ ID NO: 1576240 - DNA, 22 bp, Homo sapiens
aggagttgcctgactcctgggt

SEQ ID NO: 1576241 - DNA, 15 bp, Homo sapiens
aggagtttattacaa

SEQ ID NO: 1576242 - DNA, 18 bp, Homo sapiens
aggagtttattacaatgt

SEQ ID NO: 1576243 - DNA, 23 bp, Homo sapiens
aggagtttattacaatgtatctt

SEQ ID NO: 1576244 - DNA, 16 bp, Homo sapiens
aggagtttgagaccag

SEQ ID NO: 1576245 - DNA, 21 bp, Homo sapiens
aggagtttgagaccagcttag

SEQ ID NO: 1576246 - DNA, 20 bp, Homo sapiens
aggagtttgagaccaggctg

SEQ ID NO: 1576247 - DNA, 16 bp, Homo sapiens
aggagtttgaggctgc

SEQ ID NO: 1576248 - DNA, 20 bp, Homo sapiens
aggagtttgaggctgcaatg

SEQ ID NO: 1576249 - DNA, 20 bp, Homo sapiens
aggagtttgaggctgcagcg

SEQ ID NO: 1576250 - DNA, 24 bp, Homo sapiens
aggagtttgaggctgcagcgagct

SEQ ID NO: 1576251 - DNA, 18 bp, Homo sapiens
aggataacacaagtaaaa

SEQ ID NO: 1576252 - DNA, 17 bp, Homo sapiens
aggataatgaaataatc

SEQ ID NO: 1576253 - DNA, 18 bp, Homo sapiens
aggataatgaaataatca

SEQ ID NO: 1576254 - DNA, 18 bp, Homo sapiens
aggatactggcacagagg

SEQ ID NO: 1576255 - DNA, 14 bp, Homo sapiens
aggatagatgctgg

SEQ ID NO: 1576256 - DNA, 15 bp, Homo sapiens
aggatagatgctggc

SEQ ID NO: 1576257 - DNA, 22 bp, Homo sapiens
aggatagatgctggcccagggc

SEQ ID NO: 1576258 - DNA, 21 bp, Homo sapiens
aggatatattttcactttgtg

SEQ ID NO: 1576259 - DNA, 14 bp, Homo sapiens
aggatattgctaat

SEQ ID NO: 1576260 - DNA, 17 bp, Homo sapiens
aggatattgctaattgt

SEQ ID NO: 1576261 - DNA, 20 bp, Homo sapiens
aggatattggttcttcccct

SEQ ID NO: 1576262 - DNA, 21 bp, Homo sapiens
aggatattggttcttcccctc

SEQ ID NO: 1576263 - DNA, 14 bp, Homo sapiens
aggatatttaagaa

SEQ ID NO: 1576264 - DNA, 17 bp, Homo sapiens
aggatatttaagaaaat

SEQ ID NO: 1576265 - DNA, 15 bp, Homo sapiens
aggatcacctgaggt

SEQ ID NO: 1576266 - DNA, 19 bp, Homo sapiens
aggatcactctctgctggc

SEQ ID NO: 1576267 - DNA, 15 bp, Homo sapiens
aggatcactggagcc

SEQ ID NO: 1576268 - DNA, 19 bp, Homo sapiens
aggatcacttgagcccagg

SEQ ID NO: 1576269 - DNA, 13 bp, Homo sapiens
aggatcagttttt

SEQ ID NO: 1576270 - DNA, 20 bp, Homo sapiens
aggatcatttgttggaatga

SEQ ID NO: 1576271 - DNA, 13 bp, Homo sapiens
aggatccctcctg

SEQ ID NO: 1576272 - DNA, 18 bp, Homo sapiens
aggatccctcctgagctc

SEQ ID NO: 1576273 - DNA, 12 bp, Homo sapiens
aggatcctgcag

SEQ ID NO: 1576274 - DNA, 14 bp, Homo sapiens
aggatcctgcagga

SEQ ID NO: 1576275 - DNA, 16 bp, Homo sapiens
aggatcctgcaggaac

SEQ ID NO: 1576276 - DNA, 18 bp, Homo sapiens
aggatccttttcctaatt

SEQ ID NO: 1576277 - DNA, 23 bp, Homo sapiens
aggatctataggcagcttctaag

SEQ ID NO: 1576278 - DNA, 14 bp, Homo sapiens
aggatctcaagcca

SEQ ID NO: 1576279 - DNA, 15 bp, Homo sapiens
aggatctcaagccag

SEQ ID NO: 1576280 - DNA, 18 bp, Homo sapiens
aggatctcaagccagccc

SEQ ID NO: 1576281 - DNA, 13 bp, Homo sapiens
aggatctctcagg

SEQ ID NO: 1576282 - DNA, 20 bp, Homo sapiens
aggatctctcaggagcacag

SEQ ID NO: 1576283 - DNA, 22 bp, Homo sapiens
aggatctctcaggagcacaggc

SEQ ID NO: 1576284 - DNA, 16 bp, Homo sapiens
aggatctgctccaaca

SEQ ID NO: 1576285 - DNA, 12 bp, Homo sapiens
aggatctgctga

SEQ ID NO: 1576286 - DNA, 15 bp, Homo sapiens
aggatctgctgaggc

SEQ ID NO: 1576287 - DNA, 21 bp, Homo sapiens
aggatctgctgaggcccagtg

SEQ ID NO: 1576288 - DNA, 23 bp, Homo sapiens
aggatctgctgaggcccagtgca

SEQ ID NO: 1576289 - DNA, 12 bp, Homo sapiens
aggatctgtgat

SEQ ID NO: 1576290 - DNA, 18 bp, Homo sapiens
aggatctgtgattggctg

SEQ ID NO: 1576291 - DNA, 20 bp, Homo sapiens
aggatgaagaacacagcatg

SEQ ID NO: 1576292 - DNA, 21 bp, Homo sapiens
aggatgaagaacacagcatgt

SEQ ID NO: 1576293 - DNA, 19 bp, Homo sapiens
aggatgaatgaggtcccag

SEQ ID NO: 1576294 - DNA, 22 bp, Homo sapiens
aggatgaatgaggtcccaggca

SEQ ID NO: 1576295 - DNA, 16 bp, Homo sapiens
aggatgaattttctgc

SEQ ID NO: 1576296 - DNA, 20 bp, Homo sapiens
aggatgaattttctgcagct

SEQ ID NO: 1576297 - DNA, 15 bp, Homo sapiens
aggatgagcagaggg

SEQ ID NO: 1576298 - DNA, 15 bp, Homo sapiens
aggatgagctggaag

SEQ ID NO: 1576299 - DNA, 16 bp, Homo sapiens
aggatgagctggaagg

SEQ ID NO: 1576300 - DNA, 19 bp, Homo sapiens
aggatgcacatttctggat

SEQ ID NO: 1576301 - DNA, 14 bp, Homo sapiens
aggatgcccagggc

SEQ ID NO: 1576302 - DNA, 12 bp, Homo sapiens
aggatgcctttt

SEQ ID NO: 1576303 - DNA, 22 bp, Homo sapiens
aggatgcggaaggattgcaatg

SEQ ID NO: 1576304 - DNA, 20 bp, Homo sapiens
aggatgctctttcccaggac

SEQ ID NO: 1576305 - DNA, 14 bp, Homo sapiens
aggatgctgcagtg

SEQ ID NO: 1576306 - DNA, 21 bp, Homo sapiens
aggatgctgcagtgaggctgt

SEQ ID NO: 1576307 - DNA, 16 bp, Homo sapiens
aggatggagagcagcc

SEQ ID NO: 1576308 - DNA, 12 bp, Homo sapiens
aggatggagggg

SEQ ID NO: 1576309 - DNA, 12 bp, Homo sapiens
aggatggatggc

SEQ ID NO: 1576310 - DNA, 17 bp, Homo sapiens
aggatggatggcaccct

SEQ ID NO: 1576311 - DNA, 14 bp, Homo sapiens
aggatggcctggaa

SEQ ID NO: 1576312 - DNA, 22 bp, Homo sapiens
aggatgggatctttctgggagc

SEQ ID NO: 1576313 - DNA, 17 bp, Homo sapiens
aggatgggatgggttcc

SEQ ID NO: 1576314 - DNA, 16 bp, Homo sapiens
aggatgggggaaagaa

SEQ ID NO: 1576315 - DNA, 18 bp, Homo sapiens
aggatggggttctggaaa

SEQ ID NO: 1576316 - DNA, 17 bp, Homo sapiens
aggatgggtcagagcta

SEQ ID NO: 1576317 - DNA, 20 bp, Homo sapiens
aggatggtctcgatctcctg

SEQ ID NO: 1576318 - DNA, 21 bp, Homo sapiens
aggatggtgctgagtaaacat

SEQ ID NO: 1576319 - DNA, 22 bp, Homo sapiens
aggatgtaaacagtgcctgctg

SEQ ID NO: 1576320 - DNA, 20 bp, Homo sapiens
aggatgtaggggttaacttg

SEQ ID NO: 1576321 - DNA, 21 bp, Homo sapiens
aggatgtggagctactgatga

SEQ ID NO: 1576322 - DNA, 22 bp, Homo sapiens
aggatgttttgtcccatttcct

SEQ ID NO: 1576323 - DNA, 23 bp, Homo sapiens
aggatgttttgtcccatttcctt

SEQ ID NO: 1576324 - DNA, 18 bp, Homo sapiens
aggattatgggtcctgca

SEQ ID NO: 1576325 - DNA, 18 bp, Homo sapiens
aggattattgatagtact

SEQ ID NO: 1576326 - DNA, 12 bp, Homo sapiens
aggattcagatc

SEQ ID NO: 1576327 - DNA, 23 bp, Homo sapiens
aggattcaggcagcagtgtctgt

SEQ ID NO: 1576328 - DNA, 21 bp, Homo sapiens
aggattccaaaaacattttat

SEQ ID NO: 1576329 - DNA, 16 bp, Homo sapiens
aggattcccccagcca

SEQ ID NO: 1576330 - DNA, 12 bp, Homo sapiens
aggattcccttc

SEQ ID NO: 1576331 - DNA, 14 bp, Homo sapiens
aggattcccttctg

SEQ ID NO: 1576332 - DNA, 16 bp, Homo sapiens
aggattcccttctggg

SEQ ID NO: 1576333 - DNA, 18 bp, Homo sapiens
aggattcccttctgggct

SEQ ID NO: 1576334 - DNA, 18 bp, Homo sapiens
aggattctgttccctggg

SEQ ID NO: 1576335 - DNA, 23 bp, Homo sapiens
aggattcttcccgctccccacct

SEQ ID NO: 1576336 - DNA, 19 bp, Homo sapiens
aggattgcttgagcccagg

SEQ ID NO: 1576337 - DNA, 20 bp, Homo sapiens
aggattgcttgagcccagga

SEQ ID NO: 1576338 - DNA, 13 bp, Homo sapiens
aggattgtggaaa

SEQ ID NO: 1576339 - DNA, 19 bp, Homo sapiens
aggattgtggaaaaccagg

SEQ ID NO: 1576340 - DNA, 15 bp, Homo sapiens
aggatttaaaaactg

SEQ ID NO: 1576341 - DNA, 19 bp, Homo sapiens
aggatttaaaaactggaac

SEQ ID NO: 1576342 - DNA, 16 bp, Homo sapiens
aggatttaacagtcat

SEQ ID NO: 1576343 - DNA, 20 bp, Homo sapiens
aggatttaaggaggtgaagt

SEQ ID NO: 1576344 - DNA, 16 bp, Homo sapiens
aggatttcaagcctgc

SEQ ID NO: 1576345 - DNA, 19 bp, Homo sapiens
aggatttcatgatttcatt

SEQ ID NO: 1576346 - DNA, 14 bp, Homo sapiens
aggattttaatttc

SEQ ID NO: 1576347 - DNA, 17 bp, Homo sapiens
aggattttaatttcagg

SEQ ID NO: 1576348 - DNA, 21 bp, Homo sapiens
aggattttaatttcaggaaaa

SEQ ID NO: 1576349 - DNA, 17 bp, Homo sapiens
aggattttaccaaagca

SEQ ID NO: 1576350 - DNA, 18 bp, Homo sapiens
aggattttaccaaagcat

SEQ ID NO: 1576351 - DNA, 21 bp, Homo sapiens
aggcaaaacacgcaagggcat

SEQ ID NO: 1576352 - DNA, 12 bp, Homo sapiens
aggcaaaaggag

SEQ ID NO: 1576353 - DNA, 17 bp, Homo sapiens
aggcaaaatccttgctt

SEQ ID NO: 1576354 - DNA, 18 bp, Homo sapiens
aggcaaacattttctctt

SEQ ID NO: 1576355 - DNA, 22 bp, Homo sapiens
aggcaaacattttctcttagaa

SEQ ID NO: 1576356 - DNA, 19 bp, Homo sapiens
aggcaaagttttacagaga

SEQ ID NO: 1576357 - DNA, 16 bp, Homo sapiens
aggcaaatattgaagt

SEQ ID NO: 1576358 - DNA, 17 bp, Homo sapiens
aggcaaatattgaagtt

SEQ ID NO: 1576359 - DNA, 20 bp, Homo sapiens
aggcaaatattgaagttgtt

SEQ ID NO: 1576360 - DNA, 13 bp, Homo sapiens
aggcaaatgtgta

SEQ ID NO: 1576361 - DNA, 14 bp, Homo sapiens
aggcaaatgtgtac

SEQ ID NO: 1576362 - DNA, 18 bp, Homo sapiens
aggcaacactgctgtcca

SEQ ID NO: 1576363 - DNA, 17 bp, Homo sapiens
aggcaactgaggcagac

SEQ ID NO: 1576364 - DNA, 21 bp, Homo sapiens
aggcaagagggggtggagggg

SEQ ID NO: 1576365 - DNA, 22 bp, Homo sapiens
aggcaagccaggctcactcaca

SEQ ID NO: 1576366 - DNA, 17 bp, Homo sapiens
aggcaagcccctcagcc

SEQ ID NO: 1576367 - DNA, 23 bp, Homo sapiens
aggcaagcccctcagcccttgcc

SEQ ID NO: 1576368 - DNA, 15 bp, Homo sapiens
aggcaagctgaaatt

SEQ ID NO: 1576369 - DNA, 18 bp, Homo sapiens
aggcaagcttgaggccaa

SEQ ID NO: 1576370 - DNA, 21 bp, Homo sapiens
aggcaagcttgaggccaagat

SEQ ID NO: 1576371 - DNA, 22 bp, Homo sapiens
aggcaagcttgaggccaagatg

SEQ ID NO: 1576372 - DNA, 22 bp, Homo sapiens
aggcaaggcaggtgcctccagg

SEQ ID NO: 1576373 - DNA, 18 bp, Homo sapiens
aggcaaggctatgtgatt

SEQ ID NO: 1576374 - DNA, 17 bp, Homo sapiens
aggcaaggttatatgca

SEQ ID NO: 1576375 - DNA, 15 bp, Homo sapiens
aggcaaggtttacac

SEQ ID NO: 1576376 - DNA, 15 bp, Homo sapiens
aggcaagtttctagc

SEQ ID NO: 1576377 - DNA, 14 bp, Homo sapiens
aggcaataaaaatc

SEQ ID NO: 1576378 - DNA, 21 bp, Homo sapiens
aggcaatgattcacgcttttg

SEQ ID NO: 1576379 - DNA, 22 bp, Homo sapiens
aggcaatgtcaggaacagaagg

SEQ ID NO: 1576380 - DNA, 21 bp, Homo sapiens
aggcaattagacactttggaa

SEQ ID NO: 1576381 - DNA, 18 bp, Homo sapiens
aggcaattttagtgtatt

SEQ ID NO: 1576382 - DNA, 20 bp, Homo sapiens
aggcaattttagtgtattaa

SEQ ID NO: 1576383 - DNA, 23 bp, Homo sapiens
aggcacacagagattctggatct

SEQ ID NO: 1576384 - DNA, 15 bp, Homo sapiens
aggcacacagatccc

SEQ ID NO: 1576385 - DNA, 18 bp, Homo sapiens
aggcacacagatcccctg

SEQ ID NO: 1576386 - DNA, 13 bp, Homo sapiens
aggcacacagcta

SEQ ID NO: 1576387 - DNA, 20 bp, Homo sapiens
aggcacacagggcccggcca

SEQ ID NO: 1576388 - DNA, 12 bp, Homo sapiens
aggcacacttct

SEQ ID NO: 1576389 - DNA, 13 bp, Homo sapiens
aggcacactttct

SEQ ID NO: 1576390 - DNA, 14 bp, Homo sapiens
aggcacactttctg

SEQ ID NO: 1576391 - DNA, 15 bp, Homo sapiens
aggcacactttctgg

SEQ ID NO: 1576392 - DNA, 13 bp, Homo sapiens
aggcacagctgag

SEQ ID NO: 1576393 - DNA, 18 bp, Homo sapiens
aggcacaggacacctggc

SEQ ID NO: 1576394 - DNA, 13 bp, Homo sapiens
aggcacagggccc

SEQ ID NO: 1576395 - DNA, 14 bp, Homo sapiens
aggcacagggcccg

SEQ ID NO: 1576396 - DNA, 15 bp, Homo sapiens
aggcacagtgggagc

SEQ ID NO: 1576397 - DNA, 17 bp, Homo sapiens
aggcacagtgggagctg

SEQ ID NO: 1576398 - DNA, 18 bp, Homo sapiens
aggcacagtgggagctga

SEQ ID NO: 1576399 - DNA, 23 bp, Homo sapiens
aggcacagtgggagctgagctgg

SEQ ID NO: 1576400 - DNA, 14 bp, Homo sapiens
aggcacatggagga

SEQ ID NO: 1576401 - DNA, 21 bp, Homo sapiens
aggcacatgttgttctcattg

SEQ ID NO: 1576402 - DNA, 13 bp, Homo sapiens
aggcaccaccagg

SEQ ID NO: 1576403 - DNA, 15 bp, Homo sapiens
aggcaccaccaggag

SEQ ID NO: 1576404 - DNA, 19 bp, Homo sapiens
aggcaccaccaggagcagc

SEQ ID NO: 1576405 - DNA, 23 bp, Homo sapiens
aggcaccaccaggagcagcagcc

SEQ ID NO: 1576406 - DNA, 15 bp, Homo sapiens
aggcaccagctctgt

SEQ ID NO: 1576407 - DNA, 19 bp, Homo sapiens
aggcaccagctctgtggcc

SEQ ID NO: 1576408 - DNA, 20 bp, Homo sapiens
aggcaccagctctgtggcct

SEQ ID NO: 1576409 - DNA, 21 bp, Homo sapiens
aggcaccagctctgtggcctg

SEQ ID NO: 1576410 - DNA, 14 bp, Homo sapiens
aggcacccatctgt

SEQ ID NO: 1576411 - DNA, 22 bp, Homo sapiens
aggcacccgccctttccttgcc

SEQ ID NO: 1576412 - DNA, 14 bp, Homo sapiens
aggcaccgccacgt

SEQ ID NO: 1576413 - DNA, 17 bp, Homo sapiens
aggcaccggcgctgcag

SEQ ID NO: 1576414 - DNA, 20 bp, Homo sapiens
aggcaccggcgctgcaggta

SEQ ID NO: 1576415 - DNA, 21 bp, Homo sapiens
aggcaccgtccaggccccacc

SEQ ID NO: 1576416 - DNA, 15 bp, Homo sapiens
aggcacctccaggca

SEQ ID NO: 1576417 - DNA, 14 bp, Homo sapiens
aggcacctccccgc

SEQ ID NO: 1576418 - DNA, 14 bp, Homo sapiens
aggcacctggcctg

SEQ ID NO: 1576419 - DNA, 17 bp, Homo sapiens
aggcacctggcctgctg

SEQ ID NO: 1576420 - DNA, 20 bp, Homo sapiens
aggcacctggcctgctggga

SEQ ID NO: 1576421 - DNA, 20 bp, Homo sapiens
aggcactagtcaccgacagc

SEQ ID NO: 1576422 - DNA, 14 bp, Homo sapiens
aggcactctagatt

SEQ ID NO: 1576423 - DNA, 17 bp, Homo sapiens
aggcactctagattcca

SEQ ID NO: 1576424 - DNA, 19 bp, Homo sapiens
aggcactctgttatttaga

SEQ ID NO: 1576425 - DNA, 22 bp, Homo sapiens
aggcactgcccttttcaggaag

SEQ ID NO: 1576426 - DNA, 14 bp, Homo sapiens
aggcactgggctcc

SEQ ID NO: 1576427 - DNA, 15 bp, Homo sapiens
aggcactggtggcat

SEQ ID NO: 1576428 - DNA, 16 bp, Homo sapiens
aggcactgtagttcta

SEQ ID NO: 1576429 - DNA, 22 bp, Homo sapiens
aggcacttatcagcatgaagaa

SEQ ID NO: 1576430 - DNA, 17 bp, Homo sapiens
aggcagaaagatacaga

SEQ ID NO: 1576431 - DNA, 21 bp, Homo sapiens
aggcagaagaattgaacccag

SEQ ID NO: 1576432 - DNA, 23 bp, Homo sapiens
aggcagaagaattgaacccagga

SEQ ID NO: 1576433 - DNA, 19 bp, Homo sapiens
aggcagacaagagctgctg

SEQ ID NO: 1576434 - DNA, 13 bp, Homo sapiens
aggcagagaaatc

SEQ ID NO: 1576435 - DNA, 14 bp, Homo sapiens
aggcagaggcctgg

SEQ ID NO: 1576436 - DNA, 15 bp, Homo sapiens
aggcagaggttttaa

SEQ ID NO: 1576437 - DNA, 11 bp, Homo sapiens
aggcagatcca

SEQ ID NO: 1576438 - DNA, 16 bp, Homo sapiens
aggcagatctgtgccc

SEQ ID NO: 1576439 - DNA, 23 bp, Homo sapiens
aggcagatgtggggctgagctgg

SEQ ID NO: 1576440 - DNA, 16 bp, Homo sapiens
aggcagattgaaaagg

SEQ ID NO: 1576441 - DNA, 20 bp, Homo sapiens
aggcagcaagtcttaacaaa

SEQ ID NO: 1576442 - DNA, 19 bp, Homo sapiens
aggcagcagtgtctgtacc

SEQ ID NO: 1576443 - DNA, 13 bp, Homo sapiens
aggcagccacggc

SEQ ID NO: 1576444 - DNA, 14 bp, Homo sapiens
aggcagccacggcc

SEQ ID NO: 1576445 - DNA, 23 bp, Homo sapiens
aggcagcccagctcctgaataaa

SEQ ID NO: 1576446 - DNA, 21 bp, Homo sapiens
aggcagccgaggcctggccaa

SEQ ID NO: 1576447 - DNA, 18 bp, Homo sapiens
aggcagcctccagagcca

SEQ ID NO: 1576448 - DNA, 19 bp, Homo sapiens
aggcagcctccagagccag

SEQ ID NO: 1576449 - DNA, 23 bp, Homo sapiens
aggcagcctccagagccagcctg

SEQ ID NO: 1576450 - DNA, 13 bp, Homo sapiens
aggcagcctcctt

SEQ ID NO: 1576451 - DNA, 20 bp, Homo sapiens
aggcagcctctgtcaggcct

SEQ ID NO: 1576452 - DNA, 21 bp, Homo sapiens
aggcagcctctgtcaggcctt

SEQ ID NO: 1576453 - DNA, 17 bp, Homo sapiens
aggcagcctgaacactc

SEQ ID NO: 1576454 - DNA, 16 bp, Homo sapiens
aggcagcctgcaggga

SEQ ID NO: 1576455 - DNA, 12 bp, Homo sapiens
aggcagccttga

SEQ ID NO: 1576456 - DNA, 13 bp, Homo sapiens
aggcagcgacccc

SEQ ID NO: 1576457 - DNA, 14 bp, Homo sapiens
aggcagctgcctct

SEQ ID NO: 1576458 - DNA, 18 bp, Homo sapiens
aggcagctgcctctgctc

SEQ ID NO: 1576459 - DNA, 19 bp, Homo sapiens
aggcagctgcctctgctcc

SEQ ID NO: 1576460 - DNA, 21 bp, Homo sapiens
aggcagctgcctctgctccct

SEQ ID NO: 1576461 - DNA, 22 bp, Homo sapiens
aggcagctggatgagacttcca

SEQ ID NO: 1576462 - DNA, 13 bp, Homo sapiens
aggcagcttctaa

SEQ ID NO: 1576463 - DNA, 15 bp, Homo sapiens
aggcagcttgaaact

SEQ ID NO: 1576464 - DNA, 19 bp, Homo sapiens
aggcaggaacaaacagggc

SEQ ID NO: 1576465 - DNA, 18 bp, Homo sapiens
aggcaggagaatggtgtg

SEQ ID NO: 1576466 - DNA, 22 bp, Homo sapiens
aggcaggattgaaaatgtccag

SEQ ID NO: 1576467 - DNA, 22 bp, Homo sapiens
aggcaggcatagaggcttctcc

SEQ ID NO: 1576468 - DNA, 15 bp, Homo sapiens
aggcaggcattcctg

SEQ ID NO: 1576469 - DNA, 17 bp, Homo sapiens
aggcaggccaggctgcc

SEQ ID NO: 1576470 - DNA, 12 bp, Homo sapiens
aggcagggaggg

SEQ ID NO: 1576471 - DNA, 14 bp, Homo sapiens
aggcagggagggga

SEQ ID NO: 1576472 - DNA, 14 bp, Homo sapiens
aggcagggcagagg

SEQ ID NO: 1576473 - DNA, 19 bp, Homo sapiens
aggcagggccttgcccaga

SEQ ID NO: 1576474 - DNA, 20 bp, Homo sapiens
aggcagggccttgcccagag

SEQ ID NO: 1576475 - DNA, 15 bp, Homo sapiens
aggcagggctgggcc

SEQ ID NO: 1576476 - DNA, 19 bp, Homo sapiens
aggcagggctgggccaggt

SEQ ID NO: 1576477 - DNA, 23 bp, Homo sapiens
aggcagggctgggccaggtctcc

SEQ ID NO: 1576478 - DNA, 21 bp, Homo sapiens
aggcaggggacaagggaggca

SEQ ID NO: 1576479 - DNA, 15 bp, Homo sapiens
aggcagggggccctg

SEQ ID NO: 1576480 - DNA, 20 bp, Homo sapiens
aggcagggggccctgcccca

SEQ ID NO: 1576481 - DNA, 23 bp, Homo sapiens
aggcaggggtcctgcaggtcctg

SEQ ID NO: 1576482 - DNA, 20 bp, Homo sapiens
aggcaggggtgggggtggag

SEQ ID NO: 1576483 - DNA, 23 bp, Homo sapiens
aggcagggtcaggagaggggcag

SEQ ID NO: 1576484 - DNA, 19 bp, Homo sapiens
aggcaggtctgcaagggcc

SEQ ID NO: 1576485 - DNA, 22 bp, Homo sapiens
aggcaggtctgcaagggcccag

SEQ ID NO: 1576486 - DNA, 19 bp, Homo sapiens
aggcaggtgagaacccaga

SEQ ID NO: 1576487 - DNA, 14 bp, Homo sapiens
aggcaggtgcctcc

SEQ ID NO: 1576488 - DNA, 17 bp, Homo sapiens
aggcaggtttgccagtg

SEQ ID NO: 1576489 - DNA, 21 bp, Homo sapiens
aggcagtattttgtgtcctcc

SEQ ID NO: 1576490 - DNA, 13 bp, Homo sapiens
aggcagtctctat

SEQ ID NO: 1576491 - DNA, 20 bp, Homo sapiens
aggcagtctctatattatgt

SEQ ID NO: 1576492 - DNA, 11 bp, Homo sapiens
aggcagtctga

SEQ ID NO: 1576493 - DNA, 14 bp, Homo sapiens
aggcagtctttgct

SEQ ID NO: 1576494 - DNA, 18 bp, Homo sapiens
aggcagtgatgacttgct

SEQ ID NO: 1576495 - DNA, 21 bp, Homo sapiens
aggcagtgtggttatgttccc

SEQ ID NO: 1576496 - DNA, 15 bp, Homo sapiens
aggcagttctagaag

SEQ ID NO: 1576497 - DNA, 14 bp, Homo sapiens
aggcagtttgcaaa

SEQ ID NO: 1576498 - DNA, 14 bp, Homo sapiens
aggcataggcctgg

SEQ ID NO: 1576499 - DNA, 16 bp, Homo sapiens
aggcataggcctgggt

SEQ ID NO: 1576500 - DNA, 19 bp, Homo sapiens
aggcataggcctgggtgct

SEQ ID NO: 1576501 - DNA, 20 bp, Homo sapiens
aggcatatcttctatatctg

SEQ ID NO: 1576502 - DNA, 20 bp, Homo sapiens
aggcatcagtccctatgtat

SEQ ID NO: 1576503 - DNA, 20 bp, Homo sapiens
aggcatccaggccagggctc

SEQ ID NO: 1576504 - DNA, 19 bp, Homo sapiens
aggcatcgtcatgcacagt

SEQ ID NO: 1576505 - DNA, 17 bp, Homo sapiens
aggcatctacacagcct

SEQ ID NO: 1576506 - DNA, 22 bp, Homo sapiens
aggcatctctgtactttgcttg

SEQ ID NO: 1576507 - DNA, 14 bp, Homo sapiens
aggcatctgagggg

SEQ ID NO: 1576508 - DNA, 23 bp, Homo sapiens
aggcatcttttctagagacacat

SEQ ID NO: 1576509 - DNA, 19 bp, Homo sapiens
aggcatgaatcactgtgct

SEQ ID NO: 1576510 - DNA, 18 bp, Homo sapiens
aggcatgactaatgcttt

SEQ ID NO: 1576511 - DNA, 14 bp, Homo sapiens
aggcatgagaaaga

SEQ ID NO: 1576512 - DNA, 18 bp, Homo sapiens
aggcatgagccactgagc

SEQ ID NO: 1576513 - DNA, 23 bp, Homo sapiens
aggcatgagccactgagcctggc

SEQ ID NO: 1576514 - DNA, 15 bp, Homo sapiens
aggcatgagggatca

SEQ ID NO: 1576515 - DNA, 20 bp, Homo sapiens
aggcatgagggatcacaggg

SEQ ID NO: 1576516 - DNA, 22 bp, Homo sapiens
aggcatgagggatcacagggcc

SEQ ID NO: 1576517 - DNA, 23 bp, Homo sapiens
aggcatgagggatcacagggccc

SEQ ID NO: 1576518 - DNA, 15 bp, Homo sapiens
aggcatgcctctgat

SEQ ID NO: 1576519 - DNA, 15 bp, Homo sapiens
aggcatggccctggg

SEQ ID NO: 1576520 - DNA, 16 bp, Homo sapiens
aggcatggccctgggc

SEQ ID NO: 1576521 - DNA, 21 bp, Homo sapiens
aggcatggctcagatcggcca

SEQ ID NO: 1576522 - DNA, 12 bp, Homo sapiens
aggcatggctgg

SEQ ID NO: 1576523 - DNA, 18 bp, Homo sapiens
aggcatggggcatgtcct

SEQ ID NO: 1576524 - DNA, 19 bp, Homo sapiens
aggcatgggtgcaaggaaa

SEQ ID NO: 1576525 - DNA, 21 bp, Homo sapiens
aggcatgggtgcaaggaaaat

SEQ ID NO: 1576526 - DNA, 21 bp, Homo sapiens
aggcatggtcccttaaggcac

SEQ ID NO: 1576527 - DNA, 23 bp, Homo sapiens
aggcatggtcccttaaggcacag

SEQ ID NO: 1576528 - DNA, 23 bp, Homo sapiens
aggcatgtgtcaccatgcccagc

SEQ ID NO: 1576529 - DNA, 19 bp, Homo sapiens
aggcattaacacaaaggag

SEQ ID NO: 1576530 - DNA, 19 bp, Homo sapiens
aggcattaatgtttctatc

SEQ ID NO: 1576531 - DNA, 17 bp, Homo sapiens
aggcattcctgaaggga

SEQ ID NO: 1576532 - DNA, 13 bp, Homo sapiens
aggcattggatat

SEQ ID NO: 1576533 - DNA, 21 bp, Homo sapiens
aggcattgttagtttagtgtg

SEQ ID NO: 1576534 - DNA, 21 bp, Homo sapiens
aggcatttgcagggtcctctt

SEQ ID NO: 1576535 - DNA, 14 bp, Homo sapiens
aggcatttgtcttt

SEQ ID NO: 1576536 - DNA, 14 bp, Homo sapiens
aggccaaagataaa

SEQ ID NO: 1576537 - DNA, 17 bp, Homo sapiens
aggccaaaggctggtgg

SEQ ID NO: 1576538 - DNA, 17 bp, Homo sapiens
aggccaaatgcacaagc

SEQ ID NO: 1576539 - DNA, 14 bp, Homo sapiens
aggccaacagcacc

SEQ ID NO: 1576540 - DNA, 18 bp, Homo sapiens
aggccaacagcacctccc

SEQ ID NO: 1576541 - DNA, 15 bp, Homo sapiens
aggccaacagtagcc

SEQ ID NO: 1576542 - DNA, 19 bp, Homo sapiens
aggccaaccagcccgacag

SEQ ID NO: 1576543 - DNA, 14 bp, Homo sapiens
aggccaagagcaga

SEQ ID NO: 1576544 - DNA, 18 bp, Homo sapiens
aggccaagagcagaggca

SEQ ID NO: 1576545 - DNA, 17 bp, Homo sapiens
aggccaagatggctgct

SEQ ID NO: 1576546 - DNA, 18 bp, Homo sapiens
aggccaagatggctgctg

SEQ ID NO: 1576547 - DNA, 21 bp, Homo sapiens
aggccaagatggctgctgcct

SEQ ID NO: 1576548 - DNA, 17 bp, Homo sapiens
aggccaaggccttctcc

SEQ ID NO: 1576549 - DNA, 16 bp, Homo sapiens
aggccaaggcgggtgg

SEQ ID NO: 1576550 - DNA, 20 bp, Homo sapiens
aggccaaggcgggtggatca

SEQ ID NO: 1576551 - DNA, 19 bp, Homo sapiens
aggccaagtacactgagag

SEQ ID NO: 1576552 - DNA, 22 bp, Homo sapiens
aggccaagtgtgataaataaac

SEQ ID NO: 1576553 - DNA, 22 bp, Homo sapiens
aggccacaccatctcctttcag

SEQ ID NO: 1576554 - DNA, 24 bp, Homo sapiens
aggccacattactagagttggcat

SEQ ID NO: 1576555 - DNA, 22 bp, Homo sapiens
aggccaccatattcagtgctgt

SEQ ID NO: 1576556 - DNA, 20 bp, Homo sapiens
aggccaccattataatttat

SEQ ID NO: 1576557 - DNA, 17 bp, Homo sapiens
aggccacccactgaccc

SEQ ID NO: 1576558 - DNA, 18 bp, Homo sapiens
aggccacccactgaccca

SEQ ID NO: 1576559 - DNA, 21 bp, Homo sapiens
aggccaccccctatcctctga

SEQ ID NO: 1576560 - DNA, 19 bp, Homo sapiens
aggccaccccgctgatgga

SEQ ID NO: 1576561 - DNA, 19 bp, Homo sapiens
aggccaccgggacagacct

SEQ ID NO: 1576562 - DNA, 21 bp, Homo sapiens
aggccaccgggacagacctgg

SEQ ID NO: 1576563 - DNA, 15 bp, Homo sapiens
aggccacctcccact

SEQ ID NO: 1576564 - DNA, 11 bp, Homo sapiens
aggccacctct

SEQ ID NO: 1576565 - DNA, 12 bp, Homo sapiens
aggccacctctc

SEQ ID NO: 1576566 - DNA, 14 bp, Homo sapiens
aggccacctctcca

SEQ ID NO: 1576567 - DNA, 17 bp, Homo sapiens
aggccacctctccaagg

SEQ ID NO: 1576568 - DNA, 18 bp, Homo sapiens
aggccacctctccaaggg

SEQ ID NO: 1576569 - DNA, 19 bp, Homo sapiens
aggccacctctccaagggc

SEQ ID NO: 1576570 - DNA, 15 bp, Homo sapiens
aggccacctctgcct

SEQ ID NO: 1576571 - DNA, 19 bp, Homo sapiens
aggccactcctccaaagga

SEQ ID NO: 1576572 - DNA, 16 bp, Homo sapiens
aggccagacatggtgt

SEQ ID NO: 1576573 - DNA, 18 bp, Homo sapiens
aggccagaggcccccagc

SEQ ID NO: 1576574 - DNA, 14 bp, Homo sapiens
aggccagcaacgct

SEQ ID NO: 1576575 - DNA, 11 bp, Homo sapiens
aggccagccca

SEQ ID NO: 1576576 - DNA, 21 bp, Homo sapiens
aggccagcccggacctctgga

SEQ ID NO: 1576577 - DNA, 13 bp, Homo sapiens
aggccagcctccg

SEQ ID NO: 1576578 - DNA, 21 bp, Homo sapiens
aggccaggacgggccacacgt

SEQ ID NO: 1576579 - DNA, 11 bp, Homo sapiens
aggccaggagt

SEQ ID NO: 1576580 - DNA, 16 bp, Homo sapiens
aggccaggctgcctcg

SEQ ID NO: 1576581 - DNA, 20 bp, Homo sapiens
aggccagggcagcaagggac

SEQ ID NO: 1576582 - DNA, 13 bp, Homo sapiens
aggccagggcctc

SEQ ID NO: 1576583 - DNA, 14 bp, Homo sapiens
aggccagggctcct

SEQ ID NO: 1576584 - DNA, 21 bp, Homo sapiens
aggccaggtccctggaccagc

SEQ ID NO: 1576585 - DNA, 23 bp, Homo sapiens
aggccagtggactctgaggactc

SEQ ID NO: 1576586 - DNA, 14 bp, Homo sapiens
aggccatctcagga

SEQ ID NO: 1576587 - DNA, 17 bp, Homo sapiens
aggccatctcaggagat

SEQ ID NO: 1576588 - DNA, 18 bp, Homo sapiens
aggccatctcaggagatg

SEQ ID NO: 1576589 - DNA, 19 bp, Homo sapiens
aggccatgaaaaaaatgat

SEQ ID NO: 1576590 - DNA, 16 bp, Homo sapiens
aggccatgatggcctt

SEQ ID NO: 1576591 - DNA, 19 bp, Homo sapiens
aggccatgtgagccaccgc

SEQ ID NO: 1576592 - DNA, 17 bp, Homo sapiens
aggccattatgcctggc

SEQ ID NO: 1576593 - DNA, 19 bp, Homo sapiens
aggccattatgcctggcta

SEQ ID NO: 1576594 - DNA, 13 bp, Homo sapiens
aggcccaaatgat

SEQ ID NO: 1576595 - DNA, 20 bp, Homo sapiens
aggcccaagagatgaagagt

SEQ ID NO: 1576596 - DNA, 17 bp, Homo sapiens
aggcccaagagccctgt

SEQ ID NO: 1576597 - DNA, 17 bp, Homo sapiens
aggcccaaggctcccgg

SEQ ID NO: 1576598 - DNA, 22 bp, Homo sapiens
aggcccactagagggcccatca

SEQ ID NO: 1576599 - DNA, 18 bp, Homo sapiens
aggcccactccccagccc

SEQ ID NO: 1576600 - DNA, 21 bp, Homo sapiens
aggcccagaattgcagttcag

SEQ ID NO: 1576601 - DNA, 10 bp, Homo sapiens
aggcccagca

SEQ ID NO: 1576602 - DNA, 13 bp, Homo sapiens
aggcccagcatgc

SEQ ID NO: 1576603 - DNA, 14 bp, Homo sapiens
aggcccagcatgca

SEQ ID NO: 1576604 - DNA, 15 bp, Homo sapiens
aggcccagcatgcag

SEQ ID NO: 1576605 - DNA, 16 bp, Homo sapiens
aggcccagcatgcagg

SEQ ID NO: 1576606 - DNA, 13 bp, Homo sapiens
aggcccagcattg

SEQ ID NO: 1576607 - DNA, 18 bp, Homo sapiens
aggcccagcattgctggt

SEQ ID NO: 1576608 - DNA, 21 bp, Homo sapiens
aggcccagcattgctggttct

SEQ ID NO: 1576609 - DNA, 14 bp, Homo sapiens
aggcccagcccctc

SEQ ID NO: 1576610 - DNA, 16 bp, Homo sapiens
aggcccagccctcaga

SEQ ID NO: 1576611 - DNA, 13 bp, Homo sapiens
aggcccaggcacc

SEQ ID NO: 1576612 - DNA, 18 bp, Homo sapiens
aggcccatctcaggtgcc

SEQ ID NO: 1576613 - DNA, 19 bp, Homo sapiens
aggcccatctcaggtgcca

SEQ ID NO: 1576614 - DNA, 20 bp, Homo sapiens
aggcccatctcaggtgccac

SEQ ID NO: 1576615 - DNA, 18 bp, Homo sapiens
aggcccatggttgagaaa

SEQ ID NO: 1576616 - DNA, 15 bp, Homo sapiens
aggccccaaccctgt

SEQ ID NO: 1576617 - DNA, 21 bp, Homo sapiens
aggccccaccaagagggtgga

SEQ ID NO: 1576618 - DNA, 14 bp, Homo sapiens
aggccccagagaga

SEQ ID NO: 1576619 - DNA, 21 bp, Homo sapiens
aggccccagaggccctggagg

SEQ ID NO: 1576620 - DNA, 14 bp, Homo sapiens
aggccccagcctcc

SEQ ID NO: 1576621 - DNA, 22 bp, Homo sapiens
aggcccccaaattgccttcagc

SEQ ID NO: 1576622 - DNA, 15 bp, Homo sapiens
aggcccccaggtgcc

SEQ ID NO: 1576623 - DNA, 16 bp, Homo sapiens
aggccccctgcatcta

SEQ ID NO: 1576624 - DNA, 19 bp, Homo sapiens
aggccccgatggactcctg

SEQ ID NO: 1576625 - DNA, 23 bp, Homo sapiens
aggccccgatggactcctgacca

SEQ ID NO: 1576626 - DNA, 20 bp, Homo sapiens
aggccccgcttgtccagcgc

SEQ ID NO: 1576627 - DNA, 23 bp, Homo sapiens
aggccccgggcttcccttctccc

SEQ ID NO: 1576628 - DNA, 18 bp, Homo sapiens
aggcccctaggtgcccag

SEQ ID NO: 1576629 - DNA, 20 bp, Homo sapiens
aggcccctaggtgcccaggg

SEQ ID NO: 1576630 - DNA, 23 bp, Homo sapiens
aggcccctcctagacccaggtgg

SEQ ID NO: 1576631 - DNA, 12 bp, Homo sapiens
aggcccctgagg

SEQ ID NO: 1576632 - DNA, 20 bp, Homo sapiens
aggcccctgaggcagcccag

SEQ ID NO: 1576633 - DNA, 12 bp, Homo sapiens
aggcccctgcaa

SEQ ID NO: 1576634 - DNA, 14 bp, Homo sapiens
aggcccctggagcc

SEQ ID NO: 1576635 - DNA, 14 bp, Homo sapiens
aggcccctggccca

SEQ ID NO: 1576636 - DNA, 13 bp, Homo sapiens
aggcccctgggct

SEQ ID NO: 1576637 - DNA, 22 bp, Homo sapiens
aggcccctgggctctcacccag

SEQ ID NO: 1576638 - DNA, 13 bp, Homo sapiens
aggccccttccct

SEQ ID NO: 1576639 - DNA, 19 bp, Homo sapiens
aggcccgcaccccggcctc

SEQ ID NO: 1576640 - DNA, 21 bp, Homo sapiens
aggcccgcaccccggcctcag

SEQ ID NO: 1576641 - DNA, 23 bp, Homo sapiens
aggcccgcaccccggcctcaggg

SEQ ID NO: 1576642 - DNA, 20 bp, Homo sapiens
aggcccgctctacatcttct

SEQ ID NO: 1576643 - DNA, 13 bp, Homo sapiens
aggcccggggctg

SEQ ID NO: 1576644 - DNA, 14 bp, Homo sapiens
aggcccggggctgg

SEQ ID NO: 1576645 - DNA, 15 bp, Homo sapiens
aggcccgtcggagct

SEQ ID NO: 1576646 - DNA, 18 bp, Homo sapiens
aggcccgtcggagctgcc

SEQ ID NO: 1576647 - DNA, 12 bp, Homo sapiens
aggccctcagtg

SEQ ID NO: 1576648 - DNA, 18 bp, Homo sapiens
aggccctccatgggctag

SEQ ID NO: 1576649 - DNA, 22 bp, Homo sapiens
aggccctccctgttccccagag

SEQ ID NO: 1576650 - DNA, 14 bp, Homo sapiens
aggccctctgcctg

SEQ ID NO: 1576651 - DNA, 17 bp, Homo sapiens
aggccctctgcctgcac

SEQ ID NO: 1576652 - DNA, 13 bp, Homo sapiens
aggccctgccagt

SEQ ID NO: 1576653 - DNA, 12 bp, Homo sapiens
aggccctgccca

SEQ ID NO: 1576654 - DNA, 12 bp, Homo sapiens
aggccctgcccc

SEQ ID NO: 1576655 - DNA, 14 bp, Homo sapiens
aggccctggcctcc

SEQ ID NO: 1576656 - DNA, 22 bp, Homo sapiens
aggccctggcctcccctgccac

SEQ ID NO: 1576657 - DNA, 23 bp, Homo sapiens
aggccctggggagcttttgccca

SEQ ID NO: 1576658 - DNA, 20 bp, Homo sapiens
aggccctggtcctggcctcc

SEQ ID NO: 1576659 - DNA, 16 bp, Homo sapiens
aggccctggttcctgc

SEQ ID NO: 1576660 - DNA, 22 bp, Homo sapiens
aggccctggttcctgctgtcct

SEQ ID NO: 1576661 - DNA, 14 bp, Homo sapiens
aggccctgttccct

SEQ ID NO: 1576662 - DNA, 17 bp, Homo sapiens
aggccctgttccctgga

SEQ ID NO: 1576663 - DNA, 22 bp, Homo sapiens
aggcccttattttcaagaaact

SEQ ID NO: 1576664 - DNA, 22 bp, Homo sapiens
aggcccttcctctccactgcct

SEQ ID NO: 1576665 - DNA, 17 bp, Homo sapiens
aggcccttggctgcagg

SEQ ID NO: 1576666 - DNA, 18 bp, Homo sapiens
aggcccttggctgcaggc

SEQ ID NO: 1576667 - DNA, 14 bp, Homo sapiens
aggcccttgtcctg

SEQ ID NO: 1576668 - DNA, 17 bp, Homo sapiens
aggcccttgtcctgcca

SEQ ID NO: 1576669 - DNA, 21 bp, Homo sapiens
aggcccttgtcctgccagctg

SEQ ID NO: 1576670 - DNA, 23 bp, Homo sapiens
aggcccttgtcctgccagctgcc

SEQ ID NO: 1576671 - DNA, 16 bp, Homo sapiens
aggccctttcctttgg

SEQ ID NO: 1576672 - DNA, 18 bp, Homo sapiens
aggccctttggcttctga

SEQ ID NO: 1576673 - DNA, 19 bp, Homo sapiens
aggccctttggcttctgat

SEQ ID NO: 1576674 - DNA, 16 bp, Homo sapiens
aggccgaagctctggc

SEQ ID NO: 1576675 - DNA, 19 bp, Homo sapiens
aggccgaagctctggctga

SEQ ID NO: 1576676 - DNA, 20 bp, Homo sapiens
aggccgaaggtgcctcagac

SEQ ID NO: 1576677 - DNA, 16 bp, Homo sapiens
aggccgagcggtggcc

SEQ ID NO: 1576678 - DNA, 18 bp, Homo sapiens
aggccgaggaccaccagc

SEQ ID NO: 1576679 - DNA, 19 bp, Homo sapiens
aggccgaggaccaccagca

SEQ ID NO: 1576680 - DNA, 22 bp, Homo sapiens
aggccgaggaccaccagcaggc

SEQ ID NO: 1576681 - DNA, 20 bp, Homo sapiens
aggccgaggataaagaaaag

SEQ ID NO: 1576682 - DNA, 16 bp, Homo sapiens
aggccgaggcgggtgg

SEQ ID NO: 1576683 - DNA, 12 bp, Homo sapiens
aggccgcagctc

SEQ ID NO: 1576684 - DNA, 16 bp, Homo sapiens
aggccgcagctcttgc

SEQ ID NO: 1576685 - DNA, 21 bp, Homo sapiens
aggccgcagctcttgcccttc

SEQ ID NO: 1576686 - DNA, 22 bp, Homo sapiens
aggccgcagctcttgcccttcc

SEQ ID NO: 1576687 - DNA, 20 bp, Homo sapiens
aggccgccagcgtgtggagc

SEQ ID NO: 1576688 - DNA, 24 bp, Homo sapiens
aggccgccctgagcatcctggttc

SEQ ID NO: 1576689 - DNA, 12 bp, Homo sapiens
aggccgcgccca

SEQ ID NO: 1576690 - DNA, 15 bp, Homo sapiens
aggccgcgcccagca

SEQ ID NO: 1576691 - DNA, 17 bp, Homo sapiens
aggccgctagaggcctg

SEQ ID NO: 1576692 - DNA, 20 bp, Homo sapiens
aggccgctagaggcctgagg

SEQ ID NO: 1576693 - DNA, 21 bp, Homo sapiens
aggccgctagaggcctgagga

SEQ ID NO: 1576694 - DNA, 14 bp, Homo sapiens
aggccggagcccag

SEQ ID NO: 1576695 - DNA, 15 bp, Homo sapiens
aggccggagcccaga

SEQ ID NO: 1576696 - DNA, 16 bp, Homo sapiens
aggccggagcccagat

SEQ ID NO: 1576697 - DNA, 19 bp, Homo sapiens
aggccggggtccaggcccg

SEQ ID NO: 1576698 - DNA, 17 bp, Homo sapiens
aggcctaaaagtaaaca

SEQ ID NO: 1576699 - DNA, 22 bp, Homo sapiens
aggcctaatctcatacctctga

SEQ ID NO: 1576700 - DNA, 19 bp, Homo sapiens
aggcctaccccgcagacac

SEQ ID NO: 1576701 - DNA, 15 bp, Homo sapiens
aggcctaggattcta

SEQ ID NO: 1576702 - DNA, 16 bp, Homo sapiens
aggcctaggattctaa

SEQ ID NO: 1576703 - DNA, 17 bp, Homo sapiens
aggcctaggattctaaa

SEQ ID NO: 1576704 - DNA, 23 bp, Homo sapiens
aggcctcactactcgagcccacc

SEQ ID NO: 1576705 - DNA, 16 bp, Homo sapiens
aggcctcatccctcgg

SEQ ID NO: 1576706 - DNA, 18 bp, Homo sapiens
aggcctcatctcctttat

SEQ ID NO: 1576707 - DNA, 18 bp, Homo sapiens
aggcctccaacgcccctg

SEQ ID NO: 1576708 - DNA, 15 bp, Homo sapiens
aggcctccagcccca

SEQ ID NO: 1576709 - DNA, 13 bp, Homo sapiens
aggcctccagcct

SEQ ID NO: 1576710 - DNA, 18 bp, Homo sapiens
aggcctcccccagccagg

SEQ ID NO: 1576711 - DNA, 15 bp, Homo sapiens
aggcctccctctctc

SEQ ID NO: 1576712 - DNA, 18 bp, Homo sapiens
aggcctccctgcagactc

SEQ ID NO: 1576713 - DNA, 24 bp, Homo sapiens
aggcctctccagtttgcacctgtc

SEQ ID NO: 1576714 - DNA, 19 bp, Homo sapiens
aggcctctccatttgctct

SEQ ID NO: 1576715 - DNA, 23 bp, Homo sapiens
aggcctctcggtgctccatctcc

SEQ ID NO: 1576716 - DNA, 14 bp, Homo sapiens
aggcctctctctgc

SEQ ID NO: 1576717 - DNA, 18 bp, Homo sapiens
aggcctctctctgcctga

SEQ ID NO: 1576718 - DNA, 13 bp, Homo sapiens
aggcctctgcaga

SEQ ID NO: 1576719 - DNA, 12 bp, Homo sapiens
aggcctctgcct

SEQ ID NO: 1576720 - DNA, 20 bp, Homo sapiens
aggcctctgcctgctgggga

SEQ ID NO: 1576721 - DNA, 23 bp, Homo sapiens
aggcctctggactggcctgtctg

SEQ ID NO: 1576722 - DNA, 20 bp, Homo sapiens
aggcctcttgtgctcacgct

SEQ ID NO: 1576723 - DNA, 14 bp, Homo sapiens
aggcctgaagtctt

SEQ ID NO: 1576724 - DNA, 20 bp, Homo sapiens
aggcctgaatcatgagcctg

SEQ ID NO: 1576725 - DNA, 13 bp, Homo sapiens
aggcctgaccagg

SEQ ID NO: 1576726 - DNA, 21 bp, Homo sapiens
aggcctgacttctgctggcat

SEQ ID NO: 1576727 - DNA, 21 bp, Homo sapiens
aggcctgagaatgagtgggaa

SEQ ID NO: 1576728 - DNA, 16 bp, Homo sapiens
aggcctgagatttcat

SEQ ID NO: 1576729 - DNA, 22 bp, Homo sapiens
aggcctgagatttcatctgctc

SEQ ID NO: 1576730 - DNA, 14 bp, Homo sapiens
aggcctgagcgctc

SEQ ID NO: 1576731 - DNA, 19 bp, Homo sapiens
aggcctgagcgctcctgcc

SEQ ID NO: 1576732 - DNA, 18 bp, Homo sapiens
aggcctgaggatgagctg

SEQ ID NO: 1576733 - DNA, 20 bp, Homo sapiens
aggcctgaggatgagctgga

SEQ ID NO: 1576734 - DNA, 23 bp, Homo sapiens
aggcctgaggatgagctggaagg

SEQ ID NO: 1576735 - DNA, 20 bp, Homo sapiens
aggcctgatcttgcctgtct

SEQ ID NO: 1576736 - DNA, 17 bp, Homo sapiens
aggcctgcctccagggc

SEQ ID NO: 1576737 - DNA, 21 bp, Homo sapiens
aggcctgcctccagggctgga

SEQ ID NO: 1576738 - DNA, 20 bp, Homo sapiens
aggcctgcgaccctgggggc

SEQ ID NO: 1576739 - DNA, 14 bp, Homo sapiens
aggcctgctccctg

SEQ ID NO: 1576740 - DNA, 17 bp, Homo sapiens
aggcctgctgccagtgc

SEQ ID NO: 1576741 - DNA, 18 bp, Homo sapiens
aggcctgctgccagtgca

SEQ ID NO: 1576742 - DNA, 18 bp, Homo sapiens
aggcctgcttccccctcc

SEQ ID NO: 1576743 - DNA, 19 bp, Homo sapiens
aggcctgcttccccctccc

SEQ ID NO: 1576744 - DNA, 15 bp, Homo sapiens
aggcctggaaccagg

SEQ ID NO: 1576745 - DNA, 13 bp, Homo sapiens
aggcctggcctct

SEQ ID NO: 1576746 - DNA, 20 bp, Homo sapiens
aggcctgggccgctgccacg

SEQ ID NO: 1576747 - DNA, 21 bp, Homo sapiens
aggcctgggccgctgccacgt

SEQ ID NO: 1576748 - DNA, 16 bp, Homo sapiens
aggcctgggctgggaa

SEQ ID NO: 1576749 - DNA, 16 bp, Homo sapiens
aggcctgggtgctggc

SEQ ID NO: 1576750 - DNA, 19 bp, Homo sapiens
aggcctgtcccttgcctct

SEQ ID NO: 1576751 - DNA, 20 bp, Homo sapiens
aggcctgtcccttgcctctg

SEQ ID NO: 1576752 - DNA, 14 bp, Homo sapiens
aggcctgtggggag

SEQ ID NO: 1576753 - DNA, 18 bp, Homo sapiens
aggcctgtttggcctctc

SEQ ID NO: 1576754 - DNA, 17 bp, Homo sapiens
aggccttaacacactgg

SEQ ID NO: 1576755 - DNA, 19 bp, Homo sapiens
aggccttatcattcattct

SEQ ID NO: 1576756 - DNA, 21 bp, Homo sapiens
aggccttcagggttcagcagt

SEQ ID NO: 1576757 - DNA, 21 bp, Homo sapiens
aggccttcatcctcctcccca

SEQ ID NO: 1576758 - DNA, 13 bp, Homo sapiens
aggccttccactg

SEQ ID NO: 1576759 - DNA, 15 bp, Homo sapiens
aggccttccagctgc

SEQ ID NO: 1576760 - DNA, 18 bp, Homo sapiens
aggccttccagctgctgt

SEQ ID NO: 1576761 - DNA, 20 bp, Homo sapiens
aggccttccagctgctgtct

SEQ ID NO: 1576762 - DNA, 15 bp, Homo sapiens
aggccttcctctctc

SEQ ID NO: 1576763 - DNA, 13 bp, Homo sapiens
aggccttctcctc

SEQ ID NO: 1576764 - DNA, 15 bp, Homo sapiens
aggccttgcctggcc

SEQ ID NO: 1576765 - DNA, 20 bp, Homo sapiens
aggccttggtggagcagcca

SEQ ID NO: 1576766 - DNA, 22 bp, Homo sapiens
aggccttggtggagcagccaga

SEQ ID NO: 1576767 - DNA, 18 bp, Homo sapiens
aggcctttcttctgtgtt

SEQ ID NO: 1576768 - DNA, 20 bp, Homo sapiens
aggcctttcttctgtgttaa

SEQ ID NO: 1576769 - DNA, 13 bp, Homo sapiens
aggccttttcacg

SEQ ID NO: 1576770 - DNA, 21 bp, Homo sapiens
aggcgacaaaatctcctggct

SEQ ID NO: 1576771 - DNA, 19 bp, Homo sapiens
aggcgagctccttgaagaa

SEQ ID NO: 1576772 - DNA, 15 bp, Homo sapiens
aggcgaggagagtgg

SEQ ID NO: 1576773 - DNA, 20 bp, Homo sapiens
aggcgatggggcaagacaga

SEQ ID NO: 1576774 - DNA, 14 bp, Homo sapiens
aggcgccccttccc

SEQ ID NO: 1576775 - DNA, 19 bp, Homo sapiens
aggcgcctataatcccagc

SEQ ID NO: 1576776 - DNA, 15 bp, Homo sapiens
aggcgctgctggtgt

SEQ ID NO: 1576777 - DNA, 12 bp, Homo sapiens
aggcggcagctg

SEQ ID NO: 1576778 - DNA, 18 bp, Homo sapiens
aggcggcagctggggccg

SEQ ID NO: 1576779 - DNA, 17 bp, Homo sapiens
aggcggcccggccagcg

SEQ ID NO: 1576780 - DNA, 14 bp, Homo sapiens
aggcgggaggaggt

SEQ ID NO: 1576781 - DNA, 21 bp, Homo sapiens
aggcgggcatggcgtggagga

SEQ ID NO: 1576782 - DNA, 15 bp, Homo sapiens
aggcgggccagccag

SEQ ID NO: 1576783 - DNA, 21 bp, Homo sapiens
aggcgggccagccaggcgggc

SEQ ID NO: 1576784 - DNA, 20 bp, Homo sapiens
aggcggggtattcccactca

SEQ ID NO: 1576785 - DNA, 16 bp, Homo sapiens
aggcggggtgctgtgg

SEQ ID NO: 1576786 - DNA, 20 bp, Homo sapiens
aggcggggtggcggtggacc

SEQ ID NO: 1576787 - DNA, 19 bp, Homo sapiens
aggcgtcaacgtgcatttt

SEQ ID NO: 1576788 - DNA, 17 bp, Homo sapiens
aggcgtgcccccctcct

SEQ ID NO: 1576789 - DNA, 22 bp, Homo sapiens
aggcgtgcccccctcctccagt

SEQ ID NO: 1576790 - DNA, 20 bp, Homo sapiens
aggcgttagtgggcaggtgg

SEQ ID NO: 1576791 - DNA, 16 bp, Homo sapiens
aggcgttggtgccact

SEQ ID NO: 1576792 - DNA, 15 bp, Homo sapiens
aggctaagcatggcc

SEQ ID NO: 1576793 - DNA, 21 bp, Homo sapiens
aggctaagttcagttctgttt

SEQ ID NO: 1576794 - DNA, 22 bp, Homo sapiens
aggctacaggggttagcctgga

SEQ ID NO: 1576795 - DNA, 17 bp, Homo sapiens
aggctactgtcagctcc

SEQ ID NO: 1576796 - DNA, 23 bp, Homo sapiens
aggctatacttgtcttgttcacc

SEQ ID NO: 1576797 - DNA, 20 bp, Homo sapiens
aggctatcaacatgttattc

SEQ ID NO: 1576798 - DNA, 19 bp, Homo sapiens
aggctatggggatagatgt

SEQ ID NO: 1576799 - DNA, 21 bp, Homo sapiens
aggctatggggatagatgtgt

SEQ ID NO: 1576800 - DNA, 22 bp, Homo sapiens
aggctatggggatagatgtgtg

SEQ ID NO: 1576801 - DNA, 19 bp, Homo sapiens
aggctatgtataaaataca

SEQ ID NO: 1576802 - DNA, 20 bp, Homo sapiens
aggctatgtataaaatacat

SEQ ID NO: 1576803 - DNA, 21 bp, Homo sapiens
aggctatgtataaaatacata

SEQ ID NO: 1576804 - DNA, 14 bp, Homo sapiens
aggctatgtgatta

SEQ ID NO: 1576805 - DNA, 17 bp, Homo sapiens
aggctatgtgattacaa

SEQ ID NO: 1576806 - DNA, 16 bp, Homo sapiens
aggctattatttattg

SEQ ID NO: 1576807 - DNA, 19 bp, Homo sapiens
aggctattattttcactgt

SEQ ID NO: 1576808 - DNA, 11 bp, Homo sapiens
aggctatttgt

SEQ ID NO: 1576809 - DNA, 16 bp, Homo sapiens
aggctatttgtaaatc

SEQ ID NO: 1576810 - DNA, 17 bp, Homo sapiens
aggctatttgtaaatct

SEQ ID NO: 1576811 - DNA, 21 bp, Homo sapiens
aggctatttgtaaatctgcca

SEQ ID NO: 1576812 - DNA, 15 bp, Homo sapiens
aggctcactgccagg

SEQ ID NO: 1576813 - DNA, 17 bp, Homo sapiens
aggctcactgccaggcc

SEQ ID NO: 1576814 - DNA, 13 bp, Homo sapiens
aggctcagaagga

SEQ ID NO: 1576815 - DNA, 19 bp, Homo sapiens
aggctcaggcacatacacc

SEQ ID NO: 1576816 - DNA, 16 bp, Homo sapiens
aggctcagtctcagga

SEQ ID NO: 1576817 - DNA, 21 bp, Homo sapiens
aggctcatagggaagacctgc

SEQ ID NO: 1576818 - DNA, 15 bp, Homo sapiens
aggctcatctttctg

SEQ ID NO: 1576819 - DNA, 13 bp, Homo sapiens
aggctcatttaaa

SEQ ID NO: 1576820 - DNA, 13 bp, Homo sapiens
aggctccatgcac

SEQ ID NO: 1576821 - DNA, 16 bp, Homo sapiens
aggctccatgcacctc

SEQ ID NO: 1576822 - DNA, 19 bp, Homo sapiens
aggctccccgcctccactc

SEQ ID NO: 1576823 - DNA, 13 bp, Homo sapiens
aggctccctcgcc

SEQ ID NO: 1576824 - DNA, 20 bp, Homo sapiens
aggctcctacctgtctgctg

SEQ ID NO: 1576825 - DNA, 15 bp, Homo sapiens
aggctcggagcaccc

SEQ ID NO: 1576826 - DNA, 19 bp, Homo sapiens
aggctcggaggaccctgga

SEQ ID NO: 1576827 - DNA, 18 bp, Homo sapiens
aggctcgtggactgagtg

SEQ ID NO: 1576828 - DNA, 16 bp, Homo sapiens
aggctcgtttggatct

SEQ ID NO: 1576829 - DNA, 23 bp, Homo sapiens
aggctctcgggtgggggagccag

SEQ ID NO: 1576830 - DNA, 18 bp, Homo sapiens
aggctctgaaataaaatg

SEQ ID NO: 1576831 - DNA, 16 bp, Homo sapiens
aggctctgagagtcta

SEQ ID NO: 1576832 - DNA, 14 bp, Homo sapiens
aggctctgccctgc

SEQ ID NO: 1576833 - DNA, 16 bp, Homo sapiens
aggctctgcttctcca

SEQ ID NO: 1576834 - DNA, 15 bp, Homo sapiens
aggctctgggctcag

SEQ ID NO: 1576835 - DNA, 20 bp, Homo sapiens
aggctctgggctcagggctg

SEQ ID NO: 1576836 - DNA, 13 bp, Homo sapiens
aggctctgtgcct

SEQ ID NO: 1576837 - DNA, 17 bp, Homo sapiens
aggctctgtgccttggt

SEQ ID NO: 1576838 - DNA, 21 bp, Homo sapiens
aggctctgtgccttggtctct

SEQ ID NO: 1576839 - DNA, 22 bp, Homo sapiens
aggctcttagcagcttccagat

SEQ ID NO: 1576840 - DNA, 15 bp, Homo sapiens
aggctcttcacatcc

SEQ ID NO: 1576841 - DNA, 22 bp, Homo sapiens
aggctcttcctggacctgagtc

SEQ ID NO: 1576842 - DNA, 15 bp, Homo sapiens
aggctctttctgggc

SEQ ID NO: 1576843 - DNA, 18 bp, Homo sapiens
aggctctttctgggccaa

SEQ ID NO: 1576844 - DNA, 20 bp, Homo sapiens
aggctctttctgggccaagt

SEQ ID NO: 1576845 - DNA, 15 bp, Homo sapiens
aggctgaaaagaagg

SEQ ID NO: 1576846 - DNA, 14 bp, Homo sapiens
aggctgaagagagg

SEQ ID NO: 1576847 - DNA, 17 bp, Homo sapiens
aggctgaccaagagaga

SEQ ID NO: 1576848 - DNA, 20 bp, Homo sapiens
aggctgaccaagagagaaag

SEQ ID NO: 1576849 - DNA, 17 bp, Homo sapiens
aggctgacttttccaaa

SEQ ID NO: 1576850 - DNA, 17 bp, Homo sapiens
aggctgagacaggagaa

SEQ ID NO: 1576851 - DNA, 18 bp, Homo sapiens
aggctgagacagtgaatt

SEQ ID NO: 1576852 - DNA, 13 bp, Homo sapiens
aggctgagccatg

SEQ ID NO: 1576853 - DNA, 15 bp, Homo sapiens
aggctgagccatgag

SEQ ID NO: 1576854 - DNA, 18 bp, Homo sapiens
aggctgagccatgaggag

SEQ ID NO: 1576855 - DNA, 11 bp, Homo sapiens
aggctgaggca

SEQ ID NO: 1576856 - DNA, 12 bp, Homo sapiens
aggctgaggcag

SEQ ID NO: 1576857 - DNA, 17 bp, Homo sapiens
aggctgaggcagcagac

SEQ ID NO: 1576858 - DNA, 13 bp, Homo sapiens
aggctgaggcagg

SEQ ID NO: 1576859 - DNA, 14 bp, Homo sapiens
aggctgaggcagga

SEQ ID NO: 1576860 - DNA, 17 bp, Homo sapiens
aggctgaggcaggagga

SEQ ID NO: 1576861 - DNA, 16 bp, Homo sapiens
aggctgaggcctggac

SEQ ID NO: 1576862 - DNA, 22 bp, Homo sapiens
aggctgaggggaggatcactgg

SEQ ID NO: 1576863 - DNA, 19 bp, Homo sapiens
aggctgagtgagccacaga

SEQ ID NO: 1576864 - DNA, 18 bp, Homo sapiens
aggctgagttctggttca

SEQ ID NO: 1576865 - DNA, 20 bp, Homo sapiens
aggctgcacagcatttgctt

SEQ ID NO: 1576866 - DNA, 15 bp, Homo sapiens
aggctgcactgcagt

SEQ ID NO: 1576867 - DNA, 18 bp, Homo sapiens
aggctgcagaggcacctc

SEQ ID NO: 1576868 - DNA, 19 bp, Homo sapiens
aggctgcagaggcacctca

SEQ ID NO: 1576869 - DNA, 13 bp, Homo sapiens
aggctgcagcagg

SEQ ID NO: 1576870 - DNA, 19 bp, Homo sapiens
aggctgcagcaggtgctgg

SEQ ID NO: 1576871 - DNA, 21 bp, Homo sapiens
aggctgcagcaggtgctgggc

SEQ ID NO: 1576872 - DNA, 14 bp, Homo sapiens
aggctgcagcctcc

SEQ ID NO: 1576873 - DNA, 23 bp, Homo sapiens
aggctgcagcctccacttccctc

SEQ ID NO: 1576874 - DNA, 23 bp, Homo sapiens
aggctgcagcgcccggtgctctg

SEQ ID NO: 1576875 - DNA, 22 bp, Homo sapiens
aggctgcaggacttctgcctga

SEQ ID NO: 1576876 - DNA, 14 bp, Homo sapiens
aggctgcagtcagc

SEQ ID NO: 1576877 - DNA, 15 bp, Homo sapiens
aggctgccccaggcc

SEQ ID NO: 1576878 - DNA, 22 bp, Homo sapiens
aggctgccccaggccggagccc

SEQ ID NO: 1576879 - DNA, 23 bp, Homo sapiens
aggctgccccaggccggagccca

SEQ ID NO: 1576880 - DNA, 24 bp, Homo sapiens
aggctgccccaggccggagcccag

SEQ ID NO: 1576881 - DNA, 23 bp, Homo sapiens
aggctgccccgggtccccagctc

SEQ ID NO: 1576882 - DNA, 12 bp, Homo sapiens
aggctgcccctc

SEQ ID NO: 1576883 - DNA, 15 bp, Homo sapiens
aggctgcctcagcca

SEQ ID NO: 1576884 - DNA, 16 bp, Homo sapiens
aggctgcctcctgccc

SEQ ID NO: 1576885 - DNA, 18 bp, Homo sapiens
aggctgcctcctgccctt

SEQ ID NO: 1576886 - DNA, 11 bp, Homo sapiens
aggctgctgcc

SEQ ID NO: 1576887 - DNA, 23 bp, Homo sapiens
aggctgcttctctacagaggtga

SEQ ID NO: 1576888 - DNA, 13 bp, Homo sapiens
aggctgcttggga

SEQ ID NO: 1576889 - DNA, 17 bp, Homo sapiens
aggctgctttctgccct

SEQ ID NO: 1576890 - DNA, 15 bp, Homo sapiens
aggctggagactgga

SEQ ID NO: 1576891 - DNA, 15 bp, Homo sapiens
aggctggaggcaggg

SEQ ID NO: 1576892 - DNA, 18 bp, Homo sapiens
aggctggaggcagggcct

SEQ ID NO: 1576893 - DNA, 19 bp, Homo sapiens
aggctggaggcagggcctt

SEQ ID NO: 1576894 - DNA, 20 bp, Homo sapiens
aggctggagtgcagtggcat

SEQ ID NO: 1576895 - DNA, 20 bp, Homo sapiens
aggctggagtggagtggcgt

SEQ ID NO: 1576896 - DNA, 16 bp, Homo sapiens
aggctggatggcacct

SEQ ID NO: 1576897 - DNA, 21 bp, Homo sapiens
aggctggccaaggtgtccagg

SEQ ID NO: 1576898 - DNA, 15 bp, Homo sapiens
aggctggctgagtgg

SEQ ID NO: 1576899 - DNA, 18 bp, Homo sapiens
aggctggctgagtggaat

SEQ ID NO: 1576900 - DNA, 22 bp, Homo sapiens
aggctggctggcccgtcatgtt

SEQ ID NO: 1576901 - DNA, 18 bp, Homo sapiens
aggctgggaactcatctg

SEQ ID NO: 1576902 - DNA, 10 bp, Homo sapiens
aggctgggcc

SEQ ID NO: 1576903 - DNA, 21 bp, Homo sapiens
aggctgggccatgtccaaaga

SEQ ID NO: 1576904 - DNA, 17 bp, Homo sapiens
aggctgggctctgcctg

SEQ ID NO: 1576905 - DNA, 17 bp, Homo sapiens
aggctgggggagagccg

SEQ ID NO: 1576906 - DNA, 19 bp, Homo sapiens
aggctgggggagagccgtg

SEQ ID NO: 1576907 - DNA, 23 bp, Homo sapiens
aggctgggtgaccgactacccca

SEQ ID NO: 1576908 - DNA, 16 bp, Homo sapiens
aggctggtggccttgg

SEQ ID NO: 1576909 - DNA, 21 bp, Homo sapiens
aggctggtggccttgggcctt

SEQ ID NO: 1576910 - DNA, 20 bp, Homo sapiens
aggctggttttgatggctgg

SEQ ID NO: 1576911 - DNA, 17 bp, Homo sapiens
aggctgtaactgagaga

SEQ ID NO: 1576912 - DNA, 20 bp, Homo sapiens
aggctgtaactgagagaaag

SEQ ID NO: 1576913 - DNA, 21 bp, Homo sapiens
aggctgtaactgagagaaaga

SEQ ID NO: 1576914 - DNA, 23 bp, Homo sapiens
aggctgtagaaaggggagaatgt

SEQ ID NO: 1576915 - DNA, 22 bp, Homo sapiens
aggctgtattttcttttatatc

SEQ ID NO: 1576916 - DNA, 23 bp, Homo sapiens
aggctgtattttcttttatatct

SEQ ID NO: 1576917 - DNA, 20 bp, Homo sapiens
aggctgtcacagtcctgagt

SEQ ID NO: 1576918 - DNA, 15 bp, Homo sapiens
aggctgtctgcgaag

SEQ ID NO: 1576919 - DNA, 20 bp, Homo sapiens
aggctgtcttctcaggctct

SEQ ID NO: 1576920 - DNA, 23 bp, Homo sapiens
aggctgtcttctcaggctctgcc

SEQ ID NO: 1576921 - DNA, 13 bp, Homo sapiens
aggctgtgacctt

SEQ ID NO: 1576922 - DNA, 21 bp, Homo sapiens
aggctgttctgcactgaaaag

SEQ ID NO: 1576923 - DNA, 21 bp, Homo sapiens
aggctgttggttcaaactttt

SEQ ID NO: 1576924 - DNA, 17 bp, Homo sapiens
aggcttaggtcctcact

SEQ ID NO: 1576925 - DNA, 12 bp, Homo sapiens
aggcttcaccct

SEQ ID NO: 1576926 - DNA, 16 bp, Homo sapiens
aggcttcacgccggga

SEQ ID NO: 1576927 - DNA, 14 bp, Homo sapiens
aggcttccaggctc

SEQ ID NO: 1576928 - DNA, 18 bp, Homo sapiens
aggcttccaggctcttcc

SEQ ID NO: 1576929 - DNA, 20 bp, Homo sapiens
aggcttccaggctcttcctg

SEQ ID NO: 1576930 - DNA, 18 bp, Homo sapiens
aggcttcctgggtcctgc

SEQ ID NO: 1576931 - DNA, 19 bp, Homo sapiens
aggcttcctggtgagaact

SEQ ID NO: 1576932 - DNA, 20 bp, Homo sapiens
aggcttcctggtgagaactg

SEQ ID NO: 1576933 - DNA, 22 bp, Homo sapiens
aggcttctccaattctgcccaa

SEQ ID NO: 1576934 - DNA, 22 bp, Homo sapiens
aggcttctccgccagcctcctc

SEQ ID NO: 1576935 - DNA, 13 bp, Homo sapiens
aggcttctccttc

SEQ ID NO: 1576936 - DNA, 16 bp, Homo sapiens
aggcttctccttctcc

SEQ ID NO: 1576937 - DNA, 13 bp, Homo sapiens
aggcttctctcca

SEQ ID NO: 1576938 - DNA, 19 bp, Homo sapiens
aggcttctctccacagtgt

SEQ ID NO: 1576939 - DNA, 16 bp, Homo sapiens
aggcttggctgccctg

SEQ ID NO: 1576940 - DNA, 17 bp, Homo sapiens
aggcttggctgccctgt

SEQ ID NO: 1576941 - DNA, 19 bp, Homo sapiens
aggcttggggaaaatggcc

SEQ ID NO: 1576942 - DNA, 22 bp, Homo sapiens
aggcttggggaaaatggccatg

SEQ ID NO: 1576943 - DNA, 22 bp, Homo sapiens
aggcttgtttacctttctctct

SEQ ID NO: 1576944 - DNA, 23 bp, Homo sapiens
aggctttatgataatagattctc

SEQ ID NO: 1576945 - DNA, 20 bp, Homo sapiens
aggctttcactatttccttt

SEQ ID NO: 1576946 - DNA, 23 bp, Homo sapiens
aggctttcccacttcccaccctg

SEQ ID NO: 1576947 - DNA, 14 bp, Homo sapiens
aggcttttgctaga

SEQ ID NO: 1576948 - DNA, 17 bp, Homo sapiens
aggcttttttccagact

SEQ ID NO: 1576949 - DNA, 22 bp, Homo sapiens
agggaaaagataaagaccagaa

SEQ ID NO: 1576950 - DNA, 18 bp, Homo sapiens
agggaaaataggcaggaa

SEQ ID NO: 1576951 - DNA, 15 bp, Homo sapiens
agggaaactgccagc

SEQ ID NO: 1576952 - DNA, 21 bp, Homo sapiens
agggaaactgccagcaacgca

SEQ ID NO: 1576953 - DNA, 15 bp, Homo sapiens
agggaaactgggaaa

SEQ ID NO: 1576954 - DNA, 15 bp, Homo sapiens
agggaaacttcccgt

SEQ ID NO: 1576955 - DNA, 16 bp, Homo sapiens
agggaaagaattgagg

SEQ ID NO: 1576956 - DNA, 13 bp, Homo sapiens
agggaaagcctct

SEQ ID NO: 1576957 - DNA, 15 bp, Homo sapiens
agggaaagcctctgg

SEQ ID NO: 1576958 - DNA, 16 bp, Homo sapiens
agggaaagcctctggc

SEQ ID NO: 1576959 - DNA, 14 bp, Homo sapiens
agggaaaggcaagc

SEQ ID NO: 1576960 - DNA, 18 bp, Homo sapiens
agggaaaggggtgctttt

SEQ ID NO: 1576961 - DNA, 21 bp, Homo sapiens
agggaaataatagggaaaata

SEQ ID NO: 1576962 - DNA, 20 bp, Homo sapiens
agggaaatctgtaaagccag

SEQ ID NO: 1576963 - DNA, 14 bp, Homo sapiens
agggaacagacagg

SEQ ID NO: 1576964 - DNA, 17 bp, Homo sapiens
agggaacagacaggaga

SEQ ID NO: 1576965 - DNA, 19 bp, Homo sapiens
agggaacagacaggagaaa

SEQ ID NO: 1576966 - DNA, 15 bp, Homo sapiens
agggaacagccccag

SEQ ID NO: 1576967 - DNA, 14 bp, Homo sapiens
agggaacctgtgtc

SEQ ID NO: 1576968 - DNA, 14 bp, Homo sapiens
agggaactagataa

SEQ ID NO: 1576969 - DNA, 15 bp, Homo sapiens
agggaactttctgga

SEQ ID NO: 1576970 - DNA, 22 bp, Homo sapiens
agggaactttctggactcccac

SEQ ID NO: 1576971 - DNA, 15 bp, Homo sapiens
agggaagaaggagga

SEQ ID NO: 1576972 - DNA, 14 bp, Homo sapiens
agggaagagacagc

SEQ ID NO: 1576973 - DNA, 14 bp, Homo sapiens
agggaagagggcag

SEQ ID NO: 1576974 - DNA, 19 bp, Homo sapiens
agggaagcaagcctgtcct

SEQ ID NO: 1576975 - DNA, 18 bp, Homo sapiens
agggaagcccagctccag

SEQ ID NO: 1576976 - DNA, 17 bp, Homo sapiens
agggaagctcttttctc

SEQ ID NO: 1576977 - DNA, 13 bp, Homo sapiens
agggaagctggcc

SEQ ID NO: 1576978 - DNA, 16 bp, Homo sapiens
agggaagctggccgag

SEQ ID NO: 1576979 - DNA, 16 bp, Homo sapiens
agggaagctggcctga

SEQ ID NO: 1576980 - DNA, 13 bp, Homo sapiens
agggaagctggct

SEQ ID NO: 1576981 - DNA, 16 bp, Homo sapiens
agggaaggatgacaaa

SEQ ID NO: 1576982 - DNA, 13 bp, Homo sapiens
agggaaggcctga

SEQ ID NO: 1576983 - DNA, 14 bp, Homo sapiens
agggaaggtgctga

SEQ ID NO: 1576984 - DNA, 16 bp, Homo sapiens
agggaaggtggggccc

SEQ ID NO: 1576985 - DNA, 19 bp, Homo sapiens
agggaaggtggggccctgc

SEQ ID NO: 1576986 - DNA, 15 bp, Homo sapiens
agggaagtgaggccc

SEQ ID NO: 1576987 - DNA, 20 bp, Homo sapiens
agggaagtgaggcccaagga

SEQ ID NO: 1576988 - DNA, 15 bp, Homo sapiens
agggaagtggggagt

SEQ ID NO: 1576989 - DNA, 20 bp, Homo sapiens
agggaagttgctggaaagag

SEQ ID NO: 1576990 - DNA, 19 bp, Homo sapiens
agggaatccaagcctccac

SEQ ID NO: 1576991 - DNA, 16 bp, Homo sapiens
agggaatcctcctcca

SEQ ID NO: 1576992 - DNA, 18 bp, Homo sapiens
agggaatcctcctccagg

SEQ ID NO: 1576993 - DNA, 16 bp, Homo sapiens
agggaatctggattat

SEQ ID NO: 1576994 - DNA, 20 bp, Homo sapiens
agggaatgagagttccttct

SEQ ID NO: 1576995 - DNA, 14 bp, Homo sapiens
agggaatgtgaaat

SEQ ID NO: 1576996 - DNA, 13 bp, Homo sapiens
agggacaaagagg

SEQ ID NO: 1576997 - DNA, 13 bp, Homo sapiens
agggacaagggat

SEQ ID NO: 1576998 - DNA, 15 bp, Homo sapiens
agggacaagggattc

SEQ ID NO: 1576999 - DNA, 18 bp, Homo sapiens
agggacaagggattctgg

SEQ ID NO: 1577000 - DNA, 17 bp, Homo sapiens
agggacaagggggagga

SEQ ID NO: 1577001 - DNA, 20 bp, Homo sapiens
agggacacgggcagcctggc

SEQ ID NO: 1577002 - DNA, 14 bp, Homo sapiens
agggacactcctcc

SEQ ID NO: 1577003 - DNA, 15 bp, Homo sapiens
agggacactcctcct

SEQ ID NO: 1577004 - DNA, 15 bp, Homo sapiens
agggacagcaagtga

SEQ ID NO: 1577005 - DNA, 13 bp, Homo sapiens
agggacagcagcc

SEQ ID NO: 1577006 - DNA, 15 bp, Homo sapiens
agggacagcagcctc

SEQ ID NO: 1577007 - DNA, 16 bp, Homo sapiens
agggacagcagcctcc

SEQ ID NO: 1577008 - DNA, 20 bp, Homo sapiens
agggacagcccacggtctgg

SEQ ID NO: 1577009 - DNA, 22 bp, Homo sapiens
agggacagcccacggtctggag

SEQ ID NO: 1577010 - DNA, 15 bp, Homo sapiens
agggacaggagaaga

SEQ ID NO: 1577011 - DNA, 13 bp, Homo sapiens
agggacaggctga

SEQ ID NO: 1577012 - DNA, 22 bp, Homo sapiens
agggacatgccctgtgtggctg

SEQ ID NO: 1577013 - DNA, 16 bp, Homo sapiens
agggaccaactgggcc

SEQ ID NO: 1577014 - DNA, 13 bp, Homo sapiens
agggaccaaggca

SEQ ID NO: 1577015 - DNA, 17 bp, Homo sapiens
agggaccaaggcaaggc

SEQ ID NO: 1577016 - DNA, 21 bp, Homo sapiens
agggaccactgggtgagagag

SEQ ID NO: 1577017 - DNA, 23 bp, Homo sapiens
agggaccactgggtgagagagga

SEQ ID NO: 1577018 - DNA, 19 bp, Homo sapiens
agggaccagggccaccgca

SEQ ID NO: 1577019 - DNA, 16 bp, Homo sapiens
agggaccaggggagag

SEQ ID NO: 1577020 - DNA, 21 bp, Homo sapiens
agggaccatcaagaacctaca

SEQ ID NO: 1577021 - DNA, 17 bp, Homo sapiens
agggacccaggtgtgcc

SEQ ID NO: 1577022 - DNA, 20 bp, Homo sapiens
agggacccggggtctcctgg

SEQ ID NO: 1577023 - DNA, 18 bp, Homo sapiens
agggaccgagcccagcag

SEQ ID NO: 1577024 - DNA, 15 bp, Homo sapiens
agggaccggtgctgc

SEQ ID NO: 1577025 - DNA, 21 bp, Homo sapiens
agggaccggtgctgcaggagt

SEQ ID NO: 1577026 - DNA, 13 bp, Homo sapiens
agggaccttggag

SEQ ID NO: 1577027 - DNA, 23 bp, Homo sapiens
agggacctttttggtcatggagg

SEQ ID NO: 1577028 - DNA, 15 bp, Homo sapiens
agggactagtgagtc

SEQ ID NO: 1577029 - DNA, 14 bp, Homo sapiens
agggactgtcagct

SEQ ID NO: 1577030 - DNA, 17 bp, Homo sapiens
agggactgtcagctgag

SEQ ID NO: 1577031 - DNA, 12 bp, Homo sapiens
agggacttaaaa

SEQ ID NO: 1577032 - DNA, 12 bp, Homo sapiens
agggagaaaaga

SEQ ID NO: 1577033 - DNA, 13 bp, Homo sapiens
agggagaagctcc

SEQ ID NO: 1577034 - DNA, 21 bp, Homo sapiens
agggagaagtagctagtagca

SEQ ID NO: 1577035 - DNA, 21 bp, Homo sapiens
agggagaatggtgctgtttaa

SEQ ID NO: 1577036 - DNA, 15 bp, Homo sapiens
agggagacagggtag

SEQ ID NO: 1577037 - DNA, 16 bp, Homo sapiens
agggagacagggtagg

SEQ ID NO: 1577038 - DNA, 19 bp, Homo sapiens
agggagacccgtccatttg

SEQ ID NO: 1577039 - DNA, 23 bp, Homo sapiens
agggagactgtggtaggggcagg

SEQ ID NO: 1577040 - DNA, 15 bp, Homo sapiens
agggagactttctga

SEQ ID NO: 1577041 - DNA, 12 bp, Homo sapiens
agggagagaaaa

SEQ ID NO: 1577042 - DNA, 13 bp, Homo sapiens
agggagagaagat

SEQ ID NO: 1577043 - DNA, 14 bp, Homo sapiens
agggagagagaagc

SEQ ID NO: 1577044 - DNA, 21 bp, Homo sapiens
agggagagagaagcaggcaga

SEQ ID NO: 1577045 - DNA, 13 bp, Homo sapiens
agggagagggagg

SEQ ID NO: 1577046 - DNA, 14 bp, Homo sapiens
agggagagggaggt

SEQ ID NO: 1577047 - DNA, 15 bp, Homo sapiens
agggagagggcctct

SEQ ID NO: 1577048 - DNA, 21 bp, Homo sapiens
agggagagggcctctgcctgg

SEQ ID NO: 1577049 - DNA, 13 bp, Homo sapiens
agggagaggtcac

SEQ ID NO: 1577050 - DNA, 21 bp, Homo sapiens
agggagaggtcaccagctgct

SEQ ID NO: 1577051 - DNA, 18 bp, Homo sapiens
agggagcaagacagagac

SEQ ID NO: 1577052 - DNA, 16 bp, Homo sapiens
agggagcacctgtctg

SEQ ID NO: 1577053 - DNA, 13 bp, Homo sapiens
agggagcactggg

SEQ ID NO: 1577054 - DNA, 23 bp, Homo sapiens
agggagcccctcctctgagcagc

SEQ ID NO: 1577055 - DNA, 20 bp, Homo sapiens
agggagccggcggcctctcg

SEQ ID NO: 1577056 - DNA, 14 bp, Homo sapiens
agggagctctgggg

SEQ ID NO: 1577057 - DNA, 12 bp, Homo sapiens
agggagctgctc

SEQ ID NO: 1577058 - DNA, 14 bp, Homo sapiens
agggagctgctcag

SEQ ID NO: 1577059 - DNA, 14 bp, Homo sapiens
agggagctgggccc

SEQ ID NO: 1577060 - DNA, 16 bp, Homo sapiens
agggagctgggcccga

SEQ ID NO: 1577061 - DNA, 19 bp, Homo sapiens
agggaggaagatggctccc

SEQ ID NO: 1577062 - DNA, 16 bp, Homo sapiens
agggaggaggccacct

SEQ ID NO: 1577063 - DNA, 20 bp, Homo sapiens
agggaggaggccacctctcc

SEQ ID NO: 1577064 - DNA, 21 bp, Homo sapiens
agggaggaggccacctctcca

SEQ ID NO: 1577065 - DNA, 18 bp, Homo sapiens
agggaggcaacactgctg

SEQ ID NO: 1577066 - DNA, 13 bp, Homo sapiens
agggaggcactag

SEQ ID NO: 1577067 - DNA, 13 bp, Homo sapiens
agggaggcagtgg

SEQ ID NO: 1577068 - DNA, 11 bp, Homo sapiens
agggaggcccc

SEQ ID NO: 1577069 - DNA, 18 bp, Homo sapiens
agggaggcgggggctgcc

SEQ ID NO: 1577070 - DNA, 15 bp, Homo sapiens
agggaggctgggcgg

SEQ ID NO: 1577071 - DNA, 19 bp, Homo sapiens
agggagggggcgctcagga

SEQ ID NO: 1577072 - DNA, 23 bp, Homo sapiens
agggagggggcgctcaggaccca

SEQ ID NO: 1577073 - DNA, 21 bp, Homo sapiens
agggagggtgcagccctcttg

SEQ ID NO: 1577074 - DNA, 20 bp, Homo sapiens
agggaggtcactggaaaggg

SEQ ID NO: 1577075 - DNA, 17 bp, Homo sapiens
agggaggtttgtgagag

SEQ ID NO: 1577076 - DNA, 18 bp, Homo sapiens
agggaggtttgtgagagc

SEQ ID NO: 1577077 - DNA, 16 bp, Homo sapiens
agggagtacctgctgc

SEQ ID NO: 1577078 - DNA, 23 bp, Homo sapiens
agggagtggggctggggaaaggg

SEQ ID NO: 1577079 - DNA, 18 bp, Homo sapiens
agggagtggttcctgtgg

SEQ ID NO: 1577080 - DNA, 17 bp, Homo sapiens
agggagttagggagaga

SEQ ID NO: 1577081 - DNA, 17 bp, Homo sapiens
agggatcacagggcccc

SEQ ID NO: 1577082 - DNA, 16 bp, Homo sapiens
agggatctctctacaa

SEQ ID NO: 1577083 - DNA, 14 bp, Homo sapiens
agggatctgaaatc

SEQ ID NO: 1577084 - DNA, 16 bp, Homo sapiens
agggatctgaaatcca

SEQ ID NO: 1577085 - DNA, 18 bp, Homo sapiens
agggatctgaaatccata

SEQ ID NO: 1577086 - DNA, 17 bp, Homo sapiens
agggatgaagggcgagt

SEQ ID NO: 1577087 - DNA, 18 bp, Homo sapiens
agggatgatggcagagcc

SEQ ID NO: 1577088 - DNA, 20 bp, Homo sapiens
agggatgatggcagagccag

SEQ ID NO: 1577089 - DNA, 21 bp, Homo sapiens
agggatgcggatcctgctggg

SEQ ID NO: 1577090 - DNA, 17 bp, Homo sapiens
agggatgctgggctggg

SEQ ID NO: 1577091 - DNA, 16 bp, Homo sapiens
agggatggagaaagaa

SEQ ID NO: 1577092 - DNA, 18 bp, Homo sapiens
agggatggtaagttgaga

SEQ ID NO: 1577093 - DNA, 19 bp, Homo sapiens
agggatgtgggtaagagga

SEQ ID NO: 1577094 - DNA, 19 bp, Homo sapiens
agggattcaggctgcttgg

SEQ ID NO: 1577095 - DNA, 19 bp, Homo sapiens
agggattgaggggccctgg

SEQ ID NO: 1577096 - DNA, 19 bp, Homo sapiens
agggattgattttaaaatg

SEQ ID NO: 1577097 - DNA, 15 bp, Homo sapiens
agggattgctgaggc

SEQ ID NO: 1577098 - DNA, 16 bp, Homo sapiens
agggattgctgaggca

SEQ ID NO: 1577099 - DNA, 20 bp, Homo sapiens
agggattggaccgagctgga

SEQ ID NO: 1577100 - DNA, 19 bp, Homo sapiens
agggcaaacccaaaacctc

SEQ ID NO: 1577101 - DNA, 22 bp, Homo sapiens
agggcaaatgacatgcactgac

SEQ ID NO: 1577102 - DNA, 13 bp, Homo sapiens
agggcaagaaatg

SEQ ID NO: 1577103 - DNA, 20 bp, Homo sapiens
agggcaagaacccaagtgcc

SEQ ID NO: 1577104 - DNA, 22 bp, Homo sapiens
agggcaagaacccaagtgcctc

SEQ ID NO: 1577105 - DNA, 14 bp, Homo sapiens
agggcaaggagttt

SEQ ID NO: 1577106 - DNA, 21 bp, Homo sapiens
agggcaagggttaaggcctga

SEQ ID NO: 1577107 - DNA, 19 bp, Homo sapiens
agggcacacccctggggct

SEQ ID NO: 1577108 - DNA, 13 bp, Homo sapiens
agggcacagccct

SEQ ID NO: 1577109 - DNA, 21 bp, Homo sapiens
agggcacattgcccatggctg

SEQ ID NO: 1577110 - DNA, 13 bp, Homo sapiens
agggcaccagagg

SEQ ID NO: 1577111 - DNA, 17 bp, Homo sapiens
agggcaccagaggccga

SEQ ID NO: 1577112 - DNA, 21 bp, Homo sapiens
agggcaccaggggtttctcgc

SEQ ID NO: 1577113 - DNA, 16 bp, Homo sapiens
agggcacgcaggacca

SEQ ID NO: 1577114 - DNA, 17 bp, Homo sapiens
agggcacgcaggaccag

SEQ ID NO: 1577115 - DNA, 21 bp, Homo sapiens
agggcacgcaggaccagtttg

SEQ ID NO: 1577116 - DNA, 21 bp, Homo sapiens
agggcactcccaaccctgggc

SEQ ID NO: 1577117 - DNA, 14 bp, Homo sapiens
agggcactggtggc

SEQ ID NO: 1577118 - DNA, 18 bp, Homo sapiens
agggcagagaatggctgg

SEQ ID NO: 1577119 - DNA, 21 bp, Homo sapiens
agggcagagaatggctgggtc

SEQ ID NO: 1577120 - DNA, 19 bp, Homo sapiens
agggcagagccatgggcct

SEQ ID NO: 1577121 - DNA, 20 bp, Homo sapiens
agggcagagccatgggcctg

SEQ ID NO: 1577122 - DNA, 14 bp, Homo sapiens
agggcagaggctgg

SEQ ID NO: 1577123 - DNA, 17 bp, Homo sapiens
agggcagaggctggagg

SEQ ID NO: 1577124 - DNA, 22 bp, Homo sapiens
agggcagagggaatgttccctg

SEQ ID NO: 1577125 - DNA, 15 bp, Homo sapiens
agggcagagttactt

SEQ ID NO: 1577126 - DNA, 23 bp, Homo sapiens
agggcagcaagggacctgctcat

SEQ ID NO: 1577127 - DNA, 15 bp, Homo sapiens
agggcagccctccac

SEQ ID NO: 1577128 - DNA, 20 bp, Homo sapiens
agggcagccgtcacccctgc

SEQ ID NO: 1577129 - DNA, 11 bp, Homo sapiens
agggcagcttg

SEQ ID NO: 1577130 - DNA, 13 bp, Homo sapiens
agggcagcttgcc

SEQ ID NO: 1577131 - DNA, 18 bp, Homo sapiens
agggcagcttgccccggc

SEQ ID NO: 1577132 - DNA, 19 bp, Homo sapiens
agggcaggcttggggaaaa

SEQ ID NO: 1577133 - DNA, 23 bp, Homo sapiens
agggcagggcccacgtgtatagt

SEQ ID NO: 1577134 - DNA, 16 bp, Homo sapiens
agggcagggctctgat

SEQ ID NO: 1577135 - DNA, 16 bp, Homo sapiens
agggcagtacctggga

SEQ ID NO: 1577136 - DNA, 18 bp, Homo sapiens
agggcagtacctgggaaa

SEQ ID NO: 1577137 - DNA, 21 bp, Homo sapiens
agggcagtgcccatgtgtaca

SEQ ID NO: 1577138 - DNA, 22 bp, Homo sapiens
agggcagtgcccatgtgtacat

SEQ ID NO: 1577139 - DNA, 13 bp, Homo sapiens
agggcagttttct

SEQ ID NO: 1577140 - DNA, 14 bp, Homo sapiens
agggcagttttgag

SEQ ID NO: 1577141 - DNA, 13 bp, Homo sapiens
agggcatctcctg

SEQ ID NO: 1577142 - DNA, 16 bp, Homo sapiens
agggcatctcctgtgc

SEQ ID NO: 1577143 - DNA, 21 bp, Homo sapiens
agggcatctcctgtgcatggg

SEQ ID NO: 1577144 - DNA, 13 bp, Homo sapiens
agggcatcttgct

SEQ ID NO: 1577145 - DNA, 17 bp, Homo sapiens
agggcatgcgcacaagg

SEQ ID NO: 1577146 - DNA, 15 bp, Homo sapiens
agggcattgctcagc

SEQ ID NO: 1577147 - DNA, 16 bp, Homo sapiens
agggcattgctcagcc

SEQ ID NO: 1577148 - DNA, 19 bp, Homo sapiens
agggcattgctcagcccgc

SEQ ID NO: 1577149 - DNA, 19 bp, Homo sapiens
agggcatttgagaaatgca

SEQ ID NO: 1577150 - DNA, 18 bp, Homo sapiens
agggccaaagcacagctg

SEQ ID NO: 1577151 - DNA, 22 bp, Homo sapiens
agggccaaagcacagctgggca

SEQ ID NO: 1577152 - DNA, 20 bp, Homo sapiens
agggccaagagatctgtgtg

SEQ ID NO: 1577153 - DNA, 22 bp, Homo sapiens
agggccaagagatctgtgtggc

SEQ ID NO: 1577154 - DNA, 18 bp, Homo sapiens
agggccacactattacca

SEQ ID NO: 1577155 - DNA, 20 bp, Homo sapiens
agggccacgctccagctgcc

SEQ ID NO: 1577156 - DNA, 20 bp, Homo sapiens
agggccacgtgccaggcccg

SEQ ID NO: 1577157 - DNA, 23 bp, Homo sapiens
agggccactttttttttatactg

SEQ ID NO: 1577158 - DNA, 16 bp, Homo sapiens
agggccagaaggaggg

SEQ ID NO: 1577159 - DNA, 22 bp, Homo sapiens
agggccagaaggagggcagagc

SEQ ID NO: 1577160 - DNA, 18 bp, Homo sapiens
agggccagactggaagac

SEQ ID NO: 1577161 - DNA, 13 bp, Homo sapiens
agggccagagcca

SEQ ID NO: 1577162 - DNA, 23 bp, Homo sapiens
agggccagcaggctcctggctgt

SEQ ID NO: 1577163 - DNA, 14 bp, Homo sapiens
agggccagggaccc

SEQ ID NO: 1577164 - DNA, 15 bp, Homo sapiens
agggccaggtgcaga

SEQ ID NO: 1577165 - DNA, 13 bp, Homo sapiens
agggccagtcctg

SEQ ID NO: 1577166 - DNA, 21 bp, Homo sapiens
agggccagtcctgcctggcca

SEQ ID NO: 1577167 - DNA, 15 bp, Homo sapiens
agggccatctgactg

SEQ ID NO: 1577168 - DNA, 14 bp, Homo sapiens
agggccatgcagac

SEQ ID NO: 1577169 - DNA, 18 bp, Homo sapiens
agggcccagaccctgggc

SEQ ID NO: 1577170 - DNA, 17 bp, Homo sapiens
agggcccagagcccagc

SEQ ID NO: 1577171 - DNA, 14 bp, Homo sapiens
agggcccagccagg

SEQ ID NO: 1577172 - DNA, 18 bp, Homo sapiens
agggcccagcccagagcc

SEQ ID NO: 1577173 - DNA, 22 bp, Homo sapiens
agggcccagcccagagccacct

SEQ ID NO: 1577174 - DNA, 23 bp, Homo sapiens
agggcccagcccagagccacctg

SEQ ID NO: 1577175 - DNA, 22 bp, Homo sapiens
agggcccagctgtagccatggc

SEQ ID NO: 1577176 - DNA, 15 bp, Homo sapiens
agggcccaggcaggc

SEQ ID NO: 1577177 - DNA, 17 bp, Homo sapiens
agggcccatcaggcagt

SEQ ID NO: 1577178 - DNA, 17 bp, Homo sapiens
agggccccaggggcagc

SEQ ID NO: 1577179 - DNA, 14 bp, Homo sapiens
agggcccccacagg

SEQ ID NO: 1577180 - DNA, 15 bp, Homo sapiens
agggcccccggccac

SEQ ID NO: 1577181 - DNA, 13 bp, Homo sapiens
agggcccctccct

SEQ ID NO: 1577182 - DNA, 17 bp, Homo sapiens
agggcccctccctctgc

SEQ ID NO: 1577183 - DNA, 14 bp, Homo sapiens
agggcccctctgcc

SEQ ID NO: 1577184 - DNA, 17 bp, Homo sapiens
agggcccctctgcccag

SEQ ID NO: 1577185 - DNA, 18 bp, Homo sapiens
agggcccctctgcccagc

SEQ ID NO: 1577186 - DNA, 20 bp, Homo sapiens
agggcccctctgcccagctt

SEQ ID NO: 1577187 - DNA, 23 bp, Homo sapiens
agggcccctctgcccagcttggg

SEQ ID NO: 1577188 - DNA, 17 bp, Homo sapiens
agggcccggccacaccc

SEQ ID NO: 1577189 - DNA, 20 bp, Homo sapiens
agggcccggccacacccagc

SEQ ID NO: 1577190 - DNA, 16 bp, Homo sapiens
agggccctgagctcgg

SEQ ID NO: 1577191 - DNA, 13 bp, Homo sapiens
agggccctgcaga

SEQ ID NO: 1577192 - DNA, 21 bp, Homo sapiens
agggccctgtggagtccagct

SEQ ID NO: 1577193 - DNA, 23 bp, Homo sapiens
agggccctgtggagtccagctct

SEQ ID NO: 1577194 - DNA, 17 bp, Homo sapiens
agggcccttcccctccc

SEQ ID NO: 1577195 - DNA, 18 bp, Homo sapiens
agggcccttcccctcccc

SEQ ID NO: 1577196 - DNA, 20 bp, Homo sapiens
agggccgcccgggcccagag

SEQ ID NO: 1577197 - DNA, 18 bp, Homo sapiens
agggccgtaccccaccct

SEQ ID NO: 1577198 - DNA, 20 bp, Homo sapiens
agggccgtaccccaccctca

SEQ ID NO: 1577199 - DNA, 14 bp, Homo sapiens
agggcctccagggc

SEQ ID NO: 1577200 - DNA, 15 bp, Homo sapiens
agggcctccagggcc

SEQ ID NO: 1577201 - DNA, 22 bp, Homo sapiens
agggcctctccctttagtggag

SEQ ID NO: 1577202 - DNA, 15 bp, Homo sapiens
agggcctctgcctgg

SEQ ID NO: 1577203 - DNA, 17 bp, Homo sapiens
agggcctctgcctggga

SEQ ID NO: 1577204 - DNA, 18 bp, Homo sapiens
agggcctctgcctgggac

SEQ ID NO: 1577205 - DNA, 20 bp, Homo sapiens
agggcctgacaccccctccc

SEQ ID NO: 1577206 - DNA, 13 bp, Homo sapiens
agggcctgcagtg

SEQ ID NO: 1577207 - DNA, 19 bp, Homo sapiens
agggcctgcatggagaagg

SEQ ID NO: 1577208 - DNA, 16 bp, Homo sapiens
agggcctgctggaggc

SEQ ID NO: 1577209 - DNA, 17 bp, Homo sapiens
agggcctgctggaggcc

SEQ ID NO: 1577210 - DNA, 14 bp, Homo sapiens
agggcctggccagt

SEQ ID NO: 1577211 - DNA, 18 bp, Homo sapiens
agggcctggccagtcctg

SEQ ID NO: 1577212 - DNA, 20 bp, Homo sapiens
agggcctggccagtcctggt

SEQ ID NO: 1577213 - DNA, 14 bp, Homo sapiens
agggcctgggcctc

SEQ ID NO: 1577214 - DNA, 16 bp, Homo sapiens
agggcctgggcctcat

SEQ ID NO: 1577215 - DNA, 14 bp, Homo sapiens
agggcctgggggca

SEQ ID NO: 1577216 - DNA, 17 bp, Homo sapiens
agggcctgggggcagtg

SEQ ID NO: 1577217 - DNA, 23 bp, Homo sapiens
agggcctgggggcagtgactggc

SEQ ID NO: 1577218 - DNA, 12 bp, Homo sapiens
agggcctgtggg

SEQ ID NO: 1577219 - DNA, 12 bp, Homo sapiens
agggccttgccc

SEQ ID NO: 1577220 - DNA, 14 bp, Homo sapiens
agggccttgcccag

SEQ ID NO: 1577221 - DNA, 20 bp, Homo sapiens
agggccttttctgtgccaga

SEQ ID NO: 1577222 - DNA, 21 bp, Homo sapiens
agggccttttctgtgccagac

SEQ ID NO: 1577223 - DNA, 18 bp, Homo sapiens
agggcgagcggcaaaggc

SEQ ID NO: 1577224 - DNA, 13 bp, Homo sapiens
agggcgagtgaat

SEQ ID NO: 1577225 - DNA, 17 bp, Homo sapiens
agggcgccgccggccct

SEQ ID NO: 1577226 - DNA, 21 bp, Homo sapiens
agggcgctcagacggcggcca

SEQ ID NO: 1577227 - DNA, 20 bp, Homo sapiens
agggcgggcagagggctgga

SEQ ID NO: 1577228 - DNA, 22 bp, Homo sapiens
agggcgttctaggtaggaagag

SEQ ID NO: 1577229 - DNA, 14 bp, Homo sapiens
agggctaagagcta

SEQ ID NO: 1577230 - DNA, 20 bp, Homo sapiens
agggctagggaggtggggta

SEQ ID NO: 1577231 - DNA, 18 bp, Homo sapiens
agggctagtagaactgga

SEQ ID NO: 1577232 - DNA, 12 bp, Homo sapiens
agggctcagcct

SEQ ID NO: 1577233 - DNA, 13 bp, Homo sapiens
agggctcagcctg

SEQ ID NO: 1577234 - DNA, 20 bp, Homo sapiens
agggctccagcccctcttgg

SEQ ID NO: 1577235 - DNA, 14 bp, Homo sapiens
agggctcccagggg

SEQ ID NO: 1577236 - DNA, 20 bp, Homo sapiens
agggctcgaggggtgggctg

SEQ ID NO: 1577237 - DNA, 17 bp, Homo sapiens
agggctcgggagccatg

SEQ ID NO: 1577238 - DNA, 22 bp, Homo sapiens
agggctctgatattccatgaat

SEQ ID NO: 1577239 - DNA, 12 bp, Homo sapiens
agggctctgcag

SEQ ID NO: 1577240 - DNA, 19 bp, Homo sapiens
agggctgacctgcctctca

SEQ ID NO: 1577241 - DNA, 18 bp, Homo sapiens
agggctgcaatgccctca

SEQ ID NO: 1577242 - DNA, 16 bp, Homo sapiens
agggctgcacattgcc

SEQ ID NO: 1577243 - DNA, 11 bp, Homo sapiens
agggctgcagg

SEQ ID NO: 1577244 - DNA, 12 bp, Homo sapiens
agggctgcatga

SEQ ID NO: 1577245 - DNA, 17 bp, Homo sapiens
agggctgccgggccagg

SEQ ID NO: 1577246 - DNA, 22 bp, Homo sapiens
agggctggacctatgtcctaag

SEQ ID NO: 1577247 - DNA, 18 bp, Homo sapiens
agggctggactgaggcct

SEQ ID NO: 1577248 - DNA, 20 bp, Homo sapiens
agggctggactgaggcctga

SEQ ID NO: 1577249 - DNA, 16 bp, Homo sapiens
agggctggaggcccag

SEQ ID NO: 1577250 - DNA, 19 bp, Homo sapiens
agggctggaggcccaggct

SEQ ID NO: 1577251 - DNA, 21 bp, Homo sapiens
agggctggaggcccaggctgg

SEQ ID NO: 1577252 - DNA, 12 bp, Homo sapiens
agggctggctgg

SEQ ID NO: 1577253 - DNA, 20 bp, Homo sapiens
agggctggctggcctcaccc

SEQ ID NO: 1577254 - DNA, 18 bp, Homo sapiens
agggctgggaggaaggac

SEQ ID NO: 1577255 - DNA, 21 bp, Homo sapiens
agggctgttggacagctgctt

SEQ ID NO: 1577256 - DNA, 15 bp, Homo sapiens
agggcttactatttc

SEQ ID NO: 1577257 - DNA, 16 bp, Homo sapiens
agggcttattgactct

SEQ ID NO: 1577258 - DNA, 22 bp, Homo sapiens
agggcttcctctagaagccaag

SEQ ID NO: 1577259 - DNA, 15 bp, Homo sapiens
agggcttggcccagc

SEQ ID NO: 1577260 - DNA, 18 bp, Homo sapiens
agggcttggcccagcgcc

SEQ ID NO: 1577261 - DNA, 22 bp, Homo sapiens
agggctttgagggtggaaggat

SEQ ID NO: 1577262 - DNA, 19 bp, Homo sapiens
agggctttggttccttctc

SEQ ID NO: 1577263 - DNA, 20 bp, Homo sapiens
agggctttggttccttctct

SEQ ID NO: 1577264 - DNA, 14 bp, Homo sapiens
agggcttttcaaaa

SEQ ID NO: 1577265 - DNA, 13 bp, Homo sapiens
aggggaaaaatgg

SEQ ID NO: 1577266 - DNA, 20 bp, Homo sapiens
aggggaaaccagtgtagcct

SEQ ID NO: 1577267 - DNA, 23 bp, Homo sapiens
aggggaaaccagtgtagccttgc

SEQ ID NO: 1577268 - DNA, 18 bp, Homo sapiens
aggggaagaccaaagttt

SEQ ID NO: 1577269 - DNA, 11 bp, Homo sapiens
aggggaaggaa

SEQ ID NO: 1577270 - DNA, 19 bp, Homo sapiens
aggggaaggaaggagggca

SEQ ID NO: 1577271 - DNA, 17 bp, Homo sapiens
aggggaaggagaagtaa

SEQ ID NO: 1577272 - DNA, 14 bp, Homo sapiens
aggggaagggccag

SEQ ID NO: 1577273 - DNA, 21 bp, Homo sapiens
aggggaagggctttgagggtg

SEQ ID NO: 1577274 - DNA, 18 bp, Homo sapiens
aggggaataatagaagaa

SEQ ID NO: 1577275 - DNA, 16 bp, Homo sapiens
aggggaattttctctc

SEQ ID NO: 1577276 - DNA, 14 bp, Homo sapiens
aggggacaaggaag

SEQ ID NO: 1577277 - DNA, 23 bp, Homo sapiens
aggggacaagggaggcagtggct

SEQ ID NO: 1577278 - DNA, 18 bp, Homo sapiens
aggggacacctgtacatt

SEQ ID NO: 1577279 - DNA, 23 bp, Homo sapiens
aggggacacttccctctgtttct

SEQ ID NO: 1577280 - DNA, 21 bp, Homo sapiens
aggggacattttctggattct

SEQ ID NO: 1577281 - DNA, 21 bp, Homo sapiens
aggggaccaattctggacaga

SEQ ID NO: 1577282 - DNA, 22 bp, Homo sapiens
aggggactcagccctgaggtga

SEQ ID NO: 1577283 - DNA, 15 bp, Homo sapiens
aggggagagcctgct

SEQ ID NO: 1577284 - DNA, 17 bp, Homo sapiens
aggggagagcctgctgg

SEQ ID NO: 1577285 - DNA, 23 bp, Homo sapiens
aggggagcaaaatcgatgcagtg

SEQ ID NO: 1577286 - DNA, 12 bp, Homo sapiens
aggggagccagc

SEQ ID NO: 1577287 - DNA, 15 bp, Homo sapiens
aggggagccagctgc

SEQ ID NO: 1577288 - DNA, 18 bp, Homo sapiens
aggggagccagctgcttg

SEQ ID NO: 1577289 - DNA, 19 bp, Homo sapiens
aggggagccagctgcttga

SEQ ID NO: 1577290 - DNA, 21 bp, Homo sapiens
aggggagcccactgtcctggg

SEQ ID NO: 1577291 - DNA, 20 bp, Homo sapiens
aggggaggaaaaaagaacca

SEQ ID NO: 1577292 - DNA, 23 bp, Homo sapiens
aggggaggaaaaaagaaccaaaa

SEQ ID NO: 1577293 - DNA, 14 bp, Homo sapiens
aggggaggcacact

SEQ ID NO: 1577294 - DNA, 23 bp, Homo sapiens
aggggaggcacactttctggcaa

SEQ ID NO: 1577295 - DNA, 22 bp, Homo sapiens
aggggaggcacctccaggcagg

SEQ ID NO: 1577296 - DNA, 22 bp, Homo sapiens
aggggaggggcctagggagccg

SEQ ID NO: 1577297 - DNA, 21 bp, Homo sapiens
aggggatatttaaggtagctt

SEQ ID NO: 1577298 - DNA, 16 bp, Homo sapiens
aggggatccagccact

SEQ ID NO: 1577299 - DNA, 19 bp, Homo sapiens
aggggatgaggggcttcct

SEQ ID NO: 1577300 - DNA, 20 bp, Homo sapiens
aggggcaacgaagaaaaaaa

SEQ ID NO: 1577301 - DNA, 16 bp, Homo sapiens
aggggcaagctaggcc

SEQ ID NO: 1577302 - DNA, 18 bp, Homo sapiens
aggggcaagctaggcccc

SEQ ID NO: 1577303 - DNA, 11 bp, Homo sapiens
aggggcacacc

SEQ ID NO: 1577304 - DNA, 19 bp, Homo sapiens
aggggcacttcattgagag

SEQ ID NO: 1577305 - DNA, 17 bp, Homo sapiens
aggggcagaaaaactct

SEQ ID NO: 1577306 - DNA, 15 bp, Homo sapiens
aggggcagcaaggcc

SEQ ID NO: 1577307 - DNA, 13 bp, Homo sapiens
aggggcagcagga

SEQ ID NO: 1577308 - DNA, 14 bp, Homo sapiens
aggggcagcaggag

SEQ ID NO: 1577309 - DNA, 22 bp, Homo sapiens
aggggcagcaggaggagtggaa

SEQ ID NO: 1577310 - DNA, 13 bp, Homo sapiens
aggggcagccaca

SEQ ID NO: 1577311 - DNA, 14 bp, Homo sapiens
aggggcagccacac

SEQ ID NO: 1577312 - DNA, 16 bp, Homo sapiens
aggggcagccacacca

SEQ ID NO: 1577313 - DNA, 18 bp, Homo sapiens
aggggcagcctgtgcctg

SEQ ID NO: 1577314 - DNA, 15 bp, Homo sapiens
aggggcaggactgag

SEQ ID NO: 1577315 - DNA, 12 bp, Homo sapiens
aggggcaggcct

SEQ ID NO: 1577316 - DNA, 16 bp, Homo sapiens
aggggcaggcctggga

SEQ ID NO: 1577317 - DNA, 21 bp, Homo sapiens
aggggcaggcctgggacccag

SEQ ID NO: 1577318 - DNA, 16 bp, Homo sapiens
aggggcagggaaggac

SEQ ID NO: 1577319 - DNA, 23 bp, Homo sapiens
aggggcagggaaggacaggaccc

SEQ ID NO: 1577320 - DNA, 22 bp, Homo sapiens
aggggcaggtgtttctttcctg

SEQ ID NO: 1577321 - DNA, 16 bp, Homo sapiens
aggggcatctgcccct

SEQ ID NO: 1577322 - DNA, 19 bp, Homo sapiens
aggggcatctgcccctccc

SEQ ID NO: 1577323 - DNA, 20 bp, Homo sapiens
aggggcatctgcccctcccc

SEQ ID NO: 1577324 - DNA, 21 bp, Homo sapiens
aggggcatctgcccctccccc

SEQ ID NO: 1577325 - DNA, 21 bp, Homo sapiens
aggggcatgtattggcctgga

SEQ ID NO: 1577326 - DNA, 12 bp, Homo sapiens
aggggccacctc

SEQ ID NO: 1577327 - DNA, 15 bp, Homo sapiens
aggggccacctcctc

SEQ ID NO: 1577328 - DNA, 20 bp, Homo sapiens
aggggccacctcctccccct

SEQ ID NO: 1577329 - DNA, 21 bp, Homo sapiens
aggggccacctcctccccctg

SEQ ID NO: 1577330 - DNA, 21 bp, Homo sapiens
aggggccacgtggatgggcaa

SEQ ID NO: 1577331 - DNA, 13 bp, Homo sapiens
aggggccagggct

SEQ ID NO: 1577332 - DNA, 20 bp, Homo sapiens
aggggcccaagccccatctc

SEQ ID NO: 1577333 - DNA, 20 bp, Homo sapiens
aggggccccagatctgcctg

SEQ ID NO: 1577334 - DNA, 19 bp, Homo sapiens
aggggcccccgtgttcagg

SEQ ID NO: 1577335 - DNA, 22 bp, Homo sapiens
aggggccccggggctggcaagc

SEQ ID NO: 1577336 - DNA, 17 bp, Homo sapiens
aggggccggccctgtgt

SEQ ID NO: 1577337 - DNA, 15 bp, Homo sapiens
aggggccgtgtcccg

SEQ ID NO: 1577338 - DNA, 15 bp, Homo sapiens
aggggcctagggagc

SEQ ID NO: 1577339 - DNA, 12 bp, Homo sapiens
aggggcctctgt

SEQ ID NO: 1577340 - DNA, 12 bp, Homo sapiens
aggggcctgagt

SEQ ID NO: 1577341 - DNA, 13 bp, Homo sapiens
aggggcctgagtg

SEQ ID NO: 1577342 - DNA, 12 bp, Homo sapiens
aggggcctgcag

SEQ ID NO: 1577343 - DNA, 15 bp, Homo sapiens
aggggcctgcagaag

SEQ ID NO: 1577344 - DNA, 14 bp, Homo sapiens
aggggcctggaggt

SEQ ID NO: 1577345 - DNA, 16 bp, Homo sapiens
aggggcgctggcccag

SEQ ID NO: 1577346 - DNA, 17 bp, Homo sapiens
aggggcgctggcccagc

SEQ ID NO: 1577347 - DNA, 21 bp, Homo sapiens
aggggcgctggcccagccggc

SEQ ID NO: 1577348 - DNA, 13 bp, Homo sapiens
aggggcggggcag

SEQ ID NO: 1577349 - DNA, 14 bp, Homo sapiens
aggggctcctggaa

SEQ ID NO: 1577350 - DNA, 23 bp, Homo sapiens
aggggctcctggaaaggctcagt

SEQ ID NO: 1577351 - DNA, 20 bp, Homo sapiens
aggggctgaaagaacatgga

SEQ ID NO: 1577352 - DNA, 11 bp, Homo sapiens
aggggctgctg

SEQ ID NO: 1577353 - DNA, 16 bp, Homo sapiens
aggggctgctggggca

SEQ ID NO: 1577354 - DNA, 16 bp, Homo sapiens
aggggctgcttcctcc

SEQ ID NO: 1577355 - DNA, 18 bp, Homo sapiens
aggggctgcttcctcctg

SEQ ID NO: 1577356 - DNA, 14 bp, Homo sapiens
aggggctggggact

SEQ ID NO: 1577357 - DNA, 21 bp, Homo sapiens
aggggctggggacttgtgtct

SEQ ID NO: 1577358 - DNA, 21 bp, Homo sapiens
aggggctttctcttccccttc

SEQ ID NO: 1577359 - DNA, 14 bp, Homo sapiens
aggggctttctgga

SEQ ID NO: 1577360 - DNA, 22 bp, Homo sapiens
aggggcttttcccaccttcacc

SEQ ID NO: 1577361 - DNA, 15 bp, Homo sapiens
agggggaagagaaat

SEQ ID NO: 1577362 - DNA, 22 bp, Homo sapiens
agggggaaggtggggtcctgga

SEQ ID NO: 1577363 - DNA, 18 bp, Homo sapiens
agggggacgtttctggaa

SEQ ID NO: 1577364 - DNA, 22 bp, Homo sapiens
agggggagggggttacaaactg

SEQ ID NO: 1577365 - DNA, 18 bp, Homo sapiens
agggggccccgccagggc

SEQ ID NO: 1577366 - DNA, 22 bp, Homo sapiens
agggggccccgccagggctggg

SEQ ID NO: 1577367 - DNA, 19 bp, Homo sapiens
agggggccctgccccaccc

SEQ ID NO: 1577368 - DNA, 20 bp, Homo sapiens
agggggccctgccccacccc

SEQ ID NO: 1577369 - DNA, 12 bp, Homo sapiens
agggggcctgga

SEQ ID NO: 1577370 - DNA, 19 bp, Homo sapiens
agggggcgctcaggaccca

SEQ ID NO: 1577371 - DNA, 22 bp, Homo sapiens
agggggcgctcaggacccaggc

SEQ ID NO: 1577372 - DNA, 21 bp, Homo sapiens
agggggctctccaaaggggct

SEQ ID NO: 1577373 - DNA, 21 bp, Homo sapiens
agggggctctgccccaggccc

SEQ ID NO: 1577374 - DNA, 18 bp, Homo sapiens
agggggcttgaagccaaa

SEQ ID NO: 1577375 - DNA, 12 bp, Homo sapiens
aggggggagggg

SEQ ID NO: 1577376 - DNA, 13 bp, Homo sapiens
agggggtctctgt

SEQ ID NO: 1577377 - DNA, 14 bp, Homo sapiens
agggggtgactgga

SEQ ID NO: 1577378 - DNA, 15 bp, Homo sapiens
agggggtgactggaa

SEQ ID NO: 1577379 - DNA, 15 bp, Homo sapiens
agggggtggaggggt

SEQ ID NO: 1577380 - DNA, 16 bp, Homo sapiens
agggggtgggctgtca

SEQ ID NO: 1577381 - DNA, 19 bp, Homo sapiens
agggggtggttattggact

SEQ ID NO: 1577382 - DNA, 21 bp, Homo sapiens
agggggtggttattggactcc

SEQ ID NO: 1577383 - DNA, 19 bp, Homo sapiens
agggggtgtgcgtgcgtgt

SEQ ID NO: 1577384 - DNA, 14 bp, Homo sapiens
agggggttacaaac

SEQ ID NO: 1577385 - DNA, 22 bp, Homo sapiens
aggggtatgttccctcttgtcc

SEQ ID NO: 1577386 - DNA, 14 bp, Homo sapiens
aggggtcaggtgtc

SEQ ID NO: 1577387 - DNA, 18 bp, Homo sapiens
aggggtcccagccacccc

SEQ ID NO: 1577388 - DNA, 18 bp, Homo sapiens
aggggtctccctggctcc

SEQ ID NO: 1577389 - DNA, 20 bp, Homo sapiens
aggggtgccccctcctctcc

SEQ ID NO: 1577390 - DNA, 20 bp, Homo sapiens
aggggtggagactgcttccc

SEQ ID NO: 1577391 - DNA, 19 bp, Homo sapiens
aggggtgggcctgtgaatc

SEQ ID NO: 1577392 - DNA, 14 bp, Homo sapiens
aggggtgggctggt

SEQ ID NO: 1577393 - DNA, 13 bp, Homo sapiens
aggggtggggagc

SEQ ID NO: 1577394 - DNA, 16 bp, Homo sapiens
aggggtgggggtgccg

SEQ ID NO: 1577395 - DNA, 22 bp, Homo sapiens
aggggtgggggtgccgctgtct

SEQ ID NO: 1577396 - DNA, 20 bp, Homo sapiens
aggggtgggttcctcttccc

SEQ ID NO: 1577397 - DNA, 13 bp, Homo sapiens
aggggtggtcctg

SEQ ID NO: 1577398 - DNA, 24 bp, Homo sapiens
aggggtgtcttgggcagagctggc

SEQ ID NO: 1577399 - DNA, 18 bp, Homo sapiens
aggggtgtggcagtggtt

SEQ ID NO: 1577400 - DNA, 18 bp, Homo sapiens
aggggttaacttggtcag

SEQ ID NO: 1577401 - DNA, 14 bp, Homo sapiens
aggggttcctcaaa

SEQ ID NO: 1577402 - DNA, 20 bp, Homo sapiens
aggggttctatttattcctg

SEQ ID NO: 1577403 - DNA, 21 bp, Homo sapiens
aggggttctatttattcctgt

SEQ ID NO: 1577404 - DNA, 19 bp, Homo sapiens
aggggttggttgaggtgga

SEQ ID NO: 1577405 - DNA, 23 bp, Homo sapiens
agggtaaatcagtaagaggtgtt

SEQ ID NO: 1577406 - DNA, 17 bp, Homo sapiens
agggtacccgcctgagc

SEQ ID NO: 1577407 - DNA, 22 bp, Homo sapiens
agggtacccgcctgagctcctg

SEQ ID NO: 1577408 - DNA, 19 bp, Homo sapiens
agggtaccttgaacactgg

SEQ ID NO: 1577409 - DNA, 15 bp, Homo sapiens
agggtagcaggtacc

SEQ ID NO: 1577410 - DNA, 20 bp, Homo sapiens
agggtatccaagttggactg

SEQ ID NO: 1577411 - DNA, 22 bp, Homo sapiens
agggtatccaagttggactggg

SEQ ID NO: 1577412 - DNA, 18 bp, Homo sapiens
agggtcaggagaggggca

SEQ ID NO: 1577413 - DNA, 17 bp, Homo sapiens
agggtcaggcggagctg

SEQ ID NO: 1577414 - DNA, 19 bp, Homo sapiens
agggtccaaccagacctgg

SEQ ID NO: 1577415 - DNA, 19 bp, Homo sapiens
agggtccccgagtgcctag

SEQ ID NO: 1577416 - DNA, 20 bp, Homo sapiens
agggtccccgagtgcctagg

SEQ ID NO: 1577417 - DNA, 12 bp, Homo sapiens
agggtccctctg

SEQ ID NO: 1577418 - DNA, 15 bp, Homo sapiens
agggtccgcaccagc

SEQ ID NO: 1577419 - DNA, 16 bp, Homo sapiens
agggtccgcaccagct

SEQ ID NO: 1577420 - DNA, 18 bp, Homo sapiens
agggtccgcaccagctgc

SEQ ID NO: 1577421 - DNA, 20 bp, Homo sapiens
agggtccgcaccagctgctc

SEQ ID NO: 1577422 - DNA, 23 bp, Homo sapiens
agggtccgcaccagctgctctgc

SEQ ID NO: 1577423 - DNA, 24 bp, Homo sapiens
agggtccgcaccagctgctctgcc

SEQ ID NO: 1577424 - DNA, 20 bp, Homo sapiens
agggtcctttagtacctgaa

SEQ ID NO: 1577425 - DNA, 17 bp, Homo sapiens
agggtccttttgacact

SEQ ID NO: 1577426 - DNA, 22 bp, Homo sapiens
agggtccttttgacactgctct

SEQ ID NO: 1577427 - DNA, 15 bp, Homo sapiens
agggtctagggagag

SEQ ID NO: 1577428 - DNA, 17 bp, Homo sapiens
agggtctctctccaggt

SEQ ID NO: 1577429 - DNA, 20 bp, Homo sapiens
agggtctctctccaggtcag

SEQ ID NO: 1577430 - DNA, 23 bp, Homo sapiens
agggtctctctccaggtcagcct

SEQ ID NO: 1577431 - DNA, 13 bp, Homo sapiens
agggtctgctctt

SEQ ID NO: 1577432 - DNA, 14 bp, Homo sapiens
agggtctgctcttt

SEQ ID NO: 1577433 - DNA, 20 bp, Homo sapiens
agggtctgctctttctctgc

SEQ ID NO: 1577434 - DNA, 14 bp, Homo sapiens
agggtctggagaag

SEQ ID NO: 1577435 - DNA, 15 bp, Homo sapiens
agggtctggagaagc

SEQ ID NO: 1577436 - DNA, 13 bp, Homo sapiens
agggtctgggaca

SEQ ID NO: 1577437 - DNA, 19 bp, Homo sapiens
agggtcttggctgcctgtg

SEQ ID NO: 1577438 - DNA, 18 bp, Homo sapiens
agggtcttgggctactgg

SEQ ID NO: 1577439 - DNA, 15 bp, Homo sapiens
agggtgaaaattatt

SEQ ID NO: 1577440 - DNA, 19 bp, Homo sapiens
agggtgaaacttaaaaaaa

SEQ ID NO: 1577441 - DNA, 17 bp, Homo sapiens
agggtgacagcttcctt

SEQ ID NO: 1577442 - DNA, 19 bp, Homo sapiens
agggtgacgcccagctccg

SEQ ID NO: 1577443 - DNA, 22 bp, Homo sapiens
agggtgatgggaaagcattgta

SEQ ID NO: 1577444 - DNA, 20 bp, Homo sapiens
agggtgcagccctcttgccc

SEQ ID NO: 1577445 - DNA, 19 bp, Homo sapiens
agggtggaaataatttgaa

SEQ ID NO: 1577446 - DNA, 23 bp, Homo sapiens
agggtggaggaaggtgctgagct

SEQ ID NO: 1577447 - DNA, 19 bp, Homo sapiens
agggtggatgacagggcag

SEQ ID NO: 1577448 - DNA, 15 bp, Homo sapiens
agggtggcactggga

SEQ ID NO: 1577449 - DNA, 14 bp, Homo sapiens
agggtggcaggtca

SEQ ID NO: 1577450 - DNA, 15 bp, Homo sapiens
agggtggcaggtcac

SEQ ID NO: 1577451 - DNA, 18 bp, Homo sapiens
agggtggcccttgcagtt

SEQ ID NO: 1577452 - DNA, 14 bp, Homo sapiens
agggtggcctgttc

SEQ ID NO: 1577453 - DNA, 18 bp, Homo sapiens
agggtggcctgttcccta

SEQ ID NO: 1577454 - DNA, 17 bp, Homo sapiens
agggtgggaagaaagaa

SEQ ID NO: 1577455 - DNA, 16 bp, Homo sapiens
agggtgggagagccca

SEQ ID NO: 1577456 - DNA, 19 bp, Homo sapiens
agggtgggagagcccagcc

SEQ ID NO: 1577457 - DNA, 17 bp, Homo sapiens
agggtgggatggaggag

SEQ ID NO: 1577458 - DNA, 15 bp, Homo sapiens
agggtggggagggag

SEQ ID NO: 1577459 - DNA, 20 bp, Homo sapiens
agggtggttcaacaaagaaa

SEQ ID NO: 1577460 - DNA, 15 bp, Homo sapiens
agggtgtaggggcca

SEQ ID NO: 1577461 - DNA, 18 bp, Homo sapiens
agggtgtaggggccacct

SEQ ID NO: 1577462 - DNA, 19 bp, Homo sapiens
agggtgtaggggccacctc

SEQ ID NO: 1577463 - DNA, 14 bp, Homo sapiens
agggtgtatagtgt

SEQ ID NO: 1577464 - DNA, 15 bp, Homo sapiens
agggtgtatagtgtt

SEQ ID NO: 1577465 - DNA, 17 bp, Homo sapiens
agggtgtatctagctct

SEQ ID NO: 1577466 - DNA, 18 bp, Homo sapiens
agggtgtggtatgagggg

SEQ ID NO: 1577467 - DNA, 16 bp, Homo sapiens
agggttaaggcctgaa

SEQ ID NO: 1577468 - DNA, 22 bp, Homo sapiens
agggttcaaaatgtctgtagct

SEQ ID NO: 1577469 - DNA, 16 bp, Homo sapiens
agggttcacacagccc

SEQ ID NO: 1577470 - DNA, 15 bp, Homo sapiens
agggttctgccctgc

SEQ ID NO: 1577471 - DNA, 20 bp, Homo sapiens
agggttctgccctgcctgag

SEQ ID NO: 1577472 - DNA, 21 bp, Homo sapiens
agggttctgccctgcctgagg

SEQ ID NO: 1577473 - DNA, 22 bp, Homo sapiens
agggttctgccctgcctgagga

SEQ ID NO: 1577474 - DNA, 21 bp, Homo sapiens
agggttgaaggcagtctgaac

SEQ ID NO: 1577475 - DNA, 15 bp, Homo sapiens
agggttgggcccaga

SEQ ID NO: 1577476 - DNA, 13 bp, Homo sapiens
agggttggggggt

SEQ ID NO: 1577477 - DNA, 14 bp, Homo sapiens
agggtttcgactgg

SEQ ID NO: 1577478 - DNA, 19 bp, Homo sapiens
agggtttcgactggtccag

SEQ ID NO: 1577479 - DNA, 23 bp, Homo sapiens
agggtttcgactggtccagctct

SEQ ID NO: 1577480 - DNA, 14 bp, Homo sapiens
agggtttgtggctg

SEQ ID NO: 1577481 - DNA, 21 bp, Homo sapiens
aggtgaaagggagctatcagg

SEQ ID NO: 1577482 - DNA, 14 bp, Homo sapiens
aggtgaagaatctt

SEQ ID NO: 1577483 - DNA, 13 bp, Homo sapiens
aggtgaagcacat

SEQ ID NO: 1577484 - DNA, 14 bp, Homo sapiens
aggtgaagcacata

SEQ ID NO: 1577485 - DNA, 13 bp, Homo sapiens
aggtgactgtgct

SEQ ID NO: 1577486 - DNA, 15 bp, Homo sapiens
aggtgagaaaaaaac

SEQ ID NO: 1577487 - DNA, 14 bp, Homo sapiens
aggtgagcaggcag

SEQ ID NO: 1577488 - DNA, 23 bp, Homo sapiens
aggtgagcaggcagggctgggcc

SEQ ID NO: 1577489 - DNA, 13 bp, Homo sapiens
aggtgaggcagaa

SEQ ID NO: 1577490 - DNA, 19 bp, Homo sapiens
aggtgagtttgagctgcct

SEQ ID NO: 1577491 - DNA, 14 bp, Homo sapiens
aggtgataaaatca

SEQ ID NO: 1577492 - DNA, 12 bp, Homo sapiens
aggtgataaaga

SEQ ID NO: 1577493 - DNA, 15 bp, Homo sapiens
aggtgataagggaaa

SEQ ID NO: 1577494 - DNA, 16 bp, Homo sapiens
aggtgatagcattgct

SEQ ID NO: 1577495 - DNA, 21 bp, Homo sapiens
aggtgatctgtttgaggagag

SEQ ID NO: 1577496 - DNA, 18 bp, Homo sapiens
aggtgatgccattacaga

SEQ ID NO: 1577497 - DNA, 19 bp, Homo sapiens
aggtgatggaggtatttga

SEQ ID NO: 1577498 - DNA, 19 bp, Homo sapiens
aggtgatgtttccagctgc

SEQ ID NO: 1577499 - DNA, 23 bp, Homo sapiens
aggtgatgtttccagctgccaag

SEQ ID NO: 1577500 - DNA, 19 bp, Homo sapiens
aggtgcaatttcaaggttc

SEQ ID NO: 1577501 - DNA, 21 bp, Homo sapiens
aggtgcaatttcaaggttcta

SEQ ID NO: 1577502 - DNA, 11 bp, Homo sapiens
aggtgcagagg

SEQ ID NO: 1577503 - DNA, 17 bp, Homo sapiens
aggtgcagagtgcccag

SEQ ID NO: 1577504 - DNA, 19 bp, Homo sapiens
aggtgcagagtgcccagaa

SEQ ID NO: 1577505 - DNA, 16 bp, Homo sapiens
aggtgcagatgggctg

SEQ ID NO: 1577506 - DNA, 23 bp, Homo sapiens
aggtgcaggggaagaccaaagtt

SEQ ID NO: 1577507 - DNA, 11 bp, Homo sapiens
aggtgcagtgg

SEQ ID NO: 1577508 - DNA, 21 bp, Homo sapiens
aggtgcatctggggaactaga

SEQ ID NO: 1577509 - DNA, 12 bp, Homo sapiens
aggtgccaccac

SEQ ID NO: 1577510 - DNA, 13 bp, Homo sapiens
aggtgccaccacc

SEQ ID NO: 1577511 - DNA, 20 bp, Homo sapiens
aggtgccaccaccctgcccc

SEQ ID NO: 1577512 - DNA, 17 bp, Homo sapiens
aggtgccactccctgag

SEQ ID NO: 1577513 - DNA, 18 bp, Homo sapiens
aggtgccactccctgagc

SEQ ID NO: 1577514 - DNA, 15 bp, Homo sapiens
aggtgccatctcagg

SEQ ID NO: 1577515 - DNA, 15 bp, Homo sapiens
aggtgccatgcctgc

SEQ ID NO: 1577516 - DNA, 19 bp, Homo sapiens
aggtgccctttagccagat

SEQ ID NO: 1577517 - DNA, 15 bp, Homo sapiens
aggtgccgtgagcag

SEQ ID NO: 1577518 - DNA, 17 bp, Homo sapiens
aggtgccgtgagcaggc

SEQ ID NO: 1577519 - DNA, 19 bp, Homo sapiens
aggtgccgtgagcaggctt

SEQ ID NO: 1577520 - DNA, 17 bp, Homo sapiens
aggtgcctcacgcctgt

SEQ ID NO: 1577521 - DNA, 20 bp, Homo sapiens
aggtgcctcagactccgccc

SEQ ID NO: 1577522 - DNA, 21 bp, Homo sapiens
aggtgcctcagttttccttct

SEQ ID NO: 1577523 - DNA, 23 bp, Homo sapiens
aggtgcctcagttttccttctgt

SEQ ID NO: 1577524 - DNA, 18 bp, Homo sapiens
aggtgcctgtcccacccc

SEQ ID NO: 1577525 - DNA, 17 bp, Homo sapiens
aggtgcctgtgaggcag

SEQ ID NO: 1577526 - DNA, 22 bp, Homo sapiens
aggtgcctgtgaggcaggggcg

SEQ ID NO: 1577527 - DNA, 22 bp, Homo sapiens
aggtgccttacatcttttctaa

SEQ ID NO: 1577528 - DNA, 17 bp, Homo sapiens
aggtgcgctcacctcag

SEQ ID NO: 1577529 - DNA, 15 bp, Homo sapiens
aggtgctaacataga

SEQ ID NO: 1577530 - DNA, 18 bp, Homo sapiens
aggtgctacaaaaacaca

SEQ ID NO: 1577531 - DNA, 19 bp, Homo sapiens
aggtgctacaaaaacacag

SEQ ID NO: 1577532 - DNA, 22 bp, Homo sapiens
aggtgctacaacatgtgaggca

SEQ ID NO: 1577533 - DNA, 22 bp, Homo sapiens
aggtgctgaatgaagctgccat

SEQ ID NO: 1577534 - DNA, 18 bp, Homo sapiens
aggtgctgagcttagcct

SEQ ID NO: 1577535 - DNA, 12 bp, Homo sapiens
aggtgctgcctt

SEQ ID NO: 1577536 - DNA, 18 bp, Homo sapiens
aggtgctgggctggactg

SEQ ID NO: 1577537 - DNA, 15 bp, Homo sapiens
aggtggaagaaggga

SEQ ID NO: 1577538 - DNA, 22 bp, Homo sapiens
aggtggaagaagggagaagaaa

SEQ ID NO: 1577539 - DNA, 11 bp, Homo sapiens
aggtggaagcc

SEQ ID NO: 1577540 - DNA, 13 bp, Homo sapiens
aggtggaagccct

SEQ ID NO: 1577541 - DNA, 20 bp, Homo sapiens
aggtggaagccctccttcca

SEQ ID NO: 1577542 - DNA, 14 bp, Homo sapiens
aggtggacacacaa

SEQ ID NO: 1577543 - DNA, 13 bp, Homo sapiens
aggtggacctggc

SEQ ID NO: 1577544 - DNA, 19 bp, Homo sapiens
aggtggacctggcagtggt

SEQ ID NO: 1577545 - DNA, 20 bp, Homo sapiens
aggtggagattgcagtgagc

SEQ ID NO: 1577546 - DNA, 15 bp, Homo sapiens
aggtggagggaagga

SEQ ID NO: 1577547 - DNA, 16 bp, Homo sapiens
aggtggagggaaggat

SEQ ID NO: 1577548 - DNA, 20 bp, Homo sapiens
aggtggaggttgcagtgagc

SEQ ID NO: 1577549 - DNA, 22 bp, Homo sapiens
aggtggatgttatgaacagctg

SEQ ID NO: 1577550 - DNA, 15 bp, Homo sapiens
aggtggcagccctgt

SEQ ID NO: 1577551 - DNA, 17 bp, Homo sapiens
aggtggccgcccctgag

SEQ ID NO: 1577552 - DNA, 14 bp, Homo sapiens
aggtggcctgcgtc

SEQ ID NO: 1577553 - DNA, 17 bp, Homo sapiens
aggtggctatggccacc

SEQ ID NO: 1577554 - DNA, 22 bp, Homo sapiens
aggtggctgacccagtccctgg

SEQ ID NO: 1577555 - DNA, 14 bp, Homo sapiens
aggtgggagctgaa

SEQ ID NO: 1577556 - DNA, 14 bp, Homo sapiens
aggtgggcagctgg

SEQ ID NO: 1577557 - DNA, 15 bp, Homo sapiens
aggtgggcagctggg

SEQ ID NO: 1577558 - DNA, 14 bp, Homo sapiens
aggtgggcccagga

SEQ ID NO: 1577559 - DNA, 18 bp, Homo sapiens
aggtgggcccaggaccag

SEQ ID NO: 1577560 - DNA, 15 bp, Homo sapiens
aggtgggctgagccc

SEQ ID NO: 1577561 - DNA, 16 bp, Homo sapiens
aggtgggctgagccct

SEQ ID NO: 1577562 - DNA, 18 bp, Homo sapiens
aggtgggctgagccctgg

SEQ ID NO: 1577563 - DNA, 20 bp, Homo sapiens
aggtgggctgagccctggca

SEQ ID NO: 1577564 - DNA, 15 bp, Homo sapiens
aggtgggctggactt

SEQ ID NO: 1577565 - DNA, 14 bp, Homo sapiens
aggtgggctggggc

SEQ ID NO: 1577566 - DNA, 15 bp, Homo sapiens
aggtgggctggggct

SEQ ID NO: 1577567 - DNA, 21 bp, Homo sapiens
aggtgggctggggctgctccc

SEQ ID NO: 1577568 - DNA, 20 bp, Homo sapiens
aggtagcattctttggagtt

SEQ ID NO: 1577569 - DNA, 12 bp, Homo sapiens
aggtagcccagc

SEQ ID NO: 1577570 - DNA, 20 bp, Homo sapiens
aggtagcccagcactgtgaa

SEQ ID NO: 1577571 - DNA, 23 bp, Homo sapiens
aggtagctgcagataagtggcct

SEQ ID NO: 1577572 - DNA, 13 bp, Homo sapiens
aggtaggaagagc

SEQ ID NO: 1577573 - DNA, 21 bp, Homo sapiens
aggtaggaagcaacagcttca

SEQ ID NO: 1577574 - DNA, 15 bp, Homo sapiens
aggtagtctcactgc

SEQ ID NO: 1577575 - DNA, 17 bp, Homo sapiens
aggtagtggttaattac

SEQ ID NO: 1577576 - DNA, 15 bp, Homo sapiens
aggtataataaaatt

SEQ ID NO: 1577577 - DNA, 19 bp, Homo sapiens
aggtataattgtgtgatat

SEQ ID NO: 1577578 - DNA, 14 bp, Homo sapiens
aggtatatactttg

SEQ ID NO: 1577579 - DNA, 17 bp, Homo sapiens
aggtatatagaacacaa

SEQ ID NO: 1577580 - DNA, 22 bp, Homo sapiens
aggtatatagaacacaagggat

SEQ ID NO: 1577581 - DNA, 15 bp, Homo sapiens
aggtatattgtgaac

SEQ ID NO: 1577582 - DNA, 17 bp, Homo sapiens
aggtatcagttgcaata

SEQ ID NO: 1577583 - DNA, 22 bp, Homo sapiens
aggtatcagttgcaataatact

SEQ ID NO: 1577584 - DNA, 20 bp, Homo sapiens
aggtatggaagggtttgtgg

SEQ ID NO: 1577585 - DNA, 14 bp, Homo sapiens
aggtatggcagagg

SEQ ID NO: 1577586 - DNA, 20 bp, Homo sapiens
aggtatgttgcctttatggt

SEQ ID NO: 1577587 - DNA, 14 bp, Homo sapiens
aggtattagtgcta

SEQ ID NO: 1577588 - DNA, 18 bp, Homo sapiens
aggtattccttgttcttc

SEQ ID NO: 1577589 - DNA, 22 bp, Homo sapiens
aggtattccttttgtgtacagt

SEQ ID NO: 1577590 - DNA, 13 bp, Homo sapiens
aggtatttgaaaa

SEQ ID NO: 1577591 - DNA, 19 bp, Homo sapiens
aggtattttgtagatgtga

SEQ ID NO: 1577592 - DNA, 19 bp, Homo sapiens
aggtatttttttaaatcaa

SEQ ID NO: 1577593 - DNA, 22 bp, Homo sapiens
aggtatttttttaaatcaagga

SEQ ID NO: 1577594 - DNA, 23 bp, Homo sapiens
aggtatttttttaaatcaaggaa

SEQ ID NO: 1577595 - DNA, 14 bp, Homo sapiens
aggtcaaacaggct

SEQ ID NO: 1577596 - DNA, 19 bp, Homo sapiens
aggtcaaacaggctgtaat

SEQ ID NO: 1577597 - DNA, 20 bp, Homo sapiens
aggtcaaacaggctgtaatt

SEQ ID NO: 1577598 - DNA, 14 bp, Homo sapiens
aggtcaacagagaa

SEQ ID NO: 1577599 - DNA, 17 bp, Homo sapiens
aggtcaacagagaaggc

SEQ ID NO: 1577600 - DNA, 19 bp, Homo sapiens
aggtcaagcccagaaagtg

SEQ ID NO: 1577601 - DNA, 13 bp, Homo sapiens
aggtcaagggaaa

SEQ ID NO: 1577602 - DNA, 14 bp, Homo sapiens
aggtcaagggaaaa

SEQ ID NO: 1577603 - DNA, 18 bp, Homo sapiens
aggtcaagtaagaagaca

SEQ ID NO: 1577604 - DNA, 19 bp, Homo sapiens
aggtcaagtaagaagacat

SEQ ID NO: 1577605 - DNA, 14 bp, Homo sapiens
aggtcaataaactt

SEQ ID NO: 1577606 - DNA, 20 bp, Homo sapiens
aggtcaataacactgtattt

SEQ ID NO: 1577607 - DNA, 22 bp, Homo sapiens
aggtcaataaggtcaagggaaa

SEQ ID NO: 1577608 - DNA, 14 bp, Homo sapiens
aggtcaccagctgc

SEQ ID NO: 1577609 - DNA, 18 bp, Homo sapiens
aggtcaccagctgctgtg

SEQ ID NO: 1577610 - DNA, 18 bp, Homo sapiens
aggtcaccaggggaggag

SEQ ID NO: 1577611 - DNA, 15 bp, Homo sapiens
aggtcacccatcagg

SEQ ID NO: 1577612 - DNA, 16 bp, Homo sapiens
aggtcacccatcagga

SEQ ID NO: 1577613 - DNA, 14 bp, Homo sapiens
aggtcactccacca

SEQ ID NO: 1577614 - DNA, 18 bp, Homo sapiens
aggtcactccaccatccc

SEQ ID NO: 1577615 - DNA, 14 bp, Homo sapiens
aggtcactcctggg

SEQ ID NO: 1577616 - DNA, 14 bp, Homo sapiens
aggtcactggctct

SEQ ID NO: 1577617 - DNA, 15 bp, Homo sapiens
aggtcactggctctc

SEQ ID NO: 1577618 - DNA, 20 bp, Homo sapiens
aggtcactggctctccaagt

SEQ ID NO: 1577619 - DNA, 16 bp, Homo sapiens
aggtcactgtcactgc

SEQ ID NO: 1577620 - DNA, 19 bp, Homo sapiens
aggtcagcccgtttcagaa

SEQ ID NO: 1577621 - DNA, 15 bp, Homo sapiens
aggtcagcctggaag

SEQ ID NO: 1577622 - DNA, 16 bp, Homo sapiens
aggtcagcctggaagg

SEQ ID NO: 1577623 - DNA, 19 bp, Homo sapiens
aggtcaggagttagaggcc

SEQ ID NO: 1577624 - DNA, 20 bp, Homo sapiens
aggtcaggagttcctaacca

SEQ ID NO: 1577625 - DNA, 17 bp, Homo sapiens
aggtcaggccccactcc

SEQ ID NO: 1577626 - DNA, 20 bp, Homo sapiens
aggtcagggaggatctgttc

SEQ ID NO: 1577627 - DNA, 18 bp, Homo sapiens
aggtcatattaatatatt

SEQ ID NO: 1577628 - DNA, 15 bp, Homo sapiens
aggtcatcaaacatt

SEQ ID NO: 1577629 - DNA, 19 bp, Homo sapiens
aggtcatgcagttcctggc

SEQ ID NO: 1577630 - DNA, 18 bp, Homo sapiens
aggtcatggaatggaaac

SEQ ID NO: 1577631 - DNA, 23 bp, Homo sapiens
aggtccagctctggaggggaggg

SEQ ID NO: 1577632 - DNA, 16 bp, Homo sapiens
aggtccagctgggcct

SEQ ID NO: 1577633 - DNA, 17 bp, Homo sapiens
aggtccagctgggcctc

SEQ ID NO: 1577634 - DNA, 21 bp, Homo sapiens
aggtccagctgggcctcctgc

SEQ ID NO: 1577635 - DNA, 13 bp, Homo sapiens
aggtcccaggcag

SEQ ID NO: 1577636 - DNA, 15 bp, Homo sapiens
aggtcccccgactgc

SEQ ID NO: 1577637 - DNA, 20 bp, Homo sapiens
aggtcccccgactgcctgtc

SEQ ID NO: 1577638 - DNA, 21 bp, Homo sapiens
aggtcccccgactgcctgtct

SEQ ID NO: 1577639 - DNA, 17 bp, Homo sapiens
aggtcccctggcagtgc

SEQ ID NO: 1577640 - DNA, 21 bp, Homo sapiens
aggtcccctggcagtgctgag

SEQ ID NO: 1577641 - DNA, 18 bp, Homo sapiens
aggtcccggccagctctg

SEQ ID NO: 1577642 - DNA, 19 bp, Homo sapiens
aggtccggtgttctaagat

SEQ ID NO: 1577643 - DNA, 21 bp, Homo sapiens
aggtcctcacttctgtctcct

SEQ ID NO: 1577644 - DNA, 12 bp, Homo sapiens
aggtcctctcag

SEQ ID NO: 1577645 - DNA, 15 bp, Homo sapiens
aggtcctctggagcc

SEQ ID NO: 1577646 - DNA, 20 bp, Homo sapiens
aggtcctctggagccctaac

SEQ ID NO: 1577647 - DNA, 19 bp, Homo sapiens
aggtcctgatttctagaac

SEQ ID NO: 1577648 - DNA, 16 bp, Homo sapiens
aggtcctgctgtggaa

SEQ ID NO: 1577649 - DNA, 17 bp, Homo sapiens
aggtcctggtgggtcag

SEQ ID NO: 1577650 - DNA, 22 bp, Homo sapiens
aggtcctggtgggtcagcccag

SEQ ID NO: 1577651 - DNA, 16 bp, Homo sapiens
aggtcctgtgttaaac

SEQ ID NO: 1577652 - DNA, 15 bp, Homo sapiens
aggtcctttagaaac

SEQ ID NO: 1577653 - DNA, 15 bp, Homo sapiens
aggtcggagtgcctg

SEQ ID NO: 1577654 - DNA, 19 bp, Homo sapiens
aggtcggagtgcctggagt

SEQ ID NO: 1577655 - DNA, 22 bp, Homo sapiens
aggtcggtaggttcagccaagg

SEQ ID NO: 1577656 - DNA, 21 bp, Homo sapiens
aggtctcatctcttcaggttc

SEQ ID NO: 1577657 - DNA, 12 bp, Homo sapiens
aggtctccaagg

SEQ ID NO: 1577658 - DNA, 14 bp, Homo sapiens
agtgtaagaactgt

SEQ ID NO: 1577659 - DNA, 18 bp, Homo sapiens
agtgtaagaactgtacat

SEQ ID NO: 1577660 - DNA, 21 bp, Homo sapiens
agtgtaagaactgtacattgt

SEQ ID NO: 1577661 - DNA, 14 bp, Homo sapiens
agtgtaatgtgact

SEQ ID NO: 1577662 - DNA, 14 bp, Homo sapiens
agtgtacacagact

SEQ ID NO: 1577663 - DNA, 17 bp, Homo sapiens
agtgtacacgtctggac

SEQ ID NO: 1577664 - DNA, 21 bp, Homo sapiens
agtgtacacgtctggaccccg

SEQ ID NO: 1577665 - DNA, 21 bp, Homo sapiens
agtgtacatggaataacatgt

SEQ ID NO: 1577666 - DNA, 22 bp, Homo sapiens
agtgtacctcctctcagtgttt

SEQ ID NO: 1577667 - DNA, 18 bp, Homo sapiens
agtgtagcctaaagggca

SEQ ID NO: 1577668 - DNA, 22 bp, Homo sapiens
agtgtagcctaaagggcagggc

SEQ ID NO: 1577669 - DNA, 14 bp, Homo sapiens
agtgtagctgtaag

SEQ ID NO: 1577670 - DNA, 23 bp, Homo sapiens
agtgtagctgtaagggcagtgcc

SEQ ID NO: 1577671 - DNA, 19 bp, Homo sapiens
agtgtagtttacagaaaaa

SEQ ID NO: 1577672 - DNA, 15 bp, Homo sapiens
agtgtataatataaa

SEQ ID NO: 1577673 - DNA, 18 bp, Homo sapiens
agtgtatgactgcacatg

SEQ ID NO: 1577674 - DNA, 16 bp, Homo sapiens
agtgtatggaaataaa

SEQ ID NO: 1577675 - DNA, 22 bp, Homo sapiens
agtgtatggaaataaatgtatc

SEQ ID NO: 1577676 - DNA, 15 bp, Homo sapiens
agtgtattaatcata

SEQ ID NO: 1577677 - DNA, 14 bp, Homo sapiens
agtgtcaagttgtg

SEQ ID NO: 1577678 - DNA, 17 bp, Homo sapiens
agtgtcaagttgtgctt

SEQ ID NO: 1577679 - DNA, 18 bp, Homo sapiens
agtgtcaagttgtgcttg

SEQ ID NO: 1577680 - DNA, 22 bp, Homo sapiens
agtgtcaagttgtgcttgttta

SEQ ID NO: 1577681 - DNA, 15 bp, Homo sapiens
agtgtcactggtcag

SEQ ID NO: 1577682 - DNA, 19 bp, Homo sapiens
agtgtcacttacctagatt

SEQ ID NO: 1577683 - DNA, 16 bp, Homo sapiens
agtgtcccctgcccca

SEQ ID NO: 1577684 - DNA, 18 bp, Homo sapiens
agtgtcccctgccccaga

SEQ ID NO: 1577685 - DNA, 20 bp, Homo sapiens
agtgtcccctgccccagagg

SEQ ID NO: 1577686 - DNA, 21 bp, Homo sapiens
agtgtcccctgccccagaggt

SEQ ID NO: 1577687 - DNA, 16 bp, Homo sapiens
agtgtccgagaactaa

SEQ ID NO: 1577688 - DNA, 16 bp, Homo sapiens
agtgtcctgcccatgc

SEQ ID NO: 1577689 - DNA, 18 bp, Homo sapiens
agtgtcctggctgtgaat

SEQ ID NO: 1577690 - DNA, 13 bp, Homo sapiens
agtgtcctttcca

SEQ ID NO: 1577691 - DNA, 14 bp, Homo sapiens
agtgtctaaaaaca

SEQ ID NO: 1577692 - DNA, 16 bp, Homo sapiens
agtgtctacatgtgcc

SEQ ID NO: 1577693 - DNA, 20 bp, Homo sapiens
agtgtctgctgctgcctccc

SEQ ID NO: 1577694 - DNA, 21 bp, Homo sapiens
agtgtctgctgctgcctccct

SEQ ID NO: 1577695 - DNA, 15 bp, Homo sapiens
agtgtcttaattaaa

SEQ ID NO: 1577696 - DNA, 13 bp, Homo sapiens
agtgtcttccata

SEQ ID NO: 1577697 - DNA, 15 bp, Homo sapiens
agtgtgaaatagaca

SEQ ID NO: 1577698 - DNA, 13 bp, Homo sapiens
agtgtgaacaaaa

SEQ ID NO: 1577699 - DNA, 15 bp, Homo sapiens
agtgtgagctcttcc

SEQ ID NO: 1577700 - DNA, 16 bp, Homo sapiens
agtgtgagctcttccc

SEQ ID NO: 1577701 - DNA, 18 bp, Homo sapiens
agtgtgagtaagagctgg

SEQ ID NO: 1577702 - DNA, 20 bp, Homo sapiens
agtgtgagtggcagccatgc

SEQ ID NO: 1577703 - DNA, 22 bp, Homo sapiens
agtgtgcacccctccccattca

SEQ ID NO: 1577704 - DNA, 22 bp, Homo sapiens
agtgtgcacgagtgggaaggac

SEQ ID NO: 1577705 - DNA, 21 bp, Homo sapiens
agtgtgcagttctagtttgca

SEQ ID NO: 1577706 - DNA, 18 bp, Homo sapiens
agtgtgccaaatcagttt

SEQ ID NO: 1577707 - DNA, 14 bp, Homo sapiens
agtgtgctaaaaat

SEQ ID NO: 1577708 - DNA, 13 bp, Homo sapiens
agtgtggagaggg

SEQ ID NO: 1577709 - DNA, 23 bp, Homo sapiens
agtgtggagttcaccttggaagg

SEQ ID NO: 1577710 - DNA, 12 bp, Homo sapiens
agtgtggcctct

SEQ ID NO: 1577711 - DNA, 13 bp, Homo sapiens
agtgtggcctctt

SEQ ID NO: 1577712 - DNA, 16 bp, Homo sapiens
agtgtgggcgctctcc

SEQ ID NO: 1577713 - DNA, 20 bp, Homo sapiens
agtgtgggcgctctccctac

SEQ ID NO: 1577714 - DNA, 14 bp, Homo sapiens
agtgtgggctgccc

SEQ ID NO: 1577715 - DNA, 16 bp, Homo sapiens
agtgtgggtctgtgtg

SEQ ID NO: 1577716 - DNA, 17 bp, Homo sapiens
agtgtgggtctgtgtgt

SEQ ID NO: 1577717 - DNA, 17 bp, Homo sapiens
agtgtggtctgtaatat

SEQ ID NO: 1577718 - DNA, 21 bp, Homo sapiens
agtgtggtttctttttgaatc

SEQ ID NO: 1577719 - DNA, 20 bp, Homo sapiens
agtgtggttttgtaatttaa

SEQ ID NO: 1577720 - DNA, 13 bp, Homo sapiens
agtgtgtaattat

SEQ ID NO: 1577721 - DNA, 23 bp, Homo sapiens
agtgtgtatatattttgtgtgaa

SEQ ID NO: 1577722 - DNA, 14 bp, Homo sapiens
agtgtgtgacttac

SEQ ID NO: 1577723 - DNA, 21 bp, Homo sapiens
agtgcactgcattcctgtgcc

SEQ ID NO: 1577724 - DNA, 14 bp, Homo sapiens
agtgcactttctaa

SEQ ID NO: 1577725 - DNA, 21 bp, Homo sapiens
agtgcacttttttatgaagaa

SEQ ID NO: 1577726 - DNA, 23 bp, Homo sapiens
agtgcagaatgtaagtgggccca

SEQ ID NO: 1577727 - DNA, 13 bp, Homo sapiens
agtgcagacaggc

SEQ ID NO: 1577728 - DNA, 19 bp, Homo sapiens
agtgcagagccttctcaga

SEQ ID NO: 1577729 - DNA, 13 bp, Homo sapiens
agtgcagaggctc

SEQ ID NO: 1577730 - DNA, 14 bp, Homo sapiens
agtgcagcagagga

SEQ ID NO: 1577731 - DNA, 23 bp, Homo sapiens
agtgcagcagaggacagtctgga

SEQ ID NO: 1577732 - DNA, 16 bp, Homo sapiens
agtgcagctgaaattg

SEQ ID NO: 1577733 - DNA, 13 bp, Homo sapiens
agtgcagggagga

SEQ ID NO: 1577734 - DNA, 21 bp, Homo sapiens
agtgcagggaggaaaagtgca

SEQ ID NO: 1577735 - DNA, 14 bp, Homo sapiens
agtgcatatgcaat

SEQ ID NO: 1577736 - DNA, 14 bp, Homo sapiens
agtgcatctcagcc

SEQ ID NO: 1577737 - DNA, 16 bp, Homo sapiens
agtgcatctcagccca

SEQ ID NO: 1577738 - DNA, 22 bp, Homo sapiens
agtgcatgctctctgcagccag

SEQ ID NO: 1577739 - DNA, 17 bp, Homo sapiens
agtgcatggtggccaga

SEQ ID NO: 1577740 - DNA, 18 bp, Homo sapiens
agtgcatgtgaagcatgc

SEQ ID NO: 1577741 - DNA, 22 bp, Homo sapiens
agtgcatgtgaagcatgctttg

SEQ ID NO: 1577742 - DNA, 17 bp, Homo sapiens
agtgcattatgtacaca

SEQ ID NO: 1577743 - DNA, 16 bp, Homo sapiens
agtgcatttgactcca

SEQ ID NO: 1577744 - DNA, 19 bp, Homo sapiens
agtgcattttgtttctgta

SEQ ID NO: 1577745 - DNA, 21 bp, Homo sapiens
agtgcattttgtttctgtata

SEQ ID NO: 1577746 - DNA, 18 bp, Homo sapiens
agtgcatttttaaacttg

SEQ ID NO: 1577747 - DNA, 21 bp, Homo sapiens
agtgcatttttaaacttgaaa

SEQ ID NO: 1577748 - DNA, 22 bp, Homo sapiens
agtgcatttttaaacttgaaat

SEQ ID NO: 1577749 - DNA, 15 bp, Homo sapiens
agtgccaaacagagt

SEQ ID NO: 1577750 - DNA, 20 bp, Homo sapiens
agtgccacccacctttgcca

SEQ ID NO: 1577751 - DNA, 13 bp, Homo sapiens
agtgccacccgca

SEQ ID NO: 1577752 - DNA, 17 bp, Homo sapiens
agtgccacttaatgtat

SEQ ID NO: 1577753 - DNA, 21 bp, Homo sapiens
agtgccacttaatgtatgtta

SEQ ID NO: 1577754 - DNA, 22 bp, Homo sapiens
agtgccagaggtgggcaggtgg

SEQ ID NO: 1577755 - DNA, 11 bp, Homo sapiens
agtgccaggac

SEQ ID NO: 1577756 - DNA, 12 bp, Homo sapiens
agtgccaggacc

SEQ ID NO: 1577757 - DNA, 13 bp, Homo sapiens
agtgccaggacca

SEQ ID NO: 1577758 - DNA, 18 bp, Homo sapiens
agtgccaggaccagcctg

SEQ ID NO: 1577759 - DNA, 10 bp, Homo sapiens
agtgcccaaa

SEQ ID NO: 1577760 - DNA, 19 bp, Homo sapiens
agtgcccaccaacatccca

SEQ ID NO: 1577761 - DNA, 23 bp, Homo sapiens
agtgcccagaactggactcagga

SEQ ID NO: 1577762 - DNA, 12 bp, Homo sapiens
agtgcccagccc

SEQ ID NO: 1577763 - DNA, 19 bp, Homo sapiens
agtgcccagcccctgcccc

SEQ ID NO: 1577764 - DNA, 18 bp, Homo sapiens
agtgcccatgtgtacatt

SEQ ID NO: 1577765 - DNA, 14 bp, Homo sapiens
agtgccccagactg

SEQ ID NO: 1577766 - DNA, 18 bp, Homo sapiens
agtgccccagactgagct

SEQ ID NO: 1577767 - DNA, 19 bp, Homo sapiens
agtgccccagactgagctc

SEQ ID NO: 1577768 - DNA, 22 bp, Homo sapiens
agtgccccagactgagctctcc

SEQ ID NO: 1577769 - DNA, 14 bp, Homo sapiens
agtgccgaggacat

SEQ ID NO: 1577770 - DNA, 15 bp, Homo sapiens
agtgccgtagggagt

SEQ ID NO: 1577771 - DNA, 23 bp, Homo sapiens
agtgcctaaaattgtatgaaaat

SEQ ID NO: 1577772 - DNA, 14 bp, Homo sapiens
agtgcctagactgt

SEQ ID NO: 1577773 - DNA, 17 bp, Homo sapiens
agtgcctagactgttac

SEQ ID NO: 1577774 - DNA, 15 bp, Homo sapiens
agtgcctcgaggcac

SEQ ID NO: 1577775 - DNA, 19 bp, Homo sapiens
agtgcctcttgttgcagag

SEQ ID NO: 1577776 - DNA, 12 bp, Homo sapiens
agtgcctgagct

SEQ ID NO: 1577777 - DNA, 18 bp, Homo sapiens
agtgcctgagctggggaa

SEQ ID NO: 1577778 - DNA, 12 bp, Homo sapiens
agtgcctgccac

SEQ ID NO: 1577779 - DNA, 18 bp, Homo sapiens
agtgcctgccactctctg

SEQ ID NO: 1577780 - DNA, 20 bp, Homo sapiens
agtgcctgccactctctggg

SEQ ID NO: 1577781 - DNA, 15 bp, Homo sapiens
agtgtgtgggcaggg

SEQ ID NO: 1577782 - DNA, 23 bp, Homo sapiens
agtgtgtggtctctgccccagcc

SEQ ID NO: 1577783 - DNA, 12 bp, Homo sapiens
agtgtgtgtgca

SEQ ID NO: 1577784 - DNA, 16 bp, Homo sapiens
agtgtgtgtgcatgtg

SEQ ID NO: 1577785 - DNA, 18 bp, Homo sapiens
agtgtgtgtgcatgtgtg

SEQ ID NO: 1577786 - DNA, 14 bp, Homo sapiens
agtgtgtgtgtgca

SEQ ID NO: 1577787 - DNA, 16 bp, Homo sapiens
agtgtgtgtgtgcatg

SEQ ID NO: 1577788 - DNA, 18 bp, Homo sapiens
agtgtgtgtgtgcatgtg

SEQ ID NO: 1577789 - DNA, 15 bp, Homo sapiens
agtgtgtttagaagg

SEQ ID NO: 1577790 - DNA, 15 bp, Homo sapiens
agtgttacctgtgtg

SEQ ID NO: 1577791 - DNA, 17 bp, Homo sapiens
agtgttacctgtgtgct

SEQ ID NO: 1577792 - DNA, 14 bp, Homo sapiens
agtgttacttgcag

SEQ ID NO: 1577793 - DNA, 15 bp, Homo sapiens
agtgttagagaaatc

SEQ ID NO: 1577794 - DNA, 17 bp, Homo sapiens
agtgttagagaaatcct

SEQ ID NO: 1577795 - DNA, 19 bp, Homo sapiens
agtgttagtgctggtcaga

SEQ ID NO: 1577796 - DNA, 23 bp, Homo sapiens
agtgttatcagtcataactaaat

SEQ ID NO: 1577797 - DNA, 22 bp, Homo sapiens
agtgttattttctttgaaattg

SEQ ID NO: 1577798 - DNA, 17 bp, Homo sapiens
agtgttcaagaaataaa

SEQ ID NO: 1577799 - DNA, 13 bp, Homo sapiens
agtgttcacaaac

SEQ ID NO: 1577800 - DNA, 18 bp, Homo sapiens
agtgttcattttagtgac

SEQ ID NO: 1577801 - DNA, 21 bp, Homo sapiens
agtgttcattttagtgactgt

SEQ ID NO: 1577802 - DNA, 22 bp, Homo sapiens
agtgttcattttagtgactgta

SEQ ID NO: 1577803 - DNA, 18 bp, Homo sapiens
agtgttccctttcctact

SEQ ID NO: 1577804 - DNA, 20 bp, Homo sapiens
agtgttcctttttaaatgtg

SEQ ID NO: 1577805 - DNA, 23 bp, Homo sapiens
agtgttctcatgaagcaggaggc

SEQ ID NO: 1577806 - DNA, 22 bp, Homo sapiens
agtgttctctagaatccagcag

SEQ ID NO: 1577807 - DNA, 19 bp, Homo sapiens
agtgttctgcatggattca

SEQ ID NO: 1577808 - DNA, 18 bp, Homo sapiens
agtgttctgccagatctt

SEQ ID NO: 1577809 - DNA, 18 bp, Homo sapiens
agtgttctgctcctgctt

SEQ ID NO: 1577810 - DNA, 19 bp, Homo sapiens
agtgttctgctcctgcttt

SEQ ID NO: 1577811 - DNA, 17 bp, Homo sapiens
agtgttcttttctggtg

SEQ ID NO: 1577812 - DNA, 16 bp, Homo sapiens
agtgttgaaaatgttc

SEQ ID NO: 1577813 - DNA, 15 bp, Homo sapiens
agtgttgctgtggct

SEQ ID NO: 1577814 - DNA, 14 bp, Homo sapiens
agtgttggctgtgt

SEQ ID NO: 1577815 - DNA, 15 bp, Homo sapiens
agtgttggctgtgtg

SEQ ID NO: 1577816 - DNA, 19 bp, Homo sapiens
ataatttgtacatatgtaa

SEQ ID NO: 1577817 - DNA, 15 bp, Homo sapiens
ataattttaaacaaa

SEQ ID NO: 1577818 - DNA, 19 bp, Homo sapiens
ataattttatgaatgtctt

SEQ ID NO: 1577819 - DNA, 21 bp, Homo sapiens
ataattttatttataaactag

SEQ ID NO: 1577820 - DNA, 22 bp, Homo sapiens
ataattttcttcatgcaatgac

SEQ ID NO: 1577821 - DNA, 13 bp, Homo sapiens
ataattttgctgg

SEQ ID NO: 1577822 - DNA, 19 bp, Homo sapiens
ataatttttaaagtatata

SEQ ID NO: 1577823 - DNA, 15 bp, Homo sapiens
ataatttttacctaa

SEQ ID NO: 1577824 - DNA, 19 bp, Homo sapiens
ataatttttacctaatctc

SEQ ID NO: 1577825 - DNA, 14 bp, Homo sapiens
ataattttttctta

SEQ ID NO: 1577826 - DNA, 23 bp, Homo sapiens
ataatttttttattactgatttt

SEQ ID NO: 1577827 - DNA, 21 bp, Homo sapiens
ataatttttttcaatatttat

SEQ ID NO: 1577828 - DNA, 23 bp, Homo sapiens
atacaaaaagcaaaacaaaaccc

SEQ ID NO: 1577829 - DNA, 20 bp, Homo sapiens
atacaaaaattagccgggca

SEQ ID NO: 1577830 - DNA, 12 bp, Homo sapiens
atacaaaacctt

SEQ ID NO: 1577831 - DNA, 22 bp, Homo sapiens
atacaaaagctttttaaaattt

SEQ ID NO: 1577832 - DNA, 16 bp, Homo sapiens
atacaaacaatggaaa

SEQ ID NO: 1577833 - DNA, 18 bp, Homo sapiens
atacaaacaatggaaact

SEQ ID NO: 1577834 - DNA, 18 bp, Homo sapiens
atacaaacctaccaaaat

SEQ ID NO: 1577835 - DNA, 13 bp, Homo sapiens
atacaaactctca

SEQ ID NO: 1577836 - DNA, 16 bp, Homo sapiens
atacaaactctcacca

SEQ ID NO: 1577837 - DNA, 18 bp, Homo sapiens
atacaaactctcaccatg

SEQ ID NO: 1577838 - DNA, 13 bp, Homo sapiens
atacaaatggatt

SEQ ID NO: 1577839 - DNA, 20 bp, Homo sapiens
atacaaatggattttgggag

SEQ ID NO: 1577840 - DNA, 15 bp, Homo sapiens
atacaacacaaagag

SEQ ID NO: 1577841 - DNA, 14 bp, Homo sapiens
atacaacacatcta

SEQ ID NO: 1577842 - DNA, 21 bp, Homo sapiens
atacaacaccaaaaaatatct

SEQ ID NO: 1577843 - DNA, 14 bp, Homo sapiens
atacaactgcctgg

SEQ ID NO: 1577844 - DNA, 14 bp, Homo sapiens
atacaagaaaatgt

SEQ ID NO: 1577845 - DNA, 15 bp, Homo sapiens
atacaagattgaaaa

SEQ ID NO: 1577846 - DNA, 12 bp, Homo sapiens
atacaaggtata

SEQ ID NO: 1577847 - DNA, 13 bp, Homo sapiens
atacaagtaattt

SEQ ID NO: 1577848 - DNA, 18 bp, Homo sapiens
atacaagtttcagacagg

SEQ ID NO: 1577849 - DNA, 21 bp, Homo sapiens
atacaataaactattggaaag

SEQ ID NO: 1577850 - DNA, 14 bp, Homo sapiens
atacaataacataa

SEQ ID NO: 1577851 - DNA, 12 bp, Homo sapiens
atacaatgtaca

SEQ ID NO: 1577852 - DNA, 16 bp, Homo sapiens
atacaatgtacaatta

SEQ ID NO: 1577853 - DNA, 21 bp, Homo sapiens
atacaatgtacaattatgtct

SEQ ID NO: 1577854 - DNA, 13 bp, Homo sapiens
atacaatgtatgt

SEQ ID NO: 1577855 - DNA, 14 bp, Homo sapiens
atacaatgtatgta

SEQ ID NO: 1577856 - DNA, 17 bp, Homo sapiens
atacaatgtatgtaatt

SEQ ID NO: 1577857 - DNA, 15 bp, Homo sapiens
atacaatgtatgtac

SEQ ID NO: 1577858 - DNA, 21 bp, Homo sapiens
atacaatgtatgtacaataca

SEQ ID NO: 1577859 - DNA, 20 bp, Homo sapiens
atacaatgtatttatttaaa

SEQ ID NO: 1577860 - DNA, 20 bp, Homo sapiens
atacacacacacagacatat

SEQ ID NO: 1577861 - DNA, 16 bp, Homo sapiens
ataagtcaagcacatg

SEQ ID NO: 1577862 - DNA, 19 bp, Homo sapiens
ataagtcaagcacatgtaa

SEQ ID NO: 1577863 - DNA, 14 bp, Homo sapiens
ataagtctaaataa

SEQ ID NO: 1577864 - DNA, 23 bp, Homo sapiens
ataagtgacaccaataaatgttt

SEQ ID NO: 1577865 - DNA, 17 bp, Homo sapiens
ataagtgcagggaggaa

SEQ ID NO: 1577866 - DNA, 19 bp, Homo sapiens
ataagttatttttgtacat

SEQ ID NO: 1577867 - DNA, 20 bp, Homo sapiens
ataagttatttttgtacatg

SEQ ID NO: 1577868 - DNA, 22 bp, Homo sapiens
ataagttatttttgtacatgtt

SEQ ID NO: 1577869 - DNA, 24 bp, Homo sapiens
ataagttcaaattcttctgaactc

SEQ ID NO: 1577870 - DNA, 11 bp, Homo sapiens
ataagttcata

SEQ ID NO: 1577871 - DNA, 20 bp, Homo sapiens
ataagttcttatgccatgtt

SEQ ID NO: 1577872 - DNA, 14 bp, Homo sapiens
ataagttgaaggaa

SEQ ID NO: 1577873 - DNA, 15 bp, Homo sapiens
ataagttgaaggaaa

SEQ ID NO: 1577874 - DNA, 15 bp, Homo sapiens
ataagtttgaaggaa

SEQ ID NO: 1577875 - DNA, 19 bp, Homo sapiens
ataagtttgaaggaaacag

SEQ ID NO: 1577876 - DNA, 17 bp, Homo sapiens
ataagtttgcaatttgg

SEQ ID NO: 1577877 - DNA, 15 bp, Homo sapiens
ataataaatgtacat

SEQ ID NO: 1577878 - DNA, 17 bp, Homo sapiens
ataataactgtcttctg

SEQ ID NO: 1577879 - DNA, 20 bp, Homo sapiens
ataataagagaatgttccta

SEQ ID NO: 1577880 - DNA, 21 bp, Homo sapiens
ataataagtgatgtgctgaat

SEQ ID NO: 1577881 - DNA, 10 bp, Homo sapiens
ataataataa

SEQ ID NO: 1577882 - DNA, 12 bp, Homo sapiens
ataataataata

SEQ ID NO: 1577883 - DNA, 14 bp, Homo sapiens
ataatacacaaaat

SEQ ID NO: 1577884 - DNA, 15 bp, Homo sapiens
ataataccttagaag

SEQ ID NO: 1577885 - DNA, 20 bp, Homo sapiens
ataataggaatttgtataaa

SEQ ID NO: 1577886 - DNA, 12 bp, Homo sapiens
ataatagggaaa

SEQ ID NO: 1577887 - DNA, 14 bp, Homo sapiens
ataatagggaaaat

SEQ ID NO: 1577888 - DNA, 20 bp, Homo sapiens
ataatagtagatttgaacag

SEQ ID NO: 1577889 - DNA, 23 bp, Homo sapiens
ataatatataaacaataaaaaca

SEQ ID NO: 1577890 - DNA, 15 bp, Homo sapiens
ataatatatgacttc

SEQ ID NO: 1577891 - DNA, 14 bp, Homo sapiens
ataatatctgtgag

SEQ ID NO: 1577892 - DNA, 21 bp, Homo sapiens
ataatatctgtgaggtgctga

SEQ ID NO: 1577893 - DNA, 14 bp, Homo sapiens
ataatatgtactaa

SEQ ID NO: 1577894 - DNA, 20 bp, Homo sapiens
ataatatgtactaagaatgt

SEQ ID NO: 1577895 - DNA, 16 bp, Homo sapiens
ataatatgtgccttaa

SEQ ID NO: 1577896 - DNA, 18 bp, Homo sapiens
ataatattgaaaattgaa

SEQ ID NO: 1577897 - DNA, 14 bp, Homo sapiens
ataatattgtttgg

SEQ ID NO: 1577898 - DNA, 14 bp, Homo sapiens
ataatatttcagtg

SEQ ID NO: 1577899 - DNA, 15 bp, Homo sapiens
ataatatttttgtat

SEQ ID NO: 1577900 - DNA, 22 bp, Homo sapiens
ataatatttttgtatttctcta

SEQ ID NO: 1577901 - DNA, 13 bp, Homo sapiens
ataatcagaacac

SEQ ID NO: 1577902 - DNA, 17 bp, Homo sapiens
ataatcagtgactgaaa

SEQ ID NO: 1577903 - DNA, 22 bp, Homo sapiens
atatagtttttttttttttcct

SEQ ID NO: 1577904 - DNA, 21 bp, Homo sapiens
atatataaaaagaaaagataa

SEQ ID NO: 1577905 - DNA, 17 bp, Homo sapiens
atatataaaacggtgct

SEQ ID NO: 1577906 - DNA, 14 bp, Homo sapiens
atatataaagacaa

SEQ ID NO: 1577907 - DNA, 15 bp, Homo sapiens
atatataaatgtata

SEQ ID NO: 1577908 - DNA, 16 bp, Homo sapiens
atatataaatgtataa

SEQ ID NO: 1577909 - DNA, 16 bp, Homo sapiens
atatataactatttta

SEQ ID NO: 1577910 - DNA, 16 bp, Homo sapiens
atatatacagtaactt

SEQ ID NO: 1577911 - DNA, 18 bp, Homo sapiens
atatatacagtaacttta

SEQ ID NO: 1577912 - DNA, 21 bp, Homo sapiens
atatatacagtaactttatgt

SEQ ID NO: 1577913 - DNA, 22 bp, Homo sapiens
atatatacatagcatgacattt

SEQ ID NO: 1577914 - DNA, 17 bp, Homo sapiens
atatatagtccagacac

SEQ ID NO: 1577915 - DNA, 20 bp, Homo sapiens
atatatagtccagacactta

SEQ ID NO: 1577916 - DNA, 19 bp, Homo sapiens
atatatagtgggtacatca

SEQ ID NO: 1577917 - DNA, 15 bp, Homo sapiens
atatatatagtaact

SEQ ID NO: 1577918 - DNA, 13 bp, Homo sapiens
atatatatatgta

SEQ ID NO: 1577919 - DNA, 16 bp, Homo sapiens
atatatatatgtatat

SEQ ID NO: 1577920 - DNA, 14 bp, Homo sapiens
atatatatctatat

SEQ ID NO: 1577921 - DNA, 15 bp, Homo sapiens
atatatatctatata

SEQ ID NO: 1577922 - DNA, 14 bp, Homo sapiens
atatatatgaataa

SEQ ID NO: 1577923 - DNA, 22 bp, Homo sapiens
atatatatgtatatgtatatat

SEQ ID NO: 1577924 - DNA, 16 bp, Homo sapiens
atatatatgtcaatat

SEQ ID NO: 1577925 - DNA, 16 bp, Homo sapiens
atatatatgtgtgtgt

SEQ ID NO: 1577926 - DNA, 18 bp, Homo sapiens
atatatattcatatacaa

SEQ ID NO: 1577927 - DNA, 17 bp, Homo sapiens
atatatcaagaagtctt

SEQ ID NO: 1577928 - DNA, 20 bp, Homo sapiens
atatatcaagaagtcttgaa

SEQ ID NO: 1577929 - DNA, 20 bp, Homo sapiens
atatatctacaatatatatt

SEQ ID NO: 1577930 - DNA, 16 bp, Homo sapiens
atatatctatatcata

SEQ ID NO: 1577931 - DNA, 20 bp, Homo sapiens
atatatctgttggagaaaga

SEQ ID NO: 1577932 - DNA, 23 bp, Homo sapiens
atatatcttaagcaggtttgttt

SEQ ID NO: 1577933 - DNA, 19 bp, Homo sapiens
atatatgaagacaataatt

SEQ ID NO: 1577934 - DNA, 16 bp, Homo sapiens
atatatgcatatatat

SEQ ID NO: 1577935 - DNA, 15 bp, Homo sapiens
atatatggaagagga

SEQ ID NO: 1577936 - DNA, 19 bp, Homo sapiens
atatatggaaggttcctgt

SEQ ID NO: 1577937 - DNA, 20 bp, Homo sapiens
atatatggaaggttcctgtg

SEQ ID NO: 1577938 - DNA, 14 bp, Homo sapiens
atatatggataatg

SEQ ID NO: 1577939 - DNA, 21 bp, Homo sapiens
atatatgtataatatatatct

SEQ ID NO: 1577940 - DNA, 15 bp, Homo sapiens
atatatgtatataca

SEQ ID NO: 1577941 - DNA, 12 bp, Homo sapiens
atatatgtcaat

SEQ ID NO: 1577942 - DNA, 13 bp, Homo sapiens
atatatgtcaata

SEQ ID NO: 1577943 - DNA, 12 bp, Homo sapiens
atatatgtgtat

SEQ ID NO: 1577944 - DNA, 13 bp, Homo sapiens
atatatgtgtatg

SEQ ID NO: 1577945 - DNA, 15 bp, Homo sapiens
atatatgtgtatgta

SEQ ID NO: 1577946 - DNA, 16 bp, Homo sapiens
atatatgtgtgtgtat

SEQ ID NO: 1577947 - DNA, 23 bp, Homo sapiens
atatatgtgtttttcacatttgc

SEQ ID NO: 1577948 - DNA, 14 bp, Homo sapiens
atatctcctttgta

SEQ ID NO: 1577949 - DNA, 23 bp, Homo sapiens
atatctcctttgtattctgtctt

SEQ ID NO: 1577950 - DNA, 17 bp, Homo sapiens
atatctgaaaatgtatg

SEQ ID NO: 1577951 - DNA, 20 bp, Homo sapiens
atatctgaaaatgtatgtgt

SEQ ID NO: 1577952 - DNA, 15 bp, Homo sapiens
atatctgaaatgtga

SEQ ID NO: 1577953 - DNA, 23 bp, Homo sapiens
atatctgagagacctgtgtgaac

SEQ ID NO: 1577954 - DNA, 16 bp, Homo sapiens
atatctgcatgtgtca

SEQ ID NO: 1577955 - DNA, 14 bp, Homo sapiens
atatctgcctcccc

SEQ ID NO: 1577956 - DNA, 15 bp, Homo sapiens
atatctgcctcccct

SEQ ID NO: 1577957 - DNA, 13 bp, Homo sapiens
atatctggcactg

SEQ ID NO: 1577958 - DNA, 14 bp, Homo sapiens
atatctggcactgt

SEQ ID NO: 1577959 - DNA, 19 bp, Homo sapiens
atatctggcctctgctttc

SEQ ID NO: 1577960 - DNA, 17 bp, Homo sapiens
atatctgtaaatttaac

SEQ ID NO: 1577961 - DNA, 18 bp, Homo sapiens
atatctgtatttaatttt

SEQ ID NO: 1577962 - DNA, 21 bp, Homo sapiens
atatctgttattcaaatttga

SEQ ID NO: 1577963 - DNA, 19 bp, Homo sapiens
atatcttaaagaaacagct

SEQ ID NO: 1577964 - DNA, 20 bp, Homo sapiens
atatcttaattctttgttct

SEQ ID NO: 1577965 - DNA, 12 bp, Homo sapiens
atatcttactaa

SEQ ID NO: 1577966 - DNA, 20 bp, Homo sapiens
atatcttcaagcctgggcgt

SEQ ID NO: 1577967 - DNA, 20 bp, Homo sapiens
atatcttctatatctgaaga

SEQ ID NO: 1577968 - DNA, 19 bp, Homo sapiens
atatcttctgatttgtccc

SEQ ID NO: 1577969 - DNA, 22 bp, Homo sapiens
atatcttgctggattaatgttt

SEQ ID NO: 1577970 - DNA, 13 bp, Homo sapiens
atatcttgtagct

SEQ ID NO: 1577971 - DNA, 13 bp, Homo sapiens
atatctttctctt

SEQ ID NO: 1577972 - DNA, 13 bp, Homo sapiens
atatgaaagctga

SEQ ID NO: 1577973 - DNA, 17 bp, Homo sapiens
atatgaaagctgatttt

SEQ ID NO: 1577974 - DNA, 23 bp, Homo sapiens
atatgaacacagacaaagtgcta

SEQ ID NO: 1577975 - DNA, 15 bp, Homo sapiens
atatgaacatattgt

SEQ ID NO: 1577976 - DNA, 17 bp, Homo sapiens
atatgaacctattttca

SEQ ID NO: 1577977 - DNA, 22 bp, Homo sapiens
atatgaatacagggcatgcatt

SEQ ID NO: 1577978 - DNA, 12 bp, Homo sapiens
atatgaatctat

SEQ ID NO: 1577979 - DNA, 14 bp, Homo sapiens
atatgaatctataa

SEQ ID NO: 1577980 - DNA, 14 bp, Homo sapiens
atatgaattgtaca

SEQ ID NO: 1577981 - DNA, 15 bp, Homo sapiens
atatgaattgtacag

SEQ ID NO: 1577982 - DNA, 22 bp, Homo sapiens
atatgacaatctaccaactgtc

SEQ ID NO: 1577983 - DNA, 17 bp, Homo sapiens
atattaaaaaacttcat

SEQ ID NO: 1577984 - DNA, 17 bp, Homo sapiens
atattaaaacacaaagt

SEQ ID NO: 1577985 - DNA, 13 bp, Homo sapiens
atattaaaatgtc

SEQ ID NO: 1577986 - DNA, 20 bp, Homo sapiens
atattaaacaaagtttcaga

SEQ ID NO: 1577987 - DNA, 13 bp, Homo sapiens
atattaaatacag

SEQ ID NO: 1577988 - DNA, 20 bp, Homo sapiens
atattaacacgctgcctggt

SEQ ID NO: 1577989 - DNA, 16 bp, Homo sapiens
atattaagaaagacta

SEQ ID NO: 1577990 - DNA, 12 bp, Homo sapiens
atattaagacag

SEQ ID NO: 1577991 - DNA, 13 bp, Homo sapiens
atattaagacagt

SEQ ID NO: 1577992 - DNA, 19 bp, Homo sapiens
atattaagacagtgtacaa

SEQ ID NO: 1577993 - DNA, 20 bp, Homo sapiens
atattaagcatgacagaaaa

SEQ ID NO: 1577994 - DNA, 15 bp, Homo sapiens
atattaatgccttta

SEQ ID NO: 1577995 - DNA, 24 bp, Homo sapiens
atattaattagtttatattactct

SEQ ID NO: 1577996 - DNA, 15 bp, Homo sapiens
atattacaacattta

SEQ ID NO: 1577997 - DNA, 21 bp, Homo sapiens
atattacaacatttatgtgag

SEQ ID NO: 1577998 - DNA, 12 bp, Homo sapiens
atattacattta

SEQ ID NO: 1577999 - DNA, 15 bp, Homo sapiens
atattaccagcaaga

SEQ ID NO: 1578000 - DNA, 14 bp, Homo sapiens
atattactgtcttt

SEQ ID NO: 1578001 - DNA, 15 bp, Homo sapiens
atattactgttgcat

SEQ ID NO: 1578002 - DNA, 18 bp, Homo sapiens
atattactgttgcattta

SEQ ID NO: 1578003 - DNA, 17 bp, Homo sapiens
atattactttgtctttt

SEQ ID NO: 1578004 - DNA, 15 bp, Homo sapiens
atattagacatcaat

SEQ ID NO: 1578005 - DNA, 22 bp, Homo sapiens
atattaggatctgcaaacaatg

SEQ ID NO: 1578006 - DNA, 21 bp, Homo sapiens
atattagtgattctgatttca

SEQ ID NO: 1578007 - DNA, 22 bp, Homo sapiens
atattataatttttttcaatat

SEQ ID NO: 1578008 - DNA, 22 bp, Homo sapiens
atattatagaaaattatttgta

SEQ ID NO: 1578009 - DNA, 13 bp, Homo sapiens
atattatatagga

SEQ ID NO: 1578010 - DNA, 19 bp, Homo sapiens
atattatcatgcaaatgct

SEQ ID NO: 1578011 - DNA, 21 bp, Homo sapiens
atattatggcaagtgatatca

SEQ ID NO: 1578012 - DNA, 17 bp, Homo sapiens
atattatgtgtttccat

SEQ ID NO: 1578013 - DNA, 14 bp, Homo sapiens
atattattaatata

SEQ ID NO: 1578014 - DNA, 13 bp, Homo sapiens
atatttataactc

SEQ ID NO: 1578015 - DNA, 15 bp, Homo sapiens
atatttataactcat

SEQ ID NO: 1578016 - DNA, 20 bp, Homo sapiens
atatttatactctagaacat

SEQ ID NO: 1578017 - DNA, 12 bp, Homo sapiens
atatttatccaa

SEQ ID NO: 1578018 - DNA, 20 bp, Homo sapiens
atatttatccaaaatgtgta

SEQ ID NO: 1578019 - DNA, 20 bp, Homo sapiens
atatttatgtagatgtgcat

SEQ ID NO: 1578020 - DNA, 16 bp, Homo sapiens
atatttattacctctg

SEQ ID NO: 1578021 - DNA, 23 bp, Homo sapiens
atatttattattttcacctgttt

SEQ ID NO: 1578022 - DNA, 15 bp, Homo sapiens
atatttattgagtgc

SEQ ID NO: 1578023 - DNA, 14 bp, Homo sapiens
atatttattgatta

SEQ ID NO: 1578024 - DNA, 11 bp, Homo sapiens
atatttattgt

SEQ ID NO: 1578025 - DNA, 13 bp, Homo sapiens
atatttattgtta

SEQ ID NO: 1578026 - DNA, 19 bp, Homo sapiens
atatttcaaacatcagctg

SEQ ID NO: 1578027 - DNA, 21 bp, Homo sapiens
atatttcaaacatcagctgaa

SEQ ID NO: 1578028 - DNA, 12 bp, Homo sapiens
atatttcaagtg

SEQ ID NO: 1578029 - DNA, 23 bp, Homo sapiens
atatttcaagtgcctagactgtt

SEQ ID NO: 1578030 - DNA, 14 bp, Homo sapiens
atatttcaatcttt

SEQ ID NO: 1578031 - DNA, 14 bp, Homo sapiens
atatttcagaaata

SEQ ID NO: 1578032 - DNA, 20 bp, Homo sapiens
atatttcagaaatacagata

SEQ ID NO: 1578033 - DNA, 14 bp, Homo sapiens
atatttcagacatt

SEQ ID NO: 1578034 - DNA, 14 bp, Homo sapiens
atatttcagatatc

SEQ ID NO: 1578035 - DNA, 23 bp, Homo sapiens
atatttcagatatcaaaattcta

SEQ ID NO: 1578036 - DNA, 15 bp, Homo sapiens
atatttcagtggaat

SEQ ID NO: 1578037 - DNA, 21 bp, Homo sapiens
atatttcccatttgtgccaga

SEQ ID NO: 1578038 - DNA, 10 bp, Homo sapiens
atatttccta

SEQ ID NO: 1578039 - DNA, 22 bp, Homo sapiens
atatttcctgacttgagtgttc

SEQ ID NO: 1578040 - DNA, 18 bp, Homo sapiens
atatttcctttatgtgaa

SEQ ID NO: 1578041 - DNA, 19 bp, Homo sapiens
atatttcctttatgtgaat

SEQ ID NO: 1578042 - DNA, 20 bp, Homo sapiens
atatttcctttatgtgaatt

SEQ ID NO: 1578043 - DNA, 19 bp, Homo sapiens
atcatatttaaagatcttt

SEQ ID NO: 1578044 - DNA, 18 bp, Homo sapiens
atcatcaagaagggctgc

SEQ ID NO: 1578045 - DNA, 19 bp, Homo sapiens
atcatcactgtaaagacaa

SEQ ID NO: 1578046 - DNA, 18 bp, Homo sapiens
atcatcattcttgtggga

SEQ ID NO: 1578047 - DNA, 16 bp, Homo sapiens
atcatccacattgttt

SEQ ID NO: 1578048 - DNA, 21 bp, Homo sapiens
atcatcctttaggtaagaagt

SEQ ID NO: 1578049 - DNA, 17 bp, Homo sapiens
atcatcctttgttctga

SEQ ID NO: 1578050 - DNA, 16 bp, Homo sapiens
atcatcgccagaggtg

SEQ ID NO: 1578051 - DNA, 20 bp, Homo sapiens
atcatcgccagaggtgcttc

SEQ ID NO: 1578052 - DNA, 18 bp, Homo sapiens
atcatcgttgttattaaa

SEQ ID NO: 1578053 - DNA, 12 bp, Homo sapiens
atcatctaagtc

SEQ ID NO: 1578054 - DNA, 19 bp, Homo sapiens
atcatctatagaaagctat

SEQ ID NO: 1578055 - DNA, 20 bp, Homo sapiens
atcatgaaaagaggaacagg

SEQ ID NO: 1578056 - DNA, 19 bp, Homo sapiens
atcatgaaacacttctcat

SEQ ID NO: 1578057 - DNA, 16 bp, Homo sapiens
atcatgaaatatgcat

SEQ ID NO: 1578058 - DNA, 13 bp, Homo sapiens
atcatgaactggc

SEQ ID NO: 1578059 - DNA, 15 bp, Homo sapiens
atcatgaactggctt

SEQ ID NO: 1578060 - DNA, 22 bp, Homo sapiens
atcatgaactggcttgtacatt

SEQ ID NO: 1578061 - DNA, 23 bp, Homo sapiens
atcatgaataactgattagtaag

SEQ ID NO: 1578062 - DNA, 19 bp, Homo sapiens
atcatgaatctttgtttca

SEQ ID NO: 1578063 - DNA, 15 bp, Homo sapiens
atcatgaatgtgtaa

SEQ ID NO: 1578064 - DNA, 18 bp, Homo sapiens
atcatgaatgtgtaacac

SEQ ID NO: 1578065 - DNA, 21 bp, Homo sapiens
atcatgaattcccttttaatc

SEQ ID NO: 1578066 - DNA, 23 bp, Homo sapiens
atcatgaattcccttttaatcaa

SEQ ID NO: 1578067 - DNA, 18 bp, Homo sapiens
atcatgaattttaaagta

SEQ ID NO: 1578068 - DNA, 15 bp, Homo sapiens
atcatgagcctgctg

SEQ ID NO: 1578069 - DNA, 21 bp, Homo sapiens
atcatgagcctgctggaagcc

SEQ ID NO: 1578070 - DNA, 17 bp, Homo sapiens
atcatgatggaaaaaat

SEQ ID NO: 1578071 - DNA, 19 bp, Homo sapiens
atcatgccagtatttttaa

SEQ ID NO: 1578072 - DNA, 19 bp, Homo sapiens
atcatgcgttttatatctt

SEQ ID NO: 1578073 - DNA, 15 bp, Homo sapiens
atcatggcttaggat

SEQ ID NO: 1578074 - DNA, 22 bp, Homo sapiens
atcatggtagagaatctctccc

SEQ ID NO: 1578075 - DNA, 21 bp, Homo sapiens
atcatgtcgtaggtaaactaa

SEQ ID NO: 1578076 - DNA, 17 bp, Homo sapiens
atcatgttaaattagaa

SEQ ID NO: 1578077 - DNA, 14 bp, Homo sapiens
atcatgttatttta

SEQ ID NO: 1578078 - DNA, 19 bp, Homo sapiens
atcatgttgatcatgtact

SEQ ID NO: 1578079 - DNA, 18 bp, Homo sapiens
atcatgtttacagaggac

SEQ ID NO: 1578080 - DNA, 23 bp, Homo sapiens
atcatgtttacagaggacagtat

SEQ ID NO: 1578081 - DNA, 15 bp, Homo sapiens
atcatgtttattttg

SEQ ID NO: 1578082 - DNA, 16 bp, Homo sapiens
atcatgtttctttgat

SEQ ID NO: 1578083 - DNA, 12 bp, Homo sapiens
atcattaaaaat

SEQ ID NO: 1578084 - DNA, 16 bp, Homo sapiens
atcattaataagtgaa

SEQ ID NO: 1578085 - DNA, 16 bp, Homo sapiens
atcattactggtaaag

SEQ ID NO: 1578086 - DNA, 11 bp, Homo sapiens
atcattagaac

SEQ ID NO: 1578087 - DNA, 14 bp, Homo sapiens
atcattagttttag

SEQ ID NO: 1578088 - DNA, 23 bp, Homo sapiens
atcattataaacgtgatgatcag

SEQ ID NO: 1578089 - DNA, 22 bp, Homo sapiens
atcattataactgaaggagaag

SEQ ID NO: 1578090 - DNA, 16 bp, Homo sapiens
atcattgctcccctga

SEQ ID NO: 1578091 - DNA, 23 bp, Homo sapiens
atcattgctcccctgatagaaga

SEQ ID NO: 1578092 - DNA, 13 bp, Homo sapiens
atcattgtagaaa

SEQ ID NO: 1578093 - DNA, 19 bp, Homo sapiens
atcattgttggacatttgg

SEQ ID NO: 1578094 - DNA, 21 bp, Homo sapiens
atcatttatcttatctagcaa

SEQ ID NO: 1578095 - DNA, 14 bp, Homo sapiens
atcatttgtttaaa

SEQ ID NO: 1578096 - DNA, 14 bp, Homo sapiens
atcattttaattat

SEQ ID NO: 1578097 - DNA, 22 bp, Homo sapiens
atccaaaagaagcccccagcta

SEQ ID NO: 1578098 - DNA, 14 bp, Homo sapiens
atccaaaatgtgta

SEQ ID NO: 1578099 - DNA, 17 bp, Homo sapiens
atccaaaatgtgtattt

SEQ ID NO: 1578100 - DNA, 12 bp, Homo sapiens
atccaaatctag

SEQ ID NO: 1578101 - DNA, 14 bp, Homo sapiens
atccaagccagagt

SEQ ID NO: 1578102 - DNA, 14 bp, Homo sapiens
atccaagcctccac

SEQ ID NO: 1578103 - DNA, 19 bp, Homo sapiens
atccaagcctccacagcga

SEQ ID NO: 1578104 - DNA, 14 bp, Homo sapiens
atccaagtaccaat

SEQ ID NO: 1578105 - DNA, 23 bp, Homo sapiens
atccaagtaccaatgctgttgta

SEQ ID NO: 1578106 - DNA, 12 bp, Homo sapiens
atccaatattgt

SEQ ID NO: 1578107 - DNA, 15 bp, Homo sapiens
atccaatattgtaat

SEQ ID NO: 1578108 - DNA, 16 bp, Homo sapiens
atccaatattttgcct

SEQ ID NO: 1578109 - DNA, 14 bp, Homo sapiens
atccaatcctcact

SEQ ID NO: 1578110 - DNA, 19 bp, Homo sapiens
atccaatcctcactgggtg

SEQ ID NO: 1578111 - DNA, 18 bp, Homo sapiens
atccaatgtcttttgaca

SEQ ID NO: 1578112 - DNA, 22 bp, Homo sapiens
atccacaaggacctctttactc

SEQ ID NO: 1578113 - DNA, 19 bp, Homo sapiens
atccacacaacaccaggac

SEQ ID NO: 1578114 - DNA, 21 bp, Homo sapiens
atccacacaacaccaggactt

SEQ ID NO: 1578115 - DNA, 15 bp, Homo sapiens
atccacacacagagg

SEQ ID NO: 1578116 - DNA, 23 bp, Homo sapiens
atccacacacagaggaagagcag

SEQ ID NO: 1578117 - DNA, 13 bp, Homo sapiens
atccacattgttt

SEQ ID NO: 1578118 - DNA, 15 bp, Homo sapiens
atccacattgtttta

SEQ ID NO: 1578119 - DNA, 17 bp, Homo sapiens
atccacattgttttaaa

SEQ ID NO: 1578120 - DNA, 14 bp, Homo sapiens
atccacccagccca

SEQ ID NO: 1578121 - DNA, 15 bp, Homo sapiens
atccacccagcccat

SEQ ID NO: 1578122 - DNA, 18 bp, Homo sapiens
atccacccagtgctgcca

SEQ ID NO: 1578123 - DNA, 23 bp, Homo sapiens
atccacccagtgctgccatgcca

SEQ ID NO: 1578124 - DNA, 22 bp, Homo sapiens
atccacccgggggagcccagtg

SEQ ID NO: 1578125 - DNA, 19 bp, Homo sapiens
atccacctcatcactggac

SEQ ID NO: 1578126 - DNA, 18 bp, Homo sapiens
atccacctgtcttggcct

SEQ ID NO: 1578127 - DNA, 16 bp, Homo sapiens
atccactctaccctcc

SEQ ID NO: 1578128 - DNA, 18 bp, Homo sapiens
atccactctaccctccca

SEQ ID NO: 1578129 - DNA, 19 bp, Homo sapiens
atccactctaccctcccac

SEQ ID NO: 1578130 - DNA, 18 bp, Homo sapiens
atccagaaaactgtgatt

SEQ ID NO: 1578131 - DNA, 13 bp, Homo sapiens
atccagaaagaaa

SEQ ID NO: 1578132 - DNA, 15 bp, Homo sapiens
atccagaaagaaaaa

SEQ ID NO: 1578133 - DNA, 20 bp, Homo sapiens
atccagaattgaccttttga

SEQ ID NO: 1578134 - DNA, 22 bp, Homo sapiens
atccagaatttattagtttaaa

SEQ ID NO: 1578135 - DNA, 20 bp, Homo sapiens
atccagatcattcctcagaa

SEQ ID NO: 1578136 - DNA, 19 bp, Homo sapiens
atccagccggaggccagag

SEQ ID NO: 1578137 - DNA, 15 bp, Homo sapiens
atccagcctccaggg

SEQ ID NO: 1578138 - DNA, 17 bp, Homo sapiens
atccagcctggggtctg

SEQ ID NO: 1578139 - DNA, 13 bp, Homo sapiens
atccagcctgtgt

SEQ ID NO: 1578140 - DNA, 22 bp, Homo sapiens
atccagctccccttctgaatca

SEQ ID NO: 1578141 - DNA, 16 bp, Homo sapiens
atccaggaggcagtgg

SEQ ID NO: 1578142 - DNA, 15 bp, Homo sapiens
atccaggcagatcca

SEQ ID NO: 1578143 - DNA, 16 bp, Homo sapiens
atccaggcagatccag

SEQ ID NO: 1578144 - DNA, 19 bp, Homo sapiens
atccaggccactcttagcc

SEQ ID NO: 1578145 - DNA, 23 bp, Homo sapiens
atccaggcgtgggacgtggtcag

SEQ ID NO: 1578146 - DNA, 18 bp, Homo sapiens
atccaggctggccagtgc

SEQ ID NO: 1578147 - DNA, 24 bp, Homo sapiens
atccaggctggccagtgctgccca

SEQ ID NO: 1578148 - DNA, 13 bp, Homo sapiens
atccagggacaga

SEQ ID NO: 1578149 - DNA, 16 bp, Homo sapiens
atccaggtcatgcagt

SEQ ID NO: 1578150 - DNA, 19 bp, Homo sapiens
atccaggttccctcccaga

SEQ ID NO: 1578151 - DNA, 16 bp, Homo sapiens
atccagtaggatccag

SEQ ID NO: 1578152 - DNA, 13 bp, Homo sapiens
atccagtataaga

SEQ ID NO: 1578153 - DNA, 21 bp, Homo sapiens
atccagtgacctctctctctg

SEQ ID NO: 1578154 - DNA, 17 bp, Homo sapiens
atccgtagttccctgaa

SEQ ID NO: 1578155 - DNA, 15 bp, Homo sapiens
atccgtgaagggatt

SEQ ID NO: 1578156 - DNA, 17 bp, Homo sapiens
atccgtgaagtcacatt

SEQ ID NO: 1578157 - DNA, 19 bp, Homo sapiens
atccgttcatagaaattgt

SEQ ID NO: 1578158 - DNA, 14 bp, Homo sapiens
atccgttttttaag

SEQ ID NO: 1578159 - DNA, 14 bp, Homo sapiens
atcctaaaacaaat

SEQ ID NO: 1578160 - DNA, 18 bp, Homo sapiens
atcctaagcatctaagtt

SEQ ID NO: 1578161 - DNA, 18 bp, Homo sapiens
atcctaagggtcgaaagc

SEQ ID NO: 1578162 - DNA, 21 bp, Homo sapiens
atcctaagggtcgaaagctct

SEQ ID NO: 1578163 - DNA, 22 bp, Homo sapiens
atcctaagggtcgaaagctcta

SEQ ID NO: 1578164 - DNA, 17 bp, Homo sapiens
atcctaattgtccacat

SEQ ID NO: 1578165 - DNA, 18 bp, Homo sapiens
atcctaatttctcctccc

SEQ ID NO: 1578166 - DNA, 19 bp, Homo sapiens
atcctaatttctcctccct

SEQ ID NO: 1578167 - DNA, 22 bp, Homo sapiens
atcctaccctcgggcccacctg

SEQ ID NO: 1578168 - DNA, 20 bp, Homo sapiens
atcctagaaccaagcttcag

SEQ ID NO: 1578169 - DNA, 23 bp, Homo sapiens
atcctagaaccaagcttcagagc

SEQ ID NO: 1578170 - DNA, 15 bp, Homo sapiens
atcctagatcctaag

SEQ ID NO: 1578171 - DNA, 16 bp, Homo sapiens
atcctagatcctaagg

SEQ ID NO: 1578172 - DNA, 16 bp, Homo sapiens
atcctagccccgagac

SEQ ID NO: 1578173 - DNA, 15 bp, Homo sapiens
atcctagctttttcc

SEQ ID NO: 1578174 - DNA, 20 bp, Homo sapiens
atcctagtcactaccttcat

SEQ ID NO: 1578175 - DNA, 13 bp, Homo sapiens
atcctagtgggca

SEQ ID NO: 1578176 - DNA, 14 bp, Homo sapiens
atcctatactggtt

SEQ ID NO: 1578177 - DNA, 19 bp, Homo sapiens
atcctatcaacaacaaggt

SEQ ID NO: 1578178 - DNA, 18 bp, Homo sapiens
atcctcaaacatggaaga

SEQ ID NO: 1578179 - DNA, 18 bp, Homo sapiens
atcctcaaagaaagtgta

SEQ ID NO: 1578180 - DNA, 20 bp, Homo sapiens
atcctcaaagaaagtgtatt

SEQ ID NO: 1578181 - DNA, 17 bp, Homo sapiens
atcctcagttggaatca

SEQ ID NO: 1578182 - DNA, 22 bp, Homo sapiens
atccttttccttatttgccttc

SEQ ID NO: 1578183 - DNA, 15 bp, Homo sapiens
atccttttctgcaga

SEQ ID NO: 1578184 - DNA, 13 bp, Homo sapiens
atccttttttaaa

SEQ ID NO: 1578185 - DNA, 22 bp, Homo sapiens
atccttttttaaaagtaaatgt

SEQ ID NO: 1578186 - DNA, 17 bp, Homo sapiens
atcgaagggtttttaga

SEQ ID NO: 1578187 - DNA, 21 bp, Homo sapiens
atcgaagggtttttagagaat

SEQ ID NO: 1578188 - DNA, 13 bp, Homo sapiens
atcgaagtgttta

SEQ ID NO: 1578189 - DNA, 17 bp, Homo sapiens
atcgagaactgccattg

SEQ ID NO: 1578190 - DNA, 16 bp, Homo sapiens
atcgagtgtagctgtg

SEQ ID NO: 1578191 - DNA, 17 bp, Homo sapiens
atcgagtgtagctgtga

SEQ ID NO: 1578192 - DNA, 18 bp, Homo sapiens
atcgatataggcatttgg

SEQ ID NO: 1578193 - DNA, 13 bp, Homo sapiens
atcgatgcagtgc

SEQ ID NO: 1578194 - DNA, 13 bp, Homo sapiens
atcgatgtgctca

SEQ ID NO: 1578195 - DNA, 12 bp, Homo sapiens
atcgattggctt

SEQ ID NO: 1578196 - DNA, 18 bp, Homo sapiens
atcgcaccattctgactc

SEQ ID NO: 1578197 - DNA, 23 bp, Homo sapiens
atcgcccaggctggagctggccc

SEQ ID NO: 1578198 - DNA, 18 bp, Homo sapiens
atcgccctcctttccctt

SEQ ID NO: 1578199 - DNA, 23 bp, Homo sapiens
atcgcgccactacactccagcct

SEQ ID NO: 1578200 - DNA, 18 bp, Homo sapiens
atcgctaagctggctctg

SEQ ID NO: 1578201 - DNA, 18 bp, Homo sapiens
atcgctgatgcagacaca

SEQ ID NO: 1578202 - DNA, 15 bp, Homo sapiens
atcgcttgagcccag

SEQ ID NO: 1578203 - DNA, 19 bp, Homo sapiens
atcgcttgagcccaggagt

SEQ ID NO: 1578204 - DNA, 13 bp, Homo sapiens
atcggaacagctc

SEQ ID NO: 1578205 - DNA, 23 bp, Homo sapiens
atcggaacagctccttactctga

SEQ ID NO: 1578206 - DNA, 14 bp, Homo sapiens
atcggaagcagtgc

SEQ ID NO: 1578207 - DNA, 22 bp, Homo sapiens
atcggaagcagtgccttccata

SEQ ID NO: 1578208 - DNA, 15 bp, Homo sapiens
atcggagcctcctct

SEQ ID NO: 1578209 - DNA, 19 bp, Homo sapiens
atcggcccacagctcccac

SEQ ID NO: 1578210 - DNA, 18 bp, Homo sapiens
atcggctctattctctaa

SEQ ID NO: 1578211 - DNA, 20 bp, Homo sapiens
atcggctggggactgctacc

SEQ ID NO: 1578212 - DNA, 16 bp, Homo sapiens
atcgggagcagtgtct

SEQ ID NO: 1578213 - DNA, 18 bp, Homo sapiens
atcgggagcagtgtcttc

SEQ ID NO: 1578214 - DNA, 21 bp, Homo sapiens
atcgggagcagtgtcttccat

SEQ ID NO: 1578215 - DNA, 20 bp, Homo sapiens
atcgggtccagagaccacac

SEQ ID NO: 1578216 - DNA, 22 bp, Homo sapiens
atctgatagaatgatgttttaa

SEQ ID NO: 1578217 - DNA, 17 bp, Homo sapiens
atctgatggtgagctgg

SEQ ID NO: 1578218 - DNA, 18 bp, Homo sapiens
atctgattggacattttc

SEQ ID NO: 1578219 - DNA, 12 bp, Homo sapiens
atctgatttact

SEQ ID NO: 1578220 - DNA, 20 bp, Homo sapiens
atctgcaaacaatgaagaat

SEQ ID NO: 1578221 - DNA, 16 bp, Homo sapiens
atctgcaaagcatgtt

SEQ ID NO: 1578222 - DNA, 21 bp, Homo sapiens
atctgcaaagcatgttttgca

SEQ ID NO: 1578223 - DNA, 13 bp, Homo sapiens
atctgcaaatagt

SEQ ID NO: 1578224 - DNA, 14 bp, Homo sapiens
atctgcaatatgaa

SEQ ID NO: 1578225 - DNA, 15 bp, Homo sapiens
atctgcacagtcaga

SEQ ID NO: 1578226 - DNA, 19 bp, Homo sapiens
atctgcacagtcagaagga

SEQ ID NO: 1578227 - DNA, 23 bp, Homo sapiens
atctgcaccccttctctcctccc

SEQ ID NO: 1578228 - DNA, 12 bp, Homo sapiens
atctgcaggctg

SEQ ID NO: 1578229 - DNA, 16 bp, Homo sapiens
atctgcaggctgcacc

SEQ ID NO: 1578230 - DNA, 19 bp, Homo sapiens
atctgcattttcaccccac

SEQ ID NO: 1578231 - DNA, 16 bp, Homo sapiens
atctgccaaattgaga

SEQ ID NO: 1578232 - DNA, 16 bp, Homo sapiens
atctgccaagggccga

SEQ ID NO: 1578233 - DNA, 22 bp, Homo sapiens
atctgccattgggaccctccag

SEQ ID NO: 1578234 - DNA, 15 bp, Homo sapiens
atctgcccacctcag

SEQ ID NO: 1578235 - DNA, 13 bp, Homo sapiens
atctgcccagggg

SEQ ID NO: 1578236 - DNA, 19 bp, Homo sapiens
atctgcccaggggtgcccc

SEQ ID NO: 1578237 - DNA, 22 bp, Homo sapiens
atctgcccaggggtgccccctc

SEQ ID NO: 1578238 - DNA, 14 bp, Homo sapiens
atctgcctggcctg

SEQ ID NO: 1578239 - DNA, 17 bp, Homo sapiens
atctgcctggcctggct

SEQ ID NO: 1578240 - DNA, 19 bp, Homo sapiens
atctgcctggcctggctcc

SEQ ID NO: 1578241 - DNA, 17 bp, Homo sapiens
atctgcctgggcctgtg

SEQ ID NO: 1578242 - DNA, 19 bp, Homo sapiens
atctgcctgggcctgtgca

SEQ ID NO: 1578243 - DNA, 23 bp, Homo sapiens
atctgcgagtagatgaacctgca

SEQ ID NO: 1578244 - DNA, 14 bp, Homo sapiens
atctgctaataaaa

SEQ ID NO: 1578245 - DNA, 14 bp, Homo sapiens
atctgctagaaagt

SEQ ID NO: 1578246 - DNA, 16 bp, Homo sapiens
atctgctagtgctgta

SEQ ID NO: 1578247 - DNA, 17 bp, Homo sapiens
atctgctagtgctgtaa

SEQ ID NO: 1578248 - DNA, 23 bp, Homo sapiens
atctgctagtgctgtaatattgt

SEQ ID NO: 1578249 - DNA, 18 bp, Homo sapiens
atctgctcactttaaacc

SEQ ID NO: 1578250 - DNA, 18 bp, Homo sapiens
atctgctctagattcata

SEQ ID NO: 1578251 - DNA, 16 bp, Homo sapiens
atctgctctccttcct

SEQ ID NO: 1578252 - DNA, 21 bp, Homo sapiens
atctgctctccttcctggagc

SEQ ID NO: 1578253 - DNA, 13 bp, Homo sapiens
atctgctgcatag

SEQ ID NO: 1578254 - DNA, 22 bp, Homo sapiens
atctgctgcctctgaaaatatt

SEQ ID NO: 1578255 - DNA, 14 bp, Homo sapiens
atctgctgttgcca

SEQ ID NO: 1578256 - DNA, 19 bp, Homo sapiens
atctgctgttgccatagcc

SEQ ID NO: 1578257 - DNA, 22 bp, Homo sapiens
atctgctgttgccatagcccca

SEQ ID NO: 1578258 - DNA, 15 bp, Homo sapiens
atctgcttatgcagt

SEQ ID NO: 1578259 - DNA, 17 bp, Homo sapiens
atctgcttggttggctg

SEQ ID NO: 1578260 - DNA, 21 bp, Homo sapiens
atctgcttggttggctggcag

SEQ ID NO: 1578261 - DNA, 12 bp, Homo sapiens
atctggaaaggg

SEQ ID NO: 1578262 - DNA, 15 bp, Homo sapiens
atctggaacccagac

SEQ ID NO: 1578263 - DNA, 19 bp, Homo sapiens
atctggaacctcagcctgg

SEQ ID NO: 1578264 - DNA, 21 bp, Homo sapiens
atctggaacctcagcctggcc

SEQ ID NO: 1578265 - DNA, 14 bp, Homo sapiens
atctggaagaaaaa

SEQ ID NO: 1578266 - DNA, 17 bp, Homo sapiens
atctggaatattgtgat

SEQ ID NO: 1578267 - DNA, 20 bp, Homo sapiens
atctggaccccaaagaatag

SEQ ID NO: 1578268 - DNA, 21 bp, Homo sapiens
atctggagaccagggagcctt

SEQ ID NO: 1578269 - DNA, 17 bp, Homo sapiens
atctggaggccttccag

SEQ ID NO: 1578270 - DNA, 21 bp, Homo sapiens
atctggaggccttccagctgc

SEQ ID NO: 1578271 - DNA, 12 bp, Homo sapiens
atctggcagggt

SEQ ID NO: 1578272 - DNA, 19 bp, Homo sapiens
atctggcccagggtgtttg

SEQ ID NO: 1578273 - DNA, 11 bp, Homo sapiens
atctggccctg

SEQ ID NO: 1578274 - DNA, 23 bp, Homo sapiens
atctggcggaggtctctgggagc

SEQ ID NO: 1578275 - DNA, 16 bp, Homo sapiens
atctggctcactgcag

SEQ ID NO: 1578276 - DNA, 14 bp, Homo sapiens
atctggctcagcat

SEQ ID NO: 1578277 - DNA, 22 bp, Homo sapiens
atctggctgcagttttgctatc

SEQ ID NO: 1578278 - DNA, 17 bp, Homo sapiens
atctggcttagtgccac

SEQ ID NO: 1578279 - DNA, 13 bp, Homo sapiens
atctggcttccct

SEQ ID NO: 1578280 - DNA, 16 bp, Homo sapiens
atctggcttccctgga

SEQ ID NO: 1578281 - DNA, 17 bp, Homo sapiens
atctgggaccctttcct

SEQ ID NO: 1578282 - DNA, 23 bp, Homo sapiens
atctgggaccctttccttccttc

SEQ ID NO: 1578283 - DNA, 20 bp, Homo sapiens
atctgggaggcagaacaggc

SEQ ID NO: 1578284 - DNA, 18 bp, Homo sapiens
atctgggagtcccctttt

SEQ ID NO: 1578285 - DNA, 10 bp, Homo sapiens
atctgggcaa

SEQ ID NO: 1578286 - DNA, 17 bp, Homo sapiens
atctgggctgtgggcaa

SEQ ID NO: 1578287 - DNA, 21 bp, Homo sapiens
atctggggagagcggctggag

SEQ ID NO: 1578288 - DNA, 12 bp, Homo sapiens
atctggggaggc

SEQ ID NO: 1578289 - DNA, 16 bp, Homo sapiens
atctgggtaagaagaa

SEQ ID NO: 1578290 - DNA, 17 bp, Homo sapiens
atctgggtaagaagaaa

SEQ ID NO: 1578291 - DNA, 23 bp, Homo sapiens
atctgggtaagaagaaagcaaaa

SEQ ID NO: 1578292 - DNA, 14 bp, Homo sapiens
atctgggtgccctg

SEQ ID NO: 1578293 - DNA, 13 bp, Homo sapiens
atctggtctcttc

SEQ ID NO: 1578294 - DNA, 18 bp, Homo sapiens
atctggtcttgttagaaa

SEQ ID NO: 1578295 - DNA, 14 bp, Homo sapiens
atctggtgacaaat

SEQ ID NO: 1578296 - DNA, 21 bp, Homo sapiens
atctggttttgggtgtttttc

SEQ ID NO: 1578297 - DNA, 14 bp, Homo sapiens
atctgtaaactgtg

SEQ ID NO: 1578298 - DNA, 17 bp, Homo sapiens
atctgtaaactgtgtat

SEQ ID NO: 1578299 - DNA, 14 bp, Homo sapiens
atctgtaaagccag

SEQ ID NO: 1578300 - DNA, 23 bp, Homo sapiens
atctgtaaatttaactgcatata

SEQ ID NO: 1578301 - DNA, 16 bp, Homo sapiens
atctgtaattgataat

SEQ ID NO: 1578302 - DNA, 17 bp, Homo sapiens
atctgtagggctggacc

SEQ ID NO: 1578303 - DNA, 21 bp, Homo sapiens
atctgtagtaatttattgtct

SEQ ID NO: 1578304 - DNA, 22 bp, Homo sapiens
atctgtatataagttgctgtgt

SEQ ID NO: 1578305 - DNA, 17 bp, Homo sapiens
atctgtatttaattttg

SEQ ID NO: 1578306 - DNA, 18 bp, Homo sapiens
atctgtcagcatctggct

SEQ ID NO: 1578307 - DNA, 21 bp, Homo sapiens
atctgtccaaaggaggctggc

SEQ ID NO: 1578308 - DNA, 23 bp, Homo sapiens
atctgtccacatccccagagccc

SEQ ID NO: 1578309 - DNA, 13 bp, Homo sapiens
atctgtcctctgt

SEQ ID NO: 1578310 - DNA, 16 bp, Homo sapiens
atctgtcctctgtagt

SEQ ID NO: 1578311 - DNA, 15 bp, Homo sapiens
atctgtctgattcta

SEQ ID NO: 1578312 - DNA, 17 bp, Homo sapiens
atctgtctgattctatg

SEQ ID NO: 1578313 - DNA, 16 bp, Homo sapiens
atctgtcttgccagcc

SEQ ID NO: 1578314 - DNA, 19 bp, Homo sapiens
atctgtcttgccagccaga

SEQ ID NO: 1578315 - DNA, 17 bp, Homo sapiens
atctgtgaattgagctg

SEQ ID NO: 1578316 - DNA, 19 bp, Homo sapiens
atctgtgactataaagctg

SEQ ID NO: 1578317 - DNA, 22 bp, Homo sapiens
atctgtgaggggctctctcatg

SEQ ID NO: 1578318 - DNA, 19 bp, Homo sapiens
atctgtgaggtgctgatga

SEQ ID NO: 1578319 - DNA, 12 bp, Homo sapiens
atctgtgatgat

SEQ ID NO: 1578320 - DNA, 17 bp, Homo sapiens
atctgtgattggctggt

SEQ ID NO: 1578321 - DNA, 12 bp, Homo sapiens
atctgtgcagga

SEQ ID NO: 1578322 - DNA, 12 bp, Homo sapiens
atctgtgcccca

SEQ ID NO: 1578323 - DNA, 17 bp, Homo sapiens
atctgtggagctgccac

SEQ ID NO: 1578324 - DNA, 13 bp, Homo sapiens
atctgtggcaagc

SEQ ID NO: 1578325 - DNA, 18 bp, Homo sapiens
atctgtggcaagcaccca

SEQ ID NO: 1578326 - DNA, 11 bp, Homo sapiens
atctgtgtatt

SEQ ID NO: 1578327 - DNA, 21 bp, Homo sapiens
atctgtgtggctcctgggccg

SEQ ID NO: 1578328 - DNA, 14 bp, Homo sapiens
atctgttagggcct

SEQ ID NO: 1578329 - DNA, 17 bp, Homo sapiens
atctgttagggccttgg

SEQ ID NO: 1578330 - DNA, 22 bp, Homo sapiens
atctgttatcctgctagctgta

SEQ ID NO: 1578331 - DNA, 12 bp, Homo sapiens
atctgtttctct

SEQ ID NO: 1578332 - DNA, 16 bp, Homo sapiens
atctgtttctctgctg

SEQ ID NO: 1578333 - DNA, 18 bp, Homo sapiens
atctgtttctctgctgtc

SEQ ID NO: 1578334 - DNA, 22 bp, Homo sapiens
atctgttttgtggtttggaata

SEQ ID NO: 1578335 - DNA, 13 bp, Homo sapiens
atcttaaacaatg

SEQ ID NO: 1578336 - DNA, 16 bp, Homo sapiens
atcttaaacaatgtat

SEQ ID NO: 1578337 - DNA, 18 bp, Homo sapiens
atcttaaacaatgtataa

SEQ ID NO: 1578338 - DNA, 10 bp, Homo sapiens
atcttaaact

SEQ ID NO: 1578339 - DNA, 18 bp, Homo sapiens
atcttaaagaaacagctt

SEQ ID NO: 1578340 - DNA, 17 bp, Homo sapiens
atcttaaagatcgtgta

SEQ ID NO: 1578341 - DNA, 19 bp, Homo sapiens
atcttaaagtttcatgtga

SEQ ID NO: 1578342 - DNA, 20 bp, Homo sapiens
atcttaatactgttattctt

SEQ ID NO: 1578343 - DNA, 18 bp, Homo sapiens
atcttaatccattaaaaa

SEQ ID NO: 1578344 - DNA, 15 bp, Homo sapiens
atcttaatgttactc

SEQ ID NO: 1578345 - DNA, 18 bp, Homo sapiens
atcttaattctttgttct

SEQ ID NO: 1578346 - DNA, 17 bp, Homo sapiens
atcttacaatattgatt

SEQ ID NO: 1578347 - DNA, 18 bp, Homo sapiens
atcttagattctctgtgt

SEQ ID NO: 1578348 - DNA, 18 bp, Homo sapiens
atcttagtgcctgagagt

SEQ ID NO: 1578349 - DNA, 14 bp, Homo sapiens
atcttagtttggat

SEQ ID NO: 1578350 - DNA, 23 bp, Homo sapiens
atcttagtttggattcttatgta

SEQ ID NO: 1578351 - DNA, 18 bp, Homo sapiens
atcttatctcagatattt

SEQ ID NO: 1578352 - DNA, 20 bp, Homo sapiens
atcttatctcagatatttgc

SEQ ID NO: 1578353 - DNA, 19 bp, Homo sapiens
atcttattccgagcattcc

SEQ ID NO: 1578354 - DNA, 23 bp, Homo sapiens
atcttattccgagcattccagta

SEQ ID NO: 1578355 - DNA, 16 bp, Homo sapiens
atcttattgtttaatc

SEQ ID NO: 1578356 - DNA, 19 bp, Homo sapiens
atcttcaaactttcacttt

SEQ ID NO: 1578357 - DNA, 18 bp, Homo sapiens
atcttcaaagccttctcc

SEQ ID NO: 1578358 - DNA, 14 bp, Homo sapiens
atcttcaaggtttg

SEQ ID NO: 1578359 - DNA, 14 bp, Homo sapiens
atcttcaatatgaa

SEQ ID NO: 1578360 - DNA, 15 bp, Homo sapiens
atcttcacgacaatg

SEQ ID NO: 1578361 - DNA, 17 bp, Homo sapiens
atcttcactagaagccg

SEQ ID NO: 1578362 - DNA, 13 bp, Homo sapiens
atcttcacttcta

SEQ ID NO: 1578363 - DNA, 22 bp, Homo sapiens
atcttcagttttatctttaatc

SEQ ID NO: 1578364 - DNA, 23 bp, Homo sapiens
atcttccacctgtgccctcacca

SEQ ID NO: 1578365 - DNA, 14 bp, Homo sapiens
atcttcccacagga

SEQ ID NO: 1578366 - DNA, 23 bp, Homo sapiens
atcttcctaataaggtgtggtct

SEQ ID NO: 1578367 - DNA, 14 bp, Homo sapiens
atcttcctgctgct

SEQ ID NO: 1578368 - DNA, 14 bp, Homo sapiens
atcttcctgtgtcc

SEQ ID NO: 1578369 - DNA, 16 bp, Homo sapiens
atcttccttgtgagga

SEQ ID NO: 1578370 - DNA, 17 bp, Homo sapiens
atcttccttgtgaggat

SEQ ID NO: 1578371 - DNA, 15 bp, Homo sapiens
atcttctacttttaa

SEQ ID NO: 1578372 - DNA, 15 bp, Homo sapiens
atcttctcaagttct

SEQ ID NO: 1578373 - DNA, 23 bp, Homo sapiens
atcttctcccccacggtatccta

SEQ ID NO: 1578374 - DNA, 14 bp, Homo sapiens
atcttctgccttct

SEQ ID NO: 1578375 - DNA, 18 bp, Homo sapiens
atcttctgccttctcatg

SEQ ID NO: 1578376 - DNA, 12 bp, Homo sapiens
atcttctggctt

SEQ ID NO: 1578377 - DNA, 14 bp, Homo sapiens
atcttctggcttga

SEQ ID NO: 1578378 - DNA, 20 bp, Homo sapiens
atcttctgggtagtcccctg

SEQ ID NO: 1578379 - DNA, 20 bp, Homo sapiens
atcttcttatgcaatttcct

SEQ ID NO: 1578380 - DNA, 18 bp, Homo sapiens
atcttgaaggaaaaattc

SEQ ID NO: 1578381 - DNA, 22 bp, Homo sapiens
atcttgaaggaaaaattcaata

SEQ ID NO: 1578382 - DNA, 14 bp, Homo sapiens
atcttgaatgtttg

SEQ ID NO: 1578383 - DNA, 17 bp, Homo sapiens
atcttgacattcaaggc

SEQ ID NO: 1578384 - DNA, 16 bp, Homo sapiens
atcttgactttctgat

SEQ ID NO: 1578385 - DNA, 13 bp, Homo sapiens
atcttgagagctg

SEQ ID NO: 1578386 - DNA, 24 bp, Homo sapiens
atcttgcaccccaaagctttcctg

SEQ ID NO: 1578387 - DNA, 18 bp, Homo sapiens
atcttgcagcatttacta

SEQ ID NO: 1578388 - DNA, 21 bp, Homo sapiens
atcttgcctaaatcccaagaa

SEQ ID NO: 1578389 - DNA, 15 bp, Homo sapiens
atcttgcctccaggt

SEQ ID NO: 1578390 - DNA, 21 bp, Homo sapiens
atcttgcctccaggtgcagag

SEQ ID NO: 1578391 - DNA, 16 bp, Homo sapiens
atcttgctaccagtat

SEQ ID NO: 1578392 - DNA, 15 bp, Homo sapiens
atcttgctctgcttg

SEQ ID NO: 1578393 - DNA, 12 bp, Homo sapiens
atcttgctggct

SEQ ID NO: 1578394 - DNA, 15 bp, Homo sapiens
atcttgcttcattgt

SEQ ID NO: 1578395 - DNA, 12 bp, Homo sapiens
atcttgcttgaa

SEQ ID NO: 1578396 - DNA, 12 bp, Homo sapiens
atcttgctttct

SEQ ID NO: 1578397 - DNA, 13 bp, Homo sapiens
atcttgctttctt

SEQ ID NO: 1578398 - DNA, 15 bp, Homo sapiens
atcttggagagctgg

SEQ ID NO: 1578399 - DNA, 21 bp, Homo sapiens
atcttggagctttttcaaaag

SEQ ID NO: 1578400 - DNA, 19 bp, Homo sapiens
atcttggatggtgacattg

SEQ ID NO: 1578401 - DNA, 20 bp, Homo sapiens
atcttggcctaaacctcagt

SEQ ID NO: 1578402 - DNA, 21 bp, Homo sapiens
atcttggcctaaacctcagtt

SEQ ID NO: 1578403 - DNA, 22 bp, Homo sapiens
atcttggctatgtaattcttgt

SEQ ID NO: 1578404 - DNA, 19 bp, Homo sapiens
atcttggggctgatgaaga

SEQ ID NO: 1578405 - DNA, 20 bp, Homo sapiens
atcttggggctgatgaagaa

SEQ ID NO: 1578406 - DNA, 23 bp, Homo sapiens
atcttggtagttctgtgcctccc

SEQ ID NO: 1578407 - DNA, 20 bp, Homo sapiens
atcttgtagctttatcaaag

SEQ ID NO: 1578408 - DNA, 11 bp, Homo sapiens
atcttgtcatg

SEQ ID NO: 1578409 - DNA, 18 bp, Homo sapiens
atcttgtgagtggataat

SEQ ID NO: 1578410 - DNA, 13 bp, Homo sapiens
atcttgtgcttct

SEQ ID NO: 1578411 - DNA, 22 bp, Homo sapiens
atcttgtgcttcttcacttacc

SEQ ID NO: 1578412 - DNA, 16 bp, Homo sapiens
atcttgttactgctga

SEQ ID NO: 1578413 - DNA, 19 bp, Homo sapiens
atcttgttcaggaaaaggt

SEQ ID NO: 1578414 - DNA, 17 bp, Homo sapiens
atcttgttttgaaaata

SEQ ID NO: 1578415 - DNA, 18 bp, Homo sapiens
atctttaacatagtcctg

SEQ ID NO: 1578416 - DNA, 19 bp, Homo sapiens
atctttaacatagtcctgt

SEQ ID NO: 1578417 - DNA, 21 bp, Homo sapiens
atctttaagaatgcttaaaaa

SEQ ID NO: 1578418 - DNA, 18 bp, Homo sapiens
atctttaattaaaacctg

SEQ ID NO: 1578419 - DNA, 17 bp, Homo sapiens
atctttacctgtataca

SEQ ID NO: 1578420 - DNA, 15 bp, Homo sapiens
atctttaggccaggc

SEQ ID NO: 1578421 - DNA, 15 bp, Homo sapiens
atctttataaatgta

SEQ ID NO: 1578422 - DNA, 21 bp, Homo sapiens
atctttatagaaggaatttgt

SEQ ID NO: 1578423 - DNA, 11 bp, Homo sapiens
atctttatgct

SEQ ID NO: 1578424 - DNA, 12 bp, Homo sapiens
atctttattaaa

SEQ ID NO: 1578425 - DNA, 13 bp, Homo sapiens
atctttattaaaa

SEQ ID NO: 1578426 - DNA, 15 bp, Homo sapiens
atctttattaaaaca

SEQ ID NO: 1578427 - DNA, 13 bp, Homo sapiens
atctttattgaaa

SEQ ID NO: 1578428 - DNA, 17 bp, Homo sapiens
atctttcacacttccac

SEQ ID NO: 1578429 - DNA, 14 bp, Homo sapiens
atctttcagaaata

SEQ ID NO: 1578430 - DNA, 17 bp, Homo sapiens
atctttcagaaatataa

SEQ ID NO: 1578431 - DNA, 17 bp, Homo sapiens
atctttccatatccata

SEQ ID NO: 1578432 - DNA, 20 bp, Homo sapiens
atctttcctcaagtatcttc

SEQ ID NO: 1578433 - DNA, 12 bp, Homo sapiens
atctttctcttc

SEQ ID NO: 1578434 - DNA, 18 bp, Homo sapiens
atctttctcttccctgaa

SEQ ID NO: 1578435 - DNA, 11 bp, Homo sapiens
atctttcttct

SEQ ID NO: 1578436 - DNA, 19 bp, Homo sapiens
atctttcttctattttatt

SEQ ID NO: 1578437 - DNA, 22 bp, Homo sapiens
atctttcttctattttattccc

SEQ ID NO: 1578438 - DNA, 18 bp, Homo sapiens
atctttctttctctaatg

SEQ ID NO: 1578439 - DNA, 21 bp, Homo sapiens
atctttgaaaggttagagaat

SEQ ID NO: 1578440 - DNA, 22 bp, Homo sapiens
atctttgaaaggttagagaata

SEQ ID NO: 1578441 - DNA, 13 bp, Homo sapiens
atctttgaaataa

SEQ ID NO: 1578442 - DNA, 17 bp, Homo sapiens
atctttgattctccttc

SEQ ID NO: 1578443 - DNA, 18 bp, Homo sapiens
atctttgattctccttca

SEQ ID NO: 1578444 - DNA, 19 bp, Homo sapiens
atctttgattctccttcag

SEQ ID NO: 1578445 - DNA, 23 bp, Homo sapiens
atctttgcctcaactccaggatt

SEQ ID NO: 1578446 - DNA, 22 bp, Homo sapiens
atctttgccttgggctgctcct

SEQ ID NO: 1578447 - DNA, 20 bp, Homo sapiens
atctttgcgaaaagataaac

SEQ ID NO: 1578448 - DNA, 22 bp, Homo sapiens
atctttgctactgaatgtgttt

SEQ ID NO: 1578449 - DNA, 15 bp, Homo sapiens
atctttgtaccaaaa

SEQ ID NO: 1578450 - DNA, 17 bp, Homo sapiens
atctttgtaccaaaatt

SEQ ID NO: 1578451 - DNA, 21 bp, Homo sapiens
atctttgtaccaaaattttaa

SEQ ID NO: 1578452 - DNA, 14 bp, Homo sapiens
atctttgtataaat

SEQ ID NO: 1578453 - DNA, 16 bp, Homo sapiens
atctttgttacttcct

SEQ ID NO: 1578454 - DNA, 17 bp, Homo sapiens
atcttttaaaatcatga

SEQ ID NO: 1578455 - DNA, 19 bp, Homo sapiens
atcttttatagacgctctt

SEQ ID NO: 1578456 - DNA, 17 bp, Homo sapiens
atcttttattttggaac

SEQ ID NO: 1578457 - DNA, 18 bp, Homo sapiens
atcttttattttggaact

SEQ ID NO: 1578458 - DNA, 22 bp, Homo sapiens
atcttttcattgaacagcaaag

SEQ ID NO: 1578459 - DNA, 14 bp, Homo sapiens
atcttttctaatca

SEQ ID NO: 1578460 - DNA, 20 bp, Homo sapiens
atcttttctaatcacagtgt

SEQ ID NO: 1578461 - DNA, 22 bp, Homo sapiens
atcttttctaatcacagtgttg

SEQ ID NO: 1578462 - DNA, 15 bp, Homo sapiens
atcttttctggatga

SEQ ID NO: 1578463 - DNA, 16 bp, Homo sapiens
atcttttgaagcatag

SEQ ID NO: 1578464 - DNA, 17 bp, Homo sapiens
atcttttgaattcttga

SEQ ID NO: 1578465 - DNA, 18 bp, Homo sapiens
atcttttgtatatctaag

SEQ ID NO: 1578466 - DNA, 19 bp, Homo sapiens
atcttttgtatatctaaga

SEQ ID NO: 1578467 - DNA, 13 bp, Homo sapiens
atcttttgtatta

SEQ ID NO: 1578468 - DNA, 16 bp, Homo sapiens
atctttttatattctt

SEQ ID NO: 1578469 - DNA, 13 bp, Homo sapiens
atctttttgcttc

SEQ ID NO: 1578470 - DNA, 14 bp, Homo sapiens
atctttttgcttct

SEQ ID NO: 1578471 - DNA, 14 bp, Homo sapiens
atcttttttcaaaa

SEQ ID NO: 1578472 - DNA, 21 bp, Homo sapiens
atgaaaaaaggacaatttcaa

SEQ ID NO: 1578473 - DNA, 20 bp, Homo sapiens
atgaaaaacaaaaataacat

SEQ ID NO: 1578474 - DNA, 13 bp, Homo sapiens
atgaaaacatgta

SEQ ID NO: 1578475 - DNA, 14 bp, Homo sapiens
atgaaaagaggaac

SEQ ID NO: 1578476 - DNA, 19 bp, Homo sapiens
atgaaaagattcttctgtg

SEQ ID NO: 1578477 - DNA, 19 bp, Homo sapiens
atgaaaaggagagattaaa

SEQ ID NO: 1578478 - DNA, 16 bp, Homo sapiens
atgaaaataaaacaca

SEQ ID NO: 1578479 - DNA, 17 bp, Homo sapiens
atgaaaataaaacacac

SEQ ID NO: 1578480 - DNA, 18 bp, Homo sapiens
atgaaaataactgaattt

SEQ ID NO: 1578481 - DNA, 19 bp, Homo sapiens
atgaaaataactgaatttg

SEQ ID NO: 1578482 - DNA, 22 bp, Homo sapiens
atgaaaataactgaatttggag

SEQ ID NO: 1578483 - DNA, 16 bp, Homo sapiens
atgaaaataattttcc

SEQ ID NO: 1578484 - DNA, 13 bp, Homo sapiens
atgaaaatacaac

SEQ ID NO: 1578485 - DNA, 22 bp, Homo sapiens
atgaaaatacaacttaaataat

SEQ ID NO: 1578486 - DNA, 16 bp, Homo sapiens
atgaaaatccttttaa

SEQ ID NO: 1578487 - DNA, 16 bp, Homo sapiens
atgaaacacttctcat

SEQ ID NO: 1578488 - DNA, 22 bp, Homo sapiens
atgaaacagaaacaaaaacact

SEQ ID NO: 1578489 - DNA, 16 bp, Homo sapiens
atgaaacagaacttga

SEQ ID NO: 1578490 - DNA, 17 bp, Homo sapiens
atgaaactcctgatttt

SEQ ID NO: 1578491 - DNA, 20 bp, Homo sapiens
atgaaactcctgattttgta

SEQ ID NO: 1578492 - DNA, 23 bp, Homo sapiens
atgaaagatttttactaatatat

SEQ ID NO: 1578493 - DNA, 13 bp, Homo sapiens
atgaaagggaaac

SEQ ID NO: 1578494 - DNA, 14 bp, Homo sapiens
atgaaagggaaact

SEQ ID NO: 1578495 - DNA, 21 bp, Homo sapiens
atgaaagggaaagtcagcttt

SEQ ID NO: 1578496 - DNA, 16 bp, Homo sapiens
atgacagatgttgaat

SEQ ID NO: 1578497 - DNA, 14 bp, Homo sapiens
atgacagatttctg

SEQ ID NO: 1578498 - DNA, 15 bp, Homo sapiens
atgacagccagagcc

SEQ ID NO: 1578499 - DNA, 16 bp, Homo sapiens
atgacagcctgcagca

SEQ ID NO: 1578500 - DNA, 19 bp, Homo sapiens
atgacagctcttctaagga

SEQ ID NO: 1578501 - DNA, 15 bp, Homo sapiens
atgacagctgtccct

SEQ ID NO: 1578502 - DNA, 17 bp, Homo sapiens
atgacagctgtccctgt

SEQ ID NO: 1578503 - DNA, 13 bp, Homo sapiens
atgacagggcaga

SEQ ID NO: 1578504 - DNA, 16 bp, Homo sapiens
atgacagggcagagca

SEQ ID NO: 1578505 - DNA, 14 bp, Homo sapiens
atgacatcacttgt

SEQ ID NO: 1578506 - DNA, 18 bp, Homo sapiens
atgacatcacttgtacaa

SEQ ID NO: 1578507 - DNA, 16 bp, Homo sapiens
atgacatgcactgacc

SEQ ID NO: 1578508 - DNA, 17 bp, Homo sapiens
atgacatgcactgaccc

SEQ ID NO: 1578509 - DNA, 19 bp, Homo sapiens
atgacatgcactgaccctt

SEQ ID NO: 1578510 - DNA, 19 bp, Homo sapiens
atgacattgttaaaataaa

SEQ ID NO: 1578511 - DNA, 22 bp, Homo sapiens
atgacatttctttgtgctttgg

SEQ ID NO: 1578512 - DNA, 21 bp, Homo sapiens
atgacattttttttaactact

SEQ ID NO: 1578513 - DNA, 18 bp, Homo sapiens
atgaccaaaccagccttc

SEQ ID NO: 1578514 - DNA, 19 bp, Homo sapiens
atgaccaaaccagccttcg

SEQ ID NO: 1578515 - DNA, 18 bp, Homo sapiens
atgaccagggatgctggg

SEQ ID NO: 1578516 - DNA, 19 bp, Homo sapiens
atgacccacactgccagaa

SEQ ID NO: 1578517 - DNA, 12 bp, Homo sapiens
atgacccacccc

SEQ ID NO: 1578518 - DNA, 14 bp, Homo sapiens
atgacccacccctg

SEQ ID NO: 1578519 - DNA, 14 bp, Homo sapiens
atgacccactaaag

SEQ ID NO: 1578520 - DNA, 15 bp, Homo sapiens
atgacccactaaaga

SEQ ID NO: 1578521 - DNA, 12 bp, Homo sapiens
atgacccaggct

SEQ ID NO: 1578522 - DNA, 14 bp, Homo sapiens
atgacccttttcat

SEQ ID NO: 1578523 - DNA, 20 bp, Homo sapiens
atgaccgagccctggagagc

SEQ ID NO: 1578524 - DNA, 18 bp, Homo sapiens
atgacctacagtgctgtg

SEQ ID NO: 1578525 - DNA, 18 bp, Homo sapiens
atgacctagttttccatg

SEQ ID NO: 1578526 - DNA, 21 bp, Homo sapiens
atgacctgtgaccagcactgt

SEQ ID NO: 1578527 - DNA, 17 bp, Homo sapiens
atgaccttggggtacaa

SEQ ID NO: 1578528 - DNA, 19 bp, Homo sapiens
atgacgacgacaacgatga

SEQ ID NO: 1578529 - DNA, 19 bp, Homo sapiens
atgacggaagaacatagaa

SEQ ID NO: 1578530 - DNA, 22 bp, Homo sapiens
atgacggtaagtgttctcatga

SEQ ID NO: 1578531 - DNA, 21 bp, Homo sapiens
atgacggtgttaattttgcta

SEQ ID NO: 1578532 - DNA, 11 bp, Homo sapiens
atgactaaaga

SEQ ID NO: 1578533 - DNA, 13 bp, Homo sapiens
atgactacatttt

SEQ ID NO: 1578534 - DNA, 16 bp, Homo sapiens
atgactacattttgag

SEQ ID NO: 1578535 - DNA, 17 bp, Homo sapiens
atgactcacatgatgca

SEQ ID NO: 1578536 - DNA, 13 bp, Homo sapiens
atgactgattact

SEQ ID NO: 1578537 - DNA, 15 bp, Homo sapiens
atgactggctgtctg

SEQ ID NO: 1578538 - DNA, 17 bp, Homo sapiens
atgactgtttttgtagt

SEQ ID NO: 1578539 - DNA, 21 bp, Homo sapiens
atgacttagcgtcaagacatt

SEQ ID NO: 1578540 - DNA, 15 bp, Homo sapiens
atgacttgctgtcca

SEQ ID NO: 1578541 - DNA, 21 bp, Homo sapiens
atgacttgctgtccaggcagc

SEQ ID NO: 1578542 - DNA, 22 bp, Homo sapiens
atgacttttccattgaccagct

SEQ ID NO: 1578543 - DNA, 14 bp, Homo sapiens
atgagaaaagaggc

SEQ ID NO: 1578544 - DNA, 15 bp, Homo sapiens
atgagaaacagctca

SEQ ID NO: 1578545 - DNA, 22 bp, Homo sapiens
atgagaaacagctcagccagtg

SEQ ID NO: 1578546 - DNA, 20 bp, Homo sapiens
atgagaaacttaaatgttat

SEQ ID NO: 1578547 - DNA, 21 bp, Homo sapiens
atgagaaacttaaatgttatt

SEQ ID NO: 1578548 - DNA, 21 bp, Homo sapiens
atgagaacaagtcacagctgc

SEQ ID NO: 1578549 - DNA, 21 bp, Homo sapiens
atgagaagaaaaatggaaaaa

SEQ ID NO: 1578550 - DNA, 15 bp, Homo sapiens
atgagaagagggcct

SEQ ID NO: 1578551 - DNA, 18 bp, Homo sapiens
atgagaagagggcctgtg

SEQ ID NO: 1578552 - DNA, 14 bp, Homo sapiens
atgagaagccaagc

SEQ ID NO: 1578553 - DNA, 22 bp, Homo sapiens
atgagaatagaaacgtaaacta

SEQ ID NO: 1578554 - DNA, 14 bp, Homo sapiens
atgagaatatacct

SEQ ID NO: 1578555 - DNA, 16 bp, Homo sapiens
atgagactcagtgcag

SEQ ID NO: 1578556 - DNA, 15 bp, Homo sapiens
atgagagcaaatgca

SEQ ID NO: 1578557 - DNA, 15 bp, Homo sapiens
atgagagcgacacag

SEQ ID NO: 1578558 - DNA, 18 bp, Homo sapiens
atgagagggcagtgtttc

SEQ ID NO: 1578559 - DNA, 19 bp, Homo sapiens
atgagagggcagtgtttcc

SEQ ID NO: 1578560 - DNA, 19 bp, Homo sapiens
atgagagttccttctcact

SEQ ID NO: 1578561 - DNA, 23 bp, Homo sapiens
atgagatctaagcctttccataa

SEQ ID NO: 1578562 - DNA, 16 bp, Homo sapiens
atgagatggttaaaaa

SEQ ID NO: 1578563 - DNA, 12 bp, Homo sapiens
atgagatgtgtg

SEQ ID NO: 1578564 - DNA, 14 bp, Homo sapiens
atgagatgtgtgga

SEQ ID NO: 1578565 - DNA, 22 bp, Homo sapiens
atgagatgtgtggactgtggca

SEQ ID NO: 1578566 - DNA, 16 bp, Homo sapiens
atgagatttgccagca

SEQ ID NO: 1578567 - DNA, 22 bp, Homo sapiens
atgagcatcagagagtgtacat

SEQ ID NO: 1578568 - DNA, 18 bp, Homo sapiens
atgagccaccgcgcccag

SEQ ID NO: 1578569 - DNA, 17 bp, Homo sapiens
atgagccactgagcctg

SEQ ID NO: 1578570 - DNA, 14 bp, Homo sapiens
atgattactggcct

SEQ ID NO: 1578571 - DNA, 22 bp, Homo sapiens
atgattagaaattacctgtgga

SEQ ID NO: 1578572 - DNA, 23 bp, Homo sapiens
atgattagcaagttacagtgatg

SEQ ID NO: 1578573 - DNA, 14 bp, Homo sapiens
atgattcagaaatt

SEQ ID NO: 1578574 - DNA, 17 bp, Homo sapiens
atgattccgtgtgtgta

SEQ ID NO: 1578575 - DNA, 15 bp, Homo sapiens
atgattctctgtggt

SEQ ID NO: 1578576 - DNA, 16 bp, Homo sapiens
atgattctctgtggtt

SEQ ID NO: 1578577 - DNA, 17 bp, Homo sapiens
atgattcttctaggcat

SEQ ID NO: 1578578 - DNA, 14 bp, Homo sapiens
atgattgaaaagaa

SEQ ID NO: 1578579 - DNA, 12 bp, Homo sapiens
atgattgcagaa

SEQ ID NO: 1578580 - DNA, 19 bp, Homo sapiens
atgattgcttgagctcagg

SEQ ID NO: 1578581 - DNA, 16 bp, Homo sapiens
atgattggattattca

SEQ ID NO: 1578582 - DNA, 18 bp, Homo sapiens
atgattgtttcttcttca

SEQ ID NO: 1578583 - DNA, 16 bp, Homo sapiens
atgatttaaaaacaac

SEQ ID NO: 1578584 - DNA, 18 bp, Homo sapiens
atgatttaaaacatgtaa

SEQ ID NO: 1578585 - DNA, 15 bp, Homo sapiens
atgatttaagtatac

SEQ ID NO: 1578586 - DNA, 20 bp, Homo sapiens
atgatttataaacagacaat

SEQ ID NO: 1578587 - DNA, 12 bp, Homo sapiens
atgatttcaata

SEQ ID NO: 1578588 - DNA, 21 bp, Homo sapiens
atgatttcagtcatagcaagc

SEQ ID NO: 1578589 - DNA, 21 bp, Homo sapiens
atgatttcatcttctggaata

SEQ ID NO: 1578590 - DNA, 22 bp, Homo sapiens
atgatttcatcttctggaatat

SEQ ID NO: 1578591 - DNA, 20 bp, Homo sapiens
atgatttccaaagagaaaaa

SEQ ID NO: 1578592 - DNA, 15 bp, Homo sapiens
atgatttgttttgaa

SEQ ID NO: 1578593 - DNA, 18 bp, Homo sapiens
atgattttatttgacaaa

SEQ ID NO: 1578594 - DNA, 23 bp, Homo sapiens
atgattttatttgacaaaatttg

SEQ ID NO: 1578595 - DNA, 23 bp, Homo sapiens
atgattttcctttttcttcgctg

SEQ ID NO: 1578596 - DNA, 15 bp, Homo sapiens
atgattttttaagca

SEQ ID NO: 1578597 - DNA, 22 bp, Homo sapiens
atgattttttaagcagactcag

SEQ ID NO: 1578598 - DNA, 15 bp, Homo sapiens
atgattttttgaaag

SEQ ID NO: 1578599 - DNA, 18 bp, Homo sapiens
atgcttcctttctctcct

SEQ ID NO: 1578600 - DNA, 19 bp, Homo sapiens
atgcttcctttctctcctg

SEQ ID NO: 1578601 - DNA, 23 bp, Homo sapiens
atgcttcctttctctcctggctc

SEQ ID NO: 1578602 - DNA, 15 bp, Homo sapiens
atgcttgacatacct

SEQ ID NO: 1578603 - DNA, 17 bp, Homo sapiens
atgcttgcataagagct

SEQ ID NO: 1578604 - DNA, 20 bp, Homo sapiens
atgcttgcggcaaaaggaaa

SEQ ID NO: 1578605 - DNA, 22 bp, Homo sapiens
atgcttgcggcaaaaggaaagc

SEQ ID NO: 1578606 - DNA, 15 bp, Homo sapiens
atgcttgggccctgc

SEQ ID NO: 1578607 - DNA, 16 bp, Homo sapiens
atgcttgggccctgca

SEQ ID NO: 1578608 - DNA, 17 bp, Homo sapiens
atgcttgtaacaagaaa

SEQ ID NO: 1578609 - DNA, 12 bp, Homo sapiens
atgcttgtaatt

SEQ ID NO: 1578610 - DNA, 19 bp, Homo sapiens
atgcttgtgaaaatgtgtt

SEQ ID NO: 1578611 - DNA, 22 bp, Homo sapiens
atgcttgtttatgatatttctt

SEQ ID NO: 1578612 - DNA, 18 bp, Homo sapiens
atgctttattaatgtttt

SEQ ID NO: 1578613 - DNA, 21 bp, Homo sapiens
attgataagttcatacattgt

SEQ ID NO: 1578614 - DNA, 14 bp, Homo sapiens
attgatacttcagg

SEQ ID NO: 1578615 - DNA, 21 bp, Homo sapiens
attgatacttcaggtgctttt

SEQ ID NO: 1578616 - DNA, 18 bp, Homo sapiens
attgatagagtgttatca

SEQ ID NO: 1578617 - DNA, 17 bp, Homo sapiens
attgatatgcttataca

SEQ ID NO: 1578618 - DNA, 15 bp, Homo sapiens
attgatcaaattcat

SEQ ID NO: 1578619 - DNA, 16 bp, Homo sapiens
attgatcacacagtgt

SEQ ID NO: 1578620 - DNA, 18 bp, Homo sapiens
attgatcattttcccccc

SEQ ID NO: 1578621 - DNA, 19 bp, Homo sapiens
attgatcggagcctcctct

SEQ ID NO: 1578622 - DNA, 13 bp, Homo sapiens
attgatgcaatat

SEQ ID NO: 1578623 - DNA, 16 bp, Homo sapiens
attgatgcaatataag

SEQ ID NO: 1578624 - DNA, 13 bp, Homo sapiens
attgatgtaagga

SEQ ID NO: 1578625 - DNA, 21 bp, Homo sapiens
attgatgtacagtctgtcatg

SEQ ID NO: 1578626 - DNA, 13 bp, Homo sapiens
attgattcctttt

SEQ ID NO: 1578627 - DNA, 13 bp, Homo sapiens
attgattgggaaa

SEQ ID NO: 1578628 - DNA, 18 bp, Homo sapiens
attgattgggaaaacatt

SEQ ID NO: 1578629 - DNA, 23 bp, Homo sapiens
attgattgggaaaacatttgctg

SEQ ID NO: 1578630 - DNA, 13 bp, Homo sapiens
attgattgtattg

SEQ ID NO: 1578631 - DNA, 20 bp, Homo sapiens
attgattttaaaatgtacat

SEQ ID NO: 1578632 - DNA, 17 bp, Homo sapiens
attgatttttctcttca

SEQ ID NO: 1578633 - DNA, 13 bp, Homo sapiens
attgcaacaaaat

SEQ ID NO: 1578634 - DNA, 16 bp, Homo sapiens
attgcaacaaaataca

SEQ ID NO: 1578635 - DNA, 22 bp, Homo sapiens
attgcaacaaaatacattcttt

SEQ ID NO: 1578636 - DNA, 16 bp, Homo sapiens
attgcaataaagtata

SEQ ID NO: 1578637 - DNA, 17 bp, Homo sapiens
attgcaatatctgaagc

SEQ ID NO: 1578638 - DNA, 22 bp, Homo sapiens
attgcacaatattgaacttttt

SEQ ID NO: 1578639 - DNA, 17 bp, Homo sapiens
attgcacgtggcctctt

SEQ ID NO: 1578640 - DNA, 19 bp, Homo sapiens
attgcacgtggcctcttga

SEQ ID NO: 1578641 - DNA, 13 bp, Homo sapiens
attgcactccagt

SEQ ID NO: 1578642 - DNA, 14 bp, Homo sapiens
attgcactgctgtt

SEQ ID NO: 1578643 - DNA, 20 bp, Homo sapiens
atttctccagttgggactca

SEQ ID NO: 1578644 - DNA, 14 bp, Homo sapiens
atttctcctccctt

SEQ ID NO: 1578645 - DNA, 17 bp, Homo sapiens
atttctcctcccttcct

SEQ ID NO: 1578646 - DNA, 20 bp, Homo sapiens
atttctcctttgataaaata

SEQ ID NO: 1578647 - DNA, 20 bp, Homo sapiens
atttctctccccactgaaaa

SEQ ID NO: 1578648 - DNA, 12 bp, Homo sapiens
atttctcttgct

SEQ ID NO: 1578649 - DNA, 11 bp, Homo sapiens
atttctgagaa

SEQ ID NO: 1578650 - DNA, 14 bp, Homo sapiens
atttctgctaagtt

SEQ ID NO: 1578651 - DNA, 18 bp, Homo sapiens
atttctgctaagttctcc

SEQ ID NO: 1578652 - DNA, 14 bp, Homo sapiens
atttctgctctgga

SEQ ID NO: 1578653 - DNA, 13 bp, Homo sapiens
atttctggttgat

SEQ ID NO: 1578654 - DNA, 14 bp, Homo sapiens
atttctgtctctaa

SEQ ID NO: 1578655 - DNA, 15 bp, Homo sapiens
atttctgtctctaac

SEQ ID NO: 1578656 - DNA, 20 bp, Homo sapiens
atttctgtggagggttgcca

SEQ ID NO: 1578657 - DNA, 21 bp, Homo sapiens
atttctgtggagggttgccat

SEQ ID NO: 1578658 - DNA, 16 bp, Homo sapiens
atttctgtgggagaat

SEQ ID NO: 1578659 - DNA, 15 bp, Homo sapiens
atttctgtgttgcca

SEQ ID NO: 1578660 - DNA, 23 bp, Homo sapiens
atttctgtttcctatttaataca

SEQ ID NO: 1578661 - DNA, 18 bp, Homo sapiens
atttcttagttcatatat

SEQ ID NO: 1578662 - DNA, 15 bp, Homo sapiens
atttcttatcaccac

SEQ ID NO: 1578663 - DNA, 19 bp, Homo sapiens
atttcttatgtgacattaa

SEQ ID NO: 1578664 - DNA, 21 bp, Homo sapiens
atttcttatgtgacattaaca

SEQ ID NO: 1578665 - DNA, 13 bp, Homo sapiens
atttcttccctgc

SEQ ID NO: 1578666 - DNA, 17 bp, Homo sapiens
atttcttcgtgaacata

SEQ ID NO: 1578667 - DNA, 22 bp, Homo sapiens
atttcttctctttagtataatt

SEQ ID NO: 1578668 - DNA, 21 bp, Homo sapiens
atttcttcttctaagaagaca

SEQ ID NO: 1578669 - DNA, 23 bp, Homo sapiens
atttcttcttctaagaagacatt

SEQ ID NO: 1578670 - DNA, 14 bp, Homo sapiens
atttcttgcgagcc

SEQ ID NO: 1578671 - DNA, 11 bp, Homo sapiens
atttcttgctt

SEQ ID NO: 1578672 - DNA, 12 bp, Homo sapiens
atttcttggcat

SEQ ID NO: 1578673 - DNA, 22 bp, Homo sapiens
atttcttggcattggaattcta

SEQ ID NO: 1578674 - DNA, 18 bp, Homo sapiens
atttctttccttcccaat

SEQ ID NO: 1578675 - DNA, 11 bp, Homo sapiens
atttctttctt

SEQ ID NO: 1578676 - DNA, 17 bp, Homo sapiens
atttctttgattgtgaa

SEQ ID NO: 1578677 - DNA, 16 bp, Homo sapiens
atttctttgcattcca

SEQ ID NO: 1578678 - DNA, 19 bp, Homo sapiens
atttctttgtgctttggct

SEQ ID NO: 1578679 - DNA, 23 bp, Homo sapiens
atttctttgttatcaaacttcag

SEQ ID NO: 1578680 - DNA, 18 bp, Homo sapiens
atttctttttaattattt

SEQ ID NO: 1578681 - DNA, 20 bp, Homo sapiens
atttctttttgggagagact

SEQ ID NO: 1578682 - DNA, 20 bp, Homo sapiens
atttgaaaaatataaaatta

SEQ ID NO: 1578683 - DNA, 18 bp, Homo sapiens
atttgaaaatggttttga

SEQ ID NO: 1578684 - DNA, 16 bp, Homo sapiens
atttgaaatagtatac

SEQ ID NO: 1578685 - DNA, 23 bp, Homo sapiens
atttgaagcatgctctgtaagtt

SEQ ID NO: 1578686 - DNA, 17 bp, Homo sapiens
atttgaagtaacttatt

SEQ ID NO: 1578687 - DNA, 19 bp, Homo sapiens
atttgaataaactctcccc

SEQ ID NO: 1578688 - DNA, 17 bp, Homo sapiens
atttgaatgggtccatt

SEQ ID NO: 1578689 - DNA, 11 bp, Homo sapiens
atttgaatgta

SEQ ID NO: 1578690 - DNA, 13 bp, Homo sapiens
atttgaatgttaa

SEQ ID NO: 1578691 - DNA, 18 bp, Homo sapiens
atttgaatgttaagcaga

SEQ ID NO: 1578692 - DNA, 22 bp, Homo sapiens
atttgacacaaagcttctaaag

SEQ ID NO: 1578693 - DNA, 13 bp, Homo sapiens
atttgacctaatc

SEQ ID NO: 1578694 - DNA, 21 bp, Homo sapiens
atttgacctaatcactaattt

SEQ ID NO: 1578695 - DNA, 22 bp, Homo sapiens
atttgacctaatcactaatttt

SEQ ID NO: 1578696 - DNA, 13 bp, Homo sapiens
atttgactatgaa

SEQ ID NO: 1578697 - DNA, 13 bp, Homo sapiens
atttgactattct

SEQ ID NO: 1578698 - DNA, 15 bp, Homo sapiens
atttgacttttctgt

SEQ ID NO: 1578699 - DNA, 16 bp, Homo sapiens
atttgacttttctgta

SEQ ID NO: 1578700 - DNA, 16 bp, Homo sapiens
atttgagaaatgcata

SEQ ID NO: 1578701 - DNA, 12 bp, Homo sapiens
atttgagaagtt

SEQ ID NO: 1578702 - DNA, 20 bp, Homo sapiens
atttgagaatacataaacaa

SEQ ID NO: 1578703 - DNA, 17 bp, Homo sapiens
atttgagagaaatatga

SEQ ID NO: 1578704 - DNA, 14 bp, Homo sapiens
atttgagcatgcac

SEQ ID NO: 1578705 - DNA, 19 bp, Homo sapiens
atttgagggcccagccagg

SEQ ID NO: 1578706 - DNA, 22 bp, Homo sapiens
atttgaggtcaagtaagaagac

SEQ ID NO: 1578707 - DNA, 16 bp, Homo sapiens
atttgatatttttcca

SEQ ID NO: 1578708 - DNA, 22 bp, Homo sapiens
atttgatatttttccatttatt

SEQ ID NO: 1578709 - DNA, 11 bp, Homo sapiens
atttgatgaaa

SEQ ID NO: 1578710 - DNA, 15 bp, Homo sapiens
atttgatgaaagctg

SEQ ID NO: 1578711 - DNA, 21 bp, Homo sapiens
atttgatgaaagctgattact

SEQ ID NO: 1578712 - DNA, 21 bp, Homo sapiens
atttgatgagttaactgtgaa

SEQ ID NO: 1578713 - DNA, 23 bp, Homo sapiens
atttgatggtggtattgtgacca

SEQ ID NO: 1578714 - DNA, 13 bp, Homo sapiens
atttgatgtacat

SEQ ID NO: 1578715 - DNA, 18 bp, Homo sapiens
atttgattcattttcctg

SEQ ID NO: 1578716 - DNA, 22 bp, Homo sapiens
atttgattcattttcctgttca

SEQ ID NO: 1578717 - DNA, 17 bp, Homo sapiens
atttgatttccatctta

SEQ ID NO: 1578718 - DNA, 14 bp, Homo sapiens
atttgatttctaat

SEQ ID NO: 1578719 - DNA, 15 bp, Homo sapiens
atttgatttctaatt

SEQ ID NO: 1578720 - DNA, 21 bp, Homo sapiens
atttgatttctaattgtaagt

SEQ ID NO: 1578721 - DNA, 18 bp, Homo sapiens
atttgcaccatcatgttt

SEQ ID NO: 1578722 - DNA, 22 bp, Homo sapiens
atttgcagagacaggacctgac

SEQ ID NO: 1578723 - DNA, 16 bp, Homo sapiens
atttgcagatgttcaa

SEQ ID NO: 1578724 - DNA, 19 bp, Homo sapiens
atttgcaggattcccttct

SEQ ID NO: 1578725 - DNA, 14 bp, Homo sapiens
atttgcagggtcct

SEQ ID NO: 1578726 - DNA, 21 bp, Homo sapiens
atttgcatctgaaataggaaa

SEQ ID NO: 1578727 - DNA, 21 bp, Homo sapiens
atttgcatggctccagaaatg

SEQ ID NO: 1578728 - DNA, 18 bp, Homo sapiens
atttgcatttcagaatat

SEQ ID NO: 1578729 - DNA, 16 bp, Homo sapiens
atttgctaatttttat

SEQ ID NO: 1578730 - DNA, 17 bp, Homo sapiens
atttgctagttctgctg

SEQ ID NO: 1578731 - DNA, 16 bp, Homo sapiens
atttgctgaactcagc

SEQ ID NO: 1578732 - DNA, 23 bp, Homo sapiens
atttgctgacaaccattaaagtc

SEQ ID NO: 1578733 - DNA, 13 bp, Homo sapiens
atttgctgccatt

SEQ ID NO: 1578734 - DNA, 14 bp, Homo sapiens
atttgctgctcttc

SEQ ID NO: 1578735 - DNA, 23 bp, Homo sapiens
atttgctgggctttttttttctc

SEQ ID NO: 1578736 - DNA, 18 bp, Homo sapiens
atttgcttgtactgggac

SEQ ID NO: 1578737 - DNA, 23 bp, Homo sapiens
atttgcttttcatgtagaactca

SEQ ID NO: 1578738 - DNA, 18 bp, Homo sapiens
atttgctttttcaccaga

SEQ ID NO: 1578739 - DNA, 17 bp, Homo sapiens
atttggaaaggaccaaa

SEQ ID NO: 1578740 - DNA, 18 bp, Homo sapiens
atttggaaaggaccaaat

SEQ ID NO: 1578741 - DNA, 17 bp, Homo sapiens
atttggaacaacaaatc

SEQ ID NO: 1578742 - DNA, 15 bp, Homo sapiens
atttggactgtctat

SEQ ID NO: 1578743 - DNA, 20 bp, Homo sapiens
atttggagacacaactattt

SEQ ID NO: 1578744 - DNA, 14 bp, Homo sapiens
atttggagagaaat

SEQ ID NO: 1578745 - DNA, 20 bp, Homo sapiens
atttggagcacaaaattcaa

SEQ ID NO: 1578746 - DNA, 20 bp, Homo sapiens
atttggagctatcagtgctt

SEQ ID NO: 1578747 - DNA, 21 bp, Homo sapiens
atttggagtggaggcattgtt

SEQ ID NO: 1578748 - DNA, 23 bp, Homo sapiens
atttggatttaaaagcctgctca

SEQ ID NO: 1578749 - DNA, 18 bp, Homo sapiens
atttggcaccaggcaaac

SEQ ID NO: 1578750 - DNA, 16 bp, Homo sapiens
atttggcatctcctgt

SEQ ID NO: 1578751 - DNA, 13 bp, Homo sapiens
atttgggagctga

SEQ ID NO: 1578752 - DNA, 19 bp, Homo sapiens
atttgggcctgctccagac

SEQ ID NO: 1578753 - DNA, 21 bp, Homo sapiens
atttgggcctgctccagacct

SEQ ID NO: 1578754 - DNA, 23 bp, Homo sapiens
atttgggcctgctccagacctga

SEQ ID NO: 1578755 - DNA, 13 bp, Homo sapiens
atttgggctcagg

SEQ ID NO: 1578756 - DNA, 17 bp, Homo sapiens
atttgggctcagggttg

SEQ ID NO: 1578757 - DNA, 13 bp, Homo sapiens
atttgggctctgg

SEQ ID NO: 1578758 - DNA, 17 bp, Homo sapiens
atttgggttctgcctgc

SEQ ID NO: 1578759 - DNA, 20 bp, Homo sapiens
caaaatatattttgtttaca

SEQ ID NO: 1578760 - DNA, 13 bp, Homo sapiens
caaaatattaaca

SEQ ID NO: 1578761 - DNA, 14 bp, Homo sapiens
caaaatattaacat

SEQ ID NO: 1578762 - DNA, 19 bp, Homo sapiens
caaaatatttaagtgaagg

SEQ ID NO: 1578763 - DNA, 13 bp, Homo sapiens
caaaatatttcta

SEQ ID NO: 1578764 - DNA, 14 bp, Homo sapiens
caaaatatttctaa

SEQ ID NO: 1578765 - DNA, 21 bp, Homo sapiens
caaaatatttctaagcttatt

SEQ ID NO: 1578766 - DNA, 14 bp, Homo sapiens
caaaatccaaaact

SEQ ID NO: 1578767 - DNA, 16 bp, Homo sapiens
caaaatccttgcttat

SEQ ID NO: 1578768 - DNA, 11 bp, Homo sapiens
caaaatcttgt

SEQ ID NO: 1578769 - DNA, 24 bp, Homo sapiens
caaaatcttgttaatgtcattgct

SEQ ID NO: 1578770 - DNA, 12 bp, Homo sapiens
caaaatgaaaca

SEQ ID NO: 1578771 - DNA, 14 bp, Homo sapiens
caaaatgacaatga

SEQ ID NO: 1578772 - DNA, 15 bp, Homo sapiens
caaaatgacctggtg

SEQ ID NO: 1578773 - DNA, 17 bp, Homo sapiens
caaaatggaataaaagg

SEQ ID NO: 1578774 - DNA, 20 bp, Homo sapiens
caaaatggggcagaagagaa

SEQ ID NO: 1578775 - DNA, 19 bp, Homo sapiens
caaaatggtacagcttctg

SEQ ID NO: 1578776 - DNA, 21 bp, Homo sapiens
caaaatggtacagcttctgga

SEQ ID NO: 1578777 - DNA, 23 bp, Homo sapiens
caaaatggtacagcttctggagc

SEQ ID NO: 1578778 - DNA, 13 bp, Homo sapiens
caaaatgtctgta

SEQ ID NO: 1578779 - DNA, 10 bp, Homo sapiens
caaaatgttc

SEQ ID NO: 1578780 - DNA, 17 bp, Homo sapiens
caaaatgttctatttaa

SEQ ID NO: 1578781 - DNA, 19 bp, Homo sapiens
caaaatgttctatttaaca

SEQ ID NO: 1578782 - DNA, 21 bp, Homo sapiens
caaaatgttggtcattttatg

SEQ ID NO: 1578783 - DNA, 16 bp, Homo sapiens
caaaattgatgtgttt

SEQ ID NO: 1578784 - DNA, 10 bp, Homo sapiens
caaaattgct

SEQ ID NO: 1578785 - DNA, 16 bp, Homo sapiens
caaaattgcttctaaa

SEQ ID NO: 1578786 - DNA, 21 bp, Homo sapiens
caaaattgcttctaaaacaat

SEQ ID NO: 1578787 - DNA, 13 bp, Homo sapiens
caaaattgttttc

SEQ ID NO: 1578788 - DNA, 23 bp, Homo sapiens
caaaattgttttcacttgtattg

SEQ ID NO: 1578789 - DNA, 22 bp, Homo sapiens
caaaattgttttgagctttcca

SEQ ID NO: 1578790 - DNA, 14 bp, Homo sapiens
caaaatttctatta

SEQ ID NO: 1578791 - DNA, 11 bp, Homo sapiens
caaaatttgtt

SEQ ID NO: 1578792 - DNA, 12 bp, Homo sapiens
caaaattttaaa

SEQ ID NO: 1578793 - DNA, 16 bp, Homo sapiens
caaaattttaaaaaag

SEQ ID NO: 1578794 - DNA, 14 bp, Homo sapiens
caaaattttatttt

SEQ ID NO: 1578795 - DNA, 19 bp, Homo sapiens
caaaattttattttgtgct

SEQ ID NO: 1578796 - DNA, 10 bp, Homo sapiens
caaacaaaaa

SEQ ID NO: 1578797 - DNA, 10 bp, Homo sapiens
caaacaaaac

SEQ ID NO: 1578798 - DNA, 14 bp, Homo sapiens
caaacaaaacttgc

SEQ ID NO: 1578799 - DNA, 18 bp, Homo sapiens
caaacaaaacttgcatct

SEQ ID NO: 1578800 - DNA, 21 bp, Homo sapiens
caaacaaaagctgaacacatt

SEQ ID NO: 1578801 - DNA, 18 bp, Homo sapiens
caaacaaaatttctatta

SEQ ID NO: 1578802 - DNA, 10 bp, Homo sapiens
caaacaaaca

SEQ ID NO: 1578803 - DNA, 13 bp, Homo sapiens
caaacaaacaaaa

SEQ ID NO: 1578804 - DNA, 14 bp, Homo sapiens
caaacaaacaaaaa

SEQ ID NO: 1578805 - DNA, 14 bp, Homo sapiens
caaacaaacaaaac

SEQ ID NO: 1578806 - DNA, 16 bp, Homo sapiens
caaacaaacaaacaaa

SEQ ID NO: 1578807 - DNA, 17 bp, Homo sapiens
caaacaagcttgatttt

SEQ ID NO: 1578808 - DNA, 12 bp, Homo sapiens
caaacaaggaag

SEQ ID NO: 1578809 - DNA, 14 bp, Homo sapiens
caaacaaggaagcc

SEQ ID NO: 1578810 - DNA, 15 bp, Homo sapiens
caaacacaaatgcag

SEQ ID NO: 1578811 - DNA, 21 bp, Homo sapiens
caaacacagttacacttgtgc

SEQ ID NO: 1578812 - DNA, 15 bp, Homo sapiens
caaacacatacagga

SEQ ID NO: 1578813 - DNA, 19 bp, Homo sapiens
caaacactgcagtttcctg

SEQ ID NO: 1578814 - DNA, 15 bp, Homo sapiens
caaacactgccatat

SEQ ID NO: 1578815 - DNA, 21 bp, Homo sapiens
caaacacttgtgacttttgct

SEQ ID NO: 1578816 - DNA, 14 bp, Homo sapiens
caaacagagtatgt

SEQ ID NO: 1578817 - DNA, 19 bp, Homo sapiens
caaacagcaagagtaagca

SEQ ID NO: 1578818 - DNA, 23 bp, Homo sapiens
caaacagcaagagtaagcagtgt

SEQ ID NO: 1578819 - DNA, 15 bp, Homo sapiens
caaacaggaacaatc

SEQ ID NO: 1578820 - DNA, 15 bp, Homo sapiens
caaacaggctgtaat

SEQ ID NO: 1578821 - DNA, 17 bp, Homo sapiens
caaacagtctcaggaaa

SEQ ID NO: 1578822 - DNA, 22 bp, Homo sapiens
caaacatgaaaatttttgagtt

SEQ ID NO: 1578823 - DNA, 15 bp, Homo sapiens
caaacatgagatgtg

SEQ ID NO: 1578824 - DNA, 14 bp, Homo sapiens
caaacatggagaaa

SEQ ID NO: 1578825 - DNA, 16 bp, Homo sapiens
caaacatgtatgtata

SEQ ID NO: 1578826 - DNA, 12 bp, Homo sapiens
caaacattaaaa

SEQ ID NO: 1578827 - DNA, 19 bp, Homo sapiens
caaacattttctcttagaa

SEQ ID NO: 1578828 - DNA, 21 bp, Homo sapiens
caaacattttctcttagaaaa

SEQ ID NO: 1578829 - DNA, 18 bp, Homo sapiens
caaacattttctggccag

SEQ ID NO: 1578830 - DNA, 23 bp, Homo sapiens
caaacattttctggccagtgttt

SEQ ID NO: 1578831 - DNA, 14 bp, Homo sapiens
caaaccaaataaaa

SEQ ID NO: 1578832 - DNA, 13 bp, Homo sapiens
caaaccaacatct

SEQ ID NO: 1578833 - DNA, 15 bp, Homo sapiens
caaaccaacatcttt

SEQ ID NO: 1578834 - DNA, 19 bp, Homo sapiens
caaaccaacatctttgcga

SEQ ID NO: 1578835 - DNA, 11 bp, Homo sapiens
caaaccaagaa

SEQ ID NO: 1578836 - DNA, 15 bp, Homo sapiens
caaaccacaactgac

SEQ ID NO: 1578837 - DNA, 14 bp, Homo sapiens
caaaccacagcagg

SEQ ID NO: 1578838 - DNA, 17 bp, Homo sapiens
caaaccacgcctcttga

SEQ ID NO: 1578839 - DNA, 23 bp, Homo sapiens
caaaccaggacactaccctgaga

SEQ ID NO: 1578840 - DNA, 17 bp, Homo sapiens
caaaccagtatcgctca

SEQ ID NO: 1578841 - DNA, 14 bp, Homo sapiens
caaaccatttcagc

SEQ ID NO: 1578842 - DNA, 22 bp, Homo sapiens
caaaccatttcagccaaactgt

SEQ ID NO: 1578843 - DNA, 20 bp, Homo sapiens
caaaccatttccaacagcaa

SEQ ID NO: 1578844 - DNA, 21 bp, Homo sapiens
caaacccaaaacctcatgaca

SEQ ID NO: 1578845 - DNA, 23 bp, Homo sapiens
caaaccccctccttacgctttgt

SEQ ID NO: 1578846 - DNA, 18 bp, Homo sapiens
caaactgcacacacagct

SEQ ID NO: 1578847 - DNA, 16 bp, Homo sapiens
caaactgctgcatact

SEQ ID NO: 1578848 - DNA, 16 bp, Homo sapiens
caaactggtattctgt

SEQ ID NO: 1578849 - DNA, 19 bp, Homo sapiens
caaactggtattctgttct

SEQ ID NO: 1578850 - DNA, 21 bp, Homo sapiens
caaactggtattctgttctgg

SEQ ID NO: 1578851 - DNA, 22 bp, Homo sapiens
caaactgtgaagcatttacaga

SEQ ID NO: 1578852 - DNA, 13 bp, Homo sapiens
caaactgttgatt

SEQ ID NO: 1578853 - DNA, 16 bp, Homo sapiens
caaacttactattttg

SEQ ID NO: 1578854 - DNA, 18 bp, Homo sapiens
caaacttactattttgac

SEQ ID NO: 1578855 - DNA, 14 bp, Homo sapiens
caaacttactgtca

SEQ ID NO: 1578856 - DNA, 14 bp, Homo sapiens
caaagaaagtgtat

SEQ ID NO: 1578857 - DNA, 12 bp, Homo sapiens
caaagaaatatt

SEQ ID NO: 1578858 - DNA, 14 bp, Homo sapiens
caaagaaatattaa

SEQ ID NO: 1578859 - DNA, 16 bp, Homo sapiens
caaagaaattcagaac

SEQ ID NO: 1578860 - DNA, 23 bp, Homo sapiens
caaagaaattcagaacagcctgc

SEQ ID NO: 1578861 - DNA, 14 bp, Homo sapiens
caaagaagacaaca

SEQ ID NO: 1578862 - DNA, 20 bp, Homo sapiens
caaagaagcttccacaaaat

SEQ ID NO: 1578863 - DNA, 13 bp, Homo sapiens
caaagaattacag

SEQ ID NO: 1578864 - DNA, 21 bp, Homo sapiens
caaagacaaattctgtttctt

SEQ ID NO: 1578865 - DNA, 13 bp, Homo sapiens
caaagacaggcaa

SEQ ID NO: 1578866 - DNA, 17 bp, Homo sapiens
caaagacatgctttcca

SEQ ID NO: 1578867 - DNA, 19 bp, Homo sapiens
caaagacccgggagctggc

SEQ ID NO: 1578868 - DNA, 16 bp, Homo sapiens
caaagactccttgtgg

SEQ ID NO: 1578869 - DNA, 21 bp, Homo sapiens
caaagactctggaggtcatct

SEQ ID NO: 1578870 - DNA, 16 bp, Homo sapiens
caaagagaaaaagaaa

SEQ ID NO: 1578871 - DNA, 17 bp, Homo sapiens
caaagagaaaaagaaat

SEQ ID NO: 1578872 - DNA, 19 bp, Homo sapiens
caaagagaaaaagaaatgc

SEQ ID NO: 1578873 - DNA, 20 bp, Homo sapiens
caaagagagttaaaagcagc

SEQ ID NO: 1578874 - DNA, 19 bp, Homo sapiens
caaagagcctcccaccaga

SEQ ID NO: 1578875 - DNA, 14 bp, Homo sapiens
caaagagccttcag

SEQ ID NO: 1578876 - DNA, 23 bp, Homo sapiens
caaagagccttcagaatgctcct

SEQ ID NO: 1578877 - DNA, 19 bp, Homo sapiens
caaagagcctttccaaaga

SEQ ID NO: 1578878 - DNA, 19 bp, Homo sapiens
caaagaggcctttaaccat

SEQ ID NO: 1578879 - DNA, 14 bp, Homo sapiens
caaagagggcttcc

SEQ ID NO: 1578880 - DNA, 15 bp, Homo sapiens
caaagagggcttcct

SEQ ID NO: 1578881 - DNA, 16 bp, Homo sapiens
caaagaggtgaacatt

SEQ ID NO: 1578882 - DNA, 18 bp, Homo sapiens
caaagatagacaggtcct

SEQ ID NO: 1578883 - DNA, 19 bp, Homo sapiens
caaagatagacaggtcctg

SEQ ID NO: 1578884 - DNA, 22 bp, Homo sapiens
caaagatagacaggtcctgatt

SEQ ID NO: 1578885 - DNA, 16 bp, Homo sapiens
caaagatcaaaataaa

SEQ ID NO: 1578886 - DNA, 22 bp, Homo sapiens
caaagatctgaattaaataaat

SEQ ID NO: 1578887 - DNA, 12 bp, Homo sapiens
caaagatgaaaa

SEQ ID NO: 1578888 - DNA, 23 bp, Homo sapiens
caaagatgcattttgagtgttta

SEQ ID NO: 1578889 - DNA, 16 bp, Homo sapiens
caaagattaaatgtgt

SEQ ID NO: 1578890 - DNA, 19 bp, Homo sapiens
caaagattcatgatttata

SEQ ID NO: 1578891 - DNA, 16 bp, Homo sapiens
caaagattgagaagcc

SEQ ID NO: 1578892 - DNA, 17 bp, Homo sapiens
caaagattgagaagcca

SEQ ID NO: 1578893 - DNA, 19 bp, Homo sapiens
caaagattgattgattttc

SEQ ID NO: 1578894 - DNA, 14 bp, Homo sapiens
caaagattgatttg

SEQ ID NO: 1578895 - DNA, 13 bp, Homo sapiens
caaagatttaatc

SEQ ID NO: 1578896 - DNA, 13 bp, Homo sapiens
caaagatttttgg

SEQ ID NO: 1578897 - DNA, 17 bp, Homo sapiens
caaagcaaatgttggga

SEQ ID NO: 1578898 - DNA, 14 bp, Homo sapiens
caaagcaacaaatt

SEQ ID NO: 1578899 - DNA, 19 bp, Homo sapiens
caaagcaaccacaaatgca

SEQ ID NO: 1578900 - DNA, 14 bp, Homo sapiens
caaagcaagaccct

SEQ ID NO: 1578901 - DNA, 11 bp, Homo sapiens
caaagcaaggg

SEQ ID NO: 1578902 - DNA, 13 bp, Homo sapiens
caaagcaagggct

SEQ ID NO: 1578903 - DNA, 12 bp, Homo sapiens
caaagcacagct

SEQ ID NO: 1578904 - DNA, 14 bp, Homo sapiens
caaagcacagctgg

SEQ ID NO: 1578905 - DNA, 15 bp, Homo sapiens
caaagcacttttaaa

SEQ ID NO: 1578906 - DNA, 23 bp, Homo sapiens
caaagcagctgattcagcagtgc

SEQ ID NO: 1578907 - DNA, 20 bp, Homo sapiens
caaagcagctttaaaaaaat

SEQ ID NO: 1578908 - DNA, 22 bp, Homo sapiens
caaagcagctttaaaaaaataa

SEQ ID NO: 1578909 - DNA, 22 bp, Homo sapiens
caaagccaaactctgccagcca

SEQ ID NO: 1578910 - DNA, 23 bp, Homo sapiens
caaagccaaggcagcgaccccag

SEQ ID NO: 1578911 - DNA, 20 bp, Homo sapiens
caaagccactggaaggagca

SEQ ID NO: 1578912 - DNA, 21 bp, Homo sapiens
caaagccactggaaggagcac

SEQ ID NO: 1578913 - DNA, 11 bp, Homo sapiens
caaagccagaa

SEQ ID NO: 1578914 - DNA, 15 bp, Homo sapiens
caaagccagaggaga

SEQ ID NO: 1578915 - DNA, 11 bp, Homo sapiens
caaagccctgc

SEQ ID NO: 1578916 - DNA, 13 bp, Homo sapiens
caaagccctgcct

SEQ ID NO: 1578917 - DNA, 21 bp, Homo sapiens
caaagcctcttcaaaaagcag

SEQ ID NO: 1578918 - DNA, 14 bp, Homo sapiens
caaagcctggccta

SEQ ID NO: 1578919 - DNA, 16 bp, Homo sapiens
caaagccttctcccta

SEQ ID NO: 1578920 - DNA, 19 bp, Homo sapiens
caaagcgagatcccatctc

SEQ ID NO: 1578921 - DNA, 20 bp, Homo sapiens
caaagcgagatcccatctct

SEQ ID NO: 1578922 - DNA, 17 bp, Homo sapiens
caaagcgcccacccagg

SEQ ID NO: 1578923 - DNA, 21 bp, Homo sapiens
caaaggtgggaggatcatttg

SEQ ID NO: 1578924 - DNA, 19 bp, Homo sapiens
caaaggttctaggtttcaa

SEQ ID NO: 1578925 - DNA, 22 bp, Homo sapiens
caaaggttctaggtttcaaaga

SEQ ID NO: 1578926 - DNA, 16 bp, Homo sapiens
caaaggtttggaagga

SEQ ID NO: 1578927 - DNA, 14 bp, Homo sapiens
caaaggttttgtct

SEQ ID NO: 1578928 - DNA, 13 bp, Homo sapiens
caaagtaaaatga

SEQ ID NO: 1578929 - DNA, 20 bp, Homo sapiens
caaagtaaaatgaacatttt

SEQ ID NO: 1578930 - DNA, 18 bp, Homo sapiens
caaagtacattgtaaaat

SEQ ID NO: 1578931 - DNA, 20 bp, Homo sapiens
caaagtactctttaacatac

SEQ ID NO: 1578932 - DNA, 17 bp, Homo sapiens
caaagtcacaggaagaa

SEQ ID NO: 1578933 - DNA, 16 bp, Homo sapiens
caaagtcacttctcca

SEQ ID NO: 1578934 - DNA, 19 bp, Homo sapiens
caaagtcctgggattacag

SEQ ID NO: 1578935 - DNA, 21 bp, Homo sapiens
caaagtgctgggatgacaggc

SEQ ID NO: 1578936 - DNA, 18 bp, Homo sapiens
caaagtggagctgggagg

SEQ ID NO: 1578937 - DNA, 15 bp, Homo sapiens
caaagtggggaggga

SEQ ID NO: 1578938 - DNA, 12 bp, Homo sapiens
caaagtgtatat

SEQ ID NO: 1578939 - DNA, 19 bp, Homo sapiens
caaagtgtcttttgacatt

SEQ ID NO: 1578940 - DNA, 11 bp, Homo sapiens
caaagtgttaa

SEQ ID NO: 1578941 - DNA, 14 bp, Homo sapiens
caaagtgttgtgtt

SEQ ID NO: 1578942 - DNA, 20 bp, Homo sapiens
caaagtgttgtgttcctggc

SEQ ID NO: 1578943 - DNA, 23 bp, Homo sapiens
caaagtgttgtgttcctggctga

SEQ ID NO: 1578944 - DNA, 16 bp, Homo sapiens
caaagttccaaaatgc

SEQ ID NO: 1578945 - DNA, 18 bp, Homo sapiens
caaagttccaaaatgcca

SEQ ID NO: 1578946 - DNA, 23 bp, Homo sapiens
caaagttctaataatttctaatg

SEQ ID NO: 1578947 - DNA, 15 bp, Homo sapiens
caaagttgttgtaac

SEQ ID NO: 1578948 - DNA, 22 bp, Homo sapiens
caaagttgttgtaacctgctgt

SEQ ID NO: 1578949 - DNA, 23 bp, Homo sapiens
caaagtttacattgtcctgtagc

SEQ ID NO: 1578950 - DNA, 18 bp, Homo sapiens
caaagtttcagagtatat

SEQ ID NO: 1578951 - DNA, 14 bp, Homo sapiens
caaagttttgctgt

SEQ ID NO: 1578952 - DNA, 15 bp, Homo sapiens
caaataaaaatattg

SEQ ID NO: 1578953 - DNA, 18 bp, Homo sapiens
caaataaaaatattgtgt

SEQ ID NO: 1578954 - DNA, 16 bp, Homo sapiens
caaataaaatatcata

SEQ ID NO: 1578955 - DNA, 14 bp, Homo sapiens
caaataaaattggc

SEQ ID NO: 1578956 - DNA, 12 bp, Homo sapiens
caaataaacatt

SEQ ID NO: 1578957 - DNA, 13 bp, Homo sapiens
caaataaacattt

SEQ ID NO: 1578958 - DNA, 14 bp, Homo sapiens
caaataaacctgag

SEQ ID NO: 1578959 - DNA, 18 bp, Homo sapiens
caaataaacctgaggcag

SEQ ID NO: 1578960 - DNA, 20 bp, Homo sapiens
caaataaactgactttttcc

SEQ ID NO: 1578961 - DNA, 19 bp, Homo sapiens
caaataaagtagtaaaaga

SEQ ID NO: 1578962 - DNA, 20 bp, Homo sapiens
caaataaatgattatattca

SEQ ID NO: 1578963 - DNA, 19 bp, Homo sapiens
caaataaattcaataaaaa

SEQ ID NO: 1578964 - DNA, 14 bp, Homo sapiens
caaataagaaataa

SEQ ID NO: 1578965 - DNA, 12 bp, Homo sapiens
caaataagactt

SEQ ID NO: 1578966 - DNA, 14 bp, Homo sapiens
caaataagaggaca

SEQ ID NO: 1578967 - DNA, 22 bp, Homo sapiens
caaataaggacagcagctggtg

SEQ ID NO: 1578968 - DNA, 14 bp, Homo sapiens
caaataataagcaa

SEQ ID NO: 1578969 - DNA, 18 bp, Homo sapiens
caaataataccttagaag

SEQ ID NO: 1578970 - DNA, 13 bp, Homo sapiens
caaataatcacat

SEQ ID NO: 1578971 - DNA, 19 bp, Homo sapiens
caaataatggaaaaatagt

SEQ ID NO: 1578972 - DNA, 23 bp, Homo sapiens
caaatactcattttaggaaaaaa

SEQ ID NO: 1578973 - DNA, 14 bp, Homo sapiens
caaatactcttagg

SEQ ID NO: 1578974 - DNA, 16 bp, Homo sapiens
caaatagaaaatggtc

SEQ ID NO: 1578975 - DNA, 18 bp, Homo sapiens
caaatagccacaattata

SEQ ID NO: 1578976 - DNA, 19 bp, Homo sapiens
caaatagccacaattatat

SEQ ID NO: 1578977 - DNA, 16 bp, Homo sapiens
caaatagccccagact

SEQ ID NO: 1578978 - DNA, 22 bp, Homo sapiens
caaatagccccagactgggccc

SEQ ID NO: 1578979 - DNA, 21 bp, Homo sapiens
caaatagcgatgtgcaggaag

SEQ ID NO: 1578980 - DNA, 15 bp, Homo sapiens
caaataggcagaatg

SEQ ID NO: 1578981 - DNA, 17 bp, Homo sapiens
caaataggctattaaaa

SEQ ID NO: 1578982 - DNA, 23 bp, Homo sapiens
caaataggctattaaaaaagtct

SEQ ID NO: 1578983 - DNA, 12 bp, Homo sapiens
caaatagtgtga

SEQ ID NO: 1578984 - DNA, 15 bp, Homo sapiens
caaatagtgtgaaat

SEQ ID NO: 1578985 - DNA, 19 bp, Homo sapiens
caaatagttgcatagcagt

SEQ ID NO: 1578986 - DNA, 19 bp, Homo sapiens
caaatatacattttctaaa

SEQ ID NO: 1578987 - DNA, 14 bp, Homo sapiens
caaatatagttgaa

SEQ ID NO: 1578988 - DNA, 18 bp, Homo sapiens
caaatatcatttactctt

SEQ ID NO: 1578989 - DNA, 14 bp, Homo sapiens
caaatatgcaaagc

SEQ ID NO: 1578990 - DNA, 18 bp, Homo sapiens
caaatatgcaaagcactg

SEQ ID NO: 1578991 - DNA, 19 bp, Homo sapiens
caaatatgcaaagcactga

SEQ ID NO: 1578992 - DNA, 15 bp, Homo sapiens
caaatatgtcctggg

SEQ ID NO: 1578993 - DNA, 14 bp, Homo sapiens
caaatattattcaa

SEQ ID NO: 1578994 - DNA, 20 bp, Homo sapiens
caaatattattcaagtgcct

SEQ ID NO: 1578995 - DNA, 14 bp, Homo sapiens
caaatattgaagtt

SEQ ID NO: 1578996 - DNA, 21 bp, Homo sapiens
caaatgtaattgaataaagtt

SEQ ID NO: 1578997 - DNA, 19 bp, Homo sapiens
caaatgtcagatacaatgt

SEQ ID NO: 1578998 - DNA, 15 bp, Homo sapiens
caaatgtcattgtct

SEQ ID NO: 1578999 - DNA, 18 bp, Homo sapiens
caaatgtcctccagaagc

SEQ ID NO: 1579000 - DNA, 15 bp, Homo sapiens
caaatgtctaattgt

SEQ ID NO: 1579001 - DNA, 20 bp, Homo sapiens
caaatgtgatcaactgttca

SEQ ID NO: 1579002 - DNA, 21 bp, Homo sapiens
caaatgtggcaattattttgg

SEQ ID NO: 1579003 - DNA, 20 bp, Homo sapiens
caaatgtgtttttctatata

SEQ ID NO: 1579004 - DNA, 15 bp, Homo sapiens
caaatgttcatcctc

SEQ ID NO: 1579005 - DNA, 15 bp, Homo sapiens
caaatgttctaagtt

SEQ ID NO: 1579006 - DNA, 17 bp, Homo sapiens
caaatgtttatgttttc

SEQ ID NO: 1579007 - DNA, 12 bp, Homo sapiens
caaatgtttcct

SEQ ID NO: 1579008 - DNA, 14 bp, Homo sapiens
caaatgtttcctta

SEQ ID NO: 1579009 - DNA, 21 bp, Homo sapiens
caaatgtttccttaaacatga

SEQ ID NO: 1579010 - DNA, 21 bp, Homo sapiens
caaattaaaacaaatatacat

SEQ ID NO: 1579011 - DNA, 15 bp, Homo sapiens
caaattaatctttct

SEQ ID NO: 1579012 - DNA, 15 bp, Homo sapiens
caaattattctagtc

SEQ ID NO: 1579013 - DNA, 20 bp, Homo sapiens
caaattcaagagcctcccct

SEQ ID NO: 1579014 - DNA, 15 bp, Homo sapiens
caaattctgtttctt

SEQ ID NO: 1579015 - DNA, 13 bp, Homo sapiens
caaattctttagt

SEQ ID NO: 1579016 - DNA, 14 bp, Homo sapiens
caaattgagataat

SEQ ID NO: 1579017 - DNA, 20 bp, Homo sapiens
caaattgccctatgctgtgc

SEQ ID NO: 1579018 - DNA, 13 bp, Homo sapiens
caaattgccttca

SEQ ID NO: 1579019 - DNA, 15 bp, Homo sapiens
caaattgctgcatat

SEQ ID NO: 1579020 - DNA, 12 bp, Homo sapiens
caaattgctgct

SEQ ID NO: 1579021 - DNA, 15 bp, Homo sapiens
caaattgctgcttgg

SEQ ID NO: 1579022 - DNA, 21 bp, Homo sapiens
caaattggaatggaactactg

SEQ ID NO: 1579023 - DNA, 13 bp, Homo sapiens
caaattggacagc

SEQ ID NO: 1579024 - DNA, 15 bp, Homo sapiens
caaattggacagcta

SEQ ID NO: 1579025 - DNA, 19 bp, Homo sapiens
caaatttatgcatttcatt

SEQ ID NO: 1579026 - DNA, 22 bp, Homo sapiens
caaatttatgcatttcattcaa

SEQ ID NO: 1579027 - DNA, 17 bp, Homo sapiens
caaatttcatgaccagt

SEQ ID NO: 1579028 - DNA, 19 bp, Homo sapiens
caaatttcctgtttgaaat

SEQ ID NO: 1579029 - DNA, 16 bp, Homo sapiens
caaatttggccttaag

SEQ ID NO: 1579030 - DNA, 17 bp, Homo sapiens
caaatttggccttaaga

SEQ ID NO: 1579031 - DNA, 21 bp, Homo sapiens
caaatttggccttaagaactg

SEQ ID NO: 1579032 - DNA, 11 bp, Homo sapiens
caaatttgtgt

SEQ ID NO: 1579033 - DNA, 18 bp, Homo sapiens
caaattttaaaacatttt

SEQ ID NO: 1579034 - DNA, 13 bp, Homo sapiens
caaattttgagca

SEQ ID NO: 1579035 - DNA, 13 bp, Homo sapiens
caacaaaaaatac

SEQ ID NO: 1579036 - DNA, 13 bp, Homo sapiens
caacaaaatacat

SEQ ID NO: 1579037 - DNA, 19 bp, Homo sapiens
caacaaaatcatggcttag

SEQ ID NO: 1579038 - DNA, 20 bp, Homo sapiens
caacaaaccctctgtagcta

SEQ ID NO: 1579039 - DNA, 20 bp, Homo sapiens
caacaaagaaacaaagatgt

SEQ ID NO: 1579040 - DNA, 19 bp, Homo sapiens
caacaacatgaaactgcct

SEQ ID NO: 1579041 - DNA, 16 bp, Homo sapiens
caacaacgtgagagaa

SEQ ID NO: 1579042 - DNA, 22 bp, Homo sapiens
caacaacgtgagagaaagagag

SEQ ID NO: 1579043 - DNA, 20 bp, Homo sapiens
caacaactctgcctttatga

SEQ ID NO: 1579044 - DNA, 21 bp, Homo sapiens
caacaactctgcctttatgat

SEQ ID NO: 1579045 - DNA, 20 bp, Homo sapiens
caacaagaccgccccagggc

SEQ ID NO: 1579046 - DNA, 23 bp, Homo sapiens
caacaagaccgccccagggctat

SEQ ID NO: 1579047 - DNA, 16 bp, Homo sapiens
caacaagactgccagg

SEQ ID NO: 1579048 - DNA, 17 bp, Homo sapiens
caacaagactgccaggt

SEQ ID NO: 1579049 - DNA, 22 bp, Homo sapiens
caacaagcccgttagccccagg

SEQ ID NO: 1579050 - DNA, 12 bp, Homo sapiens
caacaataataa

SEQ ID NO: 1579051 - DNA, 16 bp, Homo sapiens
caacaatggggtgggc

SEQ ID NO: 1579052 - DNA, 18 bp, Homo sapiens
caacaatgtgaggggtcc

SEQ ID NO: 1579053 - DNA, 13 bp, Homo sapiens
caacaatttcaat

SEQ ID NO: 1579054 - DNA, 22 bp, Homo sapiens
caacacaaagagaaaaagaaat

SEQ ID NO: 1579055 - DNA, 14 bp, Homo sapiens
caacacagaggcag

SEQ ID NO: 1579056 - DNA, 22 bp, Homo sapiens
caacacagcctgggccccagct

SEQ ID NO: 1579057 - DNA, 15 bp, Homo sapiens
caacaccaaaaaata

SEQ ID NO: 1579058 - DNA, 12 bp, Homo sapiens
caacaccacaga

SEQ ID NO: 1579059 - DNA, 23 bp, Homo sapiens
caacatggagaaaccctgtctct

SEQ ID NO: 1579060 - DNA, 15 bp, Homo sapiens
caacatggtaattca

SEQ ID NO: 1579061 - DNA, 22 bp, Homo sapiens
caacatggtgaaacccccatct

SEQ ID NO: 1579062 - DNA, 23 bp, Homo sapiens
caacatgttctaccgtggatttg

SEQ ID NO: 1579063 - DNA, 13 bp, Homo sapiens
caacatgtttctg

SEQ ID NO: 1579064 - DNA, 20 bp, Homo sapiens
caacattaaaacaatattgt

SEQ ID NO: 1579065 - DNA, 15 bp, Homo sapiens
caacattaaacacaa

SEQ ID NO: 1579066 - DNA, 16 bp, Homo sapiens
caacattatgatctaa

SEQ ID NO: 1579067 - DNA, 19 bp, Homo sapiens
caacattatgatctaataa

SEQ ID NO: 1579068 - DNA, 21 bp, Homo sapiens
caacatttttttttctccata

SEQ ID NO: 1579069 - DNA, 18 bp, Homo sapiens
caaccaagtcatgtgcat

SEQ ID NO: 1579070 - DNA, 14 bp, Homo sapiens
caaccaagtgtgct

SEQ ID NO: 1579071 - DNA, 14 bp, Homo sapiens
caaccactggtctg

SEQ ID NO: 1579072 - DNA, 14 bp, Homo sapiens
caaccactgtaaaa

SEQ ID NO: 1579073 - DNA, 13 bp, Homo sapiens
caaccagccagcg

SEQ ID NO: 1579074 - DNA, 16 bp, Homo sapiens
caaccagccagcgtcc

SEQ ID NO: 1579075 - DNA, 11 bp, Homo sapiens
caaccagcccg

SEQ ID NO: 1579076 - DNA, 22 bp, Homo sapiens
caaccaggccttcatcctcctc

SEQ ID NO: 1579077 - DNA, 14 bp, Homo sapiens
caaccataaaagaa

SEQ ID NO: 1579078 - DNA, 15 bp, Homo sapiens
caaccatagaactgt

SEQ ID NO: 1579079 - DNA, 14 bp, Homo sapiens
caaccattaaagtc

SEQ ID NO: 1579080 - DNA, 22 bp, Homo sapiens
caaccatttatcttgaaggaaa

SEQ ID NO: 1579081 - DNA, 21 bp, Homo sapiens
caacccaaaccatgagaattt

SEQ ID NO: 1579082 - DNA, 15 bp, Homo sapiens
caacccacagctcag

SEQ ID NO: 1579083 - DNA, 19 bp, Homo sapiens
caacccacagctcagctgc

SEQ ID NO: 1579084 - DNA, 19 bp, Homo sapiens
caacccacatggggttcct

SEQ ID NO: 1579085 - DNA, 21 bp, Homo sapiens
caacccagccacgactgccat

SEQ ID NO: 1579086 - DNA, 20 bp, Homo sapiens
caacccagtcacactgtggc

SEQ ID NO: 1579087 - DNA, 21 bp, Homo sapiens
caacccagtcacactgtggcc

SEQ ID NO: 1579088 - DNA, 15 bp, Homo sapiens
caacccattagccat

SEQ ID NO: 1579089 - DNA, 22 bp, Homo sapiens
caacccattgttgtcaaggaag

SEQ ID NO: 1579090 - DNA, 20 bp, Homo sapiens
caaccccagggcccccacag

SEQ ID NO: 1579091 - DNA, 13 bp, Homo sapiens
caacccccacccc

SEQ ID NO: 1579092 - DNA, 17 bp, Homo sapiens
caacccccaccccacac

SEQ ID NO: 1579093 - DNA, 12 bp, Homo sapiens
caacccccagct

SEQ ID NO: 1579094 - DNA, 13 bp, Homo sapiens
caacccccatctc

SEQ ID NO: 1579095 - DNA, 16 bp, Homo sapiens
caaccccccacctgcc

SEQ ID NO: 1579096 - DNA, 14 bp, Homo sapiens
caaccccccagcac

SEQ ID NO: 1579097 - DNA, 19 bp, Homo sapiens
caaccccccagcactgagg

SEQ ID NO: 1579098 - DNA, 16 bp, Homo sapiens
caacccccctcctgct

SEQ ID NO: 1579099 - DNA, 17 bp, Homo sapiens
caacccccctcctgctc

SEQ ID NO: 1579100 - DNA, 20 bp, Homo sapiens
caaccccgcggtgctctggc

SEQ ID NO: 1579101 - DNA, 21 bp, Homo sapiens
caacccctgacctaccccagc

SEQ ID NO: 1579102 - DNA, 13 bp, Homo sapiens
caacccctgtacc

SEQ ID NO: 1579103 - DNA, 14 bp, Homo sapiens
caacccctgtaccc

SEQ ID NO: 1579104 - DNA, 22 bp, Homo sapiens
caacccctgtacccagctcctt

SEQ ID NO: 1579105 - DNA, 22 bp, Homo sapiens
caaccctatctcctgacagaag

SEQ ID NO: 1579106 - DNA, 21 bp, Homo sapiens
caaccctctcctgtctgccct

SEQ ID NO: 1579107 - DNA, 19 bp, Homo sapiens
caaccctggcattatgtcc

SEQ ID NO: 1579108 - DNA, 22 bp, Homo sapiens
caaccctgggctattgctgctg

SEQ ID NO: 1579109 - DNA, 17 bp, Homo sapiens
caaccctgggctgggga

SEQ ID NO: 1579110 - DNA, 18 bp, Homo sapiens
caaccctgggctggggag

SEQ ID NO: 1579111 - DNA, 16 bp, Homo sapiens
caaccctggggaagga

SEQ ID NO: 1579112 - DNA, 20 bp, Homo sapiens
caaccctggggaaggagcca

SEQ ID NO: 1579113 - DNA, 11 bp, Homo sapiens
caaccctgtgg

SEQ ID NO: 1579114 - DNA, 12 bp, Homo sapiens
caaccctgtggg

SEQ ID NO: 1579115 - DNA, 14 bp, Homo sapiens
caaccctgtgggct

SEQ ID NO: 1579116 - DNA, 17 bp, Homo sapiens
caacccttccctcacct

SEQ ID NO: 1579117 - DNA, 18 bp, Homo sapiens
caacccttccctcacctt

SEQ ID NO: 1579118 - DNA, 13 bp, Homo sapiens
caacctaaaactc

SEQ ID NO: 1579119 - DNA, 13 bp, Homo sapiens
caacctactgtct

SEQ ID NO: 1579120 - DNA, 19 bp, Homo sapiens
caacctagaatgtcagatt

SEQ ID NO: 1579121 - DNA, 16 bp, Homo sapiens
caacctcaatgccctg

SEQ ID NO: 1579122 - DNA, 18 bp, Homo sapiens
caacctcaatgccctgcc

SEQ ID NO: 1579123 - DNA, 19 bp, Homo sapiens
caacctcaatgccctgcca

SEQ ID NO: 1579124 - DNA, 14 bp, Homo sapiens
caacctcagggctc

SEQ ID NO: 1579125 - DNA, 17 bp, Homo sapiens
caacctcagggctccca

SEQ ID NO: 1579126 - DNA, 19 bp, Homo sapiens
caacctcagggctcccagg

SEQ ID NO: 1579127 - DNA, 11 bp, Homo sapiens
caacctcctgc

SEQ ID NO: 1579128 - DNA, 14 bp, Homo sapiens
caacctcctgctct

SEQ ID NO: 1579129 - DNA, 15 bp, Homo sapiens
caacctcctgctctg

SEQ ID NO: 1579130 - DNA, 17 bp, Homo sapiens
caacctcctgctctggg

SEQ ID NO: 1579131 - DNA, 18 bp, Homo sapiens
caacctctcctttctgtg

SEQ ID NO: 1579132 - DNA, 15 bp, Homo sapiens
caacctctctgatct

SEQ ID NO: 1579133 - DNA, 14 bp, Homo sapiens
caacctctgcctcc

SEQ ID NO: 1579134 - DNA, 15 bp, Homo sapiens
caacctctgcctccc

SEQ ID NO: 1579135 - DNA, 15 bp, Homo sapiens
caacctgaaatttat

SEQ ID NO: 1579136 - DNA, 22 bp, Homo sapiens
caacctgaaggtcccctggcag

SEQ ID NO: 1579137 - DNA, 20 bp, Homo sapiens
caacctgaccaacatggaga

SEQ ID NO: 1579138 - DNA, 23 bp, Homo sapiens
caacctgaccaacatggagaaac

SEQ ID NO: 1579139 - DNA, 17 bp, Homo sapiens
caacctgcaaagatctg

SEQ ID NO: 1579140 - DNA, 20 bp, Homo sapiens
caacctgcttttttctgttt

SEQ ID NO: 1579141 - DNA, 17 bp, Homo sapiens
caacctggacttcctgt

SEQ ID NO: 1579142 - DNA, 17 bp, Homo sapiens
caacctgtaactcacat

SEQ ID NO: 1579143 - DNA, 20 bp, Homo sapiens
caacctgttacctactttga

SEQ ID NO: 1579144 - DNA, 21 bp, Homo sapiens
caacctgttcttagagtgtag

SEQ ID NO: 1579145 - DNA, 16 bp, Homo sapiens
caaccttccaagtgta

SEQ ID NO: 1579146 - DNA, 15 bp, Homo sapiens
caaccttctggggga

SEQ ID NO: 1579147 - DNA, 19 bp, Homo sapiens
caaccttctgtggctcaca

SEQ ID NO: 1579148 - DNA, 20 bp, Homo sapiens
caaccttctgtggctcacag

SEQ ID NO: 1579149 - DNA, 13 bp, Homo sapiens
caacgacaaagcc

SEQ ID NO: 1579150 - DNA, 13 bp, Homo sapiens
caacgagacacat

SEQ ID NO: 1579151 - DNA, 20 bp, Homo sapiens
caacgagacacattgccttc

SEQ ID NO: 1579152 - DNA, 21 bp, Homo sapiens
caacgagacacattgccttct

SEQ ID NO: 1579153 - DNA, 13 bp, Homo sapiens
caacgcagccctg

SEQ ID NO: 1579154 - DNA, 17 bp, Homo sapiens
caacgcccctccaaacc

SEQ ID NO: 1579155 - DNA, 15 bp, Homo sapiens
caacgcccctgtggc

SEQ ID NO: 1579156 - DNA, 18 bp, Homo sapiens
caacgcccctgtggccaa

SEQ ID NO: 1579157 - DNA, 18 bp, Homo sapiens
caacggccctgcagccag

SEQ ID NO: 1579158 - DNA, 19 bp, Homo sapiens
caacggccctgcagccagc

SEQ ID NO: 1579159 - DNA, 20 bp, Homo sapiens
caacgggaccccctggccct

SEQ ID NO: 1579160 - DNA, 23 bp, Homo sapiens
caacggtctcctgactggtgctg

SEQ ID NO: 1579161 - DNA, 13 bp, Homo sapiens
caacgtcccctcc

SEQ ID NO: 1579162 - DNA, 21 bp, Homo sapiens
caacgtgagagaaagagagaa

SEQ ID NO: 1579163 - DNA, 22 bp, Homo sapiens
caacgtgagagaaagagagaag

SEQ ID NO: 1579164 - DNA, 23 bp, Homo sapiens
caacgtgagagaaagagagaagc

SEQ ID NO: 1579165 - DNA, 16 bp, Homo sapiens
caacgtgcaaagccaa

SEQ ID NO: 1579166 - DNA, 20 bp, Homo sapiens
caacgtgcaaagccaaggca

SEQ ID NO: 1579167 - DNA, 21 bp, Homo sapiens
caacgtgcgtgtctctgccat

SEQ ID NO: 1579168 - DNA, 17 bp, Homo sapiens
caactaaaatttgaagt

SEQ ID NO: 1579169 - DNA, 18 bp, Homo sapiens
caactaaagttgtacttt

SEQ ID NO: 1579170 - DNA, 20 bp, Homo sapiens
caactaaagttgtactttaa

SEQ ID NO: 1579171 - DNA, 14 bp, Homo sapiens
caactaatttttgt

SEQ ID NO: 1579172 - DNA, 15 bp, Homo sapiens
caactaatttttgta

SEQ ID NO: 1579173 - DNA, 15 bp, Homo sapiens
caactactaatagaa

SEQ ID NO: 1579174 - DNA, 16 bp, Homo sapiens
caactagaagcctagt

SEQ ID NO: 1579175 - DNA, 19 bp, Homo sapiens
caactagatcaaggagccc

SEQ ID NO: 1579176 - DNA, 13 bp, Homo sapiens
caactagatttgt

SEQ ID NO: 1579177 - DNA, 22 bp, Homo sapiens
caactagatttgtccttttatt

SEQ ID NO: 1579178 - DNA, 18 bp, Homo sapiens
caactatattatcatgca

SEQ ID NO: 1579179 - DNA, 22 bp, Homo sapiens
caactatgatatggtaaaagtt

SEQ ID NO: 1579180 - DNA, 14 bp, Homo sapiens
caactatgtaattt

SEQ ID NO: 1579181 - DNA, 15 bp, Homo sapiens
caactatttttccaa

SEQ ID NO: 1579182 - DNA, 13 bp, Homo sapiens
caactccagcaac

SEQ ID NO: 1579183 - DNA, 22 bp, Homo sapiens
caactccagcaacttcttctcc

SEQ ID NO: 1579184 - DNA, 19 bp, Homo sapiens
caactccaggatttaggcc

SEQ ID NO: 1579185 - DNA, 22 bp, Homo sapiens
caactccatggggttcgagact

SEQ ID NO: 1579186 - DNA, 17 bp, Homo sapiens
caactccctctctgtgc

SEQ ID NO: 1579187 - DNA, 17 bp, Homo sapiens
caactcctggaagctgt

SEQ ID NO: 1579188 - DNA, 21 bp, Homo sapiens
caactcctggaagctgtgtcc

SEQ ID NO: 1579189 - DNA, 14 bp, Homo sapiens
caactcctgtctaa

SEQ ID NO: 1579190 - DNA, 18 bp, Homo sapiens
caactcctttcagccaca

SEQ ID NO: 1579191 - DNA, 19 bp, Homo sapiens
caactcctttcagccacat

SEQ ID NO: 1579192 - DNA, 15 bp, Homo sapiens
caactccttttactg

SEQ ID NO: 1579193 - DNA, 15 bp, Homo sapiens
caactctgagcccat

SEQ ID NO: 1579194 - DNA, 13 bp, Homo sapiens
caactctgcactc

SEQ ID NO: 1579195 - DNA, 14 bp, Homo sapiens
caactctgcactcc

SEQ ID NO: 1579196 - DNA, 19 bp, Homo sapiens
caactctgcactccatggc

SEQ ID NO: 1579197 - DNA, 23 bp, Homo sapiens
caactctgcactccatggccacc

SEQ ID NO: 1579198 - DNA, 14 bp, Homo sapiens
caactctgccttta

SEQ ID NO: 1579199 - DNA, 21 bp, Homo sapiens
caactgaaggcaacctggaag

SEQ ID NO: 1579200 - DNA, 23 bp, Homo sapiens
caactgaaggggtgcacccacct

SEQ ID NO: 1579201 - DNA, 15 bp, Homo sapiens
caactgacacaggaa

SEQ ID NO: 1579202 - DNA, 16 bp, Homo sapiens
caactgacacaggaaa

SEQ ID NO: 1579203 - DNA, 20 bp, Homo sapiens
caactgaggcagacagcagc

SEQ ID NO: 1579204 - DNA, 14 bp, Homo sapiens
caactgagggccag

SEQ ID NO: 1579205 - DNA, 13 bp, Homo sapiens
caactgatcctgc

SEQ ID NO: 1579206 - DNA, 19 bp, Homo sapiens
caactgatcctgctccagc

SEQ ID NO: 1579207 - DNA, 20 bp, Homo sapiens
caactgatcctgctccagca

SEQ ID NO: 1579208 - DNA, 21 bp, Homo sapiens
caactgatcctgctccagcag

SEQ ID NO: 1579209 - DNA, 22 bp, Homo sapiens
caactgatcctgctccagcagc

SEQ ID NO: 1579210 - DNA, 24 bp, Homo sapiens
caactgatcctgctccagcagcac

SEQ ID NO: 1579211 - DNA, 21 bp, Homo sapiens
caactgcaaaaaaagcctcca

SEQ ID NO: 1579212 - DNA, 22 bp, Homo sapiens
caactgcaaaaaaagcctccaa

SEQ ID NO: 1579213 - DNA, 21 bp, Homo sapiens
caactgcctaaggccctttgt

SEQ ID NO: 1579214 - DNA, 14 bp, Homo sapiens
caactgcctactcc

SEQ ID NO: 1579215 - DNA, 15 bp, Homo sapiens
caactgcctactcca

SEQ ID NO: 1579216 - DNA, 22 bp, Homo sapiens
caactgcctactccaaaatgtt

SEQ ID NO: 1579217 - DNA, 12 bp, Homo sapiens
caactgctctta

SEQ ID NO: 1579218 - DNA, 16 bp, Homo sapiens
caactgctgttttatg

SEQ ID NO: 1579219 - DNA, 18 bp, Homo sapiens
caactggagcaagaagga

SEQ ID NO: 1579220 - DNA, 22 bp, Homo sapiens
caactggagcaagaaggaagga

SEQ ID NO: 1579221 - DNA, 16 bp, Homo sapiens
caactggcttctgtgc

SEQ ID NO: 1579222 - DNA, 17 bp, Homo sapiens
caactgggcatttcaat

SEQ ID NO: 1579223 - DNA, 13 bp, Homo sapiens
caactgggcccaa

SEQ ID NO: 1579224 - DNA, 13 bp, Homo sapiens
caactgggtcatg

SEQ ID NO: 1579225 - DNA, 19 bp, Homo sapiens
caactgggtccagaagaga

SEQ ID NO: 1579226 - DNA, 13 bp, Homo sapiens
caactgtatatat

SEQ ID NO: 1579227 - DNA, 20 bp, Homo sapiens
caactgtccctttgtttgaa

SEQ ID NO: 1579228 - DNA, 17 bp, Homo sapiens
caactgtggtagctcca

SEQ ID NO: 1579229 - DNA, 15 bp, Homo sapiens
caactgtttccctgc

SEQ ID NO: 1579230 - DNA, 15 bp, Homo sapiens
caacttaacatgaaa

SEQ ID NO: 1579231 - DNA, 14 bp, Homo sapiens
caacttaacatggg

SEQ ID NO: 1579232 - DNA, 22 bp, Homo sapiens
caacttaatactcaaatgagta

SEQ ID NO: 1579233 - DNA, 14 bp, Homo sapiens
caacttaatggaaa

SEQ ID NO: 1579234 - DNA, 18 bp, Homo sapiens
caacttagctcaggtgcc

SEQ ID NO: 1579235 - DNA, 20 bp, Homo sapiens
caacttagctcaggtgcctt

SEQ ID NO: 1579236 - DNA, 19 bp, Homo sapiens
caacttagtcaataagaaa

SEQ ID NO: 1579237 - DNA, 18 bp, Homo sapiens
caacttattctttgagta

SEQ ID NO: 1579238 - DNA, 19 bp, Homo sapiens
caacttatttaaaaatatt

SEQ ID NO: 1579239 - DNA, 16 bp, Homo sapiens
caacttcaagtgcatg

SEQ ID NO: 1579240 - DNA, 22 bp, Homo sapiens
caacttcaagtgcatgctctct

SEQ ID NO: 1579241 - DNA, 14 bp, Homo sapiens
caacttcagtccaa

SEQ ID NO: 1579242 - DNA, 23 bp, Homo sapiens
caacttcccagttcaggagtccc

SEQ ID NO: 1579243 - DNA, 19 bp, Homo sapiens
caacttccgcctcctgtgt

SEQ ID NO: 1579244 - DNA, 15 bp, Homo sapiens
caacttccgctgagg

SEQ ID NO: 1579245 - DNA, 22 bp, Homo sapiens
caacttgatgttccacctgcca

SEQ ID NO: 1579246 - DNA, 22 bp, Homo sapiens
caacttgcatccaactccagga

SEQ ID NO: 1579247 - DNA, 12 bp, Homo sapiens
caacttgccttt

SEQ ID NO: 1579248 - DNA, 17 bp, Homo sapiens
caacttgcctttgaaga

SEQ ID NO: 1579249 - DNA, 22 bp, Homo sapiens
caacttgtaaatacaccacctc

SEQ ID NO: 1579250 - DNA, 20 bp, Homo sapiens
caacttgtctgggaattgtg

SEQ ID NO: 1579251 - DNA, 17 bp, Homo sapiens
caacttgtctttttctg

SEQ ID NO: 1579252 - DNA, 13 bp, Homo sapiens
caactttactgta

SEQ ID NO: 1579253 - DNA, 14 bp, Homo sapiens
caactttcacttct

SEQ ID NO: 1579254 - DNA, 18 bp, Homo sapiens
caactttcacttcttcct

SEQ ID NO: 1579255 - DNA, 23 bp, Homo sapiens
caactttgacgtaattaaatcca

SEQ ID NO: 1579256 - DNA, 22 bp, Homo sapiens
caactttgtaaaaatcttttga

SEQ ID NO: 1579257 - DNA, 21 bp, Homo sapiens
caacttttgtgtaatgaaaat

SEQ ID NO: 1579258 - DNA, 19 bp, Homo sapiens
caactttttccctcactaa

SEQ ID NO: 1579259 - DNA, 12 bp, Homo sapiens
caagaaaacata

SEQ ID NO: 1579260 - DNA, 14 bp, Homo sapiens
caagaaacagccag

SEQ ID NO: 1579261 - DNA, 15 bp, Homo sapiens
caagaaacagccagc

SEQ ID NO: 1579262 - DNA, 16 bp, Homo sapiens
caagaaagaaatggct

SEQ ID NO: 1579263 - DNA, 17 bp, Homo sapiens
caagaaaggcagacaca

SEQ ID NO: 1579264 - DNA, 18 bp, Homo sapiens
caagaaaggcagacacac

SEQ ID NO: 1579265 - DNA, 21 bp, Homo sapiens
caagaaatgattcaaattgct

SEQ ID NO: 1579266 - DNA, 10 bp, Homo sapiens
caagaaatgg

SEQ ID NO: 1579267 - DNA, 18 bp, Homo sapiens
caagaaatggcgtctgct

SEQ ID NO: 1579268 - DNA, 21 bp, Homo sapiens
caagaaatggcgtctgctctg

SEQ ID NO: 1579269 - DNA, 22 bp, Homo sapiens
caagaaatggcgtctgctctgg

SEQ ID NO: 1579270 - DNA, 16 bp, Homo sapiens
caagaacactggacct

SEQ ID NO: 1579271 - DNA, 17 bp, Homo sapiens
caagaacattatcttag

SEQ ID NO: 1579272 - DNA, 10 bp, Homo sapiens
caagaacctg

SEQ ID NO: 1579273 - DNA, 13 bp, Homo sapiens
caagaactgcatg

SEQ ID NO: 1579274 - DNA, 16 bp, Homo sapiens
caagaactgcatggac

SEQ ID NO: 1579275 - DNA, 18 bp, Homo sapiens
caagaactgcatggacct

SEQ ID NO: 1579276 - DNA, 13 bp, Homo sapiens
caagaagaaaaag

SEQ ID NO: 1579277 - DNA, 22 bp, Homo sapiens
caagaagaaatgctttccaaaa

SEQ ID NO: 1579278 - DNA, 13 bp, Homo sapiens
caagaagggctgc

SEQ ID NO: 1579279 - DNA, 15 bp, Homo sapiens
caagaagggctgcat

SEQ ID NO: 1579280 - DNA, 19 bp, Homo sapiens
caagaagggctgcatgatg

SEQ ID NO: 1579281 - DNA, 22 bp, Homo sapiens
caagaagggttttccaccctgg

SEQ ID NO: 1579282 - DNA, 19 bp, Homo sapiens
caagaagtcaaagtaaaac

SEQ ID NO: 1579283 - DNA, 13 bp, Homo sapiens
caagaagtcttga

SEQ ID NO: 1579284 - DNA, 18 bp, Homo sapiens
caagaagtgggtgccctt

SEQ ID NO: 1579285 - DNA, 19 bp, Homo sapiens
caagaagttaaaaaacagc

SEQ ID NO: 1579286 - DNA, 16 bp, Homo sapiens
caagaataattttgga

SEQ ID NO: 1579287 - DNA, 18 bp, Homo sapiens
caagaatagatgctgact

SEQ ID NO: 1579288 - DNA, 16 bp, Homo sapiens
caagaatattgtccct

SEQ ID NO: 1579289 - DNA, 16 bp, Homo sapiens
caagaatcagaagaaa

SEQ ID NO: 1579290 - DNA, 14 bp, Homo sapiens
caagaatccacatt

SEQ ID NO: 1579291 - DNA, 10 bp, Homo sapiens
caagaatcta

SEQ ID NO: 1579292 - DNA, 21 bp, Homo sapiens
caagaatgaaaaatataatgt

SEQ ID NO: 1579293 - DNA, 20 bp, Homo sapiens
caagaatttgacttggaaaa

SEQ ID NO: 1579294 - DNA, 19 bp, Homo sapiens
caagacaataattacattg

SEQ ID NO: 1579295 - DNA, 16 bp, Homo sapiens
caagacacgtggcctc

SEQ ID NO: 1579296 - DNA, 19 bp, Homo sapiens
caagacacgtggcctcgtg

SEQ ID NO: 1579297 - DNA, 21 bp, Homo sapiens
caagacacgtggcctcgtgag

SEQ ID NO: 1579298 - DNA, 18 bp, Homo sapiens
caagacagagacgcagga

SEQ ID NO: 1579299 - DNA, 13 bp, Homo sapiens
caagacagagtct

SEQ ID NO: 1579300 - DNA, 13 bp, Homo sapiens
caagacagatgcc

SEQ ID NO: 1579301 - DNA, 12 bp, Homo sapiens
caagacatttct

SEQ ID NO: 1579302 - DNA, 11 bp, Homo sapiens
caagacatttg

SEQ ID NO: 1579303 - DNA, 15 bp, Homo sapiens
caagacatttgctga

SEQ ID NO: 1579304 - DNA, 16 bp, Homo sapiens
caagacatttgctgaa

SEQ ID NO: 1579305 - DNA, 11 bp, Homo sapiens
caagaccaaaa

SEQ ID NO: 1579306 - DNA, 13 bp, Homo sapiens
caagaccagcctg

SEQ ID NO: 1579307 - DNA, 14 bp, Homo sapiens
caagaccagcctgt

SEQ ID NO: 1579308 - DNA, 14 bp, Homo sapiens
caagacccccagca

SEQ ID NO: 1579309 - DNA, 14 bp, Homo sapiens
caagaccctgtctc

SEQ ID NO: 1579310 - DNA, 15 bp, Homo sapiens
caagaccctgtctct

SEQ ID NO: 1579311 - DNA, 20 bp, Homo sapiens
caagaccgccccagggctat

SEQ ID NO: 1579312 - DNA, 16 bp, Homo sapiens
caagacctcatctcta

SEQ ID NO: 1579313 - DNA, 23 bp, Homo sapiens
caagacctcttccctctgggcct

SEQ ID NO: 1579314 - DNA, 16 bp, Homo sapiens
caagacgaggggcagg

SEQ ID NO: 1579315 - DNA, 23 bp, Homo sapiens
caagacgggatgattgcttgagc

SEQ ID NO: 1579316 - DNA, 11 bp, Homo sapiens
caagactcctc

SEQ ID NO: 1579317 - DNA, 15 bp, Homo sapiens
caagactcctcaggc

SEQ ID NO: 1579318 - DNA, 18 bp, Homo sapiens
caagactcctcaggcagc

SEQ ID NO: 1579319 - DNA, 15 bp, Homo sapiens
caagactctgtctca

SEQ ID NO: 1579320 - DNA, 21 bp, Homo sapiens
caagactgtcattgcccctcc

SEQ ID NO: 1579321 - DNA, 16 bp, Homo sapiens
caagactgttgctcaa

SEQ ID NO: 1579322 - DNA, 19 bp, Homo sapiens
caagactttagcttttcct

SEQ ID NO: 1579323 - DNA, 12 bp, Homo sapiens
caagagaaactt

SEQ ID NO: 1579324 - DNA, 23 bp, Homo sapiens
caagagaactcgcgctcagtaaa

SEQ ID NO: 1579325 - DNA, 24 bp, Homo sapiens
caagagaactcgcgctcagtaaac

SEQ ID NO: 1579326 - DNA, 22 bp, Homo sapiens
caagagaattgcttgaacccag

SEQ ID NO: 1579327 - DNA, 13 bp, Homo sapiens
caagagagaaaga

SEQ ID NO: 1579328 - DNA, 16 bp, Homo sapiens
caagagataagtcttt

SEQ ID NO: 1579329 - DNA, 18 bp, Homo sapiens
caagagatctacacatgt

SEQ ID NO: 1579330 - DNA, 19 bp, Homo sapiens
caagagatctacacatgtt

SEQ ID NO: 1579331 - DNA, 18 bp, Homo sapiens
caagagatctgtgtggct

SEQ ID NO: 1579332 - DNA, 16 bp, Homo sapiens
caagagatgggaatga

SEQ ID NO: 1579333 - DNA, 16 bp, Homo sapiens
caagagatgggacaag

SEQ ID NO: 1579334 - DNA, 20 bp, Homo sapiens
caagagatgggatgctccga

SEQ ID NO: 1579335 - DNA, 21 bp, Homo sapiens
caagagcaaaactccgtctca

SEQ ID NO: 1579336 - DNA, 16 bp, Homo sapiens
caagagcagcctgtgg

SEQ ID NO: 1579337 - DNA, 21 bp, Homo sapiens
caagagcagcctgtggcatct

SEQ ID NO: 1579338 - DNA, 21 bp, Homo sapiens
caagagcatgcacatgctgtc

SEQ ID NO: 1579339 - DNA, 21 bp, Homo sapiens
caagagccttggtgtccacct

SEQ ID NO: 1579340 - DNA, 21 bp, Homo sapiens
caagagctagaaaaataaaat

SEQ ID NO: 1579341 - DNA, 15 bp, Homo sapiens
caagaggaagagaga

SEQ ID NO: 1579342 - DNA, 22 bp, Homo sapiens
caagaggaataagaatggagca

SEQ ID NO: 1579343 - DNA, 20 bp, Homo sapiens
caagaggaatctgtttctct

SEQ ID NO: 1579344 - DNA, 22 bp, Homo sapiens
caagaggaatctgtttctctgc

SEQ ID NO: 1579345 - DNA, 19 bp, Homo sapiens
caagaggcaagctgaaatt

SEQ ID NO: 1579346 - DNA, 20 bp, Homo sapiens
caagaggcaagctgaaattt

SEQ ID NO: 1579347 - DNA, 15 bp, Homo sapiens
caagagggcactggt

SEQ ID NO: 1579348 - DNA, 19 bp, Homo sapiens
caagagggcactggtggcc

SEQ ID NO: 1579349 - DNA, 15 bp, Homo sapiens
caagagggggtggag

SEQ ID NO: 1579350 - DNA, 17 bp, Homo sapiens
caagagggggtggaggg

SEQ ID NO: 1579351 - DNA, 22 bp, Homo sapiens
caagagggttcacacagcccag

SEQ ID NO: 1579352 - DNA, 16 bp, Homo sapiens
caagaggtctgagccc

SEQ ID NO: 1579353 - DNA, 15 bp, Homo sapiens
caagaggtgggaggg

SEQ ID NO: 1579354 - DNA, 16 bp, Homo sapiens
caagagtaagcagtgt

SEQ ID NO: 1579355 - DNA, 14 bp, Homo sapiens
caagagtccggatt

SEQ ID NO: 1579356 - DNA, 17 bp, Homo sapiens
caagagtccggatttct

SEQ ID NO: 1579357 - DNA, 22 bp, Homo sapiens
caagagtgagatgtagaaagtt

SEQ ID NO: 1579358 - DNA, 22 bp, Homo sapiens
caagagtggactgaatgtgcct

SEQ ID NO: 1579359 - DNA, 17 bp, Homo sapiens
caagagttcagtgctca

SEQ ID NO: 1579360 - DNA, 15 bp, Homo sapiens
caagagtttcttgta

SEQ ID NO: 1579361 - DNA, 16 bp, Homo sapiens
caagatacctaaaaga

SEQ ID NO: 1579362 - DNA, 22 bp, Homo sapiens
caagatactctttgtggggaag

SEQ ID NO: 1579363 - DNA, 18 bp, Homo sapiens
caagatagatttggaata

SEQ ID NO: 1579364 - DNA, 13 bp, Homo sapiens
caagatagtcttc

SEQ ID NO: 1579365 - DNA, 13 bp, Homo sapiens
caagatcgcacca

SEQ ID NO: 1579366 - DNA, 21 bp, Homo sapiens
caagatcgcaccactgcactc

SEQ ID NO: 1579367 - DNA, 12 bp, Homo sapiens
caagatctttca

SEQ ID NO: 1579368 - DNA, 15 bp, Homo sapiens
caagatctttcagga

SEQ ID NO: 1579369 - DNA, 13 bp, Homo sapiens
caagatgacagct

SEQ ID NO: 1579370 - DNA, 16 bp, Homo sapiens
caagatgacagctctt

SEQ ID NO: 1579371 - DNA, 16 bp, Homo sapiens
caagatgcaaatgttt

SEQ ID NO: 1579372 - DNA, 19 bp, Homo sapiens
caagatggaatttatcaaa

SEQ ID NO: 1579373 - DNA, 20 bp, Homo sapiens
caagatggacacgagccaca

SEQ ID NO: 1579374 - DNA, 16 bp, Homo sapiens
caagatggctgctgcc

SEQ ID NO: 1579375 - DNA, 20 bp, Homo sapiens
caagatggctgctgcctgct

SEQ ID NO: 1579376 - DNA, 13 bp, Homo sapiens
caagatgggtccc

SEQ ID NO: 1579377 - DNA, 20 bp, Homo sapiens
caagatggtccatttgttcc

SEQ ID NO: 1579378 - DNA, 22 bp, Homo sapiens
caagatggtccatttgttcctg

SEQ ID NO: 1579379 - DNA, 13 bp, Homo sapiens
caagatggttcta

SEQ ID NO: 1579380 - DNA, 14 bp, Homo sapiens
caagatgtgaatta

SEQ ID NO: 1579381 - DNA, 23 bp, Homo sapiens
caagatgttttgtataaaatctg

SEQ ID NO: 1579382 - DNA, 16 bp, Homo sapiens
caagattcccagagac

SEQ ID NO: 1579383 - DNA, 18 bp, Homo sapiens
caagattcccagagacag

SEQ ID NO: 1579384 - DNA, 18 bp, Homo sapiens
caagattccggatcctaa

SEQ ID NO: 1579385 - DNA, 19 bp, Homo sapiens
caagattccggatcctaag

SEQ ID NO: 1579386 - DNA, 18 bp, Homo sapiens
caagattctagatgatta

SEQ ID NO: 1579387 - DNA, 18 bp, Homo sapiens
caagattgcttaaaatag

SEQ ID NO: 1579388 - DNA, 21 bp, Homo sapiens
caagattgcttaaaatagcaa

SEQ ID NO: 1579389 - DNA, 14 bp, Homo sapiens
caagattgttgata

SEQ ID NO: 1579390 - DNA, 12 bp, Homo sapiens
caagattttagg

SEQ ID NO: 1579391 - DNA, 14 bp, Homo sapiens
caagattttagggc

SEQ ID NO: 1579392 - DNA, 23 bp, Homo sapiens
caagattttgggagagtaaagct

SEQ ID NO: 1579393 - DNA, 15 bp, Homo sapiens
caagatttttttcct

SEQ ID NO: 1579394 - DNA, 22 bp, Homo sapiens
caagcaacaaacctcactgaga

SEQ ID NO: 1579395 - DNA, 14 bp, Homo sapiens
caagcaataattgt

SEQ ID NO: 1579396 - DNA, 20 bp, Homo sapiens
caagcaatgatgacccacta

SEQ ID NO: 1579397 - DNA, 14 bp, Homo sapiens
caagcacagccctt

SEQ ID NO: 1579398 - DNA, 13 bp, Homo sapiens
caagcacatgtaa

SEQ ID NO: 1579399 - DNA, 18 bp, Homo sapiens
caagcacatgtaataaat

SEQ ID NO: 1579400 - DNA, 19 bp, Homo sapiens
caagcactcgagaccatcc

SEQ ID NO: 1579401 - DNA, 12 bp, Homo sapiens
caagcactgctc

SEQ ID NO: 1579402 - DNA, 14 bp, Homo sapiens
caagcactgctcac

SEQ ID NO: 1579403 - DNA, 19 bp, Homo sapiens
caagcacttcccaggatct

SEQ ID NO: 1579404 - DNA, 12 bp, Homo sapiens
caagcagccagc

SEQ ID NO: 1579405 - DNA, 14 bp, Homo sapiens
caagcagccagcca

SEQ ID NO: 1579406 - DNA, 17 bp, Homo sapiens
caagcagggaaagctcc

SEQ ID NO: 1579407 - DNA, 12 bp, Homo sapiens
caagcagtccct

SEQ ID NO: 1579408 - DNA, 15 bp, Homo sapiens
caagcagtcgtgcct

SEQ ID NO: 1579409 - DNA, 19 bp, Homo sapiens
caagcagtcgtgcctgtgt

SEQ ID NO: 1579410 - DNA, 19 bp, Homo sapiens
caagcatgacaacttttaa

SEQ ID NO: 1579411 - DNA, 14 bp, Homo sapiens
caagcatgtctctc

SEQ ID NO: 1579412 - DNA, 22 bp, Homo sapiens
caagcatgtctctctgccaaga

SEQ ID NO: 1579413 - DNA, 19 bp, Homo sapiens
caagcatttcatgaaaaag

SEQ ID NO: 1579414 - DNA, 21 bp, Homo sapiens
caagccaacttgtaaatacac

SEQ ID NO: 1579415 - DNA, 16 bp, Homo sapiens
caagccagaggctggg

SEQ ID NO: 1579416 - DNA, 23 bp, Homo sapiens
caagccagagtttttaaagcctt

SEQ ID NO: 1579417 - DNA, 18 bp, Homo sapiens
caagccagattctcttga

SEQ ID NO: 1579418 - DNA, 14 bp, Homo sapiens
caagccagctggag

SEQ ID NO: 1579419 - DNA, 14 bp, Homo sapiens
caagccatcatcct

SEQ ID NO: 1579420 - DNA, 20 bp, Homo sapiens
caagccatcttgagtggtca

SEQ ID NO: 1579421 - DNA, 13 bp, Homo sapiens
caagcccaggctt

SEQ ID NO: 1579422 - DNA, 17 bp, Homo sapiens
caagcccaggcttcctg

SEQ ID NO: 1579423 - DNA, 22 bp, Homo sapiens
caagcccaggcttcctgggtcc

SEQ ID NO: 1579424 - DNA, 14 bp, Homo sapiens
caagccccagggcc

SEQ ID NO: 1579425 - DNA, 16 bp, Homo sapiens
caagccccagggcctg

SEQ ID NO: 1579426 - DNA, 18 bp, Homo sapiens
caagccccagggcctggg

SEQ ID NO: 1579427 - DNA, 21 bp, Homo sapiens
caagccccagggcctgggggc

SEQ ID NO: 1579428 - DNA, 21 bp, Homo sapiens
caagccccatctcatcctggc

SEQ ID NO: 1579429 - DNA, 20 bp, Homo sapiens
caagcccctcagcccttgcc

SEQ ID NO: 1579430 - DNA, 10 bp, Homo sapiens
caagccctgg

SEQ ID NO: 1579431 - DNA, 14 bp, Homo sapiens
caagccgtggcttc

SEQ ID NO: 1579432 - DNA, 15 bp, Homo sapiens
caagccgtggcttcc

SEQ ID NO: 1579433 - DNA, 16 bp, Homo sapiens
caagcctaggccgccc

SEQ ID NO: 1579434 - DNA, 16 bp, Homo sapiens
caagcctccacagcga

SEQ ID NO: 1579435 - DNA, 15 bp, Homo sapiens
caagcctcttctgaa

SEQ ID NO: 1579436 - DNA, 21 bp, Homo sapiens
caagcctgaccacgctttcta

SEQ ID NO: 1579437 - DNA, 13 bp, Homo sapiens
caagcctgagaac

SEQ ID NO: 1579438 - DNA, 14 bp, Homo sapiens
caagcctgcctccc

SEQ ID NO: 1579439 - DNA, 13 bp, Homo sapiens
caagcctgctggc

SEQ ID NO: 1579440 - DNA, 12 bp, Homo sapiens
caagcctgtggg

SEQ ID NO: 1579441 - DNA, 13 bp, Homo sapiens
caagcctgtggga

SEQ ID NO: 1579442 - DNA, 14 bp, Homo sapiens
caagcctgtgggag

SEQ ID NO: 1579443 - DNA, 20 bp, Homo sapiens
caagccttggctcgttctct

SEQ ID NO: 1579444 - DNA, 20 bp, Homo sapiens
caagcgaggtcaacagagaa

SEQ ID NO: 1579445 - DNA, 18 bp, Homo sapiens
caagcgattctcctgtct

SEQ ID NO: 1579446 - DNA, 14 bp, Homo sapiens
caagcgcttctgct

SEQ ID NO: 1579447 - DNA, 18 bp, Homo sapiens
caagcgttcctggccttc

SEQ ID NO: 1579448 - DNA, 19 bp, Homo sapiens
caagcgttcctggccttct

SEQ ID NO: 1579449 - DNA, 18 bp, Homo sapiens
caagctactttatgtaaa

SEQ ID NO: 1579450 - DNA, 19 bp, Homo sapiens
caagctaggccccagaggc

SEQ ID NO: 1579451 - DNA, 20 bp, Homo sapiens
caagctaggccccagaggcc

SEQ ID NO: 1579452 - DNA, 20 bp, Homo sapiens
caagctattctcatgcctca

SEQ ID NO: 1579453 - DNA, 22 bp, Homo sapiens
caagctattctcatgcctcagc

SEQ ID NO: 1579454 - DNA, 21 bp, Homo sapiens
caagctcacagttcctcgccc

SEQ ID NO: 1579455 - DNA, 19 bp, Homo sapiens
caagctctcagcaagtgcc

SEQ ID NO: 1579456 - DNA, 22 bp, Homo sapiens
caagctctcagcaagtgcccag

SEQ ID NO: 1579457 - DNA, 17 bp, Homo sapiens
caagctctgcctcccgg

SEQ ID NO: 1579458 - DNA, 21 bp, Homo sapiens
caagctgaaattttagaaata

SEQ ID NO: 1579459 - DNA, 13 bp, Homo sapiens
caagctgacttgg

SEQ ID NO: 1579460 - DNA, 15 bp, Homo sapiens
caagctgacttggca

SEQ ID NO: 1579461 - DNA, 14 bp, Homo sapiens
caagctgagtttcc

SEQ ID NO: 1579462 - DNA, 16 bp, Homo sapiens
caagctgcactgtgaa

SEQ ID NO: 1579463 - DNA, 15 bp, Homo sapiens
caagctggaagaagt

SEQ ID NO: 1579464 - DNA, 20 bp, Homo sapiens
caagctgtacccttgagacc

SEQ ID NO: 1579465 - DNA, 16 bp, Homo sapiens
caagctgtcccctctg

SEQ ID NO: 1579466 - DNA, 20 bp, Homo sapiens
caagctgtcccctctgtcat

SEQ ID NO: 1579467 - DNA, 17 bp, Homo sapiens
caagctgtccctgcagg

SEQ ID NO: 1579468 - DNA, 19 bp, Homo sapiens
caagctgtccctgcagggc

SEQ ID NO: 1579469 - DNA, 19 bp, Homo sapiens
caagctgtgcaggcatggt

SEQ ID NO: 1579470 - DNA, 12 bp, Homo sapiens
caagctgtggca

SEQ ID NO: 1579471 - DNA, 16 bp, Homo sapiens
caagctgttttcttct

SEQ ID NO: 1579472 - DNA, 22 bp, Homo sapiens
caagcttcaaccctcagccttg

SEQ ID NO: 1579473 - DNA, 18 bp, Homo sapiens
caagcttcagagcctagc

SEQ ID NO: 1579474 - DNA, 15 bp, Homo sapiens
caagcttcttgctga

SEQ ID NO: 1579475 - DNA, 15 bp, Homo sapiens
caagcttgaggccaa

SEQ ID NO: 1579476 - DNA, 22 bp, Homo sapiens
caagcttgaggccaagatggct

SEQ ID NO: 1579477 - DNA, 16 bp, Homo sapiens
caagcttggcagccga

SEQ ID NO: 1579478 - DNA, 22 bp, Homo sapiens
caaggaaaatagtttaggagaa

SEQ ID NO: 1579479 - DNA, 17 bp, Homo sapiens
caaggaaagccccagca

SEQ ID NO: 1579480 - DNA, 20 bp, Homo sapiens
caaggaaaggctcatttaaa

SEQ ID NO: 1579481 - DNA, 17 bp, Homo sapiens
caaggaaagtgaacctt

SEQ ID NO: 1579482 - DNA, 15 bp, Homo sapiens
caaggaagaagaaat

SEQ ID NO: 1579483 - DNA, 19 bp, Homo sapiens
caaggaagaagaaatcttt

SEQ ID NO: 1579484 - DNA, 18 bp, Homo sapiens
caaggaagcagcctcaga

SEQ ID NO: 1579485 - DNA, 21 bp, Homo sapiens
caaggaagccaaagttttcaa

SEQ ID NO: 1579486 - DNA, 16 bp, Homo sapiens
caaggaaggaaaagaa

SEQ ID NO: 1579487 - DNA, 17 bp, Homo sapiens
caaggaaggaaaagaaa

SEQ ID NO: 1579488 - DNA, 14 bp, Homo sapiens
caaggaataaatga

SEQ ID NO: 1579489 - DNA, 16 bp, Homo sapiens
caaggaataaatgaga

SEQ ID NO: 1579490 - DNA, 20 bp, Homo sapiens
caaggaataaatgagaggga

SEQ ID NO: 1579491 - DNA, 22 bp, Homo sapiens
caaggaatttaaaactgttatt

SEQ ID NO: 1579492 - DNA, 18 bp, Homo sapiens
caaggaatttcttaactt

SEQ ID NO: 1579493 - DNA, 17 bp, Homo sapiens
caaggacaaagtctcca

SEQ ID NO: 1579494 - DNA, 18 bp, Homo sapiens
caaggacaaagtctccag

SEQ ID NO: 1579495 - DNA, 23 bp, Homo sapiens
caaggacattgtatgcagggagc

SEQ ID NO: 1579496 - DNA, 14 bp, Homo sapiens
caaggacgctggct

SEQ ID NO: 1579497 - DNA, 21 bp, Homo sapiens
caaggacttcctgtccagctc

SEQ ID NO: 1579498 - DNA, 22 bp, Homo sapiens
caaggacttcctgtccagctcc

SEQ ID NO: 1579499 - DNA, 15 bp, Homo sapiens
caaggactttgcagc

SEQ ID NO: 1579500 - DNA, 22 bp, Homo sapiens
caaggagaccaagtcctggcta

SEQ ID NO: 1579501 - DNA, 21 bp, Homo sapiens
caaggagatttcttagttcat

SEQ ID NO: 1579502 - DNA, 14 bp, Homo sapiens
caaggagcccagaa

SEQ ID NO: 1579503 - DNA, 14 bp, Homo sapiens
caaggagctactga

SEQ ID NO: 1579504 - DNA, 20 bp, Homo sapiens
caaggagctactgacattcc

SEQ ID NO: 1579505 - DNA, 15 bp, Homo sapiens
caaggagctcaccct

SEQ ID NO: 1579506 - DNA, 19 bp, Homo sapiens
caaggagctcaccctgccc

SEQ ID NO: 1579507 - DNA, 21 bp, Homo sapiens
caaggagctgatttccaggcc

SEQ ID NO: 1579508 - DNA, 22 bp, Homo sapiens
caaggagctgatttccaggccc

SEQ ID NO: 1579509 - DNA, 19 bp, Homo sapiens
caaggagcttacccaagct

SEQ ID NO: 1579510 - DNA, 14 bp, Homo sapiens
caaggaggaaaaac

SEQ ID NO: 1579511 - DNA, 15 bp, Homo sapiens
caaggagggcacagg

SEQ ID NO: 1579512 - DNA, 18 bp, Homo sapiens
caaggaggggctgtaaaa

SEQ ID NO: 1579513 - DNA, 17 bp, Homo sapiens
caaggagtttattacaa

SEQ ID NO: 1579514 - DNA, 18 bp, Homo sapiens
caaggagtttattacaat

SEQ ID NO: 1579515 - DNA, 18 bp, Homo sapiens
caaggataccttcttatt

SEQ ID NO: 1579516 - DNA, 17 bp, Homo sapiens
caaggatagaagtatac

SEQ ID NO: 1579517 - DNA, 21 bp, Homo sapiens
caaggatgaattctttcaatt

SEQ ID NO: 1579518 - DNA, 14 bp, Homo sapiens
caaggcaatggaaa

SEQ ID NO: 1579519 - DNA, 14 bp, Homo sapiens
caaggcactctaga

SEQ ID NO: 1579520 - DNA, 19 bp, Homo sapiens
caaggcactctagattcca

SEQ ID NO: 1579521 - DNA, 14 bp, Homo sapiens
caaggcagaggcct

SEQ ID NO: 1579522 - DNA, 16 bp, Homo sapiens
caaggcagaggcctgg

SEQ ID NO: 1579523 - DNA, 14 bp, Homo sapiens
caaggcagcctcca

SEQ ID NO: 1579524 - DNA, 21 bp, Homo sapiens
caaggcagcctccagagccag

SEQ ID NO: 1579525 - DNA, 18 bp, Homo sapiens
caaggcagcgaccccagg

SEQ ID NO: 1579526 - DNA, 21 bp, Homo sapiens
caaggcagcgaccccaggacc

SEQ ID NO: 1579527 - DNA, 15 bp, Homo sapiens
caaggcaggtgcctc

SEQ ID NO: 1579528 - DNA, 19 bp, Homo sapiens
caaggcaggtgcctccagg

SEQ ID NO: 1579529 - DNA, 17 bp, Homo sapiens
caaggcatttgtctttg

SEQ ID NO: 1579530 - DNA, 14 bp, Homo sapiens
caaggccagagtgg

SEQ ID NO: 1579531 - DNA, 20 bp, Homo sapiens
caaggccagagtggcctggc

SEQ ID NO: 1579532 - DNA, 22 bp, Homo sapiens
caaggccagagtggcctggcca

SEQ ID NO: 1579533 - DNA, 20 bp, Homo sapiens
caaggccctgctttttttct

SEQ ID NO: 1579534 - DNA, 19 bp, Homo sapiens
caaggccctttcctttgga

SEQ ID NO: 1579535 - DNA, 16 bp, Homo sapiens
caaggccgaagctctg

SEQ ID NO: 1579536 - DNA, 19 bp, Homo sapiens
caaggccgaagctctggct

SEQ ID NO: 1579537 - DNA, 21 bp, Homo sapiens
caaggccgaagctctggctga

SEQ ID NO: 1579538 - DNA, 23 bp, Homo sapiens
caaggccgaagctctggctgaac

SEQ ID NO: 1579539 - DNA, 22 bp, Homo sapiens
caaggccgctgttcacccacag

SEQ ID NO: 1579540 - DNA, 19 bp, Homo sapiens
caaggcctctctctgcctg

SEQ ID NO: 1579541 - DNA, 20 bp, Homo sapiens
caaggcctctctctgcctga

SEQ ID NO: 1579542 - DNA, 16 bp, Homo sapiens
caaggcctgctccctg

SEQ ID NO: 1579543 - DNA, 12 bp, Homo sapiens
caaggccttcag

SEQ ID NO: 1579544 - DNA, 22 bp, Homo sapiens
caaggccttggtggagcagcca

SEQ ID NO: 1579545 - DNA, 19 bp, Homo sapiens
caaggcgtccgcgcgccag

SEQ ID NO: 1579546 - DNA, 18 bp, Homo sapiens
caaggctaacatcccact

SEQ ID NO: 1579547 - DNA, 10 bp, Homo sapiens
caaggctcag

SEQ ID NO: 1579548 - DNA, 22 bp, Homo sapiens
caaggctcagaaggaatggtgc

SEQ ID NO: 1579549 - DNA, 18 bp, Homo sapiens
caaggctgaccaagagag

SEQ ID NO: 1579550 - DNA, 20 bp, Homo sapiens
caaggctgaccaagagagaa

SEQ ID NO: 1579551 - DNA, 21 bp, Homo sapiens
caaggctgaccaagagagaaa

SEQ ID NO: 1579552 - DNA, 22 bp, Homo sapiens
caaggctgagacagtgaatttg

SEQ ID NO: 1579553 - DNA, 13 bp, Homo sapiens
caaggctgctgcc

SEQ ID NO: 1579554 - DNA, 14 bp, Homo sapiens
caaggctgctgccg

SEQ ID NO: 1579555 - DNA, 20 bp, Homo sapiens
caaggcttatttatatatat

SEQ ID NO: 1579556 - DNA, 12 bp, Homo sapiens
caagggaaaggg

SEQ ID NO: 1579557 - DNA, 20 bp, Homo sapiens
caagggaaaggggtgctttt

SEQ ID NO: 1579558 - DNA, 18 bp, Homo sapiens
caagggaatgtaactgct

SEQ ID NO: 1579559 - DNA, 13 bp, Homo sapiens
caagggacagccc

SEQ ID NO: 1579560 - DNA, 23 bp, Homo sapiens
caagggacagcccacggtctgga

SEQ ID NO: 1579561 - DNA, 13 bp, Homo sapiens
caagggaccttca

SEQ ID NO: 1579562 - DNA, 18 bp, Homo sapiens
caagggagaaaagagaaa

SEQ ID NO: 1579563 - DNA, 16 bp, Homo sapiens
caagggagacaccagt

SEQ ID NO: 1579564 - DNA, 16 bp, Homo sapiens
caagggaggcagtggc

SEQ ID NO: 1579565 - DNA, 20 bp, Homo sapiens
caagggagggtgcagccctc

SEQ ID NO: 1579566 - DNA, 21 bp, Homo sapiens
caagggagggtgcagccctct

SEQ ID NO: 1579567 - DNA, 22 bp, Homo sapiens
caagggatctgccattgggacc

SEQ ID NO: 1579568 - DNA, 13 bp, Homo sapiens
caagggattctgg

SEQ ID NO: 1579569 - DNA, 16 bp, Homo sapiens
caagggattctgggaa

SEQ ID NO: 1579570 - DNA, 17 bp, Homo sapiens
caagggattctgggaag

SEQ ID NO: 1579571 - DNA, 15 bp, Homo sapiens
caagggcatcaggca

SEQ ID NO: 1579572 - DNA, 17 bp, Homo sapiens
caagggcatcaggcact

SEQ ID NO: 1579573 - DNA, 23 bp, Homo sapiens
caagggcatcaggcactggtggc

SEQ ID NO: 1579574 - DNA, 14 bp, Homo sapiens
caagggcccagacc

SEQ ID NO: 1579575 - DNA, 18 bp, Homo sapiens
caagggcccagaccctgg

SEQ ID NO: 1579576 - DNA, 13 bp, Homo sapiens
caagggcccagag

SEQ ID NO: 1579577 - DNA, 15 bp, Homo sapiens
caagggccccagggg

SEQ ID NO: 1579578 - DNA, 16 bp, Homo sapiens
caagggccccaggggc

SEQ ID NO: 1579579 - DNA, 21 bp, Homo sapiens
caagggccgtgcccttgccct

SEQ ID NO: 1579580 - DNA, 12 bp, Homo sapiens
caagggctccag

SEQ ID NO: 1579581 - DNA, 14 bp, Homo sapiens
caagggctccagca

SEQ ID NO: 1579582 - DNA, 20 bp, Homo sapiens
caagggctccagcatccagc

SEQ ID NO: 1579583 - DNA, 13 bp, Homo sapiens
caagggctgcaat

SEQ ID NO: 1579584 - DNA, 16 bp, Homo sapiens
caagggctgcaatgcc

SEQ ID NO: 1579585 - DNA, 17 bp, Homo sapiens
caagggctgcaatgccc

SEQ ID NO: 1579586 - DNA, 15 bp, Homo sapiens
caagggctggcactt

SEQ ID NO: 1579587 - DNA, 21 bp, Homo sapiens
caagggcttctgcaccctcca

SEQ ID NO: 1579588 - DNA, 23 bp, Homo sapiens
caaggggaccccgagaaccctga

SEQ ID NO: 1579589 - DNA, 16 bp, Homo sapiens
caaggggctggctgga

SEQ ID NO: 1579590 - DNA, 18 bp, Homo sapiens
caaggggctggctggagt

SEQ ID NO: 1579591 - DNA, 13 bp, Homo sapiens
caagggggcccaa

SEQ ID NO: 1579592 - DNA, 15 bp, Homo sapiens
caagggggtgactgg

SEQ ID NO: 1579593 - DNA, 16 bp, Homo sapiens
caagggggtgactgga

SEQ ID NO: 1579594 - DNA, 21 bp, Homo sapiens
caagggggtgtcatctgagga

SEQ ID NO: 1579595 - DNA, 22 bp, Homo sapiens
caagggggtgtcatctgaggag

SEQ ID NO: 1579596 - DNA, 19 bp, Homo sapiens
caaggggtggccgggcaca

SEQ ID NO: 1579597 - DNA, 12 bp, Homo sapiens
caagggtggcag

SEQ ID NO: 1579598 - DNA, 17 bp, Homo sapiens
caagggtggcaggtcac

SEQ ID NO: 1579599 - DNA, 18 bp, Homo sapiens
caagggttaaggcctgaa

SEQ ID NO: 1579600 - DNA, 18 bp, Homo sapiens
caaggtacaactgtattt

SEQ ID NO: 1579601 - DNA, 16 bp, Homo sapiens
caaggtactctggtga

SEQ ID NO: 1579602 - DNA, 16 bp, Homo sapiens
caaggtagccatccca

SEQ ID NO: 1579603 - DNA, 17 bp, Homo sapiens
caaggtataataaaatt

SEQ ID NO: 1579604 - DNA, 22 bp, Homo sapiens
caaggtatttctccagttggga

SEQ ID NO: 1579605 - DNA, 14 bp, Homo sapiens
caaggtcatcaaac

SEQ ID NO: 1579606 - DNA, 14 bp, Homo sapiens
caaggtcctgctca

SEQ ID NO: 1579607 - DNA, 15 bp, Homo sapiens
caaggtcctgctcaa

SEQ ID NO: 1579608 - DNA, 14 bp, Homo sapiens
caaggtctttggtt

SEQ ID NO: 1579609 - DNA, 23 bp, Homo sapiens
caaggtgatttcagactgcagag

SEQ ID NO: 1579610 - DNA, 11 bp, Homo sapiens
caaggtgctaa

SEQ ID NO: 1579611 - DNA, 21 bp, Homo sapiens
caaggtgctgatgtcaaagtg

SEQ ID NO: 1579612 - DNA, 14 bp, Homo sapiens
caaggtggagggaa

SEQ ID NO: 1579613 - DNA, 20 bp, Homo sapiens
caaggtggcctctgcctggg

SEQ ID NO: 1579614 - DNA, 12 bp, Homo sapiens
caaggtgggctg

SEQ ID NO: 1579615 - DNA, 17 bp, Homo sapiens
caaggtgggctgagccc

SEQ ID NO: 1579616 - DNA, 18 bp, Homo sapiens
caaggtgggctgagccct

SEQ ID NO: 1579617 - DNA, 23 bp, Homo sapiens
caaggtgggctgagccctggcag

SEQ ID NO: 1579618 - DNA, 20 bp, Homo sapiens
caaggtggggattgcccctg

SEQ ID NO: 1579619 - DNA, 23 bp, Homo sapiens
caaggtggggattgcccctggct

SEQ ID NO: 1579620 - DNA, 20 bp, Homo sapiens
caaggtgggtgattcctccc

SEQ ID NO: 1579621 - DNA, 22 bp, Homo sapiens
caaggtgggtgattcctcccag

SEQ ID NO: 1579622 - DNA, 13 bp, Homo sapiens
caaggtgtccagg

SEQ ID NO: 1579623 - DNA, 19 bp, Homo sapiens
caaggtgtccctgccttca

SEQ ID NO: 1579624 - DNA, 17 bp, Homo sapiens
caaggttactgggagtg

SEQ ID NO: 1579625 - DNA, 21 bp, Homo sapiens
caaggttataattttttttaa

SEQ ID NO: 1579626 - DNA, 13 bp, Homo sapiens
caaggttctaacc

SEQ ID NO: 1579627 - DNA, 13 bp, Homo sapiens
caaggttggagcc

SEQ ID NO: 1579628 - DNA, 17 bp, Homo sapiens
caaggtttaaagagtct

SEQ ID NO: 1579629 - DNA, 20 bp, Homo sapiens
caaggtttaaagagtctaga

SEQ ID NO: 1579630 - DNA, 22 bp, Homo sapiens
caaggtttaaagagtctagatt

SEQ ID NO: 1579631 - DNA, 18 bp, Homo sapiens
caaggtttgagtccctcc

SEQ ID NO: 1579632 - DNA, 19 bp, Homo sapiens
caaggttttataaggctga

SEQ ID NO: 1579633 - DNA, 13 bp, Homo sapiens
caagtaaacattc

SEQ ID NO: 1579634 - DNA, 14 bp, Homo sapiens
caagtaaagtgctt

SEQ ID NO: 1579635 - DNA, 13 bp, Homo sapiens
caagtaaatatat

SEQ ID NO: 1579636 - DNA, 14 bp, Homo sapiens
caagtaacacattt

SEQ ID NO: 1579637 - DNA, 17 bp, Homo sapiens
caagtaacacatttggc

SEQ ID NO: 1579638 - DNA, 18 bp, Homo sapiens
caagtaagaaaaataagc

SEQ ID NO: 1579639 - DNA, 18 bp, Homo sapiens
caagtaagaagacatgaa

SEQ ID NO: 1579640 - DNA, 12 bp, Homo sapiens
caagtacccatt

SEQ ID NO: 1579641 - DNA, 16 bp, Homo sapiens
caagtagcacatggtt

SEQ ID NO: 1579642 - DNA, 18 bp, Homo sapiens
caagtatactagggagcc

SEQ ID NO: 1579643 - DNA, 18 bp, Homo sapiens
caagtatagcctatggca

SEQ ID NO: 1579644 - DNA, 15 bp, Homo sapiens
caagtatcttctatt

SEQ ID NO: 1579645 - DNA, 19 bp, Homo sapiens
caagtatgaataaagacac

SEQ ID NO: 1579646 - DNA, 14 bp, Homo sapiens
caagtatgaatatt

SEQ ID NO: 1579647 - DNA, 19 bp, Homo sapiens
caagtatgccttaagcaga

SEQ ID NO: 1579648 - DNA, 20 bp, Homo sapiens
caagtatggtaggggagggc

SEQ ID NO: 1579649 - DNA, 22 bp, Homo sapiens
caagtattataaacaagaatga

SEQ ID NO: 1579650 - DNA, 15 bp, Homo sapiens
caagtatttaagcct

SEQ ID NO: 1579651 - DNA, 15 bp, Homo sapiens
caagtcacagctgca

SEQ ID NO: 1579652 - DNA, 17 bp, Homo sapiens
caagtcacttaactata

SEQ ID NO: 1579653 - DNA, 15 bp, Homo sapiens
caagtcagctccagc

SEQ ID NO: 1579654 - DNA, 19 bp, Homo sapiens
caagtcaggcccttatttt

SEQ ID NO: 1579655 - DNA, 13 bp, Homo sapiens
caagtcatgtgca

SEQ ID NO: 1579656 - DNA, 16 bp, Homo sapiens
caagtcatgtgcattt

SEQ ID NO: 1579657 - DNA, 17 bp, Homo sapiens
caagtcatgtgcatttc

SEQ ID NO: 1579658 - DNA, 17 bp, Homo sapiens
caagtcattttaacttt

SEQ ID NO: 1579659 - DNA, 22 bp, Homo sapiens
caagtccatgttattctctcac

SEQ ID NO: 1579660 - DNA, 22 bp, Homo sapiens
caagtcccaccctcttcccatg

SEQ ID NO: 1579661 - DNA, 18 bp, Homo sapiens
caagtccccttctgtgtt

SEQ ID NO: 1579662 - DNA, 18 bp, Homo sapiens
caagtccctgactctctg

SEQ ID NO: 1579663 - DNA, 23 bp, Homo sapiens
caagtccctgttttctgagcccg

SEQ ID NO: 1579664 - DNA, 17 bp, Homo sapiens
caagtcccttgttttgt

SEQ ID NO: 1579665 - DNA, 16 bp, Homo sapiens
caagtccgcagaagcc

SEQ ID NO: 1579666 - DNA, 19 bp, Homo sapiens
caagtcctgaagaggcggg

SEQ ID NO: 1579667 - DNA, 13 bp, Homo sapiens
caagtcctggcta

SEQ ID NO: 1579668 - DNA, 15 bp, Homo sapiens
caagtctaatgaaga

SEQ ID NO: 1579669 - DNA, 20 bp, Homo sapiens
caagtctaatgaagagaaaa

SEQ ID NO: 1579670 - DNA, 14 bp, Homo sapiens
caagtctccttccc

SEQ ID NO: 1579671 - DNA, 19 bp, Homo sapiens
caagtctctgctggcccag

SEQ ID NO: 1579672 - DNA, 22 bp, Homo sapiens
caagtctctgctggcccagcca

SEQ ID NO: 1579673 - DNA, 23 bp, Homo sapiens
caagtctctgctggcccagccaa

SEQ ID NO: 1579674 - DNA, 13 bp, Homo sapiens
caagtctggatct

SEQ ID NO: 1579675 - DNA, 12 bp, Homo sapiens
caagtgaaaaat

SEQ ID NO: 1579676 - DNA, 13 bp, Homo sapiens
caagtgaaattat

SEQ ID NO: 1579677 - DNA, 21 bp, Homo sapiens
caagtgaacactgttctacca

SEQ ID NO: 1579678 - DNA, 19 bp, Homo sapiens
caagtgaagaacactactg

SEQ ID NO: 1579679 - DNA, 16 bp, Homo sapiens
caagtgataattttat

SEQ ID NO: 1579680 - DNA, 22 bp, Homo sapiens
caagtgatccttccacctcagt

SEQ ID NO: 1579681 - DNA, 19 bp, Homo sapiens
caagtgatctgcccacctc

SEQ ID NO: 1579682 - DNA, 14 bp, Homo sapiens
caagtgattctcct

SEQ ID NO: 1579683 - DNA, 20 bp, Homo sapiens
caagtgattctcctgcctca

SEQ ID NO: 1579684 - DNA, 21 bp, Homo sapiens
caagtgattctcctgcctcag

SEQ ID NO: 1579685 - DNA, 22 bp, Homo sapiens
caagtgattctcctgcctcagc

SEQ ID NO: 1579686 - DNA, 22 bp, Homo sapiens
caagtgcagggcctgtaatccc

SEQ ID NO: 1579687 - DNA, 15 bp, Homo sapiens
caagtgccaaacaga

SEQ ID NO: 1579688 - DNA, 14 bp, Homo sapiens
caagtgccagaggt

SEQ ID NO: 1579689 - DNA, 20 bp, Homo sapiens
caagtgccagaggtgggcag

SEQ ID NO: 1579690 - DNA, 22 bp, Homo sapiens
caagtgccagaggtgggcaggt

SEQ ID NO: 1579691 - DNA, 11 bp, Homo sapiens
caagtgcctca

SEQ ID NO: 1579692 - DNA, 22 bp, Homo sapiens
caagtgcctcacctcgaaagga

SEQ ID NO: 1579693 - DNA, 16 bp, Homo sapiens
caagtgcctcttgttg

SEQ ID NO: 1579694 - DNA, 19 bp, Homo sapiens
caagtggatgggaatttgt

SEQ ID NO: 1579695 - DNA, 22 bp, Homo sapiens
caagtggatgggaatttgtcag

SEQ ID NO: 1579696 - DNA, 14 bp, Homo sapiens
caagtgggggcaga

SEQ ID NO: 1579697 - DNA, 20 bp, Homo sapiens
caagtgggggcagagggcag

SEQ ID NO: 1579698 - DNA, 17 bp, Homo sapiens
caagtggtaatttttgt

SEQ ID NO: 1579699 - DNA, 20 bp, Homo sapiens
caagtggtaatttttgtaca

SEQ ID NO: 1579700 - DNA, 22 bp, Homo sapiens
caagtggtaatttttgtacatt

SEQ ID NO: 1579701 - DNA, 22 bp, Homo sapiens
caagtggtgggaatcagatctg

SEQ ID NO: 1579702 - DNA, 17 bp, Homo sapiens
caagtggtgtttattgc

SEQ ID NO: 1579703 - DNA, 19 bp, Homo sapiens
caagtgtgaacaaaagatg

SEQ ID NO: 1579704 - DNA, 19 bp, Homo sapiens
caagtgtgctaaaaatgag

SEQ ID NO: 1579705 - DNA, 23 bp, Homo sapiens
caagtgtggagagggcagggtcc

SEQ ID NO: 1579706 - DNA, 22 bp, Homo sapiens
caagtgtgtgccaccatgcctc

SEQ ID NO: 1579707 - DNA, 18 bp, Homo sapiens
caagtgttaggtcaataa

SEQ ID NO: 1579708 - DNA, 18 bp, Homo sapiens
caagtgttcttaggttta

SEQ ID NO: 1579709 - DNA, 15 bp, Homo sapiens
caagtgttttggaaa

SEQ ID NO: 1579710 - DNA, 14 bp, Homo sapiens
caagttaaataaat

SEQ ID NO: 1579711 - DNA, 15 bp, Homo sapiens
caagttaacaaggaa

SEQ ID NO: 1579712 - DNA, 18 bp, Homo sapiens
caagttaacaaggaatgc

SEQ ID NO: 1579713 - DNA, 13 bp, Homo sapiens
caagttagctcag

SEQ ID NO: 1579714 - DNA, 17 bp, Homo sapiens
caagttagctcaggagg

SEQ ID NO: 1579715 - DNA, 20 bp, Homo sapiens
caagttataaatcaatgtca

SEQ ID NO: 1579716 - DNA, 20 bp, Homo sapiens
caagttattcaaatttgtac

SEQ ID NO: 1579717 - DNA, 17 bp, Homo sapiens
caagttcaatctgtttt

SEQ ID NO: 1579718 - DNA, 23 bp, Homo sapiens
caagttccccatccctgtcattt

SEQ ID NO: 1579719 - DNA, 21 bp, Homo sapiens
caagttccttggccatgcaga

SEQ ID NO: 1579720 - DNA, 14 bp, Homo sapiens
caagttctaagatt

SEQ ID NO: 1579721 - DNA, 20 bp, Homo sapiens
caagttctaagattctaatg

SEQ ID NO: 1579722 - DNA, 21 bp, Homo sapiens
caagttctaagattctaatga

SEQ ID NO: 1579723 - DNA, 14 bp, Homo sapiens
caagttgaagggaa

SEQ ID NO: 1579724 - DNA, 19 bp, Homo sapiens
caagttgaggacttcttgc

SEQ ID NO: 1579725 - DNA, 24 bp, Homo sapiens
caagttgggttcacttgccatgca

SEQ ID NO: 1579726 - DNA, 17 bp, Homo sapiens
caagttgtgcttgttta

SEQ ID NO: 1579727 - DNA, 18 bp, Homo sapiens
caagttgtgcttttctgt

SEQ ID NO: 1579728 - DNA, 15 bp, Homo sapiens
caagttgttaaaaca

SEQ ID NO: 1579729 - DNA, 16 bp, Homo sapiens
caagttgttaaaacat

SEQ ID NO: 1579730 - DNA, 22 bp, Homo sapiens
caagtttatcagtaaataactg

SEQ ID NO: 1579731 - DNA, 15 bp, Homo sapiens
caagtttcagacagg

SEQ ID NO: 1579732 - DNA, 17 bp, Homo sapiens
caagtttccatagcaac

SEQ ID NO: 1579733 - DNA, 20 bp, Homo sapiens
caagtttccatagcaacagg

SEQ ID NO: 1579734 - DNA, 17 bp, Homo sapiens
caagtttctgtttcaaa

SEQ ID NO: 1579735 - DNA, 14 bp, Homo sapiens
caagttttaaagtt

SEQ ID NO: 1579736 - DNA, 15 bp, Homo sapiens
caagttttaaagttc

SEQ ID NO: 1579737 - DNA, 17 bp, Homo sapiens
caagttttcttccatga

SEQ ID NO: 1579738 - DNA, 14 bp, Homo sapiens
caagttttgtataa

SEQ ID NO: 1579739 - DNA, 17 bp, Homo sapiens
caagttttgtataaata

SEQ ID NO: 1579740 - DNA, 16 bp, Homo sapiens
caataaaaaaaagaaa

SEQ ID NO: 1579741 - DNA, 19 bp, Homo sapiens
caataaaaaaaagaaatga

SEQ ID NO: 1579742 - DNA, 13 bp, Homo sapiens
caataaaaagaaa

SEQ ID NO: 1579743 - DNA, 14 bp, Homo sapiens
caataaaaatcata

SEQ ID NO: 1579744 - DNA, 12 bp, Homo sapiens
caataaaagctt

SEQ ID NO: 1579745 - DNA, 11 bp, Homo sapiens
caataaaagtg

SEQ ID NO: 1579746 - DNA, 13 bp, Homo sapiens
caataaaagtgac

SEQ ID NO: 1579747 - DNA, 20 bp, Homo sapiens
caataaaagttttctccaac

SEQ ID NO: 1579748 - DNA, 15 bp, Homo sapiens
caataaaatgtgatt

SEQ ID NO: 1579749 - DNA, 20 bp, Homo sapiens
caataaaatgtgatttttct

SEQ ID NO: 1579750 - DNA, 14 bp, Homo sapiens
caataaaatttaaa

SEQ ID NO: 1579751 - DNA, 18 bp, Homo sapiens
caataaaatttttttaaa

SEQ ID NO: 1579752 - DNA, 20 bp, Homo sapiens
caataaaatttttttaaagt

SEQ ID NO: 1579753 - DNA, 16 bp, Homo sapiens
caataaacaacagctg

SEQ ID NO: 1579754 - DNA, 21 bp, Homo sapiens
caataaacaacagctgaagca

SEQ ID NO: 1579755 - DNA, 11 bp, Homo sapiens
caataaactat

SEQ ID NO: 1579756 - DNA, 22 bp, Homo sapiens
caataaacttagaggaaaatga

SEQ ID NO: 1579757 - DNA, 19 bp, Homo sapiens
caataaagatatttccaag

SEQ ID NO: 1579758 - DNA, 15 bp, Homo sapiens
caataaagcactgag

SEQ ID NO: 1579759 - DNA, 11 bp, Homo sapiens
caataaaggca

SEQ ID NO: 1579760 - DNA, 21 bp, Homo sapiens
caataaaggtcccttagcccc

SEQ ID NO: 1579761 - DNA, 13 bp, Homo sapiens
caataaatattct

SEQ ID NO: 1579762 - DNA, 14 bp, Homo sapiens
caataaatccacac

SEQ ID NO: 1579763 - DNA, 17 bp, Homo sapiens
caataaatctgacccag

SEQ ID NO: 1579764 - DNA, 12 bp, Homo sapiens
caataaatgaat

SEQ ID NO: 1579765 - DNA, 16 bp, Homo sapiens
caataaatgaatgaat

SEQ ID NO: 1579766 - DNA, 18 bp, Homo sapiens
caataaatgtattcaaat

SEQ ID NO: 1579767 - DNA, 16 bp, Homo sapiens
caataaatgtctgttg

SEQ ID NO: 1579768 - DNA, 20 bp, Homo sapiens
caataaattgttttttaatt

SEQ ID NO: 1579769 - DNA, 20 bp, Homo sapiens
caataaatttgtaactttgc

SEQ ID NO: 1579770 - DNA, 18 bp, Homo sapiens
caataaattttttttggt

SEQ ID NO: 1579771 - DNA, 22 bp, Homo sapiens
caataaattttttttggtcaaa

SEQ ID NO: 1579772 - DNA, 16 bp, Homo sapiens
caataacactgtattt

SEQ ID NO: 1579773 - DNA, 18 bp, Homo sapiens
caataactatttttcctc

SEQ ID NO: 1579774 - DNA, 12 bp, Homo sapiens
caataactctgg

SEQ ID NO: 1579775 - DNA, 12 bp, Homo sapiens
caataacttcta

SEQ ID NO: 1579776 - DNA, 16 bp, Homo sapiens
caataacttctatatt

SEQ ID NO: 1579777 - DNA, 23 bp, Homo sapiens
caataacttctatattttaatag

SEQ ID NO: 1579778 - DNA, 13 bp, Homo sapiens
caataataaagat

SEQ ID NO: 1579779 - DNA, 22 bp, Homo sapiens
caataataaagatgtgaaaact

SEQ ID NO: 1579780 - DNA, 19 bp, Homo sapiens
caataataaatatttttgc

SEQ ID NO: 1579781 - DNA, 18 bp, Homo sapiens
caataatatttcaagtgc

SEQ ID NO: 1579782 - DNA, 19 bp, Homo sapiens
caataatatttcaagtgcc

SEQ ID NO: 1579783 - DNA, 20 bp, Homo sapiens
caataatatttcaagtgcct

SEQ ID NO: 1579784 - DNA, 19 bp, Homo sapiens
caataatggtcccatccag

SEQ ID NO: 1579785 - DNA, 14 bp, Homo sapiens
caataatgtactca

SEQ ID NO: 1579786 - DNA, 16 bp, Homo sapiens
caataatgtactcaca

SEQ ID NO: 1579787 - DNA, 21 bp, Homo sapiens
caataattacattggcacaat

SEQ ID NO: 1579788 - DNA, 12 bp, Homo sapiens
caataattgttt

SEQ ID NO: 1579789 - DNA, 15 bp, Homo sapiens
caataattgtttcca

SEQ ID NO: 1579790 - DNA, 16 bp, Homo sapiens
caatacaaatggattt

SEQ ID NO: 1579791 - DNA, 21 bp, Homo sapiens
caatacaaatggattttggga

SEQ ID NO: 1579792 - DNA, 16 bp, Homo sapiens
caatacaatgtacaat

SEQ ID NO: 1579793 - DNA, 18 bp, Homo sapiens
caatacaatgtacaatta

SEQ ID NO: 1579794 - DNA, 19 bp, Homo sapiens
caatacaatgtacaattat

SEQ ID NO: 1579795 - DNA, 17 bp, Homo sapiens
caatacactagttgttt

SEQ ID NO: 1579796 - DNA, 15 bp, Homo sapiens
caatacatgctgcta

SEQ ID NO: 1579797 - DNA, 12 bp, Homo sapiens
caatacatttgt

SEQ ID NO: 1579798 - DNA, 19 bp, Homo sapiens
caataccgctcagtatttt

SEQ ID NO: 1579799 - DNA, 19 bp, Homo sapiens
caatacgtgatctctgtta

SEQ ID NO: 1579800 - DNA, 20 bp, Homo sapiens
caatacgtttgtgcagaatc

SEQ ID NO: 1579801 - DNA, 18 bp, Homo sapiens
caatactcttgaaatgta

SEQ ID NO: 1579802 - DNA, 17 bp, Homo sapiens
caatacttttgtgtatt

SEQ ID NO: 1579803 - DNA, 21 bp, Homo sapiens
caatacttttgtgtattctgt

SEQ ID NO: 1579804 - DNA, 23 bp, Homo sapiens
caatagaaactcaccatgtaaaa

SEQ ID NO: 1579805 - DNA, 18 bp, Homo sapiens
caatagaataatctatta

SEQ ID NO: 1579806 - DNA, 12 bp, Homo sapiens
caatagagactg

SEQ ID NO: 1579807 - DNA, 16 bp, Homo sapiens
caatagagactgtaga

SEQ ID NO: 1579808 - DNA, 19 bp, Homo sapiens
caatagcaacgtagcttct

SEQ ID NO: 1579809 - DNA, 19 bp, Homo sapiens
caatagcagacagtgtttt

SEQ ID NO: 1579810 - DNA, 15 bp, Homo sapiens
caatagcctgaattt

SEQ ID NO: 1579811 - DNA, 21 bp, Homo sapiens
caatagctttaccctcaggca

SEQ ID NO: 1579812 - DNA, 22 bp, Homo sapiens
caataggagtggtgatttgaaa

SEQ ID NO: 1579813 - DNA, 16 bp, Homo sapiens
caatagggtagaatga

SEQ ID NO: 1579814 - DNA, 15 bp, Homo sapiens
caatagtaactcttt

SEQ ID NO: 1579815 - DNA, 20 bp, Homo sapiens
caatagtgcaacatctctga

SEQ ID NO: 1579816 - DNA, 14 bp, Homo sapiens
caatataagaagca

SEQ ID NO: 1579817 - DNA, 20 bp, Homo sapiens
caatatagaaaaataaaaat

SEQ ID NO: 1579818 - DNA, 21 bp, Homo sapiens
caatatataagactattccaa

SEQ ID NO: 1579819 - DNA, 18 bp, Homo sapiens
caatatatattatatata

SEQ ID NO: 1579820 - DNA, 22 bp, Homo sapiens
caatatatattatatatatcta

SEQ ID NO: 1579821 - DNA, 21 bp, Homo sapiens
caatatcagctttgataattg

SEQ ID NO: 1579822 - DNA, 21 bp, Homo sapiens
caatatcgtacctgtccctcc

SEQ ID NO: 1579823 - DNA, 22 bp, Homo sapiens
caatatcgtacctgtccctcca

SEQ ID NO: 1579824 - DNA, 15 bp, Homo sapiens
caatatcttgcttga

SEQ ID NO: 1579825 - DNA, 16 bp, Homo sapiens
caatatcttgcttgaa

SEQ ID NO: 1579826 - DNA, 16 bp, Homo sapiens
caatatgtgagtgcct

SEQ ID NO: 1579827 - DNA, 14 bp, Homo sapiens
caatattaaataca

SEQ ID NO: 1579828 - DNA, 15 bp, Homo sapiens
caatattaaatacag

SEQ ID NO: 1579829 - DNA, 17 bp, Homo sapiens
caatattaatgccttta

SEQ ID NO: 1579830 - DNA, 15 bp, Homo sapiens
caatattactttgtc

SEQ ID NO: 1579831 - DNA, 21 bp, Homo sapiens
caatattactttgtcttttca

SEQ ID NO: 1579832 - DNA, 14 bp, Homo sapiens
caatattataattt

SEQ ID NO: 1579833 - DNA, 19 bp, Homo sapiens
caatattccagatctttca

SEQ ID NO: 1579834 - DNA, 17 bp, Homo sapiens
caatattgacatttgta

SEQ ID NO: 1579835 - DNA, 17 bp, Homo sapiens
caatattgattgggaaa

SEQ ID NO: 1579836 - DNA, 12 bp, Homo sapiens
caatattgtaat

SEQ ID NO: 1579837 - DNA, 23 bp, Homo sapiens
caatattgtaatcctagcacttt

SEQ ID NO: 1579838 - DNA, 15 bp, Homo sapiens
caatatttagaaaat

SEQ ID NO: 1579839 - DNA, 17 bp, Homo sapiens
caatatttagaaaattt

SEQ ID NO: 1579840 - DNA, 14 bp, Homo sapiens
caatatttagtaaa

SEQ ID NO: 1579841 - DNA, 21 bp, Homo sapiens
caatatttattacacaaagaa

SEQ ID NO: 1579842 - DNA, 19 bp, Homo sapiens
caatatttattattttcac

SEQ ID NO: 1579843 - DNA, 19 bp, Homo sapiens
caatatttgaattttaaat

SEQ ID NO: 1579844 - DNA, 16 bp, Homo sapiens
caatatttgttactgt

SEQ ID NO: 1579845 - DNA, 16 bp, Homo sapiens
caatcaaagaattaca

SEQ ID NO: 1579846 - DNA, 22 bp, Homo sapiens
caatcaaataagtatttataat

SEQ ID NO: 1579847 - DNA, 15 bp, Homo sapiens
caatcaactctaata

SEQ ID NO: 1579848 - DNA, 17 bp, Homo sapiens
caatcaactttactgta

SEQ ID NO: 1579849 - DNA, 13 bp, Homo sapiens
caatcagcactga

SEQ ID NO: 1579850 - DNA, 16 bp, Homo sapiens
caatcagcactgaaaa

SEQ ID NO: 1579851 - DNA, 18 bp, Homo sapiens
caatcagcttttgttcta

SEQ ID NO: 1579852 - DNA, 15 bp, Homo sapiens
caatcagtataattc

SEQ ID NO: 1579853 - DNA, 19 bp, Homo sapiens
caatcagtataattctgta

SEQ ID NO: 1579854 - DNA, 16 bp, Homo sapiens
caatcagtcccctccc

SEQ ID NO: 1579855 - DNA, 22 bp, Homo sapiens
caatcagttgactttaagtgaa

SEQ ID NO: 1579856 - DNA, 17 bp, Homo sapiens
caatcattttaattatt

SEQ ID NO: 1579857 - DNA, 15 bp, Homo sapiens
caatccaaataaaga

SEQ ID NO: 1579858 - DNA, 14 bp, Homo sapiens
caatccagaggaac

SEQ ID NO: 1579859 - DNA, 15 bp, Homo sapiens
caatccatgtaaggt

SEQ ID NO: 1579860 - DNA, 23 bp, Homo sapiens
caatccatgttagtttttacttt

SEQ ID NO: 1579861 - DNA, 23 bp, Homo sapiens
caatcccaccaaccctcagagcc

SEQ ID NO: 1579862 - DNA, 15 bp, Homo sapiens
caatcccctcattca

SEQ ID NO: 1579863 - DNA, 21 bp, Homo sapiens
caatcccctcattcaggaaaa

SEQ ID NO: 1579864 - DNA, 22 bp, Homo sapiens
caatcccctcattcaggaaaac

SEQ ID NO: 1579865 - DNA, 23 bp, Homo sapiens
caatcctagaaccaagcttcaga

SEQ ID NO: 1579866 - DNA, 21 bp, Homo sapiens
caatcctgattcctctctaag

SEQ ID NO: 1579867 - DNA, 20 bp, Homo sapiens
caatcctgttactctgtccc

SEQ ID NO: 1579868 - DNA, 14 bp, Homo sapiens
caatccttaaatat

SEQ ID NO: 1579869 - DNA, 15 bp, Homo sapiens
caatcggactgccaa

SEQ ID NO: 1579870 - DNA, 16 bp, Homo sapiens
caatcggactgccaaa

SEQ ID NO: 1579871 - DNA, 16 bp, Homo sapiens
caatcgggtccagaga

SEQ ID NO: 1579872 - DNA, 18 bp, Homo sapiens
caatcgtcttaagttttt

SEQ ID NO: 1579873 - DNA, 11 bp, Homo sapiens
caatctactgg

SEQ ID NO: 1579874 - DNA, 22 bp, Homo sapiens
caatctagaggcaagcctggcc

SEQ ID NO: 1579875 - DNA, 20 bp, Homo sapiens
caatctatggcttatttcta

SEQ ID NO: 1579876 - DNA, 21 bp, Homo sapiens
caatctatggcttatttctat

SEQ ID NO: 1579877 - DNA, 19 bp, Homo sapiens
caatctattgcttcaccat

SEQ ID NO: 1579878 - DNA, 23 bp, Homo sapiens
caatctcctctctctttcctcca

SEQ ID NO: 1579879 - DNA, 14 bp, Homo sapiens
caatctctttttgt

SEQ ID NO: 1579880 - DNA, 20 bp, Homo sapiens
caatctggatgcctcattat

SEQ ID NO: 1579881 - DNA, 13 bp, Homo sapiens
caatctggctcac

SEQ ID NO: 1579882 - DNA, 14 bp, Homo sapiens
caatctggctcact

SEQ ID NO: 1579883 - DNA, 17 bp, Homo sapiens
caatctggctcactgca

SEQ ID NO: 1579884 - DNA, 22 bp, Homo sapiens
caatctggctcactgcagcctc

SEQ ID NO: 1579885 - DNA, 20 bp, Homo sapiens
caatctggcttagtgccacc

SEQ ID NO: 1579886 - DNA, 22 bp, Homo sapiens
caatctgggtggtaactgccag

SEQ ID NO: 1579887 - DNA, 15 bp, Homo sapiens
caatctgtaaactgt

SEQ ID NO: 1579888 - DNA, 18 bp, Homo sapiens
caatctgtaaactgtgta

SEQ ID NO: 1579889 - DNA, 14 bp, Homo sapiens
caatctgtaaattt

SEQ ID NO: 1579890 - DNA, 16 bp, Homo sapiens
caatctgtaaattttt

SEQ ID NO: 1579891 - DNA, 20 bp, Homo sapiens
caatctgttttggctttatg

SEQ ID NO: 1579892 - DNA, 15 bp, Homo sapiens
caatcttgttactgc

SEQ ID NO: 1579893 - DNA, 15 bp, Homo sapiens
caatctttgaaataa

SEQ ID NO: 1579894 - DNA, 19 bp, Homo sapiens
caatctttgcctttatctc

SEQ ID NO: 1579895 - DNA, 12 bp, Homo sapiens
caatcttttaaa

SEQ ID NO: 1579896 - DNA, 16 bp, Homo sapiens
caatgaaaacatgtac

SEQ ID NO: 1579897 - DNA, 18 bp, Homo sapiens
caatgaaaggtactatat

SEQ ID NO: 1579898 - DNA, 22 bp, Homo sapiens
caatgaaatacacaagtaaaca

SEQ ID NO: 1579899 - DNA, 11 bp, Homo sapiens
caatgaaatga

SEQ ID NO: 1579900 - DNA, 13 bp, Homo sapiens
caatgaaatgaat

SEQ ID NO: 1579901 - DNA, 19 bp, Homo sapiens
caatgaaatgaattaaagt

SEQ ID NO: 1579902 - DNA, 21 bp, Homo sapiens
caatgaaatgaattaaagtgg

SEQ ID NO: 1579903 - DNA, 13 bp, Homo sapiens
caatgaacagctc

SEQ ID NO: 1579904 - DNA, 16 bp, Homo sapiens
caatgaaccataaatt

SEQ ID NO: 1579905 - DNA, 20 bp, Homo sapiens
caatgaactgcttttcctca

SEQ ID NO: 1579906 - DNA, 21 bp, Homo sapiens
caatgaagccagctcacagtg

SEQ ID NO: 1579907 - DNA, 15 bp, Homo sapiens
caatgacctgtattt

SEQ ID NO: 1579908 - DNA, 11 bp, Homo sapiens
caatgactact

SEQ ID NO: 1579909 - DNA, 19 bp, Homo sapiens
caatgaggtctgaaatgga

SEQ ID NO: 1579910 - DNA, 20 bp, Homo sapiens
caatgatatatggataatgc

SEQ ID NO: 1579911 - DNA, 16 bp, Homo sapiens
caatgatgacccacta

SEQ ID NO: 1579912 - DNA, 18 bp, Homo sapiens
caatgatgacccactaaa

SEQ ID NO: 1579913 - DNA, 13 bp, Homo sapiens
caatgatggcaat

SEQ ID NO: 1579914 - DNA, 17 bp, Homo sapiens
caatgatggtttaatag

SEQ ID NO: 1579915 - DNA, 22 bp, Homo sapiens
caatgattgttaatttacagct

SEQ ID NO: 1579916 - DNA, 13 bp, Homo sapiens
caatgcaaagtaa

SEQ ID NO: 1579917 - DNA, 16 bp, Homo sapiens
caatgcattggcctct

SEQ ID NO: 1579918 - DNA, 21 bp, Homo sapiens
caatgcattggcctctgtacc

SEQ ID NO: 1579919 - DNA, 20 bp, Homo sapiens
caatgcattgtcttgtggag

SEQ ID NO: 1579920 - DNA, 13 bp, Homo sapiens
caatgcatttaaa

SEQ ID NO: 1579921 - DNA, 16 bp, Homo sapiens
caatgccatgaacaaa

SEQ ID NO: 1579922 - DNA, 18 bp, Homo sapiens
caatgccatgaacaaatt

SEQ ID NO: 1579923 - DNA, 21 bp, Homo sapiens
caatgccatgaacaaattctt

SEQ ID NO: 1579924 - DNA, 16 bp, Homo sapiens
caatgcctcttgtctt

SEQ ID NO: 1579925 - DNA, 17 bp, Homo sapiens
caatgctgttgtaaaca

SEQ ID NO: 1579926 - DNA, 15 bp, Homo sapiens
caatgcttcattatt

SEQ ID NO: 1579927 - DNA, 20 bp, Homo sapiens
caatgcttgtagaagtagga

SEQ ID NO: 1579928 - DNA, 13 bp, Homo sapiens
caatggaaactga

SEQ ID NO: 1579929 - DNA, 16 bp, Homo sapiens
caatggaaactgaatg

SEQ ID NO: 1579930 - DNA, 19 bp, Homo sapiens
caatggatttgatgctgtt

SEQ ID NO: 1579931 - DNA, 22 bp, Homo sapiens
caatggatttgatgctgtttga

SEQ ID NO: 1579932 - DNA, 20 bp, Homo sapiens
caatggcagctagactggag

SEQ ID NO: 1579933 - DNA, 21 bp, Homo sapiens
caatgggaaatactactcctg

SEQ ID NO: 1579934 - DNA, 16 bp, Homo sapiens
caatgggaagactcag

SEQ ID NO: 1579935 - DNA, 21 bp, Homo sapiens
caatgggaagactcaggagtc

SEQ ID NO: 1579936 - DNA, 20 bp, Homo sapiens
caatggggactttgttggta

SEQ ID NO: 1579937 - DNA, 15 bp, Homo sapiens
caatggggccagtca

SEQ ID NO: 1579938 - DNA, 23 bp, Homo sapiens
caatgggtttttccctgtacagt

SEQ ID NO: 1579939 - DNA, 22 bp, Homo sapiens
caatggtagattcgctgtcccc

SEQ ID NO: 1579940 - DNA, 21 bp, Homo sapiens
caatggtgcttcccccacccc

SEQ ID NO: 1579941 - DNA, 18 bp, Homo sapiens
caatggtgtagctgtcct

SEQ ID NO: 1579942 - DNA, 21 bp, Homo sapiens
caatggtgtagctgtcctctc

SEQ ID NO: 1579943 - DNA, 21 bp, Homo sapiens
caatggtttgtgtcaaaactg

SEQ ID NO: 1579944 - DNA, 16 bp, Homo sapiens
caatgtacaattatgt

SEQ ID NO: 1579945 - DNA, 17 bp, Homo sapiens
caatgtagaaagctttg

SEQ ID NO: 1579946 - DNA, 11 bp, Homo sapiens
caatgtataaa

SEQ ID NO: 1579947 - DNA, 13 bp, Homo sapiens
caatgtataaaga

SEQ ID NO: 1579948 - DNA, 18 bp, Homo sapiens
caatgtataaagattgta

SEQ ID NO: 1579949 - DNA, 11 bp, Homo sapiens
caatgtatctt

SEQ ID NO: 1579950 - DNA, 18 bp, Homo sapiens
caatgtatctttattaaa

SEQ ID NO: 1579951 - DNA, 20 bp, Homo sapiens
caatgtatctttattaaaac

SEQ ID NO: 1579952 - DNA, 22 bp, Homo sapiens
caatgtatctttattaaaacaa

SEQ ID NO: 1579953 - DNA, 18 bp, Homo sapiens
caatgtatgtaatttgtt

SEQ ID NO: 1579954 - DNA, 22 bp, Homo sapiens
caatgtatgtacaatacaatgt

SEQ ID NO: 1579955 - DNA, 18 bp, Homo sapiens
caatgtatgtgtggctgt

SEQ ID NO: 1579956 - DNA, 14 bp, Homo sapiens
caatgtatttagct

SEQ ID NO: 1579957 - DNA, 18 bp, Homo sapiens
caatgtatttagctacag

SEQ ID NO: 1579958 - DNA, 18 bp, Homo sapiens
caatgtatttatttaaaa

SEQ ID NO: 1579959 - DNA, 20 bp, Homo sapiens
caatgtatttatttaaaaga

SEQ ID NO: 1579960 - DNA, 19 bp, Homo sapiens
caatgtcacaacctctctg

SEQ ID NO: 1579961 - DNA, 14 bp, Homo sapiens
caatgtcacttaaa

SEQ ID NO: 1579962 - DNA, 21 bp, Homo sapiens
caatgtcaggaacagaaggat

SEQ ID NO: 1579963 - DNA, 17 bp, Homo sapiens
caatgtccagcagtctg

SEQ ID NO: 1579964 - DNA, 13 bp, Homo sapiens
caatgtctgtgct

SEQ ID NO: 1579965 - DNA, 14 bp, Homo sapiens
caatgtcttcccac

SEQ ID NO: 1579966 - DNA, 12 bp, Homo sapiens
caatgtgaaact

SEQ ID NO: 1579967 - DNA, 14 bp, Homo sapiens
caatgtgaaactga

SEQ ID NO: 1579968 - DNA, 19 bp, Homo sapiens
caatgtgaatcagacccta

SEQ ID NO: 1579969 - DNA, 21 bp, Homo sapiens
caatgtgagtcccagagcccg

SEQ ID NO: 1579970 - DNA, 23 bp, Homo sapiens
caatgtgccttgattgattagat

SEQ ID NO: 1579971 - DNA, 21 bp, Homo sapiens
caatgtggcctaaaaatgcaa

SEQ ID NO: 1579972 - DNA, 22 bp, Homo sapiens
caatgtggtgacacctccccct

SEQ ID NO: 1579973 - DNA, 17 bp, Homo sapiens
caatgttgtccaacaat

SEQ ID NO: 1579974 - DNA, 11 bp, Homo sapiens
caatgtttctg

SEQ ID NO: 1579975 - DNA, 19 bp, Homo sapiens
caatgtttctggacattct

SEQ ID NO: 1579976 - DNA, 20 bp, Homo sapiens
caatgtttctggacattctc

SEQ ID NO: 1579977 - DNA, 21 bp, Homo sapiens
caatgtttctggacattctct

SEQ ID NO: 1579978 - DNA, 17 bp, Homo sapiens
caatgtttcttctaggt

SEQ ID NO: 1579979 - DNA, 23 bp, Homo sapiens
caatgtttgggatattaaaacac

SEQ ID NO: 1579980 - DNA, 22 bp, Homo sapiens
caattaaatgtaggtatgaata

SEQ ID NO: 1579981 - DNA, 15 bp, Homo sapiens
caattaataaaaaat

SEQ ID NO: 1579982 - DNA, 17 bp, Homo sapiens
caattacccataaacag

SEQ ID NO: 1579983 - DNA, 15 bp, Homo sapiens
caattactttggtag

SEQ ID NO: 1579984 - DNA, 20 bp, Homo sapiens
caattagatctaaacagtta

SEQ ID NO: 1579985 - DNA, 22 bp, Homo sapiens
caattagatctaaacagttatt

SEQ ID NO: 1579986 - DNA, 21 bp, Homo sapiens
caattagcaattgactgtcac

SEQ ID NO: 1579987 - DNA, 22 bp, Homo sapiens
caattaggaagtgtaacagctg

SEQ ID NO: 1579988 - DNA, 16 bp, Homo sapiens
caattagggcctagcc

SEQ ID NO: 1579989 - DNA, 16 bp, Homo sapiens
caccactaaccatccc

SEQ ID NO: 1579990 - DNA, 18 bp, Homo sapiens
caccactaaccatcccca

SEQ ID NO: 1579991 - DNA, 20 bp, Homo sapiens
caccactaaccatccccaac

SEQ ID NO: 1579992 - DNA, 18 bp, Homo sapiens
caccactaccagccagcc

SEQ ID NO: 1579993 - DNA, 16 bp, Homo sapiens
caccactcccctccca

SEQ ID NO: 1579994 - DNA, 18 bp, Homo sapiens
caccactgcactccagcc

SEQ ID NO: 1579995 - DNA, 15 bp, Homo sapiens
caccactgccctgcc

SEQ ID NO: 1579996 - DNA, 15 bp, Homo sapiens
caccactgcttccca

SEQ ID NO: 1579997 - DNA, 19 bp, Homo sapiens
caccactggccaccaggct

SEQ ID NO: 1579998 - DNA, 20 bp, Homo sapiens
caccactggccaccaggctg

SEQ ID NO: 1579999 - DNA, 20 bp, Homo sapiens
caccacttttggattttatg

SEQ ID NO: 1580000 - DNA, 23 bp, Homo sapiens
caccagaaatatcgctgatgcag

SEQ ID NO: 1580001 - DNA, 19 bp, Homo sapiens
caccagaagatgtgaaatt

SEQ ID NO: 1580002 - DNA, 20 bp, Homo sapiens
caccagaagctgttgggaga

SEQ ID NO: 1580003 - DNA, 16 bp, Homo sapiens
caccagaatttctaag

SEQ ID NO: 1580004 - DNA, 14 bp, Homo sapiens
caccagacacccag

SEQ ID NO: 1580005 - DNA, 16 bp, Homo sapiens
caccagacacccagga

SEQ ID NO: 1580006 - DNA, 17 bp, Homo sapiens
caccagacacccaggac

SEQ ID NO: 1580007 - DNA, 13 bp, Homo sapiens
caccagagcccat

SEQ ID NO: 1580008 - DNA, 14 bp, Homo sapiens
caccagagcccatg

SEQ ID NO: 1580009 - DNA, 13 bp, Homo sapiens
caccagagccggg

SEQ ID NO: 1580010 - DNA, 22 bp, Homo sapiens
caccagagcttctctgggctga

SEQ ID NO: 1580011 - DNA, 15 bp, Homo sapiens
caccagcatcacctg

SEQ ID NO: 1580012 - DNA, 18 bp, Homo sapiens
caccagccccactgccag

SEQ ID NO: 1580013 - DNA, 20 bp, Homo sapiens
caccagccccctggatgggc

SEQ ID NO: 1580014 - DNA, 18 bp, Homo sapiens
caccagcccggcctgctc

SEQ ID NO: 1580015 - DNA, 20 bp, Homo sapiens
caccagccctagctgtccca

SEQ ID NO: 1580016 - DNA, 16 bp, Homo sapiens
caccagccgctgcagg

SEQ ID NO: 1580017 - DNA, 21 bp, Homo sapiens
caccagccgctgcagggctcc

SEQ ID NO: 1580018 - DNA, 23 bp, Homo sapiens
caccagccgctgcagggctccca

SEQ ID NO: 1580019 - DNA, 20 bp, Homo sapiens
caccagcctaagaagctctg

SEQ ID NO: 1580020 - DNA, 14 bp, Homo sapiens
caccagcgccccca

SEQ ID NO: 1580021 - DNA, 16 bp, Homo sapiens
caccagcgcccccaga

SEQ ID NO: 1580022 - DNA, 22 bp, Homo sapiens
caccagcggtccaacgccgcct

SEQ ID NO: 1580023 - DNA, 22 bp, Homo sapiens
caccagctctgtggcctgtgtc

SEQ ID NO: 1580024 - DNA, 19 bp, Homo sapiens
caccagctgctctgcccct

SEQ ID NO: 1580025 - DNA, 13 bp, Homo sapiens
caccaggaagccg

SEQ ID NO: 1580026 - DNA, 21 bp, Homo sapiens
caccaggacttaagacaaatg

SEQ ID NO: 1580027 - DNA, 16 bp, Homo sapiens
caccaggagaaccact

SEQ ID NO: 1580028 - DNA, 13 bp, Homo sapiens
caccaggagcagc

SEQ ID NO: 1580029 - DNA, 15 bp, Homo sapiens
caccccccaagctgt

SEQ ID NO: 1580030 - DNA, 21 bp, Homo sapiens
caccccccacgtctgtcctcc

SEQ ID NO: 1580031 - DNA, 20 bp, Homo sapiens
cacccccctctctttctctg

SEQ ID NO: 1580032 - DNA, 15 bp, Homo sapiens
cacccccctctgctg

SEQ ID NO: 1580033 - DNA, 17 bp, Homo sapiens
cacccccgccacggcca

SEQ ID NO: 1580034 - DNA, 16 bp, Homo sapiens
caccccctccccaggg

SEQ ID NO: 1580035 - DNA, 15 bp, Homo sapiens
caccccctccccgcc

SEQ ID NO: 1580036 - DNA, 15 bp, Homo sapiens
caccccctcctcccc

SEQ ID NO: 1580037 - DNA, 13 bp, Homo sapiens
caccccctgccct

SEQ ID NO: 1580038 - DNA, 18 bp, Homo sapiens
caccccctgctccaccag

SEQ ID NO: 1580039 - DNA, 13 bp, Homo sapiens
caccccctgtccc

SEQ ID NO: 1580040 - DNA, 16 bp, Homo sapiens
cacccccttcagtgcc

SEQ ID NO: 1580041 - DNA, 21 bp, Homo sapiens
cacccccttcagtgcccacca

SEQ ID NO: 1580042 - DNA, 18 bp, Homo sapiens
cacccccttccctgggag

SEQ ID NO: 1580043 - DNA, 16 bp, Homo sapiens
cacccccttctctgct

SEQ ID NO: 1580044 - DNA, 12 bp, Homo sapiens
caccccctttcc

SEQ ID NO: 1580045 - DNA, 12 bp, Homo sapiens
caccccctttgg

SEQ ID NO: 1580046 - DNA, 16 bp, Homo sapiens
caccccgcctgccctc

SEQ ID NO: 1580047 - DNA, 21 bp, Homo sapiens
caccccgcctgcctcctggct

SEQ ID NO: 1580048 - DNA, 23 bp, Homo sapiens
caccccgctgatggagccccacc

SEQ ID NO: 1580049 - DNA, 14 bp, Homo sapiens
caccccggcctcag

SEQ ID NO: 1580050 - DNA, 17 bp, Homo sapiens
caccccggcctcagggc

SEQ ID NO: 1580051 - DNA, 18 bp, Homo sapiens
caccccgggctctctgct

SEQ ID NO: 1580052 - DNA, 17 bp, Homo sapiens
caccccggggaccctgt

SEQ ID NO: 1580053 - DNA, 23 bp, Homo sapiens
cacccctaaaagaaaccctgcac

SEQ ID NO: 1580054 - DNA, 15 bp, Homo sapiens
cacccctaagtgccc

SEQ ID NO: 1580055 - DNA, 16 bp, Homo sapiens
cacccctcactcccca

SEQ ID NO: 1580056 - DNA, 20 bp, Homo sapiens
cacccctcactccccaggga

SEQ ID NO: 1580057 - DNA, 17 bp, Homo sapiens
cacccctccacgtgtcc

SEQ ID NO: 1580058 - DNA, 22 bp, Homo sapiens
cacccctccagaacacggctca

SEQ ID NO: 1580059 - DNA, 10 bp, Homo sapiens
cacccctccc

SEQ ID NO: 1580060 - DNA, 12 bp, Homo sapiens
cacccctcccat

SEQ ID NO: 1580061 - DNA, 13 bp, Homo sapiens
cacccctcccatt

SEQ ID NO: 1580062 - DNA, 17 bp, Homo sapiens
cacccctcccattagga

SEQ ID NO: 1580063 - DNA, 23 bp, Homo sapiens
cacccctccctgcttgcacactt

SEQ ID NO: 1580064 - DNA, 15 bp, Homo sapiens
cacccctccctttct

SEQ ID NO: 1580065 - DNA, 12 bp, Homo sapiens
cacccctccttc

SEQ ID NO: 1580066 - DNA, 17 bp, Homo sapiens
cacccctcgccaccttt

SEQ ID NO: 1580067 - DNA, 18 bp, Homo sapiens
cacccctcgccacctttc

SEQ ID NO: 1580068 - DNA, 22 bp, Homo sapiens
cacccctgcccaggcagtcttt

SEQ ID NO: 1580069 - DNA, 13 bp, Homo sapiens
cacccctgccccc

SEQ ID NO: 1580070 - DNA, 18 bp, Homo sapiens
cacccctgcccccagccc

SEQ ID NO: 1580071 - DNA, 19 bp, Homo sapiens
cacccctgcccccagcccc

SEQ ID NO: 1580072 - DNA, 16 bp, Homo sapiens
cacccctgccctggga

SEQ ID NO: 1580073 - DNA, 20 bp, Homo sapiens
cacccctggaagagcccagt

SEQ ID NO: 1580074 - DNA, 18 bp, Homo sapiens
cacccctggttctcatct

SEQ ID NO: 1580075 - DNA, 17 bp, Homo sapiens
cacccctgtcccaccca

SEQ ID NO: 1580076 - DNA, 20 bp, Homo sapiens
cacccctgtcccacccacac

SEQ ID NO: 1580077 - DNA, 12 bp, Homo sapiens
cacccctgtgct

SEQ ID NO: 1580078 - DNA, 23 bp, Homo sapiens
cacccctgtgctcccctgccaca

SEQ ID NO: 1580079 - DNA, 12 bp, Homo sapiens
caccccttctct

SEQ ID NO: 1580080 - DNA, 18 bp, Homo sapiens
cacccgagttcctctggg

SEQ ID NO: 1580081 - DNA, 14 bp, Homo sapiens
cacccgatgctgct

SEQ ID NO: 1580082 - DNA, 15 bp, Homo sapiens
cacccgatgctgctt

SEQ ID NO: 1580083 - DNA, 18 bp, Homo sapiens
cacccgatgctgctttcc

SEQ ID NO: 1580084 - DNA, 14 bp, Homo sapiens
cacccgccctttcc

SEQ ID NO: 1580085 - DNA, 15 bp, Homo sapiens
cacccgccctttcct

SEQ ID NO: 1580086 - DNA, 15 bp, Homo sapiens
cacccgcctgcagag

SEQ ID NO: 1580087 - DNA, 16 bp, Homo sapiens
cacccggccacagctg

SEQ ID NO: 1580088 - DNA, 20 bp, Homo sapiens
cacccggctcgtgtatttat

SEQ ID NO: 1580089 - DNA, 17 bp, Homo sapiens
cacccgggggagcccag

SEQ ID NO: 1580090 - DNA, 18 bp, Homo sapiens
cacccgggggagcccagt

SEQ ID NO: 1580091 - DNA, 20 bp, Homo sapiens
cacccgggggagcccagtga

SEQ ID NO: 1580092 - DNA, 21 bp, Homo sapiens
cacccggtgggacccccgtgg

SEQ ID NO: 1580093 - DNA, 15 bp, Homo sapiens
cacccgtaggcaaat

SEQ ID NO: 1580094 - DNA, 12 bp, Homo sapiens
cacctacccagc

SEQ ID NO: 1580095 - DNA, 13 bp, Homo sapiens
cacctacccagct

SEQ ID NO: 1580096 - DNA, 14 bp, Homo sapiens
cacctacccagctg

SEQ ID NO: 1580097 - DNA, 15 bp, Homo sapiens
cacctacccagctga

SEQ ID NO: 1580098 - DNA, 19 bp, Homo sapiens
cacctacccagctgatggg

SEQ ID NO: 1580099 - DNA, 18 bp, Homo sapiens
cacctaccgagttcaagt

SEQ ID NO: 1580100 - DNA, 23 bp, Homo sapiens
cacctagaacactaactcaccag

SEQ ID NO: 1580101 - DNA, 18 bp, Homo sapiens
cacctagaagtctccctg

SEQ ID NO: 1580102 - DNA, 12 bp, Homo sapiens
cacctagcagcc

SEQ ID NO: 1580103 - DNA, 16 bp, Homo sapiens
cacctagcagcctcaa

SEQ ID NO: 1580104 - DNA, 17 bp, Homo sapiens
cacctagcagcctcaaa

SEQ ID NO: 1580105 - DNA, 21 bp, Homo sapiens
cacctagcatgtgtaattttt

SEQ ID NO: 1580106 - DNA, 17 bp, Homo sapiens
cacctaggccactcctc

SEQ ID NO: 1580107 - DNA, 18 bp, Homo sapiens
cacctagtgccccagact

SEQ ID NO: 1580108 - DNA, 22 bp, Homo sapiens
cacctagtgccccagactgagc

SEQ ID NO: 1580109 - DNA, 21 bp, Homo sapiens
cacctagttctccccgatggg

SEQ ID NO: 1580110 - DNA, 22 bp, Homo sapiens
cacctatgccagtgctcaaggt

SEQ ID NO: 1580111 - DNA, 14 bp, Homo sapiens
cacctatttaatgt

SEQ ID NO: 1580112 - DNA, 13 bp, Homo sapiens
cacctcacagcta

SEQ ID NO: 1580113 - DNA, 13 bp, Homo sapiens
cacctcactcctg

SEQ ID NO: 1580114 - DNA, 14 bp, Homo sapiens
cacctcagcctgca

SEQ ID NO: 1580115 - DNA, 13 bp, Homo sapiens
cacctcagccttg

SEQ ID NO: 1580116 - DNA, 23 bp, Homo sapiens
cacctcagggcacgcaggaccag

SEQ ID NO: 1580117 - DNA, 14 bp, Homo sapiens
cacctcagtgggaa

SEQ ID NO: 1580118 - DNA, 20 bp, Homo sapiens
cacctcagttcccttggcct

SEQ ID NO: 1580119 - DNA, 21 bp, Homo sapiens
cacctcagttcccttggcctc

SEQ ID NO: 1580120 - DNA, 22 bp, Homo sapiens
cacctcagttcccttggcctca

SEQ ID NO: 1580121 - DNA, 18 bp, Homo sapiens
cacctcatcactggactg

SEQ ID NO: 1580122 - DNA, 17 bp, Homo sapiens
cacctcatgcccacccc

SEQ ID NO: 1580123 - DNA, 22 bp, Homo sapiens
cacctccaagcatttcatgaaa

SEQ ID NO: 1580124 - DNA, 21 bp, Homo sapiens
cacctccagctgccccgggat

SEQ ID NO: 1580125 - DNA, 11 bp, Homo sapiens
cacctccaggc

SEQ ID NO: 1580126 - DNA, 13 bp, Homo sapiens
cacctccaggcag

SEQ ID NO: 1580127 - DNA, 22 bp, Homo sapiens
cacctccaggcaggccaggctg

SEQ ID NO: 1580128 - DNA, 12 bp, Homo sapiens
cacctccaggct

SEQ ID NO: 1580129 - DNA, 15 bp, Homo sapiens
cacctccatcccaga

SEQ ID NO: 1580130 - DNA, 13 bp, Homo sapiens
cacctcccacccc

SEQ ID NO: 1580131 - DNA, 17 bp, Homo sapiens
cacctcccaccccactc

SEQ ID NO: 1580132 - DNA, 23 bp, Homo sapiens
cacctcccaccccactccagccc

SEQ ID NO: 1580133 - DNA, 16 bp, Homo sapiens
cacctcccactcctgc

SEQ ID NO: 1580134 - DNA, 19 bp, Homo sapiens
cacctcccactcctgctgc

SEQ ID NO: 1580135 - DNA, 14 bp, Homo sapiens
cacctcccagcccc

SEQ ID NO: 1580136 - DNA, 11 bp, Homo sapiens
cacctcccagg

SEQ ID NO: 1580137 - DNA, 12 bp, Homo sapiens
cacctcccagga

SEQ ID NO: 1580138 - DNA, 16 bp, Homo sapiens
cacctccccccactgc

SEQ ID NO: 1580139 - DNA, 21 bp, Homo sapiens
cacctccccccactgcaggcc

SEQ ID NO: 1580140 - DNA, 22 bp, Homo sapiens
cacctccccccactgcaggccc

SEQ ID NO: 1580141 - DNA, 14 bp, Homo sapiens
cacctccccctccc

SEQ ID NO: 1580142 - DNA, 19 bp, Homo sapiens
cacctccccctccccggcc

SEQ ID NO: 1580143 - DNA, 22 bp, Homo sapiens
cacctccccctccccggccaca

SEQ ID NO: 1580144 - DNA, 15 bp, Homo sapiens
cacctccccctttca

SEQ ID NO: 1580145 - DNA, 23 bp, Homo sapiens
cacctccccctttcacactggat

SEQ ID NO: 1580146 - DNA, 19 bp, Homo sapiens
cacctccccgctctccctg

SEQ ID NO: 1580147 - DNA, 16 bp, Homo sapiens
cacctcccttcccacc

SEQ ID NO: 1580148 - DNA, 15 bp, Homo sapiens
cacctcccttccctc

SEQ ID NO: 1580149 - DNA, 17 bp, Homo sapiens
cacctcccttccctccc

SEQ ID NO: 1580150 - DNA, 14 bp, Homo sapiens
cacctcctccactc

SEQ ID NO: 1580151 - DNA, 16 bp, Homo sapiens
cacctggcaaaggacc

SEQ ID NO: 1580152 - DNA, 12 bp, Homo sapiens
cacctggccacc

SEQ ID NO: 1580153 - DNA, 19 bp, Homo sapiens
cacctggccacctgaggtg

SEQ ID NO: 1580154 - DNA, 20 bp, Homo sapiens
cacctggccacctgaggtgg

SEQ ID NO: 1580155 - DNA, 14 bp, Homo sapiens
cacctggccccatg

SEQ ID NO: 1580156 - DNA, 13 bp, Homo sapiens
cacctggccctgc

SEQ ID NO: 1580157 - DNA, 15 bp, Homo sapiens
cacctggccctgctt

SEQ ID NO: 1580158 - DNA, 20 bp, Homo sapiens
cacctggccctgcttcctgc

SEQ ID NO: 1580159 - DNA, 22 bp, Homo sapiens
cacctggccctgcttcctgctt

SEQ ID NO: 1580160 - DNA, 20 bp, Homo sapiens
cacctggccgcctccaggag

SEQ ID NO: 1580161 - DNA, 21 bp, Homo sapiens
cacctggccgcctccaggagc

SEQ ID NO: 1580162 - DNA, 13 bp, Homo sapiens
cacctggcctgct

SEQ ID NO: 1580163 - DNA, 15 bp, Homo sapiens
cacctggcctgctgg

SEQ ID NO: 1580164 - DNA, 17 bp, Homo sapiens
cacctggcctgggccac

SEQ ID NO: 1580165 - DNA, 23 bp, Homo sapiens
cacctggccttaaagagggacag

SEQ ID NO: 1580166 - DNA, 19 bp, Homo sapiens
cacctggctgaggttcctc

SEQ ID NO: 1580167 - DNA, 20 bp, Homo sapiens
cacctggctgaggttcctct

SEQ ID NO: 1580168 - DNA, 21 bp, Homo sapiens
cacctggctgaggttcctctg

SEQ ID NO: 1580169 - DNA, 20 bp, Homo sapiens
cacctgggagaaggtctcca

SEQ ID NO: 1580170 - DNA, 21 bp, Homo sapiens
cacctgggagaaggtctccaa

SEQ ID NO: 1580171 - DNA, 23 bp, Homo sapiens
cacctgggcagggatgatggcag

SEQ ID NO: 1580172 - DNA, 18 bp, Homo sapiens
cacctgggccgggctgta

SEQ ID NO: 1580173 - DNA, 22 bp, Homo sapiens
cacctggtcctccgcctactgt

SEQ ID NO: 1580174 - DNA, 19 bp, Homo sapiens
cacctggtgcgggcctggc

SEQ ID NO: 1580175 - DNA, 18 bp, Homo sapiens
cacctggtttctgttctg

SEQ ID NO: 1580176 - DNA, 16 bp, Homo sapiens
cacctgtaaacctgag

SEQ ID NO: 1580177 - DNA, 16 bp, Homo sapiens
cacctgtactcaggag

SEQ ID NO: 1580178 - DNA, 22 bp, Homo sapiens
cacctgtactcaggaggctgag

SEQ ID NO: 1580179 - DNA, 22 bp, Homo sapiens
cacctgtagcacttactggtag

SEQ ID NO: 1580180 - DNA, 19 bp, Homo sapiens
cacctgtaggcagaggctg

SEQ ID NO: 1580181 - DNA, 18 bp, Homo sapiens
cacctgtagtcccagcta

SEQ ID NO: 1580182 - DNA, 19 bp, Homo sapiens
cacctgtagtcccagctac

SEQ ID NO: 1580183 - DNA, 15 bp, Homo sapiens
cacctgtcgcccagt

SEQ ID NO: 1580184 - DNA, 17 bp, Homo sapiens
cacctgtctcagcctcc

SEQ ID NO: 1580185 - DNA, 18 bp, Homo sapiens
cacctgtcttgaataaga

SEQ ID NO: 1580186 - DNA, 15 bp, Homo sapiens
cacctgtcttggcct

SEQ ID NO: 1580187 - DNA, 13 bp, Homo sapiens
cacctgtgacaaa

SEQ ID NO: 1580188 - DNA, 19 bp, Homo sapiens
cacctgtgagtttaaagca

SEQ ID NO: 1580189 - DNA, 23 bp, Homo sapiens
cacctgtgcagcgaagcttagcg

SEQ ID NO: 1580190 - DNA, 14 bp, Homo sapiens
cacctgtgtgccca

SEQ ID NO: 1580191 - DNA, 16 bp, Homo sapiens
cacctgtgtgcccagc

SEQ ID NO: 1580192 - DNA, 20 bp, Homo sapiens
cacctgttaaaatgtacact

SEQ ID NO: 1580193 - DNA, 14 bp, Homo sapiens
cacctgttttctga

SEQ ID NO: 1580194 - DNA, 16 bp, Homo sapiens
cacctgttttctgaaa

SEQ ID NO: 1580195 - DNA, 20 bp, Homo sapiens
cacctgttttctgaaacaca

SEQ ID NO: 1580196 - DNA, 21 bp, Homo sapiens
cacctgttttctgaaacacac

SEQ ID NO: 1580197 - DNA, 21 bp, Homo sapiens
caccttatctatgatgtttct

SEQ ID NO: 1580198 - DNA, 13 bp, Homo sapiens
caccttccagggc

SEQ ID NO: 1580199 - DNA, 15 bp, Homo sapiens
caccttccagggccc

SEQ ID NO: 1580200 - DNA, 18 bp, Homo sapiens
caccttccagggccctag

SEQ ID NO: 1580201 - DNA, 18 bp, Homo sapiens
caccttccattttccccc

SEQ ID NO: 1580202 - DNA, 15 bp, Homo sapiens
caccttcccacccct

SEQ ID NO: 1580203 - DNA, 16 bp, Homo sapiens
caccttcccacccctt

SEQ ID NO: 1580204 - DNA, 17 bp, Homo sapiens
caccttcccagctctcc

SEQ ID NO: 1580205 - DNA, 22 bp, Homo sapiens
caccttcccagctctccctctg

SEQ ID NO: 1580206 - DNA, 16 bp, Homo sapiens
caccttcgagtagaga

SEQ ID NO: 1580207 - DNA, 12 bp, Homo sapiens
caccttctgagt

SEQ ID NO: 1580208 - DNA, 18 bp, Homo sapiens
caccttctgagtattctc

SEQ ID NO: 1580209 - DNA, 18 bp, Homo sapiens
caccttgacgtttcttct

SEQ ID NO: 1580210 - DNA, 12 bp, Homo sapiens
caccttgctctt

SEQ ID NO: 1580211 - DNA, 22 bp, Homo sapiens
caccttgctcttctttctgaga

SEQ ID NO: 1580212 - DNA, 21 bp, Homo sapiens
caccttggacatcctcctccc

SEQ ID NO: 1580213 - DNA, 14 bp, Homo sapiens
caccttggcctccc

SEQ ID NO: 1580214 - DNA, 16 bp, Homo sapiens
caccttggctgggaag

SEQ ID NO: 1580215 - DNA, 16 bp, Homo sapiens
caccttggcttgttat

SEQ ID NO: 1580216 - DNA, 15 bp, Homo sapiens
caccttgtgcctggg

SEQ ID NO: 1580217 - DNA, 19 bp, Homo sapiens
caccttgttggagcctgca

SEQ ID NO: 1580218 - DNA, 21 bp, Homo sapiens
caccttgttggagcctgcagg

SEQ ID NO: 1580219 - DNA, 14 bp, Homo sapiens
cacctttaggttct

SEQ ID NO: 1580220 - DNA, 15 bp, Homo sapiens
cacctttattaaaat

SEQ ID NO: 1580221 - DNA, 17 bp, Homo sapiens
cacctttattaaaatct

SEQ ID NO: 1580222 - DNA, 18 bp, Homo sapiens
cacctttattaaaatctt

SEQ ID NO: 1580223 - DNA, 14 bp, Homo sapiens
cacctttcccatct

SEQ ID NO: 1580224 - DNA, 15 bp, Homo sapiens
cacctttccctaaag

SEQ ID NO: 1580225 - DNA, 20 bp, Homo sapiens
cacctttccctaaagaccct

SEQ ID NO: 1580226 - DNA, 23 bp, Homo sapiens
cacctttgtggggtttttggaga

SEQ ID NO: 1580227 - DNA, 14 bp, Homo sapiens
caccttttatgaat

SEQ ID NO: 1580228 - DNA, 16 bp, Homo sapiens
caccttttccccagga

SEQ ID NO: 1580229 - DNA, 19 bp, Homo sapiens
caccttttccccaggagca

SEQ ID NO: 1580230 - DNA, 14 bp, Homo sapiens
caccttttttccta

SEQ ID NO: 1580231 - DNA, 13 bp, Homo sapiens
cacgaaatgttat

SEQ ID NO: 1580232 - DNA, 15 bp, Homo sapiens
cacgaaatgttattt

SEQ ID NO: 1580233 - DNA, 18 bp, Homo sapiens
cacgaacccacctgctga

SEQ ID NO: 1580234 - DNA, 15 bp, Homo sapiens
cacgaccgccccagt

SEQ ID NO: 1580235 - DNA, 15 bp, Homo sapiens
cacgacgtcagcctc

SEQ ID NO: 1580236 - DNA, 16 bp, Homo sapiens
cacgagaccccggctt

SEQ ID NO: 1580237 - DNA, 17 bp, Homo sapiens
cacgagcaaacccagag

SEQ ID NO: 1580238 - DNA, 19 bp, Homo sapiens
cacgagcaaacccagaggt

SEQ ID NO: 1580239 - DNA, 20 bp, Homo sapiens
cacgagcaaacccagaggtg

SEQ ID NO: 1580240 - DNA, 12 bp, Homo sapiens
cacgagccacaa

SEQ ID NO: 1580241 - DNA, 14 bp, Homo sapiens
cacgagccacaagc

SEQ ID NO: 1580242 - DNA, 11 bp, Homo sapiens
cacgagggctg

SEQ ID NO: 1580243 - DNA, 22 bp, Homo sapiens
cacgagggctggctggcctcac

SEQ ID NO: 1580244 - DNA, 17 bp, Homo sapiens
cacgagtaagattaaga

SEQ ID NO: 1580245 - DNA, 19 bp, Homo sapiens
cacgagtcacctgcaagcc

SEQ ID NO: 1580246 - DNA, 20 bp, Homo sapiens
cacgagtcacctgcaagccc

SEQ ID NO: 1580247 - DNA, 14 bp, Homo sapiens
cacgagttccagac

SEQ ID NO: 1580248 - DNA, 14 bp, Homo sapiens
cacgatcccctccc

SEQ ID NO: 1580249 - DNA, 15 bp, Homo sapiens
cacgatgtggccctg

SEQ ID NO: 1580250 - DNA, 21 bp, Homo sapiens
cacgatgtggccctggcctgc

SEQ ID NO: 1580251 - DNA, 22 bp, Homo sapiens
cacgatgtggccctggcctgct

SEQ ID NO: 1580252 - DNA, 17 bp, Homo sapiens
cacgcaaatacactcca

SEQ ID NO: 1580253 - DNA, 13 bp, Homo sapiens
cacgcaccactgc

SEQ ID NO: 1580254 - DNA, 16 bp, Homo sapiens
cacgcaccactgcttc

SEQ ID NO: 1580255 - DNA, 19 bp, Homo sapiens
cacgcacgacgtcagcctc

SEQ ID NO: 1580256 - DNA, 21 bp, Homo sapiens
cacgcacgacgtcagcctctt

SEQ ID NO: 1580257 - DNA, 14 bp, Homo sapiens
cacgcacgcacaca

SEQ ID NO: 1580258 - DNA, 16 bp, Homo sapiens
cacgcactgcgcctgt

SEQ ID NO: 1580259 - DNA, 14 bp, Homo sapiens
cacgcactgggcca

SEQ ID NO: 1580260 - DNA, 20 bp, Homo sapiens
cacgcactgggccacggagg

SEQ ID NO: 1580261 - DNA, 14 bp, Homo sapiens
cactctagattcca

SEQ ID NO: 1580262 - DNA, 13 bp, Homo sapiens
cactctagttcta

SEQ ID NO: 1580263 - DNA, 16 bp, Homo sapiens
cactctagttctagat

SEQ ID NO: 1580264 - DNA, 21 bp, Homo sapiens
cactctatatgtagtgcattt

SEQ ID NO: 1580265 - DNA, 13 bp, Homo sapiens
cactctatgagtt

SEQ ID NO: 1580266 - DNA, 18 bp, Homo sapiens
cactctcattccccaggt

SEQ ID NO: 1580267 - DNA, 21 bp, Homo sapiens
cactctccccacactaacctg

SEQ ID NO: 1580268 - DNA, 20 bp, Homo sapiens
cactctcccccaccccctcc

SEQ ID NO: 1580269 - DNA, 15 bp, Homo sapiens
cactctccccgctca

SEQ ID NO: 1580270 - DNA, 18 bp, Homo sapiens
cactctccccgctcaggg

SEQ ID NO: 1580271 - DNA, 12 bp, Homo sapiens
cactctctgctg

SEQ ID NO: 1580272 - DNA, 13 bp, Homo sapiens
cactctctgggac

SEQ ID NO: 1580273 - DNA, 19 bp, Homo sapiens
cactctctgggactctcct

SEQ ID NO: 1580274 - DNA, 20 bp, Homo sapiens
cactctgattcacctcttcc

SEQ ID NO: 1580275 - DNA, 22 bp, Homo sapiens
cactctgattcacctcttcctc

SEQ ID NO: 1580276 - DNA, 13 bp, Homo sapiens
cactctgccccca

SEQ ID NO: 1580277 - DNA, 17 bp, Homo sapiens
cactctgccctctgctg

SEQ ID NO: 1580278 - DNA, 15 bp, Homo sapiens
cactctgcctctgcc

SEQ ID NO: 1580279 - DNA, 14 bp, Homo sapiens
cactctgcctgcct

SEQ ID NO: 1580280 - DNA, 13 bp, Homo sapiens
cactctgcttctc

SEQ ID NO: 1580281 - DNA, 16 bp, Homo sapiens
cactctgcttctctga

SEQ ID NO: 1580282 - DNA, 19 bp, Homo sapiens
cactctgcttctctgactt

SEQ ID NO: 1580283 - DNA, 21 bp, Homo sapiens
cactctgcttctctgacttct

SEQ ID NO: 1580284 - DNA, 18 bp, Homo sapiens
cactctggatgatggatt

SEQ ID NO: 1580285 - DNA, 20 bp, Homo sapiens
cactctgtaatagttcagta

SEQ ID NO: 1580286 - DNA, 24 bp, Homo sapiens
cactctgtaatagttcagtagaat

SEQ ID NO: 1580287 - DNA, 22 bp, Homo sapiens
cactcttagcccatgctgtttt

SEQ ID NO: 1580288 - DNA, 21 bp, Homo sapiens
cactcttccagaatcccaaga

SEQ ID NO: 1580289 - DNA, 16 bp, Homo sapiens
cactcttgatctctct

SEQ ID NO: 1580290 - DNA, 16 bp, Homo sapiens
cactcttgtttgcttt

SEQ ID NO: 1580291 - DNA, 13 bp, Homo sapiens
cactgaaaaaata

SEQ ID NO: 1580292 - DNA, 18 bp, Homo sapiens
cactgaaaggaaaaatgt

SEQ ID NO: 1580293 - DNA, 13 bp, Homo sapiens
cactgaaagtttt

SEQ ID NO: 1580294 - DNA, 18 bp, Homo sapiens
cactgaaagttttgtaaa

SEQ ID NO: 1580295 - DNA, 20 bp, Homo sapiens
cactgaaagttttgtaaaag

SEQ ID NO: 1580296 - DNA, 16 bp, Homo sapiens
cactgaaatgtttgga

SEQ ID NO: 1580297 - DNA, 16 bp, Homo sapiens
cactgaacaaaaccta

SEQ ID NO: 1580298 - DNA, 16 bp, Homo sapiens
cactgaaccactgctt

SEQ ID NO: 1580299 - DNA, 18 bp, Homo sapiens
cactgaaccactgcttct

SEQ ID NO: 1580300 - DNA, 22 bp, Homo sapiens
cactgaaccttaggctttgtat

SEQ ID NO: 1580301 - DNA, 14 bp, Homo sapiens
cactgaactccacc

SEQ ID NO: 1580302 - DNA, 17 bp, Homo sapiens
cactgaactccttcccc

SEQ ID NO: 1580303 - DNA, 19 bp, Homo sapiens
cactgaagccggacagctg

SEQ ID NO: 1580304 - DNA, 22 bp, Homo sapiens
cactgaagttaacagagacaga

SEQ ID NO: 1580305 - DNA, 14 bp, Homo sapiens
cactgaatatttat

SEQ ID NO: 1580306 - DNA, 15 bp, Homo sapiens
cactgaattaatcat

SEQ ID NO: 1580307 - DNA, 12 bp, Homo sapiens
cactgaattcac

SEQ ID NO: 1580308 - DNA, 15 bp, Homo sapiens
cactgaattcactcc

SEQ ID NO: 1580309 - DNA, 18 bp, Homo sapiens
cactgaattcactccagt

SEQ ID NO: 1580310 - DNA, 15 bp, Homo sapiens
cactgaatttataaa

SEQ ID NO: 1580311 - DNA, 19 bp, Homo sapiens
cactgacaaacgtccccag

SEQ ID NO: 1580312 - DNA, 20 bp, Homo sapiens
cactgacaaacgtccccagc

SEQ ID NO: 1580313 - DNA, 23 bp, Homo sapiens
cactgacaaacgtccccagcggt

SEQ ID NO: 1580314 - DNA, 11 bp, Homo sapiens
cactgacagat

SEQ ID NO: 1580315 - DNA, 17 bp, Homo sapiens
cactgacagatttccat

SEQ ID NO: 1580316 - DNA, 13 bp, Homo sapiens
cactgacagcctc

SEQ ID NO: 1580317 - DNA, 14 bp, Homo sapiens
cactgacagcctcc

SEQ ID NO: 1580318 - DNA, 15 bp, Homo sapiens
cactgacagcctccc

SEQ ID NO: 1580319 - DNA, 20 bp, Homo sapiens
cactgacagcctcccacccc

SEQ ID NO: 1580320 - DNA, 15 bp, Homo sapiens
cactgaccagcggct

SEQ ID NO: 1580321 - DNA, 20 bp, Homo sapiens
cactgacccaactgatcctg

SEQ ID NO: 1580322 - DNA, 19 bp, Homo sapiens
cactgaccctaactgcaga

SEQ ID NO: 1580323 - DNA, 19 bp, Homo sapiens
cactgacccttccagacat

SEQ ID NO: 1580324 - DNA, 22 bp, Homo sapiens
cactgaccttggagagacacag

SEQ ID NO: 1580325 - DNA, 15 bp, Homo sapiens
cactgacgtttctgg

SEQ ID NO: 1580326 - DNA, 22 bp, Homo sapiens
cactgactgaatgctgttaata

SEQ ID NO: 1580327 - DNA, 16 bp, Homo sapiens
cactgactgtatggca

SEQ ID NO: 1580328 - DNA, 14 bp, Homo sapiens
cactgacttgctgt

SEQ ID NO: 1580329 - DNA, 15 bp, Homo sapiens
cactgacttgctgtg

SEQ ID NO: 1580330 - DNA, 18 bp, Homo sapiens
cactgacttgctgtgtga

SEQ ID NO: 1580331 - DNA, 16 bp, Homo sapiens
cactgagaatgtaaga

SEQ ID NO: 1580332 - DNA, 19 bp, Homo sapiens
cactgagaatgtaagaact

SEQ ID NO: 1580333 - DNA, 20 bp, Homo sapiens
cactgagaatgtaagaacta

SEQ ID NO: 1580334 - DNA, 22 bp, Homo sapiens
cactgagactttcccctctcgc

SEQ ID NO: 1580335 - DNA, 16 bp, Homo sapiens
cactgagaggcctgga

SEQ ID NO: 1580336 - DNA, 17 bp, Homo sapiens
cactgagaggcctggag

SEQ ID NO: 1580337 - DNA, 13 bp, Homo sapiens
cactgagcctggc

SEQ ID NO: 1580338 - DNA, 15 bp, Homo sapiens
cactgagcctggccc

SEQ ID NO: 1580339 - DNA, 11 bp, Homo sapiens
cactgaggaga

SEQ ID NO: 1580340 - DNA, 20 bp, Homo sapiens
cactgaggagacagaaagcc

SEQ ID NO: 1580341 - DNA, 10 bp, Homo sapiens
cactgagggc

SEQ ID NO: 1580342 - DNA, 21 bp, Homo sapiens
cactgagggtggcactcaact

SEQ ID NO: 1580343 - DNA, 21 bp, Homo sapiens
cactgagtgatactttaagtt

SEQ ID NO: 1580344 - DNA, 21 bp, Homo sapiens
cactgatgagtttcactgtac

SEQ ID NO: 1580345 - DNA, 19 bp, Homo sapiens
cactgatgctgcccctcat

SEQ ID NO: 1580346 - DNA, 22 bp, Homo sapiens
cactgattatagtactgacaga

SEQ ID NO: 1580347 - DNA, 18 bp, Homo sapiens
cactgatttcacaacaga

SEQ ID NO: 1580348 - DNA, 16 bp, Homo sapiens
cactggtttgccaggc

SEQ ID NO: 1580349 - DNA, 16 bp, Homo sapiens
cactgtaaaatgaaat

SEQ ID NO: 1580350 - DNA, 17 bp, Homo sapiens
cactgtaaaatgaaatt

SEQ ID NO: 1580351 - DNA, 18 bp, Homo sapiens
cactgtaaattgctggca

SEQ ID NO: 1580352 - DNA, 14 bp, Homo sapiens
cactgtaacctgat

SEQ ID NO: 1580353 - DNA, 22 bp, Homo sapiens
cactgtaagtttattttttcta

SEQ ID NO: 1580354 - DNA, 22 bp, Homo sapiens
cactgtaatacgtagctctctt

SEQ ID NO: 1580355 - DNA, 21 bp, Homo sapiens
cactgtaatcttaaaagtgta

SEQ ID NO: 1580356 - DNA, 20 bp, Homo sapiens
cactgtacaaggtacccctt

SEQ ID NO: 1580357 - DNA, 13 bp, Homo sapiens
cactgtactgcat

SEQ ID NO: 1580358 - DNA, 14 bp, Homo sapiens
cactgtagttctaa

SEQ ID NO: 1580359 - DNA, 17 bp, Homo sapiens
cactgtagttctaagac

SEQ ID NO: 1580360 - DNA, 21 bp, Homo sapiens
cactgtagtttagttctgttg

SEQ ID NO: 1580361 - DNA, 19 bp, Homo sapiens
cactgtatctaaaaaataa

SEQ ID NO: 1580362 - DNA, 17 bp, Homo sapiens
cacttcttaaaggcctg

SEQ ID NO: 1580363 - DNA, 14 bp, Homo sapiens
cacttgaaaccttt

SEQ ID NO: 1580364 - DNA, 23 bp, Homo sapiens
cacttgaaagattttattgtata

SEQ ID NO: 1580365 - DNA, 17 bp, Homo sapiens
cacttgaagcacttaag

SEQ ID NO: 1580366 - DNA, 15 bp, Homo sapiens
cacttgaatttattg

SEQ ID NO: 1580367 - DNA, 16 bp, Homo sapiens
cacttgaatttattga

SEQ ID NO: 1580368 - DNA, 13 bp, Homo sapiens
cacttgacattcc

SEQ ID NO: 1580369 - DNA, 18 bp, Homo sapiens
cagaatgctgaactcctt

SEQ ID NO: 1580370 - DNA, 16 bp, Homo sapiens
cagaatggaggcaggg

SEQ ID NO: 1580371 - DNA, 23 bp, Homo sapiens
cagaatggaggcaggggacaagg

SEQ ID NO: 1580372 - DNA, 13 bp, Homo sapiens
cagaatgtaagtg

SEQ ID NO: 1580373 - DNA, 18 bp, Homo sapiens
cagaatgtaagtgggccc

SEQ ID NO: 1580374 - DNA, 20 bp, Homo sapiens
cagaatgtaagtgggcccac

SEQ ID NO: 1580375 - DNA, 22 bp, Homo sapiens
cagaatgtaagtgggcccaccc

SEQ ID NO: 1580376 - DNA, 23 bp, Homo sapiens
cagaatgtaagtgggcccacccg

SEQ ID NO: 1580377 - DNA, 15 bp, Homo sapiens
cagaatgtgttcttt

SEQ ID NO: 1580378 - DNA, 19 bp, Homo sapiens
cagaatgttgtacttgaaa

SEQ ID NO: 1580379 - DNA, 14 bp, Homo sapiens
cagaattaaacttt

SEQ ID NO: 1580380 - DNA, 23 bp, Homo sapiens
cagaattaagcagaacactgcag

SEQ ID NO: 1580381 - DNA, 13 bp, Homo sapiens
cagaattattttt

SEQ ID NO: 1580382 - DNA, 21 bp, Homo sapiens
cagaattatttttaaaaagaa

SEQ ID NO: 1580383 - DNA, 14 bp, Homo sapiens
cagaattcccttga

SEQ ID NO: 1580384 - DNA, 23 bp, Homo sapiens
cagaattcccttgaattgtgtat

SEQ ID NO: 1580385 - DNA, 19 bp, Homo sapiens
cagaattcggtgtgctgcc

SEQ ID NO: 1580386 - DNA, 21 bp, Homo sapiens
cagaattcggtgtgctgccaa

SEQ ID NO: 1580387 - DNA, 11 bp, Homo sapiens
cagaattctca

SEQ ID NO: 1580388 - DNA, 16 bp, Homo sapiens
cagaattggtaaaaac

SEQ ID NO: 1580389 - DNA, 20 bp, Homo sapiens
cagaatttattagtttaaaa

SEQ ID NO: 1580390 - DNA, 13 bp, Homo sapiens
cagaatttgaatt

SEQ ID NO: 1580391 - DNA, 15 bp, Homo sapiens
cagaatttgaattat

SEQ ID NO: 1580392 - DNA, 17 bp, Homo sapiens
cagaatttttccctcca

SEQ ID NO: 1580393 - DNA, 21 bp, Homo sapiens
cagaatttttccctccactcc

SEQ ID NO: 1580394 - DNA, 22 bp, Homo sapiens
cagacaaaaacagcctcacaga

SEQ ID NO: 1580395 - DNA, 18 bp, Homo sapiens
cagacaaaatttgagaat

SEQ ID NO: 1580396 - DNA, 15 bp, Homo sapiens
cagacaacagaagtc

SEQ ID NO: 1580397 - DNA, 14 bp, Homo sapiens
cagacaacattatg

SEQ ID NO: 1580398 - DNA, 19 bp, Homo sapiens
cagacaacattatgatcta

SEQ ID NO: 1580399 - DNA, 16 bp, Homo sapiens
cagacaagagctgctg

SEQ ID NO: 1580400 - DNA, 19 bp, Homo sapiens
cagacaagagctgctgtcc

SEQ ID NO: 1580401 - DNA, 23 bp, Homo sapiens
cagacaagcaacaggttttataa

SEQ ID NO: 1580402 - DNA, 20 bp, Homo sapiens
cagacaagcactattttata

SEQ ID NO: 1580403 - DNA, 12 bp, Homo sapiens
cagacaagcagc

SEQ ID NO: 1580404 - DNA, 19 bp, Homo sapiens
cagacaagcagcccttgct

SEQ ID NO: 1580405 - DNA, 11 bp, Homo sapiens
cagacaaggtt

SEQ ID NO: 1580406 - DNA, 20 bp, Homo sapiens
cagacaagtgttttggaaag

SEQ ID NO: 1580407 - DNA, 17 bp, Homo sapiens
cagacaataaaatggaa

SEQ ID NO: 1580408 - DNA, 17 bp, Homo sapiens
cagacaatatgtgagtg

SEQ ID NO: 1580409 - DNA, 13 bp, Homo sapiens
cagacacacacac

SEQ ID NO: 1580410 - DNA, 15 bp, Homo sapiens
cagacacacacacgc

SEQ ID NO: 1580411 - DNA, 22 bp, Homo sapiens
cagacacacacacgcacgcaca

SEQ ID NO: 1580412 - DNA, 14 bp, Homo sapiens
cagacacaggccct

SEQ ID NO: 1580413 - DNA, 15 bp, Homo sapiens
cagacacaggccctc

SEQ ID NO: 1580414 - DNA, 16 bp, Homo sapiens
cagacaccatgtgcaa

SEQ ID NO: 1580415 - DNA, 17 bp, Homo sapiens
cagacaccatgtgcaat

SEQ ID NO: 1580416 - DNA, 12 bp, Homo sapiens
cagacacccagg

SEQ ID NO: 1580417 - DNA, 13 bp, Homo sapiens
cagacacccagga

SEQ ID NO: 1580418 - DNA, 17 bp, Homo sapiens
cagacacccaggactta

SEQ ID NO: 1580419 - DNA, 15 bp, Homo sapiens
cagacaccctcaacc

SEQ ID NO: 1580420 - DNA, 14 bp, Homo sapiens
cagacaccttggac

SEQ ID NO: 1580421 - DNA, 19 bp, Homo sapiens
cagacacgagccacctcac

SEQ ID NO: 1580422 - DNA, 16 bp, Homo sapiens
cagacactaactttgt

SEQ ID NO: 1580423 - DNA, 13 bp, Homo sapiens
cagacactctgct

SEQ ID NO: 1580424 - DNA, 18 bp, Homo sapiens
cagacacttaactcaatt

SEQ ID NO: 1580425 - DNA, 18 bp, Homo sapiens
cagacacttcatggacca

SEQ ID NO: 1580426 - DNA, 14 bp, Homo sapiens
cagacactttggaa

SEQ ID NO: 1580427 - DNA, 21 bp, Homo sapiens
cagacacttttttgagtggat

SEQ ID NO: 1580428 - DNA, 15 bp, Homo sapiens
cagacagaacttgaa

SEQ ID NO: 1580429 - DNA, 20 bp, Homo sapiens
cagacagagccaggagaagc

SEQ ID NO: 1580430 - DNA, 21 bp, Homo sapiens
cagacagatggaaaagggaga

SEQ ID NO: 1580431 - DNA, 19 bp, Homo sapiens
cagacagatgttgggagga

SEQ ID NO: 1580432 - DNA, 21 bp, Homo sapiens
cagacagccctccactccagc

SEQ ID NO: 1580433 - DNA, 12 bp, Homo sapiens
cagacagctccc

SEQ ID NO: 1580434 - DNA, 21 bp, Homo sapiens
cagacaggagaaatgcatcca

SEQ ID NO: 1580435 - DNA, 20 bp, Homo sapiens
cagacaggcggggcccagcg

SEQ ID NO: 1580436 - DNA, 20 bp, Homo sapiens
cagacaggctcttagcagct

SEQ ID NO: 1580437 - DNA, 15 bp, Homo sapiens
cagacagtctgttat

SEQ ID NO: 1580438 - DNA, 13 bp, Homo sapiens
cagacatacagct

SEQ ID NO: 1580439 - DNA, 15 bp, Homo sapiens
cagacatacagctgc

SEQ ID NO: 1580440 - DNA, 17 bp, Homo sapiens
cagacatacagctgcct

SEQ ID NO: 1580441 - DNA, 19 bp, Homo sapiens
cagacatacgaaacacaaa

SEQ ID NO: 1580442 - DNA, 15 bp, Homo sapiens
cagacatctctgcac

SEQ ID NO: 1580443 - DNA, 18 bp, Homo sapiens
cagacatgttttccgtga

SEQ ID NO: 1580444 - DNA, 18 bp, Homo sapiens
cagacattgctctcagtg

SEQ ID NO: 1580445 - DNA, 15 bp, Homo sapiens
cagacattttcactg

SEQ ID NO: 1580446 - DNA, 15 bp, Homo sapiens
cagacattttctttt

SEQ ID NO: 1580447 - DNA, 12 bp, Homo sapiens
cagaccacctgc

SEQ ID NO: 1580448 - DNA, 16 bp, Homo sapiens
cagaccacctgcttct

SEQ ID NO: 1580449 - DNA, 18 bp, Homo sapiens
cagaccacctgcttctga

SEQ ID NO: 1580450 - DNA, 22 bp, Homo sapiens
cagaccacgcccgtcctgcctg

SEQ ID NO: 1580451 - DNA, 24 bp, Homo sapiens
cagaccacgcccgtcctgcctgtg

SEQ ID NO: 1580452 - DNA, 15 bp, Homo sapiens
cagaccactgtctcc

SEQ ID NO: 1580453 - DNA, 14 bp, Homo sapiens
cagaccacttgcca

SEQ ID NO: 1580454 - DNA, 16 bp, Homo sapiens
cagaccacttgccacg

SEQ ID NO: 1580455 - DNA, 20 bp, Homo sapiens
cagaccatattacctggatt

SEQ ID NO: 1580456 - DNA, 15 bp, Homo sapiens
cagacccagcttaga

SEQ ID NO: 1580457 - DNA, 20 bp, Homo sapiens
cagacccagcttagagttct

SEQ ID NO: 1580458 - DNA, 13 bp, Homo sapiens
cagaccccctgag

SEQ ID NO: 1580459 - DNA, 12 bp, Homo sapiens
cagaccccgccc

SEQ ID NO: 1580460 - DNA, 17 bp, Homo sapiens
cagacccctctggccag

SEQ ID NO: 1580461 - DNA, 20 bp, Homo sapiens
cagacccctctggccaggat

SEQ ID NO: 1580462 - DNA, 11 bp, Homo sapiens
cagacccctgc

SEQ ID NO: 1580463 - DNA, 12 bp, Homo sapiens
cagacccctgcc

SEQ ID NO: 1580464 - DNA, 14 bp, Homo sapiens
cagacccctgcctg

SEQ ID NO: 1580465 - DNA, 19 bp, Homo sapiens
cagacccctgcctggactt

SEQ ID NO: 1580466 - DNA, 16 bp, Homo sapiens
cagacccctggctttt

SEQ ID NO: 1580467 - DNA, 12 bp, Homo sapiens
cagacccctggg

SEQ ID NO: 1580468 - DNA, 14 bp, Homo sapiens
cagacccctgggag

SEQ ID NO: 1580469 - DNA, 16 bp, Homo sapiens
cagacccctgggagct

SEQ ID NO: 1580470 - DNA, 19 bp, Homo sapiens
cagacccctgggagcttcc

SEQ ID NO: 1580471 - DNA, 16 bp, Homo sapiens
cagaccctaccccacc

SEQ ID NO: 1580472 - DNA, 18 bp, Homo sapiens
cagaccctaccccaccac

SEQ ID NO: 1580473 - DNA, 12 bp, Homo sapiens
cagaccctgaag

SEQ ID NO: 1580474 - DNA, 13 bp, Homo sapiens
cagaccctgcctg

SEQ ID NO: 1580475 - DNA, 16 bp, Homo sapiens
cagaccctgcctgagc

SEQ ID NO: 1580476 - DNA, 17 bp, Homo sapiens
cagaccctgcctgagcc

SEQ ID NO: 1580477 - DNA, 18 bp, Homo sapiens
cagaccctgcctgagccc

SEQ ID NO: 1580478 - DNA, 14 bp, Homo sapiens
cagaccctggaggc

SEQ ID NO: 1580479 - DNA, 14 bp, Homo sapiens
cagacctaagccct

SEQ ID NO: 1580480 - DNA, 22 bp, Homo sapiens
cagacctaagccctgccccggg

SEQ ID NO: 1580481 - DNA, 15 bp, Homo sapiens
cagacctcatgccca

SEQ ID NO: 1580482 - DNA, 17 bp, Homo sapiens
cagacctcatgcccagc

SEQ ID NO: 1580483 - DNA, 18 bp, Homo sapiens
cagacctcttagagtcct

SEQ ID NO: 1580484 - DNA, 17 bp, Homo sapiens
cagacctgaatgcttct

SEQ ID NO: 1580485 - DNA, 12 bp, Homo sapiens
cagacctgacac

SEQ ID NO: 1580486 - DNA, 13 bp, Homo sapiens
cagacctgatcct

SEQ ID NO: 1580487 - DNA, 21 bp, Homo sapiens
cagagttaggttgtctccagg

SEQ ID NO: 1580488 - DNA, 17 bp, Homo sapiens
cagagttcctgcggagt

SEQ ID NO: 1580489 - DNA, 22 bp, Homo sapiens
cagagttcctgcggagtgaaga

SEQ ID NO: 1580490 - DNA, 20 bp, Homo sapiens
cagagttgacatgagattta

SEQ ID NO: 1580491 - DNA, 17 bp, Homo sapiens
cagagtttacattctaa

SEQ ID NO: 1580492 - DNA, 23 bp, Homo sapiens
cagagtttacattctaatttgca

SEQ ID NO: 1580493 - DNA, 13 bp, Homo sapiens
cagagtttgtgtg

SEQ ID NO: 1580494 - DNA, 14 bp, Homo sapiens
cagagtttgtgtgt

SEQ ID NO: 1580495 - DNA, 18 bp, Homo sapiens
cagagtttgtgtgtattt

SEQ ID NO: 1580496 - DNA, 21 bp, Homo sapiens
cagagtttgtgtgtatttgta

SEQ ID NO: 1580497 - DNA, 19 bp, Homo sapiens
cagagtttgtgtgttgtct

SEQ ID NO: 1580498 - DNA, 22 bp, Homo sapiens
cagagttttggtttttgaacta

SEQ ID NO: 1580499 - DNA, 17 bp, Homo sapiens
cagagtttttaaagcct

SEQ ID NO: 1580500 - DNA, 19 bp, Homo sapiens
cagagtttttaaagccttc

SEQ ID NO: 1580501 - DNA, 19 bp, Homo sapiens
cagataaactgatgtttga

SEQ ID NO: 1580502 - DNA, 12 bp, Homo sapiens
cagataaagatt

SEQ ID NO: 1580503 - DNA, 16 bp, Homo sapiens
cagataaagattgtgt

SEQ ID NO: 1580504 - DNA, 21 bp, Homo sapiens
cagataactaaggtgaagaat

SEQ ID NO: 1580505 - DNA, 19 bp, Homo sapiens
cagataactctctttcctt

SEQ ID NO: 1580506 - DNA, 19 bp, Homo sapiens
cagataagaatgctggttt

SEQ ID NO: 1580507 - DNA, 20 bp, Homo sapiens
cagataagcaagagagatgt

SEQ ID NO: 1580508 - DNA, 16 bp, Homo sapiens
cagataagtatgggat

SEQ ID NO: 1580509 - DNA, 18 bp, Homo sapiens
cagataagttggagcagg

SEQ ID NO: 1580510 - DNA, 14 bp, Homo sapiens
cagatacacacaca

SEQ ID NO: 1580511 - DNA, 18 bp, Homo sapiens
cagataccttatcttaca

SEQ ID NO: 1580512 - DNA, 18 bp, Homo sapiens
cagataccttgaaaggaa

SEQ ID NO: 1580513 - DNA, 13 bp, Homo sapiens
cagatactgtgag

SEQ ID NO: 1580514 - DNA, 23 bp, Homo sapiens
cagatataaatggctggttttta

SEQ ID NO: 1580515 - DNA, 17 bp, Homo sapiens
cagatataactgtcttg

SEQ ID NO: 1580516 - DNA, 19 bp, Homo sapiens
cagatatatttttcacagt

SEQ ID NO: 1580517 - DNA, 13 bp, Homo sapiens
cagatatcaaaat

SEQ ID NO: 1580518 - DNA, 15 bp, Homo sapiens
cagatatcaaaattc

SEQ ID NO: 1580519 - DNA, 23 bp, Homo sapiens
cagatatcaaaattctagctgta

SEQ ID NO: 1580520 - DNA, 15 bp, Homo sapiens
cagatatcagtgtct

SEQ ID NO: 1580521 - DNA, 20 bp, Homo sapiens
cagatatcttggacaaatca

SEQ ID NO: 1580522 - DNA, 12 bp, Homo sapiens
cagatatttcca

SEQ ID NO: 1580523 - DNA, 17 bp, Homo sapiens
cagatatttccatttct

SEQ ID NO: 1580524 - DNA, 18 bp, Homo sapiens
cagatatttccatttctt

SEQ ID NO: 1580525 - DNA, 12 bp, Homo sapiens
cagatatttctt

SEQ ID NO: 1580526 - DNA, 17 bp, Homo sapiens
cagatcaaagtatgtat

SEQ ID NO: 1580527 - DNA, 19 bp, Homo sapiens
cagatcaagggcctatctt

SEQ ID NO: 1580528 - DNA, 19 bp, Homo sapiens
cagatcactgaatttataa

SEQ ID NO: 1580529 - DNA, 14 bp, Homo sapiens
cagatcactgccac

SEQ ID NO: 1580530 - DNA, 16 bp, Homo sapiens
cagatcactgccacac

SEQ ID NO: 1580531 - DNA, 19 bp, Homo sapiens
cagatcatgggtcaagaga

SEQ ID NO: 1580532 - DNA, 14 bp, Homo sapiens
cagatccaggcagg

SEQ ID NO: 1580533 - DNA, 13 bp, Homo sapiens
cagatccagggac

SEQ ID NO: 1580534 - DNA, 15 bp, Homo sapiens
cagatccagggacag

SEQ ID NO: 1580535 - DNA, 12 bp, Homo sapiens
cagatcccagct

SEQ ID NO: 1580536 - DNA, 14 bp, Homo sapiens
cagatcccagctca

SEQ ID NO: 1580537 - DNA, 23 bp, Homo sapiens
cagatcctgggtactgaaagcct

SEQ ID NO: 1580538 - DNA, 21 bp, Homo sapiens
cagatcctgttacttgcttca

SEQ ID NO: 1580539 - DNA, 14 bp, Homo sapiens
cagatccttgtttc

SEQ ID NO: 1580540 - DNA, 15 bp, Homo sapiens
cagatccttgtttca

SEQ ID NO: 1580541 - DNA, 18 bp, Homo sapiens
cagatccttgtttcaaac

SEQ ID NO: 1580542 - DNA, 19 bp, Homo sapiens
cagatctatatggcaaata

SEQ ID NO: 1580543 - DNA, 20 bp, Homo sapiens
cagatctatatggcaaatag

SEQ ID NO: 1580544 - DNA, 19 bp, Homo sapiens
cagatctgcctgggcctgt

SEQ ID NO: 1580545 - DNA, 22 bp, Homo sapiens
cagatctgcctgggcctgtgca

SEQ ID NO: 1580546 - DNA, 23 bp, Homo sapiens
cagatctgcctgggcctgtgcag

SEQ ID NO: 1580547 - DNA, 20 bp, Homo sapiens
cagatctggaacctcagcct

SEQ ID NO: 1580548 - DNA, 15 bp, Homo sapiens
cagatctgtgcccca

SEQ ID NO: 1580549 - DNA, 12 bp, Homo sapiens
cagcccagccag

SEQ ID NO: 1580550 - DNA, 13 bp, Homo sapiens
cagcccagcccag

SEQ ID NO: 1580551 - DNA, 23 bp, Homo sapiens
cagcccagccccgccccgttgtg

SEQ ID NO: 1580552 - DNA, 20 bp, Homo sapiens
cagcccagcccgcccactgg

SEQ ID NO: 1580553 - DNA, 11 bp, Homo sapiens
cagcccagctg

SEQ ID NO: 1580554 - DNA, 12 bp, Homo sapiens
cagcccagctgg

SEQ ID NO: 1580555 - DNA, 15 bp, Homo sapiens
cagcccagcttcctg

SEQ ID NO: 1580556 - DNA, 16 bp, Homo sapiens
cagcccagcttcctgg

SEQ ID NO: 1580557 - DNA, 23 bp, Homo sapiens
cagcccagcttggccctttcctt

SEQ ID NO: 1580558 - DNA, 17 bp, Homo sapiens
cagcccagggctcctgc

SEQ ID NO: 1580559 - DNA, 18 bp, Homo sapiens
cagcccagggctcctgca

SEQ ID NO: 1580560 - DNA, 21 bp, Homo sapiens
cagcccagggctcctgcactt

SEQ ID NO: 1580561 - DNA, 22 bp, Homo sapiens
cagcccatccattaggccagca

SEQ ID NO: 1580562 - DNA, 24 bp, Homo sapiens
cagcccatgcccacctgcccatca

SEQ ID NO: 1580563 - DNA, 16 bp, Homo sapiens
cagcccatggccccca

SEQ ID NO: 1580564 - DNA, 21 bp, Homo sapiens
cagcccatggcccccaataaa

SEQ ID NO: 1580565 - DNA, 18 bp, Homo sapiens
cagcccattctctctcct

SEQ ID NO: 1580566 - DNA, 15 bp, Homo sapiens
cagcccattgctgcc

SEQ ID NO: 1580567 - DNA, 17 bp, Homo sapiens
cagcccatttgggctct

SEQ ID NO: 1580568 - DNA, 13 bp, Homo sapiens
cagccccaagctg

SEQ ID NO: 1580569 - DNA, 17 bp, Homo sapiens
cagccccaagctgggcc

SEQ ID NO: 1580570 - DNA, 11 bp, Homo sapiens
cagccccaccc

SEQ ID NO: 1580571 - DNA, 13 bp, Homo sapiens
cagccccacccag

SEQ ID NO: 1580572 - DNA, 16 bp, Homo sapiens
cagccccacccaggag

SEQ ID NO: 1580573 - DNA, 23 bp, Homo sapiens
cagccccacccctaagtgcccaa

SEQ ID NO: 1580574 - DNA, 18 bp, Homo sapiens
cagccccactgacaccca

SEQ ID NO: 1580575 - DNA, 19 bp, Homo sapiens
cagccccactgccagcagc

SEQ ID NO: 1580576 - DNA, 12 bp, Homo sapiens
cagccccagcaa

SEQ ID NO: 1580577 - DNA, 14 bp, Homo sapiens
cagcccccaccagg

SEQ ID NO: 1580578 - DNA, 22 bp, Homo sapiens
cagccccccttgccccacctcc

SEQ ID NO: 1580579 - DNA, 19 bp, Homo sapiens
cagccccctaaaagcactc

SEQ ID NO: 1580580 - DNA, 21 bp, Homo sapiens
cagccccctatagtcatgggg

SEQ ID NO: 1580581 - DNA, 17 bp, Homo sapiens
cagccccctccagctca

SEQ ID NO: 1580582 - DNA, 22 bp, Homo sapiens
cagccccctggatgggcattgg

SEQ ID NO: 1580583 - DNA, 17 bp, Homo sapiens
cagcccccttgccctcc

SEQ ID NO: 1580584 - DNA, 17 bp, Homo sapiens
cagccccgacttcctga

SEQ ID NO: 1580585 - DNA, 16 bp, Homo sapiens
cagccccgcgcctcct

SEQ ID NO: 1580586 - DNA, 18 bp, Homo sapiens
cagccccgcgcctccttc

SEQ ID NO: 1580587 - DNA, 17 bp, Homo sapiens
cagcccctactgctgtg

SEQ ID NO: 1580588 - DNA, 15 bp, Homo sapiens
cagcccctcctctgc

SEQ ID NO: 1580589 - DNA, 20 bp, Homo sapiens
cagcccctcctctgccacct

SEQ ID NO: 1580590 - DNA, 23 bp, Homo sapiens
cagcccctcctctgccacctccc

SEQ ID NO: 1580591 - DNA, 22 bp, Homo sapiens
cagcccctctggtcgctcctgc

SEQ ID NO: 1580592 - DNA, 24 bp, Homo sapiens
cagcccctcttggagaagtctcag

SEQ ID NO: 1580593 - DNA, 11 bp, Homo sapiens
cagcccctgcc

SEQ ID NO: 1580594 - DNA, 13 bp, Homo sapiens
cagccccttctgg

SEQ ID NO: 1580595 - DNA, 15 bp, Homo sapiens
cagccccttctggcc

SEQ ID NO: 1580596 - DNA, 22 bp, Homo sapiens
cagccccttctggccggtgctg

SEQ ID NO: 1580597 - DNA, 17 bp, Homo sapiens
cagccccttgagaaacc

SEQ ID NO: 1580598 - DNA, 16 bp, Homo sapiens
cagcccgacagtgcca

SEQ ID NO: 1580599 - DNA, 18 bp, Homo sapiens
cagcccgacagtgccatc

SEQ ID NO: 1580600 - DNA, 20 bp, Homo sapiens
cagcccgacagtgccatccc

SEQ ID NO: 1580601 - DNA, 13 bp, Homo sapiens
cagcccgcctgcc

SEQ ID NO: 1580602 - DNA, 22 bp, Homo sapiens
cagcccgcctgccgtgcatggc

SEQ ID NO: 1580603 - DNA, 23 bp, Homo sapiens
cagcccgcctgccgtgcatggct

SEQ ID NO: 1580604 - DNA, 12 bp, Homo sapiens
cagcccgcttgg

SEQ ID NO: 1580605 - DNA, 16 bp, Homo sapiens
cagcccggacctctgg

SEQ ID NO: 1580606 - DNA, 17 bp, Homo sapiens
cagcccggacctctgga

SEQ ID NO: 1580607 - DNA, 15 bp, Homo sapiens
cagcccggcgccacc

SEQ ID NO: 1580608 - DNA, 21 bp, Homo sapiens
cagcccggcgccaccatcctg

SEQ ID NO: 1580609 - DNA, 18 bp, Homo sapiens
cagcccgtgaagcagtgc

SEQ ID NO: 1580610 - DNA, 20 bp, Homo sapiens
cagcccgtgaagcagtgcct

SEQ ID NO: 1580611 - DNA, 22 bp, Homo sapiens
cagcccgtgaagcagtgcctcg

SEQ ID NO: 1580612 - DNA, 17 bp, Homo sapiens
cagccctaaggatctct

SEQ ID NO: 1580613 - DNA, 19 bp, Homo sapiens
cagccctaaggatctctca

SEQ ID NO: 1580614 - DNA, 20 bp, Homo sapiens
cagccctaaggatctctcag

SEQ ID NO: 1580615 - DNA, 21 bp, Homo sapiens
cagccctaaggatctctcagg

SEQ ID NO: 1580616 - DNA, 23 bp, Homo sapiens
cagccctaagtggctgccttctt

SEQ ID NO: 1580617 - DNA, 19 bp, Homo sapiens
cagccctagctgtcccatg

SEQ ID NO: 1580618 - DNA, 13 bp, Homo sapiens
cagccctcacccc

SEQ ID NO: 1580619 - DNA, 15 bp, Homo sapiens
cagccctcacccctg

SEQ ID NO: 1580620 - DNA, 20 bp, Homo sapiens
cagccctcacctctgaggac

SEQ ID NO: 1580621 - DNA, 16 bp, Homo sapiens
cagccctcagaagaaa

SEQ ID NO: 1580622 - DNA, 17 bp, Homo sapiens
cagccctccacttctgg

SEQ ID NO: 1580623 - DNA, 20 bp, Homo sapiens
cagccctccccatggagcca

SEQ ID NO: 1580624 - DNA, 21 bp, Homo sapiens
cagccctccccatggagccag

SEQ ID NO: 1580625 - DNA, 13 bp, Homo sapiens
cagccctccctgc

SEQ ID NO: 1580626 - DNA, 15 bp, Homo sapiens
cagccctccctgccc

SEQ ID NO: 1580627 - DNA, 18 bp, Homo sapiens
cagccctccctgcccctc

SEQ ID NO: 1580628 - DNA, 23 bp, Homo sapiens
cagccctccctggctgtgagcag

SEQ ID NO: 1580629 - DNA, 14 bp, Homo sapiens
cagccctccctgtc

SEQ ID NO: 1580630 - DNA, 18 bp, Homo sapiens
cagccctccctgtcctcc

SEQ ID NO: 1580631 - DNA, 22 bp, Homo sapiens
cagccctccctgtcctcctcgg

SEQ ID NO: 1580632 - DNA, 14 bp, Homo sapiens
cagccctcctcacc

SEQ ID NO: 1580633 - DNA, 17 bp, Homo sapiens
cagccctcctctgcact

SEQ ID NO: 1580634 - DNA, 15 bp, Homo sapiens
cagccctcggcctcc

SEQ ID NO: 1580635 - DNA, 18 bp, Homo sapiens
cagccctcttgcccgcac

SEQ ID NO: 1580636 - DNA, 19 bp, Homo sapiens
cagccctcttgcccgcacc

SEQ ID NO: 1580637 - DNA, 12 bp, Homo sapiens
cagccctgaggt

SEQ ID NO: 1580638 - DNA, 17 bp, Homo sapiens
cagccctgattgtgcca

SEQ ID NO: 1580639 - DNA, 12 bp, Homo sapiens
cagccctgccag

SEQ ID NO: 1580640 - DNA, 13 bp, Homo sapiens
cagccctgctggg

SEQ ID NO: 1580641 - DNA, 19 bp, Homo sapiens
cagccctgctttgggctgc

SEQ ID NO: 1580642 - DNA, 13 bp, Homo sapiens
cagccctggccct

SEQ ID NO: 1580643 - DNA, 15 bp, Homo sapiens
cagccctggccctgc

SEQ ID NO: 1580644 - DNA, 12 bp, Homo sapiens
cagccctgggag

SEQ ID NO: 1580645 - DNA, 12 bp, Homo sapiens
cagcccttgccc

SEQ ID NO: 1580646 - DNA, 15 bp, Homo sapiens
cagcccttgccccca

SEQ ID NO: 1580647 - DNA, 13 bp, Homo sapiens
cagcccttgcttg

SEQ ID NO: 1580648 - DNA, 15 bp, Homo sapiens
cagcccttgcttgtt

SEQ ID NO: 1580649 - DNA, 20 bp, Homo sapiens
cagccctttgggaggctgag

SEQ ID NO: 1580650 - DNA, 17 bp, Homo sapiens
cagccgagccgggcctg

SEQ ID NO: 1580651 - DNA, 18 bp, Homo sapiens
cagccgagccgggcctgg

SEQ ID NO: 1580652 - DNA, 13 bp, Homo sapiens
cagccgccagctg

SEQ ID NO: 1580653 - DNA, 23 bp, Homo sapiens
cagccgccattgccaccaggaga

SEQ ID NO: 1580654 - DNA, 19 bp, Homo sapiens
cagccgcctgaaagccaca

SEQ ID NO: 1580655 - DNA, 15 bp, Homo sapiens
cagccgctaggagag

SEQ ID NO: 1580656 - DNA, 16 bp, Homo sapiens
cagccgctaggagaga

SEQ ID NO: 1580657 - DNA, 16 bp, Homo sapiens
cagccgctcctgtctg

SEQ ID NO: 1580658 - DNA, 18 bp, Homo sapiens
cagccgctcctgtctgcc

SEQ ID NO: 1580659 - DNA, 21 bp, Homo sapiens
cagccgctcctgtctgccagc

SEQ ID NO: 1580660 - DNA, 22 bp, Homo sapiens
cagccgctcctgtctgccagcc

SEQ ID NO: 1580661 - DNA, 14 bp, Homo sapiens
cagccgcttctgac

SEQ ID NO: 1580662 - DNA, 23 bp, Homo sapiens
cagccggcacagggtctgctctt

SEQ ID NO: 1580663 - DNA, 13 bp, Homo sapiens
cagccgggcacag

SEQ ID NO: 1580664 - DNA, 16 bp, Homo sapiens
cagccgggcacagtgg

SEQ ID NO: 1580665 - DNA, 17 bp, Homo sapiens
cagccgtagggtggcac

SEQ ID NO: 1580666 - DNA, 22 bp, Homo sapiens
cagccgtagggtggcactggga

SEQ ID NO: 1580667 - DNA, 19 bp, Homo sapiens
cagccgtcagccaaatgta

SEQ ID NO: 1580668 - DNA, 15 bp, Homo sapiens
cagccgtccatagca

SEQ ID NO: 1580669 - DNA, 14 bp, Homo sapiens
cagccgtcccaggc

SEQ ID NO: 1580670 - DNA, 15 bp, Homo sapiens
cagccgtcccaggcc

SEQ ID NO: 1580671 - DNA, 18 bp, Homo sapiens
cagccgtcccaggccacc

SEQ ID NO: 1580672 - DNA, 16 bp, Homo sapiens
cagccgtgccttcagc

SEQ ID NO: 1580673 - DNA, 18 bp, Homo sapiens
cagccgtgccttcagctc

SEQ ID NO: 1580674 - DNA, 17 bp, Homo sapiens
cagcctaagaagctctg

SEQ ID NO: 1580675 - DNA, 12 bp, Homo sapiens
cagcctacagtt

SEQ ID NO: 1580676 - DNA, 15 bp, Homo sapiens
cagcctactctcctt

SEQ ID NO: 1580677 - DNA, 15 bp, Homo sapiens
cagcctagccgacct

SEQ ID NO: 1580678 - DNA, 14 bp, Homo sapiens
cagcctagggcaga

SEQ ID NO: 1580679 - DNA, 13 bp, Homo sapiens
cagcctcacagaa

SEQ ID NO: 1580680 - DNA, 21 bp, Homo sapiens
cagcctcagaaggccccagag

SEQ ID NO: 1580681 - DNA, 14 bp, Homo sapiens
cagcctcagagtgg

SEQ ID NO: 1580682 - DNA, 15 bp, Homo sapiens
cagcctcagagtggt

SEQ ID NO: 1580683 - DNA, 16 bp, Homo sapiens
cagcctcatcctgaga

SEQ ID NO: 1580684 - DNA, 18 bp, Homo sapiens
cagcctcatcctgagaga

SEQ ID NO: 1580685 - DNA, 18 bp, Homo sapiens
cagcctcattcagcatgg

SEQ ID NO: 1580686 - DNA, 14 bp, Homo sapiens
cagcctccaatgca

SEQ ID NO: 1580687 - DNA, 20 bp, Homo sapiens
cagcctccaatgcattggcc

SEQ ID NO: 1580688 - DNA, 18 bp, Homo sapiens
cagcctccaccttgctct

SEQ ID NO: 1580689 - DNA, 19 bp, Homo sapiens
cagcctccactgtgtccag

SEQ ID NO: 1580690 - DNA, 17 bp, Homo sapiens
cagcctccagagccagc

SEQ ID NO: 1580691 - DNA, 21 bp, Homo sapiens
cagcctccagagccagcctgg

SEQ ID NO: 1580692 - DNA, 22 bp, Homo sapiens
cagcctccagagccagcctggg

SEQ ID NO: 1580693 - DNA, 23 bp, Homo sapiens
cagcctccagggcattgctcagc

SEQ ID NO: 1580694 - DNA, 14 bp, Homo sapiens
cagcctcccaaagt

SEQ ID NO: 1580695 - DNA, 15 bp, Homo sapiens
cagcctcccaaagtg

SEQ ID NO: 1580696 - DNA, 22 bp, Homo sapiens
cagcctcccaaagtgctgagat

SEQ ID NO: 1580697 - DNA, 20 bp, Homo sapiens
cagcctcccaaccccagggc

SEQ ID NO: 1580698 - DNA, 12 bp, Homo sapiens
cagcctcccccg

SEQ ID NO: 1580699 - DNA, 16 bp, Homo sapiens
cagcctccctgaagcc

SEQ ID NO: 1580700 - DNA, 12 bp, Homo sapiens
cagcctccctgt

SEQ ID NO: 1580701 - DNA, 14 bp, Homo sapiens
cagcctccctgtca

SEQ ID NO: 1580702 - DNA, 14 bp, Homo sapiens
cagcctccctgtct

SEQ ID NO: 1580703 - DNA, 17 bp, Homo sapiens
cagcctccctgtctcca

SEQ ID NO: 1580704 - DNA, 21 bp, Homo sapiens
cagcctccctgtctccagctg

SEQ ID NO: 1580705 - DNA, 21 bp, Homo sapiens
cagcctcccttccatgcccca

SEQ ID NO: 1580706 - DNA, 22 bp, Homo sapiens
cagcctcccttccatgccccag

SEQ ID NO: 1580707 - DNA, 19 bp, Homo sapiens
cagcctccgagagggagag

SEQ ID NO: 1580708 - DNA, 20 bp, Homo sapiens
cagcctccgagagggagaga

SEQ ID NO: 1580709 - DNA, 18 bp, Homo sapiens
cagcctccgcctcccggg

SEQ ID NO: 1580710 - DNA, 15 bp, Homo sapiens
cagcctcctcctgac

SEQ ID NO: 1580711 - DNA, 23 bp, Homo sapiens
cagcctcctctggacggcaggct

SEQ ID NO: 1580712 - DNA, 13 bp, Homo sapiens
cagcctcctgagt

SEQ ID NO: 1580713 - DNA, 19 bp, Homo sapiens
cagcctcctgtttgcaggc

SEQ ID NO: 1580714 - DNA, 14 bp, Homo sapiens
cagcctcctttgtg

SEQ ID NO: 1580715 - DNA, 20 bp, Homo sapiens
cagcctcctttgtgtgtatt

SEQ ID NO: 1580716 - DNA, 17 bp, Homo sapiens
cagcctcgcacaggccc

SEQ ID NO: 1580717 - DNA, 22 bp, Homo sapiens
cagcctcgcacaggccctagct

SEQ ID NO: 1580718 - DNA, 21 bp, Homo sapiens
cagcctcgttggagagcagca

SEQ ID NO: 1580719 - DNA, 19 bp, Homo sapiens
cagcctctacagccgtccc

SEQ ID NO: 1580720 - DNA, 14 bp, Homo sapiens
cagcctctccccag

SEQ ID NO: 1580721 - DNA, 12 bp, Homo sapiens
cagcctctcccg

SEQ ID NO: 1580722 - DNA, 13 bp, Homo sapiens
cagcctctcccgg

SEQ ID NO: 1580723 - DNA, 14 bp, Homo sapiens
cagcctctcccggc

SEQ ID NO: 1580724 - DNA, 15 bp, Homo sapiens
cagcctctcccggct

SEQ ID NO: 1580725 - DNA, 22 bp, Homo sapiens
cagcctctcccggctgcctgcc

SEQ ID NO: 1580726 - DNA, 12 bp, Homo sapiens
cagcctctctgc

SEQ ID NO: 1580727 - DNA, 23 bp, Homo sapiens
cagcctctcttggtttccttcct

SEQ ID NO: 1580728 - DNA, 15 bp, Homo sapiens
cagcctctgccaggc

SEQ ID NO: 1580729 - DNA, 13 bp, Homo sapiens
cagcctctggcat

SEQ ID NO: 1580730 - DNA, 17 bp, Homo sapiens
cagcctgaacagaagct

SEQ ID NO: 1580731 - DNA, 14 bp, Homo sapiens
cagcctgaagcctg

SEQ ID NO: 1580732 - DNA, 21 bp, Homo sapiens
cagcctgaagcctggattcca

SEQ ID NO: 1580733 - DNA, 12 bp, Homo sapiens
cagcctgaggct

SEQ ID NO: 1580734 - DNA, 10 bp, Homo sapiens
cagcctgagt

SEQ ID NO: 1580735 - DNA, 21 bp, Homo sapiens
cagcctgatcaggcttcctgg

SEQ ID NO: 1580736 - DNA, 11 bp, Homo sapiens
cagcctgcaca

SEQ ID NO: 1580737 - DNA, 13 bp, Homo sapiens
cagcctgcacaca

SEQ ID NO: 1580738 - DNA, 18 bp, Homo sapiens
cagcctgcacacacctgc

SEQ ID NO: 1580739 - DNA, 14 bp, Homo sapiens
cagcctgcacagtg

SEQ ID NO: 1580740 - DNA, 18 bp, Homo sapiens
cagctaagaacctggaac

SEQ ID NO: 1580741 - DNA, 19 bp, Homo sapiens
cagctaagaacctggaact

SEQ ID NO: 1580742 - DNA, 19 bp, Homo sapiens
cagctaagatagaaagctg

SEQ ID NO: 1580743 - DNA, 20 bp, Homo sapiens
cagctaagatagaaagctgg

SEQ ID NO: 1580744 - DNA, 18 bp, Homo sapiens
cagctaagctaggaatga

SEQ ID NO: 1580745 - DNA, 14 bp, Homo sapiens
cagctaataaacca

SEQ ID NO: 1580746 - DNA, 15 bp, Homo sapiens
cagctaataaaccag

SEQ ID NO: 1580747 - DNA, 12 bp, Homo sapiens
cagctaatctgt

SEQ ID NO: 1580748 - DNA, 16 bp, Homo sapiens
cagctaatctgtaggg

SEQ ID NO: 1580749 - DNA, 14 bp, Homo sapiens
cagctaattctact

SEQ ID NO: 1580750 - DNA, 16 bp, Homo sapiens
cagctaattgagacca

SEQ ID NO: 1580751 - DNA, 16 bp, Homo sapiens
cagctaatttttgtat

SEQ ID NO: 1580752 - DNA, 18 bp, Homo sapiens
cagctacaaccctaccct

SEQ ID NO: 1580753 - DNA, 16 bp, Homo sapiens
cagctacacagagctt

SEQ ID NO: 1580754 - DNA, 14 bp, Homo sapiens
cagctacattcctc

SEQ ID NO: 1580755 - DNA, 15 bp, Homo sapiens
cagctacattcctca

SEQ ID NO: 1580756 - DNA, 22 bp, Homo sapiens
cagctacattcctcagctgcca

SEQ ID NO: 1580757 - DNA, 24 bp, Homo sapiens
cagctacccaggaggctgaggtgg

SEQ ID NO: 1580758 - DNA, 19 bp, Homo sapiens
cagctactcaagaggctga

SEQ ID NO: 1580759 - DNA, 16 bp, Homo sapiens
cagctactcaggaggc

SEQ ID NO: 1580760 - DNA, 19 bp, Homo sapiens
cagctactcagtggggctg

SEQ ID NO: 1580761 - DNA, 24 bp, Homo sapiens
cagctactcagtggggctggcatc

SEQ ID NO: 1580762 - DNA, 19 bp, Homo sapiens
cagctactcgggaggctga

SEQ ID NO: 1580763 - DNA, 20 bp, Homo sapiens
cagctactcgggaggctgag

SEQ ID NO: 1580764 - DNA, 15 bp, Homo sapiens
cagctactctcccca

SEQ ID NO: 1580765 - DNA, 15 bp, Homo sapiens
cagctactctgtcca

SEQ ID NO: 1580766 - DNA, 13 bp, Homo sapiens
cagctactggaat

SEQ ID NO: 1580767 - DNA, 15 bp, Homo sapiens
cagctactggaatgg

SEQ ID NO: 1580768 - DNA, 23 bp, Homo sapiens
cagctactggggaggctgaggca

SEQ ID NO: 1580769 - DNA, 17 bp, Homo sapiens
cagctacttcctcctcc

SEQ ID NO: 1580770 - DNA, 18 bp, Homo sapiens
cagctacttctgggaaaa

SEQ ID NO: 1580771 - DNA, 14 bp, Homo sapiens
cagctagactggag

SEQ ID NO: 1580772 - DNA, 14 bp, Homo sapiens
cagctaggactgag

SEQ ID NO: 1580773 - DNA, 16 bp, Homo sapiens
cagctaggactgagga

SEQ ID NO: 1580774 - DNA, 17 bp, Homo sapiens
cagctaggactgaggag

SEQ ID NO: 1580775 - DNA, 20 bp, Homo sapiens
cagctaggactgaggagtgg

SEQ ID NO: 1580776 - DNA, 12 bp, Homo sapiens
cagctagtgcct

SEQ ID NO: 1580777 - DNA, 13 bp, Homo sapiens
cagctatacagga

SEQ ID NO: 1580778 - DNA, 14 bp, Homo sapiens
cagctatatttgat

SEQ ID NO: 1580779 - DNA, 22 bp, Homo sapiens
cagctatgggagccccagggtc

SEQ ID NO: 1580780 - DNA, 18 bp, Homo sapiens
cagctattaagaaaatca

SEQ ID NO: 1580781 - DNA, 15 bp, Homo sapiens
cagctattttgtgaa

SEQ ID NO: 1580782 - DNA, 15 bp, Homo sapiens
cagctcaacctaccc

SEQ ID NO: 1580783 - DNA, 19 bp, Homo sapiens
caggctgttctgcactgaa

SEQ ID NO: 1580784 - DNA, 20 bp, Homo sapiens
caggctgttctgcactgaaa

SEQ ID NO: 1580785 - DNA, 22 bp, Homo sapiens
caggctgttctgcactgaaaag

SEQ ID NO: 1580786 - DNA, 22 bp, Homo sapiens
caggctgttggaaaatccagaa

SEQ ID NO: 1580787 - DNA, 15 bp, Homo sapiens
caggctgtttcagcc

SEQ ID NO: 1580788 - DNA, 20 bp, Homo sapiens
caggcttccatccccgtcca

SEQ ID NO: 1580789 - DNA, 15 bp, Homo sapiens
caggcttcctgggtc

SEQ ID NO: 1580790 - DNA, 16 bp, Homo sapiens
caggcttcctgggtcc

SEQ ID NO: 1580791 - DNA, 21 bp, Homo sapiens
caggcttcctgggtcctgcct

SEQ ID NO: 1580792 - DNA, 23 bp, Homo sapiens
caggcttcctgggtcctgcctgg

SEQ ID NO: 1580793 - DNA, 16 bp, Homo sapiens
caggcttcctggtgag

SEQ ID NO: 1580794 - DNA, 20 bp, Homo sapiens
caggcttctcttgctacctg

SEQ ID NO: 1580795 - DNA, 13 bp, Homo sapiens
caggcttggggaa

SEQ ID NO: 1580796 - DNA, 18 bp, Homo sapiens
caggcttgtcactagcag

SEQ ID NO: 1580797 - DNA, 13 bp, Homo sapiens
caggctttcccac

SEQ ID NO: 1580798 - DNA, 19 bp, Homo sapiens
caggctttgtacagagtgc

SEQ ID NO: 1580799 - DNA, 14 bp, Homo sapiens
caggcttttgtttc

SEQ ID NO: 1580800 - DNA, 21 bp, Homo sapiens
caggcttttttccagactcta

SEQ ID NO: 1580801 - DNA, 21 bp, Homo sapiens
cagggaaagcatttaggagaa

SEQ ID NO: 1580802 - DNA, 15 bp, Homo sapiens
cagggaaagctccac

SEQ ID NO: 1580803 - DNA, 16 bp, Homo sapiens
cagggaaagctccacg

SEQ ID NO: 1580804 - DNA, 17 bp, Homo sapiens
cagggaaagctccacgg

SEQ ID NO: 1580805 - DNA, 23 bp, Homo sapiens
cagggaaaggctctgaaagccag

SEQ ID NO: 1580806 - DNA, 18 bp, Homo sapiens
cagggaaaggtcagcccg

SEQ ID NO: 1580807 - DNA, 13 bp, Homo sapiens
cagggaacagccc

SEQ ID NO: 1580808 - DNA, 14 bp, Homo sapiens
cagggaacagcccc

SEQ ID NO: 1580809 - DNA, 19 bp, Homo sapiens
cagggaacattggagctga

SEQ ID NO: 1580810 - DNA, 12 bp, Homo sapiens
cagggaagaggg

SEQ ID NO: 1580811 - DNA, 22 bp, Homo sapiens
cagggaagagggcagtacctgg

SEQ ID NO: 1580812 - DNA, 14 bp, Homo sapiens
cagggaagcccagc

SEQ ID NO: 1580813 - DNA, 15 bp, Homo sapiens
cagggaagcccagct

SEQ ID NO: 1580814 - DNA, 18 bp, Homo sapiens
cagggaagcccagctcca

SEQ ID NO: 1580815 - DNA, 17 bp, Homo sapiens
cagggaagccccacatg

SEQ ID NO: 1580816 - DNA, 23 bp, Homo sapiens
cagggaagccccacatgtccagc

SEQ ID NO: 1580817 - DNA, 12 bp, Homo sapiens
cagggaaggaaa

SEQ ID NO: 1580818 - DNA, 14 bp, Homo sapiens
cagggaaggacagg

SEQ ID NO: 1580819 - DNA, 16 bp, Homo sapiens
cagggaaggacaggac

SEQ ID NO: 1580820 - DNA, 21 bp, Homo sapiens
cagggaaggctaagcatggcc

SEQ ID NO: 1580821 - DNA, 22 bp, Homo sapiens
cagggaagtttcgtatgcactc

SEQ ID NO: 1580822 - DNA, 14 bp, Homo sapiens
cagggaatccaagc

SEQ ID NO: 1580823 - DNA, 18 bp, Homo sapiens
cagggaatccaagcctcc

SEQ ID NO: 1580824 - DNA, 23 bp, Homo sapiens
cagggaatccaagcctccacagc

SEQ ID NO: 1580825 - DNA, 23 bp, Homo sapiens
cagggaatgcaatccttccctgc

SEQ ID NO: 1580826 - DNA, 18 bp, Homo sapiens
cagggaatgcagcaggaa

SEQ ID NO: 1580827 - DNA, 13 bp, Homo sapiens
cagggacaaagag

SEQ ID NO: 1580828 - DNA, 23 bp, Homo sapiens
cagggacaaagaggcctttaacc

SEQ ID NO: 1580829 - DNA, 16 bp, Homo sapiens
cagggacacgggcagc

SEQ ID NO: 1580830 - DNA, 21 bp, Homo sapiens
cagggacacgggcagcctggc

SEQ ID NO: 1580831 - DNA, 17 bp, Homo sapiens
cagggacagagacacct

SEQ ID NO: 1580832 - DNA, 18 bp, Homo sapiens
cagggacagagacacctg

SEQ ID NO: 1580833 - DNA, 20 bp, Homo sapiens
cagggacagagacacctgca

SEQ ID NO: 1580834 - DNA, 21 bp, Homo sapiens
cagggacagagacacctgcac

SEQ ID NO: 1580835 - DNA, 23 bp, Homo sapiens
cagggacagagacacctgcacct

SEQ ID NO: 1580836 - DNA, 19 bp, Homo sapiens
cagggacagaggccccagc

SEQ ID NO: 1580837 - DNA, 14 bp, Homo sapiens
cagggacagcagcc

SEQ ID NO: 1580838 - DNA, 20 bp, Homo sapiens
cagggacagcagcctccctg

SEQ ID NO: 1580839 - DNA, 19 bp, Homo sapiens
cagggacatgccctgtgtg

SEQ ID NO: 1580840 - DNA, 22 bp, Homo sapiens
cagggacatgccctgtgtggct

SEQ ID NO: 1580841 - DNA, 18 bp, Homo sapiens
cagggaccatcaagaacc

SEQ ID NO: 1580842 - DNA, 22 bp, Homo sapiens
cagggacccacttcacacacag

SEQ ID NO: 1580843 - DNA, 20 bp, Homo sapiens
cagggacccaggtgtgcctg

SEQ ID NO: 1580844 - DNA, 23 bp, Homo sapiens
cagggacccaggtgtgcctgtgc

SEQ ID NO: 1580845 - DNA, 21 bp, Homo sapiens
cagggacccggggtctcctgg

SEQ ID NO: 1580846 - DNA, 18 bp, Homo sapiens
cagggaccggtgctgcag

SEQ ID NO: 1580847 - DNA, 22 bp, Homo sapiens
cagggaccggtgctgcaggagt

SEQ ID NO: 1580848 - DNA, 13 bp, Homo sapiens
cagggacctgaga

SEQ ID NO: 1580849 - DNA, 14 bp, Homo sapiens
cagggacctgagag

SEQ ID NO: 1580850 - DNA, 17 bp, Homo sapiens
cagggactatctttgct

SEQ ID NO: 1580851 - DNA, 19 bp, Homo sapiens
cagggacttgtttagagag

SEQ ID NO: 1580852 - DNA, 15 bp, Homo sapiens
cagggagaagtagct

SEQ ID NO: 1580853 - DNA, 19 bp, Homo sapiens
cagggagacccgtccattt

SEQ ID NO: 1580854 - DNA, 21 bp, Homo sapiens
cagggagacggtttccaggga

SEQ ID NO: 1580855 - DNA, 20 bp, Homo sapiens
cagggagactttctgaagta

SEQ ID NO: 1580856 - DNA, 20 bp, Homo sapiens
cagggagaggtcaccagctg

SEQ ID NO: 1580857 - DNA, 15 bp, Homo sapiens
cagggagcaagacag

SEQ ID NO: 1580858 - DNA, 22 bp, Homo sapiens
cagggagcatttaatggcagct

SEQ ID NO: 1580859 - DNA, 19 bp, Homo sapiens
cagggagccggcggcctct

SEQ ID NO: 1580860 - DNA, 20 bp, Homo sapiens
cagggagccggcggcctctc

SEQ ID NO: 1580861 - DNA, 22 bp, Homo sapiens
cagggagccggcggcctctcga

SEQ ID NO: 1580862 - DNA, 22 bp, Homo sapiens
cagggagcctttggttctggcc

SEQ ID NO: 1580863 - DNA, 15 bp, Homo sapiens
cagggagctctgggg

SEQ ID NO: 1580864 - DNA, 23 bp, Homo sapiens
cagggagctctggggacagcttc

SEQ ID NO: 1580865 - DNA, 19 bp, Homo sapiens
cagggagctgggcccgaca

SEQ ID NO: 1580866 - DNA, 20 bp, Homo sapiens
cagggaggaggtggcagccc

SEQ ID NO: 1580867 - DNA, 23 bp, Homo sapiens
cagggaggaggtggcagccctgt

SEQ ID NO: 1580868 - DNA, 21 bp, Homo sapiens
cagggaggcgatgccagcctt

SEQ ID NO: 1580869 - DNA, 13 bp, Homo sapiens
cagggaggggact

SEQ ID NO: 1580870 - DNA, 13 bp, Homo sapiens
cagggaggggagg

SEQ ID NO: 1580871 - DNA, 14 bp, Homo sapiens
cagggaggggaggc

SEQ ID NO: 1580872 - DNA, 16 bp, Homo sapiens
cagggaggggaggcag

SEQ ID NO: 1580873 - DNA, 17 bp, Homo sapiens
cagggaggtggctgggt

SEQ ID NO: 1580874 - DNA, 18 bp, Homo sapiens
cagggagtgtctgcagtc

SEQ ID NO: 1580875 - DNA, 16 bp, Homo sapiens
cagggatccagggaca

SEQ ID NO: 1580876 - DNA, 20 bp, Homo sapiens
cagggatgatggcagagcca

SEQ ID NO: 1580877 - DNA, 23 bp, Homo sapiens
cagggatgatggcagagccaggc

SEQ ID NO: 1580878 - DNA, 12 bp, Homo sapiens
cagcttattgtt

SEQ ID NO: 1580879 - DNA, 18 bp, Homo sapiens
cagcttcaacttttctct

SEQ ID NO: 1580880 - DNA, 14 bp, Homo sapiens
cagcttcaccagag

SEQ ID NO: 1580881 - DNA, 16 bp, Homo sapiens
cagcttcaccagagca

SEQ ID NO: 1580882 - DNA, 17 bp, Homo sapiens
cagcttcaccctgtcaa

SEQ ID NO: 1580883 - DNA, 15 bp, Homo sapiens
cagcttcagccagga

SEQ ID NO: 1580884 - DNA, 17 bp, Homo sapiens
cagcttcagctcaactc

SEQ ID NO: 1580885 - DNA, 18 bp, Homo sapiens
cagcttcatgcctttgta

SEQ ID NO: 1580886 - DNA, 21 bp, Homo sapiens
cagcttcatgcctttgtaagt

SEQ ID NO: 1580887 - DNA, 16 bp, Homo sapiens
cagcttccaaagccta

SEQ ID NO: 1580888 - DNA, 17 bp, Homo sapiens
cagcttccaaagcctag

SEQ ID NO: 1580889 - DNA, 13 bp, Homo sapiens
cagcttcctcaca

SEQ ID NO: 1580890 - DNA, 15 bp, Homo sapiens
cagcttcctcacacc

SEQ ID NO: 1580891 - DNA, 17 bp, Homo sapiens
cagcttccttctgggac

SEQ ID NO: 1580892 - DNA, 20 bp, Homo sapiens
cagcttcggagggcccctgc

SEQ ID NO: 1580893 - DNA, 17 bp, Homo sapiens
cagcttctggagcagaa

SEQ ID NO: 1580894 - DNA, 18 bp, Homo sapiens
cagcttgaaactgagatg

SEQ ID NO: 1580895 - DNA, 19 bp, Homo sapiens
cagcttgacctgaggctgt

SEQ ID NO: 1580896 - DNA, 21 bp, Homo sapiens
cagcttgacctgaggctgtgg

SEQ ID NO: 1580897 - DNA, 14 bp, Homo sapiens
cagcttgagagggc

SEQ ID NO: 1580898 - DNA, 22 bp, Homo sapiens
cagcttgagccgggcccctggg

SEQ ID NO: 1580899 - DNA, 18 bp, Homo sapiens
cagcttgcacatttggta

SEQ ID NO: 1580900 - DNA, 13 bp, Homo sapiens
cagcttgccaggg

SEQ ID NO: 1580901 - DNA, 14 bp, Homo sapiens
cagcttgccaggga

SEQ ID NO: 1580902 - DNA, 21 bp, Homo sapiens
cagcttgccagggatgggcag

SEQ ID NO: 1580903 - DNA, 15 bp, Homo sapiens
cagcttgctgtcact

SEQ ID NO: 1580904 - DNA, 13 bp, Homo sapiens
cagcttgggccca

SEQ ID NO: 1580905 - DNA, 16 bp, Homo sapiens
cagcttgggcccagct

SEQ ID NO: 1580906 - DNA, 18 bp, Homo sapiens
cagcttgggcccagctgg

SEQ ID NO: 1580907 - DNA, 22 bp, Homo sapiens
cagcttgggcccagctgggctc

SEQ ID NO: 1580908 - DNA, 13 bp, Homo sapiens
cagcttgtttcta

SEQ ID NO: 1580909 - DNA, 15 bp, Homo sapiens
cagcttgtttctata

SEQ ID NO: 1580910 - DNA, 21 bp, Homo sapiens
cagctttatggagatataatt

SEQ ID NO: 1580911 - DNA, 17 bp, Homo sapiens
cagctttcaaagcattt

SEQ ID NO: 1580912 - DNA, 15 bp, Homo sapiens
cagctttcagagcca

SEQ ID NO: 1580913 - DNA, 19 bp, Homo sapiens
cagctttcagagccagtga

SEQ ID NO: 1580914 - DNA, 17 bp, Homo sapiens
cagctttcatgattagc

SEQ ID NO: 1580915 - DNA, 20 bp, Homo sapiens
cagctttcctcaaaaagcag

SEQ ID NO: 1580916 - DNA, 23 bp, Homo sapiens
cagctttcctcaaaaagcagaag

SEQ ID NO: 1580917 - DNA, 16 bp, Homo sapiens
cagctttgagaagcct

SEQ ID NO: 1580918 - DNA, 11 bp, Homo sapiens
cagctttgcta

SEQ ID NO: 1580919 - DNA, 20 bp, Homo sapiens
cagctttgctccgctcccac

SEQ ID NO: 1580920 - DNA, 16 bp, Homo sapiens
cagcttttctcaactg

SEQ ID NO: 1580921 - DNA, 19 bp, Homo sapiens
cagcttttggtctccttgg

SEQ ID NO: 1580922 - DNA, 22 bp, Homo sapiens
cagcttttggtctccttgggcc

SEQ ID NO: 1580923 - DNA, 16 bp, Homo sapiens
cagcttttgttctaga

SEQ ID NO: 1580924 - DNA, 21 bp, Homo sapiens
caggaaaaaaaaaaaaaagac

SEQ ID NO: 1580925 - DNA, 18 bp, Homo sapiens
caggaaaaaaaattctgt

SEQ ID NO: 1580926 - DNA, 19 bp, Homo sapiens
caggaaaactgacagagga

SEQ ID NO: 1580927 - DNA, 20 bp, Homo sapiens
caggaaaactgacagaggag

SEQ ID NO: 1580928 - DNA, 22 bp, Homo sapiens
caggaaaaggtagcttacctga

SEQ ID NO: 1580929 - DNA, 13 bp, Homo sapiens
caggaaaccaaca

SEQ ID NO: 1580930 - DNA, 15 bp, Homo sapiens
caggaaaccctggct

SEQ ID NO: 1580931 - DNA, 19 bp, Homo sapiens
caggaaaccctggcttgct

SEQ ID NO: 1580932 - DNA, 15 bp, Homo sapiens
ccaacggcaacagca

SEQ ID NO: 1580933 - DNA, 19 bp, Homo sapiens
ccaacgtgcaaagccaagg

SEQ ID NO: 1580934 - DNA, 20 bp, Homo sapiens
ccaacgtgcaaagccaaggc

SEQ ID NO: 1580935 - DNA, 15 bp, Homo sapiens
ccaactaagccctcg

SEQ ID NO: 1580936 - DNA, 14 bp, Homo sapiens
ccaactactaatag

SEQ ID NO: 1580937 - DNA, 14 bp, Homo sapiens
ccaactatgattat

SEQ ID NO: 1580938 - DNA, 13 bp, Homo sapiens
ccaactccagcaa

SEQ ID NO: 1580939 - DNA, 14 bp, Homo sapiens
ccaactccagcaac

SEQ ID NO: 1580940 - DNA, 15 bp, Homo sapiens
ccaactccagcaact

SEQ ID NO: 1580941 - DNA, 21 bp, Homo sapiens
ccaactccagcaacttcttct

SEQ ID NO: 1580942 - DNA, 21 bp, Homo sapiens
ccaactccatggggttcgaga

SEQ ID NO: 1580943 - DNA, 16 bp, Homo sapiens
ccaactcctaatttta

SEQ ID NO: 1580944 - DNA, 13 bp, Homo sapiens
ccaactctcccaa

SEQ ID NO: 1580945 - DNA, 13 bp, Homo sapiens
ccaactctcccca

SEQ ID NO: 1580946 - DNA, 14 bp, Homo sapiens
ccaactctccccag

SEQ ID NO: 1580947 - DNA, 16 bp, Homo sapiens
ccaactgatcctgctc

SEQ ID NO: 1580948 - DNA, 19 bp, Homo sapiens
ccaactgatcctgctccag

SEQ ID NO: 1580949 - DNA, 19 bp, Homo sapiens
ccaactgcaaaaaaagcct

SEQ ID NO: 1580950 - DNA, 12 bp, Homo sapiens
ccaactgcccta

SEQ ID NO: 1580951 - DNA, 13 bp, Homo sapiens
ccaactggcttct

SEQ ID NO: 1580952 - DNA, 16 bp, Homo sapiens
ccaactggcttctgtg

SEQ ID NO: 1580953 - DNA, 19 bp, Homo sapiens
ccaactgggcatttcaatc

SEQ ID NO: 1580954 - DNA, 13 bp, Homo sapiens
ccaactgtatata

SEQ ID NO: 1580955 - DNA, 21 bp, Homo sapiens
ccaactgtccctttgtttgaa

SEQ ID NO: 1580956 - DNA, 23 bp, Homo sapiens
ccaactgtccctttgtttgaagt

SEQ ID NO: 1580957 - DNA, 13 bp, Homo sapiens
ccaactgtgagca

SEQ ID NO: 1580958 - DNA, 20 bp, Homo sapiens
ccaactgtggtagctccagc

SEQ ID NO: 1580959 - DNA, 14 bp, Homo sapiens
ccaactgtttccct

SEQ ID NO: 1580960 - DNA, 20 bp, Homo sapiens
ccaactgtttccctgctgaa

SEQ ID NO: 1580961 - DNA, 18 bp, Homo sapiens
ccaacttcaccaccccct

SEQ ID NO: 1580962 - DNA, 13 bp, Homo sapiens
ccaacttcccagt

SEQ ID NO: 1580963 - DNA, 17 bp, Homo sapiens
ccaacttgtaaatacac

SEQ ID NO: 1580964 - DNA, 23 bp, Homo sapiens
ccaacttttaatgggatttcatg

SEQ ID NO: 1580965 - DNA, 11 bp, Homo sapiens
ccaagaaaaat

SEQ ID NO: 1580966 - DNA, 18 bp, Homo sapiens
ccaagaaaatgaagggat

SEQ ID NO: 1580967 - DNA, 15 bp, Homo sapiens
ccaagaaacctgact

SEQ ID NO: 1580968 - DNA, 21 bp, Homo sapiens
ccaagaaagctcactgtagct

SEQ ID NO: 1580969 - DNA, 19 bp, Homo sapiens
ccaagaaagcttcttcaga

SEQ ID NO: 1580970 - DNA, 23 bp, Homo sapiens
ccaagaaagcttcttcagagtga

SEQ ID NO: 1580971 - DNA, 20 bp, Homo sapiens
ccaagaatagatgctgactg

SEQ ID NO: 1580972 - DNA, 12 bp, Homo sapiens
ccaagaatgcaa

SEQ ID NO: 1580973 - DNA, 18 bp, Homo sapiens
ccaagaatggaagcctga

SEQ ID NO: 1580974 - DNA, 17 bp, Homo sapiens
ccaagaatgtacgtcca

SEQ ID NO: 1580975 - DNA, 18 bp, Homo sapiens
ccaagaatgtacgtccag

SEQ ID NO: 1580976 - DNA, 12 bp, Homo sapiens
ccaagacagagt

SEQ ID NO: 1580977 - DNA, 19 bp, Homo sapiens
ccaagacagatgccccaga

SEQ ID NO: 1580978 - DNA, 23 bp, Homo sapiens
ccaagacagatgccccagagctg

SEQ ID NO: 1580979 - DNA, 24 bp, Homo sapiens
ccaagacagatgccccagagctgt

SEQ ID NO: 1580980 - DNA, 21 bp, Homo sapiens
ccaagacatgtctgttctaca

SEQ ID NO: 1580981 - DNA, 15 bp, Homo sapiens
ccaagaccccctggg

SEQ ID NO: 1580982 - DNA, 17 bp, Homo sapiens
ccaagacggaggagggg

SEQ ID NO: 1580983 - DNA, 15 bp, Homo sapiens
ccaagactcctcagg

SEQ ID NO: 1580984 - DNA, 23 bp, Homo sapiens
ccaagagaactcgcgctcagtaa

SEQ ID NO: 1580985 - DNA, 20 bp, Homo sapiens
ccaagagaaggggaagcact

SEQ ID NO: 1580986 - DNA, 23 bp, Homo sapiens
ccaagagaaggtggacctggcag

SEQ ID NO: 1580987 - DNA, 13 bp, Homo sapiens
ccaagagagaaag

SEQ ID NO: 1580988 - DNA, 14 bp, Homo sapiens
ccaagagagaaaga

SEQ ID NO: 1580989 - DNA, 12 bp, Homo sapiens
ccaagagatgaa

SEQ ID NO: 1580990 - DNA, 17 bp, Homo sapiens
ccaagagccctgtggcc

SEQ ID NO: 1580991 - DNA, 13 bp, Homo sapiens
ccaagagggtgga

SEQ ID NO: 1580992 - DNA, 16 bp, Homo sapiens
ccaagaggtctgagcc

SEQ ID NO: 1580993 - DNA, 19 bp, Homo sapiens
ccaagaggtctgagccctg

SEQ ID NO: 1580994 - DNA, 15 bp, Homo sapiens
ccaagagtctaaaga

SEQ ID NO: 1580995 - DNA, 16 bp, Homo sapiens
ccaagagtctaaagat

SEQ ID NO: 1580996 - DNA, 14 bp, Homo sapiens
ccaagataaaagaa

SEQ ID NO: 1580997 - DNA, 20 bp, Homo sapiens
ccaagatggctgctgcctgc

SEQ ID NO: 1580998 - DNA, 20 bp, Homo sapiens
ccaagcaaaggtgaagagac

SEQ ID NO: 1580999 - DNA, 14 bp, Homo sapiens
ccaagcaagtagct

SEQ ID NO: 1581000 - DNA, 20 bp, Homo sapiens
ccaagcacctgggattacaa

SEQ ID NO: 1581001 - DNA, 21 bp, Homo sapiens
ccaagcactcgagaccatcct

SEQ ID NO: 1581002 - DNA, 13 bp, Homo sapiens
ccaagcactgctc

SEQ ID NO: 1581003 - DNA, 12 bp, Homo sapiens
ccaagcagccag

SEQ ID NO: 1581004 - DNA, 16 bp, Homo sapiens
ccaagcagccagccag

SEQ ID NO: 1581005 - DNA, 22 bp, Homo sapiens
ccaagcataccaacacgagcag

SEQ ID NO: 1581006 - DNA, 21 bp, Homo sapiens
ccaagcatagagaagagtctg

SEQ ID NO: 1581007 - DNA, 13 bp, Homo sapiens
ccaagcatttcat

SEQ ID NO: 1581008 - DNA, 18 bp, Homo sapiens
ccaagccaagggaacctg

SEQ ID NO: 1581009 - DNA, 22 bp, Homo sapiens
ccaagccaagggaacctgtgtc

SEQ ID NO: 1581010 - DNA, 23 bp, Homo sapiens
ccaagccaagggaacctgtgtcc

SEQ ID NO: 1581011 - DNA, 18 bp, Homo sapiens
ccaagccacaagctgacc

SEQ ID NO: 1581012 - DNA, 18 bp, Homo sapiens
ccaagccattcacttccc

SEQ ID NO: 1581013 - DNA, 18 bp, Homo sapiens
ccaagcccgacttgctgt

SEQ ID NO: 1581014 - DNA, 17 bp, Homo sapiens
ccaagccgtggcttccc

SEQ ID NO: 1581015 - DNA, 16 bp, Homo sapiens
ccaagcctccacagcg

SEQ ID NO: 1581016 - DNA, 19 bp, Homo sapiens
ccaagcctccacagcgagg

SEQ ID NO: 1581017 - DNA, 18 bp, Homo sapiens
ccaagcctgctggctgcg

SEQ ID NO: 1581018 - DNA, 11 bp, Homo sapiens
ccaagccttgg

SEQ ID NO: 1581019 - DNA, 15 bp, Homo sapiens
ccaagcgttcctggc

SEQ ID NO: 1581020 - DNA, 22 bp, Homo sapiens
ccaagcgttcctggccttctga

SEQ ID NO: 1581021 - DNA, 20 bp, Homo sapiens
ccaagctaagcactgccact

SEQ ID NO: 1581022 - DNA, 18 bp, Homo sapiens
ccaagctcacagttcctc

SEQ ID NO: 1581023 - DNA, 13 bp, Homo sapiens
ccaagctccaagc

SEQ ID NO: 1581024 - DNA, 16 bp, Homo sapiens
ccaagctgagtttcct

SEQ ID NO: 1581025 - DNA, 16 bp, Homo sapiens
ccaagctgcctctggg

SEQ ID NO: 1581026 - DNA, 17 bp, Homo sapiens
ccaagctgcctctgggc

SEQ ID NO: 1581027 - DNA, 19 bp, Homo sapiens
ccaagctgtacccttgaga

SEQ ID NO: 1581028 - DNA, 12 bp, Homo sapiens
ccaagctgtggc

SEQ ID NO: 1581029 - DNA, 13 bp, Homo sapiens
ccaagctgtggca

SEQ ID NO: 1581030 - DNA, 23 bp, Homo sapiens
ccaagctgtggcagccgtcccag

SEQ ID NO: 1581031 - DNA, 17 bp, Homo sapiens
ccaagcttcaaccctca

SEQ ID NO: 1581032 - DNA, 15 bp, Homo sapiens
ccaagctttaaatta

SEQ ID NO: 1581033 - DNA, 22 bp, Homo sapiens
ccaaggaaacgctacctctctg

SEQ ID NO: 1581034 - DNA, 21 bp, Homo sapiens
ccaaggaagcagcctcagagt

SEQ ID NO: 1581035 - DNA, 19 bp, Homo sapiens
ccaaggaatttaaaactgt

SEQ ID NO: 1581036 - DNA, 16 bp, Homo sapiens
ccaaggacagggctgg

SEQ ID NO: 1581037 - DNA, 14 bp, Homo sapiens
ccaaggactgaggg

SEQ ID NO: 1581038 - DNA, 15 bp, Homo sapiens
ccaaggagaaacaga

SEQ ID NO: 1581039 - DNA, 21 bp, Homo sapiens
ccaaggagaaacagagacagg

SEQ ID NO: 1581040 - DNA, 12 bp, Homo sapiens
ccaaggagacca

SEQ ID NO: 1581041 - DNA, 13 bp, Homo sapiens
ccaaggagcccct

SEQ ID NO: 1581042 - DNA, 21 bp, Homo sapiens
ccaaggagctgatttccaggc

SEQ ID NO: 1581043 - DNA, 19 bp, Homo sapiens
ccaaggagcttacccaagc

SEQ ID NO: 1581044 - DNA, 19 bp, Homo sapiens
ccaaggataggtattttat

SEQ ID NO: 1581045 - DNA, 13 bp, Homo sapiens
ccaaggcaaggca

SEQ ID NO: 1581046 - DNA, 16 bp, Homo sapiens
ccaaggcaaggcaggt

SEQ ID NO: 1581047 - DNA, 17 bp, Homo sapiens
ccaaggcaaggcaggtg

SEQ ID NO: 1581048 - DNA, 22 bp, Homo sapiens
ccaaggcaaggcaggtgcctcc

SEQ ID NO: 1581049 - DNA, 20 bp, Homo sapiens
ccaaggcagaggcctgggct

SEQ ID NO: 1581050 - DNA, 14 bp, Homo sapiens
ccaaggcagcctcc

SEQ ID NO: 1581051 - DNA, 16 bp, Homo sapiens
ccaaggcagcctccag

SEQ ID NO: 1581052 - DNA, 18 bp, Homo sapiens
ccaaggcagcgaccccag

SEQ ID NO: 1581053 - DNA, 20 bp, Homo sapiens
ccaaggcagcgaccccagga

SEQ ID NO: 1581054 - DNA, 11 bp, Homo sapiens
ccaaggcaggt

SEQ ID NO: 1581055 - DNA, 21 bp, Homo sapiens
ccaaggcctctctctgcctga

SEQ ID NO: 1581056 - DNA, 14 bp, Homo sapiens
ccaaggccttctcc

SEQ ID NO: 1581057 - DNA, 17 bp, Homo sapiens
ccaagggaaaggggtgc

SEQ ID NO: 1581058 - DNA, 22 bp, Homo sapiens
ccaagggaaaggggtgctttta

SEQ ID NO: 1581059 - DNA, 16 bp, Homo sapiens
ccaagggacagcaagt

SEQ ID NO: 1581060 - DNA, 16 bp, Homo sapiens
ccaagggacagcccac

SEQ ID NO: 1581061 - DNA, 20 bp, Homo sapiens
ccaagggacagcccacggtc

SEQ ID NO: 1581062 - DNA, 22 bp, Homo sapiens
ccaagggagggtgcagccctct

SEQ ID NO: 1581063 - DNA, 23 bp, Homo sapiens
ccaagggagggtgcagccctctt

SEQ ID NO: 1581064 - DNA, 24 bp, Homo sapiens
ccaagggagttaggctattcacaa

SEQ ID NO: 1581065 - DNA, 13 bp, Homo sapiens
ccaagggcccaaa

SEQ ID NO: 1581066 - DNA, 14 bp, Homo sapiens
ccaagggcccagac

SEQ ID NO: 1581067 - DNA, 16 bp, Homo sapiens
ccaagggcccagaccc

SEQ ID NO: 1581068 - DNA, 21 bp, Homo sapiens
ccaagggccccaggggcagca

SEQ ID NO: 1581069 - DNA, 13 bp, Homo sapiens
ccaagggccctgg

SEQ ID NO: 1581070 - DNA, 21 bp, Homo sapiens
ccaagggccctggcaccccca

SEQ ID NO: 1581071 - DNA, 14 bp, Homo sapiens
ccaagggcttctgc

SEQ ID NO: 1581072 - DNA, 17 bp, Homo sapiens
ccaagggcttctgcacc

SEQ ID NO: 1581073 - DNA, 19 bp, Homo sapiens
ccaagggcttctgcaccct

SEQ ID NO: 1581074 - DNA, 22 bp, Homo sapiens
ccaagggcttctgcaccctcca

SEQ ID NO: 1581075 - DNA, 19 bp, Homo sapiens
ccaaggggaatcagaactc

SEQ ID NO: 1581076 - DNA, 20 bp, Homo sapiens
ccaagggttcagagactcag

SEQ ID NO: 1581077 - DNA, 15 bp, Homo sapiens
ccaagggtttcgact

SEQ ID NO: 1581078 - DNA, 20 bp, Homo sapiens
ccaagggtttcgactggtcc

SEQ ID NO: 1581079 - DNA, 23 bp, Homo sapiens
ccaagggtttcgactggtccagc

SEQ ID NO: 1581080 - DNA, 22 bp, Homo sapiens
ccaaggtaccgatttctgctaa

SEQ ID NO: 1581081 - DNA, 14 bp, Homo sapiens
ccaaggtgctgatg

SEQ ID NO: 1581082 - DNA, 21 bp, Homo sapiens
ccaaggtgctgatgtcaaagt

SEQ ID NO: 1581083 - DNA, 20 bp, Homo sapiens
ccaaggttggagcccagggc

SEQ ID NO: 1581084 - DNA, 23 bp, Homo sapiens
ccaagtaaaaatttcttctgggc

SEQ ID NO: 1581085 - DNA, 20 bp, Homo sapiens
ccaagtaactgggattacag

SEQ ID NO: 1581086 - DNA, 20 bp, Homo sapiens
ccaagtagctgggactacag

SEQ ID NO: 1581087 - DNA, 16 bp, Homo sapiens
ccaagtatgccttaag

SEQ ID NO: 1581088 - DNA, 16 bp, Homo sapiens
ccaagtccccttctgt

SEQ ID NO: 1581089 - DNA, 12 bp, Homo sapiens
ccaagtccctgt

SEQ ID NO: 1581090 - DNA, 15 bp, Homo sapiens
ccaagtctaatgaag

SEQ ID NO: 1581091 - DNA, 21 bp, Homo sapiens
ccaagtctaatgaagagaaaa

SEQ ID NO: 1581092 - DNA, 23 bp, Homo sapiens
ccaagtctttcttcttttttaag

SEQ ID NO: 1581093 - DNA, 17 bp, Homo sapiens
ccaagtgcactttctaa

SEQ ID NO: 1581094 - DNA, 16 bp, Homo sapiens
ccaagtgccagaggtg

SEQ ID NO: 1581095 - DNA, 18 bp, Homo sapiens
ccaagtgccagaggtggg

SEQ ID NO: 1581096 - DNA, 22 bp, Homo sapiens
ccaagtgccagaggtgggcagg

SEQ ID NO: 1581097 - DNA, 13 bp, Homo sapiens
ccaagtgctggcc

SEQ ID NO: 1581098 - DNA, 15 bp, Homo sapiens
ccaagtgctggccca

SEQ ID NO: 1581099 - DNA, 20 bp, Homo sapiens
ccaagtggaccttgagacca

SEQ ID NO: 1581100 - DNA, 11 bp, Homo sapiens
ccaagtggctg

SEQ ID NO: 1581101 - DNA, 22 bp, Homo sapiens
ccaagtggggtgctgggaggag

SEQ ID NO: 1581102 - DNA, 14 bp, Homo sapiens
ccaagtggtcagga

SEQ ID NO: 1581103 - DNA, 12 bp, Homo sapiens
ccaagtgtgcta

SEQ ID NO: 1581104 - DNA, 15 bp, Homo sapiens
ccaagttataaatca

SEQ ID NO: 1581105 - DNA, 22 bp, Homo sapiens
ccaagttgtgcttgagccagga

SEQ ID NO: 1581106 - DNA, 14 bp, Homo sapiens
ccaagtttatatac

SEQ ID NO: 1581107 - DNA, 22 bp, Homo sapiens
ccaataaaagttttctccaact

SEQ ID NO: 1581108 - DNA, 17 bp, Homo sapiens
ccaataaaggcagctgc

SEQ ID NO: 1581109 - DNA, 20 bp, Homo sapiens
ccaataaaggcagctgcctc

SEQ ID NO: 1581110 - DNA, 24 bp, Homo sapiens
ccaataaaggcagctgcctctgct

SEQ ID NO: 1581111 - DNA, 14 bp, Homo sapiens
ccaataaaggtccc

SEQ ID NO: 1581112 - DNA, 19 bp, Homo sapiens
ccaataatggggcagacac

SEQ ID NO: 1581113 - DNA, 21 bp, Homo sapiens
ccaataatggggcagacacaa

SEQ ID NO: 1581114 - DNA, 14 bp, Homo sapiens
ccaatacatttgta

SEQ ID NO: 1581115 - DNA, 16 bp, Homo sapiens
ccaatacatttgtatt

SEQ ID NO: 1581116 - DNA, 17 bp, Homo sapiens
ccaatacatttgtattt

SEQ ID NO: 1581117 - DNA, 15 bp, Homo sapiens
ccaatagctctactg

SEQ ID NO: 1581118 - DNA, 12 bp, Homo sapiens
ccaatattgtaa

SEQ ID NO: 1581119 - DNA, 14 bp, Homo sapiens
ccaatattttgcct

SEQ ID NO: 1581120 - DNA, 23 bp, Homo sapiens
ccaatcaacagcatgtctactgc

SEQ ID NO: 1581121 - DNA, 16 bp, Homo sapiens
ccaatcagcactgaaa

SEQ ID NO: 1581122 - DNA, 18 bp, Homo sapiens
ccaatcagcactgaaaat

SEQ ID NO: 1581123 - DNA, 12 bp, Homo sapiens
ccaatcagcttt

SEQ ID NO: 1581124 - DNA, 14 bp, Homo sapiens
ccaatcagcttttg

SEQ ID NO: 1581125 - DNA, 23 bp, Homo sapiens
ccaatcagcttttgttctagact

SEQ ID NO: 1581126 - DNA, 16 bp, Homo sapiens
ccaatcccctccttgg

SEQ ID NO: 1581127 - DNA, 17 bp, Homo sapiens
ccaatcctcactgggtg

SEQ ID NO: 1581128 - DNA, 16 bp, Homo sapiens
ccaatcctctctcccc

SEQ ID NO: 1581129 - DNA, 14 bp, Homo sapiens
ccaatcggactgcc

SEQ ID NO: 1581130 - DNA, 18 bp, Homo sapiens
ccaatcgggtccagagac

SEQ ID NO: 1581131 - DNA, 16 bp, Homo sapiens
ccaatgaaaacatgta

SEQ ID NO: 1581132 - DNA, 17 bp, Homo sapiens
ccaatgaacagctcctc

SEQ ID NO: 1581133 - DNA, 12 bp, Homo sapiens
ccaatgaagaag

SEQ ID NO: 1581134 - DNA, 16 bp, Homo sapiens
ccaatgaagaagacaa

SEQ ID NO: 1581135 - DNA, 22 bp, Homo sapiens
ccaatgaagaagacaaagtcta

SEQ ID NO: 1581136 - DNA, 23 bp, Homo sapiens
ccaatgacacccatgccagagag

SEQ ID NO: 1581137 - DNA, 19 bp, Homo sapiens
ccaatgaggtctgaaatgg

SEQ ID NO: 1581138 - DNA, 18 bp, Homo sapiens
ccaatgcattggcctctg

SEQ ID NO: 1581139 - DNA, 22 bp, Homo sapiens
ccaatgcattggcctctgtacc

SEQ ID NO: 1581140 - DNA, 18 bp, Homo sapiens
ccaatgcggcccactttc

SEQ ID NO: 1581141 - DNA, 22 bp, Homo sapiens
ccaatgcggcccactttcctga

SEQ ID NO: 1581142 - DNA, 22 bp, Homo sapiens
ccaatgggatgaggtcactttt

SEQ ID NO: 1581143 - DNA, 22 bp, Homo sapiens
ccaatggggccagcactggagg

SEQ ID NO: 1581144 - DNA, 17 bp, Homo sapiens
ccaatgtaggagctgcc

SEQ ID NO: 1581145 - DNA, 13 bp, Homo sapiens
ccaatgtcttttg

SEQ ID NO: 1581146 - DNA, 21 bp, Homo sapiens
ccaatgtttgggatattaaaa

SEQ ID NO: 1581147 - DNA, 23 bp, Homo sapiens
ccaatgtttgggatattaaaaca

SEQ ID NO: 1581148 - DNA, 23 bp, Homo sapiens
ccaattacccataaacagcacac

SEQ ID NO: 1581149 - DNA, 14 bp, Homo sapiens
ccaattagtttcct

SEQ ID NO: 1581150 - DNA, 15 bp, Homo sapiens
ccaattagtttcctt

SEQ ID NO: 1581151 - DNA, 17 bp, Homo sapiens
ccaattatcatcttttg

SEQ ID NO: 1581152 - DNA, 14 bp, Homo sapiens
ccaattctcccctc

SEQ ID NO: 1581153 - DNA, 16 bp, Homo sapiens
ccaattgactctcaca

SEQ ID NO: 1581154 - DNA, 15 bp, Homo sapiens
ccaattgatgtatat

SEQ ID NO: 1581155 - DNA, 13 bp, Homo sapiens
ccaattgctaccg

SEQ ID NO: 1581156 - DNA, 20 bp, Homo sapiens
ccaattgttgacagttctga

SEQ ID NO: 1581157 - DNA, 12 bp, Homo sapiens
ccaatttcctct

SEQ ID NO: 1581158 - DNA, 16 bp, Homo sapiens
ccacaaacggagcccc

SEQ ID NO: 1581159 - DNA, 22 bp, Homo sapiens
ccacaaacggagcccctgaaag

SEQ ID NO: 1581160 - DNA, 20 bp, Homo sapiens
ccacaaagcacagtttgaac

SEQ ID NO: 1581161 - DNA, 18 bp, Homo sapiens
ccacaaccctgttttata

SEQ ID NO: 1581162 - DNA, 17 bp, Homo sapiens
ccacaaccttcggctcc

SEQ ID NO: 1581163 - DNA, 22 bp, Homo sapiens
ccacaactcctgtctaactgct

SEQ ID NO: 1581164 - DNA, 15 bp, Homo sapiens
ccacaactgacacag

SEQ ID NO: 1581165 - DNA, 15 bp, Homo sapiens
ccacagttttaataa

SEQ ID NO: 1581166 - DNA, 17 bp, Homo sapiens
ccacataaaagccccag

SEQ ID NO: 1581167 - DNA, 20 bp, Homo sapiens
ccacataaaagccccagctt

SEQ ID NO: 1581168 - DNA, 19 bp, Homo sapiens
ccacatacaacacaaagag

SEQ ID NO: 1581169 - DNA, 22 bp, Homo sapiens
ccacataccaggcaacctccca

SEQ ID NO: 1581170 - DNA, 20 bp, Homo sapiens
ccacatagcatgcttccttt

SEQ ID NO: 1581171 - DNA, 21 bp, Homo sapiens
ccacatagcatgcttcctttc

SEQ ID NO: 1581172 - DNA, 19 bp, Homo sapiens
ccacatagtgatggttccc

SEQ ID NO: 1581173 - DNA, 14 bp, Homo sapiens
ccacatcaaacctt

SEQ ID NO: 1581174 - DNA, 16 bp, Homo sapiens
ccacatcaaataagaa

SEQ ID NO: 1581175 - DNA, 18 bp, Homo sapiens
ccacatccaactccagca

SEQ ID NO: 1581176 - DNA, 22 bp, Homo sapiens
ccaccccctgtcccattctaga

SEQ ID NO: 1581177 - DNA, 18 bp, Homo sapiens
ccacccccttcagtgccc

SEQ ID NO: 1581178 - DNA, 16 bp, Homo sapiens
ccacccccttccctgg

SEQ ID NO: 1581179 - DNA, 23 bp, Homo sapiens
ccacccccttctctgctccacca

SEQ ID NO: 1581180 - DNA, 16 bp, Homo sapiens
ccaccccgcctgccct

SEQ ID NO: 1581181 - DNA, 15 bp, Homo sapiens
ccaccccggccccct

SEQ ID NO: 1581182 - DNA, 14 bp, Homo sapiens
ccaccccgggctct

SEQ ID NO: 1581183 - DNA, 16 bp, Homo sapiens
ccaccccgtgccaccc

SEQ ID NO: 1581184 - DNA, 17 bp, Homo sapiens
ccacccctacagcctgc

SEQ ID NO: 1581185 - DNA, 19 bp, Homo sapiens
ccacccctacagcctgcac

SEQ ID NO: 1581186 - DNA, 20 bp, Homo sapiens
ccacccctcactccccaggg

SEQ ID NO: 1581187 - DNA, 12 bp, Homo sapiens
ccacccctccac

SEQ ID NO: 1581188 - DNA, 15 bp, Homo sapiens
ccacccctgcccagg

SEQ ID NO: 1581189 - DNA, 14 bp, Homo sapiens
ccacccctggaaga

SEQ ID NO: 1581190 - DNA, 21 bp, Homo sapiens
ccacccctggaagagcccagt

SEQ ID NO: 1581191 - DNA, 22 bp, Homo sapiens
ccacccctggaagagcccagtc

SEQ ID NO: 1581192 - DNA, 13 bp, Homo sapiens
ccacccctgtgct

SEQ ID NO: 1581193 - DNA, 22 bp, Homo sapiens
ccaccccttccccaggcccacc

SEQ ID NO: 1581194 - DNA, 12 bp, Homo sapiens
ccaccccttcct

SEQ ID NO: 1581195 - DNA, 16 bp, Homo sapiens
ccaccccttggaggag

SEQ ID NO: 1581196 - DNA, 23 bp, Homo sapiens
ccaccccttggaggagagagacc

SEQ ID NO: 1581197 - DNA, 17 bp, Homo sapiens
ccacccgatgctgcttt

SEQ ID NO: 1581198 - DNA, 21 bp, Homo sapiens
ccacccgccgcctcccacggc

SEQ ID NO: 1581199 - DNA, 14 bp, Homo sapiens
ccacccggccacag

SEQ ID NO: 1581200 - DNA, 19 bp, Homo sapiens
ccacccggccacagctgct

SEQ ID NO: 1581201 - DNA, 13 bp, Homo sapiens
ccacccggctggc

SEQ ID NO: 1581202 - DNA, 18 bp, Homo sapiens
ccacccgggggagcccag

SEQ ID NO: 1581203 - DNA, 21 bp, Homo sapiens
ccacccgggggagcccagtga

SEQ ID NO: 1581204 - DNA, 20 bp, Homo sapiens
ccacccgtaggcagcctctc

SEQ ID NO: 1581205 - DNA, 15 bp, Homo sapiens
ccacccgtcttcaat

SEQ ID NO: 1581206 - DNA, 18 bp, Homo sapiens
ccacccgtggggtgctgc

SEQ ID NO: 1581207 - DNA, 21 bp, Homo sapiens
ccacccgttctgctggcctgg

SEQ ID NO: 1581208 - DNA, 22 bp, Homo sapiens
ccacccgttctgctggcctgga

SEQ ID NO: 1581209 - DNA, 12 bp, Homo sapiens
ccaccctacctg

SEQ ID NO: 1581210 - DNA, 22 bp, Homo sapiens
ccaccctacctgttcagtgtcc

SEQ ID NO: 1581211 - DNA, 19 bp, Homo sapiens
ccaccctcagcaccccttc

SEQ ID NO: 1581212 - DNA, 17 bp, Homo sapiens
ccaccctccaccttcca

SEQ ID NO: 1581213 - DNA, 13 bp, Homo sapiens
ccaccctccactc

SEQ ID NO: 1581214 - DNA, 15 bp, Homo sapiens
ccaccctccatgctc

SEQ ID NO: 1581215 - DNA, 12 bp, Homo sapiens
ccaccctcccct

SEQ ID NO: 1581216 - DNA, 18 bp, Homo sapiens
ccaccctcccctatgctg

SEQ ID NO: 1581217 - DNA, 21 bp, Homo sapiens
ccaccctgagccggccccagg

SEQ ID NO: 1581218 - DNA, 21 bp, Homo sapiens
ccaccctgagttgcttttcag

SEQ ID NO: 1581219 - DNA, 19 bp, Homo sapiens
ccaccctgccaagactcct

SEQ ID NO: 1581220 - DNA, 21 bp, Homo sapiens
ccaccctgccaagactcctca

SEQ ID NO: 1581221 - DNA, 13 bp, Homo sapiens
ccaccctgctcat

SEQ ID NO: 1581222 - DNA, 20 bp, Homo sapiens
ccaccctgctcatccactct

SEQ ID NO: 1581223 - DNA, 16 bp, Homo sapiens
ccaccctgctgctggt

SEQ ID NO: 1581224 - DNA, 11 bp, Homo sapiens
ccaccctggaa

SEQ ID NO: 1581225 - DNA, 12 bp, Homo sapiens
ccaccctggaga

SEQ ID NO: 1581226 - DNA, 12 bp, Homo sapiens
ccaccctggcag

SEQ ID NO: 1581227 - DNA, 12 bp, Homo sapiens
ccaccctgggcc

SEQ ID NO: 1581228 - DNA, 17 bp, Homo sapiens
ccaccctgggccctggg

SEQ ID NO: 1581229 - DNA, 20 bp, Homo sapiens
ccaccctgggccctgggctg

SEQ ID NO: 1581230 - DNA, 12 bp, Homo sapiens
ccaccctgggct

SEQ ID NO: 1581231 - DNA, 15 bp, Homo sapiens
ccaccctgggctcca

SEQ ID NO: 1581232 - DNA, 14 bp, Homo sapiens
ccaccctgtccccc

SEQ ID NO: 1581233 - DNA, 22 bp, Homo sapiens
ccaccctgtcccccagctctgg

SEQ ID NO: 1581234 - DNA, 12 bp, Homo sapiens
ccacccttccat

SEQ ID NO: 1581235 - DNA, 16 bp, Homo sapiens
ccacccttccatcagc

SEQ ID NO: 1581236 - DNA, 14 bp, Homo sapiens
ccacccttggcctg

SEQ ID NO: 1581237 - DNA, 15 bp, Homo sapiens
ccacccttggcctgt

SEQ ID NO: 1581238 - DNA, 16 bp, Homo sapiens
ccacccttggcctgtc

SEQ ID NO: 1581239 - DNA, 17 bp, Homo sapiens
ccaccgaccaactgccc

SEQ ID NO: 1581240 - DNA, 22 bp, Homo sapiens
ccaccgcagcgtcccccgccgc

SEQ ID NO: 1581241 - DNA, 21 bp, Homo sapiens
ccaccgcaggggactgtctca

SEQ ID NO: 1581242 - DNA, 17 bp, Homo sapiens
ccaccgcccagagaccc

SEQ ID NO: 1581243 - DNA, 12 bp, Homo sapiens
ccaccgccccca

SEQ ID NO: 1581244 - DNA, 14 bp, Homo sapiens
ccaccgcctctggc

SEQ ID NO: 1581245 - DNA, 15 bp, Homo sapiens
ccaccgctgccagca

SEQ ID NO: 1581246 - DNA, 20 bp, Homo sapiens
ccaccgctgccagcacagag

SEQ ID NO: 1581247 - DNA, 20 bp, Homo sapiens
ccaccggaggtcactccacc

SEQ ID NO: 1581248 - DNA, 14 bp, Homo sapiens
ccaccggcctcggc

SEQ ID NO: 1581249 - DNA, 19 bp, Homo sapiens
ccaccgggacagacctgga

SEQ ID NO: 1581250 - DNA, 21 bp, Homo sapiens
ccaccgggacagacctggaca

SEQ ID NO: 1581251 - DNA, 22 bp, Homo sapiens
ccaccgggacagacctggacac

SEQ ID NO: 1581252 - DNA, 21 bp, Homo sapiens
ccaccgggttctgcagcggca

SEQ ID NO: 1581253 - DNA, 23 bp, Homo sapiens
ccaccgggttctgcagcggcaga

SEQ ID NO: 1581254 - DNA, 16 bp, Homo sapiens
ccaccgtccgccctgc

SEQ ID NO: 1581255 - DNA, 18 bp, Homo sapiens
ccaccgtccgccctgctc

SEQ ID NO: 1581256 - DNA, 20 bp, Homo sapiens
ccaccgtccgccctgctcct

SEQ ID NO: 1581257 - DNA, 13 bp, Homo sapiens
ccaccgtggagga

SEQ ID NO: 1581258 - DNA, 21 bp, Homo sapiens
ccaccgtttcttcctgccagc

SEQ ID NO: 1581259 - DNA, 17 bp, Homo sapiens
ccacctacacaggagtc

SEQ ID NO: 1581260 - DNA, 23 bp, Homo sapiens
ccacctacttttctttcctcaga

SEQ ID NO: 1581261 - DNA, 18 bp, Homo sapiens
ccacctagaacactaact

SEQ ID NO: 1581262 - DNA, 17 bp, Homo sapiens
ccacctaggccactcct

SEQ ID NO: 1581263 - DNA, 15 bp, Homo sapiens
ccacctagtgcccca

SEQ ID NO: 1581264 - DNA, 20 bp, Homo sapiens
ccacctagtgccccagactg

SEQ ID NO: 1581265 - DNA, 15 bp, Homo sapiens
ccacctatgccagtg

SEQ ID NO: 1581266 - DNA, 18 bp, Homo sapiens
ccacctatgccagtgctc

SEQ ID NO: 1581267 - DNA, 20 bp, Homo sapiens
ccacctatgccagtgctcaa

SEQ ID NO: 1581268 - DNA, 14 bp, Homo sapiens
ccacctcacagcta

SEQ ID NO: 1581269 - DNA, 19 bp, Homo sapiens
ccacctcacctagcctgat

SEQ ID NO: 1581270 - DNA, 16 bp, Homo sapiens
ccacctcactcctgtt

SEQ ID NO: 1581271 - DNA, 18 bp, Homo sapiens
ccacctcactcctgttac

SEQ ID NO: 1581272 - DNA, 14 bp, Homo sapiens
ccacctcagcctcc

SEQ ID NO: 1581273 - DNA, 12 bp, Homo sapiens
ccacctcagggc

SEQ ID NO: 1581274 - DNA, 20 bp, Homo sapiens
ccacctcagggcacgcagga

SEQ ID NO: 1581275 - DNA, 15 bp, Homo sapiens
ccacctcatcactgg

SEQ ID NO: 1581276 - DNA, 15 bp, Homo sapiens
ccacctcccacccca

SEQ ID NO: 1581277 - DNA, 17 bp, Homo sapiens
ccacctcccaccccact

SEQ ID NO: 1581278 - DNA, 18 bp, Homo sapiens
ccacctcccaccccactc

SEQ ID NO: 1581279 - DNA, 13 bp, Homo sapiens
ccacctccccctc

SEQ ID NO: 1581280 - DNA, 18 bp, Homo sapiens
ccacctcctagaggtggg

SEQ ID NO: 1581281 - DNA, 12 bp, Homo sapiens
ccacctcctccc

SEQ ID NO: 1581282 - DNA, 19 bp, Homo sapiens
ccacctcctccccctgttc

SEQ ID NO: 1581283 - DNA, 17 bp, Homo sapiens
ccacctctctcctttgc

SEQ ID NO: 1581284 - DNA, 24 bp, Homo sapiens
ccacctctctcctttgctgaggcc

SEQ ID NO: 1581285 - DNA, 14 bp, Homo sapiens
ccacctctggtggc

SEQ ID NO: 1581286 - DNA, 15 bp, Homo sapiens
ccacctctggtggct

SEQ ID NO: 1581287 - DNA, 16 bp, Homo sapiens
ccacctgacacaccag

SEQ ID NO: 1581288 - DNA, 23 bp, Homo sapiens
ccacctgacacaccaggcgctaa

SEQ ID NO: 1581289 - DNA, 15 bp, Homo sapiens
ccacctgaggtgggc

SEQ ID NO: 1581290 - DNA, 22 bp, Homo sapiens
ccacctgaggtgggcccaggac

SEQ ID NO: 1581291 - DNA, 22 bp, Homo sapiens
ccacctgaggtgggctggggct

SEQ ID NO: 1581292 - DNA, 11 bp, Homo sapiens
ccacctgcaag

SEQ ID NO: 1581293 - DNA, 12 bp, Homo sapiens
ccacttgtgggc

SEQ ID NO: 1581294 - DNA, 15 bp, Homo sapiens
ccacttgtgggcttc

SEQ ID NO: 1581295 - DNA, 22 bp, Homo sapiens
ccacttgtgggcttcaggtgtt

SEQ ID NO: 1581296 - DNA, 22 bp, Homo sapiens
ccactttcagagcccccagccc

SEQ ID NO: 1581297 - DNA, 16 bp, Homo sapiens
ccactttcctgagctg

SEQ ID NO: 1581298 - DNA, 21 bp, Homo sapiens
ccactttcctgagctgtcgct

SEQ ID NO: 1581299 - DNA, 20 bp, Homo sapiens
ccactttggcttctcctgtg

SEQ ID NO: 1581300 - DNA, 21 bp, Homo sapiens
ccactttggcttctcctgtga

SEQ ID NO: 1581301 - DNA, 18 bp, Homo sapiens
ccactttgtaatttttgc

SEQ ID NO: 1581302 - DNA, 15 bp, Homo sapiens
ccacttttttttccc

SEQ ID NO: 1581303 - DNA, 15 bp, Homo sapiens
ccagaaaaccccagc

SEQ ID NO: 1581304 - DNA, 20 bp, Homo sapiens
ccagaaacacccctctgtct

SEQ ID NO: 1581305 - DNA, 12 bp, Homo sapiens
ccagaaagaaaa

SEQ ID NO: 1581306 - DNA, 19 bp, Homo sapiens
ccagaaagcaggagcagct

SEQ ID NO: 1581307 - DNA, 22 bp, Homo sapiens
ccagaaagcaggagcagctgtg

SEQ ID NO: 1581308 - DNA, 18 bp, Homo sapiens
ccagaaagcctctctctc

SEQ ID NO: 1581309 - DNA, 14 bp, Homo sapiens
ccagaaaggagact

SEQ ID NO: 1581310 - DNA, 16 bp, Homo sapiens
ccagaaaggatattta

SEQ ID NO: 1581311 - DNA, 20 bp, Homo sapiens
ccagaaaggatatttaagaa

SEQ ID NO: 1581312 - DNA, 15 bp, Homo sapiens
ccagaaagtaaaggt

SEQ ID NO: 1581313 - DNA, 10 bp, Homo sapiens
ccagaaattc

SEQ ID NO: 1581314 - DNA, 22 bp, Homo sapiens
ccagaaattctggcccagccaa

SEQ ID NO: 1581315 - DNA, 20 bp, Homo sapiens
ccagaacacggctcacgctt

SEQ ID NO: 1581316 - DNA, 13 bp, Homo sapiens
ccagaacagccct

SEQ ID NO: 1581317 - DNA, 15 bp, Homo sapiens
ccagaacagccctcg

SEQ ID NO: 1581318 - DNA, 15 bp, Homo sapiens
ccagaacatacactg

SEQ ID NO: 1581319 - DNA, 16 bp, Homo sapiens
ccagaacgtggtttgc

SEQ ID NO: 1581320 - DNA, 19 bp, Homo sapiens
ccagaactttgggaggcca

SEQ ID NO: 1581321 - DNA, 19 bp, Homo sapiens
ccagaagaagagaagctgc

SEQ ID NO: 1581322 - DNA, 21 bp, Homo sapiens
ccagaagaagagaagctgctg

SEQ ID NO: 1581323 - DNA, 23 bp, Homo sapiens
ccagaagaagagaagctgctgac

SEQ ID NO: 1581324 - DNA, 17 bp, Homo sapiens
ccagaagaatattcagg

SEQ ID NO: 1581325 - DNA, 18 bp, Homo sapiens
ccagaagaatattcagga

SEQ ID NO: 1581326 - DNA, 20 bp, Homo sapiens
ccagaagaatattcaggact

SEQ ID NO: 1581327 - DNA, 21 bp, Homo sapiens
ccagaagatgccagcttctct

SEQ ID NO: 1581328 - DNA, 16 bp, Homo sapiens
ccagaagccaaagact

SEQ ID NO: 1581329 - DNA, 20 bp, Homo sapiens
ccagaagcctctggctagag

SEQ ID NO: 1581330 - DNA, 11 bp, Homo sapiens
ccagaagctgc

SEQ ID NO: 1581331 - DNA, 17 bp, Homo sapiens
ccagaagctgtactttt

SEQ ID NO: 1581332 - DNA, 16 bp, Homo sapiens
ccagaaggagggcaga

SEQ ID NO: 1581333 - DNA, 18 bp, Homo sapiens
ccagaaggagggcagagc

SEQ ID NO: 1581334 - DNA, 21 bp, Homo sapiens
ccagaaggagggcagagccat

SEQ ID NO: 1581335 - DNA, 23 bp, Homo sapiens
ccagaaggagggcagagccatgg

SEQ ID NO: 1581336 - DNA, 12 bp, Homo sapiens
ccagaaggcagg

SEQ ID NO: 1581337 - DNA, 20 bp, Homo sapiens
ccagaagtaccagactagat

SEQ ID NO: 1581338 - DNA, 22 bp, Homo sapiens
ccagaatactgggttcttagtt

SEQ ID NO: 1581339 - DNA, 19 bp, Homo sapiens
ccagaatccataaatgtgt

SEQ ID NO: 1581340 - DNA, 13 bp, Homo sapiens
ccagaatctgctg

SEQ ID NO: 1581341 - DNA, 15 bp, Homo sapiens
ccagaatctgctgtt

SEQ ID NO: 1581342 - DNA, 18 bp, Homo sapiens
ccagaatctgctgttgcc

SEQ ID NO: 1581343 - DNA, 10 bp, Homo sapiens
ccagaatctt

SEQ ID NO: 1581344 - DNA, 17 bp, Homo sapiens
ccagaatcttgactttc

SEQ ID NO: 1581345 - DNA, 15 bp, Homo sapiens
ccagaatggagcctg

SEQ ID NO: 1581346 - DNA, 15 bp, Homo sapiens
ccagaattcccttga

SEQ ID NO: 1581347 - DNA, 17 bp, Homo sapiens
ccagaattcccttgaat

SEQ ID NO: 1581348 - DNA, 17 bp, Homo sapiens
ccagacaattccattca

SEQ ID NO: 1581349 - DNA, 16 bp, Homo sapiens
ccagacacatgggctt

SEQ ID NO: 1581350 - DNA, 22 bp, Homo sapiens
ccagacacatgggcttgtgaca

SEQ ID NO: 1581351 - DNA, 16 bp, Homo sapiens
ccagacacccaggact

SEQ ID NO: 1581352 - DNA, 15 bp, Homo sapiens
ccagacactctgctc

SEQ ID NO: 1581353 - DNA, 20 bp, Homo sapiens
ccagacatggtgtctcacac

SEQ ID NO: 1581354 - DNA, 14 bp, Homo sapiens
ccagaccatgggcc

SEQ ID NO: 1581355 - DNA, 12 bp, Homo sapiens
ccagaccccgcc

SEQ ID NO: 1581356 - DNA, 21 bp, Homo sapiens
ccagacccctctggccaggat

SEQ ID NO: 1581357 - DNA, 16 bp, Homo sapiens
ccagacccctggcttt

SEQ ID NO: 1581358 - DNA, 18 bp, Homo sapiens
ccagacccctggcttttc

SEQ ID NO: 1581359 - DNA, 13 bp, Homo sapiens
ccagaccctgaag

SEQ ID NO: 1581360 - DNA, 13 bp, Homo sapiens
ccagaccctgggc

SEQ ID NO: 1581361 - DNA, 21 bp, Homo sapiens
ccagacctgaatgcttctgag

SEQ ID NO: 1581362 - DNA, 17 bp, Homo sapiens
ccagacctgatcctgga

SEQ ID NO: 1581363 - DNA, 20 bp, Homo sapiens
ccagacctgatcctggaggc

SEQ ID NO: 1581364 - DNA, 24 bp, Homo sapiens
ccagacctgatcctggaggcccag

SEQ ID NO: 1581365 - DNA, 12 bp, Homo sapiens
ccagacctggaa

SEQ ID NO: 1581366 - DNA, 13 bp, Homo sapiens
ccagacctggctc

SEQ ID NO: 1581367 - DNA, 19 bp, Homo sapiens
ccagacctgtcgtctctcc

SEQ ID NO: 1581368 - DNA, 17 bp, Homo sapiens
ccagacggttcaccagc

SEQ ID NO: 1581369 - DNA, 12 bp, Homo sapiens
ccagactacagg

SEQ ID NO: 1581370 - DNA, 14 bp, Homo sapiens
ccagactacagggc

SEQ ID NO: 1581371 - DNA, 15 bp, Homo sapiens
ccagactcaggttcc

SEQ ID NO: 1581372 - DNA, 18 bp, Homo sapiens
ccagactcaggttccaga

SEQ ID NO: 1581373 - DNA, 18 bp, Homo sapiens
ccagactctttttttgag

SEQ ID NO: 1581374 - DNA, 14 bp, Homo sapiens
ccagactgagctct

SEQ ID NO: 1581375 - DNA, 15 bp, Homo sapiens
ccagactgagctctc

SEQ ID NO: 1581376 - DNA, 17 bp, Homo sapiens
ccagactgagctctcca

SEQ ID NO: 1581377 - DNA, 18 bp, Homo sapiens
ccagactgagctctccag

SEQ ID NO: 1581378 - DNA, 20 bp, Homo sapiens
ccagactgagctctccaggc

SEQ ID NO: 1581379 - DNA, 23 bp, Homo sapiens
ccagactgagctctccaggccag

SEQ ID NO: 1581380 - DNA, 24 bp, Homo sapiens
ccagactgagctctccaggccagg

SEQ ID NO: 1581381 - DNA, 20 bp, Homo sapiens
ccagactggaagacacttca

SEQ ID NO: 1581382 - DNA, 12 bp, Homo sapiens
ccagactgggcc

SEQ ID NO: 1581383 - DNA, 21 bp, Homo sapiens
ccagactgggcccaggcaggt

SEQ ID NO: 1581384 - DNA, 19 bp, Homo sapiens
ccagactgtctccacggcc

SEQ ID NO: 1581385 - DNA, 14 bp, Homo sapiens
ccagacttccttga

SEQ ID NO: 1581386 - DNA, 15 bp, Homo sapiens
ccagacttgcttcct

SEQ ID NO: 1581387 - DNA, 23 bp, Homo sapiens
ccagagaaaggggagcccactgt

SEQ ID NO: 1581388 - DNA, 16 bp, Homo sapiens
ccagagaaggacggtg

SEQ ID NO: 1581389 - DNA, 16 bp, Homo sapiens
ccagagaatgcacctc

SEQ ID NO: 1581390 - DNA, 13 bp, Homo sapiens
ccagagacaggaa

SEQ ID NO: 1581391 - DNA, 17 bp, Homo sapiens
ccagcaacacagcctgg

SEQ ID NO: 1581392 - DNA, 19 bp, Homo sapiens
ccagcaacacagcctgggc

SEQ ID NO: 1581393 - DNA, 18 bp, Homo sapiens
ccagcaacgcccctccaa

SEQ ID NO: 1581394 - DNA, 16 bp, Homo sapiens
ccagcaactgcccttc

SEQ ID NO: 1581395 - DNA, 19 bp, Homo sapiens
ccagcaactgcccttccag

SEQ ID NO: 1581396 - DNA, 14 bp, Homo sapiens
ccagcacacacaca

SEQ ID NO: 1581397 - DNA, 17 bp, Homo sapiens
ccagcacaccaagtggc

SEQ ID NO: 1581398 - DNA, 19 bp, Homo sapiens
ccagcacaccaagtggctg

SEQ ID NO: 1581399 - DNA, 20 bp, Homo sapiens
ccagcacaccaagtggctgg

SEQ ID NO: 1581400 - DNA, 18 bp, Homo sapiens
ccagcacaggggccccag

SEQ ID NO: 1581401 - DNA, 20 bp, Homo sapiens
ccagcacaggggccccagat

SEQ ID NO: 1581402 - DNA, 22 bp, Homo sapiens
ccagcacaggggccccagatct

SEQ ID NO: 1581403 - DNA, 19 bp, Homo sapiens
ccagcacagtaggtcccgg

SEQ ID NO: 1581404 - DNA, 20 bp, Homo sapiens
ccagcacatggccatagagg

SEQ ID NO: 1581405 - DNA, 22 bp, Homo sapiens
ccagcacatggccatagaggcc

SEQ ID NO: 1581406 - DNA, 24 bp, Homo sapiens
ccagcacatggccatagaggccca

SEQ ID NO: 1581407 - DNA, 12 bp, Homo sapiens
ccagcaccgagc

SEQ ID NO: 1581408 - DNA, 17 bp, Homo sapiens
ccagcacctcagcctgc

SEQ ID NO: 1581409 - DNA, 15 bp, Homo sapiens
ccagcacctgctccc

SEQ ID NO: 1581410 - DNA, 16 bp, Homo sapiens
ccagcaccttgtgcct

SEQ ID NO: 1581411 - DNA, 17 bp, Homo sapiens
ccagcactaaagcagtg

SEQ ID NO: 1581412 - DNA, 24 bp, Homo sapiens
ccagcactaaagcagtggacacca

SEQ ID NO: 1581413 - DNA, 20 bp, Homo sapiens
ccacttcttaaaggcctgga

SEQ ID NO: 1581414 - DNA, 23 bp, Homo sapiens
ccacttcttaaaggcctggaacc

SEQ ID NO: 1581415 - DNA, 14 bp, Homo sapiens
ccacttgaaatgtt

SEQ ID NO: 1581416 - DNA, 14 bp, Homo sapiens
ccacttgacattcc

SEQ ID NO: 1581417 - DNA, 16 bp, Homo sapiens
ccacttgacattcctt

SEQ ID NO: 1581418 - DNA, 18 bp, Homo sapiens
ccacttgaggcctgatct

SEQ ID NO: 1581419 - DNA, 20 bp, Homo sapiens
ccacttgaggcctgatctgc

SEQ ID NO: 1581420 - DNA, 24 bp, Homo sapiens
ccacttgaggcctgatctgcccat

SEQ ID NO: 1581421 - DNA, 18 bp, Homo sapiens
ccacttgcaacttctttc

SEQ ID NO: 1581422 - DNA, 20 bp, Homo sapiens
ccacttgtcaaagaaggtgc

SEQ ID NO: 1581423 - DNA, 15 bp, Homo sapiens
ccacttgtccgctgg

SEQ ID NO: 1581424 - DNA, 12 bp, Homo sapiens
ccagcactgagg

SEQ ID NO: 1581425 - DNA, 14 bp, Homo sapiens
ccagcactgaggaa

SEQ ID NO: 1581426 - DNA, 15 bp, Homo sapiens
ccagcactgaggaag

SEQ ID NO: 1581427 - DNA, 22 bp, Homo sapiens
ccagcactgaggaagaacgggg

SEQ ID NO: 1581428 - DNA, 23 bp, Homo sapiens
ccagcactggaggggcccaccca

SEQ ID NO: 1581429 - DNA, 12 bp, Homo sapiens
ccagcactgtga

SEQ ID NO: 1581430 - DNA, 18 bp, Homo sapiens
ccagcactgtgaagaccc

SEQ ID NO: 1581431 - DNA, 20 bp, Homo sapiens
ccagcactgtgaagacccag

SEQ ID NO: 1581432 - DNA, 11 bp, Homo sapiens
ccagcactttg

SEQ ID NO: 1581433 - DNA, 21 bp, Homo sapiens
ccagcactttgagaggctgag

SEQ ID NO: 1581434 - DNA, 15 bp, Homo sapiens
ccagcactttgggag

SEQ ID NO: 1581435 - DNA, 24 bp, Homo sapiens
ccagcactttgggaggccgaggtg

SEQ ID NO: 1581436 - DNA, 20 bp, Homo sapiens
ccagcactttgggaggctga

SEQ ID NO: 1581437 - DNA, 21 bp, Homo sapiens
ccagcactttgggaggctgag

SEQ ID NO: 1581438 - DNA, 15 bp, Homo sapiens
ccagcagaagacaaa

SEQ ID NO: 1581439 - DNA, 19 bp, Homo sapiens
ccagcagaatggaggcagg

SEQ ID NO: 1581440 - DNA, 16 bp, Homo sapiens
ccagcagacagagcca

SEQ ID NO: 1581441 - DNA, 18 bp, Homo sapiens
ccagcagacagagccagg

SEQ ID NO: 1581442 - DNA, 20 bp, Homo sapiens
ccagcagacagagccaggag

SEQ ID NO: 1581443 - DNA, 21 bp, Homo sapiens
ccagcagatcccagctcacgt

SEQ ID NO: 1581444 - DNA, 13 bp, Homo sapiens
ccagcagcacacc

SEQ ID NO: 1581445 - DNA, 15 bp, Homo sapiens
ccagcagcacacctc

SEQ ID NO: 1581446 - DNA, 16 bp, Homo sapiens
ccagcagcacacctca

SEQ ID NO: 1581447 - DNA, 20 bp, Homo sapiens
ccagcagcacacctcagccc

SEQ ID NO: 1581448 - DNA, 17 bp, Homo sapiens
ccagcagcactggaacc

SEQ ID NO: 1581449 - DNA, 15 bp, Homo sapiens
ccagcagcagcaggt

SEQ ID NO: 1581450 - DNA, 13 bp, Homo sapiens
ccagcagcatggc

SEQ ID NO: 1581451 - DNA, 23 bp, Homo sapiens
ccagcagcatggcatagccccgg

SEQ ID NO: 1581452 - DNA, 18 bp, Homo sapiens
ccagcagccagctctcag

SEQ ID NO: 1581453 - DNA, 19 bp, Homo sapiens
ccagcagccagctctcagc

SEQ ID NO: 1581454 - DNA, 12 bp, Homo sapiens
ccagcagcccta

SEQ ID NO: 1581455 - DNA, 21 bp, Homo sapiens
ccagcagccctaaggatctct

SEQ ID NO: 1581456 - DNA, 12 bp, Homo sapiens
ccagcagcctcg

SEQ ID NO: 1581457 - DNA, 18 bp, Homo sapiens
ccagcagcctcgcacagg

SEQ ID NO: 1581458 - DNA, 22 bp, Homo sapiens
ccagcagcctcgcacaggccct

SEQ ID NO: 1581459 - DNA, 23 bp, Homo sapiens
ccagcagctcaacctaccctggt

SEQ ID NO: 1581460 - DNA, 21 bp, Homo sapiens
ccagcagctgatgcctccttg

SEQ ID NO: 1581461 - DNA, 22 bp, Homo sapiens
ccagcagctgatgcctccttgg

SEQ ID NO: 1581462 - DNA, 23 bp, Homo sapiens
ccagcagctgcgggtctgaagga

SEQ ID NO: 1581463 - DNA, 22 bp, Homo sapiens
ccagcaggagagactgagcagc

SEQ ID NO: 1581464 - DNA, 12 bp, Homo sapiens
ccagcaggccca

SEQ ID NO: 1581465 - DNA, 13 bp, Homo sapiens
ccagcaggcccag

SEQ ID NO: 1581466 - DNA, 14 bp, Homo sapiens
ccagcaggcccagc

SEQ ID NO: 1581467 - DNA, 20 bp, Homo sapiens
ccagcaggcccagcatgcag

SEQ ID NO: 1581468 - DNA, 21 bp, Homo sapiens
ccagcaggctcctggctgtgc

SEQ ID NO: 1581469 - DNA, 15 bp, Homo sapiens
ccagcagggctgtga

SEQ ID NO: 1581470 - DNA, 12 bp, Homo sapiens
ccagcaggggcc

SEQ ID NO: 1581471 - DNA, 19 bp, Homo sapiens
ccagcaggggggctgtgcc

SEQ ID NO: 1581472 - DNA, 17 bp, Homo sapiens
ccagcagtctgcctgga

SEQ ID NO: 1581473 - DNA, 15 bp, Homo sapiens
ccagcagtgaatgct

SEQ ID NO: 1581474 - DNA, 18 bp, Homo sapiens
ccagcatcacctgcctgt

SEQ ID NO: 1581475 - DNA, 13 bp, Homo sapiens
ccagcatccagcc

SEQ ID NO: 1581476 - DNA, 17 bp, Homo sapiens
ccagcatccagcctgtg

SEQ ID NO: 1581477 - DNA, 19 bp, Homo sapiens
ccagcatccagcctgtgtg

SEQ ID NO: 1581478 - DNA, 19 bp, Homo sapiens
ccagcatccctggagcagg

SEQ ID NO: 1581479 - DNA, 21 bp, Homo sapiens
ccagcatccttttctgcagag

SEQ ID NO: 1581480 - DNA, 16 bp, Homo sapiens
ccagcatctcccagca

SEQ ID NO: 1581481 - DNA, 16 bp, Homo sapiens
ccagcattcagcacac

SEQ ID NO: 1581482 - DNA, 13 bp, Homo sapiens
ccagcattccagc

SEQ ID NO: 1581483 - DNA, 17 bp, Homo sapiens
ccagcattccagcccct

SEQ ID NO: 1581484 - DNA, 19 bp, Homo sapiens
ccagcattccagcccctct

SEQ ID NO: 1581485 - DNA, 20 bp, Homo sapiens
ccagcattccagcccctctg

SEQ ID NO: 1581486 - DNA, 15 bp, Homo sapiens
ccagcattccagctc

SEQ ID NO: 1581487 - DNA, 16 bp, Homo sapiens
ccagcattccagctct

SEQ ID NO: 1581488 - DNA, 20 bp, Homo sapiens
ccagcattccagctctgccc

SEQ ID NO: 1581489 - DNA, 21 bp, Homo sapiens
ccagcattccagctctgcccc

SEQ ID NO: 1581490 - DNA, 13 bp, Homo sapiens
ccagcattgctgg

SEQ ID NO: 1581491 - DNA, 19 bp, Homo sapiens
ccagcatttagctggccac

SEQ ID NO: 1581492 - DNA, 20 bp, Homo sapiens
ccagcatttagctggccaca

SEQ ID NO: 1581493 - DNA, 19 bp, Homo sapiens
ccagccaaaccctgtctga

SEQ ID NO: 1581494 - DNA, 22 bp, Homo sapiens
ccagccaacttttgcatgtttt

SEQ ID NO: 1581495 - DNA, 14 bp, Homo sapiens
ccagccaagggtcc

SEQ ID NO: 1581496 - DNA, 18 bp, Homo sapiens
ccagccaagggtcctcac

SEQ ID NO: 1581497 - DNA, 21 bp, Homo sapiens
ccagccaatctagaggcaagc

SEQ ID NO: 1581498 - DNA, 9 bp, Homo sapiens
ccagccaca

SEQ ID NO: 1581499 - DNA, 12 bp, Homo sapiens
ccagccacagac

SEQ ID NO: 1581500 - DNA, 15 bp, Homo sapiens
ccagccacagagcaa

SEQ ID NO: 1581501 - DNA, 15 bp, Homo sapiens
ccagccacaggccaa

SEQ ID NO: 1581502 - DNA, 13 bp, Homo sapiens
ccagccaccccgg

SEQ ID NO: 1581503 - DNA, 14 bp, Homo sapiens
ccagccacgcaggg

SEQ ID NO: 1581504 - DNA, 17 bp, Homo sapiens
ccagccacgcagggcca

SEQ ID NO: 1581505 - DNA, 18 bp, Homo sapiens
ccagccacgcagggccat

SEQ ID NO: 1581506 - DNA, 24 bp, Homo sapiens
ccagccacgcagggccatccactg

SEQ ID NO: 1581507 - DNA, 20 bp, Homo sapiens
ccagccagaggcatctgagg

SEQ ID NO: 1581508 - DNA, 22 bp, Homo sapiens
ccagccagcagcagcccaagct

SEQ ID NO: 1581509 - DNA, 13 bp, Homo sapiens
ccagccagcagcc

SEQ ID NO: 1581510 - DNA, 16 bp, Homo sapiens
ccagccagcagccagc

SEQ ID NO: 1581511 - DNA, 14 bp, Homo sapiens
ccagccagcgtccc

SEQ ID NO: 1581512 - DNA, 14 bp, Homo sapiens
ccagccaggagcag

SEQ ID NO: 1581513 - DNA, 12 bp, Homo sapiens
ccagccaggcag

SEQ ID NO: 1581514 - DNA, 17 bp, Homo sapiens
ccagccaggccaacagc

SEQ ID NO: 1581515 - DNA, 18 bp, Homo sapiens
ccatagcaagattgctta

SEQ ID NO: 1581516 - DNA, 14 bp, Homo sapiens
ccataggacatact

SEQ ID NO: 1581517 - DNA, 20 bp, Homo sapiens
ccataggactaccgcaggcc

SEQ ID NO: 1581518 - DNA, 21 bp, Homo sapiens
ccataggactaccgcaggccc

SEQ ID NO: 1581519 - DNA, 14 bp, Homo sapiens
ccatagtgactttt

SEQ ID NO: 1581520 - DNA, 19 bp, Homo sapiens
ccatagtggggcctgggag

SEQ ID NO: 1581521 - DNA, 17 bp, Homo sapiens
ccatagttactgtaaaa

SEQ ID NO: 1581522 - DNA, 19 bp, Homo sapiens
ccatataagtttgaaggaa

SEQ ID NO: 1581523 - DNA, 22 bp, Homo sapiens
ccatataagtttgaaggaaaca

SEQ ID NO: 1581524 - DNA, 17 bp, Homo sapiens
ccatatgattgaaaaga

SEQ ID NO: 1581525 - DNA, 12 bp, Homo sapiens
ccatatgctcca

SEQ ID NO: 1581526 - DNA, 16 bp, Homo sapiens
ccatatggaggcctga

SEQ ID NO: 1581527 - DNA, 22 bp, Homo sapiens
ccatatgtcagtgtaaatcctt

SEQ ID NO: 1581528 - DNA, 22 bp, Homo sapiens
ccatatgtgtgaattctgcaac

SEQ ID NO: 1581529 - DNA, 14 bp, Homo sapiens
ccatatgttacact

SEQ ID NO: 1581530 - DNA, 14 bp, Homo sapiens
ccatattaaaatct

SEQ ID NO: 1581531 - DNA, 12 bp, Homo sapiens
ccatatttattc

SEQ ID NO: 1581532 - DNA, 21 bp, Homo sapiens
ccatcaaacctcacatttgtg

SEQ ID NO: 1581533 - DNA, 22 bp, Homo sapiens
ccatcaactaaagttgtacttt

SEQ ID NO: 1581534 - DNA, 21 bp, Homo sapiens
ccatcaactcccaacttcttc

SEQ ID NO: 1581535 - DNA, 23 bp, Homo sapiens
ccatcaactcccaacttcttcct

SEQ ID NO: 1581536 - DNA, 12 bp, Homo sapiens
ccatcaagcact

SEQ ID NO: 1581537 - DNA, 15 bp, Homo sapiens
ccatcaagcacttcc

SEQ ID NO: 1581538 - DNA, 17 bp, Homo sapiens
ccatcaagcacttccca

SEQ ID NO: 1581539 - DNA, 19 bp, Homo sapiens
ccatcaagcacttcccagg

SEQ ID NO: 1581540 - DNA, 20 bp, Homo sapiens
ccatcaagcacttcccagga

SEQ ID NO: 1581541 - DNA, 21 bp, Homo sapiens
ccatcaaggcgggagggcctg

SEQ ID NO: 1581542 - DNA, 17 bp, Homo sapiens
ccatcaataaagtaccc

SEQ ID NO: 1581543 - DNA, 20 bp, Homo sapiens
ccatcacagggttgggccca

SEQ ID NO: 1581544 - DNA, 15 bp, Homo sapiens
ccatcaccaccgcct

SEQ ID NO: 1581545 - DNA, 16 bp, Homo sapiens
ccatcacttctccccg

SEQ ID NO: 1581546 - DNA, 13 bp, Homo sapiens
ccatcagatattt

SEQ ID NO: 1581547 - DNA, 18 bp, Homo sapiens
ccatcagcgggtctcctc

SEQ ID NO: 1581548 - DNA, 22 bp, Homo sapiens
ccatcagcgggtctcctcccag

SEQ ID NO: 1581549 - DNA, 20 bp, Homo sapiens
ccatcagttcccccagtacc

SEQ ID NO: 1581550 - DNA, 15 bp, Homo sapiens
ccatcataggaaggg

SEQ ID NO: 1581551 - DNA, 17 bp, Homo sapiens
ccatcatcctttgttct

SEQ ID NO: 1581552 - DNA, 14 bp, Homo sapiens
ccatcatgcccagc

SEQ ID NO: 1581553 - DNA, 10 bp, Homo sapiens
ccatcatgtc

SEQ ID NO: 1581554 - DNA, 13 bp, Homo sapiens
ccatcatgtctgt

SEQ ID NO: 1581555 - DNA, 18 bp, Homo sapiens
ccatcattgcacctgcag

SEQ ID NO: 1581556 - DNA, 15 bp, Homo sapiens
ccatccactgtgacg

SEQ ID NO: 1581557 - DNA, 16 bp, Homo sapiens
ccatccagacctggct

SEQ ID NO: 1581558 - DNA, 12 bp, Homo sapiens
ccatccagccag

SEQ ID NO: 1581559 - DNA, 13 bp, Homo sapiens
ccatccagcctcc

SEQ ID NO: 1581560 - DNA, 17 bp, Homo sapiens
ccatccagcctccaggg

SEQ ID NO: 1581561 - DNA, 18 bp, Homo sapiens
ccatccagcctccagggc

SEQ ID NO: 1581562 - DNA, 19 bp, Homo sapiens
ccatccagcctccagggca

SEQ ID NO: 1581563 - DNA, 14 bp, Homo sapiens
ccatccattctgga

SEQ ID NO: 1581564 - DNA, 15 bp, Homo sapiens
ccatccattctggaa

SEQ ID NO: 1581565 - DNA, 16 bp, Homo sapiens
ccatcccacaccctgg

SEQ ID NO: 1581566 - DNA, 22 bp, Homo sapiens
ccatcccacccccgaccctgcc

SEQ ID NO: 1581567 - DNA, 15 bp, Homo sapiens
ccatcccagtccctc

SEQ ID NO: 1581568 - DNA, 22 bp, Homo sapiens
ccatcccccactgccacaccct

SEQ ID NO: 1581569 - DNA, 14 bp, Homo sapiens
ccatccccctgccc

SEQ ID NO: 1581570 - DNA, 22 bp, Homo sapiens
ccatcccgaagccatcacttct

SEQ ID NO: 1581571 - DNA, 16 bp, Homo sapiens
ccatccctccccagtt

SEQ ID NO: 1581572 - DNA, 13 bp, Homo sapiens
ccatccctgtcat

SEQ ID NO: 1581573 - DNA, 17 bp, Homo sapiens
ccatccctttttttaca

SEQ ID NO: 1581574 - DNA, 23 bp, Homo sapiens
ccatccggtttgccatgttgcca

SEQ ID NO: 1581575 - DNA, 12 bp, Homo sapiens
ccatcctaccct

SEQ ID NO: 1581576 - DNA, 16 bp, Homo sapiens
ccatcctaccctcggg

SEQ ID NO: 1581577 - DNA, 17 bp, Homo sapiens
ccatcctaccctcgggc

SEQ ID NO: 1581578 - DNA, 16 bp, Homo sapiens
ccatcctcatccctga

SEQ ID NO: 1581579 - DNA, 14 bp, Homo sapiens
ccatcctgagccag

SEQ ID NO: 1581580 - DNA, 16 bp, Homo sapiens
ccatcctgagccaggg

SEQ ID NO: 1581581 - DNA, 16 bp, Homo sapiens
ccatcctgcagcctcc

SEQ ID NO: 1581582 - DNA, 16 bp, Homo sapiens
ccatcctggcccctcc

SEQ ID NO: 1581583 - DNA, 18 bp, Homo sapiens
ccatcctggcccctccag

SEQ ID NO: 1581584 - DNA, 19 bp, Homo sapiens
ccatcctggcccctccaga

SEQ ID NO: 1581585 - DNA, 13 bp, Homo sapiens
ccatcctggctgc

SEQ ID NO: 1581586 - DNA, 20 bp, Homo sapiens
ccatcctggggcagcactcc

SEQ ID NO: 1581587 - DNA, 17 bp, Homo sapiens
ccatccttcaccagagc

SEQ ID NO: 1581588 - DNA, 16 bp, Homo sapiens
ccatccttctgtgtac

SEQ ID NO: 1581589 - DNA, 17 bp, Homo sapiens
ccatccttgctgcagct

SEQ ID NO: 1581590 - DNA, 20 bp, Homo sapiens
ccatccttggggccttgtgt

SEQ ID NO: 1581591 - DNA, 17 bp, Homo sapiens
ccatcgccatcttcttc

SEQ ID NO: 1581592 - DNA, 19 bp, Homo sapiens
ccatcgccatcttcttccc

SEQ ID NO: 1581593 - DNA, 15 bp, Homo sapiens
ccatcggccaagaat

SEQ ID NO: 1581594 - DNA, 23 bp, Homo sapiens
ccatcgtgtgtgccttgggtctc

SEQ ID NO: 1581595 - DNA, 15 bp, Homo sapiens
ccatctaaaaatata

SEQ ID NO: 1581596 - DNA, 14 bp, Homo sapiens
ccatctagtcacaa

SEQ ID NO: 1581597 - DNA, 20 bp, Homo sapiens
ccatctagtcacaaagactc

SEQ ID NO: 1581598 - DNA, 17 bp, Homo sapiens
ccatctcaaaacaaaac

SEQ ID NO: 1581599 - DNA, 14 bp, Homo sapiens
ccatctcaggagat

SEQ ID NO: 1581600 - DNA, 23 bp, Homo sapiens
ccatctcaggagatggagggctt

SEQ ID NO: 1581601 - DNA, 14 bp, Homo sapiens
ccatctcaggtgcc

SEQ ID NO: 1581602 - DNA, 15 bp, Homo sapiens
ccatctcaggtgcca

SEQ ID NO: 1581603 - DNA, 22 bp, Homo sapiens
ccatctcaggtgccactccctg

SEQ ID NO: 1581604 - DNA, 13 bp, Homo sapiens
ccatctcatcctg

SEQ ID NO: 1581605 - DNA, 15 bp, Homo sapiens
ccatctcatcctggc

SEQ ID NO: 1581606 - DNA, 20 bp, Homo sapiens
ccatctcatgaggggagagg

SEQ ID NO: 1581607 - DNA, 14 bp, Homo sapiens
ccatctccccaggc

SEQ ID NO: 1581608 - DNA, 19 bp, Homo sapiens
ccatctccccaggcctcca

SEQ ID NO: 1581609 - DNA, 14 bp, Homo sapiens
ccatctccctgcct

SEQ ID NO: 1581610 - DNA, 14 bp, Homo sapiens
ccatctccttcccc

SEQ ID NO: 1581611 - DNA, 20 bp, Homo sapiens
ccatctccttcccccagccc

SEQ ID NO: 1581612 - DNA, 14 bp, Homo sapiens
ccatctcgccaccc

SEQ ID NO: 1581613 - DNA, 18 bp, Homo sapiens
ccatctctcatcctccag

SEQ ID NO: 1581614 - DNA, 17 bp, Homo sapiens
ccatctctccctcccct

SEQ ID NO: 1581615 - DNA, 21 bp, Homo sapiens
ccatctctctactgctggact

SEQ ID NO: 1581616 - DNA, 11 bp, Homo sapiens
ccatctctgcc

SEQ ID NO: 1581617 - DNA, 14 bp, Homo sapiens
ccatctctgcctgt

SEQ ID NO: 1581618 - DNA, 20 bp, Homo sapiens
ccatctgcaccccttctctc

SEQ ID NO: 1581619 - DNA, 22 bp, Homo sapiens
ccatctgcaccccttctctcct

SEQ ID NO: 1581620 - DNA, 12 bp, Homo sapiens
ccatctgcatgg

SEQ ID NO: 1581621 - DNA, 13 bp, Homo sapiens
ccatctgcccagg

SEQ ID NO: 1581622 - DNA, 23 bp, Homo sapiens
ccatctgcccaggggtgccccct

SEQ ID NO: 1581623 - DNA, 22 bp, Homo sapiens
ccatctgctgccccgcttcccc

SEQ ID NO: 1581624 - DNA, 15 bp, Homo sapiens
ccatctggatgtaaa

SEQ ID NO: 1581625 - DNA, 17 bp, Homo sapiens
ccatctgggagtcccct

SEQ ID NO: 1581626 - DNA, 21 bp, Homo sapiens
ccatctgtagtaatttattgt

SEQ ID NO: 1581627 - DNA, 18 bp, Homo sapiens
ccatctgtcttgccagcc

SEQ ID NO: 1581628 - DNA, 20 bp, Homo sapiens
ccatctgtcttgccagccag

SEQ ID NO: 1581629 - DNA, 15 bp, Homo sapiens
ccatcttagtttgga

SEQ ID NO: 1581630 - DNA, 18 bp, Homo sapiens
ccatcttccacctgtgcc

SEQ ID NO: 1581631 - DNA, 19 bp, Homo sapiens
ccatcttccacctgtgccc

SEQ ID NO: 1581632 - DNA, 22 bp, Homo sapiens
ccatgttaatttcatgtgtcaa

SEQ ID NO: 1581633 - DNA, 13 bp, Homo sapiens
ccatgttcattat

SEQ ID NO: 1581634 - DNA, 14 bp, Homo sapiens
ccatgttgcgttca

SEQ ID NO: 1581635 - DNA, 14 bp, Homo sapiens
ccatgttgctgcca

SEQ ID NO: 1581636 - DNA, 15 bp, Homo sapiens
ccatgttgctgccaa

SEQ ID NO: 1581637 - DNA, 22 bp, Homo sapiens
ccatgttggccaggatggtctc

SEQ ID NO: 1581638 - DNA, 18 bp, Homo sapiens
ccatgttgtaatgctgca

SEQ ID NO: 1581639 - DNA, 23 bp, Homo sapiens
ccatgtttattgttttttaaaga

SEQ ID NO: 1581640 - DNA, 13 bp, Homo sapiens
ccatgtttctcac

SEQ ID NO: 1581641 - DNA, 21 bp, Homo sapiens
ccatgtttggttgtaaatgct

SEQ ID NO: 1581642 - DNA, 20 bp, Homo sapiens
ccattaaaaagttgttcttt

SEQ ID NO: 1581643 - DNA, 15 bp, Homo sapiens
ccattaaaactgctt

SEQ ID NO: 1581644 - DNA, 14 bp, Homo sapiens
ccattaaagtcaga

SEQ ID NO: 1581645 - DNA, 19 bp, Homo sapiens
ccattaaagtcagaagttt

SEQ ID NO: 1581646 - DNA, 20 bp, Homo sapiens
ccattaaatccgcaaacagc

SEQ ID NO: 1581647 - DNA, 18 bp, Homo sapiens
ccattaaccagtggccgg

SEQ ID NO: 1581648 - DNA, 15 bp, Homo sapiens
ccattaaggggaaga

SEQ ID NO: 1581649 - DNA, 13 bp, Homo sapiens
ccattaattacat

SEQ ID NO: 1581650 - DNA, 14 bp, Homo sapiens
ccattacccagtgc

SEQ ID NO: 1581651 - DNA, 14 bp, Homo sapiens
ccattactgtgatt

SEQ ID NO: 1581652 - DNA, 22 bp, Homo sapiens
ccattagaaaattttgtaaaac

SEQ ID NO: 1581653 - DNA, 19 bp, Homo sapiens
ccattagataaacacaggc

SEQ ID NO: 1581654 - DNA, 22 bp, Homo sapiens
ccattagataaacacaggcagg

SEQ ID NO: 1581655 - DNA, 20 bp, Homo sapiens
ccattaggccagcaacgctt

SEQ ID NO: 1581656 - DNA, 15 bp, Homo sapiens
ccattattatgatgt

SEQ ID NO: 1581657 - DNA, 16 bp, Homo sapiens
ccattattatttctgt

SEQ ID NO: 1581658 - DNA, 13 bp, Homo sapiens
ccattcacaccag

SEQ ID NO: 1581659 - DNA, 16 bp, Homo sapiens
ccattcacagagcctt

SEQ ID NO: 1581660 - DNA, 18 bp, Homo sapiens
ccattcacatttgatgta

SEQ ID NO: 1581661 - DNA, 14 bp, Homo sapiens
ccattcacttcccc

SEQ ID NO: 1581662 - DNA, 14 bp, Homo sapiens
ccattcagaatatc

SEQ ID NO: 1581663 - DNA, 20 bp, Homo sapiens
ccattcagagctatggtgct

SEQ ID NO: 1581664 - DNA, 23 bp, Homo sapiens
ccattcatattaagacagtgtac

SEQ ID NO: 1581665 - DNA, 18 bp, Homo sapiens
ccattccacacagaatgc

SEQ ID NO: 1581666 - DNA, 14 bp, Homo sapiens
ccattcccccatgt

SEQ ID NO: 1581667 - DNA, 17 bp, Homo sapiens
ccattcccccatgtggc

SEQ ID NO: 1581668 - DNA, 17 bp, Homo sapiens
ccattcccgtggtctcc

SEQ ID NO: 1581669 - DNA, 22 bp, Homo sapiens
ccattccctgccttgctgacaa

SEQ ID NO: 1581670 - DNA, 13 bp, Homo sapiens
ccattcctgaaga

SEQ ID NO: 1581671 - DNA, 17 bp, Homo sapiens
ccattcctggtacccag

SEQ ID NO: 1581672 - DNA, 21 bp, Homo sapiens
ccattcctggtacccagccat

SEQ ID NO: 1581673 - DNA, 15 bp, Homo sapiens
ccattctagatcctg

SEQ ID NO: 1581674 - DNA, 18 bp, Homo sapiens
ccattctagatcctgcac

SEQ ID NO: 1581675 - DNA, 22 bp, Homo sapiens
ccattctagatcctgcacccca

SEQ ID NO: 1581676 - DNA, 15 bp, Homo sapiens
ccattctcccaggta

SEQ ID NO: 1581677 - DNA, 22 bp, Homo sapiens
ccattctcccaggtaccagctg

SEQ ID NO: 1581678 - DNA, 23 bp, Homo sapiens
ccattctcccaggtaccagctgc

SEQ ID NO: 1581679 - DNA, 16 bp, Homo sapiens
ccattctctctcctgt

SEQ ID NO: 1581680 - DNA, 22 bp, Homo sapiens
ccattctgccgccccctcctga

SEQ ID NO: 1581681 - DNA, 22 bp, Homo sapiens
ccattcttatgttccagatggc

SEQ ID NO: 1581682 - DNA, 19 bp, Homo sapiens
ccattgaagccgactctgg

SEQ ID NO: 1581683 - DNA, 15 bp, Homo sapiens
ccattgaccagctct

SEQ ID NO: 1581684 - DNA, 23 bp, Homo sapiens
ccattgaccagctctcttcctgt

SEQ ID NO: 1581685 - DNA, 13 bp, Homo sapiens
ccattgacctcag

SEQ ID NO: 1581686 - DNA, 13 bp, Homo sapiens
ccattgatttttt

SEQ ID NO: 1581687 - DNA, 18 bp, Homo sapiens
ccattgcactccagcctg

SEQ ID NO: 1581688 - DNA, 17 bp, Homo sapiens
ccattgccccagacctg

SEQ ID NO: 1581689 - DNA, 19 bp, Homo sapiens
ccattgctgttctactttt

SEQ ID NO: 1581690 - DNA, 20 bp, Homo sapiens
ccattgctgttctacttttt

SEQ ID NO: 1581691 - DNA, 18 bp, Homo sapiens
ccattgcttattatgtag

SEQ ID NO: 1581692 - DNA, 22 bp, Homo sapiens
ccattggttcacctgtgactcc

SEQ ID NO: 1581693 - DNA, 22 bp, Homo sapiens
ccattggttggaagctaccaga

SEQ ID NO: 1581694 - DNA, 15 bp, Homo sapiens
ccattgtactccagc

SEQ ID NO: 1581695 - DNA, 19 bp, Homo sapiens
ccattgtactccagcctgg

SEQ ID NO: 1581696 - DNA, 14 bp, Homo sapiens
ccattgtcctcctt

SEQ ID NO: 1581697 - DNA, 20 bp, Homo sapiens
ccattgtgcctaagtccagt

SEQ ID NO: 1581698 - DNA, 13 bp, Homo sapiens
ccatttaaagctt

SEQ ID NO: 1581699 - DNA, 22 bp, Homo sapiens
ccatttaaagcttattaaaact

SEQ ID NO: 1581700 - DNA, 20 bp, Homo sapiens
ccatttaagtatcttgtgct

SEQ ID NO: 1581701 - DNA, 20 bp, Homo sapiens
ccatttagaatctagaaatg

SEQ ID NO: 1581702 - DNA, 15 bp, Homo sapiens
ccatttatcttgaag

SEQ ID NO: 1581703 - DNA, 19 bp, Homo sapiens
ccatttcaggaatttaaaa

SEQ ID NO: 1581704 - DNA, 16 bp, Homo sapiens
ccatttcagtggcttc

SEQ ID NO: 1581705 - DNA, 17 bp, Homo sapiens
ccatttcagtggcttcc

SEQ ID NO: 1581706 - DNA, 15 bp, Homo sapiens
ccatttccattgctt

SEQ ID NO: 1581707 - DNA, 14 bp, Homo sapiens
ccatttcccatctg

SEQ ID NO: 1581708 - DNA, 15 bp, Homo sapiens
ccatttcccatctgc

SEQ ID NO: 1581709 - DNA, 18 bp, Homo sapiens
ccatttcccgcacatggt

SEQ ID NO: 1581710 - DNA, 16 bp, Homo sapiens
ccatttcctcacgtgc

SEQ ID NO: 1581711 - DNA, 12 bp, Homo sapiens
ccatttccttgg

SEQ ID NO: 1581712 - DNA, 18 bp, Homo sapiens
ccatttccttggaggcca

SEQ ID NO: 1581713 - DNA, 15 bp, Homo sapiens
ccatttctctacact

SEQ ID NO: 1581714 - DNA, 13 bp, Homo sapiens
ccatttctctgct

SEQ ID NO: 1581715 - DNA, 17 bp, Homo sapiens
ccatttgatttttctaa

SEQ ID NO: 1581716 - DNA, 21 bp, Homo sapiens
ccatttgctagttctgctgcc

SEQ ID NO: 1581717 - DNA, 23 bp, Homo sapiens
ccatttggatcctgtgtggagag

SEQ ID NO: 1581718 - DNA, 12 bp, Homo sapiens
ccatttgtaata

SEQ ID NO: 1581719 - DNA, 18 bp, Homo sapiens
ccatttgtctctactttt

SEQ ID NO: 1581720 - DNA, 16 bp, Homo sapiens
ccatttgtgccagagg

SEQ ID NO: 1581721 - DNA, 13 bp, Homo sapiens
ccatttgttcctg

SEQ ID NO: 1581722 - DNA, 14 bp, Homo sapiens
ccattttaatttta

SEQ ID NO: 1581723 - DNA, 12 bp, Homo sapiens
ccattttatgca

SEQ ID NO: 1581724 - DNA, 18 bp, Homo sapiens
ccattttcaactgctttg

SEQ ID NO: 1581725 - DNA, 21 bp, Homo sapiens
ccattttcccatcatcctttg

SEQ ID NO: 1581726 - DNA, 22 bp, Homo sapiens
ccattttgttattgactaacag

SEQ ID NO: 1581727 - DNA, 15 bp, Homo sapiens
ccatttttctataaa

SEQ ID NO: 1581728 - DNA, 19 bp, Homo sapiens
ccattttttaaggaaacaa

SEQ ID NO: 1581729 - DNA, 15 bp, Homo sapiens
ccattttttttttct

SEQ ID NO: 1581730 - DNA, 19 bp, Homo sapiens
cccaaacaccttccagctc

SEQ ID NO: 1581731 - DNA, 16 bp, Homo sapiens
cccaaacacttctgct

SEQ ID NO: 1581732 - DNA, 22 bp, Homo sapiens
ccatcttccacctgtgccctca

SEQ ID NO: 1581733 - DNA, 13 bp, Homo sapiens
ccatcttcccagc

SEQ ID NO: 1581734 - DNA, 15 bp, Homo sapiens
ccatcttcctgctgc

SEQ ID NO: 1581735 - DNA, 17 bp, Homo sapiens
ccatcttcctgctgctg

SEQ ID NO: 1581736 - DNA, 20 bp, Homo sapiens
ccatcttggtagttctgtgc

SEQ ID NO: 1581737 - DNA, 22 bp, Homo sapiens
ccatcttggtagttctgtgcct

SEQ ID NO: 1581738 - DNA, 19 bp, Homo sapiens
ccatcttgtggggccagga

SEQ ID NO: 1581739 - DNA, 21 bp, Homo sapiens
ccatgaaaaaaatgatcccca

SEQ ID NO: 1581740 - DNA, 17 bp, Homo sapiens
ccatgaaatcaactcag

SEQ ID NO: 1581741 - DNA, 12 bp, Homo sapiens
ccatgaacacac

SEQ ID NO: 1581742 - DNA, 16 bp, Homo sapiens
ccatgaacagaaaaca

SEQ ID NO: 1581743 - DNA, 22 bp, Homo sapiens
ccatgaacagaaaacattctga

SEQ ID NO: 1581744 - DNA, 22 bp, Homo sapiens
ccatgaacttgatacgtccgtg

SEQ ID NO: 1581745 - DNA, 17 bp, Homo sapiens
ccatgaagacaggacag

SEQ ID NO: 1581746 - DNA, 11 bp, Homo sapiens
ccatgaatgag

SEQ ID NO: 1581747 - DNA, 15 bp, Homo sapiens
ccatgaatgttcctg

SEQ ID NO: 1581748 - DNA, 15 bp, Homo sapiens
ccatgacccacccct

SEQ ID NO: 1581749 - DNA, 20 bp, Homo sapiens
ccatgacccacccctgtgct

SEQ ID NO: 1581750 - DNA, 21 bp, Homo sapiens
ccatgaccctacataaggctg

SEQ ID NO: 1581751 - DNA, 17 bp, Homo sapiens
ccatgactggctgtctg

SEQ ID NO: 1581752 - DNA, 18 bp, Homo sapiens
ccatgagaagagggcctg

SEQ ID NO: 1581753 - DNA, 19 bp, Homo sapiens
ccatgagaagagggcctgt

SEQ ID NO: 1581754 - DNA, 16 bp, Homo sapiens
ccatgaggagcgtgga

SEQ ID NO: 1581755 - DNA, 20 bp, Homo sapiens
ccatgaggagttgctgtttg

SEQ ID NO: 1581756 - DNA, 18 bp, Homo sapiens
ccatgatagctggggctt

SEQ ID NO: 1581757 - DNA, 23 bp, Homo sapiens
ccatgatcagacatacagctgcc

SEQ ID NO: 1581758 - DNA, 21 bp, Homo sapiens
ccatgatcgagccactgcact

SEQ ID NO: 1581759 - DNA, 16 bp, Homo sapiens
ccatgatggcaacaga

SEQ ID NO: 1581760 - DNA, 19 bp, Homo sapiens
ccatgatggcaacagatct

SEQ ID NO: 1581761 - DNA, 17 bp, Homo sapiens
ccatgatttcccactgc

SEQ ID NO: 1581762 - DNA, 23 bp, Homo sapiens
ccatgatttcccactgcactcca

SEQ ID NO: 1581763 - DNA, 22 bp, Homo sapiens
ccatgatttgtcccagcctggg

SEQ ID NO: 1581764 - DNA, 13 bp, Homo sapiens
ccatgcaaaccat

SEQ ID NO: 1581765 - DNA, 19 bp, Homo sapiens
ccatgcaagcagaggacca

SEQ ID NO: 1581766 - DNA, 22 bp, Homo sapiens
ccatgcaattttattaaatgca

SEQ ID NO: 1581767 - DNA, 20 bp, Homo sapiens
ccatgcaccaggactggctg

SEQ ID NO: 1581768 - DNA, 22 bp, Homo sapiens
ccatgcacctcccttccctccc

SEQ ID NO: 1581769 - DNA, 11 bp, Homo sapiens
ccatgcagaaa

SEQ ID NO: 1581770 - DNA, 14 bp, Homo sapiens
ccatgcagaaagca

SEQ ID NO: 1581771 - DNA, 18 bp, Homo sapiens
ccatgcagacctcatgcc

SEQ ID NO: 1581772 - DNA, 13 bp, Homo sapiens
ccatgcagccttg

SEQ ID NO: 1581773 - DNA, 15 bp, Homo sapiens
ccatgcagccttggg

SEQ ID NO: 1581774 - DNA, 17 bp, Homo sapiens
ccatgcaggaagaggcc

SEQ ID NO: 1581775 - DNA, 14 bp, Homo sapiens
ccatgcaggaggtg

SEQ ID NO: 1581776 - DNA, 16 bp, Homo sapiens
ccatgcaggaggtgga

SEQ ID NO: 1581777 - DNA, 14 bp, Homo sapiens
ccatgccaccaccc

SEQ ID NO: 1581778 - DNA, 16 bp, Homo sapiens
ccatgccaccacccac

SEQ ID NO: 1581779 - DNA, 19 bp, Homo sapiens
ccatgccaccacccacccc

SEQ ID NO: 1581780 - DNA, 15 bp, Homo sapiens
ccatgcccacctgcc

SEQ ID NO: 1581781 - DNA, 16 bp, Homo sapiens
ccatgcccacctgccc

SEQ ID NO: 1581782 - DNA, 16 bp, Homo sapiens
ccatgccccagctctg

SEQ ID NO: 1581783 - DNA, 16 bp, Homo sapiens
ccatgccccaggatca

SEQ ID NO: 1581784 - DNA, 14 bp, Homo sapiens
ccatgcctcatgcc

SEQ ID NO: 1581785 - DNA, 20 bp, Homo sapiens
ccatgcctcatgccacacct

SEQ ID NO: 1581786 - DNA, 13 bp, Homo sapiens
ccatgcctgaggg

SEQ ID NO: 1581787 - DNA, 15 bp, Homo sapiens
ccatgcctgagggtg

SEQ ID NO: 1581788 - DNA, 16 bp, Homo sapiens
ccatgcctgctccctg

SEQ ID NO: 1581789 - DNA, 21 bp, Homo sapiens
ccatgcctgctccctgtctgt

SEQ ID NO: 1581790 - DNA, 13 bp, Homo sapiens
ccatgcctgtcca

SEQ ID NO: 1581791 - DNA, 14 bp, Homo sapiens
ccatgcctgtccag

SEQ ID NO: 1581792 - DNA, 19 bp, Homo sapiens
ccatgcctgtccagcctgg

SEQ ID NO: 1581793 - DNA, 15 bp, Homo sapiens
ccatgcctgtctctg

SEQ ID NO: 1581794 - DNA, 16 bp, Homo sapiens
ccatgccttaaaccta

SEQ ID NO: 1581795 - DNA, 20 bp, Homo sapiens
ccatgcgccccctccgccct

SEQ ID NO: 1581796 - DNA, 13 bp, Homo sapiens
ccatgcgctcagg

SEQ ID NO: 1581797 - DNA, 15 bp, Homo sapiens
ccatgcgctcagggc

SEQ ID NO: 1581798 - DNA, 16 bp, Homo sapiens
ccatgctcatctgctg

SEQ ID NO: 1581799 - DNA, 17 bp, Homo sapiens
ccatgctcatctgctgg

SEQ ID NO: 1581800 - DNA, 16 bp, Homo sapiens
ccatgctccagggtca

SEQ ID NO: 1581801 - DNA, 16 bp, Homo sapiens
ccatgctcctcacctg

SEQ ID NO: 1581802 - DNA, 13 bp, Homo sapiens
ccatgctctgccc

SEQ ID NO: 1581803 - DNA, 15 bp, Homo sapiens
ccatgctctgcccca

SEQ ID NO: 1581804 - DNA, 17 bp, Homo sapiens
ccatgctctgccccaag

SEQ ID NO: 1581805 - DNA, 15 bp, Homo sapiens
ccatgctgaggcctg

SEQ ID NO: 1581806 - DNA, 20 bp, Homo sapiens
ccatgctgaggcctgggccg

SEQ ID NO: 1581807 - DNA, 20 bp, Homo sapiens
ccatgctgcaaaggagaagc

SEQ ID NO: 1581808 - DNA, 14 bp, Homo sapiens
ccatgctgctgggg

SEQ ID NO: 1581809 - DNA, 19 bp, Homo sapiens
ccatgctgctggggaagac

SEQ ID NO: 1581810 - DNA, 20 bp, Homo sapiens
ccatgctgctttttggcaca

SEQ ID NO: 1581811 - DNA, 17 bp, Homo sapiens
ccatgcttagtcactgc

SEQ ID NO: 1581812 - DNA, 17 bp, Homo sapiens
ccatggagacaagaagg

SEQ ID NO: 1581813 - DNA, 20 bp, Homo sapiens
ccatggagacgtggtgggac

SEQ ID NO: 1581814 - DNA, 14 bp, Homo sapiens
ccatggagccagct

SEQ ID NO: 1581815 - DNA, 18 bp, Homo sapiens
ccatggagccagctccct

SEQ ID NO: 1581816 - DNA, 22 bp, Homo sapiens
ccatggagccagctccctctat

SEQ ID NO: 1581817 - DNA, 16 bp, Homo sapiens
ccatggatctgatctg

SEQ ID NO: 1581818 - DNA, 15 bp, Homo sapiens
ccatggcaccagccc

SEQ ID NO: 1581819 - DNA, 19 bp, Homo sapiens
ccatggcaccagccccctg

SEQ ID NO: 1581820 - DNA, 23 bp, Homo sapiens
ccatggcaccttcagactttgct

SEQ ID NO: 1581821 - DNA, 14 bp, Homo sapiens
ccatggcagcagcc

SEQ ID NO: 1581822 - DNA, 13 bp, Homo sapiens
ccatggccacccc

SEQ ID NO: 1581823 - DNA, 15 bp, Homo sapiens
ccatggccccaggcc

SEQ ID NO: 1581824 - DNA, 16 bp, Homo sapiens
ccatggcccccaataa

SEQ ID NO: 1581825 - DNA, 23 bp, Homo sapiens
ccatggccgaagccccttggaga

SEQ ID NO: 1581826 - DNA, 16 bp, Homo sapiens
ccatggctcaggcaag

SEQ ID NO: 1581827 - DNA, 16 bp, Homo sapiens
ccatggctcagggtgg

SEQ ID NO: 1581828 - DNA, 15 bp, Homo sapiens
ccatggctgaagctg

SEQ ID NO: 1581829 - DNA, 20 bp, Homo sapiens
ccatggctgaagctggagca

SEQ ID NO: 1581830 - DNA, 21 bp, Homo sapiens
ccatggctgaagctggagcag

SEQ ID NO: 1581831 - DNA, 14 bp, Homo sapiens
ccatgggagccagc

SEQ ID NO: 1581832 - DNA, 22 bp, Homo sapiens
ccatgggagctggttagaaatg

SEQ ID NO: 1581833 - DNA, 20 bp, Homo sapiens
ccatgggccccaccatttat

SEQ ID NO: 1581834 - DNA, 12 bp, Homo sapiens
ccatgggcctgg

SEQ ID NO: 1581835 - DNA, 17 bp, Homo sapiens
ccatgggcctgggcctg

SEQ ID NO: 1581836 - DNA, 20 bp, Homo sapiens
ccatgggcctgggcctgctt

SEQ ID NO: 1581837 - DNA, 20 bp, Homo sapiens
ccatgggctagtgtgagtgg

SEQ ID NO: 1581838 - DNA, 11 bp, Homo sapiens
ccatgggcttg

SEQ ID NO: 1581839 - DNA, 12 bp, Homo sapiens
ccatggggaggg

SEQ ID NO: 1581840 - DNA, 16 bp, Homo sapiens
ccatgggggcacttga

SEQ ID NO: 1581841 - DNA, 20 bp, Homo sapiens
ccatgggggcacttgagttt

SEQ ID NO: 1581842 - DNA, 16 bp, Homo sapiens
ccatggggttcgagac

SEQ ID NO: 1581843 - DNA, 17 bp, Homo sapiens
ccatggggttcgagact

SEQ ID NO: 1581844 - DNA, 23 bp, Homo sapiens
ccatggtgggagagactgtgagg

SEQ ID NO: 1581845 - DNA, 20 bp, Homo sapiens
ccatggttaagagtccaaga

SEQ ID NO: 1581846 - DNA, 18 bp, Homo sapiens
ccatgtaaggtatcagtt

SEQ ID NO: 1581847 - DNA, 20 bp, Homo sapiens
ccatgtagccccctggcctc

SEQ ID NO: 1581848 - DNA, 23 bp, Homo sapiens
ccatgtagccccctggcctctgt

SEQ ID NO: 1581849 - DNA, 20 bp, Homo sapiens
ccaggggagagggtctggag

SEQ ID NO: 1581850 - DNA, 15 bp, Homo sapiens
ccaggggagccagct

SEQ ID NO: 1581851 - DNA, 14 bp, Homo sapiens
ccaggggcagcaag

SEQ ID NO: 1581852 - DNA, 16 bp, Homo sapiens
ccaggggcagcaaggc

SEQ ID NO: 1581853 - DNA, 15 bp, Homo sapiens
ccaggggcagccaca

SEQ ID NO: 1581854 - DNA, 23 bp, Homo sapiens
ccaggggcagccacaccactgcc

SEQ ID NO: 1581855 - DNA, 13 bp, Homo sapiens
ccaggggcaggac

SEQ ID NO: 1581856 - DNA, 15 bp, Homo sapiens
ccaggggcaggactg

SEQ ID NO: 1581857 - DNA, 22 bp, Homo sapiens
ccaggggcatgtattggcctgg

SEQ ID NO: 1581858 - DNA, 12 bp, Homo sapiens
ccaggggcctgc

SEQ ID NO: 1581859 - DNA, 13 bp, Homo sapiens
ccaggggcctgca

SEQ ID NO: 1581860 - DNA, 16 bp, Homo sapiens
ccaggggcctgcagaa

SEQ ID NO: 1581861 - DNA, 20 bp, Homo sapiens
ccaggggcctgcagaaggaa

SEQ ID NO: 1581862 - DNA, 20 bp, Homo sapiens
ccaggggctgcttcctcctg

SEQ ID NO: 1581863 - DNA, 19 bp, Homo sapiens
ccagggggagaaggaagat

SEQ ID NO: 1581864 - DNA, 17 bp, Homo sapiens
ccaggggtcccagccac

SEQ ID NO: 1581865 - DNA, 18 bp, Homo sapiens
ccaggggtcccagccacc

SEQ ID NO: 1581866 - DNA, 16 bp, Homo sapiens
ccaggggtctccctgg

SEQ ID NO: 1581867 - DNA, 18 bp, Homo sapiens
ccaggggtctccctggct

SEQ ID NO: 1581868 - DNA, 21 bp, Homo sapiens
ccaggggtctccctggctccc

SEQ ID NO: 1581869 - DNA, 22 bp, Homo sapiens
ccaggggtgctcacctctgccc

SEQ ID NO: 1581870 - DNA, 17 bp, Homo sapiens
ccagggtagaattcaat

SEQ ID NO: 1581871 - DNA, 17 bp, Homo sapiens
ccagggtccgcaccagc

SEQ ID NO: 1581872 - DNA, 20 bp, Homo sapiens
ccagggtccgcaccagctgc

SEQ ID NO: 1581873 - DNA, 19 bp, Homo sapiens
ccagggtcctgtgcctgga

SEQ ID NO: 1581874 - DNA, 14 bp, Homo sapiens
ccagggtcttccct

SEQ ID NO: 1581875 - DNA, 23 bp, Homo sapiens
ccagggtcttccctacctcaggc

SEQ ID NO: 1581876 - DNA, 21 bp, Homo sapiens
ccagggtcttgggctactggc

SEQ ID NO: 1581877 - DNA, 19 bp, Homo sapiens
ccagggtgtggccctgcca

SEQ ID NO: 1581878 - DNA, 13 bp, Homo sapiens
ccaggtacaggag

SEQ ID NO: 1581879 - DNA, 20 bp, Homo sapiens
ccaggtacaggagaggcagc

SEQ ID NO: 1581880 - DNA, 22 bp, Homo sapiens
ccaggtactgcattctctccca

SEQ ID NO: 1581881 - DNA, 16 bp, Homo sapiens
ccaggtacttgagaaa

SEQ ID NO: 1581882 - DNA, 17 bp, Homo sapiens
ccaggtcagcctggaag

SEQ ID NO: 1581883 - DNA, 11 bp, Homo sapiens
ccaggtcagga

SEQ ID NO: 1581884 - DNA, 19 bp, Homo sapiens
ccaggtcaggatgcacatt

SEQ ID NO: 1581885 - DNA, 21 bp, Homo sapiens
ccaggtcatgcagttcctggc

SEQ ID NO: 1581886 - DNA, 16 bp, Homo sapiens
cccactcaccagggtc

SEQ ID NO: 1581887 - DNA, 19 bp, Homo sapiens
cccactcagaactctccag

SEQ ID NO: 1581888 - DNA, 13 bp, Homo sapiens
cccactccagccc

SEQ ID NO: 1581889 - DNA, 18 bp, Homo sapiens
cccactccagccctgtcc

SEQ ID NO: 1581890 - DNA, 13 bp, Homo sapiens
cccactccagcct

SEQ ID NO: 1581891 - DNA, 21 bp, Homo sapiens
cccactcccccgtttctcctt

SEQ ID NO: 1581892 - DNA, 22 bp, Homo sapiens
cccactcccccgtttctccttt

SEQ ID NO: 1581893 - DNA, 22 bp, Homo sapiens
cccactcccggcctaggcacct

SEQ ID NO: 1581894 - DNA, 20 bp, Homo sapiens
cccactccctggctctcaga

SEQ ID NO: 1581895 - DNA, 14 bp, Homo sapiens
cccactccctttcc

SEQ ID NO: 1581896 - DNA, 16 bp, Homo sapiens
cccactcctgctgcac

SEQ ID NO: 1581897 - DNA, 13 bp, Homo sapiens
ccccacccccagc

SEQ ID NO: 1581898 - DNA, 17 bp, Homo sapiens
ccccacccccagctcaa

SEQ ID NO: 1581899 - DNA, 17 bp, Homo sapiens
ccccaccccctccccag

SEQ ID NO: 1581900 - DNA, 22 bp, Homo sapiens
ccccaccccggggaccctgtga

SEQ ID NO: 1581901 - DNA, 23 bp, Homo sapiens
ccccaccccggggaccctgtgac

SEQ ID NO: 1581902 - DNA, 14 bp, Homo sapiens
ccccacccctaagt

SEQ ID NO: 1581903 - DNA, 23 bp, Homo sapiens
ccccacccctaagtgcccaaagt

SEQ ID NO: 1581904 - DNA, 12 bp, Homo sapiens
ccccacccctac

SEQ ID NO: 1581905 - DNA, 14 bp, Homo sapiens
ccccacccctccag

SEQ ID NO: 1581906 - DNA, 14 bp, Homo sapiens
ccccacccctgccc

SEQ ID NO: 1581907 - DNA, 23 bp, Homo sapiens
ccccacccctggaagagcccagt

SEQ ID NO: 1581908 - DNA, 17 bp, Homo sapiens
ccccaccctccactcag

SEQ ID NO: 1581909 - DNA, 14 bp, Homo sapiens
ccccaccctggcct

SEQ ID NO: 1581910 - DNA, 20 bp, Homo sapiens
ccccaccctgggccctgggc

SEQ ID NO: 1581911 - DNA, 18 bp, Homo sapiens
ccccaccggtccagctgg

SEQ ID NO: 1581912 - DNA, 12 bp, Homo sapiens
ccccacctgcct

SEQ ID NO: 1581913 - DNA, 13 bp, Homo sapiens
ccccacctgtgtc

SEQ ID NO: 1581914 - DNA, 15 bp, Homo sapiens
ccccacgtctgtcct

SEQ ID NO: 1581915 - DNA, 19 bp, Homo sapiens
ccccactactgcagcacct

SEQ ID NO: 1581916 - DNA, 21 bp, Homo sapiens
ccccactactgcagcacctcc

SEQ ID NO: 1581917 - DNA, 11 bp, Homo sapiens
ccccactccag

SEQ ID NO: 1581918 - DNA, 15 bp, Homo sapiens
ccccactccagcctg

SEQ ID NO: 1581919 - DNA, 22 bp, Homo sapiens
ccccactcccccgtttctcctt

SEQ ID NO: 1581920 - DNA, 21 bp, Homo sapiens
ccccactctaggggtcaggct

SEQ ID NO: 1581921 - DNA, 12 bp, Homo sapiens
ccccactctccc

SEQ ID NO: 1581922 - DNA, 18 bp, Homo sapiens
ccccactctccccacact

SEQ ID NO: 1581923 - DNA, 16 bp, Homo sapiens
ccccactgcaggcccc

SEQ ID NO: 1581924 - DNA, 14 bp, Homo sapiens
ccccactgccacac

SEQ ID NO: 1581925 - DNA, 17 bp, Homo sapiens
ccccactgccagcagca

SEQ ID NO: 1581926 - DNA, 19 bp, Homo sapiens
ccccactgccagcagcagc

SEQ ID NO: 1581927 - DNA, 22 bp, Homo sapiens
ccccactgccagcagcagcagg

SEQ ID NO: 1581928 - DNA, 15 bp, Homo sapiens
ccccactgggccagc

SEQ ID NO: 1581929 - DNA, 16 bp, Homo sapiens
ccccacttcagaaggt

SEQ ID NO: 1581930 - DNA, 14 bp, Homo sapiens
ccccagaccccgcc

SEQ ID NO: 1581931 - DNA, 15 bp, Homo sapiens
ccccagactagatgt

SEQ ID NO: 1581932 - DNA, 18 bp, Homo sapiens
cccgcctgccgtgcatgg

SEQ ID NO: 1581933 - DNA, 14 bp, Homo sapiens
cccgcctgcctcct

SEQ ID NO: 1581934 - DNA, 16 bp, Homo sapiens
cccgcctgcctcctgg

SEQ ID NO: 1581935 - DNA, 16 bp, Homo sapiens
cccgcctgcctgccac

SEQ ID NO: 1581936 - DNA, 19 bp, Homo sapiens
cccgccttcctcctccaca

SEQ ID NO: 1581937 - DNA, 19 bp, Homo sapiens
cccgcgcgcgtccccctgc

SEQ ID NO: 1581938 - DNA, 17 bp, Homo sapiens
cccgcgctcgcccagca

SEQ ID NO: 1581939 - DNA, 16 bp, Homo sapiens
cccgcgggttctagac

SEQ ID NO: 1581940 - DNA, 16 bp, Homo sapiens
cccgcggtgctctggc

SEQ ID NO: 1581941 - DNA, 19 bp, Homo sapiens
cccgcggtgctctggcggc

SEQ ID NO: 1581942 - DNA, 16 bp, Homo sapiens
cccgcggtgctgactg

SEQ ID NO: 1581943 - DNA, 17 bp, Homo sapiens
cccgcggtgctgactga

SEQ ID NO: 1581944 - DNA, 12 bp, Homo sapiens
cccgcgttcaag

SEQ ID NO: 1581945 - DNA, 14 bp, Homo sapiens
cccgcgttcaagac

SEQ ID NO: 1581946 - DNA, 12 bp, Homo sapiens
cccgctcagccc

SEQ ID NO: 1581947 - DNA, 17 bp, Homo sapiens
cccgctcagcccagctg

SEQ ID NO: 1581948 - DNA, 13 bp, Homo sapiens
cccgctcagccct

SEQ ID NO: 1581949 - DNA, 14 bp, Homo sapiens
cccgctcaggggcc

SEQ ID NO: 1581950 - DNA, 15 bp, Homo sapiens
cccgctcccacaccc

SEQ ID NO: 1581951 - DNA, 12 bp, Homo sapiens
cccgctccccac

SEQ ID NO: 1581952 - DNA, 18 bp, Homo sapiens
cccgctccccacctaccc

SEQ ID NO: 1581953 - DNA, 16 bp, Homo sapiens
cccgctccgtctctgt

SEQ ID NO: 1581954 - DNA, 14 bp, Homo sapiens
cccgctctccctgt

SEQ ID NO: 1581955 - DNA, 18 bp, Homo sapiens
cccgctctccctgtcacg

SEQ ID NO: 1581956 - DNA, 23 bp, Homo sapiens
cccgctgatggagccccaccttg

SEQ ID NO: 1581957 - DNA, 12 bp, Homo sapiens
cccgctgctgtg

SEQ ID NO: 1581958 - DNA, 16 bp, Homo sapiens
cccgctgctgtgcaac

SEQ ID NO: 1581959 - DNA, 12 bp, Homo sapiens
cccgcttcccca

SEQ ID NO: 1581960 - DNA, 18 bp, Homo sapiens
cccgcttccccacagaac

SEQ ID NO: 1581961 - DNA, 15 bp, Homo sapiens
cccgcttgtccagcg

SEQ ID NO: 1581962 - DNA, 20 bp, Homo sapiens
cccgcttttgttcttcccca

SEQ ID NO: 1581963 - DNA, 19 bp, Homo sapiens
cccggaattccgtcaccac

SEQ ID NO: 1581964 - DNA, 18 bp, Homo sapiens
cccggactcaccaacttg

SEQ ID NO: 1581965 - DNA, 19 bp, Homo sapiens
cccggagtaatcaggcagc

SEQ ID NO: 1581966 - DNA, 22 bp, Homo sapiens
cccggcaagcgcttctgctgaa

SEQ ID NO: 1581967 - DNA, 16 bp, Homo sapiens
cccggcagccccttct

SEQ ID NO: 1581968 - DNA, 18 bp, Homo sapiens
cccggcagccccttctgg

SEQ ID NO: 1581969 - DNA, 12 bp, Homo sapiens
cccggcagggcg

SEQ ID NO: 1581970 - DNA, 14 bp, Homo sapiens
cccggcagggcggg

SEQ ID NO: 1581971 - DNA, 21 bp, Homo sapiens
cccggcagggcgggcagaggg

SEQ ID NO: 1581972 - DNA, 16 bp, Homo sapiens
cccggccacacccagc

SEQ ID NO: 1581973 - DNA, 13 bp, Homo sapiens
cccggccacagct

SEQ ID NO: 1581974 - DNA, 16 bp, Homo sapiens
cccggccacagctgct

SEQ ID NO: 1581975 - DNA, 21 bp, Homo sapiens
cccggccacagctgctggaga

SEQ ID NO: 1581976 - DNA, 16 bp, Homo sapiens
cccggccagcgggcac

SEQ ID NO: 1581977 - DNA, 21 bp, Homo sapiens
cccggccagcgggcacagggc

SEQ ID NO: 1581978 - DNA, 24 bp, Homo sapiens
cccggccagcgggcacagggcacc

SEQ ID NO: 1581979 - DNA, 13 bp, Homo sapiens
cccggccccagcc

SEQ ID NO: 1581980 - DNA, 15 bp, Homo sapiens
cccggccccagccag

SEQ ID NO: 1581981 - DNA, 21 bp, Homo sapiens
cccggccccccgcgctcgccc

SEQ ID NO: 1581982 - DNA, 22 bp, Homo sapiens
cccggccctaccagcgcccgct

SEQ ID NO: 1581983 - DNA, 14 bp, Homo sapiens
cccggccgcgccgc

SEQ ID NO: 1581984 - DNA, 17 bp, Homo sapiens
cccggccgctccaccag

SEQ ID NO: 1581985 - DNA, 16 bp, Homo sapiens
cccggccggcctggca

SEQ ID NO: 1581986 - DNA, 16 bp, Homo sapiens
cccggcctaggcacct

SEQ ID NO: 1581987 - DNA, 19 bp, Homo sapiens
cccggcctaggcacctccc

SEQ ID NO: 1581988 - DNA, 17 bp, Homo sapiens
cccggcctcagggcgct

SEQ ID NO: 1581989 - DNA, 23 bp, Homo sapiens
cccggcctcctcggagagcagca

SEQ ID NO: 1581990 - DNA, 14 bp, Homo sapiens
cccggcctcttcca

SEQ ID NO: 1581991 - DNA, 17 bp, Homo sapiens
cccggcctcttccaccc

SEQ ID NO: 1581992 - DNA, 15 bp, Homo sapiens
cccggcgccgggcac

SEQ ID NO: 1581993 - DNA, 16 bp, Homo sapiens
cccggcgccgggcacc

SEQ ID NO: 1581994 - DNA, 14 bp, Homo sapiens
cccggcgcggtggc

SEQ ID NO: 1581995 - DNA, 20 bp, Homo sapiens
cccggctctacgggggccgc

SEQ ID NO: 1581996 - DNA, 16 bp, Homo sapiens
cccggctgcagaggcc

SEQ ID NO: 1581997 - DNA, 21 bp, Homo sapiens
cccggctgcagaggccagagg

SEQ ID NO: 1581998 - DNA, 23 bp, Homo sapiens
cccggctggttttgtaagatgct

SEQ ID NO: 1581999 - DNA, 23 bp, Homo sapiens
cccggctgtgattgctgccaggc

SEQ ID NO: 1582000 - DNA, 23 bp, Homo sapiens
cccgggaggcagaggttgcagtg

SEQ ID NO: 1582001 - DNA, 18 bp, Homo sapiens
cccgggataaactgagcc

SEQ ID NO: 1582002 - DNA, 14 bp, Homo sapiens
cccgggatattata

SEQ ID NO: 1582003 - DNA, 12 bp, Homo sapiens
cccgggcagggc

SEQ ID NO: 1582004 - DNA, 15 bp, Homo sapiens
cccgggccagggctg

SEQ ID NO: 1582005 - DNA, 20 bp, Homo sapiens
cccgggcccgttgaggatga

SEQ ID NO: 1582006 - DNA, 17 bp, Homo sapiens
cccgggccctcccttgg

SEQ ID NO: 1582007 - DNA, 15 bp, Homo sapiens
cccgggctctggcca

SEQ ID NO: 1582008 - DNA, 16 bp, Homo sapiens
cccgggctgcctgggc

SEQ ID NO: 1582009 - DNA, 23 bp, Homo sapiens
cccgggctgcctgggctgttggc

SEQ ID NO: 1582010 - DNA, 21 bp, Homo sapiens
cccgggcttcccttctcccca

SEQ ID NO: 1582011 - DNA, 15 bp, Homo sapiens
cccggggaccctgtg

SEQ ID NO: 1582012 - DNA, 21 bp, Homo sapiens
cccggggaccctgtgacatgg

SEQ ID NO: 1582013 - DNA, 14 bp, Homo sapiens
cccggggactcaag

SEQ ID NO: 1582014 - DNA, 17 bp, Homo sapiens
cccggggcaaggtctcc

SEQ ID NO: 1582015 - DNA, 14 bp, Homo sapiens
cccggggccagcac

SEQ ID NO: 1582016 - DNA, 14 bp, Homo sapiens
cccggggccttcct

SEQ ID NO: 1582017 - DNA, 12 bp, Homo sapiens
cccggggctggc

SEQ ID NO: 1582018 - DNA, 16 bp, Homo sapiens
cccggggctggcaagc

SEQ ID NO: 1582019 - DNA, 14 bp, Homo sapiens
cccggggtctcctg

SEQ ID NO: 1582020 - DNA, 15 bp, Homo sapiens
cccggggtctcctgg

SEQ ID NO: 1582021 - DNA, 16 bp, Homo sapiens
cccgggtccccagctc

SEQ ID NO: 1582022 - DNA, 19 bp, Homo sapiens
cccgggtctggtgctgagg

SEQ ID NO: 1582023 - DNA, 18 bp, Homo sapiens
cccggtggcggccccagc

SEQ ID NO: 1582024 - DNA, 17 bp, Homo sapiens
cccggtggtttgccatg

SEQ ID NO: 1582025 - DNA, 19 bp, Homo sapiens
cccgtactaggttggacag

SEQ ID NO: 1582026 - DNA, 22 bp, Homo sapiens
cccgtactttgtcccgtggcat

SEQ ID NO: 1582027 - DNA, 14 bp, Homo sapiens
cccgtagctgccag

SEQ ID NO: 1582028 - DNA, 15 bp, Homo sapiens
cccgtaggcagcctc

SEQ ID NO: 1582029 - DNA, 15 bp, Homo sapiens
cccgtatcacagtgt

SEQ ID NO: 1582030 - DNA, 14 bp, Homo sapiens
cccgtcagggagag

SEQ ID NO: 1582031 - DNA, 16 bp, Homo sapiens
cccgtcccatatcctg

SEQ ID NO: 1582032 - DNA, 11 bp, Homo sapiens
cccgtccctgc

SEQ ID NO: 1582033 - DNA, 12 bp, Homo sapiens
cccgtccctgcc

SEQ ID NO: 1582034 - DNA, 17 bp, Homo sapiens
cccgtcctgcctgtggc

SEQ ID NO: 1582035 - DNA, 18 bp, Homo sapiens
cccgtcgcgctggacagc

SEQ ID NO: 1582036 - DNA, 15 bp, Homo sapiens
cccgtcggagctgcc

SEQ ID NO: 1582037 - DNA, 16 bp, Homo sapiens
cccgtcggagctgcct

SEQ ID NO: 1582038 - DNA, 13 bp, Homo sapiens
cccgtcgtgtgct

SEQ ID NO: 1582039 - DNA, 20 bp, Homo sapiens
cccgtcgtgtgctgaagaca

SEQ ID NO: 1582040 - DNA, 17 bp, Homo sapiens
cccgtctggcccaccag

SEQ ID NO: 1582041 - DNA, 23 bp, Homo sapiens
cccgtctggggttcagcccctcc

SEQ ID NO: 1582042 - DNA, 13 bp, Homo sapiens
cccgtcttcagcc

SEQ ID NO: 1582043 - DNA, 14 bp, Homo sapiens
cccgtcttcagcct

SEQ ID NO: 1582044 - DNA, 14 bp, Homo sapiens
cccgtgaagcagtg

SEQ ID NO: 1582045 - DNA, 19 bp, Homo sapiens
cccgtgaagcagtgcctcg

SEQ ID NO: 1582046 - DNA, 16 bp, Homo sapiens
cccgtgacagtggctg

SEQ ID NO: 1582047 - DNA, 18 bp, Homo sapiens
cccgtgcagtacaggcaa

SEQ ID NO: 1582048 - DNA, 14 bp, Homo sapiens
cccgtgggctcccg

SEQ ID NO: 1582049 - DNA, 20 bp, Homo sapiens
cccgtgtaaaaagcctcctt

SEQ ID NO: 1582050 - DNA, 22 bp, Homo sapiens
cccctctgccggtcgggcagcc

SEQ ID NO: 1582051 - DNA, 14 bp, Homo sapiens
cccctctgctgccg

SEQ ID NO: 1582052 - DNA, 16 bp, Homo sapiens
cccctctgctgctgtc

SEQ ID NO: 1582053 - DNA, 19 bp, Homo sapiens
cccctctgctgtcctgcag

SEQ ID NO: 1582054 - DNA, 12 bp, Homo sapiens
cccctctggtgt

SEQ ID NO: 1582055 - DNA, 23 bp, Homo sapiens
cccctcttcttctgaagatcaga

SEQ ID NO: 1582056 - DNA, 14 bp, Homo sapiens
cccctcttggagaa

SEQ ID NO: 1582057 - DNA, 18 bp, Homo sapiens
cccctgacctcactgtga

SEQ ID NO: 1582058 - DNA, 14 bp, Homo sapiens
cccctgactcatca

SEQ ID NO: 1582059 - DNA, 21 bp, Homo sapiens
cccctgagacaaatggaggcc

SEQ ID NO: 1582060 - DNA, 13 bp, Homo sapiens
cccctgaggagct

SEQ ID NO: 1582061 - DNA, 19 bp, Homo sapiens
cccctgaggagctttgtgt

SEQ ID NO: 1582062 - DNA, 16 bp, Homo sapiens
cccctgatgcagcctg

SEQ ID NO: 1582063 - DNA, 15 bp, Homo sapiens
cccctgcacccaccc

SEQ ID NO: 1582064 - DNA, 19 bp, Homo sapiens
cccctgcacccacccctgc

SEQ ID NO: 1582065 - DNA, 17 bp, Homo sapiens
cccctgcactgtaaaat

SEQ ID NO: 1582066 - DNA, 21 bp, Homo sapiens
cccctgcagttggcagaaagg

SEQ ID NO: 1582067 - DNA, 23 bp, Homo sapiens
cccctgcagtttggccctggagc

SEQ ID NO: 1582068 - DNA, 16 bp, Homo sapiens
cccctgccacactgat

SEQ ID NO: 1582069 - DNA, 20 bp, Homo sapiens
cccctgccaccaggccacct

SEQ ID NO: 1582070 - DNA, 15 bp, Homo sapiens
cccctgccagtgcct

SEQ ID NO: 1582071 - DNA, 17 bp, Homo sapiens
cccctgccagtgcctta

SEQ ID NO: 1582072 - DNA, 13 bp, Homo sapiens
cccctgccccaga

SEQ ID NO: 1582073 - DNA, 14 bp, Homo sapiens
cccctgccctcgtg

SEQ ID NO: 1582074 - DNA, 22 bp, Homo sapiens
cccctgccctcgtggccagccc

SEQ ID NO: 1582075 - DNA, 12 bp, Homo sapiens
cccctgccctgc

SEQ ID NO: 1582076 - DNA, 14 bp, Homo sapiens
cccctgccctgcac

SEQ ID NO: 1582077 - DNA, 17 bp, Homo sapiens
cccctgccggccggggc

SEQ ID NO: 1582078 - DNA, 16 bp, Homo sapiens
cccctgcctcctgcca

SEQ ID NO: 1582079 - DNA, 12 bp, Homo sapiens
cccctgcctgcc

SEQ ID NO: 1582080 - DNA, 21 bp, Homo sapiens
cccctgcgtgggggccagtca

SEQ ID NO: 1582081 - DNA, 12 bp, Homo sapiens
cccctgctgccc

SEQ ID NO: 1582082 - DNA, 17 bp, Homo sapiens
cccctgctgtctctctg

SEQ ID NO: 1582083 - DNA, 19 bp, Homo sapiens
cccctgctgtctctctggg

SEQ ID NO: 1582084 - DNA, 18 bp, Homo sapiens
cccctggaagagcccagt

SEQ ID NO: 1582085 - DNA, 11 bp, Homo sapiens
cccctggagcc

SEQ ID NO: 1582086 - DNA, 17 bp, Homo sapiens
cccctggagccagcagg

SEQ ID NO: 1582087 - DNA, 20 bp, Homo sapiens
cccctggatgtcccctgtcc

SEQ ID NO: 1582088 - DNA, 13 bp, Homo sapiens
cccctggccagct

SEQ ID NO: 1582089 - DNA, 16 bp, Homo sapiens
cccctggccagctctg

SEQ ID NO: 1582090 - DNA, 14 bp, Homo sapiens
cccctggcccagag

SEQ ID NO: 1582091 - DNA, 13 bp, Homo sapiens
cccctggccctgc

SEQ ID NO: 1582092 - DNA, 20 bp, Homo sapiens
cccctggcctcagttcccag

SEQ ID NO: 1582093 - DNA, 10 bp, Homo sapiens
cccctggctt

SEQ ID NO: 1582094 - DNA, 11 bp, Homo sapiens
cccctggcttt

SEQ ID NO: 1582095 - DNA, 16 bp, Homo sapiens
cccctggctttgcctc

SEQ ID NO: 1582096 - DNA, 16 bp, Homo sapiens
ccctctgggggtcctc

SEQ ID NO: 1582097 - DNA, 17 bp, Homo sapiens
ccctctgggggtcctct

SEQ ID NO: 1582098 - DNA, 21 bp, Homo sapiens
ccctctgggggtcctctctga

SEQ ID NO: 1582099 - DNA, 18 bp, Homo sapiens
ccctctggtcgctcctgc

SEQ ID NO: 1582100 - DNA, 19 bp, Homo sapiens
ccctctggtcgctcctgcc

SEQ ID NO: 1582101 - DNA, 20 bp, Homo sapiens
ccctctggtcgctcctgccc

SEQ ID NO: 1582102 - DNA, 19 bp, Homo sapiens
ccctctggtctactctaga

SEQ ID NO: 1582103 - DNA, 23 bp, Homo sapiens
ccctctgtagctccctcctccca

SEQ ID NO: 1582104 - DNA, 20 bp, Homo sapiens
ccctctgtcatcactccctg

SEQ ID NO: 1582105 - DNA, 16 bp, Homo sapiens
ccctcttcctccctgg

SEQ ID NO: 1582106 - DNA, 14 bp, Homo sapiens
ccctcttcctgtga

SEQ ID NO: 1582107 - DNA, 15 bp, Homo sapiens
ccctcttcctgtgat

SEQ ID NO: 1582108 - DNA, 21 bp, Homo sapiens
ccctcttcttctttccttcca

SEQ ID NO: 1582109 - DNA, 13 bp, Homo sapiens
ccctcttgcccat

SEQ ID NO: 1582110 - DNA, 22 bp, Homo sapiens
ccctcttgcccatcctgactga

SEQ ID NO: 1582111 - DNA, 15 bp, Homo sapiens
ccctcttgcgggcct

SEQ ID NO: 1582112 - DNA, 21 bp, Homo sapiens
ccctcttgtaagtcatctact

SEQ ID NO: 1582113 - DNA, 21 bp, Homo sapiens
ccctcttgtccctttccctac

SEQ ID NO: 1582114 - DNA, 12 bp, Homo sapiens
ccctctttccct

SEQ ID NO: 1582115 - DNA, 15 bp, Homo sapiens
ccctctttccctgcg

SEQ ID NO: 1582116 - DNA, 19 bp, Homo sapiens
ccctctttgctgcagagaa

SEQ ID NO: 1582117 - DNA, 19 bp, Homo sapiens
ccctctttggctcccctgt

SEQ ID NO: 1582118 - DNA, 14 bp, Homo sapiens
ccctctttgggcag

SEQ ID NO: 1582119 - DNA, 19 bp, Homo sapiens
ccctctttgggcagtgcca

SEQ ID NO: 1582120 - DNA, 15 bp, Homo sapiens
ccctgaaaacccaga

SEQ ID NO: 1582121 - DNA, 16 bp, Homo sapiens
ccctgaaaacccagag

SEQ ID NO: 1582122 - DNA, 17 bp, Homo sapiens
ccctgaaaacccagaga

SEQ ID NO: 1582123 - DNA, 18 bp, Homo sapiens
ccctgaaagcctcacgta

SEQ ID NO: 1582124 - DNA, 14 bp, Homo sapiens
ccctgaacaagaat

SEQ ID NO: 1582125 - DNA, 13 bp, Homo sapiens
ccctgaaccatcc

SEQ ID NO: 1582126 - DNA, 18 bp, Homo sapiens
ccctgaacccctggccag

SEQ ID NO: 1582127 - DNA, 19 bp, Homo sapiens
ccctgaacccctggccagc

SEQ ID NO: 1582128 - DNA, 22 bp, Homo sapiens
ccctgaacgttttcttctttcc

SEQ ID NO: 1582129 - DNA, 18 bp, Homo sapiens
ccctgaagatttcagagg

SEQ ID NO: 1582130 - DNA, 19 bp, Homo sapiens
ccctgaagatttcagaggc

SEQ ID NO: 1582131 - DNA, 19 bp, Homo sapiens
ccctgaagctgtgcggagc

SEQ ID NO: 1582132 - DNA, 23 bp, Homo sapiens
ccctgaaggaacattccttagtc

SEQ ID NO: 1582133 - DNA, 16 bp, Homo sapiens
ccctgacctaccccag

SEQ ID NO: 1582134 - DNA, 22 bp, Homo sapiens
ccctgaccttagcgttctggac

SEQ ID NO: 1582135 - DNA, 13 bp, Homo sapiens
ccctgactctctg

SEQ ID NO: 1582136 - DNA, 17 bp, Homo sapiens
ccctgactctctgtgac

SEQ ID NO: 1582137 - DNA, 13 bp, Homo sapiens
ccctgacttctgg

SEQ ID NO: 1582138 - DNA, 18 bp, Homo sapiens
ccctgagaaacccaccag

SEQ ID NO: 1582139 - DNA, 16 bp, Homo sapiens
ccctgagacaaatgga

SEQ ID NO: 1582140 - DNA, 13 bp, Homo sapiens
ccctgagactcca

SEQ ID NO: 1582141 - DNA, 22 bp, Homo sapiens
ccctgagatctgcacagtcaga

SEQ ID NO: 1582142 - DNA, 21 bp, Homo sapiens
ccctgagcaatgtctgtgcta

SEQ ID NO: 1582143 - DNA, 23 bp, Homo sapiens
ccctgagcagaatactggtctca

SEQ ID NO: 1582144 - DNA, 11 bp, Homo sapiens
ccctgagcagg

SEQ ID NO: 1582145 - DNA, 14 bp, Homo sapiens
ccctgagcatcctg

SEQ ID NO: 1582146 - DNA, 12 bp, Homo sapiens
ccctgagctcgg

SEQ ID NO: 1582147 - DNA, 12 bp, Homo sapiens
ccctgaggactg

SEQ ID NO: 1582148 - DNA, 13 bp, Homo sapiens
ccctgaggactgg

SEQ ID NO: 1582149 - DNA, 14 bp, Homo sapiens
ccctgaggagccag

SEQ ID NO: 1582150 - DNA, 16 bp, Homo sapiens
ccctgaggcagcccag

SEQ ID NO: 1582151 - DNA, 22 bp, Homo sapiens
ccctgaggcaggtgagaaccca

SEQ ID NO: 1582152 - DNA, 19 bp, Homo sapiens
ccctgaggcctagactctg

SEQ ID NO: 1582153 - DNA, 13 bp, Homo sapiens
ccctgaggcttca

SEQ ID NO: 1582154 - DNA, 16 bp, Homo sapiens
ccctgaggtcactgct

SEQ ID NO: 1582155 - DNA, 17 bp, Homo sapiens
ccctgaggtcactgcta

SEQ ID NO: 1582156 - DNA, 15 bp, Homo sapiens
ccctgaggtgtgggg

SEQ ID NO: 1582157 - DNA, 19 bp, Homo sapiens
ccctgagtcaactggagca

SEQ ID NO: 1582158 - DNA, 16 bp, Homo sapiens
ccctgagtctgggcag

SEQ ID NO: 1582159 - DNA, 20 bp, Homo sapiens
ccctgatcaagtcaccggag

SEQ ID NO: 1582160 - DNA, 16 bp, Homo sapiens
ccctgatcccattttc

SEQ ID NO: 1582161 - DNA, 21 bp, Homo sapiens
ccctgatttaggagaagccag

SEQ ID NO: 1582162 - DNA, 16 bp, Homo sapiens
ccctgcacaagccagg

SEQ ID NO: 1582163 - DNA, 20 bp, Homo sapiens
ccctgcacagatatttccat

SEQ ID NO: 1582164 - DNA, 13 bp, Homo sapiens
ccctgcacagttg

SEQ ID NO: 1582165 - DNA, 21 bp, Homo sapiens
ccctgcacccacccctgccca

SEQ ID NO: 1582166 - DNA, 22 bp, Homo sapiens
ccctgcacccacccctgcccag

SEQ ID NO: 1582167 - DNA, 13 bp, Homo sapiens
ccctgcaccctgg

SEQ ID NO: 1582168 - DNA, 14 bp, Homo sapiens
ccctgcaccctgga

SEQ ID NO: 1582169 - DNA, 16 bp, Homo sapiens
ccctgcacctgctgcg

SEQ ID NO: 1582170 - DNA, 12 bp, Homo sapiens
ccctgcacctgg

SEQ ID NO: 1582171 - DNA, 15 bp, Homo sapiens
ccctgcacctggcct

SEQ ID NO: 1582172 - DNA, 16 bp, Homo sapiens
ccctgcacctggcctg

SEQ ID NO: 1582173 - DNA, 17 bp, Homo sapiens
ccctgcactgtaaaatg

SEQ ID NO: 1582174 - DNA, 17 bp, Homo sapiens
ccctgcacttcagacac

SEQ ID NO: 1582175 - DNA, 13 bp, Homo sapiens
ccctgcagactcc

SEQ ID NO: 1582176 - DNA, 20 bp, Homo sapiens
ccctgcagatgccaccctag

SEQ ID NO: 1582177 - DNA, 22 bp, Homo sapiens
ccctgcagggccatctgactgc

SEQ ID NO: 1582178 - DNA, 18 bp, Homo sapiens
ccctgcagtttggccctg

SEQ ID NO: 1582179 - DNA, 19 bp, Homo sapiens
ccctgcagtttggccctgg

SEQ ID NO: 1582180 - DNA, 18 bp, Homo sapiens
ccctgcattggcctggcc

SEQ ID NO: 1582181 - DNA, 19 bp, Homo sapiens
ccctgcattggcctggcct

SEQ ID NO: 1582182 - DNA, 19 bp, Homo sapiens
ccctgcattttcctcttgt

SEQ ID NO: 1582183 - DNA, 18 bp, Homo sapiens
ccctgccaagactcctca

SEQ ID NO: 1582184 - DNA, 17 bp, Homo sapiens
ccctgccaagtctcaga

SEQ ID NO: 1582185 - DNA, 18 bp, Homo sapiens
ccctgccacactcagtcc

SEQ ID NO: 1582186 - DNA, 20 bp, Homo sapiens
ccctgccacactcagtcccc

SEQ ID NO: 1582187 - DNA, 18 bp, Homo sapiens
ccctgccactcactaggc

SEQ ID NO: 1582188 - DNA, 19 bp, Homo sapiens
ccctgccactcactaggcc

SEQ ID NO: 1582189 - DNA, 21 bp, Homo sapiens
ccctgccacttcaacccccag

SEQ ID NO: 1582190 - DNA, 22 bp, Homo sapiens
ccctgccaggagctttggacct

SEQ ID NO: 1582191 - DNA, 15 bp, Homo sapiens
ccctgccagtgcctt

SEQ ID NO: 1582192 - DNA, 20 bp, Homo sapiens
ccctgccatcatgtttacag

SEQ ID NO: 1582193 - DNA, 17 bp, Homo sapiens
ccctgccatcttcccag

SEQ ID NO: 1582194 - DNA, 14 bp, Homo sapiens
ccctgcccccagga

SEQ ID NO: 1582195 - DNA, 20 bp, Homo sapiens
ccctgcccccaggactgggc

SEQ ID NO: 1582196 - DNA, 15 bp, Homo sapiens
ccctgcccccatctc

SEQ ID NO: 1582197 - DNA, 21 bp, Homo sapiens
ccctgcccccatctccccagg

SEQ ID NO: 1582198 - DNA, 23 bp, Homo sapiens
ccctgcccccatctccccaggcc

SEQ ID NO: 1582199 - DNA, 14 bp, Homo sapiens
ccctgccccccaag

SEQ ID NO: 1582200 - DNA, 15 bp, Homo sapiens
ccctgccccccagcc

SEQ ID NO: 1582201 - DNA, 19 bp, Homo sapiens
ccctgccccccagcctctg

SEQ ID NO: 1582202 - DNA, 21 bp, Homo sapiens
ccctgcccctaggatgctgca

SEQ ID NO: 1582203 - DNA, 18 bp, Homo sapiens
ccctgcccgagagagctc

SEQ ID NO: 1582204 - DNA, 23 bp, Homo sapiens
ccctgcccggtggtttgccatgt

SEQ ID NO: 1582205 - DNA, 20 bp, Homo sapiens
ccctgcccgttcttgaaatg

SEQ ID NO: 1582206 - DNA, 18 bp, Homo sapiens
ccctgccctcccctgctc

SEQ ID NO: 1582207 - DNA, 19 bp, Homo sapiens
ccctgccctcgtggccagc

SEQ ID NO: 1582208 - DNA, 20 bp, Homo sapiens
ccctgccctcgtggccagcc

SEQ ID NO: 1582209 - DNA, 22 bp, Homo sapiens
ccctgccctcgtggccagcccg

SEQ ID NO: 1582210 - DNA, 11 bp, Homo sapiens
ccctgccctct

SEQ ID NO: 1582211 - DNA, 13 bp, Homo sapiens
ccctgccctggga

SEQ ID NO: 1582212 - DNA, 16 bp, Homo sapiens
ccctggcttgcttgcc

SEQ ID NO: 1582213 - DNA, 14 bp, Homo sapiens
ccctggcttggagg

SEQ ID NO: 1582214 - DNA, 19 bp, Homo sapiens
ccctggcttgtaactccac

SEQ ID NO: 1582215 - DNA, 18 bp, Homo sapiens
ccctggctttgcctcttc

SEQ ID NO: 1582216 - DNA, 20 bp, Homo sapiens
ccctggctttgcctcttctt

SEQ ID NO: 1582217 - DNA, 17 bp, Homo sapiens
ccctggcttttcactgc

SEQ ID NO: 1582218 - DNA, 18 bp, Homo sapiens
ccctggcttttcactgct

SEQ ID NO: 1582219 - DNA, 18 bp, Homo sapiens
ccctgggaaccactccca

SEQ ID NO: 1582220 - DNA, 19 bp, Homo sapiens
ccctgggagccagtcctcc

SEQ ID NO: 1582221 - DNA, 19 bp, Homo sapiens
ccctgggagggaggtggtc

SEQ ID NO: 1582222 - DNA, 18 bp, Homo sapiens
ccctgggcaaacagagct

SEQ ID NO: 1582223 - DNA, 19 bp, Homo sapiens
ccctgggcatcttctggct

SEQ ID NO: 1582224 - DNA, 16 bp, Homo sapiens
ccctgggccccaccac

SEQ ID NO: 1582225 - DNA, 19 bp, Homo sapiens
ccctgggctaccatctgca

SEQ ID NO: 1582226 - DNA, 13 bp, Homo sapiens
ccctgggctctca

SEQ ID NO: 1582227 - DNA, 15 bp, Homo sapiens
ccctgggctctgccc

SEQ ID NO: 1582228 - DNA, 16 bp, Homo sapiens
ccctgggctctgcccc

SEQ ID NO: 1582229 - DNA, 15 bp, Homo sapiens
ccctgggctggggag

SEQ ID NO: 1582230 - DNA, 16 bp, Homo sapiens
ccctgggctggggagg

SEQ ID NO: 1582231 - DNA, 21 bp, Homo sapiens
ccctgggctggggaggaggag

SEQ ID NO: 1582232 - DNA, 17 bp, Homo sapiens
ccctgggcttggcctgc

SEQ ID NO: 1582233 - DNA, 18 bp, Homo sapiens
ccctgggcttggcctgct

SEQ ID NO: 1582234 - DNA, 22 bp, Homo sapiens
ccctgggcttggcctgctgtga

SEQ ID NO: 1582235 - DNA, 13 bp, Homo sapiens
ccctggggaaata

SEQ ID NO: 1582236 - DNA, 19 bp, Homo sapiens
ccctggggaaggagccagt

SEQ ID NO: 1582237 - DNA, 17 bp, Homo sapiens
ccctggggaccaggagc

SEQ ID NO: 1582238 - DNA, 18 bp, Homo sapiens
ccctggggaccaggagct

SEQ ID NO: 1582239 - DNA, 20 bp, Homo sapiens
ccctggggaccaggagctag

SEQ ID NO: 1582240 - DNA, 13 bp, Homo sapiens
ccctggggcctgg

SEQ ID NO: 1582241 - DNA, 14 bp, Homo sapiens
ccctggggcctgga

SEQ ID NO: 1582242 - DNA, 23 bp, Homo sapiens
ccctggggctgagtctccagggc

SEQ ID NO: 1582243 - DNA, 13 bp, Homo sapiens
ccctggggctgta

SEQ ID NO: 1582244 - DNA, 21 bp, Homo sapiens
ccctgggggcacaggaggcag

SEQ ID NO: 1582245 - DNA, 15 bp, Homo sapiens
ccctgggtaccctga

SEQ ID NO: 1582246 - DNA, 17 bp, Homo sapiens
ccctgggtcctccaaag

SEQ ID NO: 1582247 - DNA, 19 bp, Homo sapiens
ccctgggtgccattcccag

SEQ ID NO: 1582248 - DNA, 21 bp, Homo sapiens
ccctgggtgggtggtggggag

SEQ ID NO: 1582249 - DNA, 23 bp, Homo sapiens
ccctgggtgggtggtggggaggg

SEQ ID NO: 1582250 - DNA, 16 bp, Homo sapiens
ccctggtccagggaag

SEQ ID NO: 1582251 - DNA, 16 bp, Homo sapiens
ccctggtcctgacttc

SEQ ID NO: 1582252 - DNA, 15 bp, Homo sapiens
ccctggtcctggcct

SEQ ID NO: 1582253 - DNA, 17 bp, Homo sapiens
ccctggtcctggcctcc

SEQ ID NO: 1582254 - DNA, 18 bp, Homo sapiens
ccctggtccttcactggc

SEQ ID NO: 1582255 - DNA, 13 bp, Homo sapiens
ccctggtccttcc

SEQ ID NO: 1582256 - DNA, 19 bp, Homo sapiens
ccctggtgcctctgtgcac

SEQ ID NO: 1582257 - DNA, 21 bp, Homo sapiens
ccctggtgcctctgtgcacag

SEQ ID NO: 1582258 - DNA, 17 bp, Homo sapiens
ccctggtggacagtcct

SEQ ID NO: 1582259 - DNA, 18 bp, Homo sapiens
ccctggtggacagtcctg

SEQ ID NO: 1582260 - DNA, 23 bp, Homo sapiens
ccctggtggacagtcctgggaga

SEQ ID NO: 1582261 - DNA, 23 bp, Homo sapiens
ccctggtggagaaagcactgacc

SEQ ID NO: 1582262 - DNA, 18 bp, Homo sapiens
ccctggttatattctcac

SEQ ID NO: 1582263 - DNA, 15 bp, Homo sapiens
ccctggttcctgctg

SEQ ID NO: 1582264 - DNA, 17 bp, Homo sapiens
ccctggttcctgctgtc

SEQ ID NO: 1582265 - DNA, 19 bp, Homo sapiens
ccctggttcctgctgtcct

SEQ ID NO: 1582266 - DNA, 22 bp, Homo sapiens
ccctggttcctgctgtcctggt

SEQ ID NO: 1582267 - DNA, 14 bp, Homo sapiens
ccctggttctcatc

SEQ ID NO: 1582268 - DNA, 13 bp, Homo sapiens
ccctgtacccagc

SEQ ID NO: 1582269 - DNA, 13 bp, Homo sapiens
ccctgtagctcag

SEQ ID NO: 1582270 - DNA, 17 bp, Homo sapiens
ccctgtagctctgcctc

SEQ ID NO: 1582271 - DNA, 18 bp, Homo sapiens
ccctgtagctctgcctcc

SEQ ID NO: 1582272 - DNA, 21 bp, Homo sapiens
ccctgtagggaaaccttggag

SEQ ID NO: 1582273 - DNA, 23 bp, Homo sapiens
ccctgtattcccacccctggact

SEQ ID NO: 1582274 - DNA, 22 bp, Homo sapiens
ccctgtcaaatatcagttaccc

SEQ ID NO: 1582275 - DNA, 18 bp, Homo sapiens
ccctgtcaagttaacaag

SEQ ID NO: 1582276 - DNA, 13 bp, Homo sapiens
ccctgtcacgctc

SEQ ID NO: 1582277 - DNA, 19 bp, Homo sapiens
ccctgtcacgctcatgtcc

SEQ ID NO: 1582278 - DNA, 15 bp, Homo sapiens
ccctgtcactcagct

SEQ ID NO: 1582279 - DNA, 12 bp, Homo sapiens
ccctgtcccacc

SEQ ID NO: 1582280 - DNA, 15 bp, Homo sapiens
ccctgtcccaccaac

SEQ ID NO: 1582281 - DNA, 18 bp, Homo sapiens
ccctgtcccaccaactct

SEQ ID NO: 1582282 - DNA, 24 bp, Homo sapiens
ccctgtcccaccaactctgcactc

SEQ ID NO: 1582283 - DNA, 19 bp, Homo sapiens
ccctgtcccacccacacag

SEQ ID NO: 1582284 - DNA, 22 bp, Homo sapiens
ccctgtcccacccacacagctg

SEQ ID NO: 1582285 - DNA, 23 bp, Homo sapiens
ccctgtcccacccacacagctgc

SEQ ID NO: 1582286 - DNA, 22 bp, Homo sapiens
ccctgtcccacccccttccccc

SEQ ID NO: 1582287 - DNA, 18 bp, Homo sapiens
ccctgtcccccagctctg

SEQ ID NO: 1582288 - DNA, 14 bp, Homo sapiens
ccctgtcccctgaa

SEQ ID NO: 1582289 - DNA, 22 bp, Homo sapiens
ccctgtccctctagtgccttct

SEQ ID NO: 1582290 - DNA, 22 bp, Homo sapiens
ccctgtcccttcgagtccagga

SEQ ID NO: 1582291 - DNA, 14 bp, Homo sapiens
ccctgtctaaaaaa

SEQ ID NO: 1582292 - DNA, 18 bp, Homo sapiens
ccctgtctccagctgcct

SEQ ID NO: 1582293 - DNA, 14 bp, Homo sapiens
ccctgtctgtccct

SEQ ID NO: 1582294 - DNA, 22 bp, Homo sapiens
ccctgtctgtgtcccagccacg

SEQ ID NO: 1582295 - DNA, 17 bp, Homo sapiens
ccctgtcttctgggcac

SEQ ID NO: 1582296 - DNA, 21 bp, Homo sapiens
ccctgtcttctgggcacagtg

SEQ ID NO: 1582297 - DNA, 22 bp, Homo sapiens
ccctgtcttctgggcacagtgg

SEQ ID NO: 1582298 - DNA, 20 bp, Homo sapiens
ccctgtgacatggtgcctga

SEQ ID NO: 1582299 - DNA, 12 bp, Homo sapiens
ccctgtgcctgg

SEQ ID NO: 1582300 - DNA, 14 bp, Homo sapiens
ccctgtgcctgggc

SEQ ID NO: 1582301 - DNA, 23 bp, Homo sapiens
ccctgtgcctgggccctgggctg

SEQ ID NO: 1582302 - DNA, 15 bp, Homo sapiens
ccctgtgctcccctg

SEQ ID NO: 1582303 - DNA, 22 bp, Homo sapiens
ccctgtgctcccctgccacact

SEQ ID NO: 1582304 - DNA, 18 bp, Homo sapiens
ccctgtgctccgtgcctc

SEQ ID NO: 1582305 - DNA, 22 bp, Homo sapiens
ccctgtgctccgtgcctccacc

SEQ ID NO: 1582306 - DNA, 20 bp, Homo sapiens
ccctgtgctggtgtcctgac

SEQ ID NO: 1582307 - DNA, 23 bp, Homo sapiens
ccctgtgctggtgtcctgaccac

SEQ ID NO: 1582308 - DNA, 18 bp, Homo sapiens
ccctgtggagtccagctc

SEQ ID NO: 1582309 - DNA, 17 bp, Homo sapiens
ccctgtggccctggcca

SEQ ID NO: 1582310 - DNA, 14 bp, Homo sapiens
ccctgtggccgcca

SEQ ID NO: 1582311 - DNA, 17 bp, Homo sapiens
ccctgtggccgccacct

SEQ ID NO: 1582312 - DNA, 19 bp, Homo sapiens
ccctgtggggcaggagtgc

SEQ ID NO: 1582313 - DNA, 23 bp, Homo sapiens
ccctgtggggcaggagtgccagg

SEQ ID NO: 1582314 - DNA, 12 bp, Homo sapiens
ccctgtgtccac

SEQ ID NO: 1582315 - DNA, 23 bp, Homo sapiens
ccctgtgtgagttgagtctcctc

SEQ ID NO: 1582316 - DNA, 16 bp, Homo sapiens
ccctgtgttgtctcta

SEQ ID NO: 1582317 - DNA, 13 bp, Homo sapiens
ccctgttcactct

SEQ ID NO: 1582318 - DNA, 14 bp, Homo sapiens
ccctgttcactcta

SEQ ID NO: 1582319 - DNA, 14 bp, Homo sapiens
ccctgttccccaga

SEQ ID NO: 1582320 - DNA, 16 bp, Homo sapiens
ccctgttccccagaga

SEQ ID NO: 1582321 - DNA, 17 bp, Homo sapiens
ccctgttctcctcccca

SEQ ID NO: 1582322 - DNA, 22 bp, Homo sapiens
ccctgttctgttggggaggggt

SEQ ID NO: 1582323 - DNA, 15 bp, Homo sapiens
ccgctcaggggcctg

SEQ ID NO: 1582324 - DNA, 16 bp, Homo sapiens
ccgctcaggggcctgg

SEQ ID NO: 1582325 - DNA, 22 bp, Homo sapiens
ccgctcccaacccccctcctgc

SEQ ID NO: 1582326 - DNA, 16 bp, Homo sapiens
ccgctcccaccgcccc

SEQ ID NO: 1582327 - DNA, 23 bp, Homo sapiens
ccgctcccaccgcccccacccct

SEQ ID NO: 1582328 - DNA, 20 bp, Homo sapiens
ccgctcccttcctgccactg

SEQ ID NO: 1582329 - DNA, 21 bp, Homo sapiens
ccgctccgtctctgtcctcga

SEQ ID NO: 1582330 - DNA, 15 bp, Homo sapiens
ccgctcctgccgcag

SEQ ID NO: 1582331 - DNA, 22 bp, Homo sapiens
ccgctcctgccgcagacgggca

SEQ ID NO: 1582332 - DNA, 14 bp, Homo sapiens
ccgctcctgtctgc

SEQ ID NO: 1582333 - DNA, 13 bp, Homo sapiens
ccgctctccctgt

SEQ ID NO: 1582334 - DNA, 22 bp, Homo sapiens
ccgctctccctgtcacgctcat

SEQ ID NO: 1582335 - DNA, 20 bp, Homo sapiens
ccgctgaccctgggcctgga

SEQ ID NO: 1582336 - DNA, 22 bp, Homo sapiens
ccgctgaccctgggcctggagg

SEQ ID NO: 1582337 - DNA, 13 bp, Homo sapiens
ccgctgaggggtc

SEQ ID NO: 1582338 - DNA, 13 bp, Homo sapiens
ccgctgataagca

SEQ ID NO: 1582339 - DNA, 16 bp, Homo sapiens
ccgctgccccagcccc

SEQ ID NO: 1582340 - DNA, 20 bp, Homo sapiens
ccgctgcctaagtggctgct

SEQ ID NO: 1582341 - DNA, 14 bp, Homo sapiens
ccgctgctgctgct

SEQ ID NO: 1582342 - DNA, 21 bp, Homo sapiens
ccgctgctgtgctctggggat

SEQ ID NO: 1582343 - DNA, 23 bp, Homo sapiens
ccgctgcttccaggctgggcagc

SEQ ID NO: 1582344 - DNA, 17 bp, Homo sapiens
ccgggctctggccaccc

SEQ ID NO: 1582345 - DNA, 18 bp, Homo sapiens
ccgggctgagggcctgct

SEQ ID NO: 1582346 - DNA, 18 bp, Homo sapiens
ccgggctgcctgggctgt

SEQ ID NO: 1582347 - DNA, 13 bp, Homo sapiens
ccgggctgctgct

SEQ ID NO: 1582348 - DNA, 16 bp, Homo sapiens
ccgggctgctgctgat

SEQ ID NO: 1582349 - DNA, 23 bp, Homo sapiens
ccgggctgctgctgatgtaggag

SEQ ID NO: 1582350 - DNA, 17 bp, Homo sapiens
ccgggctggagaaagag

SEQ ID NO: 1582351 - DNA, 23 bp, Homo sapiens
ccgggctggagaaagagctgcct

SEQ ID NO: 1582352 - DNA, 20 bp, Homo sapiens
ccgggcttcccttctcccca

SEQ ID NO: 1582353 - DNA, 21 bp, Homo sapiens
ccgggcttcccttctccccag

SEQ ID NO: 1582354 - DNA, 22 bp, Homo sapiens
ccgggcttcccttctccccagc

SEQ ID NO: 1582355 - DNA, 21 bp, Homo sapiens
ccgggcttgggccctgcacag

SEQ ID NO: 1582356 - DNA, 15 bp, Homo sapiens
ccggggaaaggcaag

SEQ ID NO: 1582357 - DNA, 20 bp, Homo sapiens
ccggggaccttgtgggacca

SEQ ID NO: 1582358 - DNA, 15 bp, Homo sapiens
ccggggccagcactt

SEQ ID NO: 1582359 - DNA, 14 bp, Homo sapiens
ccggggccttcctt

SEQ ID NO: 1582360 - DNA, 12 bp, Homo sapiens
ccggggctggca

SEQ ID NO: 1582361 - DNA, 19 bp, Homo sapiens
ccggggctggcaagcaggg

SEQ ID NO: 1582362 - DNA, 19 bp, Homo sapiens
ccggggctggcggctactc

SEQ ID NO: 1582363 - DNA, 22 bp, Homo sapiens
ccgggggagagggacactcctc

SEQ ID NO: 1582364 - DNA, 17 bp, Homo sapiens
ccgggggcagggtgggg

SEQ ID NO: 1582365 - DNA, 19 bp, Homo sapiens
ccggggggaaagaaaagga

SEQ ID NO: 1582366 - DNA, 15 bp, Homo sapiens
ccggggtccaggccc

SEQ ID NO: 1582367 - DNA, 18 bp, Homo sapiens
ccggggtctgtgctgtgc

SEQ ID NO: 1582368 - DNA, 20 bp, Homo sapiens
ccggggtctgtgctgtgcct

SEQ ID NO: 1582369 - DNA, 22 bp, Homo sapiens
ccggggtctgtgctgtgcctgc

SEQ ID NO: 1582370 - DNA, 13 bp, Homo sapiens
cctaaacctcagt

SEQ ID NO: 1582371 - DNA, 18 bp, Homo sapiens
cctaaactacctttttgt

SEQ ID NO: 1582372 - DNA, 15 bp, Homo sapiens
cctaaagattttgat

SEQ ID NO: 1582373 - DNA, 20 bp, Homo sapiens
cctaaagtatacaactgcct

SEQ ID NO: 1582374 - DNA, 17 bp, Homo sapiens
cctaaataaatgagctg

SEQ ID NO: 1582375 - DNA, 22 bp, Homo sapiens
cctaaatatacatctgtgtatt

SEQ ID NO: 1582376 - DNA, 17 bp, Homo sapiens
cctaaatccattttcta

SEQ ID NO: 1582377 - DNA, 18 bp, Homo sapiens
cctaaatccattttctaa

SEQ ID NO: 1582378 - DNA, 16 bp, Homo sapiens
cctaaattaaattggg

SEQ ID NO: 1582379 - DNA, 18 bp, Homo sapiens
cctaaatttaatgctgcc

SEQ ID NO: 1582380 - DNA, 20 bp, Homo sapiens
cctaaatttaatgctgcctt

SEQ ID NO: 1582381 - DNA, 15 bp, Homo sapiens
cctaacatagtgtct

SEQ ID NO: 1582382 - DNA, 17 bp, Homo sapiens
cctaactagaattagta

SEQ ID NO: 1582383 - DNA, 23 bp, Homo sapiens
cctaactagaattagtatgtctg

SEQ ID NO: 1582384 - DNA, 20 bp, Homo sapiens
cctaactcttttctattttg

SEQ ID NO: 1582385 - DNA, 17 bp, Homo sapiens
cctaactgttcccttat

SEQ ID NO: 1582386 - DNA, 14 bp, Homo sapiens
cctaacttttcaat

SEQ ID NO: 1582387 - DNA, 12 bp, Homo sapiens
cctaagaatttt

SEQ ID NO: 1582388 - DNA, 22 bp, Homo sapiens
cctaagacatgtgaggaggaaa

SEQ ID NO: 1582389 - DNA, 18 bp, Homo sapiens
cctaagagtggaggagga

SEQ ID NO: 1582390 - DNA, 19 bp, Homo sapiens
cctaagagtggaggaggag

SEQ ID NO: 1582391 - DNA, 12 bp, Homo sapiens
cctaagagtgtt

SEQ ID NO: 1582392 - DNA, 21 bp, Homo sapiens
cctaagatatacttgtttttg

SEQ ID NO: 1582393 - DNA, 12 bp, Homo sapiens
cctaagccctgc

SEQ ID NO: 1582394 - DNA, 16 bp, Homo sapiens
cctaaggatctctcag

SEQ ID NO: 1582395 - DNA, 17 bp, Homo sapiens
cctaaggatctctcagg

SEQ ID NO: 1582396 - DNA, 19 bp, Homo sapiens
cctaaggatctctcaggag

SEQ ID NO: 1582397 - DNA, 23 bp, Homo sapiens
cctaaggatctctcaggagcaca

SEQ ID NO: 1582398 - DNA, 21 bp, Homo sapiens
cctaaggcatctatctgtgct

SEQ ID NO: 1582399 - DNA, 15 bp, Homo sapiens
cctaagtcaggtaat

SEQ ID NO: 1582400 - DNA, 18 bp, Homo sapiens
cctaagtggctgccttct

SEQ ID NO: 1582401 - DNA, 22 bp, Homo sapiens
cctaataaacatccttcaagaa

SEQ ID NO: 1582402 - DNA, 14 bp, Homo sapiens
cctaatccaggcag

SEQ ID NO: 1582403 - DNA, 18 bp, Homo sapiens
cctaatccaggcagatcc

SEQ ID NO: 1582404 - DNA, 18 bp, Homo sapiens
cctaatccccttctcccc

SEQ ID NO: 1582405 - DNA, 22 bp, Homo sapiens
cctaatccctgggcattgcttt

SEQ ID NO: 1582406 - DNA, 19 bp, Homo sapiens
cctaatctcatacctctga

SEQ ID NO: 1582407 - DNA, 18 bp, Homo sapiens
cctaatggctatttttga

SEQ ID NO: 1582408 - DNA, 13 bp, Homo sapiens
cctaatgtgttta

SEQ ID NO: 1582409 - DNA, 12 bp, Homo sapiens
cctaattatgaa

SEQ ID NO: 1582410 - DNA, 14 bp, Homo sapiens
cctaatttctcctc

SEQ ID NO: 1582411 - DNA, 18 bp, Homo sapiens
cctaatttctcctccctt

SEQ ID NO: 1582412 - DNA, 17 bp, Homo sapiens
cctacaagagcagcctg

SEQ ID NO: 1582413 - DNA, 19 bp, Homo sapiens
cctacaagatttagaaaaa

SEQ ID NO: 1582414 - DNA, 16 bp, Homo sapiens
cctacaataaaaagaa

SEQ ID NO: 1582415 - DNA, 16 bp, Homo sapiens
cctacagactccatct

SEQ ID NO: 1582416 - DNA, 18 bp, Homo sapiens
cctacagactccatctct

SEQ ID NO: 1582417 - DNA, 14 bp, Homo sapiens
cctacagcctgcac

SEQ ID NO: 1582418 - DNA, 20 bp, Homo sapiens
cctacagcctgcacacacct

SEQ ID NO: 1582419 - DNA, 14 bp, Homo sapiens
cctacagctgtctt

SEQ ID NO: 1582420 - DNA, 17 bp, Homo sapiens
cctacatatcccttcca

SEQ ID NO: 1582421 - DNA, 13 bp, Homo sapiens
cctaccaggactc

SEQ ID NO: 1582422 - DNA, 17 bp, Homo sapiens
cctacccagctgatggg

SEQ ID NO: 1582423 - DNA, 13 bp, Homo sapiens
cctaccccacacc

SEQ ID NO: 1582424 - DNA, 20 bp, Homo sapiens
cctaccccacaccaggccgt

SEQ ID NO: 1582425 - DNA, 23 bp, Homo sapiens
cctaccccacaccaggccgtcct

SEQ ID NO: 1582426 - DNA, 20 bp, Homo sapiens
cctaccccagccaggctcct

SEQ ID NO: 1582427 - DNA, 12 bp, Homo sapiens
cctaccccatag

SEQ ID NO: 1582428 - DNA, 22 bp, Homo sapiens
cctaccccatggtgctaggaag

SEQ ID NO: 1582429 - DNA, 22 bp, Homo sapiens
cctaccccttggaaatgtctgc

SEQ ID NO: 1582430 - DNA, 15 bp, Homo sapiens
cctaccctaaccaag

SEQ ID NO: 1582431 - DNA, 16 bp, Homo sapiens
cctaccctaaccaagt

SEQ ID NO: 1582432 - DNA, 19 bp, Homo sapiens
cctaccctcgggcccacct

SEQ ID NO: 1582433 - DNA, 23 bp, Homo sapiens
cctaccctggcagggacctgaga

SEQ ID NO: 1582434 - DNA, 16 bp, Homo sapiens
cctaccgagtctcttc

SEQ ID NO: 1582435 - DNA, 13 bp, Homo sapiens
cctacctcagcct

SEQ ID NO: 1582436 - DNA, 18 bp, Homo sapiens
cctacctcagcctagacc

SEQ ID NO: 1582437 - DNA, 15 bp, Homo sapiens
cctacctcaggcagg

SEQ ID NO: 1582438 - DNA, 14 bp, Homo sapiens
cctaccttccccag

SEQ ID NO: 1582439 - DNA, 15 bp, Homo sapiens
cctaccttccccaga

SEQ ID NO: 1582440 - DNA, 16 bp, Homo sapiens
cctaccttccccagac

SEQ ID NO: 1582441 - DNA, 15 bp, Homo sapiens
cctaccttgcctcct

SEQ ID NO: 1582442 - DNA, 12 bp, Homo sapiens
cctactattggc

SEQ ID NO: 1582443 - DNA, 13 bp, Homo sapiens
cctgcagccagct

SEQ ID NO: 1582444 - DNA, 18 bp, Homo sapiens
cctgcagcccaaaaccca

SEQ ID NO: 1582445 - DNA, 22 bp, Homo sapiens
cctgcagcccaaaacccagggc

SEQ ID NO: 1582446 - DNA, 22 bp, Homo sapiens
cctgcagcccctcctcctcggg

SEQ ID NO: 1582447 - DNA, 18 bp, Homo sapiens
cctgcaggaacgagcact

SEQ ID NO: 1582448 - DNA, 23 bp, Homo sapiens
cctgcaggcaggaacaaacaggg

SEQ ID NO: 1582449 - DNA, 12 bp, Homo sapiens
cctgcaggctcc

SEQ ID NO: 1582450 - DNA, 13 bp, Homo sapiens
cctgcaggctgga

SEQ ID NO: 1582451 - DNA, 15 bp, Homo sapiens
cctgcaggctggaga

SEQ ID NO: 1582452 - DNA, 17 bp, Homo sapiens
cctgcaggctggagact

SEQ ID NO: 1582453 - DNA, 13 bp, Homo sapiens
cctgcaggctggc

SEQ ID NO: 1582454 - DNA, 14 bp, Homo sapiens
cctgcaggctggct

SEQ ID NO: 1582455 - DNA, 19 bp, Homo sapiens
cctgcaggctggctgttgg

SEQ ID NO: 1582456 - DNA, 22 bp, Homo sapiens
cctgcaggcttaggtcctcact

SEQ ID NO: 1582457 - DNA, 21 bp, Homo sapiens
cctgcagggccatctgactgc

SEQ ID NO: 1582458 - DNA, 17 bp, Homo sapiens
cctgcagggccatggct

SEQ ID NO: 1582459 - DNA, 15 bp, Homo sapiens
cctgcagggcttctc

SEQ ID NO: 1582460 - DNA, 22 bp, Homo sapiens
cctgcaggggcaaggggctggc

SEQ ID NO: 1582461 - DNA, 19 bp, Homo sapiens
cctgcagggtggtgctggg

SEQ ID NO: 1582462 - DNA, 17 bp, Homo sapiens
cctgcaggtcagttgta

SEQ ID NO: 1582463 - DNA, 16 bp, Homo sapiens
cctgcaggtcctggtg

SEQ ID NO: 1582464 - DNA, 14 bp, Homo sapiens
cctgcaggtgagca

SEQ ID NO: 1582465 - DNA, 20 bp, Homo sapiens
cctgcaggtgagcaggcagg

SEQ ID NO: 1582466 - DNA, 15 bp, Homo sapiens
cctgcagtcacagct

SEQ ID NO: 1582467 - DNA, 19 bp, Homo sapiens
cctgcagtgattcagcagg

SEQ ID NO: 1582468 - DNA, 13 bp, Homo sapiens
cctgcagtgccag

SEQ ID NO: 1582469 - DNA, 19 bp, Homo sapiens
cctgcagtttggccctgga

SEQ ID NO: 1582470 - DNA, 22 bp, Homo sapiens
cctgcatcccgatacctcagcc

SEQ ID NO: 1582471 - DNA, 19 bp, Homo sapiens
cctgcatccgtagttccct

SEQ ID NO: 1582472 - DNA, 21 bp, Homo sapiens
cctgcatgagctggcaaccag

SEQ ID NO: 1582473 - DNA, 22 bp, Homo sapiens
cctgcatgagctggcaaccagc

SEQ ID NO: 1582474 - DNA, 13 bp, Homo sapiens
cctgcatgttctg

SEQ ID NO: 1582475 - DNA, 21 bp, Homo sapiens
cctgcattggcctggcctcca

SEQ ID NO: 1582476 - DNA, 16 bp, Homo sapiens
cctgcattttcctctt

SEQ ID NO: 1582477 - DNA, 22 bp, Homo sapiens
cctgcattttcctcttgtcctg

SEQ ID NO: 1582478 - DNA, 17 bp, Homo sapiens
cctgccaagactcctca

SEQ ID NO: 1582479 - DNA, 18 bp, Homo sapiens
cctgccaagactcctcag

SEQ ID NO: 1582480 - DNA, 13 bp, Homo sapiens
cctgccaattgct

SEQ ID NO: 1582481 - DNA, 22 bp, Homo sapiens
cctgccacaaaccaccaggact

SEQ ID NO: 1582482 - DNA, 15 bp, Homo sapiens
cctgccacactcagt

SEQ ID NO: 1582483 - DNA, 20 bp, Homo sapiens
cctgccacactgatggctca

SEQ ID NO: 1582484 - DNA, 21 bp, Homo sapiens
cctgccacactgatggctcaa

SEQ ID NO: 1582485 - DNA, 17 bp, Homo sapiens
cctgccacatggagccc

SEQ ID NO: 1582486 - DNA, 14 bp, Homo sapiens
cctgccaccaggcc

SEQ ID NO: 1582487 - DNA, 18 bp, Homo sapiens
cctgccaccaggccacct

SEQ ID NO: 1582488 - DNA, 19 bp, Homo sapiens
cctgccaccaggccacctc

SEQ ID NO: 1582489 - DNA, 21 bp, Homo sapiens
cctgccacccccttccctggg

SEQ ID NO: 1582490 - DNA, 15 bp, Homo sapiens
cctgccactcactag

SEQ ID NO: 1582491 - DNA, 15 bp, Homo sapiens
cctgccactctctgg

SEQ ID NO: 1582492 - DNA, 22 bp, Homo sapiens
cctgccactctctgggactctc

SEQ ID NO: 1582493 - DNA, 23 bp, Homo sapiens
cctgccagaggatgctctttccc

SEQ ID NO: 1582494 - DNA, 16 bp, Homo sapiens
cctgccagcctggctt

SEQ ID NO: 1582495 - DNA, 21 bp, Homo sapiens
cctgccagcctggcttctgga

SEQ ID NO: 1582496 - DNA, 17 bp, Homo sapiens
cctgccagctgcactga

SEQ ID NO: 1582497 - DNA, 19 bp, Homo sapiens
cctgccaggcaggggtggg

SEQ ID NO: 1582498 - DNA, 12 bp, Homo sapiens
cctgccaggccg

SEQ ID NO: 1582499 - DNA, 13 bp, Homo sapiens
cctgccagtgcct

SEQ ID NO: 1582500 - DNA, 14 bp, Homo sapiens
cctgccagtgcctt

SEQ ID NO: 1582501 - DNA, 23 bp, Homo sapiens
cctgccagtgccttacctcctgc

SEQ ID NO: 1582502 - DNA, 16 bp, Homo sapiens
cctgccatcatgcctg

SEQ ID NO: 1582503 - DNA, 14 bp, Homo sapiens
cctgccatcttccc

SEQ ID NO: 1582504 - DNA, 15 bp, Homo sapiens
cctgccatcttccca

SEQ ID NO: 1582505 - DNA, 19 bp, Homo sapiens
cctgccatcttctccccga

SEQ ID NO: 1582506 - DNA, 17 bp, Homo sapiens
cctgccatgtttagtga

SEQ ID NO: 1582507 - DNA, 16 bp, Homo sapiens
cctgccattcttctgg

SEQ ID NO: 1582508 - DNA, 18 bp, Homo sapiens
cctgccattcttctggtg

SEQ ID NO: 1582509 - DNA, 21 bp, Homo sapiens
cctgccattcttctggtgcta

SEQ ID NO: 1582510 - DNA, 18 bp, Homo sapiens
cctgccatttaaaaagtt

SEQ ID NO: 1582511 - DNA, 23 bp, Homo sapiens
cctgcccaatgagactctagggt

SEQ ID NO: 1582512 - DNA, 13 bp, Homo sapiens
cctgcccagccca

SEQ ID NO: 1582513 - DNA, 14 bp, Homo sapiens
cctgcccaggagca

SEQ ID NO: 1582514 - DNA, 16 bp, Homo sapiens
cctgcccaggagcagc

SEQ ID NO: 1582515 - DNA, 18 bp, Homo sapiens
cctgcccaggagcagctt

SEQ ID NO: 1582516 - DNA, 17 bp, Homo sapiens
cctgcccatgccccagt

SEQ ID NO: 1582517 - DNA, 17 bp, Homo sapiens
cctgccccaagggccca

SEQ ID NO: 1582518 - DNA, 18 bp, Homo sapiens
cctgccccaagggcccag

SEQ ID NO: 1582519 - DNA, 13 bp, Homo sapiens
cctgccccacccc

SEQ ID NO: 1582520 - DNA, 22 bp, Homo sapiens
cctgccccaccccacctcacag

SEQ ID NO: 1582521 - DNA, 16 bp, Homo sapiens
cctgccccaccccatc

SEQ ID NO: 1582522 - DNA, 23 bp, Homo sapiens
cctgccccaccccatccagccag

SEQ ID NO: 1582523 - DNA, 18 bp, Homo sapiens
cctgccccaggcctgaaa

SEQ ID NO: 1582524 - DNA, 17 bp, Homo sapiens
cctgcccccagccccgg

SEQ ID NO: 1582525 - DNA, 18 bp, Homo sapiens
cctgcccccagccccggg

SEQ ID NO: 1582526 - DNA, 20 bp, Homo sapiens
cctgcccccaggactgggcc

SEQ ID NO: 1582527 - DNA, 22 bp, Homo sapiens
cctgcccccaggactgggccac

SEQ ID NO: 1582528 - DNA, 23 bp, Homo sapiens
cctgcccccatctccccaggcct

SEQ ID NO: 1582529 - DNA, 21 bp, Homo sapiens
cctgccccccaaggttctggt

SEQ ID NO: 1582530 - DNA, 15 bp, Homo sapiens
cctgccccccagcct

SEQ ID NO: 1582531 - DNA, 19 bp, Homo sapiens
cctgccccccctaagagac

SEQ ID NO: 1582532 - DNA, 13 bp, Homo sapiens
cctgccccctggt

SEQ ID NO: 1582533 - DNA, 15 bp, Homo sapiens
cctgccccctggtgg

SEQ ID NO: 1582534 - DNA, 18 bp, Homo sapiens
cctgccccgcccccagtc

SEQ ID NO: 1582535 - DNA, 12 bp, Homo sapiens
cctgccccgttg

SEQ ID NO: 1582536 - DNA, 15 bp, Homo sapiens
cctgcccctcccttc

SEQ ID NO: 1582537 - DNA, 18 bp, Homo sapiens
cctgcccctcccttcaac

SEQ ID NO: 1582538 - DNA, 15 bp, Homo sapiens
cctgcccctctcccg

SEQ ID NO: 1582539 - DNA, 17 bp, Homo sapiens
cctgccccttaacccca

SEQ ID NO: 1582540 - DNA, 16 bp, Homo sapiens
cctgccccttccttta

SEQ ID NO: 1582541 - DNA, 17 bp, Homo sapiens
cctgcccgagagagctc

SEQ ID NO: 1582542 - DNA, 20 bp, Homo sapiens
cctgcccgcaccctggcctg

SEQ ID NO: 1582543 - DNA, 24 bp, Homo sapiens
cctgcccgcaccctggcctggtcc

SEQ ID NO: 1582544 - DNA, 14 bp, Homo sapiens
cctgcccgctccca

SEQ ID NO: 1582545 - DNA, 14 bp, Homo sapiens
cctgccctagctcc

SEQ ID NO: 1582546 - DNA, 18 bp, Homo sapiens
cctgccctcaagggtgtg

SEQ ID NO: 1582547 - DNA, 15 bp, Homo sapiens
cctgccctcccaagt

SEQ ID NO: 1582548 - DNA, 16 bp, Homo sapiens
cctgccctcccaagtc

SEQ ID NO: 1582549 - DNA, 14 bp, Homo sapiens
cctgccctcccctg

SEQ ID NO: 1582550 - DNA, 19 bp, Homo sapiens
cctgccctcccgcaccttc

SEQ ID NO: 1582551 - DNA, 17 bp, Homo sapiens
cctgccctcgtggccag

SEQ ID NO: 1582552 - DNA, 20 bp, Homo sapiens
cctgccctcgtggccagccc

SEQ ID NO: 1582553 - DNA, 15 bp, Homo sapiens
cctgccctctattta

SEQ ID NO: 1582554 - DNA, 19 bp, Homo sapiens
cctgccctctatttattag

SEQ ID NO: 1582555 - DNA, 13 bp, Homo sapiens
cctgccctctctg

SEQ ID NO: 1582556 - DNA, 14 bp, Homo sapiens
cctgccctctctgc

SEQ ID NO: 1582557 - DNA, 23 bp, Homo sapiens
cctgccctctgctctgcctggag

SEQ ID NO: 1582558 - DNA, 13 bp, Homo sapiens
cctgccctgcctg

SEQ ID NO: 1582559 - DNA, 14 bp, Homo sapiens
cctgccctgcctga

SEQ ID NO: 1582560 - DNA, 16 bp, Homo sapiens
cctgcccttcctcctg

SEQ ID NO: 1582561 - DNA, 23 bp, Homo sapiens
cctgcccttgaaccccctccctg

SEQ ID NO: 1582562 - DNA, 19 bp, Homo sapiens
cctgccgaaaacaggagca

SEQ ID NO: 1582563 - DNA, 15 bp, Homo sapiens
cctgccgaacacaca

SEQ ID NO: 1582564 - DNA, 13 bp, Homo sapiens
cctgccgcagagc

SEQ ID NO: 1582565 - DNA, 16 bp, Homo sapiens
cctgccgcagagctgg

SEQ ID NO: 1582566 - DNA, 18 bp, Homo sapiens
cctgccgcccccgcctgg

SEQ ID NO: 1582567 - DNA, 18 bp, Homo sapiens
cctgccggtgcacaggcc

SEQ ID NO: 1582568 - DNA, 22 bp, Homo sapiens
cctgccggtgggaccctgtccg

SEQ ID NO: 1582569 - DNA, 14 bp, Homo sapiens
cctgccgtgcatgg

SEQ ID NO: 1582570 - DNA, 20 bp, Homo sapiens
cctgccgtgcatggctcctg

SEQ ID NO: 1582571 - DNA, 22 bp, Homo sapiens
cctgcctacacacacagcctat

SEQ ID NO: 1582572 - DNA, 16 bp, Homo sapiens
cctgcctcaccctccc

SEQ ID NO: 1582573 - DNA, 16 bp, Homo sapiens
cctgcctcagcctccc

SEQ ID NO: 1582574 - DNA, 13 bp, Homo sapiens
cctgcctcagtgg

SEQ ID NO: 1582575 - DNA, 17 bp, Homo sapiens
cctgcctccagggctgg

SEQ ID NO: 1582576 - DNA, 21 bp, Homo sapiens
cctgcctccagggctggactg

SEQ ID NO: 1582577 - DNA, 23 bp, Homo sapiens
cctgcctccagggctggactgag

SEQ ID NO: 1582578 - DNA, 13 bp, Homo sapiens
cctgcctcccaag

SEQ ID NO: 1582579 - DNA, 19 bp, Homo sapiens
cctgcctcccctccgcagc

SEQ ID NO: 1582580 - DNA, 19 bp, Homo sapiens
cctgcctcctgccacccct

SEQ ID NO: 1582581 - DNA, 20 bp, Homo sapiens
cctgcctctcatcaactgaa

SEQ ID NO: 1582582 - DNA, 13 bp, Homo sapiens
cctgcctctgcct

SEQ ID NO: 1582583 - DNA, 18 bp, Homo sapiens
cctgcctgagcccaggag

SEQ ID NO: 1582584 - DNA, 21 bp, Homo sapiens
cctgcctgagcccaggagctg

SEQ ID NO: 1582585 - DNA, 16 bp, Homo sapiens
cctgcctgaggaggag

SEQ ID NO: 1582586 - DNA, 14 bp, Homo sapiens
cctgcctgagggcc

SEQ ID NO: 1582587 - DNA, 18 bp, Homo sapiens
cctgcctgagggcccctc

SEQ ID NO: 1582588 - DNA, 21 bp, Homo sapiens
cctgcctgagggcccctctgc

SEQ ID NO: 1582589 - DNA, 18 bp, Homo sapiens
cctgcctgatccctgaac

SEQ ID NO: 1582590 - DNA, 11 bp, Homo sapiens
cctgcctggcc

SEQ ID NO: 1582591 - DNA, 19 bp, Homo sapiens
cctgcctggtgcattgctg

SEQ ID NO: 1582592 - DNA, 13 bp, Homo sapiens
cctgcctgtctcc

SEQ ID NO: 1582593 - DNA, 14 bp, Homo sapiens
cctgcctgtctcct

SEQ ID NO: 1582594 - DNA, 17 bp, Homo sapiens
cctgcctgtctgtctct

SEQ ID NO: 1582595 - DNA, 18 bp, Homo sapiens
cctgcctgtctgtctctc

SEQ ID NO: 1582596 - DNA, 22 bp, Homo sapiens
cctgcctgtctgtctctccatc

SEQ ID NO: 1582597 - DNA, 12 bp, Homo sapiens
cctgcctgtgtg

SEQ ID NO: 1582598 - DNA, 14 bp, Homo sapiens
cctgccttcgttaa

SEQ ID NO: 1582599 - DNA, 13 bp, Homo sapiens
cctgccttgaagc

SEQ ID NO: 1582600 - DNA, 21 bp, Homo sapiens
cctgccttgaagccactgaag

SEQ ID NO: 1582601 - DNA, 23 bp, Homo sapiens
cctgccttgaagccactgaagct

SEQ ID NO: 1582602 - DNA, 15 bp, Homo sapiens
cctgcctttaagcca

SEQ ID NO: 1582603 - DNA, 20 bp, Homo sapiens
cctgcctttaagccaaagaa

SEQ ID NO: 1582604 - DNA, 22 bp, Homo sapiens
cctgcctttaagccaaagaaac

SEQ ID NO: 1582605 - DNA, 15 bp, Homo sapiens
cctgcgaaggggccc

SEQ ID NO: 1582606 - DNA, 17 bp, Homo sapiens
cctgcgaaggggccctg

SEQ ID NO: 1582607 - DNA, 20 bp, Homo sapiens
cctgcgagggccgcccgctc

SEQ ID NO: 1582608 - DNA, 20 bp, Homo sapiens
cctgcgccaccgcccagaga

SEQ ID NO: 1582609 - DNA, 19 bp, Homo sapiens
cctgcggagtgaagagggg

SEQ ID NO: 1582610 - DNA, 19 bp, Homo sapiens
cctgcgggcttttccccgg

SEQ ID NO: 1582611 - DNA, 18 bp, Homo sapiens
cctgcgtcctcctcacct

SEQ ID NO: 1582612 - DNA, 20 bp, Homo sapiens
cctgcgtcctgacgccctgc

SEQ ID NO: 1582613 - DNA, 13 bp, Homo sapiens
cctgcgttggagc

SEQ ID NO: 1582614 - DNA, 14 bp, Homo sapiens
cctgcgttggagcc

SEQ ID NO: 1582615 - DNA, 20 bp, Homo sapiens
cctgcgttggagccactcct

SEQ ID NO: 1582616 - DNA, 21 bp, Homo sapiens
cctgcgttggagccactcctg

SEQ ID NO: 1582617 - DNA, 22 bp, Homo sapiens
cctgcgtttggaggcccctggg

SEQ ID NO: 1582618 - DNA, 16 bp, Homo sapiens
cctgctaaggctcctc

SEQ ID NO: 1582619 - DNA, 16 bp, Homo sapiens
cctgctactcctgtgc

SEQ ID NO: 1582620 - DNA, 14 bp, Homo sapiens
cctgctcacctgtg

SEQ ID NO: 1582621 - DNA, 20 bp, Homo sapiens
cctgctcacctgtgtgccca

SEQ ID NO: 1582622 - DNA, 21 bp, Homo sapiens
cctgctcacctgtgtgcccag

SEQ ID NO: 1582623 - DNA, 22 bp, Homo sapiens
cctgctcacctgtgtgcccagc

SEQ ID NO: 1582624 - DNA, 13 bp, Homo sapiens
cctgctcagcagc

SEQ ID NO: 1582625 - DNA, 17 bp, Homo sapiens
cctgctcagcagccagt

SEQ ID NO: 1582626 - DNA, 22 bp, Homo sapiens
cctgctcagcagccagtctcag

SEQ ID NO: 1582627 - DNA, 16 bp, Homo sapiens
cctgctcagccctgca

SEQ ID NO: 1582628 - DNA, 19 bp, Homo sapiens
cctgctcagccctgcacca

SEQ ID NO: 1582629 - DNA, 18 bp, Homo sapiens
cctgctcatcatattcca

SEQ ID NO: 1582630 - DNA, 16 bp, Homo sapiens
cctgctccaccagcag

SEQ ID NO: 1582631 - DNA, 18 bp, Homo sapiens
cctgctccaccagcagca

SEQ ID NO: 1582632 - DNA, 22 bp, Homo sapiens
cctgctccagaagatgccagct

SEQ ID NO: 1582633 - DNA, 13 bp, Homo sapiens
cctgctccagacc

SEQ ID NO: 1582634 - DNA, 15 bp, Homo sapiens
cctgctccagacctg

SEQ ID NO: 1582635 - DNA, 21 bp, Homo sapiens
cctgggtatcccctgcctcct

SEQ ID NO: 1582636 - DNA, 19 bp, Homo sapiens
cctgggtcaaaaaaaagaa

SEQ ID NO: 1582637 - DNA, 19 bp, Homo sapiens
cctgggtcacagagtgaga

SEQ ID NO: 1582638 - DNA, 15 bp, Homo sapiens
cctgggtcctgcctg

SEQ ID NO: 1582639 - DNA, 21 bp, Homo sapiens
cctgggtcctgcctggtcctc

SEQ ID NO: 1582640 - DNA, 23 bp, Homo sapiens
cctgggtcctgcctggtcctccc

SEQ ID NO: 1582641 - DNA, 20 bp, Homo sapiens
cctgggtcctgttccctacc

SEQ ID NO: 1582642 - DNA, 18 bp, Homo sapiens
cctgggtctaaggggttg

SEQ ID NO: 1582643 - DNA, 14 bp, Homo sapiens
cctgggtctccctg

SEQ ID NO: 1582644 - DNA, 19 bp, Homo sapiens
cctgggtctccctggtggg

SEQ ID NO: 1582645 - DNA, 16 bp, Homo sapiens
cctgggtgacagagtg

SEQ ID NO: 1582646 - DNA, 16 bp, Homo sapiens
cctgggtgggctctgt

SEQ ID NO: 1582647 - DNA, 17 bp, Homo sapiens
cctgggtgggtggtggg

SEQ ID NO: 1582648 - DNA, 20 bp, Homo sapiens
cctgggtgggtggtggggag

SEQ ID NO: 1582649 - DNA, 22 bp, Homo sapiens
cctgggtgggtggtggggaggg

SEQ ID NO: 1582650 - DNA, 19 bp, Homo sapiens
cctgggtggtacccaggct

SEQ ID NO: 1582651 - DNA, 14 bp, Homo sapiens
cctgggtgtccccg

SEQ ID NO: 1582652 - DNA, 21 bp, Homo sapiens
cctgggtgtccccgctgctgt

SEQ ID NO: 1582653 - DNA, 14 bp, Homo sapiens
cctggtacccagcc

SEQ ID NO: 1582654 - DNA, 15 bp, Homo sapiens
cctggtacccagcca

SEQ ID NO: 1582655 - DNA, 18 bp, Homo sapiens
cctggtacccagccatct

SEQ ID NO: 1582656 - DNA, 19 bp, Homo sapiens
cctggtacccagccatctg

SEQ ID NO: 1582657 - DNA, 17 bp, Homo sapiens
cctggtaccctcctggc

SEQ ID NO: 1582658 - DNA, 15 bp, Homo sapiens
cctggtacctggacg

SEQ ID NO: 1582659 - DNA, 17 bp, Homo sapiens
cctggtactgacccagg

SEQ ID NO: 1582660 - DNA, 21 bp, Homo sapiens
cctggtccagggaagctggcc

SEQ ID NO: 1582661 - DNA, 15 bp, Homo sapiens
cctggtccctcaccc

SEQ ID NO: 1582662 - DNA, 21 bp, Homo sapiens
cctggtccctcgtccacaggg

SEQ ID NO: 1582663 - DNA, 12 bp, Homo sapiens
cctggtccctgg

SEQ ID NO: 1582664 - DNA, 14 bp, Homo sapiens
cctggtccctggga

SEQ ID NO: 1582665 - DNA, 14 bp, Homo sapiens
cctggtccctggtc

SEQ ID NO: 1582666 - DNA, 18 bp, Homo sapiens
cctggtcctccctcccaa

SEQ ID NO: 1582667 - DNA, 15 bp, Homo sapiens
cctggtcctgatgcc

SEQ ID NO: 1582668 - DNA, 18 bp, Homo sapiens
cctggtcctggctgcact

SEQ ID NO: 1582669 - DNA, 20 bp, Homo sapiens
cctggtccttcactggcgcc

SEQ ID NO: 1582670 - DNA, 17 bp, Homo sapiens
cctggtctgaggatgta

SEQ ID NO: 1582671 - DNA, 22 bp, Homo sapiens
cctggtctggttgggcagccag

SEQ ID NO: 1582672 - DNA, 14 bp, Homo sapiens
cctggtctgtctgg

SEQ ID NO: 1582673 - DNA, 16 bp, Homo sapiens
cctggtcttgagatgt

SEQ ID NO: 1582674 - DNA, 12 bp, Homo sapiens
cctggtcttttt

SEQ ID NO: 1582675 - DNA, 15 bp, Homo sapiens
cctggtgagaactga

SEQ ID NO: 1582676 - DNA, 15 bp, Homo sapiens
cctggtgcattgctg

SEQ ID NO: 1582677 - DNA, 18 bp, Homo sapiens
cctggtgcattgctgtgt

SEQ ID NO: 1582678 - DNA, 20 bp, Homo sapiens
cctggtgcattgctgtgtga

SEQ ID NO: 1582679 - DNA, 15 bp, Homo sapiens
cctggtgcctctgtg

SEQ ID NO: 1582680 - DNA, 15 bp, Homo sapiens
cctggtgcgggcctg

SEQ ID NO: 1582681 - DNA, 19 bp, Homo sapiens
cctggtgctctctgccact

SEQ ID NO: 1582682 - DNA, 18 bp, Homo sapiens
cctggtgctgccacactt

SEQ ID NO: 1582683 - DNA, 15 bp, Homo sapiens
cctggtgcttccaaa

SEQ ID NO: 1582684 - DNA, 17 bp, Homo sapiens
cctggtggacagtcctg

SEQ ID NO: 1582685 - DNA, 23 bp, Homo sapiens
cctggtggctgggcccagcaggg

SEQ ID NO: 1582686 - DNA, 20 bp, Homo sapiens
cctggtgggcctcctctgtc

SEQ ID NO: 1582687 - DNA, 12 bp, Homo sapiens
cctggtgggctg

SEQ ID NO: 1582688 - DNA, 16 bp, Homo sapiens
cctggtggggctgagc

SEQ ID NO: 1582689 - DNA, 17 bp, Homo sapiens
cctggtggggctgagcc

SEQ ID NO: 1582690 - DNA, 19 bp, Homo sapiens
cctggtggggctgagcctg

SEQ ID NO: 1582691 - DNA, 21 bp, Homo sapiens
cctggtgggtcagcccagcac

SEQ ID NO: 1582692 - DNA, 23 bp, Homo sapiens
cctggtgggtcagcccagcacct

SEQ ID NO: 1582693 - DNA, 20 bp, Homo sapiens
cctggtgggtggtgtcctga

SEQ ID NO: 1582694 - DNA, 16 bp, Homo sapiens
cctggttcatatttat

SEQ ID NO: 1582695 - DNA, 19 bp, Homo sapiens
cctgtccaacctaacccct

SEQ ID NO: 1582696 - DNA, 17 bp, Homo sapiens
cctgtccaccctgccaa

SEQ ID NO: 1582697 - DNA, 16 bp, Homo sapiens
cctgtccagcctgggc

SEQ ID NO: 1582698 - DNA, 14 bp, Homo sapiens
cctgtccagctcca

SEQ ID NO: 1582699 - DNA, 22 bp, Homo sapiens
cctgtcccaccaactctgcact

SEQ ID NO: 1582700 - DNA, 12 bp, Homo sapiens
cctgtcccaccc

SEQ ID NO: 1582701 - DNA, 16 bp, Homo sapiens
cctgtcccacccacac

SEQ ID NO: 1582702 - DNA, 16 bp, Homo sapiens
cctgtcccaccccctt

SEQ ID NO: 1582703 - DNA, 16 bp, Homo sapiens
cctgtcccagggccct

SEQ ID NO: 1582704 - DNA, 13 bp, Homo sapiens
cctgtcccattct

SEQ ID NO: 1582705 - DNA, 13 bp, Homo sapiens
cctgtccccaccc

SEQ ID NO: 1582706 - DNA, 17 bp, Homo sapiens
cctgtcccccagctctg

SEQ ID NO: 1582707 - DNA, 19 bp, Homo sapiens
cctgtcccccagctctggt

SEQ ID NO: 1582708 - DNA, 12 bp, Homo sapiens
cctgtccccgca

SEQ ID NO: 1582709 - DNA, 14 bp, Homo sapiens
cctgtccccgcagc

SEQ ID NO: 1582710 - DNA, 13 bp, Homo sapiens
cctgtcccgcctt

SEQ ID NO: 1582711 - DNA, 13 bp, Homo sapiens
cctgtccctctcc

SEQ ID NO: 1582712 - DNA, 21 bp, Homo sapiens
cctgtcccttcgagtccagga

SEQ ID NO: 1582713 - DNA, 14 bp, Homo sapiens
cctgtcccttgcct

SEQ ID NO: 1582714 - DNA, 13 bp, Homo sapiens
cctgtcccttttc

SEQ ID NO: 1582715 - DNA, 14 bp, Homo sapiens
cctgtccggcccag

SEQ ID NO: 1582716 - DNA, 17 bp, Homo sapiens
cctgtcctaaggaacct

SEQ ID NO: 1582717 - DNA, 21 bp, Homo sapiens
cctgtcctaaggaaccttcct

SEQ ID NO: 1582718 - DNA, 23 bp, Homo sapiens
cctgtcctcctcggatcaccgag

SEQ ID NO: 1582719 - DNA, 18 bp, Homo sapiens
cctgtccttgaaaaacaa

SEQ ID NO: 1582720 - DNA, 12 bp, Homo sapiens
cctgtccttgca

SEQ ID NO: 1582721 - DNA, 23 bp, Homo sapiens
cctgtcgaaggggaggcacactt

SEQ ID NO: 1582722 - DNA, 16 bp, Homo sapiens
cctgtcgtctctccca

SEQ ID NO: 1582723 - DNA, 14 bp, Homo sapiens
cctgtcgtgccagt

SEQ ID NO: 1582724 - DNA, 16 bp, Homo sapiens
cctgtcgtgccagtcc

SEQ ID NO: 1582725 - DNA, 19 bp, Homo sapiens
cctgtctaggtctcctcag

SEQ ID NO: 1582726 - DNA, 21 bp, Homo sapiens
cctgtctaggtctcctcaggg

SEQ ID NO: 1582727 - DNA, 22 bp, Homo sapiens
cctgtctaggtctcctcagggt

SEQ ID NO: 1582728 - DNA, 15 bp, Homo sapiens
cctgtctcacctgga

SEQ ID NO: 1582729 - DNA, 20 bp, Homo sapiens
cctgtctcagcctcctgagt

SEQ ID NO: 1582730 - DNA, 17 bp, Homo sapiens
cctgtctcatccccagg

SEQ ID NO: 1582731 - DNA, 18 bp, Homo sapiens
cctgtctcatccccaggg

SEQ ID NO: 1582732 - DNA, 20 bp, Homo sapiens
cctgtctcatccccaggggt

SEQ ID NO: 1582733 - DNA, 13 bp, Homo sapiens
cctgtctccagct

SEQ ID NO: 1582734 - DNA, 23 bp, Homo sapiens
cctgtctccagctgcctgggccc

SEQ ID NO: 1582735 - DNA, 14 bp, Homo sapiens
cctgtctcggggct

SEQ ID NO: 1582736 - DNA, 13 bp, Homo sapiens
cctgtctctgccc

SEQ ID NO: 1582737 - DNA, 15 bp, Homo sapiens
cctgtctctgcctgc

SEQ ID NO: 1582738 - DNA, 17 bp, Homo sapiens
cctgtctgactactttg

SEQ ID NO: 1582739 - DNA, 14 bp, Homo sapiens
cctgtctgccagcc

SEQ ID NO: 1582740 - DNA, 16 bp, Homo sapiens
cctgtctgccagccag

SEQ ID NO: 1582741 - DNA, 20 bp, Homo sapiens
cctgtctgccagccagcagc

SEQ ID NO: 1582742 - DNA, 14 bp, Homo sapiens
cctgtctgccccag

SEQ ID NO: 1582743 - DNA, 13 bp, Homo sapiens
cctgtctgctgcc

SEQ ID NO: 1582744 - DNA, 15 bp, Homo sapiens
cctgtctgctgccag

SEQ ID NO: 1582745 - DNA, 16 bp, Homo sapiens
cctgtctggattgttt

SEQ ID NO: 1582746 - DNA, 14 bp, Homo sapiens
cctgtctggctcag

SEQ ID NO: 1582747 - DNA, 17 bp, Homo sapiens
cctgtctgtcccttttc

SEQ ID NO: 1582748 - DNA, 18 bp, Homo sapiens
cctgtctgtctctccatc

SEQ ID NO: 1582749 - DNA, 19 bp, Homo sapiens
cctgtcttatggtccagaa

SEQ ID NO: 1582750 - DNA, 21 bp, Homo sapiens
cctgtcttatggtccagaaac

SEQ ID NO: 1582751 - DNA, 22 bp, Homo sapiens
cctgtcttatggtccagaaact

SEQ ID NO: 1582752 - DNA, 19 bp, Homo sapiens
cctgtcttcagagaaccca

SEQ ID NO: 1582753 - DNA, 16 bp, Homo sapiens
cctgtcttcagagcaa

SEQ ID NO: 1582754 - DNA, 14 bp, Homo sapiens
cctgtcttccaagg

SEQ ID NO: 1582755 - DNA, 15 bp, Homo sapiens
cctgtcttctgggca

SEQ ID NO: 1582756 - DNA, 14 bp, Homo sapiens
cctgtcttgaataa

SEQ ID NO: 1582757 - DNA, 22 bp, Homo sapiens
cctgtcttgaataagagtgatt

SEQ ID NO: 1582758 - DNA, 20 bp, Homo sapiens
cctgtcttggggccactttc

SEQ ID NO: 1582759 - DNA, 14 bp, Homo sapiens
cctgtctttaagga

SEQ ID NO: 1582760 - DNA, 17 bp, Homo sapiens
cctgtctttaaggaaaa

SEQ ID NO: 1582761 - DNA, 20 bp, Homo sapiens
cctgtctttgttgtctccct

SEQ ID NO: 1582762 - DNA, 20 bp, Homo sapiens
cctgtgaataaaaaccctgt

SEQ ID NO: 1582763 - DNA, 17 bp, Homo sapiens
cctgtgaatgccactgc

SEQ ID NO: 1582764 - DNA, 18 bp, Homo sapiens
cctgtgacatggtgcctg

SEQ ID NO: 1582765 - DNA, 14 bp, Homo sapiens
cctgtgactcctgt

SEQ ID NO: 1582766 - DNA, 16 bp, Homo sapiens
cctgtgactgtctcac

SEQ ID NO: 1582767 - DNA, 17 bp, Homo sapiens
cctgtgaggcaggggcg

SEQ ID NO: 1582768 - DNA, 17 bp, Homo sapiens
cctgtgcagcagcccag

SEQ ID NO: 1582769 - DNA, 18 bp, Homo sapiens
cctgtgcagcagcccagc

SEQ ID NO: 1582770 - DNA, 19 bp, Homo sapiens
cctgtgcagcagcccagct

SEQ ID NO: 1582771 - DNA, 13 bp, Homo sapiens
cctgtgccagcac

SEQ ID NO: 1582772 - DNA, 16 bp, Homo sapiens
cctgtgccctgtggta

SEQ ID NO: 1582773 - DNA, 21 bp, Homo sapiens
cctgtgcctcctcacccccag

SEQ ID NO: 1582774 - DNA, 17 bp, Homo sapiens
cctgtgccttttgccat

SEQ ID NO: 1582775 - DNA, 18 bp, Homo sapiens
cctgtgcgtcccagctga

SEQ ID NO: 1582776 - DNA, 19 bp, Homo sapiens
cctgtgctcccctgccaca

SEQ ID NO: 1582777 - DNA, 19 bp, Homo sapiens
cctgtgctccgtgcctcca

SEQ ID NO: 1582778 - DNA, 22 bp, Homo sapiens
cctgtgctccgtgcctccacca

SEQ ID NO: 1582779 - DNA, 13 bp, Homo sapiens
cctgtgctcctgc

SEQ ID NO: 1582780 - DNA, 18 bp, Homo sapiens
cctgtgctcctgcccagg

SEQ ID NO: 1582781 - DNA, 22 bp, Homo sapiens
cctgtgctgatcctgctgacct

SEQ ID NO: 1582782 - DNA, 15 bp, Homo sapiens
cctgtgctgcatgcg

SEQ ID NO: 1582783 - DNA, 22 bp, Homo sapiens
cctgtgctgcccgtcttcagcc

SEQ ID NO: 1582784 - DNA, 19 bp, Homo sapiens
cctgtggaaggcagagaaa

SEQ ID NO: 1582785 - DNA, 20 bp, Homo sapiens
cctgtggaaggcagagaaat

SEQ ID NO: 1582786 - DNA, 19 bp, Homo sapiens
cctgtggagtccagctcta

SEQ ID NO: 1582787 - DNA, 17 bp, Homo sapiens
cctgtggcacagccctg

SEQ ID NO: 1582788 - DNA, 24 bp, Homo sapiens
cctgtggcacagccctgagtgtcc

SEQ ID NO: 1582789 - DNA, 16 bp, Homo sapiens
cctgtggcagaaaaga

SEQ ID NO: 1582790 - DNA, 23 bp, Homo sapiens
cctgtggcagaaaagaggagacc

SEQ ID NO: 1582791 - DNA, 22 bp, Homo sapiens
cctgtggcagctgcccctggca

SEQ ID NO: 1582792 - DNA, 20 bp, Homo sapiens
cctgtggccccaccctgggc

SEQ ID NO: 1582793 - DNA, 15 bp, Homo sapiens
cctgtggccgccacc

SEQ ID NO: 1582794 - DNA, 14 bp, Homo sapiens
cctgtggcctgtgt

SEQ ID NO: 1582795 - DNA, 19 bp, Homo sapiens
cctgtggcctgtgtcccat

SEQ ID NO: 1582796 - DNA, 23 bp, Homo sapiens
cctgtggcctgtgtcccatgacc

SEQ ID NO: 1582797 - DNA, 21 bp, Homo sapiens
cctgtggcgccgtctccaggg

SEQ ID NO: 1582798 - DNA, 15 bp, Homo sapiens
cctgtggcggtgcct

SEQ ID NO: 1582799 - DNA, 14 bp, Homo sapiens
cctgtggcttggag

SEQ ID NO: 1582800 - DNA, 16 bp, Homo sapiens
cctgtggcttggagtg

SEQ ID NO: 1582801 - DNA, 18 bp, Homo sapiens
cctgtggggatctcaggg

SEQ ID NO: 1582802 - DNA, 19 bp, Homo sapiens
cctgtggggcaggagtgcc

SEQ ID NO: 1582803 - DNA, 21 bp, Homo sapiens
cctgtggggcaggagtgccag

SEQ ID NO: 1582804 - DNA, 16 bp, Homo sapiens
cctgtgggtctctgaa

SEQ ID NO: 1582805 - DNA, 16 bp, Homo sapiens
cctgtggtggctcccc

SEQ ID NO: 1582806 - DNA, 22 bp, Homo sapiens
cctgtggtggctccccctctgc

SEQ ID NO: 1582807 - DNA, 22 bp, Homo sapiens
cctgtggtgtgcggagtctcct

SEQ ID NO: 1582808 - DNA, 15 bp, Homo sapiens
cctgtggttacagtg

SEQ ID NO: 1582809 - DNA, 16 bp, Homo sapiens
cctgtggttacagtgc

SEQ ID NO: 1582810 - DNA, 19 bp, Homo sapiens
cctgtgtccaagaactcta

SEQ ID NO: 1582811 - DNA, 15 bp, Homo sapiens
cctgtgtccagcagc

SEQ ID NO: 1582812 - DNA, 19 bp, Homo sapiens
cctgttttctgaaacacac

SEQ ID NO: 1582813 - DNA, 16 bp, Homo sapiens
cctgttttctgagccc

SEQ ID NO: 1582814 - DNA, 21 bp, Homo sapiens
cctgtttttagagcttccaaa

SEQ ID NO: 1582815 - DNA, 16 bp, Homo sapiens
cctgtttttcacattt

SEQ ID NO: 1582816 - DNA, 16 bp, Homo sapiens
cctgtttttttttcat

SEQ ID NO: 1582817 - DNA, 13 bp, Homo sapiens
ccttaaaaataac

SEQ ID NO: 1582818 - DNA, 22 bp, Homo sapiens
ccttaaaaggagagaagaaagt

SEQ ID NO: 1582819 - DNA, 15 bp, Homo sapiens
ccttaaactgtgtgg

SEQ ID NO: 1582820 - DNA, 22 bp, Homo sapiens
ccttaaagagggacaggctgaa

SEQ ID NO: 1582821 - DNA, 22 bp, Homo sapiens
ccttaaatacagataattcatt

SEQ ID NO: 1582822 - DNA, 16 bp, Homo sapiens
ccttaacacactggcc

SEQ ID NO: 1582823 - DNA, 17 bp, Homo sapiens
ccttaacagttgtattt

SEQ ID NO: 1582824 - DNA, 14 bp, Homo sapiens
ccttaaccagtctc

SEQ ID NO: 1582825 - DNA, 17 bp, Homo sapiens
ccttaacccacctctcc

SEQ ID NO: 1582826 - DNA, 17 bp, Homo sapiens
ccttaactatttcacat

SEQ ID NO: 1582827 - DNA, 14 bp, Homo sapiens
ccttaactggagcc

SEQ ID NO: 1582828 - DNA, 23 bp, Homo sapiens
ccttaactggagccccatcagct

SEQ ID NO: 1582829 - DNA, 20 bp, Homo sapiens
ccttaagaatgagtttctta

SEQ ID NO: 1582830 - DNA, 16 bp, Homo sapiens
ccttaagatattgaag

SEQ ID NO: 1582831 - DNA, 15 bp, Homo sapiens
ccttaagcagcaaca

SEQ ID NO: 1582832 - DNA, 20 bp, Homo sapiens
ccttaaggcacagtgggagc

SEQ ID NO: 1582833 - DNA, 19 bp, Homo sapiens
ccttaagggttgaaggcag

SEQ ID NO: 1582834 - DNA, 19 bp, Homo sapiens
ccttaatctaatctaaaag

SEQ ID NO: 1582835 - DNA, 14 bp, Homo sapiens
ccttaatcttgctt

SEQ ID NO: 1582836 - DNA, 22 bp, Homo sapiens
ccttaatttcctttttgacact

SEQ ID NO: 1582837 - DNA, 19 bp, Homo sapiens
ccttaatttttttttcata

SEQ ID NO: 1582838 - DNA, 12 bp, Homo sapiens
ccttacaaaggg

SEQ ID NO: 1582839 - DNA, 13 bp, Homo sapiens
ccttacagagcat

SEQ ID NO: 1582840 - DNA, 19 bp, Homo sapiens
ccttactatgatctcagga

SEQ ID NO: 1582841 - DNA, 14 bp, Homo sapiens
ccttactctgagcc

SEQ ID NO: 1582842 - DNA, 16 bp, Homo sapiens
ccttactctgagccca

SEQ ID NO: 1582843 - DNA, 17 bp, Homo sapiens
ccttactctgagcccag

SEQ ID NO: 1582844 - DNA, 20 bp, Homo sapiens
ccttactctgagcccaggcc

SEQ ID NO: 1582845 - DNA, 16 bp, Homo sapiens
ccttactcttcttgaa

SEQ ID NO: 1582846 - DNA, 16 bp, Homo sapiens
ccttactgatatttat

SEQ ID NO: 1582847 - DNA, 13 bp, Homo sapiens
ccttactggctta

SEQ ID NO: 1582848 - DNA, 19 bp, Homo sapiens
ccttactggtttccccagg

SEQ ID NO: 1582849 - DNA, 16 bp, Homo sapiens
ccttactgtctcactc

SEQ ID NO: 1582850 - DNA, 14 bp, Homo sapiens
ccttagaacctttc

SEQ ID NO: 1582851 - DNA, 16 bp, Homo sapiens
ccttagacccgccagg

SEQ ID NO: 1582852 - DNA, 17 bp, Homo sapiens
ccttagaggtcctctgg

SEQ ID NO: 1582853 - DNA, 19 bp, Homo sapiens
ccttagaggtcctctggag

SEQ ID NO: 1582854 - DNA, 10 bp, Homo sapiens
ccttagccag

SEQ ID NO: 1582855 - DNA, 14 bp, Homo sapiens
ccttagcctccctg

SEQ ID NO: 1582856 - DNA, 12 bp, Homo sapiens
ccttagcctctc

SEQ ID NO: 1582857 - DNA, 16 bp, Homo sapiens
ccttagcctctcccac

SEQ ID NO: 1582858 - DNA, 18 bp, Homo sapiens
ccttagcctctcccaccc

SEQ ID NO: 1582859 - DNA, 23 bp, Homo sapiens
ccttagcgttctggactctgccc

SEQ ID NO: 1582860 - DNA, 20 bp, Homo sapiens
ccttagcttagacctcagcc

SEQ ID NO: 1582861 - DNA, 14 bp, Homo sapiens
ccttaggccttcct

SEQ ID NO: 1582862 - DNA, 13 bp, Homo sapiens
ccttaggctttgt

SEQ ID NO: 1582863 - DNA, 22 bp, Homo sapiens
ccttaggctttgtatgacagtg

SEQ ID NO: 1582864 - DNA, 21 bp, Homo sapiens
ccttagggaagctggcctgag

SEQ ID NO: 1582865 - DNA, 20 bp, Homo sapiens
ccttaggggtaattggtaat

SEQ ID NO: 1582866 - DNA, 17 bp, Homo sapiens
ccttatagtctaagact

SEQ ID NO: 1582867 - DNA, 16 bp, Homo sapiens
ccttatcattcattct

SEQ ID NO: 1582868 - DNA, 16 bp, Homo sapiens
ccttatctataaaagg

SEQ ID NO: 1582869 - DNA, 23 bp, Homo sapiens
ccttatgcccggcgccgggcacc

SEQ ID NO: 1582870 - DNA, 20 bp, Homo sapiens
ccttatgggctgaagtgttc

SEQ ID NO: 1582871 - DNA, 17 bp, Homo sapiens
ccttattaaggccccag

SEQ ID NO: 1582872 - DNA, 21 bp, Homo sapiens
ccttattgcctcccaggcaag

SEQ ID NO: 1582873 - DNA, 19 bp, Homo sapiens
ccttattgctgtcctggag

SEQ ID NO: 1582874 - DNA, 16 bp, Homo sapiens
ccttatttgccttcta

SEQ ID NO: 1582875 - DNA, 19 bp, Homo sapiens
ccttatttgccttctactc

SEQ ID NO: 1582876 - DNA, 11 bp, Homo sapiens
ccttatttgtc

SEQ ID NO: 1582877 - DNA, 16 bp, Homo sapiens
ccttcctccccacact

SEQ ID NO: 1582878 - DNA, 19 bp, Homo sapiens
ccttcctccccacactcca

SEQ ID NO: 1582879 - DNA, 21 bp, Homo sapiens
ccttcctccccacactccact

SEQ ID NO: 1582880 - DNA, 16 bp, Homo sapiens
ccttcctcccggggcc

SEQ ID NO: 1582881 - DNA, 19 bp, Homo sapiens
ccttcctcccggggccttc

SEQ ID NO: 1582882 - DNA, 13 bp, Homo sapiens
ccttcctcctcca

SEQ ID NO: 1582883 - DNA, 15 bp, Homo sapiens
ccttcctcctccaca

SEQ ID NO: 1582884 - DNA, 15 bp, Homo sapiens
ccttcctctccactg

SEQ ID NO: 1582885 - DNA, 21 bp, Homo sapiens
ccttcctctccactgccttcg

SEQ ID NO: 1582886 - DNA, 18 bp, Homo sapiens
ccttcctcttcctgccct

SEQ ID NO: 1582887 - DNA, 14 bp, Homo sapiens
ccttcctgaagagt

SEQ ID NO: 1582888 - DNA, 12 bp, Homo sapiens
ccttcctgccac

SEQ ID NO: 1582889 - DNA, 16 bp, Homo sapiens
ccttcctggaaacagc

SEQ ID NO: 1582890 - DNA, 12 bp, Homo sapiens
ccttcctggcct

SEQ ID NO: 1582891 - DNA, 14 bp, Homo sapiens
ccttcctggcctca

SEQ ID NO: 1582892 - DNA, 20 bp, Homo sapiens
ccttcctggcctcactggct

SEQ ID NO: 1582893 - DNA, 13 bp, Homo sapiens
ccttcctggcctg

SEQ ID NO: 1582894 - DNA, 19 bp, Homo sapiens
ccttcctgtttttcacatt

SEQ ID NO: 1582895 - DNA, 16 bp, Homo sapiens
ccttccttccctggct

SEQ ID NO: 1582896 - DNA, 14 bp, Homo sapiens
ccttccttcttgct

SEQ ID NO: 1582897 - DNA, 16 bp, Homo sapiens
ccttcctttctcctgc

SEQ ID NO: 1582898 - DNA, 13 bp, Homo sapiens
ccttccttttccc

SEQ ID NO: 1582899 - DNA, 15 bp, Homo sapiens
ccttccttttccctg

SEQ ID NO: 1582900 - DNA, 21 bp, Homo sapiens
ccttccttttccctgcttcca

SEQ ID NO: 1582901 - DNA, 20 bp, Homo sapiens
ccttccttttgaggagctgg

SEQ ID NO: 1582902 - DNA, 22 bp, Homo sapiens
ccttccttttgaggagctggag

SEQ ID NO: 1582903 - DNA, 20 bp, Homo sapiens
ccttcgcttcttgcctctgt

SEQ ID NO: 1582904 - DNA, 23 bp, Homo sapiens
ccttcgcttcttgcctctgtgct

SEQ ID NO: 1582905 - DNA, 23 bp, Homo sapiens
ccttcggagcgttctctgtccta

SEQ ID NO: 1582906 - DNA, 18 bp, Homo sapiens
ccttcgggtgctggaagt

SEQ ID NO: 1582907 - DNA, 19 bp, Homo sapiens
ccttcgtccccagttgccg

SEQ ID NO: 1582908 - DNA, 15 bp, Homo sapiens
ccttctaaaagccat

SEQ ID NO: 1582909 - DNA, 20 bp, Homo sapiens
ccttctaccccaaggccagt

SEQ ID NO: 1582910 - DNA, 15 bp, Homo sapiens
ccttctactgagcct

SEQ ID NO: 1582911 - DNA, 18 bp, Homo sapiens
ccttctagattcactgtc

SEQ ID NO: 1582912 - DNA, 16 bp, Homo sapiens
ccttctagtttcccac

SEQ ID NO: 1582913 - DNA, 17 bp, Homo sapiens
ccttctcaccccaggat

SEQ ID NO: 1582914 - DNA, 18 bp, Homo sapiens
ccttctcaccccaggata

SEQ ID NO: 1582915 - DNA, 15 bp, Homo sapiens
ccttctcagaagcac

SEQ ID NO: 1582916 - DNA, 14 bp, Homo sapiens
ccttctcaggcccc

SEQ ID NO: 1582917 - DNA, 17 bp, Homo sapiens
ccttctccccagccaga

SEQ ID NO: 1582918 - DNA, 19 bp, Homo sapiens
cctttaagcctgcattctt

SEQ ID NO: 1582919 - DNA, 19 bp, Homo sapiens
cctttacactcaggctttc

SEQ ID NO: 1582920 - DNA, 23 bp, Homo sapiens
cctttacattcaacttttctaag

SEQ ID NO: 1582921 - DNA, 15 bp, Homo sapiens
cctttaccctcttgg

SEQ ID NO: 1582922 - DNA, 19 bp, Homo sapiens
cctttaccctctttgctgc

SEQ ID NO: 1582923 - DNA, 19 bp, Homo sapiens
cctttacgtgtttaaaaaa

SEQ ID NO: 1582924 - DNA, 14 bp, Homo sapiens
cctttactcagccc

SEQ ID NO: 1582925 - DNA, 16 bp, Homo sapiens
cctttactcagcccag

SEQ ID NO: 1582926 - DNA, 13 bp, Homo sapiens
ccttttcacggga

SEQ ID NO: 1582927 - DNA, 16 bp, Homo sapiens
ccttttcactttattg

SEQ ID NO: 1582928 - DNA, 12 bp, Homo sapiens
ccttttcaggaa

SEQ ID NO: 1582929 - DNA, 17 bp, Homo sapiens
ccttttccccaggagca

SEQ ID NO: 1582930 - DNA, 14 bp, Homo sapiens
ccttttccctgctt

SEQ ID NO: 1582931 - DNA, 17 bp, Homo sapiens
ccttttcctatccttat

SEQ ID NO: 1582932 - DNA, 19 bp, Homo sapiens
ccttttcgccccctgcctg

SEQ ID NO: 1582933 - DNA, 11 bp, Homo sapiens
ccttttctcag

SEQ ID NO: 1582934 - DNA, 15 bp, Homo sapiens
ccttttctggcaccg

SEQ ID NO: 1582935 - DNA, 20 bp, Homo sapiens
ccttttgaatacatttgtat

SEQ ID NO: 1582936 - DNA, 21 bp, Homo sapiens
ccttttgaggagccccagcta

SEQ ID NO: 1582937 - DNA, 23 bp, Homo sapiens
ccttttgaggagccccagctacc

SEQ ID NO: 1582938 - DNA, 19 bp, Homo sapiens
cgagaccatcctggcccct

SEQ ID NO: 1582939 - DNA, 20 bp, Homo sapiens
cgagaccatcctggcccctc

SEQ ID NO: 1582940 - DNA, 16 bp, Homo sapiens
cgagaccatcctggct

SEQ ID NO: 1582941 - DNA, 14 bp, Homo sapiens
cgagacccccatcc

SEQ ID NO: 1582942 - DNA, 16 bp, Homo sapiens
cgagacccccatccag

SEQ ID NO: 1582943 - DNA, 22 bp, Homo sapiens
cgagacccccatccagcctcca

SEQ ID NO: 1582944 - DNA, 15 bp, Homo sapiens
cgagactctgtctca

SEQ ID NO: 1582945 - DNA, 17 bp, Homo sapiens
cgagagcagtgggcagg

SEQ ID NO: 1582946 - DNA, 13 bp, Homo sapiens
cgagagcctgctc

SEQ ID NO: 1582947 - DNA, 14 bp, Homo sapiens
cgagagcctgctcc

SEQ ID NO: 1582948 - DNA, 19 bp, Homo sapiens
cgagagcctgctcccccac

SEQ ID NO: 1582949 - DNA, 14 bp, Homo sapiens
cgagagctggccaa

SEQ ID NO: 1582950 - DNA, 19 bp, Homo sapiens
cgagaggccaaaggctggt

SEQ ID NO: 1582951 - DNA, 18 bp, Homo sapiens
cgagagggaagctggctg

SEQ ID NO: 1582952 - DNA, 16 bp, Homo sapiens
cgagagggagagagag

SEQ ID NO: 1582953 - DNA, 15 bp, Homo sapiens
cgagaggtgggccag

SEQ ID NO: 1582954 - DNA, 14 bp, Homo sapiens
cgagagtctgtctc

SEQ ID NO: 1582955 - DNA, 15 bp, Homo sapiens
cgagagtctgtctca

SEQ ID NO: 1582956 - DNA, 16 bp, Homo sapiens
cgagatcacgccactg

SEQ ID NO: 1582957 - DNA, 15 bp, Homo sapiens
cgagatctcaggagc

SEQ ID NO: 1582958 - DNA, 16 bp, Homo sapiens
cgagatctcaggagcc

SEQ ID NO: 1582959 - DNA, 15 bp, Homo sapiens
cgagcaaacccagag

SEQ ID NO: 1582960 - DNA, 23 bp, Homo sapiens
cgagcaaagatcaaaataaaaag

SEQ ID NO: 1582961 - DNA, 12 bp, Homo sapiens
cgagcacccacg

SEQ ID NO: 1582962 - DNA, 18 bp, Homo sapiens
cgagcacctccagcctga

SEQ ID NO: 1582963 - DNA, 14 bp, Homo sapiens
cgagcactggccag

SEQ ID NO: 1582964 - DNA, 15 bp, Homo sapiens
cgagcactggccaga

SEQ ID NO: 1582965 - DNA, 16 bp, Homo sapiens
cgagcactggccagag

SEQ ID NO: 1582966 - DNA, 18 bp, Homo sapiens
cgagcactggccagagag

SEQ ID NO: 1582967 - DNA, 11 bp, Homo sapiens
cgagcagccca

SEQ ID NO: 1582968 - DNA, 12 bp, Homo sapiens
cgagcagcccag

SEQ ID NO: 1582969 - DNA, 18 bp, Homo sapiens
cgagcaggctactgtcag

SEQ ID NO: 1582970 - DNA, 20 bp, Homo sapiens
cgagcatgggggctgccagc

SEQ ID NO: 1582971 - DNA, 17 bp, Homo sapiens
cgagccacaagctgcac

SEQ ID NO: 1582972 - DNA, 22 bp, Homo sapiens
cgagccacaagctgcactgtga

SEQ ID NO: 1582973 - DNA, 14 bp, Homo sapiens
cgagcccagctaca

SEQ ID NO: 1582974 - DNA, 19 bp, Homo sapiens
cgagccccacagagcagga

SEQ ID NO: 1582975 - DNA, 14 bp, Homo sapiens
cgagccccctggat

SEQ ID NO: 1582976 - DNA, 16 bp, Homo sapiens
cgagcccctcggctct

SEQ ID NO: 1582977 - DNA, 20 bp, Homo sapiens
cgagcccctcggctctggag

SEQ ID NO: 1582978 - DNA, 21 bp, Homo sapiens
cgagcccctcggctctggagg

SEQ ID NO: 1582979 - DNA, 19 bp, Homo sapiens
cgagccctggagagcccca

SEQ ID NO: 1582980 - DNA, 14 bp, Homo sapiens
cgagccgggcctgg

SEQ ID NO: 1582981 - DNA, 17 bp, Homo sapiens
cgagccgggcctggggc

SEQ ID NO: 1582982 - DNA, 15 bp, Homo sapiens
cgagcggtggccccg

SEQ ID NO: 1582983 - DNA, 21 bp, Homo sapiens
cgagctcgtgtatcctggggc

SEQ ID NO: 1582984 - DNA, 20 bp, Homo sapiens
cgaggaaacgaaacccactc

SEQ ID NO: 1582985 - DNA, 18 bp, Homo sapiens
cgaggaaaggattttacc

SEQ ID NO: 1582986 - DNA, 16 bp, Homo sapiens
cgaggaactcgcctca

SEQ ID NO: 1582987 - DNA, 22 bp, Homo sapiens
cgaggaactcgcctcagcctga

SEQ ID NO: 1582988 - DNA, 22 bp, Homo sapiens
cgaggaatctgtgggtctggga

SEQ ID NO: 1582989 - DNA, 14 bp, Homo sapiens
cgaggaccaccagc

SEQ ID NO: 1582990 - DNA, 20 bp, Homo sapiens
cgaggaccaccagcaggcag

SEQ ID NO: 1582991 - DNA, 22 bp, Homo sapiens
cgaggagtaacaatacaaatgg

SEQ ID NO: 1582992 - DNA, 15 bp, Homo sapiens
cgaggatttctggga

SEQ ID NO: 1582993 - DNA, 19 bp, Homo sapiens
cgaggcaccggcgctgcag

SEQ ID NO: 1582994 - DNA, 21 bp, Homo sapiens
cgaggcaccggcgctgcaggt

SEQ ID NO: 1582995 - DNA, 12 bp, Homo sapiens
cgaggcccagcg

SEQ ID NO: 1582996 - DNA, 13 bp, Homo sapiens
cgaggcccgcatg

SEQ ID NO: 1582997 - DNA, 11 bp, Homo sapiens
cgaggcctgaa

SEQ ID NO: 1582998 - DNA, 13 bp, Homo sapiens
cgaggcctggcca

SEQ ID NO: 1582999 - DNA, 14 bp, Homo sapiens
cgaggctccccgcc

SEQ ID NO: 1583000 - DNA, 19 bp, Homo sapiens
cgaggctccccgcctccac

SEQ ID NO: 1583001 - DNA, 20 bp, Homo sapiens
cgaggctccccgcctccact

SEQ ID NO: 1583002 - DNA, 22 bp, Homo sapiens
cgaggctccccgcctccactct

SEQ ID NO: 1583003 - DNA, 18 bp, Homo sapiens
cgaggctcggagcaccct

SEQ ID NO: 1583004 - DNA, 14 bp, Homo sapiens
cgaggctgccccag

SEQ ID NO: 1583005 - DNA, 18 bp, Homo sapiens
cgaggctgccccaggccg

SEQ ID NO: 1583006 - DNA, 13 bp, Homo sapiens
cgagggcagctgc

SEQ ID NO: 1583007 - DNA, 15 bp, Homo sapiens
cgagggctggctggc

SEQ ID NO: 1583008 - DNA, 23 bp, Homo sapiens
cgagggctggctggcctcaccca

SEQ ID NO: 1583009 - DNA, 12 bp, Homo sapiens
cgaggggcaggg

SEQ ID NO: 1583010 - DNA, 13 bp, Homo sapiens
cgaggggcaggga

SEQ ID NO: 1583011 - DNA, 17 bp, Homo sapiens
cgaggtcaacagagaag

SEQ ID NO: 1583012 - DNA, 23 bp, Homo sapiens
cgaggtcaacagagaaggcagga

SEQ ID NO: 1583013 - DNA, 14 bp, Homo sapiens
cgaggtcaggagat

SEQ ID NO: 1583014 - DNA, 22 bp, Homo sapiens
cgaggtggatcacagaggcttc

SEQ ID NO: 1583015 - DNA, 22 bp, Homo sapiens
cgagtaatgacgtgtgtggctg

SEQ ID NO: 1583016 - DNA, 20 bp, Homo sapiens
cgagtagatgaacctgcagc

SEQ ID NO: 1583017 - DNA, 20 bp, Homo sapiens
cgagtcaatcccctcattca

SEQ ID NO: 1583018 - DNA, 22 bp, Homo sapiens
cgagtcacacccggtggctctg

SEQ ID NO: 1583019 - DNA, 13 bp, Homo sapiens
cgagtcacctgca

SEQ ID NO: 1583020 - DNA, 16 bp, Homo sapiens
cgagtcacctgcaagc

SEQ ID NO: 1583021 - DNA, 12 bp, Homo sapiens
cgagtcactgcc

SEQ ID NO: 1583022 - DNA, 15 bp, Homo sapiens
cgagtcactgcctct

SEQ ID NO: 1583023 - DNA, 17 bp, Homo sapiens
cgagtcctaaggcctta

SEQ ID NO: 1583024 - DNA, 18 bp, Homo sapiens
cgagtctcttctccactg

SEQ ID NO: 1583025 - DNA, 21 bp, Homo sapiens
cgagtctcttctccactggat

SEQ ID NO: 1583026 - DNA, 14 bp, Homo sapiens
cgagtgtagctgtg

SEQ ID NO: 1583027 - DNA, 13 bp, Homo sapiens
cgagttcctctgg

SEQ ID NO: 1583028 - DNA, 20 bp, Homo sapiens
cgagttcctctgggtttcta

SEQ ID NO: 1583029 - DNA, 20 bp, Homo sapiens
cgatacaccgggcctggaga

SEQ ID NO: 1583030 - DNA, 20 bp, Homo sapiens
cgatacctcagccctggccc

SEQ ID NO: 1583031 - DNA, 23 bp, Homo sapiens
cgatacctcagccctggccctgc

SEQ ID NO: 1583032 - DNA, 21 bp, Homo sapiens
cgatcaagttgttgactgtga

SEQ ID NO: 1583033 - DNA, 22 bp, Homo sapiens
cgatcaagttgttgactgtgat

SEQ ID NO: 1583034 - DNA, 15 bp, Homo sapiens
cgatccacctgtctc

SEQ ID NO: 1583035 - DNA, 22 bp, Homo sapiens
cgatccacctgtctcagcctcc

SEQ ID NO: 1583036 - DNA, 13 bp, Homo sapiens
cgatctcagctca

SEQ ID NO: 1583037 - DNA, 16 bp, Homo sapiens
cgatctcctgacctcg

SEQ ID NO: 1583038 - DNA, 20 bp, Homo sapiens
cgatgagataatatgagatt

SEQ ID NO: 1583039 - DNA, 13 bp, Homo sapiens
cgatgagggaagg

SEQ ID NO: 1583040 - DNA, 20 bp, Homo sapiens
cgatgagggaaggagcccag

SEQ ID NO: 1583041 - DNA, 20 bp, Homo sapiens
cgatgatgcttgtaacaaga

SEQ ID NO: 1583042 - DNA, 19 bp, Homo sapiens
cgatgcaaacattggaaga

SEQ ID NO: 1583043 - DNA, 14 bp, Homo sapiens
cgatgcatttaata

SEQ ID NO: 1583044 - DNA, 15 bp, Homo sapiens
cgatgcatttaataa

SEQ ID NO: 1583045 - DNA, 16 bp, Homo sapiens
cgatgcgtattttagt

SEQ ID NO: 1583046 - DNA, 22 bp, Homo sapiens
ctcagtgccttctctcagctcc

SEQ ID NO: 1583047 - DNA, 17 bp, Homo sapiens
ctcagtgttagagaaat

SEQ ID NO: 1583048 - DNA, 21 bp, Homo sapiens
ctcagtgttggtatattttat

SEQ ID NO: 1583049 - DNA, 22 bp, Homo sapiens
ctcagtgttggtatattttata

SEQ ID NO: 1583050 - DNA, 22 bp, Homo sapiens
ctcagttaaatctttgaagaat

SEQ ID NO: 1583051 - DNA, 19 bp, Homo sapiens
ctcagttcaaaccatttca

SEQ ID NO: 1583052 - DNA, 21 bp, Homo sapiens
ctcagttccaaagtcacagga

SEQ ID NO: 1583053 - DNA, 16 bp, Homo sapiens
ctcagttccaggcctg

SEQ ID NO: 1583054 - DNA, 14 bp, Homo sapiens
ctcagttcccagct

SEQ ID NO: 1583055 - DNA, 17 bp, Homo sapiens
ctcagttcccagctccc

SEQ ID NO: 1583056 - DNA, 20 bp, Homo sapiens
ctcagttcccagctcccccc

SEQ ID NO: 1583057 - DNA, 21 bp, Homo sapiens
ctcagttcccttggcctcaga

SEQ ID NO: 1583058 - DNA, 22 bp, Homo sapiens
ctcagttctctcccttcctctc

SEQ ID NO: 1583059 - DNA, 15 bp, Homo sapiens
ctcagttgtttgctt

SEQ ID NO: 1583060 - DNA, 22 bp, Homo sapiens
ctcagtttgtgtgtcttaatta

SEQ ID NO: 1583061 - DNA, 13 bp, Homo sapiens
ctcagttttcata

SEQ ID NO: 1583062 - DNA, 14 bp, Homo sapiens
ctcagttttcataa

SEQ ID NO: 1583063 - DNA, 18 bp, Homo sapiens
ctcagttttccttctgtt

SEQ ID NO: 1583064 - DNA, 19 bp, Homo sapiens
ctcataaacctgttttgca

SEQ ID NO: 1583065 - DNA, 17 bp, Homo sapiens
ctcataagttggaccag

SEQ ID NO: 1583066 - DNA, 23 bp, Homo sapiens
ctcataagttggaccagaggaag

SEQ ID NO: 1583067 - DNA, 18 bp, Homo sapiens
ctcataagtttgtttaaa

SEQ ID NO: 1583068 - DNA, 15 bp, Homo sapiens
ctcataatgctttgt

SEQ ID NO: 1583069 - DNA, 22 bp, Homo sapiens
ctcataatttatacaggtcata

SEQ ID NO: 1583070 - DNA, 15 bp, Homo sapiens
ctcataccacactta

SEQ ID NO: 1583071 - DNA, 24 bp, Homo sapiens
ctcatacccatgcacagtacaata

SEQ ID NO: 1583072 - DNA, 16 bp, Homo sapiens
ctcataccctccctcc

SEQ ID NO: 1583073 - DNA, 14 bp, Homo sapiens
ctcatacctctgac

SEQ ID NO: 1583074 - DNA, 14 bp, Homo sapiens
ctcatactgtctgg

SEQ ID NO: 1583075 - DNA, 19 bp, Homo sapiens
ctcatagaggtgagaaaac

SEQ ID NO: 1583076 - DNA, 18 bp, Homo sapiens
ctcatagcatagccagca

SEQ ID NO: 1583077 - DNA, 21 bp, Homo sapiens
ctcatagcatagccagcattc

SEQ ID NO: 1583078 - DNA, 14 bp, Homo sapiens
ctcataggacctgc

SEQ ID NO: 1583079 - DNA, 17 bp, Homo sapiens
ctcataggagactgcgt

SEQ ID NO: 1583080 - DNA, 21 bp, Homo sapiens
ctcatagtaataagatggctg

SEQ ID NO: 1583081 - DNA, 13 bp, Homo sapiens
ctcatatatttaa

SEQ ID NO: 1583082 - DNA, 15 bp, Homo sapiens
ctcatatatttaagc

SEQ ID NO: 1583083 - DNA, 21 bp, Homo sapiens
ctcatatcaacttagtcaata

SEQ ID NO: 1583084 - DNA, 13 bp, Homo sapiens
ctcatatggccca

SEQ ID NO: 1583085 - DNA, 14 bp, Homo sapiens
ctcatatgttccca

SEQ ID NO: 1583086 - DNA, 13 bp, Homo sapiens
ctcatattgtgat

SEQ ID NO: 1583087 - DNA, 14 bp, Homo sapiens
ctcatcaactgaat

SEQ ID NO: 1583088 - DNA, 17 bp, Homo sapiens
ctcatcaatcaaataag

SEQ ID NO: 1583089 - DNA, 18 bp, Homo sapiens
ctcatcaatggggccagt

SEQ ID NO: 1583090 - DNA, 19 bp, Homo sapiens
ctcatcactggactgcatg

SEQ ID NO: 1583091 - DNA, 15 bp, Homo sapiens
ctcatcactggatga

SEQ ID NO: 1583092 - DNA, 24 bp, Homo sapiens
ctcatcagtgtcctcttgctcaaa

SEQ ID NO: 1583093 - DNA, 19 bp, Homo sapiens
ctcatcatattccaaccca

SEQ ID NO: 1583094 - DNA, 14 bp, Homo sapiens
ctcatcatattgta

SEQ ID NO: 1583095 - DNA, 15 bp, Homo sapiens
ctcatcatattgtat

SEQ ID NO: 1583096 - DNA, 22 bp, Homo sapiens
ctcatccactctactaatgcct

SEQ ID NO: 1583097 - DNA, 21 bp, Homo sapiens
ctcatccagaccccatgcctg

SEQ ID NO: 1583098 - DNA, 22 bp, Homo sapiens
ctcatccccaggggtcccagcc

SEQ ID NO: 1583099 - DNA, 23 bp, Homo sapiens
ctcatccccaggggtcccagcca

SEQ ID NO: 1583100 - DNA, 17 bp, Homo sapiens
ctcatcccccctgctgc

SEQ ID NO: 1583101 - DNA, 19 bp, Homo sapiens
ctcatcccccctgctgccc

SEQ ID NO: 1583102 - DNA, 22 bp, Homo sapiens
ctcatcccctcgtcctgtccca

SEQ ID NO: 1583103 - DNA, 12 bp, Homo sapiens
ctcatccctcaa

SEQ ID NO: 1583104 - DNA, 18 bp, Homo sapiens
ctcatccctgactggcca

SEQ ID NO: 1583105 - DNA, 23 bp, Homo sapiens
ctcatcctccagtaccttgcttc

SEQ ID NO: 1583106 - DNA, 14 bp, Homo sapiens
ctcatcctgagaga

SEQ ID NO: 1583107 - DNA, 14 bp, Homo sapiens
ctcatcctgctctt

SEQ ID NO: 1583108 - DNA, 18 bp, Homo sapiens
ctcatcctgctcttttgt

SEQ ID NO: 1583109 - DNA, 22 bp, Homo sapiens
ctcatcctggcacgccctactc

SEQ ID NO: 1583110 - DNA, 15 bp, Homo sapiens
ctcatcggagactgc

SEQ ID NO: 1583111 - DNA, 12 bp, Homo sapiens
ctcatcggaggc

SEQ ID NO: 1583112 - DNA, 16 bp, Homo sapiens
ctcatcggaggcccat

SEQ ID NO: 1583113 - DNA, 17 bp, Homo sapiens
ctcatcggaggcccatg

SEQ ID NO: 1583114 - DNA, 16 bp, Homo sapiens
ctcatctatttggaac

SEQ ID NO: 1583115 - DNA, 12 bp, Homo sapiens
ctcatctcaggt

SEQ ID NO: 1583116 - DNA, 20 bp, Homo sapiens
ctcatctcttagctcccctc

SEQ ID NO: 1583117 - DNA, 22 bp, Homo sapiens
ctcatctcttagctcccctcca

SEQ ID NO: 1583118 - DNA, 16 bp, Homo sapiens
ctcatctgagaggctc

SEQ ID NO: 1583119 - DNA, 20 bp, Homo sapiens
ctcatctgagaggctctccg

SEQ ID NO: 1583120 - DNA, 13 bp, Homo sapiens
ctcatctgctggt

SEQ ID NO: 1583121 - DNA, 15 bp, Homo sapiens
ctcatctgctggtcc

SEQ ID NO: 1583122 - DNA, 20 bp, Homo sapiens
ctcatctgctggtccgtggg

SEQ ID NO: 1583123 - DNA, 13 bp, Homo sapiens
ctcatctttctgc

SEQ ID NO: 1583124 - DNA, 12 bp, Homo sapiens
ctcatgaagcta

SEQ ID NO: 1583125 - DNA, 14 bp, Homo sapiens
ctcatgaatgtaaa

SEQ ID NO: 1583126 - DNA, 21 bp, Homo sapiens
ctcatgacactgtttggcctt

SEQ ID NO: 1583127 - DNA, 18 bp, Homo sapiens
ctcatgacagccagagcc

SEQ ID NO: 1583128 - DNA, 16 bp, Homo sapiens
ctcatgagaagccaag

SEQ ID NO: 1583129 - DNA, 15 bp, Homo sapiens
ctcatgaggggagag

SEQ ID NO: 1583130 - DNA, 21 bp, Homo sapiens
ctcatgataccacctttactg

SEQ ID NO: 1583131 - DNA, 22 bp, Homo sapiens
ctcatgataccacctttactgt

SEQ ID NO: 1583132 - DNA, 23 bp, Homo sapiens
ctcatgatagaaggctatgggga

SEQ ID NO: 1583133 - DNA, 16 bp, Homo sapiens
ctcatgcaaatcaatt

SEQ ID NO: 1583134 - DNA, 19 bp, Homo sapiens
ctcatgcaaatcaattact

SEQ ID NO: 1583135 - DNA, 20 bp, Homo sapiens
ctcatgcatagtcccagcta

SEQ ID NO: 1583136 - DNA, 12 bp, Homo sapiens
ctcatgccatca

SEQ ID NO: 1583137 - DNA, 16 bp, Homo sapiens
ctcatgcccaccccct

SEQ ID NO: 1583138 - DNA, 21 bp, Homo sapiens
ctcatgcccaccccctgccct

SEQ ID NO: 1583139 - DNA, 23 bp, Homo sapiens
ctcatgccccctttcagatgtct

SEQ ID NO: 1583140 - DNA, 16 bp, Homo sapiens
ctcatgcctcagcctc

SEQ ID NO: 1583141 - DNA, 16 bp, Homo sapiens
ctcatgctgttgctgc

SEQ ID NO: 1583142 - DNA, 21 bp, Homo sapiens
ctcatggaaactggccagggg

SEQ ID NO: 1583143 - DNA, 20 bp, Homo sapiens
ctcatggaccagtggctggt

SEQ ID NO: 1583144 - DNA, 21 bp, Homo sapiens
ctcatggaccagtggctggtc

SEQ ID NO: 1583145 - DNA, 22 bp, Homo sapiens
ctcatggaccagtggctggtct

SEQ ID NO: 1583146 - DNA, 23 bp, Homo sapiens
ctcatggaccagtggctggtctc

SEQ ID NO: 1583147 - DNA, 14 bp, Homo sapiens
ctcatggcagctgt

SEQ ID NO: 1583148 - DNA, 22 bp, Homo sapiens
ctcatggcccccaggggcagga

SEQ ID NO: 1583149 - DNA, 20 bp, Homo sapiens
ctcatggcccctctgacctg

SEQ ID NO: 1583150 - DNA, 21 bp, Homo sapiens
ctcatggcttttgctttccct

SEQ ID NO: 1583151 - DNA, 23 bp, Homo sapiens
ctcatgggtggcactcagtctct

SEQ ID NO: 1583152 - DNA, 17 bp, Homo sapiens
ctcatgtaacattggtg

SEQ ID NO: 1583153 - DNA, 19 bp, Homo sapiens
ctcatgtaacattggtgaa

SEQ ID NO: 1583154 - DNA, 12 bp, Homo sapiens
ctcatgtcctgt

SEQ ID NO: 1583155 - DNA, 14 bp, Homo sapiens
ctcatgtcctgtcc

SEQ ID NO: 1583156 - DNA, 15 bp, Homo sapiens
ctcatgtcctgtcct

SEQ ID NO: 1583157 - DNA, 22 bp, Homo sapiens
ctcatgtcctgtcctggtcctg

SEQ ID NO: 1583158 - DNA, 17 bp, Homo sapiens
ctcatgtctggagtccc

SEQ ID NO: 1583159 - DNA, 13 bp, Homo sapiens
ctcatgtggctgg

SEQ ID NO: 1583160 - DNA, 14 bp, Homo sapiens
ctcatgttgagcca

SEQ ID NO: 1583161 - DNA, 15 bp, Homo sapiens
ctcatgttgagccag

SEQ ID NO: 1583162 - DNA, 20 bp, Homo sapiens
ctcatgttgagccagtgggc

SEQ ID NO: 1583163 - DNA, 15 bp, Homo sapiens
ctcattaaacttttt

SEQ ID NO: 1583164 - DNA, 19 bp, Homo sapiens
ctcattacagatttagttt

SEQ ID NO: 1583165 - DNA, 19 bp, Homo sapiens
ctcattcaaaagttgaaat

SEQ ID NO: 1583166 - DNA, 22 bp, Homo sapiens
ctcattcaggaaaactgacaga

SEQ ID NO: 1583167 - DNA, 14 bp, Homo sapiens
ctcattcagtatta

SEQ ID NO: 1583168 - DNA, 17 bp, Homo sapiens
ctcattccactgttggt

SEQ ID NO: 1583169 - DNA, 12 bp, Homo sapiens
ctcattcccaac

SEQ ID NO: 1583170 - DNA, 14 bp, Homo sapiens
ctcattccccaggt

SEQ ID NO: 1583171 - DNA, 12 bp, Homo sapiens
ctcattcctgcc

SEQ ID NO: 1583172 - DNA, 17 bp, Homo sapiens
ctcattcctgcctgtct

SEQ ID NO: 1583173 - DNA, 15 bp, Homo sapiens
ctcattcgcctttgt

SEQ ID NO: 1583174 - DNA, 20 bp, Homo sapiens
ctcattcgtggcatgttttg

SEQ ID NO: 1583175 - DNA, 16 bp, Homo sapiens
ctcattctttgaacat

SEQ ID NO: 1583176 - DNA, 22 bp, Homo sapiens
ctcattcttttcagcttgtttc

SEQ ID NO: 1583177 - DNA, 19 bp, Homo sapiens
ctcattgcctcctgttctg

SEQ ID NO: 1583178 - DNA, 18 bp, Homo sapiens
ctcattgctaccacagac

SEQ ID NO: 1583179 - DNA, 20 bp, Homo sapiens
ctcattgctaccacagactt

SEQ ID NO: 1583180 - DNA, 18 bp, Homo sapiens
ctcattgctgagcctctg

SEQ ID NO: 1583181 - DNA, 20 bp, Homo sapiens
ctcattgctgagcctctgct

SEQ ID NO: 1583182 - DNA, 21 bp, Homo sapiens
ctcatttaaagctaaattttg

SEQ ID NO: 1583183 - DNA, 17 bp, Homo sapiens
ctcatttcacccctccc

SEQ ID NO: 1583184 - DNA, 22 bp, Homo sapiens
ctcatttcacccctccctttct

SEQ ID NO: 1583185 - DNA, 20 bp, Homo sapiens
ctcatttctcataattttgc

SEQ ID NO: 1583186 - DNA, 15 bp, Homo sapiens
ctcatttgttctcac

SEQ ID NO: 1583187 - DNA, 16 bp, Homo sapiens
ctcatttgttctcaca

SEQ ID NO: 1583188 - DNA, 21 bp, Homo sapiens
ctcattttgacaaagtgcctc

SEQ ID NO: 1583189 - DNA, 17 bp, Homo sapiens
ctcatttttcattagat

SEQ ID NO: 1583190 - DNA, 16 bp, Homo sapiens
ctccaaaatattaaca

SEQ ID NO: 1583191 - DNA, 22 bp, Homo sapiens
ctccaaaatgttggtcatttta

SEQ ID NO: 1583192 - DNA, 16 bp, Homo sapiens
ctccaaacaccggcag

SEQ ID NO: 1583193 - DNA, 18 bp, Homo sapiens
ctccaaacaccggcagaa

SEQ ID NO: 1583194 - DNA, 22 bp, Homo sapiens
ctccaaacctccagcctccctg

SEQ ID NO: 1583195 - DNA, 18 bp, Homo sapiens
ctccaaactgaagcagcc

SEQ ID NO: 1583196 - DNA, 13 bp, Homo sapiens
ctccaaagaaatg

SEQ ID NO: 1583197 - DNA, 14 bp, Homo sapiens
ctccaaaggggctg

SEQ ID NO: 1583198 - DNA, 16 bp, Homo sapiens
ctccaaaggggctgct

SEQ ID NO: 1583199 - DNA, 19 bp, Homo sapiens
ctccaaaggggctgctggg

SEQ ID NO: 1583200 - DNA, 21 bp, Homo sapiens
ctccaaatattattcaagtgc

SEQ ID NO: 1583201 - DNA, 22 bp, Homo sapiens
ctccaacccccgccacctcagg

SEQ ID NO: 1583202 - DNA, 13 bp, Homo sapiens
ctccaacctgcaa

SEQ ID NO: 1583203 - DNA, 14 bp, Homo sapiens
ctccaacctggaca

SEQ ID NO: 1583204 - DNA, 17 bp, Homo sapiens
ctccaacgcccctgtgg

SEQ ID NO: 1583205 - DNA, 19 bp, Homo sapiens
ctccaacgcccctgtggcc

SEQ ID NO: 1583206 - DNA, 21 bp, Homo sapiens
ctccaacgcccctgtggccaa

SEQ ID NO: 1583207 - DNA, 19 bp, Homo sapiens
ctccaactgcctaaggccc

SEQ ID NO: 1583208 - DNA, 12 bp, Homo sapiens
ctccaagaaact

SEQ ID NO: 1583209 - DNA, 23 bp, Homo sapiens
ctccaagcaagtagctttccaca

SEQ ID NO: 1583210 - DNA, 18 bp, Homo sapiens
ctccaagccccatcttct

SEQ ID NO: 1583211 - DNA, 17 bp, Homo sapiens
ctccaagcctgcctccc

SEQ ID NO: 1583212 - DNA, 19 bp, Homo sapiens
ctccaagcctgcctcccaa

SEQ ID NO: 1583213 - DNA, 23 bp, Homo sapiens
ctccaaggactaaggcctccagc

SEQ ID NO: 1583214 - DNA, 20 bp, Homo sapiens
ctccaagggtttcgactggt

SEQ ID NO: 1583215 - DNA, 21 bp, Homo sapiens
ctccaagggtttcgactggtc

SEQ ID NO: 1583216 - DNA, 15 bp, Homo sapiens
ctccaagtgccagag

SEQ ID NO: 1583217 - DNA, 21 bp, Homo sapiens
ctccaagtgccagaggtgggc

SEQ ID NO: 1583218 - DNA, 19 bp, Homo sapiens
ctccaatgcattggcctct

SEQ ID NO: 1583219 - DNA, 23 bp, Homo sapiens
ctccaatgcattggcctctgtac

SEQ ID NO: 1583220 - DNA, 16 bp, Homo sapiens
ctccaatggggccagc

SEQ ID NO: 1583221 - DNA, 14 bp, Homo sapiens
ctccaatttcccca

SEQ ID NO: 1583222 - DNA, 18 bp, Homo sapiens
ctccacacagcagtgtcc

SEQ ID NO: 1583223 - DNA, 12 bp, Homo sapiens
ctccacactcca

SEQ ID NO: 1583224 - DNA, 17 bp, Homo sapiens
ctccacagagtgagcca

SEQ ID NO: 1583225 - DNA, 14 bp, Homo sapiens
ctccacagccgcag

SEQ ID NO: 1583226 - DNA, 12 bp, Homo sapiens
ctccacagctgc

SEQ ID NO: 1583227 - DNA, 13 bp, Homo sapiens
ctccacagtgctg

SEQ ID NO: 1583228 - DNA, 14 bp, Homo sapiens
ctccacagtgctgc

SEQ ID NO: 1583229 - DNA, 16 bp, Homo sapiens
ctccacagtgctgctt

SEQ ID NO: 1583230 - DNA, 19 bp, Homo sapiens
ctccacatctgcatcactc

SEQ ID NO: 1583231 - DNA, 15 bp, Homo sapiens
ctccacatctgcctt

SEQ ID NO: 1583232 - DNA, 12 bp, Homo sapiens
ctccaccaaccc

SEQ ID NO: 1583233 - DNA, 13 bp, Homo sapiens
ctccaccaaccca

SEQ ID NO: 1583234 - DNA, 13 bp, Homo sapiens
ctccaccacatcc

SEQ ID NO: 1583235 - DNA, 17 bp, Homo sapiens
ctccaccaccactggcc

SEQ ID NO: 1583236 - DNA, 19 bp, Homo sapiens
ctccaccaccactggccac

SEQ ID NO: 1583237 - DNA, 21 bp, Homo sapiens
ctccaccaccactggccacca

SEQ ID NO: 1583238 - DNA, 13 bp, Homo sapiens
ctccaccagcagc

SEQ ID NO: 1583239 - DNA, 14 bp, Homo sapiens
ctccaccagcagca

SEQ ID NO: 1583240 - DNA, 15 bp, Homo sapiens
ctccaccagcctgct

SEQ ID NO: 1583241 - DNA, 16 bp, Homo sapiens
ctccaccagcctgctg

SEQ ID NO: 1583242 - DNA, 18 bp, Homo sapiens
ctccaccagcctgctgac

SEQ ID NO: 1583243 - DNA, 18 bp, Homo sapiens
ctccacccaccagtcagg

SEQ ID NO: 1583244 - DNA, 19 bp, Homo sapiens
ctccacccaccccctttgg

SEQ ID NO: 1583245 - DNA, 14 bp, Homo sapiens
ctccaccccccacg

SEQ ID NO: 1583246 - DNA, 21 bp, Homo sapiens
ctccaccccccacgtctgtcc

SEQ ID NO: 1583247 - DNA, 21 bp, Homo sapiens
ctccaccccccagaacctgtc

SEQ ID NO: 1583248 - DNA, 23 bp, Homo sapiens
ctccaccccccagaacctgtcct

SEQ ID NO: 1583249 - DNA, 18 bp, Homo sapiens
ctccacccccgccacggc

SEQ ID NO: 1583250 - DNA, 16 bp, Homo sapiens
ctccaccctccacctt

SEQ ID NO: 1583251 - DNA, 12 bp, Homo sapiens
ctccaccctgca

SEQ ID NO: 1583252 - DNA, 22 bp, Homo sapiens
ctccaccctgtcccccagctct

SEQ ID NO: 1583253 - DNA, 12 bp, Homo sapiens
ctccacccttgg

SEQ ID NO: 1583254 - DNA, 13 bp, Homo sapiens
ctccacccttggc

SEQ ID NO: 1583255 - DNA, 17 bp, Homo sapiens
ctccacccttggcctgt

SEQ ID NO: 1583256 - DNA, 17 bp, Homo sapiens
ctccaccgaccaactgc

SEQ ID NO: 1583257 - DNA, 21 bp, Homo sapiens
ctccaccgaccaactgcccta

SEQ ID NO: 1583258 - DNA, 15 bp, Homo sapiens
ctccaccgctgccta

SEQ ID NO: 1583259 - DNA, 19 bp, Homo sapiens
ctccaccgctgcctaagtg

SEQ ID NO: 1583260 - DNA, 15 bp, Homo sapiens
ctccacctagactgt

SEQ ID NO: 1583261 - DNA, 17 bp, Homo sapiens
ctccacctcagccttgg

SEQ ID NO: 1583262 - DNA, 22 bp, Homo sapiens
ctccacctcccccaaaccctgc

SEQ ID NO: 1583263 - DNA, 13 bp, Homo sapiens
ctccacctctggt

SEQ ID NO: 1583264 - DNA, 20 bp, Homo sapiens
ctccacctctggtggctcct

SEQ ID NO: 1583265 - DNA, 14 bp, Homo sapiens
ctccaccttcccac

SEQ ID NO: 1583266 - DNA, 17 bp, Homo sapiens
ctccacggtgcgtggct

SEQ ID NO: 1583267 - DNA, 20 bp, Homo sapiens
ctccacgtgtccgtccaccc

SEQ ID NO: 1583268 - DNA, 18 bp, Homo sapiens
ctccactaaatgagctcc

SEQ ID NO: 1583269 - DNA, 19 bp, Homo sapiens
ctccactaaatgagctcct

SEQ ID NO: 1583270 - DNA, 20 bp, Homo sapiens
ctccactaaatgagctcctg

SEQ ID NO: 1583271 - DNA, 13 bp, Homo sapiens
ctccactcactcc

SEQ ID NO: 1583272 - DNA, 15 bp, Homo sapiens
ctccactcactccag

SEQ ID NO: 1583273 - DNA, 18 bp, Homo sapiens
ctccactcactccagccc

SEQ ID NO: 1583274 - DNA, 19 bp, Homo sapiens
ctccactcactccagccca

SEQ ID NO: 1583275 - DNA, 18 bp, Homo sapiens
ctccactcagctgtcctg

SEQ ID NO: 1583276 - DNA, 23 bp, Homo sapiens
ctccactcagctgtcctgcagca

SEQ ID NO: 1583277 - DNA, 17 bp, Homo sapiens
ctccactccagctctga

SEQ ID NO: 1583278 - DNA, 19 bp, Homo sapiens
ctccactccagctctgaga

SEQ ID NO: 1583279 - DNA, 15 bp, Homo sapiens
ctccactccatccct

SEQ ID NO: 1583280 - DNA, 16 bp, Homo sapiens
ctccactcccccacct

SEQ ID NO: 1583281 - DNA, 17 bp, Homo sapiens
ctccactcccccacctg

SEQ ID NO: 1583282 - DNA, 19 bp, Homo sapiens
ctccactctagttctagat

SEQ ID NO: 1583283 - DNA, 20 bp, Homo sapiens
ctccactctagttctagatg

SEQ ID NO: 1583284 - DNA, 13 bp, Homo sapiens
ctccactctcctt

SEQ ID NO: 1583285 - DNA, 22 bp, Homo sapiens
ctccactctccttcgtgtctct

SEQ ID NO: 1583286 - DNA, 15 bp, Homo sapiens
ctccactctgattca

SEQ ID NO: 1583287 - DNA, 18 bp, Homo sapiens
ctccactctgattcacct

SEQ ID NO: 1583288 - DNA, 21 bp, Homo sapiens
ctccactctgattcacctctt

SEQ ID NO: 1583289 - DNA, 15 bp, Homo sapiens
ctccactctgcttct

SEQ ID NO: 1583290 - DNA, 20 bp, Homo sapiens
ctccactctgcttctctgac

SEQ ID NO: 1583291 - DNA, 22 bp, Homo sapiens
ctccactcttgatctctcttgt

SEQ ID NO: 1583292 - DNA, 24 bp, Homo sapiens
ctccactcttgatctctcttgtcc

SEQ ID NO: 1583293 - DNA, 12 bp, Homo sapiens
ctccactgccct

SEQ ID NO: 1583294 - DNA, 14 bp, Homo sapiens
ctccactgccctgg

SEQ ID NO: 1583295 - DNA, 20 bp, Homo sapiens
ctccactgccctggcagcag

SEQ ID NO: 1583296 - DNA, 21 bp, Homo sapiens
ctccactgccctggcagcagc

SEQ ID NO: 1583297 - DNA, 16 bp, Homo sapiens
ctccactgcctctgga

SEQ ID NO: 1583298 - DNA, 14 bp, Homo sapiens
ctccactgccttcg

SEQ ID NO: 1583299 - DNA, 16 bp, Homo sapiens
ctccactgccttcgat

SEQ ID NO: 1583300 - DNA, 15 bp, Homo sapiens
ctccactgctctcag

SEQ ID NO: 1583301 - DNA, 17 bp, Homo sapiens
ctccactgctctcagcc

SEQ ID NO: 1583302 - DNA, 18 bp, Homo sapiens
ctccactgctctcagcct

SEQ ID NO: 1583303 - DNA, 21 bp, Homo sapiens
ctccagaagatgccagcttct

SEQ ID NO: 1583304 - DNA, 23 bp, Homo sapiens
ctccagaagatgccagcttctct

SEQ ID NO: 1583305 - DNA, 15 bp, Homo sapiens
ctccagaagcctctg

SEQ ID NO: 1583306 - DNA, 19 bp, Homo sapiens
ctccagaagcctctggcta

SEQ ID NO: 1583307 - DNA, 20 bp, Homo sapiens
ctccagaagcctctggctag

SEQ ID NO: 1583308 - DNA, 21 bp, Homo sapiens
ctccagaagcctctggctaga

SEQ ID NO: 1583309 - DNA, 16 bp, Homo sapiens
ctccagaatctgctgt

SEQ ID NO: 1583310 - DNA, 22 bp, Homo sapiens
ctccagaatctgctgttgccat

SEQ ID NO: 1583311 - DNA, 17 bp, Homo sapiens
ctccagacccctggctt

SEQ ID NO: 1583312 - DNA, 20 bp, Homo sapiens
ctccagacccctggcttttc

SEQ ID NO: 1583313 - DNA, 21 bp, Homo sapiens
ctccagacccctggcttttca

SEQ ID NO: 1583314 - DNA, 15 bp, Homo sapiens
ctccagaccctgcct

SEQ ID NO: 1583315 - DNA, 17 bp, Homo sapiens
ctccagaccctgcctga

SEQ ID NO: 1583316 - DNA, 19 bp, Homo sapiens
ctccagaccctgcctgagc

SEQ ID NO: 1583317 - DNA, 11 bp, Homo sapiens
ctccagacctg

SEQ ID NO: 1583318 - DNA, 16 bp, Homo sapiens
ctccagagacagggaa

SEQ ID NO: 1583319 - DNA, 11 bp, Homo sapiens
ctccagagcca

SEQ ID NO: 1583320 - DNA, 20 bp, Homo sapiens
ctccagagccagcctgggac

SEQ ID NO: 1583321 - DNA, 14 bp, Homo sapiens
ctccagaggtcctc

SEQ ID NO: 1583322 - DNA, 17 bp, Homo sapiens
ctccagagtctgagccc

SEQ ID NO: 1583323 - DNA, 19 bp, Homo sapiens
ctccagagtctgagccccc

SEQ ID NO: 1583324 - DNA, 20 bp, Homo sapiens
ctccagagtctgagcccccg

SEQ ID NO: 1583325 - DNA, 19 bp, Homo sapiens
ctccagataactctctttc

SEQ ID NO: 1583326 - DNA, 21 bp, Homo sapiens
ctccagatagctcatttcatt

SEQ ID NO: 1583327 - DNA, 19 bp, Homo sapiens
ctccagattagagcctgta

SEQ ID NO: 1583328 - DNA, 18 bp, Homo sapiens
ctccagcaacacagcctg

SEQ ID NO: 1583329 - DNA, 21 bp, Homo sapiens
ctccagcaacacagcctgggc

SEQ ID NO: 1583330 - DNA, 16 bp, Homo sapiens
ctccagcaactgccct

SEQ ID NO: 1583331 - DNA, 17 bp, Homo sapiens
ctccagcaactgccctt

SEQ ID NO: 1583332 - DNA, 19 bp, Homo sapiens
ctccagcaactgcccttcc

SEQ ID NO: 1583333 - DNA, 22 bp, Homo sapiens
ctccagcaactgcccttccagg

SEQ ID NO: 1583334 - DNA, 15 bp, Homo sapiens
ctccagcaacttctt

SEQ ID NO: 1583335 - DNA, 13 bp, Homo sapiens
ctccagcagcaca

SEQ ID NO: 1583336 - DNA, 15 bp, Homo sapiens
ctccagcagcacacc

SEQ ID NO: 1583337 - DNA, 20 bp, Homo sapiens
ctccagcagcacacctcagc

SEQ ID NO: 1583338 - DNA, 14 bp, Homo sapiens
ctccagcatccagc

SEQ ID NO: 1583339 - DNA, 18 bp, Homo sapiens
ctccagcatccagcctgt

SEQ ID NO: 1583340 - DNA, 16 bp, Homo sapiens
ctccagccagcaatga

SEQ ID NO: 1583341 - DNA, 12 bp, Homo sapiens
ctccagccccat

SEQ ID NO: 1583342 - DNA, 13 bp, Homo sapiens
ctccagcccctgt

SEQ ID NO: 1583343 - DNA, 14 bp, Homo sapiens
ctccagcccctgtc

SEQ ID NO: 1583344 - DNA, 15 bp, Homo sapiens
ctccagcccctgtcc

SEQ ID NO: 1583345 - DNA, 16 bp, Homo sapiens
ctccagcccctgtccc

SEQ ID NO: 1583346 - DNA, 18 bp, Homo sapiens
ctccagccgctggcaaca

SEQ ID NO: 1583347 - DNA, 15 bp, Homo sapiens
ctccagcctcagcct

SEQ ID NO: 1583348 - DNA, 18 bp, Homo sapiens
ctccagcctccctgtctc

SEQ ID NO: 1583349 - DNA, 23 bp, Homo sapiens
ctccagcctctcccggctgcctg

SEQ ID NO: 1583350 - DNA, 23 bp, Homo sapiens
ctccagcctgggcaacaagagca

SEQ ID NO: 1583351 - DNA, 13 bp, Homo sapiens
ctccagcctgggg

SEQ ID NO: 1583352 - DNA, 14 bp, Homo sapiens
ctccagcctgggga

SEQ ID NO: 1583353 - DNA, 12 bp, Homo sapiens
ctccagctgcct

SEQ ID NO: 1583354 - DNA, 14 bp, Homo sapiens
ctccagctgcctgg

SEQ ID NO: 1583355 - DNA, 17 bp, Homo sapiens
ctccagctgcctgggcc

SEQ ID NO: 1583356 - DNA, 20 bp, Homo sapiens
ctccagctgggctctgcaat

SEQ ID NO: 1583357 - DNA, 13 bp, Homo sapiens
ctccagcttcagc

SEQ ID NO: 1583358 - DNA, 21 bp, Homo sapiens
ctccaggaaggtagcccagca

SEQ ID NO: 1583359 - DNA, 18 bp, Homo sapiens
ctccaggagagagccagg

SEQ ID NO: 1583360 - DNA, 15 bp, Homo sapiens
ctccaggatctttga

SEQ ID NO: 1583361 - DNA, 21 bp, Homo sapiens
ctccaggattttaatttcagg

SEQ ID NO: 1583362 - DNA, 17 bp, Homo sapiens
ctccaggcaggccaggc

SEQ ID NO: 1583363 - DNA, 23 bp, Homo sapiens
ctccaggccaggtgggaacggct

SEQ ID NO: 1583364 - DNA, 11 bp, Homo sapiens
ctccaggccca

SEQ ID NO: 1583365 - DNA, 16 bp, Homo sapiens
ctccaggcccaaggct

SEQ ID NO: 1583366 - DNA, 20 bp, Homo sapiens
ctccaggccctcctctccca

SEQ ID NO: 1583367 - DNA, 15 bp, Homo sapiens
ctccaggcctgacca

SEQ ID NO: 1583368 - DNA, 18 bp, Homo sapiens
ctccaggcctgaccaggg

SEQ ID NO: 1583369 - DNA, 14 bp, Homo sapiens
ctccaggcctgcag

SEQ ID NO: 1583370 - DNA, 15 bp, Homo sapiens
ctccaggcctgcagg

SEQ ID NO: 1583371 - DNA, 19 bp, Homo sapiens
ctccagggaatccaagcct

SEQ ID NO: 1583372 - DNA, 20 bp, Homo sapiens
ctccagggaatccaagcctc

SEQ ID NO: 1583373 - DNA, 21 bp, Homo sapiens
ctccagggaatccaagcctcc

SEQ ID NO: 1583374 - DNA, 15 bp, Homo sapiens
ctccagggagcaaga

SEQ ID NO: 1583375 - DNA, 15 bp, Homo sapiens
ctccagggcattgct

SEQ ID NO: 1583376 - DNA, 20 bp, Homo sapiens
ctccagggcattgctcagcc

SEQ ID NO: 1583377 - DNA, 21 bp, Homo sapiens
ctccagggcattgctcagccc

SEQ ID NO: 1583378 - DNA, 23 bp, Homo sapiens
ctccagggccacgtgccaggccc

SEQ ID NO: 1583379 - DNA, 15 bp, Homo sapiens
ctccagggcccccca

SEQ ID NO: 1583380 - DNA, 15 bp, Homo sapiens
ctccagggctccaaa

SEQ ID NO: 1583381 - DNA, 18 bp, Homo sapiens
ctccagggctggactgag

SEQ ID NO: 1583382 - DNA, 17 bp, Homo sapiens
ctccaggggcctgcaga

SEQ ID NO: 1583383 - DNA, 23 bp, Homo sapiens
ctccaggggctgcttcctcctgg

SEQ ID NO: 1583384 - DNA, 17 bp, Homo sapiens
ctccagggtcaggcgga

SEQ ID NO: 1583385 - DNA, 20 bp, Homo sapiens
ctccagggtcttgggctact

SEQ ID NO: 1583386 - DNA, 20 bp, Homo sapiens
ctccaggtcagcctggaagg

SEQ ID NO: 1583387 - DNA, 17 bp, Homo sapiens
ctccaggtcagctgccc

SEQ ID NO: 1583388 - DNA, 21 bp, Homo sapiens
ctccaggtcggagtgcctgga

SEQ ID NO: 1583389 - DNA, 23 bp, Homo sapiens
ctccaggtcggagtgcctggagt

SEQ ID NO: 1583390 - DNA, 13 bp, Homo sapiens
ctccaggtgcaga

SEQ ID NO: 1583391 - DNA, 14 bp, Homo sapiens
ctccaggtgtgcac

SEQ ID NO: 1583392 - DNA, 14 bp, Homo sapiens
ctccagtacgtccc

SEQ ID NO: 1583393 - DNA, 21 bp, Homo sapiens
ctccagtacgtcccgctgctg

SEQ ID NO: 1583394 - DNA, 24 bp, Homo sapiens
ctccagtacgtcccgctgctgtgc

SEQ ID NO: 1583395 - DNA, 19 bp, Homo sapiens
ctccagtattgccccctct

SEQ ID NO: 1583396 - DNA, 17 bp, Homo sapiens
ctccagtcaacagattc

SEQ ID NO: 1583397 - DNA, 22 bp, Homo sapiens
ctccagtcatctgtaagagctt

SEQ ID NO: 1583398 - DNA, 21 bp, Homo sapiens
ctccagtgagtacctgcaaaa

SEQ ID NO: 1583399 - DNA, 13 bp, Homo sapiens
ctccagtgctcag

SEQ ID NO: 1583400 - DNA, 14 bp, Homo sapiens
ctccagtgctcagc

SEQ ID NO: 1583401 - DNA, 18 bp, Homo sapiens
ctccagtgctcagctgtg

SEQ ID NO: 1583402 - DNA, 20 bp, Homo sapiens
ctccagtgctcagctgtggc

SEQ ID NO: 1583403 - DNA, 22 bp, Homo sapiens
ctccagtgctcagctgtggctg

SEQ ID NO: 1583404 - DNA, 20 bp, Homo sapiens
ctccagttgggactcaggat

SEQ ID NO: 1583405 - DNA, 21 bp, Homo sapiens
ctccagttgggactcaggata

SEQ ID NO: 1583406 - DNA, 16 bp, Homo sapiens
ctccagtttgcatttg

SEQ ID NO: 1583407 - DNA, 20 bp, Homo sapiens
ctccataaagtacaaatgaa

SEQ ID NO: 1583408 - DNA, 14 bp, Homo sapiens
ctccatacagcctc

SEQ ID NO: 1583409 - DNA, 15 bp, Homo sapiens
ctccatacagcctct

SEQ ID NO: 1583410 - DNA, 16 bp, Homo sapiens
ctccataccttttctc

SEQ ID NO: 1583411 - DNA, 17 bp, Homo sapiens
ctccataccttttctct

SEQ ID NO: 1583412 - DNA, 17 bp, Homo sapiens
ctccatatctccttccc

SEQ ID NO: 1583413 - DNA, 19 bp, Homo sapiens
ctccatcacaaccagattt

SEQ ID NO: 1583414 - DNA, 17 bp, Homo sapiens
ctccatcccaacagcca

SEQ ID NO: 1583415 - DNA, 20 bp, Homo sapiens
ctccatcgccatcttcttcc

SEQ ID NO: 1583416 - DNA, 20 bp, Homo sapiens
ctccatctcaaaacaaaaca

SEQ ID NO: 1583417 - DNA, 19 bp, Homo sapiens
ctccatctccgcctccaca

SEQ ID NO: 1583418 - DNA, 20 bp, Homo sapiens
ctccatctctcatcctccag

SEQ ID NO: 1583419 - DNA, 21 bp, Homo sapiens
ctccatctctcatcctccagt

SEQ ID NO: 1583420 - DNA, 15 bp, Homo sapiens
ctccatctcttctgc

SEQ ID NO: 1583421 - DNA, 20 bp, Homo sapiens
ctccatcttggtagttctgt

SEQ ID NO: 1583422 - DNA, 17 bp, Homo sapiens
ctccatgaagagcttgt

SEQ ID NO: 1583423 - DNA, 21 bp, Homo sapiens
ctccatgcacctcccttccct

SEQ ID NO: 1583424 - DNA, 22 bp, Homo sapiens
ctccatgcaggggtcagtgcag

SEQ ID NO: 1583425 - DNA, 21 bp, Homo sapiens
ctccatgccccagctctggat

SEQ ID NO: 1583426 - DNA, 14 bp, Homo sapiens
ctccatgctcctca

SEQ ID NO: 1583427 - DNA, 13 bp, Homo sapiens
ctccatgctgcaa

SEQ ID NO: 1583428 - DNA, 15 bp, Homo sapiens
ctccatggcagcagc

SEQ ID NO: 1583429 - DNA, 16 bp, Homo sapiens
ctccatggcagcagcc

SEQ ID NO: 1583430 - DNA, 12 bp, Homo sapiens
ctccatggccac

SEQ ID NO: 1583431 - DNA, 21 bp, Homo sapiens
ctccatggccaccccgtgcca

SEQ ID NO: 1583432 - DNA, 17 bp, Homo sapiens
ctccatgggctagtgtg

SEQ ID NO: 1583433 - DNA, 17 bp, Homo sapiens
ctccatggggttcgaga

SEQ ID NO: 1583434 - DNA, 13 bp, Homo sapiens
ctccattactgtg

SEQ ID NO: 1583435 - DNA, 19 bp, Homo sapiens
ctccattagaaaattttgt

SEQ ID NO: 1583436 - DNA, 13 bp, Homo sapiens
ctccattcatcct

SEQ ID NO: 1583437 - DNA, 15 bp, Homo sapiens
ctccattcatccttc

SEQ ID NO: 1583438 - DNA, 17 bp, Homo sapiens
ctccatttctctccagg

SEQ ID NO: 1583439 - DNA, 15 bp, Homo sapiens
ctccatttgctcttc

SEQ ID NO: 1583440 - DNA, 12 bp, Homo sapiens
ctccatttttct

SEQ ID NO: 1583441 - DNA, 14 bp, Homo sapiens
ctccattttttctt

SEQ ID NO: 1583442 - DNA, 16 bp, Homo sapiens
ctcccaaaagctagaa

SEQ ID NO: 1583443 - DNA, 20 bp, Homo sapiens
ctcccaaacgccctttcctc

SEQ ID NO: 1583444 - DNA, 20 bp, Homo sapiens
ctcccaaagctcagacttgc

SEQ ID NO: 1583445 - DNA, 17 bp, Homo sapiens
ctcccaaagtgctggga

SEQ ID NO: 1583446 - DNA, 21 bp, Homo sapiens
ctcccaaatgtctattttctt

SEQ ID NO: 1583447 - DNA, 15 bp, Homo sapiens
ctcccaacagcgctt

SEQ ID NO: 1583448 - DNA, 17 bp, Homo sapiens
ctcccaaccccagggcc

SEQ ID NO: 1583449 - DNA, 18 bp, Homo sapiens
ctcccaacccccctcctg

SEQ ID NO: 1583450 - DNA, 22 bp, Homo sapiens
ctcccaacccccctcctgctcc

SEQ ID NO: 1583451 - DNA, 21 bp, Homo sapiens
ctcccaacctcaatgccctgc

SEQ ID NO: 1583452 - DNA, 23 bp, Homo sapiens
ctcccaacctcaatgccctgcca

SEQ ID NO: 1583453 - DNA, 14 bp, Homo sapiens
ctcccaacttcttc

SEQ ID NO: 1583454 - DNA, 16 bp, Homo sapiens
ctcccaacttcttcct

SEQ ID NO: 1583455 - DNA, 20 bp, Homo sapiens
ctcccaacttcttcctgtga

SEQ ID NO: 1583456 - DNA, 22 bp, Homo sapiens
ctcccaagcacctgggattaca

SEQ ID NO: 1583457 - DNA, 18 bp, Homo sapiens
ctcccaaggtcctctcag

SEQ ID NO: 1583458 - DNA, 13 bp, Homo sapiens
ctcccaaggttcc

SEQ ID NO: 1583459 - DNA, 15 bp, Homo sapiens
ctcccaatcagcttt

SEQ ID NO: 1583460 - DNA, 21 bp, Homo sapiens
ctcccacacccaaagctgagc

SEQ ID NO: 1583461 - DNA, 22 bp, Homo sapiens
ctcccacacccaaagctgagcc

SEQ ID NO: 1583462 - DNA, 13 bp, Homo sapiens
ctcccacacccct

SEQ ID NO: 1583463 - DNA, 13 bp, Homo sapiens
ctcccacagagac

SEQ ID NO: 1583464 - DNA, 16 bp, Homo sapiens
ctcccacagtgctggg

SEQ ID NO: 1583465 - DNA, 20 bp, Homo sapiens
ctcccaccaccagtgagaca

SEQ ID NO: 1583466 - DNA, 16 bp, Homo sapiens
ctcccacccacagcca

SEQ ID NO: 1583467 - DNA, 22 bp, Homo sapiens
ctcccaccccacccccttcagt

SEQ ID NO: 1583468 - DNA, 18 bp, Homo sapiens
ctcccaccccactccagc

SEQ ID NO: 1583469 - DNA, 15 bp, Homo sapiens
ctcccacccccatct

SEQ ID NO: 1583470 - DNA, 17 bp, Homo sapiens
ctcccacccgatgctgc

SEQ ID NO: 1583471 - DNA, 23 bp, Homo sapiens
ctcccacccgatgctgctttccc

SEQ ID NO: 1583472 - DNA, 20 bp, Homo sapiens
ctcccacccggccacagctg

SEQ ID NO: 1583473 - DNA, 17 bp, Homo sapiens
ctcccaccgcagcgtcc

SEQ ID NO: 1583474 - DNA, 22 bp, Homo sapiens
ctcccaccgcagcgtcccccgc

SEQ ID NO: 1583475 - DNA, 20 bp, Homo sapiens
ctcccaccgcccccacccct

SEQ ID NO: 1583476 - DNA, 22 bp, Homo sapiens
ctcccaccgcccccaccccttc

SEQ ID NO: 1583477 - DNA, 16 bp, Homo sapiens
ctcccacctagtgccc

SEQ ID NO: 1583478 - DNA, 20 bp, Homo sapiens
ctcccacctagtgccccaga

SEQ ID NO: 1583479 - DNA, 16 bp, Homo sapiens
ctcccacctcagcctc

SEQ ID NO: 1583480 - DNA, 15 bp, Homo sapiens
ctcccacctgacaca

SEQ ID NO: 1583481 - DNA, 20 bp, Homo sapiens
ctcccacctgacacaccagg

SEQ ID NO: 1583482 - DNA, 18 bp, Homo sapiens
ctcccacggcacctcggg

SEQ ID NO: 1583483 - DNA, 16 bp, Homo sapiens
ctcccactccctttcc

SEQ ID NO: 1583484 - DNA, 15 bp, Homo sapiens
ctcccactcctgctg

SEQ ID NO: 1583485 - DNA, 21 bp, Homo sapiens
ctcccagaaacatctctggcc

SEQ ID NO: 1583486 - DNA, 16 bp, Homo sapiens
ctcccagcccattgct

SEQ ID NO: 1583487 - DNA, 19 bp, Homo sapiens
ctcccagcccattgctgcc

SEQ ID NO: 1583488 - DNA, 22 bp, Homo sapiens
ctcccagcctcttgctcagagc

SEQ ID NO: 1583489 - DNA, 17 bp, Homo sapiens
ctcccagctaattgaga

SEQ ID NO: 1583490 - DNA, 11 bp, Homo sapiens
ctcccaggaca

SEQ ID NO: 1583491 - DNA, 20 bp, Homo sapiens
ctcccaggaggtgcttgagg

SEQ ID NO: 1583492 - DNA, 12 bp, Homo sapiens
ctcccaggcaag

SEQ ID NO: 1583493 - DNA, 17 bp, Homo sapiens
ctcccaggcaagcagct

SEQ ID NO: 1583494 - DNA, 20 bp, Homo sapiens
ctcccaggccaacagtagcc

SEQ ID NO: 1583495 - DNA, 21 bp, Homo sapiens
ctcccaggccaacagtagcca

SEQ ID NO: 1583496 - DNA, 15 bp, Homo sapiens
ctcccaggccccctg

SEQ ID NO: 1583497 - DNA, 18 bp, Homo sapiens
ctcccaggccccctgcat

SEQ ID NO: 1583498 - DNA, 19 bp, Homo sapiens
ctcccaggcgccccttccc

SEQ ID NO: 1583499 - DNA, 18 bp, Homo sapiens
ctcccaggggagccagct

SEQ ID NO: 1583500 - DNA, 16 bp, Homo sapiens
ctcccaggtaccagct

SEQ ID NO: 1583501 - DNA, 17 bp, Homo sapiens
ctcccaggtaccagctg

SEQ ID NO: 1583502 - DNA, 19 bp, Homo sapiens
ctcccaggtaccagctgcg

SEQ ID NO: 1583503 - DNA, 17 bp, Homo sapiens
ctcccagtcatttaata

SEQ ID NO: 1583504 - DNA, 16 bp, Homo sapiens
ctcccatcattccttc

SEQ ID NO: 1583505 - DNA, 11 bp, Homo sapiens
ctcccatccca

SEQ ID NO: 1583506 - DNA, 12 bp, Homo sapiens
ctcccatccccc

SEQ ID NO: 1583507 - DNA, 24 bp, Homo sapiens
ctcccatccccctgccctcgtggc

SEQ ID NO: 1583508 - DNA, 21 bp, Homo sapiens
ctcccatcctggggcagcact

SEQ ID NO: 1583509 - DNA, 13 bp, Homo sapiens
ctcccatctcctg

SEQ ID NO: 1583510 - DNA, 14 bp, Homo sapiens
ctcccatctcctga

SEQ ID NO: 1583511 - DNA, 15 bp, Homo sapiens
ctcccatctccttcc

SEQ ID NO: 1583512 - DNA, 20 bp, Homo sapiens
ctcccatctccttcccccag

SEQ ID NO: 1583513 - DNA, 22 bp, Homo sapiens
ctcccatctccttcccccagcc

SEQ ID NO: 1583514 - DNA, 23 bp, Homo sapiens
ctcccatctccttcccccagccc

SEQ ID NO: 1583515 - DNA, 21 bp, Homo sapiens
ctcccatctgatttacttaat

SEQ ID NO: 1583516 - DNA, 21 bp, Homo sapiens
ctcccatgaccatactgaggg

SEQ ID NO: 1583517 - DNA, 20 bp, Homo sapiens
ctcccatgtgagtccctgtg

SEQ ID NO: 1583518 - DNA, 19 bp, Homo sapiens
ctcccattcactcttccag

SEQ ID NO: 1583519 - DNA, 20 bp, Homo sapiens
ctcccattcactcttccaga

SEQ ID NO: 1583520 - DNA, 20 bp, Homo sapiens
ctccccaaagccactggaag

SEQ ID NO: 1583521 - DNA, 21 bp, Homo sapiens
ctccccaaagccactggaagg

SEQ ID NO: 1583522 - DNA, 16 bp, Homo sapiens
ctccccaaagggtgtg

SEQ ID NO: 1583523 - DNA, 17 bp, Homo sapiens
ctccccaattctcccct

SEQ ID NO: 1583524 - DNA, 12 bp, Homo sapiens
ctccccacacct

SEQ ID NO: 1583525 - DNA, 21 bp, Homo sapiens
ctccccacaccttccagggcc

SEQ ID NO: 1583526 - DNA, 14 bp, Homo sapiens
ctccccacactcca

SEQ ID NO: 1583527 - DNA, 17 bp, Homo sapiens
ctccccacactccactc

SEQ ID NO: 1583528 - DNA, 15 bp, Homo sapiens
ctccccacagcgtcc

SEQ ID NO: 1583529 - DNA, 19 bp, Homo sapiens
ctccccacagcgtccctgg

SEQ ID NO: 1583530 - DNA, 20 bp, Homo sapiens
ctccccacagcgtccctggc

SEQ ID NO: 1583531 - DNA, 15 bp, Homo sapiens
ctccccacctccagg

SEQ ID NO: 1583532 - DNA, 16 bp, Homo sapiens
ctccccacctccaggc

SEQ ID NO: 1583533 - DNA, 21 bp, Homo sapiens
ctccccaccttcaattcctgg

SEQ ID NO: 1583534 - DNA, 22 bp, Homo sapiens
ctccccacgagtcacctgcaag

SEQ ID NO: 1583535 - DNA, 23 bp, Homo sapiens
ctccccacggggcctcgggacct

SEQ ID NO: 1583536 - DNA, 12 bp, Homo sapiens
ctccccactgaa

SEQ ID NO: 1583537 - DNA, 20 bp, Homo sapiens
ctccccactgaaaacatttc

SEQ ID NO: 1583538 - DNA, 15 bp, Homo sapiens
ctccccagagctgtg

SEQ ID NO: 1583539 - DNA, 16 bp, Homo sapiens
ctccccagagctgtgc

SEQ ID NO: 1583540 - DNA, 17 bp, Homo sapiens
ctccccagccagaggtg

SEQ ID NO: 1583541 - DNA, 23 bp, Homo sapiens
ctccccagccagaggtggagcca

SEQ ID NO: 1583542 - DNA, 17 bp, Homo sapiens
ctccccaggactcaccc

SEQ ID NO: 1583543 - DNA, 14 bp, Homo sapiens
ctccccaggccacc

SEQ ID NO: 1583544 - DNA, 15 bp, Homo sapiens
ctccccaggccaccc

SEQ ID NO: 1583545 - DNA, 12 bp, Homo sapiens
ctccccaggcct

SEQ ID NO: 1583546 - DNA, 13 bp, Homo sapiens
ctccccaggcctc

SEQ ID NO: 1583547 - DNA, 15 bp, Homo sapiens
ctccccaggcctcca

SEQ ID NO: 1583548 - DNA, 14 bp, Homo sapiens
ctccccagggagct

SEQ ID NO: 1583549 - DNA, 18 bp, Homo sapiens
ctccccagggagctctgg

SEQ ID NO: 1583550 - DNA, 19 bp, Homo sapiens
ctccccagggagctctggg

SEQ ID NO: 1583551 - DNA, 21 bp, Homo sapiens
ctccccagggagctctgggga

SEQ ID NO: 1583552 - DNA, 18 bp, Homo sapiens
ctccccaggtccagctct

SEQ ID NO: 1583553 - DNA, 12 bp, Homo sapiens
ctccccagtgcc

SEQ ID NO: 1583554 - DNA, 15 bp, Homo sapiens
ctccccagtgcctgc

SEQ ID NO: 1583555 - DNA, 17 bp, Homo sapiens
ctccccagtgcctgcca

SEQ ID NO: 1583556 - DNA, 18 bp, Homo sapiens
ctccccagtgcctgccac

SEQ ID NO: 1583557 - DNA, 11 bp, Homo sapiens
ctccccagttc

SEQ ID NO: 1583558 - DNA, 20 bp, Homo sapiens
ctccccatgtgcctgcacca

SEQ ID NO: 1583559 - DNA, 21 bp, Homo sapiens
ctccccatgtgtcctggttcc

SEQ ID NO: 1583560 - DNA, 21 bp, Homo sapiens
ctccccattagagtcagcctt

SEQ ID NO: 1583561 - DNA, 15 bp, Homo sapiens
ctccccattcacaga

SEQ ID NO: 1583562 - DNA, 18 bp, Homo sapiens
ctccccattcacagagcc

SEQ ID NO: 1583563 - DNA, 20 bp, Homo sapiens
ctccccatttcccatctgca

SEQ ID NO: 1583564 - DNA, 19 bp, Homo sapiens
ctcccccaaaccctgcttc

SEQ ID NO: 1583565 - DNA, 21 bp, Homo sapiens
ctcccccaacccccaccccac

SEQ ID NO: 1583566 - DNA, 23 bp, Homo sapiens
ctcccccaacccccaccccacac

SEQ ID NO: 1583567 - DNA, 13 bp, Homo sapiens
ctcccccacctga

SEQ ID NO: 1583568 - DNA, 13 bp, Homo sapiens
ctcccccagcaga

SEQ ID NO: 1583569 - DNA, 18 bp, Homo sapiens
ctcccccagccaggacca

SEQ ID NO: 1583570 - DNA, 23 bp, Homo sapiens
ctcccccatgggggtgagaccct

SEQ ID NO: 1583571 - DNA, 13 bp, Homo sapiens
ctccccccactgc

SEQ ID NO: 1583572 - DNA, 14 bp, Homo sapiens
ctccccccagaccc

SEQ ID NO: 1583573 - DNA, 15 bp, Homo sapiens
ctccccccgcccacc

SEQ ID NO: 1583574 - DNA, 21 bp, Homo sapiens
ctccccccgcccacccacgca

SEQ ID NO: 1583575 - DNA, 22 bp, Homo sapiens
ctcccccgacactgctgcacca

SEQ ID NO: 1583576 - DNA, 18 bp, Homo sapiens
ctcccccgcagtccccag

SEQ ID NO: 1583577 - DNA, 22 bp, Homo sapiens
ctcccccgccagccccaagctg

SEQ ID NO: 1583578 - DNA, 15 bp, Homo sapiens
ctcccccggctctac

SEQ ID NO: 1583579 - DNA, 16 bp, Homo sapiens
ctcccccggctgggcc

SEQ ID NO: 1583580 - DNA, 17 bp, Homo sapiens
ctcccccgtttctcctt

SEQ ID NO: 1583581 - DNA, 13 bp, Homo sapiens
ctccccctcctgc

SEQ ID NO: 1583582 - DNA, 13 bp, Homo sapiens
ctccccctgcaac

SEQ ID NO: 1583583 - DNA, 14 bp, Homo sapiens
ctccccctgcaact

SEQ ID NO: 1583584 - DNA, 23 bp, Homo sapiens
ctccccctgcaacttccgctgag

SEQ ID NO: 1583585 - DNA, 11 bp, Homo sapiens
ctccccctgcc

SEQ ID NO: 1583586 - DNA, 13 bp, Homo sapiens
ctccccctgccag

SEQ ID NO: 1583587 - DNA, 16 bp, Homo sapiens
ctccccctgccagtgc

SEQ ID NO: 1583588 - DNA, 17 bp, Homo sapiens
ctccccctgccagtgcc

SEQ ID NO: 1583589 - DNA, 11 bp, Homo sapiens
ctccccctggg

SEQ ID NO: 1583590 - DNA, 19 bp, Homo sapiens
ctccccgaggctgccccag

SEQ ID NO: 1583591 - DNA, 22 bp, Homo sapiens
ctccccgcagcccgcctgccgt

SEQ ID NO: 1583592 - DNA, 13 bp, Homo sapiens
ctccccgcccctg

SEQ ID NO: 1583593 - DNA, 17 bp, Homo sapiens
ctccccgcccctgtggc

SEQ ID NO: 1583594 - DNA, 15 bp, Homo sapiens
ctccccgcctccact

SEQ ID NO: 1583595 - DNA, 20 bp, Homo sapiens
ctccccgcctccactctagt

SEQ ID NO: 1583596 - DNA, 15 bp, Homo sapiens
ctccccgctcagggg

SEQ ID NO: 1583597 - DNA, 20 bp, Homo sapiens
ctccccgctcaggggcctgg

SEQ ID NO: 1583598 - DNA, 22 bp, Homo sapiens
ctccccgctcaggggcctggag

SEQ ID NO: 1583599 - DNA, 18 bp, Homo sapiens
ctccccgctccgtctctg

SEQ ID NO: 1583600 - DNA, 20 bp, Homo sapiens
ctccccgctccgtctctgtc

SEQ ID NO: 1583601 - DNA, 14 bp, Homo sapiens
ctccccgctctccc

SEQ ID NO: 1583602 - DNA, 19 bp, Homo sapiens
ctccccgctctccctgtca

SEQ ID NO: 1583603 - DNA, 13 bp, Homo sapiens
ctccccggcccta

SEQ ID NO: 1583604 - DNA, 14 bp, Homo sapiens
ctccccggccctac

SEQ ID NO: 1583605 - DNA, 12 bp, Homo sapiens
ctcccctagctc

SEQ ID NO: 1583606 - DNA, 16 bp, Homo sapiens
ctcccctagctcacca

SEQ ID NO: 1583607 - DNA, 21 bp, Homo sapiens
ctcccctagctcaccaggcct

SEQ ID NO: 1583608 - DNA, 12 bp, Homo sapiens
ctcccctccaca

SEQ ID NO: 1583609 - DNA, 20 bp, Homo sapiens
ctcccctcccacccacagcc

SEQ ID NO: 1583610 - DNA, 23 bp, Homo sapiens
ctcccctccgcagcagggaagct

SEQ ID NO: 1583611 - DNA, 15 bp, Homo sapiens
ctcccctcctcttcc

SEQ ID NO: 1583612 - DNA, 16 bp, Homo sapiens
ctcccctcctcttccc

SEQ ID NO: 1583613 - DNA, 23 bp, Homo sapiens
ctcccctcctcttcccttagcct

SEQ ID NO: 1583614 - DNA, 15 bp, Homo sapiens
ctcccctcctgctgg

SEQ ID NO: 1583615 - DNA, 14 bp, Homo sapiens
ctcccctcggagaa

SEQ ID NO: 1583616 - DNA, 13 bp, Homo sapiens
ctcccctctcaga

SEQ ID NO: 1583617 - DNA, 23 bp, Homo sapiens
ctcccctctcagaacatactgat

SEQ ID NO: 1583618 - DNA, 12 bp, Homo sapiens
ctcccctctctt

SEQ ID NO: 1583619 - DNA, 17 bp, Homo sapiens
ctcccctctcttgcacc

SEQ ID NO: 1583620 - DNA, 15 bp, Homo sapiens
ctcccctgcactgta

SEQ ID NO: 1583621 - DNA, 19 bp, Homo sapiens
ctcccctgcactgtaaaat

SEQ ID NO: 1583622 - DNA, 21 bp, Homo sapiens
ctcccctgcactgtaaaatgt

SEQ ID NO: 1583623 - DNA, 13 bp, Homo sapiens
ctcccctgccaca

SEQ ID NO: 1583624 - DNA, 13 bp, Homo sapiens
ctcccctgccacc

SEQ ID NO: 1583625 - DNA, 18 bp, Homo sapiens
ctcccctgccaccaggcc

SEQ ID NO: 1583626 - DNA, 23 bp, Homo sapiens
ctcccctgccaccaggccacctc

SEQ ID NO: 1583627 - DNA, 14 bp, Homo sapiens
ctcccctgccccca

SEQ ID NO: 1583628 - DNA, 17 bp, Homo sapiens
ctcccctgcccccagga

SEQ ID NO: 1583629 - DNA, 19 bp, Homo sapiens
ctcccctgcccccaggact

SEQ ID NO: 1583630 - DNA, 21 bp, Homo sapiens
ctcccctgcccccaggactgg

SEQ ID NO: 1583631 - DNA, 14 bp, Homo sapiens
ctcccctgccctgg

SEQ ID NO: 1583632 - DNA, 21 bp, Homo sapiens
ctcccctgcccttcctcctga

SEQ ID NO: 1583633 - DNA, 13 bp, Homo sapiens
ctcccctgccggt

SEQ ID NO: 1583634 - DNA, 13 bp, Homo sapiens
ctcccctgggcag

SEQ ID NO: 1583635 - DNA, 20 bp, Homo sapiens
ctcccctgggcagggttctc

SEQ ID NO: 1583636 - DNA, 23 bp, Homo sapiens
ctcccctgggcatcttctggctt

SEQ ID NO: 1583637 - DNA, 18 bp, Homo sapiens
ctcccctgggttaacaaa

SEQ ID NO: 1583638 - DNA, 20 bp, Homo sapiens
ctcccctgggttaacaaatg

SEQ ID NO: 1583639 - DNA, 14 bp, Homo sapiens
ctcccctgtacctt

SEQ ID NO: 1583640 - DNA, 12 bp, Homo sapiens
ctccccttctct

SEQ ID NO: 1583641 - DNA, 22 bp, Homo sapiens
ctccccttgatttaaacacaca

SEQ ID NO: 1583642 - DNA, 12 bp, Homo sapiens
ctccccttgggc

SEQ ID NO: 1583643 - DNA, 13 bp, Homo sapiens
ctccccttgggcg

SEQ ID NO: 1583644 - DNA, 15 bp, Homo sapiens
ctccccttgggcggc

SEQ ID NO: 1583645 - DNA, 17 bp, Homo sapiens
ctcccctttctttgcaa

SEQ ID NO: 1583646 - DNA, 14 bp, Homo sapiens
ctcccgagctcctc

SEQ ID NO: 1583647 - DNA, 20 bp, Homo sapiens
ctcccgcaccttcctcctcc

SEQ ID NO: 1583648 - DNA, 21 bp, Homo sapiens
ctcccgccagactgttagaaa

SEQ ID NO: 1583649 - DNA, 13 bp, Homo sapiens
ctcccgcctcagc

SEQ ID NO: 1583650 - DNA, 15 bp, Homo sapiens
ctcccgcctcagcct

SEQ ID NO: 1583651 - DNA, 16 bp, Homo sapiens
ctcccgcctcagcctc

SEQ ID NO: 1583652 - DNA, 21 bp, Homo sapiens
ctcccgcctcagcctcctgag

SEQ ID NO: 1583653 - DNA, 14 bp, Homo sapiens
ctcccgctcccagg

SEQ ID NO: 1583654 - DNA, 16 bp, Homo sapiens
ctcccgctgctgctgc

SEQ ID NO: 1583655 - DNA, 17 bp, Homo sapiens
ctcccgcttcctggcct

SEQ ID NO: 1583656 - DNA, 19 bp, Homo sapiens
ctcccgcttcctggcctcc

SEQ ID NO: 1583657 - DNA, 19 bp, Homo sapiens
ctcccggaggttgggtggg

SEQ ID NO: 1583658 - DNA, 19 bp, Homo sapiens
ctcccggcgggtgctctga

SEQ ID NO: 1583659 - DNA, 19 bp, Homo sapiens
ctcccgggccctcccttgg

SEQ ID NO: 1583660 - DNA, 20 bp, Homo sapiens
ctcccgggccctcccttgga

SEQ ID NO: 1583661 - DNA, 14 bp, Homo sapiens
ctcccggggactca

SEQ ID NO: 1583662 - DNA, 15 bp, Homo sapiens
ctcccggggcagggc

SEQ ID NO: 1583663 - DNA, 16 bp, Homo sapiens
ctcccggggcagggca

SEQ ID NO: 1583664 - DNA, 15 bp, Homo sapiens
ctcccggggccttcc

SEQ ID NO: 1583665 - DNA, 16 bp, Homo sapiens
ctcccggggccttcct

SEQ ID NO: 1583666 - DNA, 15 bp, Homo sapiens
ctcccggtgcccaag

SEQ ID NO: 1583667 - DNA, 15 bp, Homo sapiens
ctcccggttcttcca

SEQ ID NO: 1583668 - DNA, 21 bp, Homo sapiens
ctcccggttcttccagtggtt

SEQ ID NO: 1583669 - DNA, 14 bp, Homo sapiens
ctcccgtcagggcc

SEQ ID NO: 1583670 - DNA, 15 bp, Homo sapiens
ctcccgtcagggccc

SEQ ID NO: 1583671 - DNA, 21 bp, Homo sapiens
ctcccgtcagggcccaagtcc

SEQ ID NO: 1583672 - DNA, 13 bp, Homo sapiens
ctccctaccctaa

SEQ ID NO: 1583673 - DNA, 18 bp, Homo sapiens
ctccctaccttgcctcct

SEQ ID NO: 1583674 - DNA, 15 bp, Homo sapiens
ctccctacttccaag

SEQ ID NO: 1583675 - DNA, 19 bp, Homo sapiens
ctccctacttccaagaaaa

SEQ ID NO: 1583676 - DNA, 24 bp, Homo sapiens
ctccctagttagcatccaggctgg

SEQ ID NO: 1583677 - DNA, 13 bp, Homo sapiens
ctccctcaactga

SEQ ID NO: 1583678 - DNA, 22 bp, Homo sapiens
ctccctcaagccagactctgcc

SEQ ID NO: 1583679 - DNA, 18 bp, Homo sapiens
ctccctcagctctctggg

SEQ ID NO: 1583680 - DNA, 22 bp, Homo sapiens
ctccctccccacacctccctac

SEQ ID NO: 1583681 - DNA, 16 bp, Homo sapiens
ctccctccccgtctca

SEQ ID NO: 1583682 - DNA, 17 bp, Homo sapiens
ctccctcccctctcaga

SEQ ID NO: 1583683 - DNA, 15 bp, Homo sapiens
ctccctcccctgcca

SEQ ID NO: 1583684 - DNA, 16 bp, Homo sapiens
ctccctcccctgccct

SEQ ID NO: 1583685 - DNA, 18 bp, Homo sapiens
ctccctcccctgccctgg

SEQ ID NO: 1583686 - DNA, 18 bp, Homo sapiens
ctccctcctcacctctgg

SEQ ID NO: 1583687 - DNA, 17 bp, Homo sapiens
ctccctcctccaggtcg

SEQ ID NO: 1583688 - DNA, 13 bp, Homo sapiens
ctccctcctccca

SEQ ID NO: 1583689 - DNA, 14 bp, Homo sapiens
ctccctcctcccat

SEQ ID NO: 1583690 - DNA, 13 bp, Homo sapiens
ctccctcctgcag

SEQ ID NO: 1583691 - DNA, 14 bp, Homo sapiens
ctccctcctgcagg

SEQ ID NO: 1583692 - DNA, 17 bp, Homo sapiens
ctccctcctgcaggctg

SEQ ID NO: 1583693 - DNA, 12 bp, Homo sapiens
ctccctcctgga

SEQ ID NO: 1583694 - DNA, 15 bp, Homo sapiens
ctccctcctggagct

SEQ ID NO: 1583695 - DNA, 20 bp, Homo sapiens
ctccctcctggagctctgtg

SEQ ID NO: 1583696 - DNA, 19 bp, Homo sapiens
ctccctccttccttcttgc

SEQ ID NO: 1583697 - DNA, 16 bp, Homo sapiens
ctccctcgctgtatga

SEQ ID NO: 1583698 - DNA, 14 bp, Homo sapiens
ctccctctatttat

SEQ ID NO: 1583699 - DNA, 15 bp, Homo sapiens
ctccctctcctgcct

SEQ ID NO: 1583700 - DNA, 12 bp, Homo sapiens
ctccctctctct

SEQ ID NO: 1583701 - DNA, 17 bp, Homo sapiens
ctccctctctcttctgc

SEQ ID NO: 1583702 - DNA, 12 bp, Homo sapiens
ctccctctctgg

SEQ ID NO: 1583703 - DNA, 21 bp, Homo sapiens
ctccctctgacctgcaggcca

SEQ ID NO: 1583704 - DNA, 12 bp, Homo sapiens
ctccctctgccc

SEQ ID NO: 1583705 - DNA, 22 bp, Homo sapiens
ctccctctgccccaagcagcca

SEQ ID NO: 1583706 - DNA, 22 bp, Homo sapiens
ctccctctgcctgaaccttcca

SEQ ID NO: 1583707 - DNA, 14 bp, Homo sapiens
ctccctctgccttc

SEQ ID NO: 1583708 - DNA, 14 bp, Homo sapiens
ctccctctggccct

SEQ ID NO: 1583709 - DNA, 19 bp, Homo sapiens
ctccctctggccctgcctt

SEQ ID NO: 1583710 - DNA, 21 bp, Homo sapiens
ctccctctggtctactctaga

SEQ ID NO: 1583711 - DNA, 23 bp, Homo sapiens
ctccctctggtctactctagaag

SEQ ID NO: 1583712 - DNA, 18 bp, Homo sapiens
ctccctcttcactgtggc

SEQ ID NO: 1583713 - DNA, 19 bp, Homo sapiens
ctccctgaaccatccctga

SEQ ID NO: 1583714 - DNA, 19 bp, Homo sapiens
ctccctgaccttagcgttc

SEQ ID NO: 1583715 - DNA, 12 bp, Homo sapiens
ctccctgaggca

SEQ ID NO: 1583716 - DNA, 20 bp, Homo sapiens
ctccctgatcccaccccctc

SEQ ID NO: 1583717 - DNA, 15 bp, Homo sapiens
ctccctgcacagcct

SEQ ID NO: 1583718 - DNA, 20 bp, Homo sapiens
ctccctgcactccctcctgg

SEQ ID NO: 1583719 - DNA, 14 bp, Homo sapiens
ctccctgcagactc

SEQ ID NO: 1583720 - DNA, 16 bp, Homo sapiens
ctccctgcagactcca

SEQ ID NO: 1583721 - DNA, 15 bp, Homo sapiens
ctccctgcagatgcc

SEQ ID NO: 1583722 - DNA, 16 bp, Homo sapiens
ctccctgcagatgcca

SEQ ID NO: 1583723 - DNA, 12 bp, Homo sapiens
ctccctgccccc

SEQ ID NO: 1583724 - DNA, 13 bp, Homo sapiens
ctccctgcccccc

SEQ ID NO: 1583725 - DNA, 21 bp, Homo sapiens
ctccctgcccctcccttcaac

SEQ ID NO: 1583726 - DNA, 16 bp, Homo sapiens
ctccctgccgcctcaa

SEQ ID NO: 1583727 - DNA, 13 bp, Homo sapiens
ctccctgcctggc

SEQ ID NO: 1583728 - DNA, 20 bp, Homo sapiens
ctccctgcgggccaggcact

SEQ ID NO: 1583729 - DNA, 23 bp, Homo sapiens
ctccctgctgtgccatgctgggc

SEQ ID NO: 1583730 - DNA, 24 bp, Homo sapiens
ctccctggaggcacgcaccactgc

SEQ ID NO: 1583731 - DNA, 19 bp, Homo sapiens
ctccctggatgtgtggggc

SEQ ID NO: 1583732 - DNA, 16 bp, Homo sapiens
ctccctggccttgccc

SEQ ID NO: 1583733 - DNA, 14 bp, Homo sapiens
ctccctggctcact

SEQ ID NO: 1583734 - DNA, 14 bp, Homo sapiens
ctccctggctccca

SEQ ID NO: 1583735 - DNA, 15 bp, Homo sapiens
ctccctggctcccat

SEQ ID NO: 1583736 - DNA, 14 bp, Homo sapiens
ctccctggctccct

SEQ ID NO: 1583737 - DNA, 16 bp, Homo sapiens
ctccctggctccctcc

SEQ ID NO: 1583738 - DNA, 22 bp, Homo sapiens
ctccctggctgccctggccctg

SEQ ID NO: 1583739 - DNA, 23 bp, Homo sapiens
ctccctgggaagcctgtgccagc

SEQ ID NO: 1583740 - DNA, 11 bp, Homo sapiens
ctccctgggcc

SEQ ID NO: 1583741 - DNA, 12 bp, Homo sapiens
ctccctgggcct

SEQ ID NO: 1583742 - DNA, 11 bp, Homo sapiens
ctccctgggtt

SEQ ID NO: 1583743 - DNA, 20 bp, Homo sapiens
ctccctggtgcctctgtgca

SEQ ID NO: 1583744 - DNA, 22 bp, Homo sapiens
ctccctggtgcctctgtgcaca

SEQ ID NO: 1583745 - DNA, 19 bp, Homo sapiens
ctccctgtagctctgcctc

SEQ ID NO: 1583746 - DNA, 15 bp, Homo sapiens
ctccctgtcacgctc

SEQ ID NO: 1583747 - DNA, 22 bp, Homo sapiens
ctccctgtcacgctcatgtcct

SEQ ID NO: 1583748 - DNA, 18 bp, Homo sapiens
ctccctgtcactcagctg

SEQ ID NO: 1583749 - DNA, 21 bp, Homo sapiens
ctccctgtcactcagctgaga

SEQ ID NO: 1583750 - DNA, 12 bp, Homo sapiens
ctccctgtccca

SEQ ID NO: 1583751 - DNA, 18 bp, Homo sapiens
ctccctgtcccagggccc

SEQ ID NO: 1583752 - DNA, 15 bp, Homo sapiens
ctccctgtcctcctc

SEQ ID NO: 1583753 - DNA, 18 bp, Homo sapiens
ctccctgtcctcctcgga

SEQ ID NO: 1583754 - DNA, 15 bp, Homo sapiens
ctccctgtctccagc

SEQ ID NO: 1583755 - DNA, 16 bp, Homo sapiens
ctccctgtctccagct

SEQ ID NO: 1583756 - DNA, 23 bp, Homo sapiens
ctccctgtctccagctgcctggg

SEQ ID NO: 1583757 - DNA, 23 bp, Homo sapiens
ctccctgtctgtgtcccagccac

SEQ ID NO: 1583758 - DNA, 22 bp, Homo sapiens
ctccctgttatttttctgccct

SEQ ID NO: 1583759 - DNA, 16 bp, Homo sapiens
ctccctgttccccaga

SEQ ID NO: 1583760 - DNA, 17 bp, Homo sapiens
ctccctgttccccagag

SEQ ID NO: 1583761 - DNA, 19 bp, Homo sapiens
ctccctgttccccagagaa

SEQ ID NO: 1583762 - DNA, 21 bp, Homo sapiens
ctccctgttttagtttctgaa

SEQ ID NO: 1583763 - DNA, 18 bp, Homo sapiens
ctcccttaagcagcaaca

SEQ ID NO: 1583764 - DNA, 20 bp, Homo sapiens
ctcccttcaaccattcccca

SEQ ID NO: 1583765 - DNA, 22 bp, Homo sapiens
ctcccttcaagacgaggggcag

SEQ ID NO: 1583766 - DNA, 17 bp, Homo sapiens
ctcccttccatgcccca

SEQ ID NO: 1583767 - DNA, 11 bp, Homo sapiens
ctcccttccca

SEQ ID NO: 1583768 - DNA, 14 bp, Homo sapiens
ctcccttcccagga

SEQ ID NO: 1583769 - DNA, 14 bp, Homo sapiens
ctcccttcctggcc

SEQ ID NO: 1583770 - DNA, 21 bp, Homo sapiens
ctcccttctctacactcttgt

SEQ ID NO: 1583771 - DNA, 13 bp, Homo sapiens
ctcccttctctct

SEQ ID NO: 1583772 - DNA, 13 bp, Homo sapiens
ctcccttgccctc

SEQ ID NO: 1583773 - DNA, 14 bp, Homo sapiens
ctcccttgccctcc

SEQ ID NO: 1583774 - DNA, 15 bp, Homo sapiens
ctcccttgccctccc

SEQ ID NO: 1583775 - DNA, 21 bp, Homo sapiens
ctcccttgcctttcgaggcct

SEQ ID NO: 1583776 - DNA, 17 bp, Homo sapiens
ctcccttgctggcccca

SEQ ID NO: 1583777 - DNA, 18 bp, Homo sapiens
ctcccttgctggccccag

SEQ ID NO: 1583778 - DNA, 22 bp, Homo sapiens
ctcccttgctggccccagccct

SEQ ID NO: 1583779 - DNA, 13 bp, Homo sapiens
ctcccttggccca

SEQ ID NO: 1583780 - DNA, 17 bp, Homo sapiens
ctcccttggcccagaga

SEQ ID NO: 1583781 - DNA, 18 bp, Homo sapiens
ctcccttggcccagagac

SEQ ID NO: 1583782 - DNA, 17 bp, Homo sapiens
ctccctttccaacctca

SEQ ID NO: 1583783 - DNA, 12 bp, Homo sapiens
ctccctttctcc

SEQ ID NO: 1583784 - DNA, 20 bp, Homo sapiens
ctccgacgctgcctctcatt

SEQ ID NO: 1583785 - DNA, 14 bp, Homo sapiens
ctccgagaggtggg

SEQ ID NO: 1583786 - DNA, 15 bp, Homo sapiens
ctccgagaggtgggc

SEQ ID NO: 1583787 - DNA, 18 bp, Homo sapiens
ctccgagctctggtgctt

SEQ ID NO: 1583788 - DNA, 18 bp, Homo sapiens
ctccgagctgtaggagag

SEQ ID NO: 1583789 - DNA, 17 bp, Homo sapiens
ctccgatgctgaggcca

SEQ ID NO: 1583790 - DNA, 20 bp, Homo sapiens
ctccgcagtgtctccaccta

SEQ ID NO: 1583791 - DNA, 20 bp, Homo sapiens
ctccgccctcctcgggccga

SEQ ID NO: 1583792 - DNA, 13 bp, Homo sapiens
ctccgccctgcca

SEQ ID NO: 1583793 - DNA, 17 bp, Homo sapiens
ctccgcctactgtccct

SEQ ID NO: 1583794 - DNA, 15 bp, Homo sapiens
ctccgcctccacact

SEQ ID NO: 1583795 - DNA, 15 bp, Homo sapiens
ctccgcctgggatct

SEQ ID NO: 1583796 - DNA, 19 bp, Homo sapiens
ctccgccttcactccggtg

SEQ ID NO: 1583797 - DNA, 21 bp, Homo sapiens
ctccgccttcactccggtgtg

SEQ ID NO: 1583798 - DNA, 16 bp, Homo sapiens
ctccgcgccgatgcca

SEQ ID NO: 1583799 - DNA, 19 bp, Homo sapiens
ctccgcgccgatgccaccg

SEQ ID NO: 1583800 - DNA, 12 bp, Homo sapiens
ctccgctcccac

SEQ ID NO: 1583801 - DNA, 21 bp, Homo sapiens
ctccgctgccgtgccgcctgc

SEQ ID NO: 1583802 - DNA, 12 bp, Homo sapiens
ctccgctgcctg

SEQ ID NO: 1583803 - DNA, 18 bp, Homo sapiens
ctccgctgggcttcattc

SEQ ID NO: 1583804 - DNA, 19 bp, Homo sapiens
ctccgctgggcttcattcc

SEQ ID NO: 1583805 - DNA, 15 bp, Homo sapiens
ctccggcgcagacag

SEQ ID NO: 1583806 - DNA, 22 bp, Homo sapiens
ctccggcgtcttgcccagcagc

SEQ ID NO: 1583807 - DNA, 23 bp, Homo sapiens
ctccggcgtcttgcccagcagct

SEQ ID NO: 1583808 - DNA, 12 bp, Homo sapiens
ctccgggcaaat

SEQ ID NO: 1583809 - DNA, 13 bp, Homo sapiens
ctccggtgtgcct

SEQ ID NO: 1583810 - DNA, 17 bp, Homo sapiens
ctccgtagggtctttct

SEQ ID NO: 1583811 - DNA, 15 bp, Homo sapiens
ctccgtccacccagg

SEQ ID NO: 1583812 - DNA, 17 bp, Homo sapiens
ctccgtccacccaggct

SEQ ID NO: 1583813 - DNA, 22 bp, Homo sapiens
ctccgtccacccaggctgcact

SEQ ID NO: 1583814 - DNA, 23 bp, Homo sapiens
ctccgtccacccaggctgcactg

SEQ ID NO: 1583815 - DNA, 18 bp, Homo sapiens
ctccgtccaggagcctgg

SEQ ID NO: 1583816 - DNA, 22 bp, Homo sapiens
ctccgtccaggagcctgtgcct

SEQ ID NO: 1583817 - DNA, 13 bp, Homo sapiens
ctccgtctctgtc

SEQ ID NO: 1583818 - DNA, 16 bp, Homo sapiens
ctccgtctctgtcctc

SEQ ID NO: 1583819 - DNA, 17 bp, Homo sapiens
ctccgtgaggctgctgc

SEQ ID NO: 1583820 - DNA, 19 bp, Homo sapiens
ctccgtgaggctgctgcca

SEQ ID NO: 1583821 - DNA, 15 bp, Homo sapiens
ctccgtgcctccacc

SEQ ID NO: 1583822 - DNA, 18 bp, Homo sapiens
ctccgtgttcctcggtgg

SEQ ID NO: 1583823 - DNA, 17 bp, Homo sapiens
ctccgttagctcctgtg

SEQ ID NO: 1583824 - DNA, 15 bp, Homo sapiens
ctccgttccatctgg

SEQ ID NO: 1583825 - DNA, 19 bp, Homo sapiens
ctccgttccatctgggctt

SEQ ID NO: 1583826 - DNA, 15 bp, Homo sapiens
ctccgtttatgggcc

SEQ ID NO: 1583827 - DNA, 14 bp, Homo sapiens
ctcctaacaaaaga

SEQ ID NO: 1583828 - DNA, 20 bp, Homo sapiens
ctcctaactgccagccccct

SEQ ID NO: 1583829 - DNA, 13 bp, Homo sapiens
ctcctaattattg

SEQ ID NO: 1583830 - DNA, 15 bp, Homo sapiens
ctcctaattttaaat

SEQ ID NO: 1583831 - DNA, 21 bp, Homo sapiens
ctcctaattttaaataatttc

SEQ ID NO: 1583832 - DNA, 16 bp, Homo sapiens
ctcctacctcagccta

SEQ ID NO: 1583833 - DNA, 18 bp, Homo sapiens
ctcctacctcagcctaga

SEQ ID NO: 1583834 - DNA, 17 bp, Homo sapiens
ctcctacctgtctgctg

SEQ ID NO: 1583835 - DNA, 18 bp, Homo sapiens
ctcctacctgtctgctgc

SEQ ID NO: 1583836 - DNA, 22 bp, Homo sapiens
ctcctacctgtctgctgccagc

SEQ ID NO: 1583837 - DNA, 23 bp, Homo sapiens
ctcctacctgtctgctgccagca

SEQ ID NO: 1583838 - DNA, 18 bp, Homo sapiens
ctcctagaggtgggcagc

SEQ ID NO: 1583839 - DNA, 20 bp, Homo sapiens
ctcctagaggtgggcagctg

SEQ ID NO: 1583840 - DNA, 17 bp, Homo sapiens
ctcctagtttgggagga

SEQ ID NO: 1583841 - DNA, 23 bp, Homo sapiens
ctcctataaagggcccacacctg

SEQ ID NO: 1583842 - DNA, 15 bp, Homo sapiens
ctcctatatatttct

SEQ ID NO: 1583843 - DNA, 17 bp, Homo sapiens
ctcctatatatttctat

SEQ ID NO: 1583844 - DNA, 14 bp, Homo sapiens
ctcctatctccctg

SEQ ID NO: 1583845 - DNA, 19 bp, Homo sapiens
ctcctatctccctggctca

SEQ ID NO: 1583846 - DNA, 13 bp, Homo sapiens
ctcctatctgtgt

SEQ ID NO: 1583847 - DNA, 14 bp, Homo sapiens
ctcctatctgtgtt

SEQ ID NO: 1583848 - DNA, 22 bp, Homo sapiens
ctcctatggaaaagggtcttct

SEQ ID NO: 1583849 - DNA, 18 bp, Homo sapiens
ctcctatgtggcagctgg

SEQ ID NO: 1583850 - DNA, 20 bp, Homo sapiens
ctcctcacccccagctttgc

SEQ ID NO: 1583851 - DNA, 15 bp, Homo sapiens
ctcctcaccccgtct

SEQ ID NO: 1583852 - DNA, 18 bp, Homo sapiens
ctcctcacccctgtaggg

SEQ ID NO: 1583853 - DNA, 14 bp, Homo sapiens
ctcctcacctcatg

SEQ ID NO: 1583854 - DNA, 20 bp, Homo sapiens
ctcctcacctcatgcccacc

SEQ ID NO: 1583855 - DNA, 13 bp, Homo sapiens
ctcctcacctctg

SEQ ID NO: 1583856 - DNA, 14 bp, Homo sapiens
ctcctcacctctgg

SEQ ID NO: 1583857 - DNA, 15 bp, Homo sapiens
ctcctcacctgtcta

SEQ ID NO: 1583858 - DNA, 23 bp, Homo sapiens
ctcctcacttggctgtctgacca

SEQ ID NO: 1583859 - DNA, 21 bp, Homo sapiens
ctcctcaggagagacccctcc

SEQ ID NO: 1583860 - DNA, 18 bp, Homo sapiens
ctcctcagggcagcctcc

SEQ ID NO: 1583861 - DNA, 14 bp, Homo sapiens
ctcctcagggtggg

SEQ ID NO: 1583862 - DNA, 15 bp, Homo sapiens
ctcctcagggtgggg

SEQ ID NO: 1583863 - DNA, 21 bp, Homo sapiens
ctcctcagtgaaggtggtggg

SEQ ID NO: 1583864 - DNA, 12 bp, Homo sapiens
ctcctcatcccg

SEQ ID NO: 1583865 - DNA, 20 bp, Homo sapiens
ctcctcatggcagcctactc

SEQ ID NO: 1583866 - DNA, 15 bp, Homo sapiens
ctcctccaaaggaag

SEQ ID NO: 1583867 - DNA, 17 bp, Homo sapiens
ctcctccacagtgctgc

SEQ ID NO: 1583868 - DNA, 17 bp, Homo sapiens
ctcctccacccaccccc

SEQ ID NO: 1583869 - DNA, 20 bp, Homo sapiens
ctcctccacccacccccttt

SEQ ID NO: 1583870 - DNA, 13 bp, Homo sapiens
ctcctccactcac

SEQ ID NO: 1583871 - DNA, 17 bp, Homo sapiens
ctcctccactctccccc

SEQ ID NO: 1583872 - DNA, 15 bp, Homo sapiens
ctcctccaggcctgc

SEQ ID NO: 1583873 - DNA, 17 bp, Homo sapiens
ctcctccaggcctgcct

SEQ ID NO: 1583874 - DNA, 21 bp, Homo sapiens
ctcctccaggcctgcctccca

SEQ ID NO: 1583875 - DNA, 19 bp, Homo sapiens
ctcctccagggccacgtgc

SEQ ID NO: 1583876 - DNA, 22 bp, Homo sapiens
ctcctccagggccacgtgccag

SEQ ID NO: 1583877 - DNA, 23 bp, Homo sapiens
ctcctccagtgtgggcttgacca

SEQ ID NO: 1583878 - DNA, 14 bp, Homo sapiens
ctcctcccagcggc

SEQ ID NO: 1583879 - DNA, 12 bp, Homo sapiens
ctcctcccagga

SEQ ID NO: 1583880 - DNA, 23 bp, Homo sapiens
ctcctcccaggcgccccttcccc

SEQ ID NO: 1583881 - DNA, 16 bp, Homo sapiens
ctcctcccagtgcctt

SEQ ID NO: 1583882 - DNA, 13 bp, Homo sapiens
ctcctccccagct

SEQ ID NO: 1583883 - DNA, 23 bp, Homo sapiens
ctcctcccccggctgggcctcct

SEQ ID NO: 1583884 - DNA, 16 bp, Homo sapiens
ctcctccccctgttct

SEQ ID NO: 1583885 - DNA, 22 bp, Homo sapiens
ctcctccccgctccgtctctgt

SEQ ID NO: 1583886 - DNA, 14 bp, Homo sapiens
ctcctcccctcctc

SEQ ID NO: 1583887 - DNA, 15 bp, Homo sapiens
ctcctcccgcccttc

SEQ ID NO: 1583888 - DNA, 14 bp, Homo sapiens
ctcctcccggtgcc

SEQ ID NO: 1583889 - DNA, 10 bp, Homo sapiens
ctcctccctc

SEQ ID NO: 1583890 - DNA, 22 bp, Homo sapiens
ctcctccctcagctctctggga

SEQ ID NO: 1583891 - DNA, 18 bp, Homo sapiens
ctcctccctggctgccct

SEQ ID NO: 1583892 - DNA, 21 bp, Homo sapiens
ctcctccctggctgccctggc

SEQ ID NO: 1583893 - DNA, 13 bp, Homo sapiens
ctcctcccttcct

SEQ ID NO: 1583894 - DNA, 21 bp, Homo sapiens
ctcctcccttccttttccctg

SEQ ID NO: 1583895 - DNA, 14 bp, Homo sapiens
ctcctcctccccca

SEQ ID NO: 1583896 - DNA, 14 bp, Homo sapiens
ctcctcctcccctc

SEQ ID NO: 1583897 - DNA, 16 bp, Homo sapiens
ctcctcctcccctcct

SEQ ID NO: 1583898 - DNA, 13 bp, Homo sapiens
ctcctcctcgaag

SEQ ID NO: 1583899 - DNA, 14 bp, Homo sapiens
ctcctcctcggaag

SEQ ID NO: 1583900 - DNA, 13 bp, Homo sapiens
ctcctcctcttgg

SEQ ID NO: 1583901 - DNA, 17 bp, Homo sapiens
ctcctcgaacccactcc

SEQ ID NO: 1583902 - DNA, 17 bp, Homo sapiens
ctcctcggagagcagca

SEQ ID NO: 1583903 - DNA, 15 bp, Homo sapiens
ctcctctcccatccc

SEQ ID NO: 1583904 - DNA, 21 bp, Homo sapiens
ctcctctcccatccccctgcc

SEQ ID NO: 1583905 - DNA, 23 bp, Homo sapiens
ctcctctcccatccccctgccct

SEQ ID NO: 1583906 - DNA, 15 bp, Homo sapiens
ctcctctccccagcc

SEQ ID NO: 1583907 - DNA, 20 bp, Homo sapiens
ctcctctccccagcccagag

SEQ ID NO: 1583908 - DNA, 21 bp, Homo sapiens
ctcctctccttgggctcctgg

SEQ ID NO: 1583909 - DNA, 13 bp, Homo sapiens
ctcctctgagcag

SEQ ID NO: 1583910 - DNA, 16 bp, Homo sapiens
ctcctctgagcagcct

SEQ ID NO: 1583911 - DNA, 12 bp, Homo sapiens
ctcctctgcact

SEQ ID NO: 1583912 - DNA, 16 bp, Homo sapiens
ctcctctgccacctcc

SEQ ID NO: 1583913 - DNA, 16 bp, Homo sapiens
ctcctctgtccagggc

SEQ ID NO: 1583914 - DNA, 19 bp, Homo sapiens
ctcctcttaaaaaataaaa

SEQ ID NO: 1583915 - DNA, 21 bp, Homo sapiens
ctcctcttaaaaaataaaaac

SEQ ID NO: 1583916 - DNA, 23 bp, Homo sapiens
ctcctcttaaaaaataaaaactg

SEQ ID NO: 1583917 - DNA, 20 bp, Homo sapiens
ctcctcttaccgtagcctcc

SEQ ID NO: 1583918 - DNA, 20 bp, Homo sapiens
ctcctcttccatgctgtgcg

SEQ ID NO: 1583919 - DNA, 20 bp, Homo sapiens
ctcctcttcccttagcctct

SEQ ID NO: 1583920 - DNA, 21 bp, Homo sapiens
ctcctcttggagctgagatga

SEQ ID NO: 1583921 - DNA, 22 bp, Homo sapiens
ctcctcttggtgggtgtggcca

SEQ ID NO: 1583922 - DNA, 14 bp, Homo sapiens
ctcctgacagaagg

SEQ ID NO: 1583923 - DNA, 23 bp, Homo sapiens
ctcctgacccagtccccgtgccc

SEQ ID NO: 1583924 - DNA, 17 bp, Homo sapiens
ctcctgagaaggcgagg

SEQ ID NO: 1583925 - DNA, 21 bp, Homo sapiens
ctcctgagaaggcgaggagag

SEQ ID NO: 1583926 - DNA, 23 bp, Homo sapiens
ctcctgagctcggggggctctgc

SEQ ID NO: 1583927 - DNA, 19 bp, Homo sapiens
ctcctgaggggcatctgcc

SEQ ID NO: 1583928 - DNA, 20 bp, Homo sapiens
ctcctgaggggcatctgccc

SEQ ID NO: 1583929 - DNA, 22 bp, Homo sapiens
ctcctgaggggcatctgcccct

SEQ ID NO: 1583930 - DNA, 23 bp, Homo sapiens
ctcctgaggggcatctgcccctc

SEQ ID NO: 1583931 - DNA, 17 bp, Homo sapiens
ctcctgagtagatggga

SEQ ID NO: 1583932 - DNA, 20 bp, Homo sapiens
ctcctgatggagtgtgcaga

SEQ ID NO: 1583933 - DNA, 14 bp, Homo sapiens
ctcctgatggccaa

SEQ ID NO: 1583934 - DNA, 17 bp, Homo sapiens
ctcctgatttctctgaa

SEQ ID NO: 1583935 - DNA, 14 bp, Homo sapiens
ctcctgattttgta

SEQ ID NO: 1583936 - DNA, 22 bp, Homo sapiens
ctcctgcacacagaatgctcag

SEQ ID NO: 1583937 - DNA, 23 bp, Homo sapiens
ctcctgcacacagaatgctcagg

SEQ ID NO: 1583938 - DNA, 19 bp, Homo sapiens
ctcctgcacttacttgctt

SEQ ID NO: 1583939 - DNA, 20 bp, Homo sapiens
ctcctgcacttacttgctta

SEQ ID NO: 1583940 - DNA, 14 bp, Homo sapiens
ctcctgcagaccac

SEQ ID NO: 1583941 - DNA, 22 bp, Homo sapiens
ctcctgcaggctggctgttggc

SEQ ID NO: 1583942 - DNA, 22 bp, Homo sapiens
ctcctgccacatggagccccct

SEQ ID NO: 1583943 - DNA, 17 bp, Homo sapiens
ctcctgccaccccttcc

SEQ ID NO: 1583944 - DNA, 14 bp, Homo sapiens
ctcctgccattctt

SEQ ID NO: 1583945 - DNA, 17 bp, Homo sapiens
ctcctgcccacggagtc

SEQ ID NO: 1583946 - DNA, 17 bp, Homo sapiens
ctcctgcccaggagagc

SEQ ID NO: 1583947 - DNA, 15 bp, Homo sapiens
ctcctgccctctgct

SEQ ID NO: 1583948 - DNA, 23 bp, Homo sapiens
ctcctgccctctgctctgcctgg

SEQ ID NO: 1583949 - DNA, 13 bp, Homo sapiens
ctcctgccgcaga

SEQ ID NO: 1583950 - DNA, 16 bp, Homo sapiens
ctcctgccgcagacgg

SEQ ID NO: 1583951 - DNA, 18 bp, Homo sapiens
ctcctgccgcagacgggc

SEQ ID NO: 1583952 - DNA, 20 bp, Homo sapiens
ctcctgcctcaccctcccaa

SEQ ID NO: 1583953 - DNA, 19 bp, Homo sapiens
ctcctgcctcagcctcctg

SEQ ID NO: 1583954 - DNA, 16 bp, Homo sapiens
ctcctgcctccgggca

SEQ ID NO: 1583955 - DNA, 19 bp, Homo sapiens
ctcctgcctccgggcaggc

SEQ ID NO: 1583956 - DNA, 14 bp, Homo sapiens
ctcctgcctgcccc

SEQ ID NO: 1583957 - DNA, 17 bp, Homo sapiens
ctcctgcctgcccctct

SEQ ID NO: 1583958 - DNA, 23 bp, Homo sapiens
ctcctgcgggagtagttggaaag

SEQ ID NO: 1583959 - DNA, 12 bp, Homo sapiens
ctcctgctcctc

SEQ ID NO: 1583960 - DNA, 21 bp, Homo sapiens
ctcctgctcctccctgccccc

SEQ ID NO: 1583961 - DNA, 15 bp, Homo sapiens
ctcctgctctgggac

SEQ ID NO: 1583962 - DNA, 16 bp, Homo sapiens
ctcctgctctgggacg

SEQ ID NO: 1583963 - DNA, 17 bp, Homo sapiens
ctcctgctctgggacgt

SEQ ID NO: 1583964 - DNA, 16 bp, Homo sapiens
ctcctgctgcacaggc

SEQ ID NO: 1583965 - DNA, 20 bp, Homo sapiens
ctcctgctggtacctgccct

SEQ ID NO: 1583966 - DNA, 22 bp, Homo sapiens
ctcctgctggtacctgccctct

SEQ ID NO: 1583967 - DNA, 14 bp, Homo sapiens
ctcctgctgtgctg

SEQ ID NO: 1583968 - DNA, 21 bp, Homo sapiens
ctcctgcttttctgtcctggg

SEQ ID NO: 1583969 - DNA, 20 bp, Homo sapiens
ctcctggaaaggctcagtct

SEQ ID NO: 1583970 - DNA, 23 bp, Homo sapiens
ctcctggaaaggctcagtctcag

SEQ ID NO: 1583971 - DNA, 15 bp, Homo sapiens
ctcctggaagctgtg

SEQ ID NO: 1583972 - DNA, 20 bp, Homo sapiens
ctcctggaagctgtgtcctt

SEQ ID NO: 1583973 - DNA, 19 bp, Homo sapiens
ctcctggagctctgtgggt

SEQ ID NO: 1583974 - DNA, 22 bp, Homo sapiens
ctcctggcctatccgctgccag

SEQ ID NO: 1583975 - DNA, 23 bp, Homo sapiens
ctcctggcctatccgctgccagc

SEQ ID NO: 1583976 - DNA, 17 bp, Homo sapiens
ctcctggcctcaagtga

SEQ ID NO: 1583977 - DNA, 12 bp, Homo sapiens
ctcctggccttt

SEQ ID NO: 1583978 - DNA, 14 bp, Homo sapiens
ctcctggccttttg

SEQ ID NO: 1583979 - DNA, 18 bp, Homo sapiens
ctcctggcgagttctctt

SEQ ID NO: 1583980 - DNA, 21 bp, Homo sapiens
ctcctggcgagttctctttgg

SEQ ID NO: 1583981 - DNA, 15 bp, Homo sapiens
ctcctggctcaggcc

SEQ ID NO: 1583982 - DNA, 17 bp, Homo sapiens
ctcctggctcaggccca

SEQ ID NO: 1583983 - DNA, 14 bp, Homo sapiens
ctcctggctgccag

SEQ ID NO: 1583984 - DNA, 16 bp, Homo sapiens
ctcctggctgccaggc

SEQ ID NO: 1583985 - DNA, 19 bp, Homo sapiens
ctcctggctgccaggcgtt

SEQ ID NO: 1583986 - DNA, 11 bp, Homo sapiens
ctcctggctgt

SEQ ID NO: 1583987 - DNA, 18 bp, Homo sapiens
ctcctggctgtgcccagc

SEQ ID NO: 1583988 - DNA, 23 bp, Homo sapiens
ctcctgggcagcttgagagggca

SEQ ID NO: 1583989 - DNA, 22 bp, Homo sapiens
ctcctgggccggctgagtggca

SEQ ID NO: 1583990 - DNA, 23 bp, Homo sapiens
ctcctgggtgggtggggtacagg

SEQ ID NO: 1583991 - DNA, 16 bp, Homo sapiens
ctcctggtctgtgaag

SEQ ID NO: 1583992 - DNA, 15 bp, Homo sapiens
ctcctggtcttgaga

SEQ ID NO: 1583993 - DNA, 21 bp, Homo sapiens
ctcctgtaaatggtgtacata

SEQ ID NO: 1583994 - DNA, 23 bp, Homo sapiens
ctcctgtaacatactggcctgga

SEQ ID NO: 1583995 - DNA, 16 bp, Homo sapiens
ctcctgtaattcctac

SEQ ID NO: 1583996 - DNA, 19 bp, Homo sapiens
ctcctgtagccactggcat

SEQ ID NO: 1583997 - DNA, 13 bp, Homo sapiens
ctcctgtcaccta

SEQ ID NO: 1583998 - DNA, 19 bp, Homo sapiens
ctcctgtccaaagtaggga

SEQ ID NO: 1583999 - DNA, 14 bp, Homo sapiens
ctcctgtccaacct

SEQ ID NO: 1584000 - DNA, 17 bp, Homo sapiens
ctcctgtccctgtagct

SEQ ID NO: 1584001 - DNA, 22 bp, Homo sapiens
ctcctgtccctgtagctcagtc

SEQ ID NO: 1584002 - DNA, 13 bp, Homo sapiens
ctcctgtcccttt

SEQ ID NO: 1584003 - DNA, 17 bp, Homo sapiens
ctcctgtcccttttccc

SEQ ID NO: 1584004 - DNA, 18 bp, Homo sapiens
ctcctgtctcagcctcct

SEQ ID NO: 1584005 - DNA, 21 bp, Homo sapiens
ctcctgtctcagcctcctgag

SEQ ID NO: 1584006 - DNA, 11 bp, Homo sapiens
ctcctgtctgc

SEQ ID NO: 1584007 - DNA, 13 bp, Homo sapiens
ctcctgtctgcca

SEQ ID NO: 1584008 - DNA, 16 bp, Homo sapiens
ctcctgtctgccagcc

SEQ ID NO: 1584009 - DNA, 17 bp, Homo sapiens
ctcctgtctgccagcca

SEQ ID NO: 1584010 - DNA, 19 bp, Homo sapiens
ctcctgtctgccagccagc

SEQ ID NO: 1584011 - DNA, 14 bp, Homo sapiens
ctcctgtcttcaga

SEQ ID NO: 1584012 - DNA, 18 bp, Homo sapiens
ctcctgtcttcagagcaa

SEQ ID NO: 1584013 - DNA, 17 bp, Homo sapiens
ctcctgtgcatgggtga

SEQ ID NO: 1584014 - DNA, 20 bp, Homo sapiens
ctcctgtgcatgggtgaagg

SEQ ID NO: 1584015 - DNA, 14 bp, Homo sapiens
ctcctgtgcccaca

SEQ ID NO: 1584016 - DNA, 11 bp, Homo sapiens
ctcctgtgcta

SEQ ID NO: 1584017 - DNA, 21 bp, Homo sapiens
ctcctgtgctctggaggctgc

SEQ ID NO: 1584018 - DNA, 18 bp, Homo sapiens
ctcctgtggcagctgccc

SEQ ID NO: 1584019 - DNA, 19 bp, Homo sapiens
ctcctgttttgcacagcca

SEQ ID NO: 1584020 - DNA, 20 bp, Homo sapiens
ctccttaccaatagcctgaa

SEQ ID NO: 1584021 - DNA, 13 bp, Homo sapiens
ctccttagaaaaa

SEQ ID NO: 1584022 - DNA, 22 bp, Homo sapiens
ctccttagccctgtctgctagg

SEQ ID NO: 1584023 - DNA, 19 bp, Homo sapiens
ctccttattggaaggtatt

SEQ ID NO: 1584024 - DNA, 15 bp, Homo sapiens
ctccttattttgtat

SEQ ID NO: 1584025 - DNA, 23 bp, Homo sapiens
ctccttcactgttccctctggct

SEQ ID NO: 1584026 - DNA, 12 bp, Homo sapiens
ctccttcagcac

SEQ ID NO: 1584027 - DNA, 22 bp, Homo sapiens
ctccttcattaatgatgatctt

SEQ ID NO: 1584028 - DNA, 15 bp, Homo sapiens
ctccttcccatgcct

SEQ ID NO: 1584029 - DNA, 22 bp, Homo sapiens
ctccttcccatttctctacact

SEQ ID NO: 1584030 - DNA, 14 bp, Homo sapiens
ctccttcccccagc

SEQ ID NO: 1584031 - DNA, 17 bp, Homo sapiens
ctccttcccccagccca

SEQ ID NO: 1584032 - DNA, 19 bp, Homo sapiens
ctccttcccccagcccaat

SEQ ID NO: 1584033 - DNA, 14 bp, Homo sapiens
ctccttcccctgca

SEQ ID NO: 1584034 - DNA, 20 bp, Homo sapiens
ctccttcccctgcacctggc

SEQ ID NO: 1584035 - DNA, 22 bp, Homo sapiens
ctccttcccgccgcccgacccc

SEQ ID NO: 1584036 - DNA, 14 bp, Homo sapiens
ctccttcctcttgg

SEQ ID NO: 1584037 - DNA, 15 bp, Homo sapiens
ctccttcctcttggc

SEQ ID NO: 1584038 - DNA, 14 bp, Homo sapiens
ctccttcctggcct

SEQ ID NO: 1584039 - DNA, 12 bp, Homo sapiens
ctccttcctgtc

SEQ ID NO: 1584040 - DNA, 15 bp, Homo sapiens
ctccttcctgtgtgt

SEQ ID NO: 1584041 - DNA, 19 bp, Homo sapiens
ctccttccttacccaaact

SEQ ID NO: 1584042 - DNA, 14 bp, Homo sapiens
ctccttccttgacc

SEQ ID NO: 1584043 - DNA, 22 bp, Homo sapiens
ctccttccttgctgtcctaggc

SEQ ID NO: 1584044 - DNA, 14 bp, Homo sapiens
ctccttcgtgtctc

SEQ ID NO: 1584045 - DNA, 21 bp, Homo sapiens
ctccttcgtgtctctcccacc

SEQ ID NO: 1584046 - DNA, 11 bp, Homo sapiens
ctccttctccc

SEQ ID NO: 1584047 - DNA, 13 bp, Homo sapiens
ctccttcttgctt

SEQ ID NO: 1584048 - DNA, 15 bp, Homo sapiens
ctccttgcttcctga

SEQ ID NO: 1584049 - DNA, 15 bp, Homo sapiens
ctccttggctgtctg

SEQ ID NO: 1584050 - DNA, 22 bp, Homo sapiens
ctccttggctgtctgtgggccg

SEQ ID NO: 1584051 - DNA, 17 bp, Homo sapiens
ctccttggctttatgca

SEQ ID NO: 1584052 - DNA, 21 bp, Homo sapiens
ctccttggctttatgcaaata

SEQ ID NO: 1584053 - DNA, 23 bp, Homo sapiens
ctccttggctttatgcaaataca

SEQ ID NO: 1584054 - DNA, 13 bp, Homo sapiens
ctccttgggccct

SEQ ID NO: 1584055 - DNA, 15 bp, Homo sapiens
ctccttgggcccttt

SEQ ID NO: 1584056 - DNA, 18 bp, Homo sapiens
ctccttgggccctttttc

SEQ ID NO: 1584057 - DNA, 13 bp, Homo sapiens
ctccttgggctcc

SEQ ID NO: 1584058 - DNA, 22 bp, Homo sapiens
ctccttgggctcctggctgcca

SEQ ID NO: 1584059 - DNA, 14 bp, Homo sapiens
ctccttggtgcctg

SEQ ID NO: 1584060 - DNA, 16 bp, Homo sapiens
ctccttggtttgctag

SEQ ID NO: 1584061 - DNA, 16 bp, Homo sapiens
ctccttgtaaagactg

SEQ ID NO: 1584062 - DNA, 17 bp, Homo sapiens
ctccttgtccaggtctc

SEQ ID NO: 1584063 - DNA, 19 bp, Homo sapiens
ctccttgtgcaattgtctt

SEQ ID NO: 1584064 - DNA, 16 bp, Homo sapiens
ctccttgtggactggc

SEQ ID NO: 1584065 - DNA, 15 bp, Homo sapiens
ctcctttaattgtaa

SEQ ID NO: 1584066 - DNA, 12 bp, Homo sapiens
ctcctttaccag

SEQ ID NO: 1584067 - DNA, 16 bp, Homo sapiens
ctcctttcacaacctt

SEQ ID NO: 1584068 - DNA, 17 bp, Homo sapiens
ctcctttcacaaccttc

SEQ ID NO: 1584069 - DNA, 15 bp, Homo sapiens
ctcctttcagccaca

SEQ ID NO: 1584070 - DNA, 13 bp, Homo sapiens
ctcctttccactg

SEQ ID NO: 1584071 - DNA, 13 bp, Homo sapiens
ctcctttccttcc

SEQ ID NO: 1584072 - DNA, 21 bp, Homo sapiens
ctcctttctccagccagcaat

SEQ ID NO: 1584073 - DNA, 13 bp, Homo sapiens
ctcctttctgtgc

SEQ ID NO: 1584074 - DNA, 17 bp, Homo sapiens
ctcctttgtattctgtc

SEQ ID NO: 1584075 - DNA, 19 bp, Homo sapiens
ctcctttgtgtggctgccc

SEQ ID NO: 1584076 - DNA, 21 bp, Homo sapiens
ctcctttgtttaataaaggct

SEQ ID NO: 1584077 - DNA, 13 bp, Homo sapiens
ctccttttcccaa

SEQ ID NO: 1584078 - DNA, 12 bp, Homo sapiens
ctccttttccta

SEQ ID NO: 1584079 - DNA, 12 bp, Homo sapiens
ctccttttctct

SEQ ID NO: 1584080 - DNA, 15 bp, Homo sapiens
ctccttttctctttg

SEQ ID NO: 1584081 - DNA, 17 bp, Homo sapiens
ctccttttgtccccagg

SEQ ID NO: 1584082 - DNA, 23 bp, Homo sapiens
ctcgaacatggaactcattcctg

SEQ ID NO: 1584083 - DNA, 19 bp, Homo sapiens
ctcgaaccaaggcagcctc

SEQ ID NO: 1584084 - DNA, 14 bp, Homo sapiens
ctcgaactcctggc

SEQ ID NO: 1584085 - DNA, 11 bp, Homo sapiens
ctcgaagccat

SEQ ID NO: 1584086 - DNA, 15 bp, Homo sapiens
ctcgaatctctgtgc

SEQ ID NO: 1584087 - DNA, 13 bp, Homo sapiens
ctcgaatgtaatt

SEQ ID NO: 1584088 - DNA, 18 bp, Homo sapiens
ctcgaattttatctgtgg

SEQ ID NO: 1584089 - DNA, 15 bp, Homo sapiens
ctcgacctccccacc

SEQ ID NO: 1584090 - DNA, 22 bp, Homo sapiens
ctcgacctccccacccgctccc

SEQ ID NO: 1584091 - DNA, 14 bp, Homo sapiens
ctcgactctgtgcc

SEQ ID NO: 1584092 - DNA, 21 bp, Homo sapiens
ctcgagacacagtgaagcaaa

SEQ ID NO: 1584093 - DNA, 22 bp, Homo sapiens
ctcgagaccatcctggcccctc

SEQ ID NO: 1584094 - DNA, 23 bp, Homo sapiens
ctcgagagggctggtccttattt

SEQ ID NO: 1584095 - DNA, 15 bp, Homo sapiens
ctcgagcaactgctg

SEQ ID NO: 1584096 - DNA, 23 bp, Homo sapiens
ctcgagcagtcctgcctcagcct

SEQ ID NO: 1584097 - DNA, 16 bp, Homo sapiens
ctcgagccccctggat

SEQ ID NO: 1584098 - DNA, 18 bp, Homo sapiens
ctcgaggcaccggcgctg

SEQ ID NO: 1584099 - DNA, 19 bp, Homo sapiens
ctcgaggcaccggcgctgc

SEQ ID NO: 1584100 - DNA, 20 bp, Homo sapiens
ctcgaggcaccggcgctgca

SEQ ID NO: 1584101 - DNA, 21 bp, Homo sapiens
ctcgaggcaccggcgctgcag

SEQ ID NO: 1584102 - DNA, 14 bp, Homo sapiens
ctcgaggggtgggc

SEQ ID NO: 1584103 - DNA, 19 bp, Homo sapiens
ctcgaggggtgggctggta

SEQ ID NO: 1584104 - DNA, 22 bp, Homo sapiens
ctcgagtgaatttctaaatgtt

SEQ ID NO: 1584105 - DNA, 14 bp, Homo sapiens
ctcgatcaaaacct

SEQ ID NO: 1584106 - DNA, 22 bp, Homo sapiens
ctcgatcaaaaccttccttccc

SEQ ID NO: 1584107 - DNA, 21 bp, Homo sapiens
ctcgatcatatttccccttgg

SEQ ID NO: 1584108 - DNA, 23 bp, Homo sapiens
ctcgatcatatttccccttggac

SEQ ID NO: 1584109 - DNA, 23 bp, Homo sapiens
ctcgcaaaaacgtatctcctaat

SEQ ID NO: 1584110 - DNA, 15 bp, Homo sapiens
ctcgcagacctaagc

SEQ ID NO: 1584111 - DNA, 17 bp, Homo sapiens
ctcgcagacctaagccc

SEQ ID NO: 1584112 - DNA, 19 bp, Homo sapiens
ctcgcagggaatgcagcag

SEQ ID NO: 1584113 - DNA, 21 bp, Homo sapiens
ctcgcagggaatgcagcagga

SEQ ID NO: 1584114 - DNA, 15 bp, Homo sapiens
ctcgcagtcgcagga

SEQ ID NO: 1584115 - DNA, 18 bp, Homo sapiens
ctcgcagtcgcaggatcc

SEQ ID NO: 1584116 - DNA, 19 bp, Homo sapiens
ctcgccatttcctcacgtg

SEQ ID NO: 1584117 - DNA, 23 bp, Homo sapiens
ctcgccatttcctcacgtgcagg

SEQ ID NO: 1584118 - DNA, 14 bp, Homo sapiens
ctcgcccagacacc

SEQ ID NO: 1584119 - DNA, 12 bp, Homo sapiens
ctcgcccagcag

SEQ ID NO: 1584120 - DNA, 16 bp, Homo sapiens
ctcgccccaacactgt

SEQ ID NO: 1584121 - DNA, 12 bp, Homo sapiens
ctcgcccgccca

SEQ ID NO: 1584122 - DNA, 15 bp, Homo sapiens
ctcgccctgggtcta

SEQ ID NO: 1584123 - DNA, 13 bp, Homo sapiens
ctcgccctgtgag

SEQ ID NO: 1584124 - DNA, 19 bp, Homo sapiens
ctcgccgtccctcccaggt

SEQ ID NO: 1584125 - DNA, 15 bp, Homo sapiens
ctcgcctcagcctga

SEQ ID NO: 1584126 - DNA, 16 bp, Homo sapiens
ctcgcgggcagcgggc

SEQ ID NO: 1584127 - DNA, 19 bp, Homo sapiens
ctcgcgggcagcgggccag

SEQ ID NO: 1584128 - DNA, 14 bp, Homo sapiens
ctcgcggggcagca

SEQ ID NO: 1584129 - DNA, 15 bp, Homo sapiens
ctcgctccctgtagc

SEQ ID NO: 1584130 - DNA, 20 bp, Homo sapiens
ctcgctgccctgtggacagg

SEQ ID NO: 1584131 - DNA, 14 bp, Homo sapiens
ctcgctgctgctac

SEQ ID NO: 1584132 - DNA, 16 bp, Homo sapiens
ctcgctggctttctct

SEQ ID NO: 1584133 - DNA, 23 bp, Homo sapiens
ctcgcttgccgggcctgggcctc

SEQ ID NO: 1584134 - DNA, 13 bp, Homo sapiens
ctcggaagagccc

SEQ ID NO: 1584135 - DNA, 18 bp, Homo sapiens
ctcggaagccgtctgact

SEQ ID NO: 1584136 - DNA, 23 bp, Homo sapiens
ctcggacccaccaaactgcacac

SEQ ID NO: 1584137 - DNA, 15 bp, Homo sapiens
ctcggacccacccca

SEQ ID NO: 1584138 - DNA, 17 bp, Homo sapiens
ctcggacccaccccaac

SEQ ID NO: 1584139 - DNA, 13 bp, Homo sapiens
ctcggactctgct

SEQ ID NO: 1584140 - DNA, 17 bp, Homo sapiens
ctcggagagcagcagca

SEQ ID NO: 1584141 - DNA, 20 bp, Homo sapiens
ctcggagagcagcagcacca

SEQ ID NO: 1584142 - DNA, 20 bp, Homo sapiens
ctcggatcaccgagagtagc

SEQ ID NO: 1584143 - DNA, 20 bp, Homo sapiens
ctcggatgaccatactcaga

SEQ ID NO: 1584144 - DNA, 16 bp, Homo sapiens
ctcggccccctccatc

SEQ ID NO: 1584145 - DNA, 15 bp, Homo sapiens
ctcggcccctcccac

SEQ ID NO: 1584146 - DNA, 13 bp, Homo sapiens
ctcggcctcccaa

SEQ ID NO: 1584147 - DNA, 19 bp, Homo sapiens
ctcggcctcccacagtgct

SEQ ID NO: 1584148 - DNA, 18 bp, Homo sapiens
ctcggcctccgaggctcc

SEQ ID NO: 1584149 - DNA, 21 bp, Homo sapiens
ctcggcctccgaggctccccg

SEQ ID NO: 1584150 - DNA, 23 bp, Homo sapiens
ctcggcgtgctccttttctcttt

SEQ ID NO: 1584151 - DNA, 22 bp, Homo sapiens
ctcggctccccatgtgtcctgg

SEQ ID NO: 1584152 - DNA, 17 bp, Homo sapiens
ctcggcttcttggacct

SEQ ID NO: 1584153 - DNA, 18 bp, Homo sapiens
ctcggcttggatcctggg

SEQ ID NO: 1584154 - DNA, 16 bp, Homo sapiens
ctcgggaagcagccag

SEQ ID NO: 1584155 - DNA, 19 bp, Homo sapiens
ctcgggaagcagccagctc

SEQ ID NO: 1584156 - DNA, 18 bp, Homo sapiens
ctcgggagtcctctagca

SEQ ID NO: 1584157 - DNA, 19 bp, Homo sapiens
ctcgggcccacctggccac

SEQ ID NO: 1584158 - DNA, 22 bp, Homo sapiens
ctcgggccgaggcccagcgggc

SEQ ID NO: 1584159 - DNA, 22 bp, Homo sapiens
ctcgggcgagtcactgcctctc

SEQ ID NO: 1584160 - DNA, 22 bp, Homo sapiens
ctcggggcccttggggcctggc

SEQ ID NO: 1584161 - DNA, 21 bp, Homo sapiens
ctcggggtaaaaagtggctgc

SEQ ID NO: 1584162 - DNA, 14 bp, Homo sapiens
ctcggggtccagtg

SEQ ID NO: 1584163 - DNA, 15 bp, Homo sapiens
ctcggtatctggctt

SEQ ID NO: 1584164 - DNA, 17 bp, Homo sapiens
ctcggtatctggcttcc

SEQ ID NO: 1584165 - DNA, 14 bp, Homo sapiens
ctcggtgagccggg

SEQ ID NO: 1584166 - DNA, 18 bp, Homo sapiens
ctcggtgagccggggccg

SEQ ID NO: 1584167 - DNA, 14 bp, Homo sapiens
ctcggtggacccag

SEQ ID NO: 1584168 - DNA, 18 bp, Homo sapiens
ctcggtgggccagagctg

SEQ ID NO: 1584169 - DNA, 22 bp, Homo sapiens
ctcggtttgccaaaattcattt

SEQ ID NO: 1584170 - DNA, 22 bp, Homo sapiens
ctcgtatccaacccaaggacct

SEQ ID NO: 1584171 - DNA, 21 bp, Homo sapiens
ctcgtccaagggacagcccac

SEQ ID NO: 1584172 - DNA, 16 bp, Homo sapiens
ctcgtccacaggggca

SEQ ID NO: 1584173 - DNA, 18 bp, Homo sapiens
ctcgtccacaggggcagg

SEQ ID NO: 1584174 - DNA, 19 bp, Homo sapiens
ctcgtccacaggggcaggc

SEQ ID NO: 1584175 - DNA, 20 bp, Homo sapiens
ctcgtccacaggggcaggcc

SEQ ID NO: 1584176 - DNA, 22 bp, Homo sapiens
ctcgtcctccccctgccagtgc

SEQ ID NO: 1584177 - DNA, 17 bp, Homo sapiens
ctcgtcctgtcccagag

SEQ ID NO: 1584178 - DNA, 20 bp, Homo sapiens
ctcgtgaggggcaagctagg

SEQ ID NO: 1584179 - DNA, 19 bp, Homo sapiens
ctcgtgatccgcctgcctc

SEQ ID NO: 1584180 - DNA, 18 bp, Homo sapiens
ctcgtgattggcatataa

SEQ ID NO: 1584181 - DNA, 16 bp, Homo sapiens
ctcgtgcatccctgag

SEQ ID NO: 1584182 - DNA, 21 bp, Homo sapiens
ctcgtgcattaaaatttctta

SEQ ID NO: 1584183 - DNA, 12 bp, Homo sapiens
ctcgtgccagca

SEQ ID NO: 1584184 - DNA, 18 bp, Homo sapiens
ctcgtgccagcagcctcg

SEQ ID NO: 1584185 - DNA, 19 bp, Homo sapiens
ctcgtgccagcagcctcgc

SEQ ID NO: 1584186 - DNA, 18 bp, Homo sapiens
ctcgtgctgcatccctgt

SEQ ID NO: 1584187 - DNA, 15 bp, Homo sapiens
ctcgtggactgtgct

SEQ ID NO: 1584188 - DNA, 12 bp, Homo sapiens
ctcgtggccagc

SEQ ID NO: 1584189 - DNA, 13 bp, Homo sapiens
ctcgtggccagcc

SEQ ID NO: 1584190 - DNA, 14 bp, Homo sapiens
ctcgtggccagccc

SEQ ID NO: 1584191 - DNA, 23 bp, Homo sapiens
ctcgtggccttccccttttgcct

SEQ ID NO: 1584192 - DNA, 14 bp, Homo sapiens
ctcgtgtatcctgg

SEQ ID NO: 1584193 - DNA, 20 bp, Homo sapiens
ctcgttctctgggtggccgg

SEQ ID NO: 1584194 - DNA, 17 bp, Homo sapiens
ctctaaactggcatctg

SEQ ID NO: 1584195 - DNA, 17 bp, Homo sapiens
ctctaaagtagcaactg

SEQ ID NO: 1584196 - DNA, 15 bp, Homo sapiens
ctctaaatcttcctt

SEQ ID NO: 1584197 - DNA, 19 bp, Homo sapiens
ctctaaatcttccttgtga

SEQ ID NO: 1584198 - DNA, 21 bp, Homo sapiens
ctctaaatgcagttttaagaa

SEQ ID NO: 1584199 - DNA, 23 bp, Homo sapiens
ctctaaattaaagagaaaattga

SEQ ID NO: 1584200 - DNA, 14 bp, Homo sapiens
ctctaacagccctc

SEQ ID NO: 1584201 - DNA, 12 bp, Homo sapiens
ctctaaccagtg

SEQ ID NO: 1584202 - DNA, 16 bp, Homo sapiens
ctctaaccattcaaat

SEQ ID NO: 1584203 - DNA, 17 bp, Homo sapiens
ctctaaccattcaaatg

SEQ ID NO: 1584204 - DNA, 16 bp, Homo sapiens
ctctaacccagtggct

SEQ ID NO: 1584205 - DNA, 18 bp, Homo sapiens
ctctaactcactgcctag

SEQ ID NO: 1584206 - DNA, 18 bp, Homo sapiens
ctctaactggacatgaag

SEQ ID NO: 1584207 - DNA, 14 bp, Homo sapiens
ctctaacttctcaa

SEQ ID NO: 1584208 - DNA, 14 bp, Homo sapiens
ctctaagatcttag

SEQ ID NO: 1584209 - DNA, 22 bp, Homo sapiens
ctctaagatcttagattctctg

SEQ ID NO: 1584210 - DNA, 14 bp, Homo sapiens
ctctaaggttgggc

SEQ ID NO: 1584211 - DNA, 20 bp, Homo sapiens
ctctaagtgggcattgccat

SEQ ID NO: 1584212 - DNA, 16 bp, Homo sapiens
ctctaatgtctgcagc

SEQ ID NO: 1584213 - DNA, 18 bp, Homo sapiens
ctctaatgtctgcagctc

SEQ ID NO: 1584214 - DNA, 15 bp, Homo sapiens
ctctaattcacagtg

SEQ ID NO: 1584215 - DNA, 20 bp, Homo sapiens
ctctaattcccattttgcaa

SEQ ID NO: 1584216 - DNA, 15 bp, Homo sapiens
ctctacagccgtccc

SEQ ID NO: 1584217 - DNA, 21 bp, Homo sapiens
ctctacagctaatcagcattc

SEQ ID NO: 1584218 - DNA, 18 bp, Homo sapiens
ctctacatcttctgcctt

SEQ ID NO: 1584219 - DNA, 23 bp, Homo sapiens
ctctacatttgcagatgttcaaa

SEQ ID NO: 1584220 - DNA, 14 bp, Homo sapiens
ctctaccagtctat

SEQ ID NO: 1584221 - DNA, 14 bp, Homo sapiens
ctctacccatctcc

SEQ ID NO: 1584222 - DNA, 22 bp, Homo sapiens
ctctacccctgctcccattcct

SEQ ID NO: 1584223 - DNA, 16 bp, Homo sapiens
ctctaccctcccaccc

SEQ ID NO: 1584224 - DNA, 13 bp, Homo sapiens
ctctaccctgtct

SEQ ID NO: 1584225 - DNA, 20 bp, Homo sapiens
ctctacctcatatcagtttg

SEQ ID NO: 1584226 - DNA, 19 bp, Homo sapiens
ctctactaaaaagaaggaa

SEQ ID NO: 1584227 - DNA, 17 bp, Homo sapiens
ctctactaaaattcaaa

SEQ ID NO: 1584228 - DNA, 19 bp, Homo sapiens
ctctactcttacagagcct

SEQ ID NO: 1584229 - DNA, 19 bp, Homo sapiens
ctctacttagcatgtccct

SEQ ID NO: 1584230 - DNA, 12 bp, Homo sapiens
ctctagaaattt

SEQ ID NO: 1584231 - DNA, 23 bp, Homo sapiens
ctctagaacatgcacatttatat

SEQ ID NO: 1584232 - DNA, 15 bp, Homo sapiens
ctctagaagccaagg

SEQ ID NO: 1584233 - DNA, 16 bp, Homo sapiens
ctctagaatccagcag

SEQ ID NO: 1584234 - DNA, 16 bp, Homo sapiens
ctctagaatcccagca

SEQ ID NO: 1584235 - DNA, 17 bp, Homo sapiens
ctctagaatcccagcag

SEQ ID NO: 1584236 - DNA, 21 bp, Homo sapiens
ctctagaatcccagcagcaga

SEQ ID NO: 1584237 - DNA, 12 bp, Homo sapiens
ctctagaatctg

SEQ ID NO: 1584238 - DNA, 15 bp, Homo sapiens
ctctagaattttaag

SEQ ID NO: 1584239 - DNA, 20 bp, Homo sapiens
ctctagaattttaagtgctt

SEQ ID NO: 1584240 - DNA, 23 bp, Homo sapiens
ctctagaattttaagtgctttgt

SEQ ID NO: 1584241 - DNA, 16 bp, Homo sapiens
ctctagacaagatatt

SEQ ID NO: 1584242 - DNA, 21 bp, Homo sapiens
ctctagacaagatattgtaca

SEQ ID NO: 1584243 - DNA, 15 bp, Homo sapiens
ctctagagagcctta

SEQ ID NO: 1584244 - DNA, 16 bp, Homo sapiens
ctctagagcagggatt

SEQ ID NO: 1584245 - DNA, 14 bp, Homo sapiens
ctctagatcataag

SEQ ID NO: 1584246 - DNA, 16 bp, Homo sapiens
ctctagattcataaat

SEQ ID NO: 1584247 - DNA, 17 bp, Homo sapiens
ctctagcagcacctcct

SEQ ID NO: 1584248 - DNA, 13 bp, Homo sapiens
ctctagccaggag

SEQ ID NO: 1584249 - DNA, 20 bp, Homo sapiens
ctctagccaggagtctgtgc

SEQ ID NO: 1584250 - DNA, 20 bp, Homo sapiens
ctctagcccactccctgcct

SEQ ID NO: 1584251 - DNA, 12 bp, Homo sapiens
ctctagctggca

SEQ ID NO: 1584252 - DNA, 16 bp, Homo sapiens
ctctagctggcaggac

SEQ ID NO: 1584253 - DNA, 17 bp, Homo sapiens
ctctagctggcaggaca

SEQ ID NO: 1584254 - DNA, 21 bp, Homo sapiens
ctctaggaagacatttttccg

SEQ ID NO: 1584255 - DNA, 18 bp, Homo sapiens
ctctaggagggagccttg

SEQ ID NO: 1584256 - DNA, 16 bp, Homo sapiens
ctctaggcctctccag

SEQ ID NO: 1584257 - DNA, 14 bp, Homo sapiens
ctctaggctgcccc

SEQ ID NO: 1584258 - DNA, 20 bp, Homo sapiens
ctctaggggtcaggctccat

SEQ ID NO: 1584259 - DNA, 19 bp, Homo sapiens
ctctagtccccaaggcctc

SEQ ID NO: 1584260 - DNA, 21 bp, Homo sapiens
ctctagtgccctccacagccg

SEQ ID NO: 1584261 - DNA, 20 bp, Homo sapiens
ctctagtgggacagcccaga

SEQ ID NO: 1584262 - DNA, 22 bp, Homo sapiens
ctctagtgggacagcccagagc

SEQ ID NO: 1584263 - DNA, 12 bp, Homo sapiens
ctctagttcaaa

SEQ ID NO: 1584264 - DNA, 15 bp, Homo sapiens
ctctagttctagatg

SEQ ID NO: 1584265 - DNA, 21 bp, Homo sapiens
ctctagttttcagccttggga

SEQ ID NO: 1584266 - DNA, 22 bp, Homo sapiens
ctctataagcaaattgcttttt

SEQ ID NO: 1584267 - DNA, 14 bp, Homo sapiens
ctctataattgttt

SEQ ID NO: 1584268 - DNA, 17 bp, Homo sapiens
ctctataccaataaagt

SEQ ID NO: 1584269 - DNA, 19 bp, Homo sapiens
ctctataccaataaagtga

SEQ ID NO: 1584270 - DNA, 14 bp, Homo sapiens
ctctatactttgtt

SEQ ID NO: 1584271 - DNA, 19 bp, Homo sapiens
ctctatactttgttctgtt

SEQ ID NO: 1584272 - DNA, 11 bp, Homo sapiens
ctctatattta

SEQ ID NO: 1584273 - DNA, 19 bp, Homo sapiens
ctctatcagaaatacaaaa

SEQ ID NO: 1584274 - DNA, 18 bp, Homo sapiens
ctctatcctctcttcctc

SEQ ID NO: 1584275 - DNA, 15 bp, Homo sapiens
ctctatgagtctaga

SEQ ID NO: 1584276 - DNA, 21 bp, Homo sapiens
ctctatgccagctcagtccca

SEQ ID NO: 1584277 - DNA, 19 bp, Homo sapiens
ctctattgggcacagccta

SEQ ID NO: 1584278 - DNA, 14 bp, Homo sapiens
ctctatttaagatt

SEQ ID NO: 1584279 - DNA, 19 bp, Homo sapiens
ctctatttattagccaact

SEQ ID NO: 1584280 - DNA, 20 bp, Homo sapiens
ctctatttattagccaactg

SEQ ID NO: 1584281 - DNA, 20 bp, Homo sapiens
ctctatttgagaagttctca

SEQ ID NO: 1584282 - DNA, 23 bp, Homo sapiens
ctctcaaaacaatattactttgt

SEQ ID NO: 1584283 - DNA, 23 bp, Homo sapiens
ctctcaaaagagaaaaacaaaac

SEQ ID NO: 1584284 - DNA, 15 bp, Homo sapiens
ctctcaagaccagag

SEQ ID NO: 1584285 - DNA, 14 bp, Homo sapiens
ctctcaagtaatat

SEQ ID NO: 1584286 - DNA, 12 bp, Homo sapiens
ctctcacacaca

SEQ ID NO: 1584287 - DNA, 13 bp, Homo sapiens
ctctcacacacac

SEQ ID NO: 1584288 - DNA, 19 bp, Homo sapiens
ctctcaccatgatgtgaag

SEQ ID NO: 1584289 - DNA, 22 bp, Homo sapiens
ctctcaccatgatgtgaagagt

SEQ ID NO: 1584290 - DNA, 16 bp, Homo sapiens
ctctcaccatttggat

SEQ ID NO: 1584291 - DNA, 16 bp, Homo sapiens
ctctcacccccatccc

SEQ ID NO: 1584292 - DNA, 14 bp, Homo sapiens
ctctcactccccag

SEQ ID NO: 1584293 - DNA, 19 bp, Homo sapiens
ctctcactccccagcccca

SEQ ID NO: 1584294 - DNA, 19 bp, Homo sapiens
ctctcactgtgttactgct

SEQ ID NO: 1584295 - DNA, 20 bp, Homo sapiens
ctctcactgtgttactgctt

SEQ ID NO: 1584296 - DNA, 13 bp, Homo sapiens
ctctcagaacata

SEQ ID NO: 1584297 - DNA, 20 bp, Homo sapiens
ctctcagaactcctgtgtgt

SEQ ID NO: 1584298 - DNA, 22 bp, Homo sapiens
ctctcagaggcctgctgccagt

SEQ ID NO: 1584299 - DNA, 19 bp, Homo sapiens
ctctcagcaagtgcccagt

SEQ ID NO: 1584300 - DNA, 20 bp, Homo sapiens
ctctcagcatagcctgcctg

SEQ ID NO: 1584301 - DNA, 11 bp, Homo sapiens
ctctcagccaa

SEQ ID NO: 1584302 - DNA, 23 bp, Homo sapiens
ctctcagccaacgagtaatttat

SEQ ID NO: 1584303 - DNA, 15 bp, Homo sapiens
ctctcagcctcccac

SEQ ID NO: 1584304 - DNA, 12 bp, Homo sapiens
ctctcagctcca

SEQ ID NO: 1584305 - DNA, 14 bp, Homo sapiens
ctctcagctcccag

SEQ ID NO: 1584306 - DNA, 16 bp, Homo sapiens
ctctcagctcccaggc

SEQ ID NO: 1584307 - DNA, 15 bp, Homo sapiens
ctctcagctggcagt

SEQ ID NO: 1584308 - DNA, 21 bp, Homo sapiens
ctctcaggagcacaggcagct

SEQ ID NO: 1584309 - DNA, 16 bp, Homo sapiens
ctctcaggatccaagc

SEQ ID NO: 1584310 - DNA, 17 bp, Homo sapiens
ctctcagtgccttctct

SEQ ID NO: 1584311 - DNA, 18 bp, Homo sapiens
ctctcagtgccttctctc

SEQ ID NO: 1584312 - DNA, 20 bp, Homo sapiens
ctctcagtgccttctctcag

SEQ ID NO: 1584313 - DNA, 22 bp, Homo sapiens
ctctcagtgccttctctcagct

SEQ ID NO: 1584314 - DNA, 17 bp, Homo sapiens
ctctcagttctctccct

SEQ ID NO: 1584315 - DNA, 12 bp, Homo sapiens
ctctcagttttt

SEQ ID NO: 1584316 - DNA, 17 bp, Homo sapiens
ctctcatcaactgaatg

SEQ ID NO: 1584317 - DNA, 18 bp, Homo sapiens
ctctcatcaactgaatga

SEQ ID NO: 1584318 - DNA, 19 bp, Homo sapiens
ctctcatcctccagtacct

SEQ ID NO: 1584319 - DNA, 18 bp, Homo sapiens
ctctcatcgccagacaac

SEQ ID NO: 1584320 - DNA, 16 bp, Homo sapiens
ctctcattccccaggt

SEQ ID NO: 1584321 - DNA, 20 bp, Homo sapiens
ctctcattccccaggtggct

SEQ ID NO: 1584322 - DNA, 20 bp, Homo sapiens
ctctccaaaggggctgctgg

SEQ ID NO: 1584323 - DNA, 21 bp, Homo sapiens
ctctccaaaggggctgctggg

SEQ ID NO: 1584324 - DNA, 22 bp, Homo sapiens
ctctccaaatattattcaagtg

SEQ ID NO: 1584325 - DNA, 23 bp, Homo sapiens
ctctccaaatattattcaagtgc

SEQ ID NO: 1584326 - DNA, 22 bp, Homo sapiens
ctctccaaccactgtgccactg

SEQ ID NO: 1584327 - DNA, 23 bp, Homo sapiens
ctctccaaccactgtgccactga

SEQ ID NO: 1584328 - DNA, 14 bp, Homo sapiens
ctctccaacctgga

SEQ ID NO: 1584329 - DNA, 21 bp, Homo sapiens
ctctccaactgcctaaggccc

SEQ ID NO: 1584330 - DNA, 12 bp, Homo sapiens
ctctccaagggc

SEQ ID NO: 1584331 - DNA, 13 bp, Homo sapiens
ctctccaagggct

SEQ ID NO: 1584332 - DNA, 17 bp, Homo sapiens
ctctccaagggcttctg

SEQ ID NO: 1584333 - DNA, 15 bp, Homo sapiens
ctctccaagtgccag

SEQ ID NO: 1584334 - DNA, 14 bp, Homo sapiens
ctctccacccccca

SEQ ID NO: 1584335 - DNA, 16 bp, Homo sapiens
ctctccaccccccacg

SEQ ID NO: 1584336 - DNA, 12 bp, Homo sapiens
ctctccacctca

SEQ ID NO: 1584337 - DNA, 18 bp, Homo sapiens
ctctccaccttagtactt

SEQ ID NO: 1584338 - DNA, 20 bp, Homo sapiens
ctctccaccttagtacttta

SEQ ID NO: 1584339 - DNA, 21 bp, Homo sapiens
ctctccaccttagtactttag

SEQ ID NO: 1584340 - DNA, 14 bp, Homo sapiens
ctctccactcaatg

SEQ ID NO: 1584341 - DNA, 16 bp, Homo sapiens
ctctccactgccttcg

SEQ ID NO: 1584342 - DNA, 13 bp, Homo sapiens
ctctccactgctg

SEQ ID NO: 1584343 - DNA, 21 bp, Homo sapiens
ctctccaggaaggtagcccag

SEQ ID NO: 1584344 - DNA, 14 bp, Homo sapiens
ctctccaggccagg

SEQ ID NO: 1584345 - DNA, 12 bp, Homo sapiens
ctctccaggccc

SEQ ID NO: 1584346 - DNA, 13 bp, Homo sapiens
ctctccaggcccc

SEQ ID NO: 1584347 - DNA, 12 bp, Homo sapiens
ctctccagggtg

SEQ ID NO: 1584348 - DNA, 14 bp, Homo sapiens
ctctccaggtcagc

SEQ ID NO: 1584349 - DNA, 17 bp, Homo sapiens
ctctccagtttgcacct

SEQ ID NO: 1584350 - DNA, 20 bp, Homo sapiens
ctctccagtttgcacctgtc

SEQ ID NO: 1584351 - DNA, 15 bp, Homo sapiens
ctctcccaagtccac

SEQ ID NO: 1584352 - DNA, 15 bp, Homo sapiens
ctctcccaccccggc

SEQ ID NO: 1584353 - DNA, 19 bp, Homo sapiens
ctctcccacccggccacag

SEQ ID NO: 1584354 - DNA, 13 bp, Homo sapiens
ctctcccatcact

SEQ ID NO: 1584355 - DNA, 14 bp, Homo sapiens
ctctcccatcactt

SEQ ID NO: 1584356 - DNA, 16 bp, Homo sapiens
ctctcccatcctgggg

SEQ ID NO: 1584357 - DNA, 17 bp, Homo sapiens
ctctcccatttcaggaa

SEQ ID NO: 1584358 - DNA, 14 bp, Homo sapiens
ctctcccatttcct

SEQ ID NO: 1584359 - DNA, 13 bp, Homo sapiens
ctctccccacact

SEQ ID NO: 1584360 - DNA, 20 bp, Homo sapiens
ctctccccaggtccagctct

SEQ ID NO: 1584361 - DNA, 12 bp, Homo sapiens
ctctccccagtg

SEQ ID NO: 1584362 - DNA, 13 bp, Homo sapiens
ctctccccagtgc

SEQ ID NO: 1584363 - DNA, 22 bp, Homo sapiens
ctctccccagtgcctgccactc

SEQ ID NO: 1584364 - DNA, 17 bp, Homo sapiens
ctctccccctatttatt

SEQ ID NO: 1584365 - DNA, 14 bp, Homo sapiens
ctctccccctttca

SEQ ID NO: 1584366 - DNA, 21 bp, Homo sapiens
ctctccccggcaggcctgaga

SEQ ID NO: 1584367 - DNA, 14 bp, Homo sapiens
ctctcccctcctgc

SEQ ID NO: 1584368 - DNA, 19 bp, Homo sapiens
ctctcccggttcttccagt

SEQ ID NO: 1584369 - DNA, 17 bp, Homo sapiens
ctctcccgtcagggccc

SEQ ID NO: 1584370 - DNA, 16 bp, Homo sapiens
ctctccctctctctgg

SEQ ID NO: 1584371 - DNA, 19 bp, Homo sapiens
ctctccctctggccctgcc

SEQ ID NO: 1584372 - DNA, 21 bp, Homo sapiens
ctctccctctggccctgcctt

SEQ ID NO: 1584373 - DNA, 22 bp, Homo sapiens
ctctccctgcactccctcctgg

SEQ ID NO: 1584374 - DNA, 21 bp, Homo sapiens
ctctccctgccaagtctcaga

SEQ ID NO: 1584375 - DNA, 17 bp, Homo sapiens
ctctccgactctgcacc

SEQ ID NO: 1584376 - DNA, 20 bp, Homo sapiens
ctctccgagctctggtgctt

SEQ ID NO: 1584377 - DNA, 16 bp, Homo sapiens
ctctccgaggggtgga

SEQ ID NO: 1584378 - DNA, 22 bp, Homo sapiens
ctctcctaactgccagccccct

SEQ ID NO: 1584379 - DNA, 23 bp, Homo sapiens
ctctcctatgtggcagctgggga

SEQ ID NO: 1584380 - DNA, 11 bp, Homo sapiens
ctctcctcccc

SEQ ID NO: 1584381 - DNA, 18 bp, Homo sapiens
ctctcctcccgccccgcc

SEQ ID NO: 1584382 - DNA, 14 bp, Homo sapiens
ctctcctcctcccc

SEQ ID NO: 1584383 - DNA, 20 bp, Homo sapiens
ctctcctcggccccctccat

SEQ ID NO: 1584384 - DNA, 13 bp, Homo sapiens
ctctcctgccctg

SEQ ID NO: 1584385 - DNA, 12 bp, Homo sapiens
ctctcctgccta

SEQ ID NO: 1584386 - DNA, 16 bp, Homo sapiens
ctctcctgcttcctct

SEQ ID NO: 1584387 - DNA, 21 bp, Homo sapiens
ctctcctggcctatccgctgc

SEQ ID NO: 1584388 - DNA, 20 bp, Homo sapiens
ctctcctgtctgccctctgg

SEQ ID NO: 1584389 - DNA, 18 bp, Homo sapiens
ctctccttcctcttggct

SEQ ID NO: 1584390 - DNA, 21 bp, Homo sapiens
ctctccttcctcttggctgag

SEQ ID NO: 1584391 - DNA, 16 bp, Homo sapiens
ctctccttcctggagc

SEQ ID NO: 1584392 - DNA, 17 bp, Homo sapiens
ctctccttccttaccca

SEQ ID NO: 1584393 - DNA, 18 bp, Homo sapiens
ctctccttggccacagac

SEQ ID NO: 1584394 - DNA, 13 bp, Homo sapiens
ctctccttgggct

SEQ ID NO: 1584395 - DNA, 15 bp, Homo sapiens
ctctccttgggctcc

SEQ ID NO: 1584396 - DNA, 20 bp, Homo sapiens
ctctccttgggctcctggct

SEQ ID NO: 1584397 - DNA, 21 bp, Homo sapiens
ctctccttgggctcctggctg

SEQ ID NO: 1584398 - DNA, 22 bp, Homo sapiens
ctctccttgggctcctggctgc

SEQ ID NO: 1584399 - DNA, 14 bp, Homo sapiens
ctctcctttctttt

SEQ ID NO: 1584400 - DNA, 20 bp, Homo sapiens
ctctcctttgtgtggctgcc

SEQ ID NO: 1584401 - DNA, 16 bp, Homo sapiens
ctctcgacggcacgca

SEQ ID NO: 1584402 - DNA, 22 bp, Homo sapiens
ctctcgactgtcagtggggcag

SEQ ID NO: 1584403 - DNA, 14 bp, Homo sapiens
ctctcggccaggca

SEQ ID NO: 1584404 - DNA, 15 bp, Homo sapiens
ctctcggccaggcat

SEQ ID NO: 1584405 - DNA, 17 bp, Homo sapiens
ctctcggctccccatgt

SEQ ID NO: 1584406 - DNA, 19 bp, Homo sapiens
ctctcgggttgtgtgtctg

SEQ ID NO: 1584407 - DNA, 14 bp, Homo sapiens
ctctcggtgctcca

SEQ ID NO: 1584408 - DNA, 21 bp, Homo sapiens
ctctctaaatcttccttgtga

SEQ ID NO: 1584409 - DNA, 22 bp, Homo sapiens
ctctctaaatcttccttgtgag

SEQ ID NO: 1584410 - DNA, 18 bp, Homo sapiens
ctctctacagagaggaaa

SEQ ID NO: 1584411 - DNA, 19 bp, Homo sapiens
ctctctacagagaggaaat

SEQ ID NO: 1584412 - DNA, 15 bp, Homo sapiens
ctctctaccagtcta

SEQ ID NO: 1584413 - DNA, 16 bp, Homo sapiens
ctctctacctccaccc

SEQ ID NO: 1584414 - DNA, 17 bp, Homo sapiens
ctctctacctccaccct

SEQ ID NO: 1584415 - DNA, 19 bp, Homo sapiens
ctctctactcctacctcag

SEQ ID NO: 1584416 - DNA, 14 bp, Homo sapiens
ctctctaggcctct

SEQ ID NO: 1584417 - DNA, 24 bp, Homo sapiens
ctctctatcctctcttcctcttcc

SEQ ID NO: 1584418 - DNA, 14 bp, Homo sapiens
ctctctattgtcat

SEQ ID NO: 1584419 - DNA, 19 bp, Homo sapiens
ctctctcagttatgtagtt

SEQ ID NO: 1584420 - DNA, 14 bp, Homo sapiens
ctctctccagatgt

SEQ ID NO: 1584421 - DNA, 13 bp, Homo sapiens
ctctctccagggt

SEQ ID NO: 1584422 - DNA, 13 bp, Homo sapiens
ctctctcccagga

SEQ ID NO: 1584423 - DNA, 14 bp, Homo sapiens
ctctctcccatttc

SEQ ID NO: 1584424 - DNA, 18 bp, Homo sapiens
ctctctcccctctgcaac

SEQ ID NO: 1584425 - DNA, 16 bp, Homo sapiens
ctctctccttggccac

SEQ ID NO: 1584426 - DNA, 12 bp, Homo sapiens
ctctctctctca

SEQ ID NO: 1584427 - DNA, 13 bp, Homo sapiens
ctctctctctcac

SEQ ID NO: 1584428 - DNA, 15 bp, Homo sapiens
ctctctctctcgctc

SEQ ID NO: 1584429 - DNA, 15 bp, Homo sapiens
ctctctctgaggaca

SEQ ID NO: 1584430 - DNA, 12 bp, Homo sapiens
ctctctctgcct

SEQ ID NO: 1584431 - DNA, 12 bp, Homo sapiens
ctctctctgggt

SEQ ID NO: 1584432 - DNA, 12 bp, Homo sapiens
ctctctcttctg

SEQ ID NO: 1584433 - DNA, 18 bp, Homo sapiens
ctctctctttctagaggt

SEQ ID NO: 1584434 - DNA, 23 bp, Homo sapiens
ctctctgacgcttgtgacagtgc

SEQ ID NO: 1584435 - DNA, 13 bp, Homo sapiens
ctctctgagactg

SEQ ID NO: 1584436 - DNA, 17 bp, Homo sapiens
ctctctgagtcaaatcc

SEQ ID NO: 1584437 - DNA, 19 bp, Homo sapiens
ctctctgagtcaaatccag

SEQ ID NO: 1584438 - DNA, 23 bp, Homo sapiens
ctctctgatcttgtgctcagcat

SEQ ID NO: 1584439 - DNA, 19 bp, Homo sapiens
ctctctgcagccagcccag

SEQ ID NO: 1584440 - DNA, 12 bp, Homo sapiens
ctctctgccctg

SEQ ID NO: 1584441 - DNA, 15 bp, Homo sapiens
ctctctgccctgtgt

SEQ ID NO: 1584442 - DNA, 16 bp, Homo sapiens
ctctctgccctgtgta

SEQ ID NO: 1584443 - DNA, 17 bp, Homo sapiens
ctctctgcccttgatca

SEQ ID NO: 1584444 - DNA, 12 bp, Homo sapiens
ctctctgcctga

SEQ ID NO: 1584445 - DNA, 14 bp, Homo sapiens
ctctctgcctgtga

SEQ ID NO: 1584446 - DNA, 15 bp, Homo sapiens
ctctctgcctgtgag

SEQ ID NO: 1584447 - DNA, 18 bp, Homo sapiens
ctctctgcctgtgagcca

SEQ ID NO: 1584448 - DNA, 20 bp, Homo sapiens
ctctctgcctgtgagccagt

SEQ ID NO: 1584449 - DNA, 14 bp, Homo sapiens
ctctctgctccttc

SEQ ID NO: 1584450 - DNA, 18 bp, Homo sapiens
ctctctgctccttcactg

SEQ ID NO: 1584451 - DNA, 14 bp, Homo sapiens
ctctctgctctagc

SEQ ID NO: 1584452 - DNA, 13 bp, Homo sapiens
ctctctgctggca

SEQ ID NO: 1584453 - DNA, 12 bp, Homo sapiens
ctctctggagcc

SEQ ID NO: 1584454 - DNA, 20 bp, Homo sapiens
ctctctggagcccctcctcc

SEQ ID NO: 1584455 - DNA, 14 bp, Homo sapiens
ctctctggcttctc

SEQ ID NO: 1584456 - DNA, 15 bp, Homo sapiens
ctctctggcttctct

SEQ ID NO: 1584457 - DNA, 16 bp, Homo sapiens
ctctctggcttctctc

SEQ ID NO: 1584458 - DNA, 20 bp, Homo sapiens
ctctctggcttctctctttt

SEQ ID NO: 1584459 - DNA, 23 bp, Homo sapiens
ctctctggcttctctcttttcct

SEQ ID NO: 1584460 - DNA, 17 bp, Homo sapiens
ctctctgggacctcctt

SEQ ID NO: 1584461 - DNA, 21 bp, Homo sapiens
ctctctgggactctcctcctc

SEQ ID NO: 1584462 - DNA, 12 bp, Homo sapiens
ctctctgggcct

SEQ ID NO: 1584463 - DNA, 12 bp, Homo sapiens
ctctctgggctg

SEQ ID NO: 1584464 - DNA, 21 bp, Homo sapiens
ctctctgggtcagaaccagag

SEQ ID NO: 1584465 - DNA, 23 bp, Homo sapiens
ctctctgtcccttgctgtatgct

SEQ ID NO: 1584466 - DNA, 13 bp, Homo sapiens
ctctctgtggggc

SEQ ID NO: 1584467 - DNA, 18 bp, Homo sapiens
ctctcttcaatctctgga

SEQ ID NO: 1584468 - DNA, 23 bp, Homo sapiens
ctctcttcaggaggccctggtgt

SEQ ID NO: 1584469 - DNA, 14 bp, Homo sapiens
ctctcttccccttc

SEQ ID NO: 1584470 - DNA, 19 bp, Homo sapiens
ctctcttccccttccctta

SEQ ID NO: 1584471 - DNA, 12 bp, Homo sapiens
ctctcttcctgt

SEQ ID NO: 1584472 - DNA, 16 bp, Homo sapiens
ctctcttctctccagc

SEQ ID NO: 1584473 - DNA, 14 bp, Homo sapiens
ctctcttctgctcc

SEQ ID NO: 1584474 - DNA, 18 bp, Homo sapiens
ctctcttctgctccaccc

SEQ ID NO: 1584475 - DNA, 13 bp, Homo sapiens
ctctcttgcaccc

SEQ ID NO: 1584476 - DNA, 20 bp, Homo sapiens
ctctcttgtgacgtgcactg

SEQ ID NO: 1584477 - DNA, 21 bp, Homo sapiens
ctctcttgtgacgtgcactgt

SEQ ID NO: 1584478 - DNA, 22 bp, Homo sapiens
ctctcttgtgacgtgcactgtg

SEQ ID NO: 1584479 - DNA, 11 bp, Homo sapiens
ctctctttcct

SEQ ID NO: 1584480 - DNA, 17 bp, Homo sapiens
ctctctttcctccaccc

SEQ ID NO: 1584481 - DNA, 18 bp, Homo sapiens
ctctctttccttgagctg

SEQ ID NO: 1584482 - DNA, 12 bp, Homo sapiens
ctctcttttcct

SEQ ID NO: 1584483 - DNA, 14 bp, Homo sapiens
ctctcttttcctcc

SEQ ID NO: 1584484 - DNA, 20 bp, Homo sapiens
ctctcttttcctcctccacc

SEQ ID NO: 1584485 - DNA, 12 bp, Homo sapiens
ctctcttttgtt

SEQ ID NO: 1584486 - DNA, 22 bp, Homo sapiens
ctctgaaaagcaattgccctgt

SEQ ID NO: 1584487 - DNA, 23 bp, Homo sapiens
ctctgaaaagcaattgccctgta

SEQ ID NO: 1584488 - DNA, 22 bp, Homo sapiens
ctctgaaatctgaagacctcga

SEQ ID NO: 1584489 - DNA, 23 bp, Homo sapiens
ctctgaaatcttcccatgcattc

SEQ ID NO: 1584490 - DNA, 15 bp, Homo sapiens
ctctgaacttgcctt

SEQ ID NO: 1584491 - DNA, 21 bp, Homo sapiens
ctctgaagagtgggtttcaca

SEQ ID NO: 1584492 - DNA, 22 bp, Homo sapiens
ctctgaataaatacccattgaa

SEQ ID NO: 1584493 - DNA, 15 bp, Homo sapiens
ctctgaatattttgt

SEQ ID NO: 1584494 - DNA, 22 bp, Homo sapiens
ctctgaatttatctttgataac

SEQ ID NO: 1584495 - DNA, 16 bp, Homo sapiens
ctctgacaagggctga

SEQ ID NO: 1584496 - DNA, 22 bp, Homo sapiens
ctctgacagtccacaggggcca

SEQ ID NO: 1584497 - DNA, 16 bp, Homo sapiens
ctctgacatcccttcc

SEQ ID NO: 1584498 - DNA, 14 bp, Homo sapiens
ctctgacctttcat

SEQ ID NO: 1584499 - DNA, 18 bp, Homo sapiens
ctctgacgcttgtgacag

SEQ ID NO: 1584500 - DNA, 19 bp, Homo sapiens
ctctgacttaagcaaaaga

SEQ ID NO: 1584501 - DNA, 20 bp, Homo sapiens
ctctgacttaagcaaaagaa

SEQ ID NO: 1584502 - DNA, 14 bp, Homo sapiens
ctctgacttctgcc

SEQ ID NO: 1584503 - DNA, 15 bp, Homo sapiens
ctctgacttctgcct

SEQ ID NO: 1584504 - DNA, 17 bp, Homo sapiens
ctctgacttctgcctgg

SEQ ID NO: 1584505 - DNA, 13 bp, Homo sapiens
ctctgagaatcac

SEQ ID NO: 1584506 - DNA, 16 bp, Homo sapiens
ctctgagccacagtgg

SEQ ID NO: 1584507 - DNA, 17 bp, Homo sapiens
ctctgagcccaggccgt

SEQ ID NO: 1584508 - DNA, 19 bp, Homo sapiens
ctctgagcccatacttttg

SEQ ID NO: 1584509 - DNA, 13 bp, Homo sapiens
ctctgagcgcctc

SEQ ID NO: 1584510 - DNA, 18 bp, Homo sapiens
ctctgaggacagagcttg

SEQ ID NO: 1584511 - DNA, 15 bp, Homo sapiens
ctctgaggtgcctgt

SEQ ID NO: 1584512 - DNA, 16 bp, Homo sapiens
ctctgagtcaaatcca

SEQ ID NO: 1584513 - DNA, 20 bp, Homo sapiens
ctctgagtcaaatccagtgg

SEQ ID NO: 1584514 - DNA, 21 bp, Homo sapiens
ctctgagtttaccatttgtaa

SEQ ID NO: 1584515 - DNA, 17 bp, Homo sapiens
ctctgagtttatctgtg

SEQ ID NO: 1584516 - DNA, 21 bp, Homo sapiens
ctctgatatgggactgagcct

SEQ ID NO: 1584517 - DNA, 19 bp, Homo sapiens
ctctgatattccatgaatg

SEQ ID NO: 1584518 - DNA, 23 bp, Homo sapiens
ctctgatattccatgaatgtatc

SEQ ID NO: 1584519 - DNA, 17 bp, Homo sapiens
ctctgatcacatcccct

SEQ ID NO: 1584520 - DNA, 21 bp, Homo sapiens
ctctgatcacattcttcaaag

SEQ ID NO: 1584521 - DNA, 13 bp, Homo sapiens
ctctgatcttgtg

SEQ ID NO: 1584522 - DNA, 17 bp, Homo sapiens
ctctgatcttgtgctca

SEQ ID NO: 1584523 - DNA, 22 bp, Homo sapiens
ctctgatggttcttcacctcct

SEQ ID NO: 1584524 - DNA, 13 bp, Homo sapiens
ctctgattcacct

SEQ ID NO: 1584525 - DNA, 16 bp, Homo sapiens
ctctgattcacctctt

SEQ ID NO: 1584526 - DNA, 19 bp, Homo sapiens
ctctgattcacctcttcct

SEQ ID NO: 1584527 - DNA, 18 bp, Homo sapiens
ctctgcaagacagaaacc

SEQ ID NO: 1584528 - DNA, 15 bp, Homo sapiens
ctctgcaattcccct

SEQ ID NO: 1584529 - DNA, 17 bp, Homo sapiens
ctctgcaattcccctct

SEQ ID NO: 1584530 - DNA, 18 bp, Homo sapiens
ctctgcaattcccctctg

SEQ ID NO: 1584531 - DNA, 20 bp, Homo sapiens
ctctgcaattcccctctgct

SEQ ID NO: 1584532 - DNA, 10 bp, Homo sapiens
ctctgcacag

SEQ ID NO: 1584533 - DNA, 17 bp, Homo sapiens
ctctgcacagacaagca

SEQ ID NO: 1584534 - DNA, 14 bp, Homo sapiens
ctctgcacagatgg

SEQ ID NO: 1584535 - DNA, 14 bp, Homo sapiens
ctctgcacatgtct

SEQ ID NO: 1584536 - DNA, 14 bp, Homo sapiens
ctctgcacccagaa

SEQ ID NO: 1584537 - DNA, 15 bp, Homo sapiens
ctctgcacccagaac

SEQ ID NO: 1584538 - DNA, 14 bp, Homo sapiens
ctctgcacccagtg

SEQ ID NO: 1584539 - DNA, 16 bp, Homo sapiens
ctctgcacccgcctcg

SEQ ID NO: 1584540 - DNA, 20 bp, Homo sapiens
ctctgcacccttatcatggg

SEQ ID NO: 1584541 - DNA, 13 bp, Homo sapiens
ctctgcactactc

SEQ ID NO: 1584542 - DNA, 23 bp, Homo sapiens
ctctgcactactcctctgcagtg

SEQ ID NO: 1584543 - DNA, 16 bp, Homo sapiens
ctctgcactactgaca

SEQ ID NO: 1584544 - DNA, 18 bp, Homo sapiens
ctctgcactactgacatg

SEQ ID NO: 1584545 - DNA, 20 bp, Homo sapiens
ctctgcactactgacatgtg

SEQ ID NO: 1584546 - DNA, 19 bp, Homo sapiens
ctctgcactccatggccac

SEQ ID NO: 1584547 - DNA, 21 bp, Homo sapiens
ctctgcactccatggccaccc

SEQ ID NO: 1584548 - DNA, 19 bp, Homo sapiens
ctctgcactcccacctgac

SEQ ID NO: 1584549 - DNA, 17 bp, Homo sapiens
ctctgcagacttcccag

SEQ ID NO: 1584550 - DNA, 18 bp, Homo sapiens
ctctgcagacttcccagc

SEQ ID NO: 1584551 - DNA, 13 bp, Homo sapiens
ctctgcagccagc

SEQ ID NO: 1584552 - DNA, 19 bp, Homo sapiens
ctctgcagccagcccagcc

SEQ ID NO: 1584553 - DNA, 14 bp, Homo sapiens
ctctgcagctgacc

SEQ ID NO: 1584554 - DNA, 16 bp, Homo sapiens
ctctgcagctgacctc

SEQ ID NO: 1584555 - DNA, 18 bp, Homo sapiens
ctctgcagctgacctctg

SEQ ID NO: 1584556 - DNA, 14 bp, Homo sapiens
ctctgcagctgccg

SEQ ID NO: 1584557 - DNA, 19 bp, Homo sapiens
ctctgcagtacttgatgta

SEQ ID NO: 1584558 - DNA, 17 bp, Homo sapiens
ctctgcagtctcatttc

SEQ ID NO: 1584559 - DNA, 19 bp, Homo sapiens
ctctgcagtctcatttctc

SEQ ID NO: 1584560 - DNA, 14 bp, Homo sapiens
ctctgcattctagt

SEQ ID NO: 1584561 - DNA, 18 bp, Homo sapiens
ctctgccaccctacctgt

SEQ ID NO: 1584562 - DNA, 14 bp, Homo sapiens
ctctgccacctccc

SEQ ID NO: 1584563 - DNA, 18 bp, Homo sapiens
ctctgccacctcccctat

SEQ ID NO: 1584564 - DNA, 14 bp, Homo sapiens
ctctgccagtgaca

SEQ ID NO: 1584565 - DNA, 15 bp, Homo sapiens
ctctgccagtgacag

SEQ ID NO: 1584566 - DNA, 16 bp, Homo sapiens
ctctgccatgtggcag

SEQ ID NO: 1584567 - DNA, 17 bp, Homo sapiens
ctctgcccagccgggca

SEQ ID NO: 1584568 - DNA, 13 bp, Homo sapiens
ctctgcccagctt

SEQ ID NO: 1584569 - DNA, 14 bp, Homo sapiens
ctctgcccagcttg

SEQ ID NO: 1584570 - DNA, 20 bp, Homo sapiens
ctctgccccaagcagccagc

SEQ ID NO: 1584571 - DNA, 22 bp, Homo sapiens
ctctgccccaagcagccagcca

SEQ ID NO: 1584572 - DNA, 14 bp, Homo sapiens
ctctgccccaagcc

SEQ ID NO: 1584573 - DNA, 22 bp, Homo sapiens
ctctgccccaatcgggtccaga

SEQ ID NO: 1584574 - DNA, 23 bp, Homo sapiens
ctctgccccaatcgggtccagag

SEQ ID NO: 1584575 - DNA, 11 bp, Homo sapiens
ctctgccccag

SEQ ID NO: 1584576 - DNA, 15 bp, Homo sapiens
ctctgccccagcctg

SEQ ID NO: 1584577 - DNA, 17 bp, Homo sapiens
ctctgccccagctctgg

SEQ ID NO: 1584578 - DNA, 15 bp, Homo sapiens
ctctgccccaggccc

SEQ ID NO: 1584579 - DNA, 23 bp, Homo sapiens
ctctgcccccgcgggttctagac

SEQ ID NO: 1584580 - DNA, 12 bp, Homo sapiens
ctctgccctctg

SEQ ID NO: 1584581 - DNA, 17 bp, Homo sapiens
ctctgccctctgctgct

SEQ ID NO: 1584582 - DNA, 15 bp, Homo sapiens
ctctgccctgcccta

SEQ ID NO: 1584583 - DNA, 16 bp, Homo sapiens
ctctgccctgccctag

SEQ ID NO: 1584584 - DNA, 23 bp, Homo sapiens
ctctgccctgccctagctccaca

SEQ ID NO: 1584585 - DNA, 14 bp, Homo sapiens
ctctgccctggatt

SEQ ID NO: 1584586 - DNA, 16 bp, Homo sapiens
ctctgccctggattgg

SEQ ID NO: 1584587 - DNA, 19 bp, Homo sapiens
ctctgcccttgttccctag

SEQ ID NO: 1584588 - DNA, 14 bp, Homo sapiens
ctctgccgctacct

SEQ ID NO: 1584589 - DNA, 21 bp, Homo sapiens
ctctgccgctacctccctccc

SEQ ID NO: 1584590 - DNA, 21 bp, Homo sapiens
ctgaactcctgccatagtctt

SEQ ID NO: 1584591 - DNA, 23 bp, Homo sapiens
ctgaactcttcagaacacacaga

SEQ ID NO: 1584592 - DNA, 13 bp, Homo sapiens
ctgaactgaacac

SEQ ID NO: 1584593 - DNA, 12 bp, Homo sapiens
ctgaactgagcc

SEQ ID NO: 1584594 - DNA, 13 bp, Homo sapiens
ctgaactgagcct

SEQ ID NO: 1584595 - DNA, 17 bp, Homo sapiens
ctgaactgaggccttgt

SEQ ID NO: 1584596 - DNA, 18 bp, Homo sapiens
ctgaactgaggccttgtg

SEQ ID NO: 1584597 - DNA, 13 bp, Homo sapiens
ctgaactgtgcat

SEQ ID NO: 1584598 - DNA, 13 bp, Homo sapiens
ctgaactgttaca

SEQ ID NO: 1584599 - DNA, 15 bp, Homo sapiens
ctgaagaaccagtcc

SEQ ID NO: 1584600 - DNA, 22 bp, Homo sapiens
ctgaagaaccagtccccccacc

SEQ ID NO: 1584601 - DNA, 21 bp, Homo sapiens
ctgaagaagtcactgaacaaa

SEQ ID NO: 1584602 - DNA, 17 bp, Homo sapiens
ctgaagaattaagatac

SEQ ID NO: 1584603 - DNA, 18 bp, Homo sapiens
ctgaagaattgaaaagtt

SEQ ID NO: 1584604 - DNA, 16 bp, Homo sapiens
ctgaagacctcgagca

SEQ ID NO: 1584605 - DNA, 21 bp, Homo sapiens
ctgaagagaagggcagggctg

SEQ ID NO: 1584606 - DNA, 20 bp, Homo sapiens
ctgaagagctattatataaa

SEQ ID NO: 1584607 - DNA, 14 bp, Homo sapiens
ctgaagaggcgggc

SEQ ID NO: 1584608 - DNA, 23 bp, Homo sapiens
ctgaagaggcgggccagccaggc

SEQ ID NO: 1584609 - DNA, 20 bp, Homo sapiens
ctgaagagtatccttccttc

SEQ ID NO: 1584610 - DNA, 19 bp, Homo sapiens
ctgaagatctaaacttttg

SEQ ID NO: 1584611 - DNA, 16 bp, Homo sapiens
ctgaagattaggcaca

SEQ ID NO: 1584612 - DNA, 22 bp, Homo sapiens
ctgaagattcttaaaaattgaa

SEQ ID NO: 1584613 - DNA, 14 bp, Homo sapiens
ctgaagcagcctct

SEQ ID NO: 1584614 - DNA, 15 bp, Homo sapiens
ctgaagccctcccag

SEQ ID NO: 1584615 - DNA, 22 bp, Homo sapiens
ctgaagcctggattccagcagt

SEQ ID NO: 1584616 - DNA, 12 bp, Homo sapiens
ctgaagctgctg

SEQ ID NO: 1584617 - DNA, 19 bp, Homo sapiens
ctgaagctgctgcagccct

SEQ ID NO: 1584618 - DNA, 22 bp, Homo sapiens
ctgaagctgctgcagccctgcc

SEQ ID NO: 1584619 - DNA, 17 bp, Homo sapiens
ctgaagctggagcagcg

SEQ ID NO: 1584620 - DNA, 15 bp, Homo sapiens
ctgaagcttgactcc

SEQ ID NO: 1584621 - DNA, 16 bp, Homo sapiens
ctgaaggaaaaacaca

SEQ ID NO: 1584622 - DNA, 17 bp, Homo sapiens
ctgaaggaaaagcaaga

SEQ ID NO: 1584623 - DNA, 23 bp, Homo sapiens
ctgaaggaaaagcaagaaacagt

SEQ ID NO: 1584624 - DNA, 17 bp, Homo sapiens
ctgaaggaatagccaga

SEQ ID NO: 1584625 - DNA, 23 bp, Homo sapiens
ctgaaggaatagccagagaggag

SEQ ID NO: 1584626 - DNA, 18 bp, Homo sapiens
ctgaaggacacttcctgc

SEQ ID NO: 1584627 - DNA, 16 bp, Homo sapiens
ctgaaggcaacctgga

SEQ ID NO: 1584628 - DNA, 18 bp, Homo sapiens
ctgaaggcaacctggaag

SEQ ID NO: 1584629 - DNA, 11 bp, Homo sapiens
ctgaaggcagt

SEQ ID NO: 1584630 - DNA, 16 bp, Homo sapiens
ctgaaggcagtggcag

SEQ ID NO: 1584631 - DNA, 17 bp, Homo sapiens
ctgaaggcagtggcagg

SEQ ID NO: 1584632 - DNA, 21 bp, Homo sapiens
ctgaaggcagtggcaggggag

SEQ ID NO: 1584633 - DNA, 15 bp, Homo sapiens
ctgaagggaactaga

SEQ ID NO: 1584634 - DNA, 14 bp, Homo sapiens
ctgaagggaccccc

SEQ ID NO: 1584635 - DNA, 21 bp, Homo sapiens
ctgaaggggcacaccactgcc

SEQ ID NO: 1584636 - DNA, 15 bp, Homo sapiens
ctgaaggggccatga

SEQ ID NO: 1584637 - DNA, 19 bp, Homo sapiens
ctgaaggggccatgatggc

SEQ ID NO: 1584638 - DNA, 18 bp, Homo sapiens
ctgaaggggtgcacccac

SEQ ID NO: 1584639 - DNA, 22 bp, Homo sapiens
ctgaaggggtgcacccacctgt

SEQ ID NO: 1584640 - DNA, 19 bp, Homo sapiens
ctgaaggtaaaattgaaag

SEQ ID NO: 1584641 - DNA, 20 bp, Homo sapiens
ctgaaggtcaataaattatt

SEQ ID NO: 1584642 - DNA, 17 bp, Homo sapiens
ctgaaggtcccctggca

SEQ ID NO: 1584643 - DNA, 19 bp, Homo sapiens
ctgaaggtcccctggcagt

SEQ ID NO: 1584644 - DNA, 17 bp, Homo sapiens
ctgaagtagtgtgcagt

SEQ ID NO: 1584645 - DNA, 22 bp, Homo sapiens
ctgaagtcactgcacagtgcat

SEQ ID NO: 1584646 - DNA, 18 bp, Homo sapiens
ctgaagtcttctcctcca

SEQ ID NO: 1584647 - DNA, 18 bp, Homo sapiens
ctgaagtcttttctgtca

SEQ ID NO: 1584648 - DNA, 18 bp, Homo sapiens
ctgaagtgagcacagcct

SEQ ID NO: 1584649 - DNA, 21 bp, Homo sapiens
ctgaagtgagcacagcctagg

SEQ ID NO: 1584650 - DNA, 20 bp, Homo sapiens
ctgaagtggctggtagaaaa

SEQ ID NO: 1584651 - DNA, 16 bp, Homo sapiens
ctgaagttaacagaga

SEQ ID NO: 1584652 - DNA, 14 bp, Homo sapiens
ctgaagttatgtgt

SEQ ID NO: 1584653 - DNA, 13 bp, Homo sapiens
ctgaataaagcaa

SEQ ID NO: 1584654 - DNA, 14 bp, Homo sapiens
ctgaataaatggta

SEQ ID NO: 1584655 - DNA, 17 bp, Homo sapiens
ctgaataaatggtagta

SEQ ID NO: 1584656 - DNA, 17 bp, Homo sapiens
ctgaatacaagcctatg

SEQ ID NO: 1584657 - DNA, 18 bp, Homo sapiens
ctgaatacattctgcttt

SEQ ID NO: 1584658 - DNA, 15 bp, Homo sapiens
ctgaatagatatgaa

SEQ ID NO: 1584659 - DNA, 14 bp, Homo sapiens
ctgaatattctaga

SEQ ID NO: 1584660 - DNA, 16 bp, Homo sapiens
ctgaatatttatattt

SEQ ID NO: 1584661 - DNA, 21 bp, Homo sapiens
ctgaatatttatatttcacta

SEQ ID NO: 1584662 - DNA, 14 bp, Homo sapiens
ctgaatattttgta

SEQ ID NO: 1584663 - DNA, 14 bp, Homo sapiens
ctgaatcagctgct

SEQ ID NO: 1584664 - DNA, 19 bp, Homo sapiens
ctgaatccaaactaatcca

SEQ ID NO: 1584665 - DNA, 17 bp, Homo sapiens
ctgaatgaaatatcaga

SEQ ID NO: 1584666 - DNA, 18 bp, Homo sapiens
ctgaatgaagctgccatc

SEQ ID NO: 1584667 - DNA, 19 bp, Homo sapiens
ctgaatgaatccattggag

SEQ ID NO: 1584668 - DNA, 21 bp, Homo sapiens
ctgaatgccccctgcttactt

SEQ ID NO: 1584669 - DNA, 18 bp, Homo sapiens
ctgaatgcctcgctccct

SEQ ID NO: 1584670 - DNA, 14 bp, Homo sapiens
ctgaatgctgccac

SEQ ID NO: 1584671 - DNA, 17 bp, Homo sapiens
ctgaatgcttctgagag

SEQ ID NO: 1584672 - DNA, 19 bp, Homo sapiens
ctgaatgggaccctgttga

SEQ ID NO: 1584673 - DNA, 21 bp, Homo sapiens
ctgaatgggagccagaattca

SEQ ID NO: 1584674 - DNA, 14 bp, Homo sapiens
ctgaattaaataaa

SEQ ID NO: 1584675 - DNA, 15 bp, Homo sapiens
ctgaattaaataaat

SEQ ID NO: 1584676 - DNA, 20 bp, Homo sapiens
ctgaattaatgacagagcca

SEQ ID NO: 1584677 - DNA, 14 bp, Homo sapiens
ctgaattacagtga

SEQ ID NO: 1584678 - DNA, 23 bp, Homo sapiens
ctgaattacagtgaaattttggt

SEQ ID NO: 1584679 - DNA, 17 bp, Homo sapiens
ctgaattatctatttca

SEQ ID NO: 1584680 - DNA, 22 bp, Homo sapiens
ctgaattcacttaagtttttcc

SEQ ID NO: 1584681 - DNA, 23 bp, Homo sapiens
ctgaattctatttgctgggcttt

SEQ ID NO: 1584682 - DNA, 18 bp, Homo sapiens
ctgaattgctatgtgaaa

SEQ ID NO: 1584683 - DNA, 13 bp, Homo sapiens
ctgaattggaagg

SEQ ID NO: 1584684 - DNA, 14 bp, Homo sapiens
ctgaattggaaggg

SEQ ID NO: 1584685 - DNA, 15 bp, Homo sapiens
ctgaattgtccccag

SEQ ID NO: 1584686 - DNA, 15 bp, Homo sapiens
ctgaatttaactact

SEQ ID NO: 1584687 - DNA, 17 bp, Homo sapiens
ctgaatttatctttgat

SEQ ID NO: 1584688 - DNA, 18 bp, Homo sapiens
ctgaatttatctttgata

SEQ ID NO: 1584689 - DNA, 13 bp, Homo sapiens
ctgaatttccctc

SEQ ID NO: 1584690 - DNA, 17 bp, Homo sapiens
ctgaattttgcaatgta

SEQ ID NO: 1584691 - DNA, 20 bp, Homo sapiens
ctgaattttgcaatgtattt

SEQ ID NO: 1584692 - DNA, 16 bp, Homo sapiens
ctgaattttgggactt

SEQ ID NO: 1584693 - DNA, 19 bp, Homo sapiens
ctgaatttttttgtaataa

SEQ ID NO: 1584694 - DNA, 20 bp, Homo sapiens
ctgaatttttttgtaataag

SEQ ID NO: 1584695 - DNA, 18 bp, Homo sapiens
ctgacaaaaagtttccat

SEQ ID NO: 1584696 - DNA, 21 bp, Homo sapiens
ctgacaaaggtggtaaattca

SEQ ID NO: 1584697 - DNA, 20 bp, Homo sapiens
ctgacaaccactggtctgta

SEQ ID NO: 1584698 - DNA, 18 bp, Homo sapiens
ctgacaacttagctcagg

SEQ ID NO: 1584699 - DNA, 21 bp, Homo sapiens
ctgacaacttagctcaggtgc

SEQ ID NO: 1584700 - DNA, 13 bp, Homo sapiens
ctgacaacttgaa

SEQ ID NO: 1584701 - DNA, 14 bp, Homo sapiens
ctgacaagccatct

SEQ ID NO: 1584702 - DNA, 13 bp, Homo sapiens
ctgacaagggctg

SEQ ID NO: 1584703 - DNA, 14 bp, Homo sapiens
ctgacaataaagat

SEQ ID NO: 1584704 - DNA, 18 bp, Homo sapiens
ctgacaatggcagctaga

SEQ ID NO: 1584705 - DNA, 22 bp, Homo sapiens
ctgacaatggcagctagactgg

SEQ ID NO: 1584706 - DNA, 18 bp, Homo sapiens
ctgacacaaaaagtagat

SEQ ID NO: 1584707 - DNA, 17 bp, Homo sapiens
ctgacacaccaggcgct

SEQ ID NO: 1584708 - DNA, 19 bp, Homo sapiens
ctgacacaccaggcgctaa

SEQ ID NO: 1584709 - DNA, 16 bp, Homo sapiens
ctgacacactaaccaa

SEQ ID NO: 1584710 - DNA, 10 bp, Homo sapiens
ctgacacagg

SEQ ID NO: 1584711 - DNA, 21 bp, Homo sapiens
ctgacacaggaaaccaacacc

SEQ ID NO: 1584712 - DNA, 13 bp, Homo sapiens
ctgacaccccctc

SEQ ID NO: 1584713 - DNA, 14 bp, Homo sapiens
ctgacaccccctcc

SEQ ID NO: 1584714 - DNA, 17 bp, Homo sapiens
ctgacaccctggtcctg

SEQ ID NO: 1584715 - DNA, 18 bp, Homo sapiens
ctgacaccgtccctcagt

SEQ ID NO: 1584716 - DNA, 16 bp, Homo sapiens
ctgacacgcagcctgc

SEQ ID NO: 1584717 - DNA, 19 bp, Homo sapiens
ctgacacgcagcctgctct

SEQ ID NO: 1584718 - DNA, 20 bp, Homo sapiens
ctgacactaccttatcaggc

SEQ ID NO: 1584719 - DNA, 19 bp, Homo sapiens
ctgacagaaagattttcct

SEQ ID NO: 1584720 - DNA, 12 bp, Homo sapiens
ctgacagaggag

SEQ ID NO: 1584721 - DNA, 18 bp, Homo sapiens
ctgacagattgacaggga

SEQ ID NO: 1584722 - DNA, 11 bp, Homo sapiens
ctgacagattt

SEQ ID NO: 1584723 - DNA, 21 bp, Homo sapiens
ctgacagggacatgccctgtg

SEQ ID NO: 1584724 - DNA, 16 bp, Homo sapiens
ctgacagggagcagcc

SEQ ID NO: 1584725 - DNA, 16 bp, Homo sapiens
ctgacagtcagctgtg

SEQ ID NO: 1584726 - DNA, 17 bp, Homo sapiens
ctgacagtcagctgtgg

SEQ ID NO: 1584727 - DNA, 19 bp, Homo sapiens
ctgacagtcagctgtgggg

SEQ ID NO: 1584728 - DNA, 13 bp, Homo sapiens
ctgacagtccaca

SEQ ID NO: 1584729 - DNA, 19 bp, Homo sapiens
ctgacagtccacaggggcc

SEQ ID NO: 1584730 - DNA, 14 bp, Homo sapiens
ctgacatagagaaa

SEQ ID NO: 1584731 - DNA, 20 bp, Homo sapiens
ctgacatcaattttaccctg

SEQ ID NO: 1584732 - DNA, 13 bp, Homo sapiens
ctgacatcccttc

SEQ ID NO: 1584733 - DNA, 18 bp, Homo sapiens
ctgacatcccttcctgga

SEQ ID NO: 1584734 - DNA, 23 bp, Homo sapiens
ctgacatgaagctgttgtgtgag

SEQ ID NO: 1584735 - DNA, 15 bp, Homo sapiens
ctgacatgctcacac

SEQ ID NO: 1584736 - DNA, 14 bp, Homo sapiens
ctgacatttcttct

SEQ ID NO: 1584737 - DNA, 18 bp, Homo sapiens
ctgacatttcttctagtg

SEQ ID NO: 1584738 - DNA, 20 bp, Homo sapiens
ctgacatttgtttatttttt

SEQ ID NO: 1584739 - DNA, 19 bp, Homo sapiens
ctgaccaaagactgcagaa

SEQ ID NO: 1584740 - DNA, 13 bp, Homo sapiens
ctgaccaacaggc

SEQ ID NO: 1584741 - DNA, 16 bp, Homo sapiens
ctgaccaacatggaga

SEQ ID NO: 1584742 - DNA, 21 bp, Homo sapiens
ctgaccaagtgctggcccacc

SEQ ID NO: 1584743 - DNA, 14 bp, Homo sapiens
ctgaccaattgtgc

SEQ ID NO: 1584744 - DNA, 17 bp, Homo sapiens
ctgaccaattgtgctgc

SEQ ID NO: 1584745 - DNA, 18 bp, Homo sapiens
ctgaccaattgtgctgcc

SEQ ID NO: 1584746 - DNA, 21 bp, Homo sapiens
ctgaccaattgtgctgccatt

SEQ ID NO: 1584747 - DNA, 22 bp, Homo sapiens
ctgaccaattgtgctgccattt

SEQ ID NO: 1584748 - DNA, 21 bp, Homo sapiens
ctgaccacaccaaccaggcct

SEQ ID NO: 1584749 - DNA, 14 bp, Homo sapiens
ctgaccaccctccc

SEQ ID NO: 1584750 - DNA, 17 bp, Homo sapiens
ctgaccaccctcccctc

SEQ ID NO: 1584751 - DNA, 23 bp, Homo sapiens
ctgaccacggacgtttccatcag

SEQ ID NO: 1584752 - DNA, 13 bp, Homo sapiens
ctgaccagaacta

SEQ ID NO: 1584753 - DNA, 17 bp, Homo sapiens
ctgaccagcggctgctc

SEQ ID NO: 1584754 - DNA, 13 bp, Homo sapiens
ctgaccagctgct

SEQ ID NO: 1584755 - DNA, 16 bp, Homo sapiens
ctgaccagctgctccg

SEQ ID NO: 1584756 - DNA, 19 bp, Homo sapiens
ctgaccataatcctagccc

SEQ ID NO: 1584757 - DNA, 15 bp, Homo sapiens
ctgaccatccactct

SEQ ID NO: 1584758 - DNA, 13 bp, Homo sapiens
ctgaccatctgtg

SEQ ID NO: 1584759 - DNA, 18 bp, Homo sapiens
ctgaccatctgtgactat

SEQ ID NO: 1584760 - DNA, 23 bp, Homo sapiens
ctgacccaactgatcctgctcca

SEQ ID NO: 1584761 - DNA, 21 bp, Homo sapiens
ctgacccaagtggggcctcct

SEQ ID NO: 1584762 - DNA, 20 bp, Homo sapiens
ctgacccagagtggagtctg

SEQ ID NO: 1584763 - DNA, 22 bp, Homo sapiens
ctgacccagagtggagtctgag

SEQ ID NO: 1584764 - DNA, 23 bp, Homo sapiens
ctgacccagagtggagtctgagt

SEQ ID NO: 1584765 - DNA, 18 bp, Homo sapiens
ctgacccagcatctccca

SEQ ID NO: 1584766 - DNA, 21 bp, Homo sapiens
ctgacccagcatctcccagca

SEQ ID NO: 1584767 - DNA, 18 bp, Homo sapiens
ctgacccaggaccatcct

SEQ ID NO: 1584768 - DNA, 19 bp, Homo sapiens
ctgacccaggccgcagctc

SEQ ID NO: 1584769 - DNA, 23 bp, Homo sapiens
ctgacccaggccgcagctcttgc

SEQ ID NO: 1584770 - DNA, 10 bp, Homo sapiens
ctgacccagt

SEQ ID NO: 1584771 - DNA, 11 bp, Homo sapiens
ctgacccagtc

SEQ ID NO: 1584772 - DNA, 15 bp, Homo sapiens
ctgacccagtccctg

SEQ ID NO: 1584773 - DNA, 17 bp, Homo sapiens
ctgacccagtccctggg

SEQ ID NO: 1584774 - DNA, 18 bp, Homo sapiens
ctgacccagtgcccccac

SEQ ID NO: 1584775 - DNA, 17 bp, Homo sapiens
ctgaccccattcctgat

SEQ ID NO: 1584776 - DNA, 16 bp, Homo sapiens
ctgaccccctcccctg

SEQ ID NO: 1584777 - DNA, 20 bp, Homo sapiens
ctgaccccgagaagtgctct

SEQ ID NO: 1584778 - DNA, 22 bp, Homo sapiens
ctgaccccgagaagtgctcttg

SEQ ID NO: 1584779 - DNA, 20 bp, Homo sapiens
ctgaccccggtggcggcccc

SEQ ID NO: 1584780 - DNA, 19 bp, Homo sapiens
ctgacccctgcctgttggc

SEQ ID NO: 1584781 - DNA, 23 bp, Homo sapiens
ctgacccctgcctgttggcaggc

SEQ ID NO: 1584782 - DNA, 14 bp, Homo sapiens
ctgacccctgctca

SEQ ID NO: 1584783 - DNA, 17 bp, Homo sapiens
ctgaccctatgggtcta

SEQ ID NO: 1584784 - DNA, 13 bp, Homo sapiens
ctgaccctgggcc

SEQ ID NO: 1584785 - DNA, 18 bp, Homo sapiens
ctgaccctgggcctggag

SEQ ID NO: 1584786 - DNA, 19 bp, Homo sapiens
ctgaccctgggcctggagg

SEQ ID NO: 1584787 - DNA, 14 bp, Homo sapiens
ctgacccttccaga

SEQ ID NO: 1584788 - DNA, 21 bp, Homo sapiens
ctgaccgttaaaaaattcttg

SEQ ID NO: 1584789 - DNA, 20 bp, Homo sapiens
ctgacctaaaagttgaaaag

SEQ ID NO: 1584790 - DNA, 18 bp, Homo sapiens
ctgacctaccccagccag

SEQ ID NO: 1584791 - DNA, 20 bp, Homo sapiens
ctgacctaccccagccaggc

SEQ ID NO: 1584792 - DNA, 24 bp, Homo sapiens
ctgacctaccccagccaggctcct

SEQ ID NO: 1584793 - DNA, 17 bp, Homo sapiens
ctgacctcacctggtcc

SEQ ID NO: 1584794 - DNA, 12 bp, Homo sapiens
ctgacctcactg

SEQ ID NO: 1584795 - DNA, 18 bp, Homo sapiens
ctgacctcactgtcctgt

SEQ ID NO: 1584796 - DNA, 17 bp, Homo sapiens
ctgacctccgccatcca

SEQ ID NO: 1584797 - DNA, 19 bp, Homo sapiens
ctgacctccgccatccacc

SEQ ID NO: 1584798 - DNA, 19 bp, Homo sapiens
ctgacctgaccccattcct

SEQ ID NO: 1584799 - DNA, 19 bp, Homo sapiens
ctgacctgtcatgcccccc

SEQ ID NO: 1584800 - DNA, 20 bp, Homo sapiens
ctgacctgtcatgcccccct

SEQ ID NO: 1584801 - DNA, 22 bp, Homo sapiens
ctgaccttagcgttctggactc

SEQ ID NO: 1584802 - DNA, 21 bp, Homo sapiens
ctgaccttggagagacacagc

SEQ ID NO: 1584803 - DNA, 21 bp, Homo sapiens
ctgacctttgtcatctttctt

SEQ ID NO: 1584804 - DNA, 16 bp, Homo sapiens
ctgacgcaacccacgt

SEQ ID NO: 1584805 - DNA, 13 bp, Homo sapiens
ctgacgcttgtga

SEQ ID NO: 1584806 - DNA, 15 bp, Homo sapiens
ctgacgcttgtgaca

SEQ ID NO: 1584807 - DNA, 19 bp, Homo sapiens
ctgacgcttgtgacagtgc

SEQ ID NO: 1584808 - DNA, 21 bp, Homo sapiens
ctgacgcttgtgacagtgcct

SEQ ID NO: 1584809 - DNA, 22 bp, Homo sapiens
ctgacgcttgtgacagtgcctc

SEQ ID NO: 1584810 - DNA, 15 bp, Homo sapiens
ctgacggccagggag

SEQ ID NO: 1584811 - DNA, 20 bp, Homo sapiens
ctgacggcgcccccagtgtg

SEQ ID NO: 1584812 - DNA, 24 bp, Homo sapiens
ctgacgtcagtagtttgagaccag

SEQ ID NO: 1584813 - DNA, 22 bp, Homo sapiens
ctgacgtctgaagcttgactcc

SEQ ID NO: 1584814 - DNA, 14 bp, Homo sapiens
ctgacgtgcctttt

SEQ ID NO: 1584815 - DNA, 20 bp, Homo sapiens
ctgacgtgccttttgcaccc

SEQ ID NO: 1584816 - DNA, 14 bp, Homo sapiens
ctgactaaactttt

SEQ ID NO: 1584817 - DNA, 15 bp, Homo sapiens
ctgactaaacttttt

SEQ ID NO: 1584818 - DNA, 22 bp, Homo sapiens
ctgactaaactttttttctgta

SEQ ID NO: 1584819 - DNA, 18 bp, Homo sapiens
ctgactcaacatgttact

SEQ ID NO: 1584820 - DNA, 17 bp, Homo sapiens
ctgactcaattatttgc

SEQ ID NO: 1584821 - DNA, 21 bp, Homo sapiens
ctgactcaattatttgcatat

SEQ ID NO: 1584822 - DNA, 22 bp, Homo sapiens
ctgactcacacctgaactgaac

SEQ ID NO: 1584823 - DNA, 19 bp, Homo sapiens
ctgactcatccccacagct

SEQ ID NO: 1584824 - DNA, 13 bp, Homo sapiens
ctgactccagagt

SEQ ID NO: 1584825 - DNA, 14 bp, Homo sapiens
ctgactccagagtc

SEQ ID NO: 1584826 - DNA, 22 bp, Homo sapiens
ctgactccagagtctgagcccc

SEQ ID NO: 1584827 - DNA, 13 bp, Homo sapiens
ctgactccttaga

SEQ ID NO: 1584828 - DNA, 16 bp, Homo sapiens
ctgactcggtttctcc

SEQ ID NO: 1584829 - DNA, 17 bp, Homo sapiens
ctgactcggtttctcca

SEQ ID NO: 1584830 - DNA, 22 bp, Homo sapiens
ctgactctcgtgcatttcaact

SEQ ID NO: 1584831 - DNA, 14 bp, Homo sapiens
ctgactctctgtga

SEQ ID NO: 1584832 - DNA, 14 bp, Homo sapiens
ctgactctgaaatc

SEQ ID NO: 1584833 - DNA, 15 bp, Homo sapiens
ctgactcttattttt

SEQ ID NO: 1584834 - DNA, 22 bp, Homo sapiens
ctgactgaacattagttgcact

SEQ ID NO: 1584835 - DNA, 14 bp, Homo sapiens
ctgactgaaggaaa

SEQ ID NO: 1584836 - DNA, 12 bp, Homo sapiens
ctgactgagata

SEQ ID NO: 1584837 - DNA, 12 bp, Homo sapiens
ctgactgaggcc

SEQ ID NO: 1584838 - DNA, 13 bp, Homo sapiens
ctgactgaggcct

SEQ ID NO: 1584839 - DNA, 19 bp, Homo sapiens
ctgactgaggcctgcttcc

SEQ ID NO: 1584840 - DNA, 24 bp, Homo sapiens
ctgactgatagcttacactgagga

SEQ ID NO: 1584841 - DNA, 17 bp, Homo sapiens
ctgactgccaagccaga

SEQ ID NO: 1584842 - DNA, 16 bp, Homo sapiens
ctgactggtgctgcag

SEQ ID NO: 1584843 - DNA, 20 bp, Homo sapiens
ctgactggttaacagcagtc

SEQ ID NO: 1584844 - DNA, 13 bp, Homo sapiens
ctgactgtggccc

SEQ ID NO: 1584845 - DNA, 19 bp, Homo sapiens
ctgactgtggccccctccg

SEQ ID NO: 1584846 - DNA, 15 bp, Homo sapiens
ctgactgttcttggt

SEQ ID NO: 1584847 - DNA, 23 bp, Homo sapiens
ctgactgtttatttaaggatgga

SEQ ID NO: 1584848 - DNA, 18 bp, Homo sapiens
ctgacttaactttaactt

SEQ ID NO: 1584849 - DNA, 18 bp, Homo sapiens
ctgacttaagcaaaagaa

SEQ ID NO: 1584850 - DNA, 24 bp, Homo sapiens
ctgacttaagcaaaagaaaaagat

SEQ ID NO: 1584851 - DNA, 23 bp, Homo sapiens
ctgacttcagtgaatatttttgt

SEQ ID NO: 1584852 - DNA, 14 bp, Homo sapiens
ctgacttctgcctg

SEQ ID NO: 1584853 - DNA, 19 bp, Homo sapiens
ctgacttctgcctggagac

SEQ ID NO: 1584854 - DNA, 15 bp, Homo sapiens
ctgacttgagtgttc

SEQ ID NO: 1584855 - DNA, 22 bp, Homo sapiens
ctgacttgagtgttccttttta

SEQ ID NO: 1584856 - DNA, 23 bp, Homo sapiens
ctgacttggatcccaaagcaagg

SEQ ID NO: 1584857 - DNA, 14 bp, Homo sapiens
ctgacttggcactt

SEQ ID NO: 1584858 - DNA, 20 bp, Homo sapiens
ctgacttggggagatggagt

SEQ ID NO: 1584859 - DNA, 21 bp, Homo sapiens
ctgacttggggagatggagtt

SEQ ID NO: 1584860 - DNA, 21 bp, Homo sapiens
ctgactttctgattactgtcc

SEQ ID NO: 1584861 - DNA, 17 bp, Homo sapiens
ctgactttgcttgcttt

SEQ ID NO: 1584862 - DNA, 18 bp, Homo sapiens
ctgactttgcttgctttg

SEQ ID NO: 1584863 - DNA, 19 bp, Homo sapiens
ctgactttgcttgctttga

SEQ ID NO: 1584864 - DNA, 18 bp, Homo sapiens
ctgacttttccaaataaa

SEQ ID NO: 1584865 - DNA, 12 bp, Homo sapiens
ctgagaaagact

SEQ ID NO: 1584866 - DNA, 23 bp, Homo sapiens
ctgagaaagactattcaaacagt

SEQ ID NO: 1584867 - DNA, 23 bp, Homo sapiens
ctgagaacacgttgccaggggct

SEQ ID NO: 1584868 - DNA, 15 bp, Homo sapiens
ctgagaactgaattt

SEQ ID NO: 1584869 - DNA, 20 bp, Homo sapiens
ctgagaagaatgaaaatgca

SEQ ID NO: 1584870 - DNA, 23 bp, Homo sapiens
ctgagaaggtttggtccagcctg

SEQ ID NO: 1584871 - DNA, 22 bp, Homo sapiens
ctgagaatcacggtggtaaaga

SEQ ID NO: 1584872 - DNA, 20 bp, Homo sapiens
ctgagacaaatggaggcctg

SEQ ID NO: 1584873 - DNA, 14 bp, Homo sapiens
ctgagaccagttgg

SEQ ID NO: 1584874 - DNA, 19 bp, Homo sapiens
ctgagaccagttgggagca

SEQ ID NO: 1584875 - DNA, 22 bp, Homo sapiens
ctgagaccagttgggagcactg

SEQ ID NO: 1584876 - DNA, 21 bp, Homo sapiens
ctgagacccttttctcaggac

SEQ ID NO: 1584877 - DNA, 13 bp, Homo sapiens
ctgagacctcaat

SEQ ID NO: 1584878 - DNA, 19 bp, Homo sapiens
ctgagacctctagagaaaa

SEQ ID NO: 1584879 - DNA, 16 bp, Homo sapiens
ctgagactgctaagta

SEQ ID NO: 1584880 - DNA, 20 bp, Homo sapiens
ctgagactggcacttagccc

SEQ ID NO: 1584881 - DNA, 20 bp, Homo sapiens
ctgagactgggtaatttata

SEQ ID NO: 1584882 - DNA, 22 bp, Homo sapiens
ctgagactgggtaatttataaa

SEQ ID NO: 1584883 - DNA, 17 bp, Homo sapiens
ctgagactttcccctct

SEQ ID NO: 1584884 - DNA, 15 bp, Homo sapiens
ctgagagacccaagg

SEQ ID NO: 1584885 - DNA, 19 bp, Homo sapiens
ctgagagacccaaggagga

SEQ ID NO: 1584886 - DNA, 20 bp, Homo sapiens
ctgagagacccaaggaggaa

SEQ ID NO: 1584887 - DNA, 22 bp, Homo sapiens
ctgagagacctgccctctctgc

SEQ ID NO: 1584888 - DNA, 18 bp, Homo sapiens
ctgagagagaatagagct

SEQ ID NO: 1584889 - DNA, 23 bp, Homo sapiens
ctgagagagaatagagctgccac

SEQ ID NO: 1584890 - DNA, 15 bp, Homo sapiens
ctgagagcatctcag

SEQ ID NO: 1584891 - DNA, 17 bp, Homo sapiens
ctgagagcatctcagga

SEQ ID NO: 1584892 - DNA, 19 bp, Homo sapiens
ctgagagcatctcaggagg

SEQ ID NO: 1584893 - DNA, 20 bp, Homo sapiens
ctgagagccagatgcctccc

SEQ ID NO: 1584894 - DNA, 16 bp, Homo sapiens
ctgagagccccagctg

SEQ ID NO: 1584895 - DNA, 17 bp, Homo sapiens
ctgagagccccagctga

SEQ ID NO: 1584896 - DNA, 15 bp, Homo sapiens
ctgagaggcaggcat

SEQ ID NO: 1584897 - DNA, 17 bp, Homo sapiens
ctgagaggcaggcatag

SEQ ID NO: 1584898 - DNA, 14 bp, Homo sapiens
ctgagaggcctgga

SEQ ID NO: 1584899 - DNA, 15 bp, Homo sapiens
ctgagaggcctggag

SEQ ID NO: 1584900 - DNA, 14 bp, Homo sapiens
ctgagaggctctcc

SEQ ID NO: 1584901 - DNA, 18 bp, Homo sapiens
ctgagagtcagctctctg

SEQ ID NO: 1584902 - DNA, 14 bp, Homo sapiens
ctgagagtctagat

SEQ ID NO: 1584903 - DNA, 15 bp, Homo sapiens
ctgagagtctagatt

SEQ ID NO: 1584904 - DNA, 22 bp, Homo sapiens
ctgagagtggtgccctggaaca

SEQ ID NO: 1584905 - DNA, 15 bp, Homo sapiens
ctgagataagaaaag

SEQ ID NO: 1584906 - DNA, 20 bp, Homo sapiens
ctgagataagaaaagcctga

SEQ ID NO: 1584907 - DNA, 12 bp, Homo sapiens
ctgagatatgaa

SEQ ID NO: 1584908 - DNA, 15 bp, Homo sapiens
ctgagatatgaacat

SEQ ID NO: 1584909 - DNA, 21 bp, Homo sapiens
ctgagatatgaacatattgtt

SEQ ID NO: 1584910 - DNA, 14 bp, Homo sapiens
ctgagatcgtgccg

SEQ ID NO: 1584911 - DNA, 15 bp, Homo sapiens
ctgagatgagcccca

SEQ ID NO: 1584912 - DNA, 17 bp, Homo sapiens
ctgagattctttaagga

SEQ ID NO: 1584913 - DNA, 16 bp, Homo sapiens
ctgagattgtgtttgt

SEQ ID NO: 1584914 - DNA, 14 bp, Homo sapiens
ctgagatttcatct

SEQ ID NO: 1584915 - DNA, 20 bp, Homo sapiens
ctgagatttcatctgctctc

SEQ ID NO: 1584916 - DNA, 22 bp, Homo sapiens
ctgagcaaactatttgcgactc

SEQ ID NO: 1584917 - DNA, 16 bp, Homo sapiens
ctgagcaacagagtga

SEQ ID NO: 1584918 - DNA, 23 bp, Homo sapiens
ctgagcaacagagtgagaccctg

SEQ ID NO: 1584919 - DNA, 24 bp, Homo sapiens
ctgagcaacagagtgagaccctgt

SEQ ID NO: 1584920 - DNA, 18 bp, Homo sapiens
ctgagcaacatctcggga

SEQ ID NO: 1584921 - DNA, 13 bp, Homo sapiens
ctgagcacccgct

SEQ ID NO: 1584922 - DNA, 16 bp, Homo sapiens
ctgagcaccctctgga

SEQ ID NO: 1584923 - DNA, 20 bp, Homo sapiens
ctgagcaccgtgtcaagctg

SEQ ID NO: 1584924 - DNA, 13 bp, Homo sapiens
ctgagcacctccc

SEQ ID NO: 1584925 - DNA, 12 bp, Homo sapiens
ctgagcactgtt

SEQ ID NO: 1584926 - DNA, 12 bp, Homo sapiens
ctgagcacttag

SEQ ID NO: 1584927 - DNA, 15 bp, Homo sapiens
ctgagcacttagcag

SEQ ID NO: 1584928 - DNA, 19 bp, Homo sapiens
ctgagcagcctctgccagg

SEQ ID NO: 1584929 - DNA, 20 bp, Homo sapiens
ctgagcagcctctgccaggc

SEQ ID NO: 1584930 - DNA, 24 bp, Homo sapiens
ctgagcagcctctgccaggcctgt

SEQ ID NO: 1584931 - DNA, 16 bp, Homo sapiens
ctgagcagctggatct

SEQ ID NO: 1584932 - DNA, 16 bp, Homo sapiens
ctgagcaggattttaa

SEQ ID NO: 1584933 - DNA, 21 bp, Homo sapiens
ctgagcaggggaacaaaataa

SEQ ID NO: 1584934 - DNA, 23 bp, Homo sapiens
ctgagcaggggaacaaaataagg

SEQ ID NO: 1584935 - DNA, 15 bp, Homo sapiens
ctgagcagggtccac

SEQ ID NO: 1584936 - DNA, 17 bp, Homo sapiens
ctgagcagggtccacag

SEQ ID NO: 1584937 - DNA, 18 bp, Homo sapiens
ctgagcagggtccacagc

SEQ ID NO: 1584938 - DNA, 23 bp, Homo sapiens
ctgagcagggtccacagctggaa

SEQ ID NO: 1584939 - DNA, 18 bp, Homo sapiens
ctgagcatggggcgctcc

SEQ ID NO: 1584940 - DNA, 22 bp, Homo sapiens
ctgagccagggaacagccccag

SEQ ID NO: 1584941 - DNA, 23 bp, Homo sapiens
ctgagccagggaacagccccagg

SEQ ID NO: 1584942 - DNA, 15 bp, Homo sapiens
ctgagccatgaggag

SEQ ID NO: 1584943 - DNA, 16 bp, Homo sapiens
ctgagccatgaggagc

SEQ ID NO: 1584944 - DNA, 22 bp, Homo sapiens
ctgagcccaccagggacacctc

SEQ ID NO: 1584945 - DNA, 14 bp, Homo sapiens
ctgagcccaggccg

SEQ ID NO: 1584946 - DNA, 19 bp, Homo sapiens
ctgagcccaggccgttccc

SEQ ID NO: 1584947 - DNA, 15 bp, Homo sapiens
ctgagccccccatgc

SEQ ID NO: 1584948 - DNA, 20 bp, Homo sapiens
ctgagccccctgcacccacc

SEQ ID NO: 1584949 - DNA, 14 bp, Homo sapiens
ctgagcccctaccc

SEQ ID NO: 1584950 - DNA, 15 bp, Homo sapiens
ctgagcccctacccc

SEQ ID NO: 1584951 - DNA, 14 bp, Homo sapiens
ctgagcccctgggg

SEQ ID NO: 1584952 - DNA, 22 bp, Homo sapiens
ctgagcccgggctgcctgggct

SEQ ID NO: 1584953 - DNA, 23 bp, Homo sapiens
ctgagcccgggctgcctgggctg

SEQ ID NO: 1584954 - DNA, 13 bp, Homo sapiens
ctgagccctggca

SEQ ID NO: 1584955 - DNA, 14 bp, Homo sapiens
ctgagccctggcag

SEQ ID NO: 1584956 - DNA, 15 bp, Homo sapiens
ctgagccctggcagg

SEQ ID NO: 1584957 - DNA, 13 bp, Homo sapiens
ctgagccctggtg

SEQ ID NO: 1584958 - DNA, 18 bp, Homo sapiens
ctgagccctggtgtgttt

SEQ ID NO: 1584959 - DNA, 23 bp, Homo sapiens
ctgagccggccccaggctcgtgg

SEQ ID NO: 1584960 - DNA, 14 bp, Homo sapiens
ctgagcctcacttg

SEQ ID NO: 1584961 - DNA, 18 bp, Homo sapiens
ctgagcctgcagggaagc

SEQ ID NO: 1584962 - DNA, 11 bp, Homo sapiens
ctgagcctggc

SEQ ID NO: 1584963 - DNA, 19 bp, Homo sapiens
ctgagcctggcccatagaa

SEQ ID NO: 1584964 - DNA, 22 bp, Homo sapiens
ctgagcctggcccatagaaaca

SEQ ID NO: 1584965 - DNA, 16 bp, Homo sapiens
ctgagccttgtaattc

SEQ ID NO: 1584966 - DNA, 17 bp, Homo sapiens
ctgagcgagtgctctca

SEQ ID NO: 1584967 - DNA, 20 bp, Homo sapiens
ctgagcgctgtggactgtcc

SEQ ID NO: 1584968 - DNA, 22 bp, Homo sapiens
ctgagcggcgcagagccctcca

SEQ ID NO: 1584969 - DNA, 22 bp, Homo sapiens
ctgagcggtgggggaggagggt

SEQ ID NO: 1584970 - DNA, 16 bp, Homo sapiens
ctgagctatttcatct

SEQ ID NO: 1584971 - DNA, 11 bp, Homo sapiens
ctgagctcaaa

SEQ ID NO: 1584972 - DNA, 13 bp, Homo sapiens
ctgagctccacct

SEQ ID NO: 1584973 - DNA, 18 bp, Homo sapiens
ctgagctccacctctggt

SEQ ID NO: 1584974 - DNA, 14 bp, Homo sapiens
ctgagctcccacct

SEQ ID NO: 1584975 - DNA, 20 bp, Homo sapiens
ctgagctcccacctcccttc

SEQ ID NO: 1584976 - DNA, 22 bp, Homo sapiens
ctgagctcccacctcccttccc

SEQ ID NO: 1584977 - DNA, 23 bp, Homo sapiens
ctgagctcccacctcccttccca

SEQ ID NO: 1584978 - DNA, 18 bp, Homo sapiens
ctgagctcctgctgcgga

SEQ ID NO: 1584979 - DNA, 22 bp, Homo sapiens
ctgagctcctgctgcggaggag

SEQ ID NO: 1584980 - DNA, 22 bp, Homo sapiens
ctgagctcggggggctctgcct

SEQ ID NO: 1584981 - DNA, 18 bp, Homo sapiens
ctgagctcggtggaccca

SEQ ID NO: 1584982 - DNA, 22 bp, Homo sapiens
ctgagctcggtggacccaggga

SEQ ID NO: 1584983 - DNA, 14 bp, Homo sapiens
ctgagctctccagg

SEQ ID NO: 1584984 - DNA, 16 bp, Homo sapiens
ctgagctctccaggcc

SEQ ID NO: 1584985 - DNA, 22 bp, Homo sapiens
ctgagctctccaggccaggtgg

SEQ ID NO: 1584986 - DNA, 14 bp, Homo sapiens
ctgagctggaaggg

SEQ ID NO: 1584987 - DNA, 17 bp, Homo sapiens
ctgagctggaaggggcc

SEQ ID NO: 1584988 - DNA, 18 bp, Homo sapiens
ctgagctggaaggggcca

SEQ ID NO: 1584989 - DNA, 13 bp, Homo sapiens
ctgagctggggcc

SEQ ID NO: 1584990 - DNA, 21 bp, Homo sapiens
ctgagctgtaatttcgcctta

SEQ ID NO: 1584991 - DNA, 21 bp, Homo sapiens
ctgagctgtcgctgcctccat

SEQ ID NO: 1584992 - DNA, 16 bp, Homo sapiens
ctgagcttaaataaca

SEQ ID NO: 1584993 - DNA, 15 bp, Homo sapiens
ctgagcttagccttg

SEQ ID NO: 1584994 - DNA, 17 bp, Homo sapiens
ctgagcttagccttgtg

SEQ ID NO: 1584995 - DNA, 21 bp, Homo sapiens
ctgagcttagccttgtgccct

SEQ ID NO: 1584996 - DNA, 16 bp, Homo sapiens
ctgagcttctctgtga

SEQ ID NO: 1584997 - DNA, 20 bp, Homo sapiens
ctgagcttgagctcccctgg

SEQ ID NO: 1584998 - DNA, 17 bp, Homo sapiens
ctgagctttggggacag

SEQ ID NO: 1584999 - DNA, 19 bp, Homo sapiens
ctgagcttttcatggaagt

SEQ ID NO: 1585000 - DNA, 16 bp, Homo sapiens
ctgaggaaacaaaaag

SEQ ID NO: 1585001 - DNA, 16 bp, Homo sapiens
ctgaggaactgtctcg

SEQ ID NO: 1585002 - DNA, 21 bp, Homo sapiens
ctgaggaatcaacagggcagc

SEQ ID NO: 1585003 - DNA, 16 bp, Homo sapiens
ctgaggaatttcacct

SEQ ID NO: 1585004 - DNA, 13 bp, Homo sapiens
ctgaggacagagc

SEQ ID NO: 1585005 - DNA, 16 bp, Homo sapiens
ctgaggacaggccccc

SEQ ID NO: 1585006 - DNA, 19 bp, Homo sapiens
ctgaggaccgctgataagc

SEQ ID NO: 1585007 - DNA, 16 bp, Homo sapiens
ctgaggacctctcagc

SEQ ID NO: 1585008 - DNA, 9 bp, Homo sapiens
ctgaggacg

SEQ ID NO: 1585009 - DNA, 16 bp, Homo sapiens
ctgaggacgagacccc

SEQ ID NO: 1585010 - DNA, 18 bp, Homo sapiens
ctgaggacgagaccccca

SEQ ID NO: 1585011 - DNA, 14 bp, Homo sapiens
ctgaggactgattt

SEQ ID NO: 1585012 - DNA, 14 bp, Homo sapiens
ctgaggactggaga

SEQ ID NO: 1585013 - DNA, 21 bp, Homo sapiens
ctgaggagaagctgatccagt

SEQ ID NO: 1585014 - DNA, 18 bp, Homo sapiens
ctgaggagacagaaagcc

SEQ ID NO: 1585015 - DNA, 20 bp, Homo sapiens
ctgaggagacagaaagcctc

SEQ ID NO: 1585016 - DNA, 17 bp, Homo sapiens
ctgaggagatgaccagg

SEQ ID NO: 1585017 - DNA, 19 bp, Homo sapiens
ctgaggagatgaccaggga

SEQ ID NO: 1585018 - DNA, 22 bp, Homo sapiens
ctgaggagatgaccagggatgc

SEQ ID NO: 1585019 - DNA, 13 bp, Homo sapiens
ctgaggagccctg

SEQ ID NO: 1585020 - DNA, 23 bp, Homo sapiens
ctgaggagccctgaggacctctc

SEQ ID NO: 1585021 - DNA, 21 bp, Homo sapiens
ctgaggaggaggacacagcac

SEQ ID NO: 1585022 - DNA, 23 bp, Homo sapiens
ctgaggaggaggacacagcacaa

SEQ ID NO: 1585023 - DNA, 21 bp, Homo sapiens
ctgaggagtattaagaatgca

SEQ ID NO: 1585024 - DNA, 16 bp, Homo sapiens
ctgaggatacagctct

SEQ ID NO: 1585025 - DNA, 21 bp, Homo sapiens
ctgaggatatggacactggtg

SEQ ID NO: 1585026 - DNA, 16 bp, Homo sapiens
ctgaggatgaccagaa

SEQ ID NO: 1585027 - DNA, 18 bp, Homo sapiens
ctgaggatttcaagcctg

SEQ ID NO: 1585028 - DNA, 12 bp, Homo sapiens
ctgaggcaagag

SEQ ID NO: 1585029 - DNA, 15 bp, Homo sapiens
ctgaggcagacagca

SEQ ID NO: 1585030 - DNA, 20 bp, Homo sapiens
ctgaggcaggtgagaaccca

SEQ ID NO: 1585031 - DNA, 21 bp, Homo sapiens
ctgaggcaggtgagaacccag

SEQ ID NO: 1585032 - DNA, 22 bp, Homo sapiens
ctgaggcaggtgagaacccaga

SEQ ID NO: 1585033 - DNA, 19 bp, Homo sapiens
ctgaggccacccactgacc

SEQ ID NO: 1585034 - DNA, 21 bp, Homo sapiens
ctgaggccaggacgtctgggg

SEQ ID NO: 1585035 - DNA, 16 bp, Homo sapiens
ctgaggcccagtgcat

SEQ ID NO: 1585036 - DNA, 14 bp, Homo sapiens
ctgaggcccctagg

SEQ ID NO: 1585037 - DNA, 21 bp, Homo sapiens
ctgaggcccctaggtgcccag

SEQ ID NO: 1585038 - DNA, 23 bp, Homo sapiens
ctgaggcccctaggtgcccaggg

SEQ ID NO: 1585039 - DNA, 19 bp, Homo sapiens
ctgaggcctagactctgtc

SEQ ID NO: 1585040 - DNA, 11 bp, Homo sapiens
ctgaggcctca

SEQ ID NO: 1585041 - DNA, 17 bp, Homo sapiens
ctgaggcctgagcgctc

SEQ ID NO: 1585042 - DNA, 18 bp, Homo sapiens
ctgaggcctgagcgctcc

SEQ ID NO: 1585043 - DNA, 16 bp, Homo sapiens
ctgaggcctgcagcac

SEQ ID NO: 1585044 - DNA, 14 bp, Homo sapiens
ctgaggcctgcttc

SEQ ID NO: 1585045 - DNA, 20 bp, Homo sapiens
ctgaggcctgcttccccctc

SEQ ID NO: 1585046 - DNA, 22 bp, Homo sapiens
ctgaggcctggactttcctgca

SEQ ID NO: 1585047 - DNA, 15 bp, Homo sapiens
ctgaggcctgggccg

SEQ ID NO: 1585048 - DNA, 23 bp, Homo sapiens
ctgaggcctgggccgctgccacg

SEQ ID NO: 1585049 - DNA, 15 bp, Homo sapiens
ctgaggccttccaga

SEQ ID NO: 1585050 - DNA, 15 bp, Homo sapiens
ctgaggctgagactg

SEQ ID NO: 1585051 - DNA, 14 bp, Homo sapiens
ctgaggctgtggtc

SEQ ID NO: 1585052 - DNA, 20 bp, Homo sapiens
ctgaggctgtggtcacagcg

SEQ ID NO: 1585053 - DNA, 18 bp, Homo sapiens
ctgagggaccaactgggc

SEQ ID NO: 1585054 - DNA, 21 bp, Homo sapiens
ctgagggaccaactgggccca

SEQ ID NO: 1585055 - DNA, 16 bp, Homo sapiens
ctgagggaccgagccc

SEQ ID NO: 1585056 - DNA, 19 bp, Homo sapiens
ctgagggaccttggagagc

SEQ ID NO: 1585057 - DNA, 23 bp, Homo sapiens
ctgagggaccttggagagctcag

SEQ ID NO: 1585058 - DNA, 20 bp, Homo sapiens
ctgagggaggaggccacctc

SEQ ID NO: 1585059 - DNA, 21 bp, Homo sapiens
ctgagggaggaggccacctct

SEQ ID NO: 1585060 - DNA, 20 bp, Homo sapiens
ctgagggcagactggggcat

SEQ ID NO: 1585061 - DNA, 11 bp, Homo sapiens
ctgagggcagt

SEQ ID NO: 1585062 - DNA, 16 bp, Homo sapiens
ctgagggcagtgccct

SEQ ID NO: 1585063 - DNA, 17 bp, Homo sapiens
ctgagggcagtgccctt

SEQ ID NO: 1585064 - DNA, 19 bp, Homo sapiens
ctgagggcagtgccctttg

SEQ ID NO: 1585065 - DNA, 16 bp, Homo sapiens
ctgagggccacactat

SEQ ID NO: 1585066 - DNA, 12 bp, Homo sapiens
ctgagggccagg

SEQ ID NO: 1585067 - DNA, 15 bp, Homo sapiens
ctgagggccagggac

SEQ ID NO: 1585068 - DNA, 19 bp, Homo sapiens
ctgagggccagggacccag

SEQ ID NO: 1585069 - DNA, 16 bp, Homo sapiens
ctgagggcccctctgc

SEQ ID NO: 1585070 - DNA, 20 bp, Homo sapiens
ctgagggcccctctgcccag

SEQ ID NO: 1585071 - DNA, 22 bp, Homo sapiens
ctgagggcccctctgcccagct

SEQ ID NO: 1585072 - DNA, 14 bp, Homo sapiens
ctgagggccctgtg

SEQ ID NO: 1585073 - DNA, 16 bp, Homo sapiens
ctgagggccctgtgga

SEQ ID NO: 1585074 - DNA, 19 bp, Homo sapiens
ctgagggcctgctggaggc

SEQ ID NO: 1585075 - DNA, 22 bp, Homo sapiens
ctgaggggaggatcactggagc

SEQ ID NO: 1585076 - DNA, 16 bp, Homo sapiens
ctgaggggaggcacct

SEQ ID NO: 1585077 - DNA, 19 bp, Homo sapiens
ctgaggggaggcacctcca

SEQ ID NO: 1585078 - DNA, 23 bp, Homo sapiens
ctgaggggaggcacctccaggca

SEQ ID NO: 1585079 - DNA, 19 bp, Homo sapiens
ctgaggggcatctgcccct

SEQ ID NO: 1585080 - DNA, 21 bp, Homo sapiens
ctgagggggtgggggtgccgc

SEQ ID NO: 1585081 - DNA, 21 bp, Homo sapiens
ctgagggggtgggggtgctgc

SEQ ID NO: 1585082 - DNA, 17 bp, Homo sapiens
ctgaggggtgggggtgc

SEQ ID NO: 1585083 - DNA, 18 bp, Homo sapiens
ctgagggtctgggcggcg

SEQ ID NO: 1585084 - DNA, 19 bp, Homo sapiens
ctgagggtggagactaagc

SEQ ID NO: 1585085 - DNA, 20 bp, Homo sapiens
ctgagggtggagactaagcc

SEQ ID NO: 1585086 - DNA, 14 bp, Homo sapiens
ctgaggtataaaga

SEQ ID NO: 1585087 - DNA, 16 bp, Homo sapiens
ctgaggtataaagaca

SEQ ID NO: 1585088 - DNA, 20 bp, Homo sapiens
ctgaggtccttatgtcctgt

SEQ ID NO: 1585089 - DNA, 16 bp, Homo sapiens
ctgaggtctcttgagg

SEQ ID NO: 1585090 - DNA, 17 bp, Homo sapiens
ctgaggtgaaagggagc

SEQ ID NO: 1585091 - DNA, 14 bp, Homo sapiens
ctgaggtgggcaga

SEQ ID NO: 1585092 - DNA, 14 bp, Homo sapiens
ctgaggtgggccca

SEQ ID NO: 1585093 - DNA, 16 bp, Homo sapiens
ctgaggtgggcccagg

SEQ ID NO: 1585094 - DNA, 22 bp, Homo sapiens
ctgaggtgggctggggctgctc

SEQ ID NO: 1585095 - DNA, 21 bp, Homo sapiens
ctgaggtggtaggatcacctg

SEQ ID NO: 1585096 - DNA, 14 bp, Homo sapiens
ctgaggtgtggggg

SEQ ID NO: 1585097 - DNA, 18 bp, Homo sapiens
ctgaggtgtgggggctgc

SEQ ID NO: 1585098 - DNA, 22 bp, Homo sapiens
ctgaggtgtgggggctgcagca

SEQ ID NO: 1585099 - DNA, 17 bp, Homo sapiens
ctgaggttcctctgcct

SEQ ID NO: 1585100 - DNA, 22 bp, Homo sapiens
ctgagtaactggttgctgtgtc

SEQ ID NO: 1585101 - DNA, 22 bp, Homo sapiens
ctgagtaatcgcttaaagatgt

SEQ ID NO: 1585102 - DNA, 20 bp, Homo sapiens
ctgagtagatgggactacag

SEQ ID NO: 1585103 - DNA, 20 bp, Homo sapiens
ctgagtagctgggactacag

SEQ ID NO: 1585104 - DNA, 21 bp, Homo sapiens
ctgagtattaatatctgagga

SEQ ID NO: 1585105 - DNA, 13 bp, Homo sapiens
ctgagtatttttt

SEQ ID NO: 1585106 - DNA, 12 bp, Homo sapiens
ctgagtcaaatc

SEQ ID NO: 1585107 - DNA, 20 bp, Homo sapiens
ctgagtcaaatccagtggtg

SEQ ID NO: 1585108 - DNA, 21 bp, Homo sapiens
ctgagtcaaatccagtggtgg

SEQ ID NO: 1585109 - DNA, 22 bp, Homo sapiens
ctgagtcaaatccagtggtggg

SEQ ID NO: 1585110 - DNA, 14 bp, Homo sapiens
ctgagtcaccagga

SEQ ID NO: 1585111 - DNA, 15 bp, Homo sapiens
ctgagtcaccaggaa

SEQ ID NO: 1585112 - DNA, 20 bp, Homo sapiens
ctgagtcacccatgaagaca

SEQ ID NO: 1585113 - DNA, 22 bp, Homo sapiens
ctgagtcaccctacctgtgcct

SEQ ID NO: 1585114 - DNA, 17 bp, Homo sapiens
ctgagtcacctcctcca

SEQ ID NO: 1585115 - DNA, 19 bp, Homo sapiens
ctgagtcacctcctccact

SEQ ID NO: 1585116 - DNA, 23 bp, Homo sapiens
ctgagtcacctcctccactcact

SEQ ID NO: 1585117 - DNA, 13 bp, Homo sapiens
ctgagtcagtgct

SEQ ID NO: 1585118 - DNA, 19 bp, Homo sapiens
ctgagtcagtgctctcagc

SEQ ID NO: 1585119 - DNA, 22 bp, Homo sapiens
ctgagtcatctgttagggcctt

SEQ ID NO: 1585120 - DNA, 18 bp, Homo sapiens
ctgagtcatgatctccct

SEQ ID NO: 1585121 - DNA, 20 bp, Homo sapiens
ctgagtcatgatctccctgc

SEQ ID NO: 1585122 - DNA, 21 bp, Homo sapiens
ctgagtcatgatctccctgcc

SEQ ID NO: 1585123 - DNA, 16 bp, Homo sapiens
ctgagtccagagcttg

SEQ ID NO: 1585124 - DNA, 20 bp, Homo sapiens
ctgagtccagagcttgtgct

SEQ ID NO: 1585125 - DNA, 16 bp, Homo sapiens
ctgagtcccaggagct

SEQ ID NO: 1585126 - DNA, 17 bp, Homo sapiens
ctgagtcccaggagctg

SEQ ID NO: 1585127 - DNA, 20 bp, Homo sapiens
ctgagtcccctccaggaaga

SEQ ID NO: 1585128 - DNA, 22 bp, Homo sapiens
ctgagtcctggtttcctggcag

SEQ ID NO: 1585129 - DNA, 20 bp, Homo sapiens
ctgagtcctgtctctgcctg

SEQ ID NO: 1585130 - DNA, 21 bp, Homo sapiens
ctgagtcctgtctctgcctgc

SEQ ID NO: 1585131 - DNA, 14 bp, Homo sapiens
ctgagtctatgttc

SEQ ID NO: 1585132 - DNA, 18 bp, Homo sapiens
ctgagtctatgttcaaag

SEQ ID NO: 1585133 - DNA, 14 bp, Homo sapiens
ctgagtctccaggg

SEQ ID NO: 1585134 - DNA, 14 bp, Homo sapiens
ctgagtctcctgtg

SEQ ID NO: 1585135 - DNA, 14 bp, Homo sapiens
ctgagtctgagtcc

SEQ ID NO: 1585136 - DNA, 18 bp, Homo sapiens
ctgagtctgagtcctgtc

SEQ ID NO: 1585137 - DNA, 19 bp, Homo sapiens
ctgagtctgagtcctgtct

SEQ ID NO: 1585138 - DNA, 20 bp, Homo sapiens
ctgagtgagttattgggagt

SEQ ID NO: 1585139 - DNA, 13 bp, Homo sapiens
ctgagtggcagca

SEQ ID NO: 1585140 - DNA, 15 bp, Homo sapiens
ctgagtggcagcagc

SEQ ID NO: 1585141 - DNA, 18 bp, Homo sapiens
ctgagtggcagcagcccc

SEQ ID NO: 1585142 - DNA, 17 bp, Homo sapiens
ctgagtgggaagcccat

SEQ ID NO: 1585143 - DNA, 13 bp, Homo sapiens
ctgagtgggctgg

SEQ ID NO: 1585144 - DNA, 16 bp, Homo sapiens
ctgagtgtcccaagcc

SEQ ID NO: 1585145 - DNA, 15 bp, Homo sapiens
ctgagtgtttggaaa

SEQ ID NO: 1585146 - DNA, 15 bp, Homo sapiens
ctgagttacttgtct

SEQ ID NO: 1585147 - DNA, 18 bp, Homo sapiens
ctgagttacttgtctgag

SEQ ID NO: 1585148 - DNA, 20 bp, Homo sapiens
ctgagttacttgtctgaggc

SEQ ID NO: 1585149 - DNA, 17 bp, Homo sapiens
ctgagttatcaggtgca

SEQ ID NO: 1585150 - DNA, 18 bp, Homo sapiens
ctgagttatcaggtgcag

SEQ ID NO: 1585151 - DNA, 20 bp, Homo sapiens
ctgagttctggttcatgcag

SEQ ID NO: 1585152 - DNA, 17 bp, Homo sapiens
ctgagttgaagagggga

SEQ ID NO: 1585153 - DNA, 15 bp, Homo sapiens
ctgagttgttctaac

SEQ ID NO: 1585154 - DNA, 20 bp, Homo sapiens
ctgagtttaccatttgtaat

SEQ ID NO: 1585155 - DNA, 22 bp, Homo sapiens
ctgagtttaccatttgtaataa

SEQ ID NO: 1585156 - DNA, 20 bp, Homo sapiens
ctgagtttcctatgggaaca

SEQ ID NO: 1585157 - DNA, 14 bp, Homo sapiens
ctgagttttgtgtt

SEQ ID NO: 1585158 - DNA, 19 bp, Homo sapiens
ctgagttttgtgtttgttg

SEQ ID NO: 1585159 - DNA, 18 bp, Homo sapiens
ctgataaaagatggccat

SEQ ID NO: 1585160 - DNA, 15 bp, Homo sapiens
ctgataaacctaata

SEQ ID NO: 1585161 - DNA, 16 bp, Homo sapiens
ctgataaagcacagct

SEQ ID NO: 1585162 - DNA, 17 bp, Homo sapiens
ctgataacttggggagg

SEQ ID NO: 1585163 - DNA, 20 bp, Homo sapiens
ctgataacttggggaggcaa

SEQ ID NO: 1585164 - DNA, 18 bp, Homo sapiens
ctgatactttagccatca

SEQ ID NO: 1585165 - DNA, 20 bp, Homo sapiens
ctgatactttgacagtgttt

SEQ ID NO: 1585166 - DNA, 18 bp, Homo sapiens
ctgatagaatgatgtttt

SEQ ID NO: 1585167 - DNA, 17 bp, Homo sapiens
ctgatagcttacactga

SEQ ID NO: 1585168 - DNA, 20 bp, Homo sapiens
ctgatagcttacactgagga

SEQ ID NO: 1585169 - DNA, 14 bp, Homo sapiens
ctgatatactgtgt

SEQ ID NO: 1585170 - DNA, 22 bp, Homo sapiens
ctgatatatgtgtttttcacat

SEQ ID NO: 1585171 - DNA, 16 bp, Homo sapiens
ctgatatattttacaa

SEQ ID NO: 1585172 - DNA, 14 bp, Homo sapiens
ctgatatcaacagc

SEQ ID NO: 1585173 - DNA, 16 bp, Homo sapiens
ctgatatcaacagctt

SEQ ID NO: 1585174 - DNA, 18 bp, Homo sapiens
ctgatatcaacagcttcc

SEQ ID NO: 1585175 - DNA, 16 bp, Homo sapiens
ctgatatgatttaaaa

SEQ ID NO: 1585176 - DNA, 17 bp, Homo sapiens
ctgatattaatcaaaat

SEQ ID NO: 1585177 - DNA, 18 bp, Homo sapiens
ctgatattatttcttctc

SEQ ID NO: 1585178 - DNA, 20 bp, Homo sapiens
ctgatattatttcttctctt

SEQ ID NO: 1585179 - DNA, 21 bp, Homo sapiens
ctgatattatttcttctctta

SEQ ID NO: 1585180 - DNA, 17 bp, Homo sapiens
ctgatcaaaaataaact

SEQ ID NO: 1585181 - DNA, 23 bp, Homo sapiens
ctgatcaaaaataaactagtttc

SEQ ID NO: 1585182 - DNA, 21 bp, Homo sapiens
ctgatcacccaatgcatcacg

SEQ ID NO: 1585183 - DNA, 18 bp, Homo sapiens
ctgatcaggcttcctggt

SEQ ID NO: 1585184 - DNA, 13 bp, Homo sapiens
ctgatccagagca

SEQ ID NO: 1585185 - DNA, 17 bp, Homo sapiens
ctgatcccatggccagg

SEQ ID NO: 1585186 - DNA, 23 bp, Homo sapiens
ctgatccccaagacatgtggagg

SEQ ID NO: 1585187 - DNA, 11 bp, Homo sapiens
ctgatccctgc

SEQ ID NO: 1585188 - DNA, 14 bp, Homo sapiens
ctgatccctgctct

SEQ ID NO: 1585189 - DNA, 15 bp, Homo sapiens
ctgatccctgctctc

SEQ ID NO: 1585190 - DNA, 19 bp, Homo sapiens
ctgatccctgctctctgag

SEQ ID NO: 1585191 - DNA, 20 bp, Homo sapiens
ctgatccctgctctctgagt

SEQ ID NO: 1585192 - DNA, 21 bp, Homo sapiens
ctgatcctgctccagcagcac

SEQ ID NO: 1585193 - DNA, 12 bp, Homo sapiens
ctgatcctggag

SEQ ID NO: 1585194 - DNA, 15 bp, Homo sapiens
ctgatcctggaggcc

SEQ ID NO: 1585195 - DNA, 19 bp, Homo sapiens
ctgatcctggaggcccagt

SEQ ID NO: 1585196 - DNA, 19 bp, Homo sapiens
ctgatcgtgctaaattttc

SEQ ID NO: 1585197 - DNA, 14 bp, Homo sapiens
ctgatctaacaaaa

SEQ ID NO: 1585198 - DNA, 15 bp, Homo sapiens
ctgatctaacaaaat

SEQ ID NO: 1585199 - DNA, 21 bp, Homo sapiens
ctgatctcaagtatatgtcat

SEQ ID NO: 1585200 - DNA, 12 bp, Homo sapiens
ctgatctcaggg

SEQ ID NO: 1585201 - DNA, 22 bp, Homo sapiens
ctgatctcagggaagcccagct

SEQ ID NO: 1585202 - DNA, 23 bp, Homo sapiens
ctgatctcagggaagcccagctc

SEQ ID NO: 1585203 - DNA, 13 bp, Homo sapiens
ctgatctgcccat

SEQ ID NO: 1585204 - DNA, 12 bp, Homo sapiens
ctgatctgcgga

SEQ ID NO: 1585205 - DNA, 20 bp, Homo sapiens
ctgatctgcggatctcagct

SEQ ID NO: 1585206 - DNA, 13 bp, Homo sapiens
ctgatctgttata

SEQ ID NO: 1585207 - DNA, 16 bp, Homo sapiens
ctgatcttgcctgtct

SEQ ID NO: 1585208 - DNA, 14 bp, Homo sapiens
ctgatctttctaga

SEQ ID NO: 1585209 - DNA, 20 bp, Homo sapiens
ctgatgaaatctgctagaaa

SEQ ID NO: 1585210 - DNA, 23 bp, Homo sapiens
ctgatgaaatctgctagaaagtt

SEQ ID NO: 1585211 - DNA, 20 bp, Homo sapiens
ctgatgaacttattctgtag

SEQ ID NO: 1585212 - DNA, 13 bp, Homo sapiens
ctgatgacccagg

SEQ ID NO: 1585213 - DNA, 23 bp, Homo sapiens
ctgatgacccaggctgcctgagc

SEQ ID NO: 1585214 - DNA, 14 bp, Homo sapiens
ctgatgacttgctt

SEQ ID NO: 1585215 - DNA, 19 bp, Homo sapiens
ctgatgagtgattgacaca

SEQ ID NO: 1585216 - DNA, 21 bp, Homo sapiens
ctgatgagtgattgacacaca

SEQ ID NO: 1585217 - DNA, 20 bp, Homo sapiens
ctgatgagtttcactgtact

SEQ ID NO: 1585218 - DNA, 14 bp, Homo sapiens
ctgatgatatattc

SEQ ID NO: 1585219 - DNA, 14 bp, Homo sapiens
ctgatgatcaaaac

SEQ ID NO: 1585220 - DNA, 19 bp, Homo sapiens
ctgatgatcaaaacctgtg

SEQ ID NO: 1585221 - DNA, 14 bp, Homo sapiens
ctgatgatccagaa

SEQ ID NO: 1585222 - DNA, 21 bp, Homo sapiens
ctgatgatgtctcttgtagaa

SEQ ID NO: 1585223 - DNA, 22 bp, Homo sapiens
ctgatgatgtctcttgtagaag

SEQ ID NO: 1585224 - DNA, 15 bp, Homo sapiens
ctgatgattttcctt

SEQ ID NO: 1585225 - DNA, 17 bp, Homo sapiens
ctgatgattttcctttt

SEQ ID NO: 1585226 - DNA, 15 bp, Homo sapiens
ctgatgcagacacag

SEQ ID NO: 1585227 - DNA, 16 bp, Homo sapiens
ctgatgcagcctgtgg

SEQ ID NO: 1585228 - DNA, 20 bp, Homo sapiens
ctgatgcagcctgtggcttg

SEQ ID NO: 1585229 - DNA, 23 bp, Homo sapiens
ctgatgcatacggctatattggt

SEQ ID NO: 1585230 - DNA, 17 bp, Homo sapiens
ctgatgcctccttggcc

SEQ ID NO: 1585231 - DNA, 15 bp, Homo sapiens
ctgatgctccctccc

SEQ ID NO: 1585232 - DNA, 21 bp, Homo sapiens
ctgatgctccctcccctgccc

SEQ ID NO: 1585233 - DNA, 22 bp, Homo sapiens
ctgatgctccctcccctgccct

SEQ ID NO: 1585234 - DNA, 15 bp, Homo sapiens
ctgatgctgggcaat

SEQ ID NO: 1585235 - DNA, 22 bp, Homo sapiens
ctgatgctgggcaatgaggcag

SEQ ID NO: 1585236 - DNA, 15 bp, Homo sapiens
ctgatggaagatggt

SEQ ID NO: 1585237 - DNA, 21 bp, Homo sapiens
ctgatggaccgggtgggcctg

SEQ ID NO: 1585238 - DNA, 12 bp, Homo sapiens
ctgatggagccc

SEQ ID NO: 1585239 - DNA, 15 bp, Homo sapiens
ctgatggagccccac

SEQ ID NO: 1585240 - DNA, 16 bp, Homo sapiens
ctgatggagccccacc

SEQ ID NO: 1585241 - DNA, 17 bp, Homo sapiens
ctgatggaggaaaaagg

SEQ ID NO: 1585242 - DNA, 16 bp, Homo sapiens
ctgatggagtgtgcag

SEQ ID NO: 1585243 - DNA, 22 bp, Homo sapiens
ctgatggagtgtgcagacagcc

SEQ ID NO: 1585244 - DNA, 17 bp, Homo sapiens
ctgatggcacagaagga

SEQ ID NO: 1585245 - DNA, 14 bp, Homo sapiens
ctgatggcagctgg

SEQ ID NO: 1585246 - DNA, 17 bp, Homo sapiens
ctgatggccaagggggt

SEQ ID NO: 1585247 - DNA, 17 bp, Homo sapiens
ctgatggcccctccagc

SEQ ID NO: 1585248 - DNA, 21 bp, Homo sapiens
ctgatggccttaatttccttt

SEQ ID NO: 1585249 - DNA, 19 bp, Homo sapiens
ctgatggctgctagatttt

SEQ ID NO: 1585250 - DNA, 15 bp, Homo sapiens
ctgatggtgagctgg

SEQ ID NO: 1585251 - DNA, 16 bp, Homo sapiens
ctgatggtgagctggg

SEQ ID NO: 1585252 - DNA, 14 bp, Homo sapiens
ctgatgtcaaagtg

SEQ ID NO: 1585253 - DNA, 18 bp, Homo sapiens
ctgatgtcaatttctgtg

SEQ ID NO: 1585254 - DNA, 20 bp, Homo sapiens
ctgatgtcaatttctgtgtt

SEQ ID NO: 1585255 - DNA, 11 bp, Homo sapiens
ctgatgtcatc

SEQ ID NO: 1585256 - DNA, 13 bp, Homo sapiens
ctgatgtcatctt

SEQ ID NO: 1585257 - DNA, 14 bp, Homo sapiens
ctgatgtcatcttg

SEQ ID NO: 1585258 - DNA, 23 bp, Homo sapiens
ctgatgtcttaacgaataaaggt

SEQ ID NO: 1585259 - DNA, 15 bp, Homo sapiens
ctgatgtgatattct

SEQ ID NO: 1585260 - DNA, 15 bp, Homo sapiens
ctgatgtggactgtc

SEQ ID NO: 1585261 - DNA, 13 bp, Homo sapiens
ctgatgttcctag

SEQ ID NO: 1585262 - DNA, 21 bp, Homo sapiens
ctgatgttcctagtgaaagag

SEQ ID NO: 1585263 - DNA, 22 bp, Homo sapiens
ctgatgttcctttggaagaaaa

SEQ ID NO: 1585264 - DNA, 22 bp, Homo sapiens
ctgatgttgagggaacagacag

SEQ ID NO: 1585265 - DNA, 17 bp, Homo sapiens
ctgatgtttctgtgaaa

SEQ ID NO: 1585266 - DNA, 23 bp, Homo sapiens
ctgatgtttctgtgaaattctca

SEQ ID NO: 1585267 - DNA, 17 bp, Homo sapiens
ctgattaaatatttgaa

SEQ ID NO: 1585268 - DNA, 22 bp, Homo sapiens
ctgattaaatttaatatactgc

SEQ ID NO: 1585269 - DNA, 21 bp, Homo sapiens
ctgattaagttgtctaaacaa

SEQ ID NO: 1585270 - DNA, 13 bp, Homo sapiens
ctgattactgtca

SEQ ID NO: 1585271 - DNA, 22 bp, Homo sapiens
ctgattagtaagtcttgcctat

SEQ ID NO: 1585272 - DNA, 18 bp, Homo sapiens
ctgattatttatgacctg

SEQ ID NO: 1585273 - DNA, 16 bp, Homo sapiens
ctgattcaagaacaag

SEQ ID NO: 1585274 - DNA, 18 bp, Homo sapiens
ctgattcacctcttcctc

SEQ ID NO: 1585275 - DNA, 19 bp, Homo sapiens
ctgattcacctcttcctct

SEQ ID NO: 1585276 - DNA, 22 bp, Homo sapiens
ctgattcacctcttcctctggt

SEQ ID NO: 1585277 - DNA, 13 bp, Homo sapiens
ctgattcactgca

SEQ ID NO: 1585278 - DNA, 20 bp, Homo sapiens
ctgattcatagtaaaatacc

SEQ ID NO: 1585279 - DNA, 19 bp, Homo sapiens
ctgattctatgcctgtatt

SEQ ID NO: 1585280 - DNA, 21 bp, Homo sapiens
ctgattctatgcctgtatttc

SEQ ID NO: 1585281 - DNA, 15 bp, Homo sapiens
ctgattctggcttta

SEQ ID NO: 1585282 - DNA, 18 bp, Homo sapiens
ctgattctggctttaagc

SEQ ID NO: 1585283 - DNA, 19 bp, Homo sapiens
ctgattctggctttaagcc

SEQ ID NO: 1585284 - DNA, 16 bp, Homo sapiens
ctgattctgggatgct

SEQ ID NO: 1585285 - DNA, 13 bp, Homo sapiens
ctgattctgtggc

SEQ ID NO: 1585286 - DNA, 19 bp, Homo sapiens
ctgattcttgattcctggc

SEQ ID NO: 1585287 - DNA, 14 bp, Homo sapiens
ctgattggctgctt

SEQ ID NO: 1585288 - DNA, 16 bp, Homo sapiens
ctgattggctgcttaa

SEQ ID NO: 1585289 - DNA, 19 bp, Homo sapiens
ctgattgggaggtgcgtgt

SEQ ID NO: 1585290 - DNA, 15 bp, Homo sapiens
ctgattggtgattca

SEQ ID NO: 1585291 - DNA, 22 bp, Homo sapiens
ctgattgtgccagtgcactccg

SEQ ID NO: 1585292 - DNA, 14 bp, Homo sapiens
ctgattgtttacag

SEQ ID NO: 1585293 - DNA, 17 bp, Homo sapiens
ctgattgtttcattgcg

SEQ ID NO: 1585294 - DNA, 16 bp, Homo sapiens
ctgatttagatatgca

SEQ ID NO: 1585295 - DNA, 17 bp, Homo sapiens
ctgatttaggagaagcc

SEQ ID NO: 1585296 - DNA, 19 bp, Homo sapiens
ctgatttattgaaattttt

SEQ ID NO: 1585297 - DNA, 18 bp, Homo sapiens
ctgatttcagtttttcat

SEQ ID NO: 1585298 - DNA, 21 bp, Homo sapiens
ctgatttcagtttttcatttg

SEQ ID NO: 1585299 - DNA, 18 bp, Homo sapiens
ctgatttccaggcccctg

SEQ ID NO: 1585300 - DNA, 22 bp, Homo sapiens
ctgatttgcaataaaaatgata

SEQ ID NO: 1585301 - DNA, 14 bp, Homo sapiens
ctgatttggtactt

SEQ ID NO: 1585302 - DNA, 12 bp, Homo sapiens
ctgattttaatg

SEQ ID NO: 1585303 - DNA, 16 bp, Homo sapiens
ctgattttaatgaaat

SEQ ID NO: 1585304 - DNA, 17 bp, Homo sapiens
ctgattttattcttgat

SEQ ID NO: 1585305 - DNA, 21 bp, Homo sapiens
ctgattttcaaagctttttcc

SEQ ID NO: 1585306 - DNA, 15 bp, Homo sapiens
ctgattttctcactg

SEQ ID NO: 1585307 - DNA, 16 bp, Homo sapiens
ctgatttttctctttt

SEQ ID NO: 1585308 - DNA, 15 bp, Homo sapiens
ctgattttttttcct

SEQ ID NO: 1585309 - DNA, 19 bp, Homo sapiens
ctgattttttttcctttta

SEQ ID NO: 1585310 - DNA, 14 bp, Homo sapiens
ctgcaaaaagaaaa

SEQ ID NO: 1585311 - DNA, 12 bp, Homo sapiens
ctgcaaaaatga

SEQ ID NO: 1585312 - DNA, 13 bp, Homo sapiens
ctgcaaaaatgag

SEQ ID NO: 1585313 - DNA, 13 bp, Homo sapiens
ctgcaaaatttta

SEQ ID NO: 1585314 - DNA, 22 bp, Homo sapiens
ctgcaaacaccaacatgttggg

SEQ ID NO: 1585315 - DNA, 20 bp, Homo sapiens
ctgcaaacattgtacatcca

SEQ ID NO: 1585316 - DNA, 16 bp, Homo sapiens
ctgcaaactcactgct

SEQ ID NO: 1585317 - DNA, 20 bp, Homo sapiens
ctgcaaactcactgctcaag

SEQ ID NO: 1585318 - DNA, 19 bp, Homo sapiens
ctgcaaaggacagtgggca

SEQ ID NO: 1585319 - DNA, 15 bp, Homo sapiens
ctgcaaaggagaagc

SEQ ID NO: 1585320 - DNA, 16 bp, Homo sapiens
ctgcaaagtcgccagt

SEQ ID NO: 1585321 - DNA, 20 bp, Homo sapiens
ctgcaaataaggacagcagc

SEQ ID NO: 1585322 - DNA, 21 bp, Homo sapiens
ctgcaaataaggacagcagct

SEQ ID NO: 1585323 - DNA, 22 bp, Homo sapiens
ctgcaaataaggacagcagctg

SEQ ID NO: 1585324 - DNA, 23 bp, Homo sapiens
ctgcaaataaggacagcagctgg

SEQ ID NO: 1585325 - DNA, 18 bp, Homo sapiens
ctgcaaatcaggcttttg

SEQ ID NO: 1585326 - DNA, 20 bp, Homo sapiens
ctgcaaatcaggcttttgtt

SEQ ID NO: 1585327 - DNA, 20 bp, Homo sapiens
ctgcaaatctgatggcctta

SEQ ID NO: 1585328 - DNA, 22 bp, Homo sapiens
ctgcaaccaattgaaaagtgtt

SEQ ID NO: 1585329 - DNA, 23 bp, Homo sapiens
ctgcaacctcacctcccgggttc

SEQ ID NO: 1585330 - DNA, 15 bp, Homo sapiens
ctgcaacctctgcct

SEQ ID NO: 1585331 - DNA, 17 bp, Homo sapiens
ctgcaacggcttagact

SEQ ID NO: 1585332 - DNA, 18 bp, Homo sapiens
ctgcaactagccaaggct

SEQ ID NO: 1585333 - DNA, 19 bp, Homo sapiens
ctgcaacttccgcctcctg

SEQ ID NO: 1585334 - DNA, 16 bp, Homo sapiens
ctgcaacttccgctga

SEQ ID NO: 1585335 - DNA, 18 bp, Homo sapiens
ctgcaacttccgctgagg

SEQ ID NO: 1585336 - DNA, 13 bp, Homo sapiens
ctgcaagaccacg

SEQ ID NO: 1585337 - DNA, 19 bp, Homo sapiens
ctgcaagaccacggaggga

SEQ ID NO: 1585338 - DNA, 15 bp, Homo sapiens
ctgcaagagccaagt

SEQ ID NO: 1585339 - DNA, 13 bp, Homo sapiens
ctgcaagagcctt

SEQ ID NO: 1585340 - DNA, 18 bp, Homo sapiens
ctgcaagagccttggtgt

SEQ ID NO: 1585341 - DNA, 19 bp, Homo sapiens
ctgcaagagccttggtgtc

SEQ ID NO: 1585342 - DNA, 21 bp, Homo sapiens
ctgcaagagccttggtgtcca

SEQ ID NO: 1585343 - DNA, 20 bp, Homo sapiens
ctgcaagcacatctgcattt

SEQ ID NO: 1585344 - DNA, 20 bp, Homo sapiens
ctgcaagccccagggcctgg

SEQ ID NO: 1585345 - DNA, 21 bp, Homo sapiens
ctgcaagccccagggcctggg

SEQ ID NO: 1585346 - DNA, 22 bp, Homo sapiens
ctgcaagctctgcctcccgggt

SEQ ID NO: 1585347 - DNA, 14 bp, Homo sapiens
ctgcaagggcccag

SEQ ID NO: 1585348 - DNA, 15 bp, Homo sapiens
ctgcaagggcccaga

SEQ ID NO: 1585349 - DNA, 17 bp, Homo sapiens
ctgcaaggtactctggt

SEQ ID NO: 1585350 - DNA, 21 bp, Homo sapiens
ctgcaaggtggcctctgcctg

SEQ ID NO: 1585351 - DNA, 23 bp, Homo sapiens
ctgcaaggtggcctctgcctggg

SEQ ID NO: 1585352 - DNA, 15 bp, Homo sapiens
ctgcaatagagactg

SEQ ID NO: 1585353 - DNA, 12 bp, Homo sapiens
ctgcaatatttg

SEQ ID NO: 1585354 - DNA, 19 bp, Homo sapiens
ctgcaatatttgaatttta

SEQ ID NO: 1585355 - DNA, 15 bp, Homo sapiens
ctgcaatcctgtctt

SEQ ID NO: 1585356 - DNA, 13 bp, Homo sapiens
ctgcaatgaaagg

SEQ ID NO: 1585357 - DNA, 14 bp, Homo sapiens
ctgcaatgccctca

SEQ ID NO: 1585358 - DNA, 22 bp, Homo sapiens
ctgcaattcaaaagttccaaga

SEQ ID NO: 1585359 - DNA, 20 bp, Homo sapiens
ctgcaattcccctctgctgc

SEQ ID NO: 1585360 - DNA, 19 bp, Homo sapiens
ctgcaattctacagtttct

SEQ ID NO: 1585361 - DNA, 20 bp, Homo sapiens
ctgcaattgcagctcactgc

SEQ ID NO: 1585362 - DNA, 15 bp, Homo sapiens
ctgcacaagccaggg

SEQ ID NO: 1585363 - DNA, 14 bp, Homo sapiens
ctgcacacacagct

SEQ ID NO: 1585364 - DNA, 16 bp, Homo sapiens
ctgcacacacctgcct

SEQ ID NO: 1585365 - DNA, 20 bp, Homo sapiens
ctgcacacacctgcctgcag

SEQ ID NO: 1585366 - DNA, 20 bp, Homo sapiens
ctgcacacagaatgctcagg

SEQ ID NO: 1585367 - DNA, 16 bp, Homo sapiens
ctgcacacaggacagc

SEQ ID NO: 1585368 - DNA, 15 bp, Homo sapiens
ctgcacacagtgact

SEQ ID NO: 1585369 - DNA, 22 bp, Homo sapiens
ctgcacagatatttccatttct

SEQ ID NO: 1585370 - DNA, 12 bp, Homo sapiens
ctgcacagatgg

SEQ ID NO: 1585371 - DNA, 13 bp, Homo sapiens
ctgcacagatgga

SEQ ID NO: 1585372 - DNA, 20 bp, Homo sapiens
ctgcacagatggatttgcct

SEQ ID NO: 1585373 - DNA, 19 bp, Homo sapiens
ctgcacagcatttgctttc

SEQ ID NO: 1585374 - DNA, 18 bp, Homo sapiens
ctgcacaggccctgggga

SEQ ID NO: 1585375 - DNA, 18 bp, Homo sapiens
ctgcacagtcagaaggac

SEQ ID NO: 1585376 - DNA, 22 bp, Homo sapiens
ctgcacagtcagaaggacggca

SEQ ID NO: 1585377 - DNA, 23 bp, Homo sapiens
ctgcacagtcagaaggacggcag

SEQ ID NO: 1585378 - DNA, 20 bp, Homo sapiens
ctgcacagtgacttctgaga

SEQ ID NO: 1585379 - DNA, 18 bp, Homo sapiens
ctgcacagtgcatctcag

SEQ ID NO: 1585380 - DNA, 21 bp, Homo sapiens
ctgcacagtgcatctcagccc

SEQ ID NO: 1585381 - DNA, 17 bp, Homo sapiens
ctgcacagtggcacaaa

SEQ ID NO: 1585382 - DNA, 12 bp, Homo sapiens
ctgcacattcct

SEQ ID NO: 1585383 - DNA, 18 bp, Homo sapiens
ctgcacattcctggcccc

SEQ ID NO: 1585384 - DNA, 21 bp, Homo sapiens
ctgcacattcctggccccggg

SEQ ID NO: 1585385 - DNA, 15 bp, Homo sapiens
ctgcacattgcctgt

SEQ ID NO: 1585386 - DNA, 20 bp, Homo sapiens
ctgcacattgcctgttctgc

SEQ ID NO: 1585387 - DNA, 23 bp, Homo sapiens
ctgcacattgcctgttctgcttc

SEQ ID NO: 1585388 - DNA, 18 bp, Homo sapiens
ctgcaccagcgcccccag

SEQ ID NO: 1585389 - DNA, 11 bp, Homo sapiens
ctgcaccagga

SEQ ID NO: 1585390 - DNA, 13 bp, Homo sapiens
ctgcaccaggaga

SEQ ID NO: 1585391 - DNA, 20 bp, Homo sapiens
ctgcaccatgctgctgggga

SEQ ID NO: 1585392 - DNA, 16 bp, Homo sapiens
ctgcacccacccctgc

SEQ ID NO: 1585393 - DNA, 18 bp, Homo sapiens
ctgcacccacccctgccc

SEQ ID NO: 1585394 - DNA, 16 bp, Homo sapiens
ctgcaccccagcattc

SEQ ID NO: 1585395 - DNA, 21 bp, Homo sapiens
ctgcaccccagcattccagct

SEQ ID NO: 1585396 - DNA, 19 bp, Homo sapiens
ctgcaccccttctctcctc

SEQ ID NO: 1585397 - DNA, 20 bp, Homo sapiens
ctgcaccccttctctcctcc

SEQ ID NO: 1585398 - DNA, 21 bp, Homo sapiens
ctgcaccccttctctcctccc

SEQ ID NO: 1585399 - DNA, 16 bp, Homo sapiens
ctgcaccctgcgcctc

SEQ ID NO: 1585400 - DNA, 22 bp, Homo sapiens
ctgcaccctgcgcctccagagg

SEQ ID NO: 1585401 - DNA, 12 bp, Homo sapiens
ctgcaccctgga

SEQ ID NO: 1585402 - DNA, 23 bp, Homo sapiens
ctgcaccctggggcctggacctg

SEQ ID NO: 1585403 - DNA, 17 bp, Homo sapiens
ctgcacctctggctaga

SEQ ID NO: 1585404 - DNA, 21 bp, Homo sapiens
ctgcacctgattagttgaaag

SEQ ID NO: 1585405 - DNA, 18 bp, Homo sapiens
ctgcacctggcctgggcc

SEQ ID NO: 1585406 - DNA, 20 bp, Homo sapiens
ctgcacgaagtggctgatgg

SEQ ID NO: 1585407 - DNA, 16 bp, Homo sapiens
ctgcactaatttgatg

SEQ ID NO: 1585408 - DNA, 18 bp, Homo sapiens
ctgcactactcctctgca

SEQ ID NO: 1585409 - DNA, 20 bp, Homo sapiens
ctgcactactcctctgcagt

SEQ ID NO: 1585410 - DNA, 16 bp, Homo sapiens
ctgcactccatggcca

SEQ ID NO: 1585411 - DNA, 19 bp, Homo sapiens
ctgcactccatggccaccc

SEQ ID NO: 1585412 - DNA, 22 bp, Homo sapiens
ctgcactccatggccaccccgt

SEQ ID NO: 1585413 - DNA, 22 bp, Homo sapiens
ctgcactcccacctgacacacc

SEQ ID NO: 1585414 - DNA, 14 bp, Homo sapiens
ctgcactcctcagg

SEQ ID NO: 1585415 - DNA, 22 bp, Homo sapiens
ctgcactcctcagggcagcctc

SEQ ID NO: 1585416 - DNA, 12 bp, Homo sapiens
ctgcactgaaaa

SEQ ID NO: 1585417 - DNA, 18 bp, Homo sapiens
ctgcactgaaaaggttct

SEQ ID NO: 1585418 - DNA, 14 bp, Homo sapiens
ctgcactgagaggg

SEQ ID NO: 1585419 - DNA, 19 bp, Homo sapiens
ctgcactgatgctgcccct

SEQ ID NO: 1585420 - DNA, 16 bp, Homo sapiens
ctgcactggagtccag

SEQ ID NO: 1585421 - DNA, 14 bp, Homo sapiens
ctgcactgtaaaat

SEQ ID NO: 1585422 - DNA, 15 bp, Homo sapiens
ctgcactgtaaaatg

SEQ ID NO: 1585423 - DNA, 12 bp, Homo sapiens
ctgcactgtcaa

SEQ ID NO: 1585424 - DNA, 11 bp, Homo sapiens
ctgcactgtga

SEQ ID NO: 1585425 - DNA, 21 bp, Homo sapiens
ctgcactgtgtcatcttttca

SEQ ID NO: 1585426 - DNA, 16 bp, Homo sapiens
ctgcacttacttgctt

SEQ ID NO: 1585427 - DNA, 14 bp, Homo sapiens
ctgcacttcctgtt

SEQ ID NO: 1585428 - DNA, 19 bp, Homo sapiens
ctgcactttcccccttccc

SEQ ID NO: 1585429 - DNA, 20 bp, Homo sapiens
ctgcactttcccccttcccg

SEQ ID NO: 1585430 - DNA, 12 bp, Homo sapiens
ctgcagaaccca

SEQ ID NO: 1585431 - DNA, 20 bp, Homo sapiens
ctgcagaacccccaggtggc

SEQ ID NO: 1585432 - DNA, 23 bp, Homo sapiens
ctgcagaacgtattggtccagct

SEQ ID NO: 1585433 - DNA, 21 bp, Homo sapiens
ctgcagaagaagctggtgccc

SEQ ID NO: 1585434 - DNA, 23 bp, Homo sapiens
ctgcagaagccaagggaagacag

SEQ ID NO: 1585435 - DNA, 20 bp, Homo sapiens
ctgcagaaggaaagaagggg

SEQ ID NO: 1585436 - DNA, 22 bp, Homo sapiens
ctgcagaaggaaagaagggggc

SEQ ID NO: 1585437 - DNA, 14 bp, Homo sapiens
ctgcagacacgcct

SEQ ID NO: 1585438 - DNA, 18 bp, Homo sapiens
ctgcagacgtctgccttg

SEQ ID NO: 1585439 - DNA, 23 bp, Homo sapiens
ctgcagacgtctgccttggcatc

SEQ ID NO: 1585440 - DNA, 22 bp, Homo sapiens
ctgcagagaaacttaagcaaag

SEQ ID NO: 1585441 - DNA, 23 bp, Homo sapiens
ctgcagagaaacttaagcaaagg

SEQ ID NO: 1585442 - DNA, 17 bp, Homo sapiens
ctgcagagctgacccag

SEQ ID NO: 1585443 - DNA, 14 bp, Homo sapiens
ctgcagaggaccac

SEQ ID NO: 1585444 - DNA, 16 bp, Homo sapiens
ctgcagaggaccacag

SEQ ID NO: 1585445 - DNA, 21 bp, Homo sapiens
ctgcagaggaccacagtgggt

SEQ ID NO: 1585446 - DNA, 20 bp, Homo sapiens
ctgcagaggccagaggcccc

SEQ ID NO: 1585447 - DNA, 21 bp, Homo sapiens
ctgcagaggggaaagacttcc

SEQ ID NO: 1585448 - DNA, 19 bp, Homo sapiens
ctgcagaggggctttctgg

SEQ ID NO: 1585449 - DNA, 20 bp, Homo sapiens
ctgcagaggggctttctgga

SEQ ID NO: 1585450 - DNA, 17 bp, Homo sapiens
ctgcagaggtctgtgct

SEQ ID NO: 1585451 - DNA, 22 bp, Homo sapiens
ctgcagaggtctgtgctgaggc

SEQ ID NO: 1585452 - DNA, 18 bp, Homo sapiens
ctgcagagtctgccccac

SEQ ID NO: 1585453 - DNA, 17 bp, Homo sapiens
ctgcagagtttccaaaa

SEQ ID NO: 1585454 - DNA, 18 bp, Homo sapiens
ctgcagatagaaagcatt

SEQ ID NO: 1585455 - DNA, 16 bp, Homo sapiens
ctgcagatgccaccct

SEQ ID NO: 1585456 - DNA, 22 bp, Homo sapiens
ctgcagatgccaccctagccaa

SEQ ID NO: 1585457 - DNA, 20 bp, Homo sapiens
ctgcagattagttctttttg

SEQ ID NO: 1585458 - DNA, 24 bp, Homo sapiens
ctgcagattagttctttttgccag

SEQ ID NO: 1585459 - DNA, 20 bp, Homo sapiens
ctgcagcaaacactccaccc

SEQ ID NO: 1585460 - DNA, 13 bp, Homo sapiens
ctgcagcacatgc

SEQ ID NO: 1585461 - DNA, 15 bp, Homo sapiens
ctgcagcacctcacc

SEQ ID NO: 1585462 - DNA, 20 bp, Homo sapiens
ctgcagcacctccaggcctg

SEQ ID NO: 1585463 - DNA, 17 bp, Homo sapiens
ctgcagcaggtgctggg

SEQ ID NO: 1585464 - DNA, 18 bp, Homo sapiens
ctgcagcaggtgctgggc

SEQ ID NO: 1585465 - DNA, 19 bp, Homo sapiens
ctgcagcaggtgctgggct

SEQ ID NO: 1585466 - DNA, 19 bp, Homo sapiens
ctgcagcatgacctgtgac

SEQ ID NO: 1585467 - DNA, 18 bp, Homo sapiens
ctgcagcatgttgctgag

SEQ ID NO: 1585468 - DNA, 15 bp, Homo sapiens
ctgcagccagcccag

SEQ ID NO: 1585469 - DNA, 23 bp, Homo sapiens
ctgcagccagcccagcccagctg

SEQ ID NO: 1585470 - DNA, 22 bp, Homo sapiens
ctgcagccagctcacgtccagg

SEQ ID NO: 1585471 - DNA, 15 bp, Homo sapiens
ctgcagccctgccag

SEQ ID NO: 1585472 - DNA, 16 bp, Homo sapiens
ctgcagccgtggtcca

SEQ ID NO: 1585473 - DNA, 14 bp, Homo sapiens
ctgcagcctccgcc

SEQ ID NO: 1585474 - DNA, 13 bp, Homo sapiens
ctgcagcctcctc

SEQ ID NO: 1585475 - DNA, 17 bp, Homo sapiens
ctgcagcgcccggtgct

SEQ ID NO: 1585476 - DNA, 16 bp, Homo sapiens
ctgcagcggcaggacc

SEQ ID NO: 1585477 - DNA, 12 bp, Homo sapiens
ctgcagctgacc

SEQ ID NO: 1585478 - DNA, 13 bp, Homo sapiens
ctgcagctgacct

SEQ ID NO: 1585479 - DNA, 11 bp, Homo sapiens
ctgcagctgcc

SEQ ID NO: 1585480 - DNA, 12 bp, Homo sapiens
ctgcagctgccg

SEQ ID NO: 1585481 - DNA, 22 bp, Homo sapiens
ctgcagctgccgggcctgattt

SEQ ID NO: 1585482 - DNA, 15 bp, Homo sapiens
ctgcagctgctgaag

SEQ ID NO: 1585483 - DNA, 14 bp, Homo sapiens
ctgcagctgggccc

SEQ ID NO: 1585484 - DNA, 19 bp, Homo sapiens
ctgcagctgggccccatgc

SEQ ID NO: 1585485 - DNA, 21 bp, Homo sapiens
ctgcaggaacgagcactggcc

SEQ ID NO: 1585486 - DNA, 24 bp, Homo sapiens
ctgcaggaacgagcactggccaga

SEQ ID NO: 1585487 - DNA, 16 bp, Homo sapiens
ctgcaggagttaaaaa

SEQ ID NO: 1585488 - DNA, 14 bp, Homo sapiens
ctgcaggcaggaac

SEQ ID NO: 1585489 - DNA, 15 bp, Homo sapiens
ctgcaggcaggaaca

SEQ ID NO: 1585490 - DNA, 15 bp, Homo sapiens
ctgcaggccaagagc

SEQ ID NO: 1585491 - DNA, 20 bp, Homo sapiens
ctgcaggccactgtgagcgc

SEQ ID NO: 1585492 - DNA, 16 bp, Homo sapiens
ctgcaggccctggcct

SEQ ID NO: 1585493 - DNA, 19 bp, Homo sapiens
ctgcaggccctggcctccc

SEQ ID NO: 1585494 - DNA, 21 bp, Homo sapiens
ctgcaggccctggcctcccct

SEQ ID NO: 1585495 - DNA, 21 bp, Homo sapiens
ctgcaggcctgactactgccc

SEQ ID NO: 1585496 - DNA, 17 bp, Homo sapiens
ctgcaggctccatgcac

SEQ ID NO: 1585497 - DNA, 10 bp, Homo sapiens
ctgcaggctg

SEQ ID NO: 1585498 - DNA, 15 bp, Homo sapiens
ctgcaggctgcacct

SEQ ID NO: 1585499 - DNA, 23 bp, Homo sapiens
ctgcaggctgcacctctggctag

SEQ ID NO: 1585500 - DNA, 18 bp, Homo sapiens
ctgcaggctggagactgg

SEQ ID NO: 1585501 - DNA, 14 bp, Homo sapiens
ctgcaggctggctg

SEQ ID NO: 1585502 - DNA, 11 bp, Homo sapiens
ctgcagggcca

SEQ ID NO: 1585503 - DNA, 22 bp, Homo sapiens
ctgcagggccatctgactgcca

SEQ ID NO: 1585504 - DNA, 23 bp, Homo sapiens
ctgcagggccatctgactgccaa

SEQ ID NO: 1585505 - DNA, 19 bp, Homo sapiens
ctgcagggccatggctcag

SEQ ID NO: 1585506 - DNA, 20 bp, Homo sapiens
ctgcagggccatggctcagg

SEQ ID NO: 1585507 - DNA, 21 bp, Homo sapiens
ctgcagggccatggctcaggg

SEQ ID NO: 1585508 - DNA, 22 bp, Homo sapiens
ctgcagggccctcccttttccc

SEQ ID NO: 1585509 - DNA, 19 bp, Homo sapiens
ctgcagggccgcgagaggc

SEQ ID NO: 1585510 - DNA, 14 bp, Homo sapiens
ctgcagggctccca

SEQ ID NO: 1585511 - DNA, 16 bp, Homo sapiens
ctgcagggctcccatg

SEQ ID NO: 1585512 - DNA, 19 bp, Homo sapiens
ctgcagggctcccatgggc

SEQ ID NO: 1585513 - DNA, 12 bp, Homo sapiens
ctgcaggggagc

SEQ ID NO: 1585514 - DNA, 15 bp, Homo sapiens
ctgcaggggcctctg

SEQ ID NO: 1585515 - DNA, 23 bp, Homo sapiens
ctgcagggggtgtgtctgctcag

SEQ ID NO: 1585516 - DNA, 15 bp, Homo sapiens
ctgcaggtacttcct

SEQ ID NO: 1585517 - DNA, 15 bp, Homo sapiens
ctgcaggtcagttgt

SEQ ID NO: 1585518 - DNA, 19 bp, Homo sapiens
ctgcaggtcagttgtaata

SEQ ID NO: 1585519 - DNA, 21 bp, Homo sapiens
ctgcaggtcagttgtaataaa

SEQ ID NO: 1585520 - DNA, 21 bp, Homo sapiens
ctgcaggtcagtttggaatga

SEQ ID NO: 1585521 - DNA, 18 bp, Homo sapiens
ctgcaggtgagcaggcag

SEQ ID NO: 1585522 - DNA, 14 bp, Homo sapiens
ctgcagtcacagct

SEQ ID NO: 1585523 - DNA, 18 bp, Homo sapiens
ctgcagtcacattgatgt

SEQ ID NO: 1585524 - DNA, 12 bp, Homo sapiens
ctgcagtcctgg

SEQ ID NO: 1585525 - DNA, 19 bp, Homo sapiens
ctgcagtcggcatgccagg

SEQ ID NO: 1585526 - DNA, 20 bp, Homo sapiens
ctgcagtcggcatgccagga

SEQ ID NO: 1585527 - DNA, 16 bp, Homo sapiens
ctgcagtctcatttct

SEQ ID NO: 1585528 - DNA, 16 bp, Homo sapiens
ctgcagtgattcagca

SEQ ID NO: 1585529 - DNA, 17 bp, Homo sapiens
ctgcagtgattcagcag

SEQ ID NO: 1585530 - DNA, 16 bp, Homo sapiens
ctgcagtgccagctcc

SEQ ID NO: 1585531 - DNA, 16 bp, Homo sapiens
ctgcagtgcctggaaa

SEQ ID NO: 1585532 - DNA, 15 bp, Homo sapiens
ctgcagtgtgccccc

SEQ ID NO: 1585533 - DNA, 15 bp, Homo sapiens
ctgcagtttcctgga

SEQ ID NO: 1585534 - DNA, 17 bp, Homo sapiens
ctgcagtttggccctgg

SEQ ID NO: 1585535 - DNA, 23 bp, Homo sapiens
ctgcagtttggccctggagccag

SEQ ID NO: 1585536 - DNA, 21 bp, Homo sapiens
ctgcagttttgctatctgggc

SEQ ID NO: 1585537 - DNA, 14 bp, Homo sapiens
ctgcataatgtccc

SEQ ID NO: 1585538 - DNA, 14 bp, Homo sapiens
ctgcatacaatctg

SEQ ID NO: 1585539 - DNA, 21 bp, Homo sapiens
ctgcatactttgacaaggaaa

SEQ ID NO: 1585540 - DNA, 16 bp, Homo sapiens
ctgcatagctctattt

SEQ ID NO: 1585541 - DNA, 19 bp, Homo sapiens
ctgcatagctctattttaa

SEQ ID NO: 1585542 - DNA, 15 bp, Homo sapiens
ctgcatatgaaagga

SEQ ID NO: 1585543 - DNA, 22 bp, Homo sapiens
ctgcatatttgtgccgtaatta

SEQ ID NO: 1585544 - DNA, 12 bp, Homo sapiens
ctgcatcactca

SEQ ID NO: 1585545 - DNA, 15 bp, Homo sapiens
ctgcatcactcatgg

SEQ ID NO: 1585546 - DNA, 20 bp, Homo sapiens
ctgcatcagctgctgaaaca

SEQ ID NO: 1585547 - DNA, 23 bp, Homo sapiens
ctgcatcccgatacctcagccct

SEQ ID NO: 1585548 - DNA, 13 bp, Homo sapiens
ctgcatccctgtg

SEQ ID NO: 1585549 - DNA, 23 bp, Homo sapiens
ctgcatccctgtgtccactgaga

SEQ ID NO: 1585550 - DNA, 19 bp, Homo sapiens
ctgcatccgtagttccctg

SEQ ID NO: 1585551 - DNA, 21 bp, Homo sapiens
ctgcatccgtagttccctgaa

SEQ ID NO: 1585552 - DNA, 17 bp, Homo sapiens
ctgcatcctccaagaat

SEQ ID NO: 1585553 - DNA, 23 bp, Homo sapiens
ctgcatcctccaagaatctatct

SEQ ID NO: 1585554 - DNA, 15 bp, Homo sapiens
ctgcatccttcctgg

SEQ ID NO: 1585555 - DNA, 17 bp, Homo sapiens
ctgcatccttcctgggg

SEQ ID NO: 1585556 - DNA, 22 bp, Homo sapiens
ctgcatctattctttgtaccat

SEQ ID NO: 1585557 - DNA, 18 bp, Homo sapiens
ctgcatcttggttatttc

SEQ ID NO: 1585558 - DNA, 22 bp, Homo sapiens
ctgcatgaccaaagtgataaat

SEQ ID NO: 1585559 - DNA, 21 bp, Homo sapiens
ctgcatgagctggcaaccagc

SEQ ID NO: 1585560 - DNA, 12 bp, Homo sapiens
ctgcatgctctg

SEQ ID NO: 1585561 - DNA, 13 bp, Homo sapiens
ctgcatgctctgg

SEQ ID NO: 1585562 - DNA, 18 bp, Homo sapiens
ctgcatgctctggaagcc

SEQ ID NO: 1585563 - DNA, 21 bp, Homo sapiens
ctgcatgctctggaagcctgg

SEQ ID NO: 1585564 - DNA, 18 bp, Homo sapiens
ctgcatggacctaacatt

SEQ ID NO: 1585565 - DNA, 13 bp, Homo sapiens
ctgcatggagaag

SEQ ID NO: 1585566 - DNA, 15 bp, Homo sapiens
ctgcatggattcagc

SEQ ID NO: 1585567 - DNA, 15 bp, Homo sapiens
ctgcatggcttctga

SEQ ID NO: 1585568 - DNA, 17 bp, Homo sapiens
ctgcatggcttctgaaa

SEQ ID NO: 1585569 - DNA, 20 bp, Homo sapiens
ctgcatggcttctgaaagca

SEQ ID NO: 1585570 - DNA, 12 bp, Homo sapiens
ctgcatggggag

SEQ ID NO: 1585571 - DNA, 14 bp, Homo sapiens
ctgcatggggaggc

SEQ ID NO: 1585572 - DNA, 22 bp, Homo sapiens
ctgcatggggaggcagcagagc

SEQ ID NO: 1585573 - DNA, 22 bp, Homo sapiens
ctgcatgtgacttctcccctgc

SEQ ID NO: 1585574 - DNA, 22 bp, Homo sapiens
ctgcatgtgtcatgaagaatgt

SEQ ID NO: 1585575 - DNA, 21 bp, Homo sapiens
ctgcattcacccagacagctc

SEQ ID NO: 1585576 - DNA, 12 bp, Homo sapiens
ctgcattccgca

SEQ ID NO: 1585577 - DNA, 21 bp, Homo sapiens
ctgcattctctcccatcctgg

SEQ ID NO: 1585578 - DNA, 14 bp, Homo sapiens
ctgcattcttaaca

SEQ ID NO: 1585579 - DNA, 17 bp, Homo sapiens
ctgcattgagaactgca

SEQ ID NO: 1585580 - DNA, 18 bp, Homo sapiens
ctgcattgctagataaaa

SEQ ID NO: 1585581 - DNA, 19 bp, Homo sapiens
ctgcattgctagataaaag

SEQ ID NO: 1585582 - DNA, 13 bp, Homo sapiens
ctgcattggcctg

SEQ ID NO: 1585583 - DNA, 19 bp, Homo sapiens
ctgcattggcctggcctcc

SEQ ID NO: 1585584 - DNA, 20 bp, Homo sapiens
ctgcattggcctggcctcca

SEQ ID NO: 1585585 - DNA, 22 bp, Homo sapiens
ctgcattggcctggcctccagc

SEQ ID NO: 1585586 - DNA, 18 bp, Homo sapiens
ctgcatttaaatttgatt

SEQ ID NO: 1585587 - DNA, 17 bp, Homo sapiens
ctgcatttcacatgcct

SEQ ID NO: 1585588 - DNA, 18 bp, Homo sapiens
ctgcatttcacatgcctt

SEQ ID NO: 1585589 - DNA, 21 bp, Homo sapiens
ctgcattttaacaagcacccc

SEQ ID NO: 1585590 - DNA, 20 bp, Homo sapiens
ctgcattttaattttaacca

SEQ ID NO: 1585591 - DNA, 22 bp, Homo sapiens
ctgcattttaattttaaccaaa

SEQ ID NO: 1585592 - DNA, 23 bp, Homo sapiens
ctgccaaccataccttccttccc

SEQ ID NO: 1585593 - DNA, 19 bp, Homo sapiens
ctgccaactgatctgttat

SEQ ID NO: 1585594 - DNA, 17 bp, Homo sapiens
ctgccaagccagattct

SEQ ID NO: 1585595 - DNA, 21 bp, Homo sapiens
ctgccaaggtggagggaagga

SEQ ID NO: 1585596 - DNA, 12 bp, Homo sapiens
ctgccacacagg

SEQ ID NO: 1585597 - DNA, 17 bp, Homo sapiens
ctgccacaccctcccca

SEQ ID NO: 1585598 - DNA, 23 bp, Homo sapiens
ctgccacactcagtcccccacca

SEQ ID NO: 1585599 - DNA, 17 bp, Homo sapiens
ctgccacactgatggct

SEQ ID NO: 1585600 - DNA, 14 bp, Homo sapiens
ctgccacatggagc

SEQ ID NO: 1585601 - DNA, 19 bp, Homo sapiens
ctgccaccacgtctgccag

SEQ ID NO: 1585602 - DNA, 21 bp, Homo sapiens
ctgccaccacgtctgccaggc

SEQ ID NO: 1585603 - DNA, 22 bp, Homo sapiens
ctgccaccacgtctgccaggcc

SEQ ID NO: 1585604 - DNA, 23 bp, Homo sapiens
ctgccaccacgtctgccaggccc

SEQ ID NO: 1585605 - DNA, 14 bp, Homo sapiens
ctgccaccaggcca

SEQ ID NO: 1585606 - DNA, 15 bp, Homo sapiens
ctgccaccaggccac

SEQ ID NO: 1585607 - DNA, 22 bp, Homo sapiens
ctgccacccccttccctgggag

SEQ ID NO: 1585608 - DNA, 13 bp, Homo sapiens
ctgccaccccttc

SEQ ID NO: 1585609 - DNA, 14 bp, Homo sapiens
ctgccaccccttcc

SEQ ID NO: 1585610 - DNA, 20 bp, Homo sapiens
ctgccaccccttcctcccca

SEQ ID NO: 1585611 - DNA, 15 bp, Homo sapiens
ctgccaccctacctg

SEQ ID NO: 1585612 - DNA, 13 bp, Homo sapiens
ctgccacctcccc

SEQ ID NO: 1585613 - DNA, 13 bp, Homo sapiens
ctgccacctccct

SEQ ID NO: 1585614 - DNA, 15 bp, Homo sapiens
ctgccacctccctga

SEQ ID NO: 1585615 - DNA, 16 bp, Homo sapiens
ctgccacctccctgac

SEQ ID NO: 1585616 - DNA, 16 bp, Homo sapiens
ctgccactctctggga

SEQ ID NO: 1585617 - DNA, 20 bp, Homo sapiens
ctgccactctctgggactct

SEQ ID NO: 1585618 - DNA, 23 bp, Homo sapiens
ctgccactctctgggactctcct

SEQ ID NO: 1585619 - DNA, 20 bp, Homo sapiens
ctgccactgactgcagggac

SEQ ID NO: 1585620 - DNA, 21 bp, Homo sapiens
ctgccactgactgcagggaca

SEQ ID NO: 1585621 - DNA, 15 bp, Homo sapiens
ctgccactgaggaga

SEQ ID NO: 1585622 - DNA, 16 bp, Homo sapiens
ctgccactgaggagac

SEQ ID NO: 1585623 - DNA, 21 bp, Homo sapiens
ctgccacttcaacccccagct

SEQ ID NO: 1585624 - DNA, 21 bp, Homo sapiens
ctgccactttcacgtggcctc

SEQ ID NO: 1585625 - DNA, 14 bp, Homo sapiens
ctgccagcacagag

SEQ ID NO: 1585626 - DNA, 13 bp, Homo sapiens
ctgccagcacagt

SEQ ID NO: 1585627 - DNA, 15 bp, Homo sapiens
ctgccagcagcagca

SEQ ID NO: 1585628 - DNA, 19 bp, Homo sapiens
ctgccagcagcagcaggtg

SEQ ID NO: 1585629 - DNA, 21 bp, Homo sapiens
ctgccagcagcagcaggtgat

SEQ ID NO: 1585630 - DNA, 15 bp, Homo sapiens
ctgccagccagcagc

SEQ ID NO: 1585631 - DNA, 19 bp, Homo sapiens
ctgccagccagcagccagc

SEQ ID NO: 1585632 - DNA, 12 bp, Homo sapiens
ctgccagcctgg

SEQ ID NO: 1585633 - DNA, 13 bp, Homo sapiens
ctgccagcctggc

SEQ ID NO: 1585634 - DNA, 14 bp, Homo sapiens
ctgccagcctggct

SEQ ID NO: 1585635 - DNA, 20 bp, Homo sapiens
ctgccagcctggcttctgga

SEQ ID NO: 1585636 - DNA, 21 bp, Homo sapiens
ctgccagccttgagccctggc

SEQ ID NO: 1585637 - DNA, 22 bp, Homo sapiens
ctgccagccttgagccctggct

SEQ ID NO: 1585638 - DNA, 14 bp, Homo sapiens
ctgccagcgtctgt

SEQ ID NO: 1585639 - DNA, 12 bp, Homo sapiens
ctgccagctgca

SEQ ID NO: 1585640 - DNA, 12 bp, Homo sapiens
ctgccagctgcc

SEQ ID NO: 1585641 - DNA, 14 bp, Homo sapiens
ctgccagctgcctt

SEQ ID NO: 1585642 - DNA, 16 bp, Homo sapiens
ctgccagctgccttcc

SEQ ID NO: 1585643 - DNA, 22 bp, Homo sapiens
ctgccaggcacctggcctgctg

SEQ ID NO: 1585644 - DNA, 23 bp, Homo sapiens
ctgccaggcacctggcctgctgg

SEQ ID NO: 1585645 - DNA, 23 bp, Homo sapiens
ctgccaggcactgttcatctcag

SEQ ID NO: 1585646 - DNA, 13 bp, Homo sapiens
ctgccaggcaggg

SEQ ID NO: 1585647 - DNA, 15 bp, Homo sapiens
ctgccaggccagcct

SEQ ID NO: 1585648 - DNA, 17 bp, Homo sapiens
ctgccaggccagcctcc

SEQ ID NO: 1585649 - DNA, 13 bp, Homo sapiens
ctgccaggcccat

SEQ ID NO: 1585650 - DNA, 16 bp, Homo sapiens
ctgccaggcccatctc

SEQ ID NO: 1585651 - DNA, 14 bp, Homo sapiens
ctgccaggcgttgg

SEQ ID NO: 1585652 - DNA, 14 bp, Homo sapiens
ctgccaggctgcct

SEQ ID NO: 1585653 - DNA, 19 bp, Homo sapiens
ctgccaggggttcttgagc

SEQ ID NO: 1585654 - DNA, 12 bp, Homo sapiens
ctgccagtgaca

SEQ ID NO: 1585655 - DNA, 16 bp, Homo sapiens
ctgccagtgacagaca

SEQ ID NO: 1585656 - DNA, 23 bp, Homo sapiens
ctgccagtgacagacaggctctt

SEQ ID NO: 1585657 - DNA, 17 bp, Homo sapiens
ctgccagtgcagccact

SEQ ID NO: 1585658 - DNA, 19 bp, Homo sapiens
ctgccagtgcagccactgg

SEQ ID NO: 1585659 - DNA, 12 bp, Homo sapiens
ctgccagtgcct

SEQ ID NO: 1585660 - DNA, 13 bp, Homo sapiens
ctgccagtgcctt

SEQ ID NO: 1585661 - DNA, 14 bp, Homo sapiens
ctgccagtgcctta

SEQ ID NO: 1585662 - DNA, 21 bp, Homo sapiens
ctgccagtgccttacctcctg

SEQ ID NO: 1585663 - DNA, 22 bp, Homo sapiens
ctgccagtgccttacctcctgc

SEQ ID NO: 1585664 - DNA, 23 bp, Homo sapiens
ctgccagtgccttacctcctgcc

SEQ ID NO: 1585665 - DNA, 16 bp, Homo sapiens
ctgccatattgtgtaa

SEQ ID NO: 1585666 - DNA, 22 bp, Homo sapiens
ctgccatcatgtttacagagga

SEQ ID NO: 1585667 - DNA, 15 bp, Homo sapiens
ctgccatcctcccaa

SEQ ID NO: 1585668 - DNA, 15 bp, Homo sapiens
ctgccatccttgctg

SEQ ID NO: 1585669 - DNA, 20 bp, Homo sapiens
ctgccatctagccagcccct

SEQ ID NO: 1585670 - DNA, 23 bp, Homo sapiens
ctgccatcttagtttggattctt

SEQ ID NO: 1585671 - DNA, 17 bp, Homo sapiens
ctgccatcttctccccg

SEQ ID NO: 1585672 - DNA, 16 bp, Homo sapiens
ctgccatgatagctgg

SEQ ID NO: 1585673 - DNA, 15 bp, Homo sapiens
ctgccatgccactgc

SEQ ID NO: 1585674 - DNA, 24 bp, Homo sapiens
ctgccatgccactgccaggcacct

SEQ ID NO: 1585675 - DNA, 18 bp, Homo sapiens
ctgccatgccaggaacct

SEQ ID NO: 1585676 - DNA, 14 bp, Homo sapiens
ctgccatggcgtgt

SEQ ID NO: 1585677 - DNA, 22 bp, Homo sapiens
ctgccatgtaaggttgtgcagg

SEQ ID NO: 1585678 - DNA, 23 bp, Homo sapiens
ctgccatgtttagtgaatgactt

SEQ ID NO: 1585679 - DNA, 22 bp, Homo sapiens
ctgccattacagaggtattaaa

SEQ ID NO: 1585680 - DNA, 16 bp, Homo sapiens
ctgccattacccagtg

SEQ ID NO: 1585681 - DNA, 17 bp, Homo sapiens
ctgccattcacttcata

SEQ ID NO: 1585682 - DNA, 16 bp, Homo sapiens
ctgccattcttctggt

SEQ ID NO: 1585683 - DNA, 17 bp, Homo sapiens
ctgccattcttctggtg

SEQ ID NO: 1585684 - DNA, 21 bp, Homo sapiens
ctgccatttcccttctggaca

SEQ ID NO: 1585685 - DNA, 17 bp, Homo sapiens
ctgcccaacccttccct

SEQ ID NO: 1585686 - DNA, 22 bp, Homo sapiens
ctgcccaatgctttgggaggcc

SEQ ID NO: 1585687 - DNA, 15 bp, Homo sapiens
ctgcccaccccctca

SEQ ID NO: 1585688 - DNA, 19 bp, Homo sapiens
ctgcccacttagccgtcca

SEQ ID NO: 1585689 - DNA, 13 bp, Homo sapiens
ctgcccagacaca

SEQ ID NO: 1585690 - DNA, 14 bp, Homo sapiens
ctgcccagacacat

SEQ ID NO: 1585691 - DNA, 17 bp, Homo sapiens
ctgcccagacacatggg

SEQ ID NO: 1585692 - DNA, 23 bp, Homo sapiens
ctgcccagacacatgggcttgtg

SEQ ID NO: 1585693 - DNA, 23 bp, Homo sapiens
ctgcccagacccctctggccagg

SEQ ID NO: 1585694 - DNA, 23 bp, Homo sapiens
ctgcccagcccatttgggctctg

SEQ ID NO: 1585695 - DNA, 15 bp, Homo sapiens
ctgcccagccgggca

SEQ ID NO: 1585696 - DNA, 16 bp, Homo sapiens
ctgcccagccgggcac

SEQ ID NO: 1585697 - DNA, 15 bp, Homo sapiens
ctgcccagcttgggc

SEQ ID NO: 1585698 - DNA, 16 bp, Homo sapiens
ctgcccagcttgggcc

SEQ ID NO: 1585699 - DNA, 23 bp, Homo sapiens
ctgcccagcttgggcccagctgg

SEQ ID NO: 1585700 - DNA, 12 bp, Homo sapiens
ctgcccaggaga

SEQ ID NO: 1585701 - DNA, 13 bp, Homo sapiens
ctgcccaggagac

SEQ ID NO: 1585702 - DNA, 22 bp, Homo sapiens
ctgcccaggagagccagccctc

SEQ ID NO: 1585703 - DNA, 14 bp, Homo sapiens
ctgcccaggggtgc

SEQ ID NO: 1585704 - DNA, 17 bp, Homo sapiens
ctgcccaggggtgcccc

SEQ ID NO: 1585705 - DNA, 19 bp, Homo sapiens
ctgcccagtcgaccccaaa

SEQ ID NO: 1585706 - DNA, 11 bp, Homo sapiens
ctgcccagtgt

SEQ ID NO: 1585707 - DNA, 20 bp, Homo sapiens
ctgcccagtgttgtttgtaa

SEQ ID NO: 1585708 - DNA, 23 bp, Homo sapiens
ctgcccagtgttgtttgtaaata

SEQ ID NO: 1585709 - DNA, 15 bp, Homo sapiens
ctgcccatcacaggg

SEQ ID NO: 1585710 - DNA, 18 bp, Homo sapiens
ctgcccatcacagggttg

SEQ ID NO: 1585711 - DNA, 22 bp, Homo sapiens
ctgcccatcacagggttgggcc

SEQ ID NO: 1585712 - DNA, 18 bp, Homo sapiens
ctgcccatcatgtggccc

SEQ ID NO: 1585713 - DNA, 13 bp, Homo sapiens
ctgcccatcccag

SEQ ID NO: 1585714 - DNA, 22 bp, Homo sapiens
ctgcccatcgtgaagaagcctg

SEQ ID NO: 1585715 - DNA, 19 bp, Homo sapiens
ctgcccatgagcaagccta

SEQ ID NO: 1585716 - DNA, 20 bp, Homo sapiens
ctgcccatgagcaagcctag

SEQ ID NO: 1585717 - DNA, 17 bp, Homo sapiens
ctgccccaacctgctga

SEQ ID NO: 1585718 - DNA, 18 bp, Homo sapiens
ctgccccaactcctggaa

SEQ ID NO: 1585719 - DNA, 20 bp, Homo sapiens
ctgccccaagcagccagcca

SEQ ID NO: 1585720 - DNA, 19 bp, Homo sapiens
ctgccccaagggcccagac

SEQ ID NO: 1585721 - DNA, 20 bp, Homo sapiens
ctgccccaagggcccagacc

SEQ ID NO: 1585722 - DNA, 22 bp, Homo sapiens
ctgccccaccccatccagccag

SEQ ID NO: 1585723 - DNA, 23 bp, Homo sapiens
ctgccccaccccatccagccaga

SEQ ID NO: 1585724 - DNA, 14 bp, Homo sapiens
ctgccccacctgcc

SEQ ID NO: 1585725 - DNA, 12 bp, Homo sapiens
ctgccccagagg

SEQ ID NO: 1585726 - DNA, 13 bp, Homo sapiens
ctgccccagaggt

SEQ ID NO: 1585727 - DNA, 14 bp, Homo sapiens
ctgccccagagtgg

SEQ ID NO: 1585728 - DNA, 19 bp, Homo sapiens
ctgccccagagtgggtctt

SEQ ID NO: 1585729 - DNA, 15 bp, Homo sapiens
ctgccccagcccaga

SEQ ID NO: 1585730 - DNA, 18 bp, Homo sapiens
ctgccccagctctggctt

SEQ ID NO: 1585731 - DNA, 22 bp, Homo sapiens
ctgccccaggccggagcccaga

SEQ ID NO: 1585732 - DNA, 14 bp, Homo sapiens
ctgccccaggcctg

SEQ ID NO: 1585733 - DNA, 18 bp, Homo sapiens
ctgccccagtagtcagaa

SEQ ID NO: 1585734 - DNA, 19 bp, Homo sapiens
ctgccccagtagtcagaag

SEQ ID NO: 1585735 - DNA, 17 bp, Homo sapiens
ctgcccccaggactggg

SEQ ID NO: 1585736 - DNA, 23 bp, Homo sapiens
ctgccccccaaggttctggttcc

SEQ ID NO: 1585737 - DNA, 12 bp, Homo sapiens
ctgccccccagc

SEQ ID NO: 1585738 - DNA, 13 bp, Homo sapiens
ctgccccccgagg

SEQ ID NO: 1585739 - DNA, 18 bp, Homo sapiens
ctgccccccgaggctgct

SEQ ID NO: 1585740 - DNA, 19 bp, Homo sapiens
ctgccccccgaggctgcta

SEQ ID NO: 1585741 - DNA, 13 bp, Homo sapiens
ctgcccccgctga

SEQ ID NO: 1585742 - DNA, 19 bp, Homo sapiens
ctgcccccgttccagctga

SEQ ID NO: 1585743 - DNA, 20 bp, Homo sapiens
ctgcccccgttccagctgac

SEQ ID NO: 1585744 - DNA, 21 bp, Homo sapiens
ctgcccccgttccagctgaca

SEQ ID NO: 1585745 - DNA, 12 bp, Homo sapiens
ctgccccctccc

SEQ ID NO: 1585746 - DNA, 22 bp, Homo sapiens
ctgccccctctttgtagctcct

SEQ ID NO: 1585747 - DNA, 13 bp, Homo sapiens
ctgccccctgctg

SEQ ID NO: 1585748 - DNA, 22 bp, Homo sapiens
ctgccccctggtggacagtcct

SEQ ID NO: 1585749 - DNA, 15 bp, Homo sapiens
ctgccccgcccagct

SEQ ID NO: 1585750 - DNA, 16 bp, Homo sapiens
ctgccccgcccagctg

SEQ ID NO: 1585751 - DNA, 17 bp, Homo sapiens
ctgccccgcccagctgc

SEQ ID NO: 1585752 - DNA, 14 bp, Homo sapiens
ctgccccgccccca

SEQ ID NO: 1585753 - DNA, 17 bp, Homo sapiens
ctgccccgcccccagtc

SEQ ID NO: 1585754 - DNA, 23 bp, Homo sapiens
ctgccccgcccccagtccccacc

SEQ ID NO: 1585755 - DNA, 19 bp, Homo sapiens
ctgccccgcttccccacag

SEQ ID NO: 1585756 - DNA, 20 bp, Homo sapiens
ctgccccgcttccccacaga

SEQ ID NO: 1585757 - DNA, 17 bp, Homo sapiens
ctgccccgggtccccag

SEQ ID NO: 1585758 - DNA, 19 bp, Homo sapiens
ctgccccgggtccccagct

SEQ ID NO: 1585759 - DNA, 22 bp, Homo sapiens
ctgccccgggtccccagctccc

SEQ ID NO: 1585760 - DNA, 15 bp, Homo sapiens
ctgccccgttccctg

SEQ ID NO: 1585761 - DNA, 19 bp, Homo sapiens
ctgccccgttccctgtcag

SEQ ID NO: 1585762 - DNA, 22 bp, Homo sapiens
ctgcccctacgggcgctgcagc

SEQ ID NO: 1585763 - DNA, 24 bp, Homo sapiens
ctgcccctacgggcgctgcagcct

SEQ ID NO: 1585764 - DNA, 20 bp, Homo sapiens
ctgcccctaggatgctgcag

SEQ ID NO: 1585765 - DNA, 15 bp, Homo sapiens
ctgcccctcagagac

SEQ ID NO: 1585766 - DNA, 22 bp, Homo sapiens
ctgcccctcccccaacccccac

SEQ ID NO: 1585767 - DNA, 17 bp, Homo sapiens
ctgcccctcccttcaac

SEQ ID NO: 1585768 - DNA, 17 bp, Homo sapiens
ctgcccctctcaccaaa

SEQ ID NO: 1585769 - DNA, 16 bp, Homo sapiens
ctgcccctgcagttgg

SEQ ID NO: 1585770 - DNA, 12 bp, Homo sapiens
ctgcccctggca

SEQ ID NO: 1585771 - DNA, 21 bp, Homo sapiens
ctgccccttaaacacaggctg

SEQ ID NO: 1585772 - DNA, 18 bp, Homo sapiens
ctgccccttaaccccaag

SEQ ID NO: 1585773 - DNA, 18 bp, Homo sapiens
ctgccccttgggcatcca

SEQ ID NO: 1585774 - DNA, 14 bp, Homo sapiens
ctgcccgagagagc

SEQ ID NO: 1585775 - DNA, 16 bp, Homo sapiens
ctgcccgcaccctggc

SEQ ID NO: 1585776 - DNA, 18 bp, Homo sapiens
ctgcccgcaccctggcct

SEQ ID NO: 1585777 - DNA, 14 bp, Homo sapiens
ctgcccgctcccaa

SEQ ID NO: 1585778 - DNA, 18 bp, Homo sapiens
ctgcccggctacatcagc

SEQ ID NO: 1585779 - DNA, 21 bp, Homo sapiens
ctgcccggtggtttgccatgt

SEQ ID NO: 1585780 - DNA, 15 bp, Homo sapiens
ctgcccgtcttcagc

SEQ ID NO: 1585781 - DNA, 21 bp, Homo sapiens
ctgcccgtcttcagcctagcc

SEQ ID NO: 1585782 - DNA, 13 bp, Homo sapiens
ctgccctaacctg

SEQ ID NO: 1585783 - DNA, 16 bp, Homo sapiens
ctgccctactcactct

SEQ ID NO: 1585784 - DNA, 12 bp, Homo sapiens
ctgccctagctg

SEQ ID NO: 1585785 - DNA, 17 bp, Homo sapiens
ctgccctatgggcctgc

SEQ ID NO: 1585786 - DNA, 21 bp, Homo sapiens
ctgccctatgggcctgccggg

SEQ ID NO: 1585787 - DNA, 19 bp, Homo sapiens
ctgccctcactccctctgc

SEQ ID NO: 1585788 - DNA, 22 bp, Homo sapiens
ctgccctcactccctctgcaga

SEQ ID NO: 1585789 - DNA, 19 bp, Homo sapiens
ctgccctcatggcccctct

SEQ ID NO: 1585790 - DNA, 14 bp, Homo sapiens
ctgccctcccaagt

SEQ ID NO: 1585791 - DNA, 18 bp, Homo sapiens
ctgccctcccaagtccca

SEQ ID NO: 1585792 - DNA, 13 bp, Homo sapiens
ctgccctcccctg

SEQ ID NO: 1585793 - DNA, 19 bp, Homo sapiens
ctgccctcccctgctccca

SEQ ID NO: 1585794 - DNA, 21 bp, Homo sapiens
ctgccctcccctgctcccagg

SEQ ID NO: 1585795 - DNA, 15 bp, Homo sapiens
ctgccctcccgcacc

SEQ ID NO: 1585796 - DNA, 17 bp, Homo sapiens
ctgccctcccgcacctt

SEQ ID NO: 1585797 - DNA, 17 bp, Homo sapiens
ctgccctccctccttcc

SEQ ID NO: 1585798 - DNA, 18 bp, Homo sapiens
ctgccctccctccttcct

SEQ ID NO: 1585799 - DNA, 17 bp, Homo sapiens
ctgccctcgtggccagc

SEQ ID NO: 1585800 - DNA, 21 bp, Homo sapiens
ctgccctcgtggccagcccgg

SEQ ID NO: 1585801 - DNA, 23 bp, Homo sapiens
ctgccctcgtggccagcccggct

SEQ ID NO: 1585802 - DNA, 15 bp, Homo sapiens
ctgccctctatttat

SEQ ID NO: 1585803 - DNA, 20 bp, Homo sapiens
ctgccctctatttattagcc

SEQ ID NO: 1585804 - DNA, 22 bp, Homo sapiens
ctgccctctcccaaaaaactac

SEQ ID NO: 1585805 - DNA, 17 bp, Homo sapiens
ctgccctctccttcctt

SEQ ID NO: 1585806 - DNA, 13 bp, Homo sapiens
ctgccctctctgc

SEQ ID NO: 1585807 - DNA, 11 bp, Homo sapiens
ctgccctctgc

SEQ ID NO: 1585808 - DNA, 15 bp, Homo sapiens
ctgccctctgcccca

SEQ ID NO: 1585809 - DNA, 19 bp, Homo sapiens
ctgccctctgctctgcctg

SEQ ID NO: 1585810 - DNA, 21 bp, Homo sapiens
ctgccctctgctctgcctgga

SEQ ID NO: 1585811 - DNA, 22 bp, Homo sapiens
ctgccctctgctctgcctggag

SEQ ID NO: 1585812 - DNA, 13 bp, Homo sapiens
ctgccctctgctg

SEQ ID NO: 1585813 - DNA, 14 bp, Homo sapiens
ctgccctctgctgc

SEQ ID NO: 1585814 - DNA, 17 bp, Homo sapiens
ctgccctctgctgctgc

SEQ ID NO: 1585815 - DNA, 18 bp, Homo sapiens
ctgccctctgctgctgcc

SEQ ID NO: 1585816 - DNA, 19 bp, Homo sapiens
ctgccctctgctgctgccc

SEQ ID NO: 1585817 - DNA, 21 bp, Homo sapiens
ctgccctctgctgctgcccgg

SEQ ID NO: 1585818 - DNA, 13 bp, Homo sapiens
ctgccctgccact

SEQ ID NO: 1585819 - DNA, 11 bp, Homo sapiens
ctgccctgccc

SEQ ID NO: 1585820 - DNA, 13 bp, Homo sapiens
ctgccctgccccc

SEQ ID NO: 1585821 - DNA, 18 bp, Homo sapiens
ctgccctgccctagctcc

SEQ ID NO: 1585822 - DNA, 12 bp, Homo sapiens
ctgccctgcctg

SEQ ID NO: 1585823 - DNA, 14 bp, Homo sapiens
ctgccctgcctgag

SEQ ID NO: 1585824 - DNA, 14 bp, Homo sapiens
ctgccctgcctgcc

SEQ ID NO: 1585825 - DNA, 17 bp, Homo sapiens
ctgccctgcctgcccac

SEQ ID NO: 1585826 - DNA, 14 bp, Homo sapiens
ctgccctgctgttt

SEQ ID NO: 1585827 - DNA, 16 bp, Homo sapiens
ctgccctggctgctgc

SEQ ID NO: 1585828 - DNA, 18 bp, Homo sapiens
ctgccctggctgctgccc

SEQ ID NO: 1585829 - DNA, 21 bp, Homo sapiens
ctgccctggctgctgccccca

SEQ ID NO: 1585830 - DNA, 17 bp, Homo sapiens
ctgccctggctgtgatg

SEQ ID NO: 1585831 - DNA, 21 bp, Homo sapiens
ctgccctgggatgtccacaga

SEQ ID NO: 1585832 - DNA, 23 bp, Homo sapiens
ctgccctggtccagggaagctgg

SEQ ID NO: 1585833 - DNA, 18 bp, Homo sapiens
ctgccctggtgctgccac

SEQ ID NO: 1585834 - DNA, 19 bp, Homo sapiens
ctgccctggtgctgccaca

SEQ ID NO: 1585835 - DNA, 23 bp, Homo sapiens
ctgccctggtgctgccacacttc

SEQ ID NO: 1585836 - DNA, 13 bp, Homo sapiens
ctgccctgtaccc

SEQ ID NO: 1585837 - DNA, 21 bp, Homo sapiens
ctgccctgtaccccagcactt

SEQ ID NO: 1585838 - DNA, 14 bp, Homo sapiens
ctgccctgtggaca

SEQ ID NO: 1585839 - DNA, 15 bp, Homo sapiens
ctgccctgtggacag

SEQ ID NO: 1585840 - DNA, 22 bp, Homo sapiens
ctgccctgtgtacttcccgggc

SEQ ID NO: 1585841 - DNA, 15 bp, Homo sapiens
ctgccctgtttctgt

SEQ ID NO: 1585842 - DNA, 20 bp, Homo sapiens
ctgcccttccaggtgggtgt

SEQ ID NO: 1585843 - DNA, 12 bp, Homo sapiens
ctgcccttcctc

SEQ ID NO: 1585844 - DNA, 15 bp, Homo sapiens
ctgcccttcctcagt

SEQ ID NO: 1585845 - DNA, 20 bp, Homo sapiens
ctgcccttcctcctgatgga

SEQ ID NO: 1585846 - DNA, 16 bp, Homo sapiens
ctgcccttctcaagac

SEQ ID NO: 1585847 - DNA, 21 bp, Homo sapiens
ctgcccttgaaccccctccct

SEQ ID NO: 1585848 - DNA, 17 bp, Homo sapiens
ctgcccttgatcagccc

SEQ ID NO: 1585849 - DNA, 12 bp, Homo sapiens
ctgcccttgggc

SEQ ID NO: 1585850 - DNA, 17 bp, Homo sapiens
ctgcccttgttgcctgc

SEQ ID NO: 1585851 - DNA, 17 bp, Homo sapiens
ctgcccttttcaggaag

SEQ ID NO: 1585852 - DNA, 22 bp, Homo sapiens
ctgccgaacacacatcccagga

SEQ ID NO: 1585853 - DNA, 13 bp, Homo sapiens
ctgccgaccagag

SEQ ID NO: 1585854 - DNA, 15 bp, Homo sapiens
ctgccgaccagagcc

SEQ ID NO: 1585855 - DNA, 15 bp, Homo sapiens
ctgccgacctcgtcc

SEQ ID NO: 1585856 - DNA, 17 bp, Homo sapiens
ctgccgacttggagact

SEQ ID NO: 1585857 - DNA, 22 bp, Homo sapiens
ctgccgacttggagactcctgg

SEQ ID NO: 1585858 - DNA, 22 bp, Homo sapiens
ctgccgagtaatgacgtgtgtg

SEQ ID NO: 1585859 - DNA, 15 bp, Homo sapiens
ctgccgcaccccaga

SEQ ID NO: 1585860 - DNA, 18 bp, Homo sapiens
ctgccgcagacgggcaca

SEQ ID NO: 1585861 - DNA, 13 bp, Homo sapiens
ctgccgcagagct

SEQ ID NO: 1585862 - DNA, 17 bp, Homo sapiens
ctgccgcccccgcctgg

SEQ ID NO: 1585863 - DNA, 20 bp, Homo sapiens
ctgccgcccccgcctgggca

SEQ ID NO: 1585864 - DNA, 22 bp, Homo sapiens
ctgccgcccccgcctgggcacc

SEQ ID NO: 1585865 - DNA, 18 bp, Homo sapiens
ctgccgccccctcctgaa

SEQ ID NO: 1585866 - DNA, 22 bp, Homo sapiens
ctgccgctgcttccaggctggg

SEQ ID NO: 1585867 - DNA, 18 bp, Homo sapiens
ctgccggatctgggctgt

SEQ ID NO: 1585868 - DNA, 15 bp, Homo sapiens
ctgccgggctgaggg

SEQ ID NO: 1585869 - DNA, 19 bp, Homo sapiens
ctgccgggctgagggcctg

SEQ ID NO: 1585870 - DNA, 22 bp, Homo sapiens
ctgccgggctgagggcctgctg

SEQ ID NO: 1585871 - DNA, 21 bp, Homo sapiens
ctgccgggttctagtctcctt

SEQ ID NO: 1585872 - DNA, 18 bp, Homo sapiens
ctgccggtcccccatgcc

SEQ ID NO: 1585873 - DNA, 22 bp, Homo sapiens
ctgccggtcccccatgccacca

SEQ ID NO: 1585874 - DNA, 23 bp, Homo sapiens
ctgccggtcgggcagccagcaga

SEQ ID NO: 1585875 - DNA, 14 bp, Homo sapiens
ctgccggtgggacc

SEQ ID NO: 1585876 - DNA, 18 bp, Homo sapiens
ctgccggtgggaccctgt

SEQ ID NO: 1585877 - DNA, 22 bp, Homo sapiens
ctgccggtgggaccctgtccgg

SEQ ID NO: 1585878 - DNA, 20 bp, Homo sapiens
ctgccggtttgaaaatatgc

SEQ ID NO: 1585879 - DNA, 14 bp, Homo sapiens
ctgccgtgcatggc

SEQ ID NO: 1585880 - DNA, 16 bp, Homo sapiens
ctgccgtgcatggctc

SEQ ID NO: 1585881 - DNA, 14 bp, Homo sapiens
ctgccgtgcctgtg

SEQ ID NO: 1585882 - DNA, 20 bp, Homo sapiens
ctgccgtggggccgccgcct

SEQ ID NO: 1585883 - DNA, 18 bp, Homo sapiens
ctgcctaagtggctgctg

SEQ ID NO: 1585884 - DNA, 20 bp, Homo sapiens
ctgcctaagtggctgctgac

SEQ ID NO: 1585885 - DNA, 17 bp, Homo sapiens
ctgcctacacacacagc

SEQ ID NO: 1585886 - DNA, 20 bp, Homo sapiens
ctgcctacagaacttcagaa

SEQ ID NO: 1585887 - DNA, 17 bp, Homo sapiens
ctgcctacggagggtgg

SEQ ID NO: 1585888 - DNA, 23 bp, Homo sapiens
ctgcctagagtgtagcctaaagg

SEQ ID NO: 1585889 - DNA, 23 bp, Homo sapiens
ctgcctaggtttttcctactgtc

SEQ ID NO: 1585890 - DNA, 23 bp, Homo sapiens
ctgcctattcacgccgtaattct

SEQ ID NO: 1585891 - DNA, 20 bp, Homo sapiens
ctgcctcagccagtggcaca

SEQ ID NO: 1585892 - DNA, 22 bp, Homo sapiens
ctgcctcagccagtggcacagg

SEQ ID NO: 1585893 - DNA, 14 bp, Homo sapiens
ctgcctcagcccgc

SEQ ID NO: 1585894 - DNA, 16 bp, Homo sapiens
ctgcctcagcctcctg

SEQ ID NO: 1585895 - DNA, 13 bp, Homo sapiens
ctgcctccaccag

SEQ ID NO: 1585896 - DNA, 16 bp, Homo sapiens
ctgcctccaccgagcc

SEQ ID NO: 1585897 - DNA, 19 bp, Homo sapiens
ctgcctccaccgagccagc

SEQ ID NO: 1585898 - DNA, 22 bp, Homo sapiens
ctgcctccaccgagccagcttg

SEQ ID NO: 1585899 - DNA, 19 bp, Homo sapiens
ctgcctccagggctggact

SEQ ID NO: 1585900 - DNA, 19 bp, Homo sapiens
ctgcctccatggcagcagc

SEQ ID NO: 1585901 - DNA, 20 bp, Homo sapiens
ctgcctccatggcagcagcc

SEQ ID NO: 1585902 - DNA, 21 bp, Homo sapiens
ctgcctccatggcagcagcca

SEQ ID NO: 1585903 - DNA, 14 bp, Homo sapiens
ctgcctcccacttc

SEQ ID NO: 1585904 - DNA, 16 bp, Homo sapiens
ctgcctcccctccgca

SEQ ID NO: 1585905 - DNA, 23 bp, Homo sapiens
ctgcctccctctccatatctcct

SEQ ID NO: 1585906 - DNA, 22 bp, Homo sapiens
ctgcctccctggggaccaggag

SEQ ID NO: 1585907 - DNA, 14 bp, Homo sapiens
ctgcctcctgccac

SEQ ID NO: 1585908 - DNA, 14 bp, Homo sapiens
ctgcctcctgccct

SEQ ID NO: 1585909 - DNA, 13 bp, Homo sapiens
ctgcctcctgcct

SEQ ID NO: 1585910 - DNA, 15 bp, Homo sapiens
ctgcctcctggctca

SEQ ID NO: 1585911 - DNA, 18 bp, Homo sapiens
ctgcctcctttgcacctg

SEQ ID NO: 1585912 - DNA, 14 bp, Homo sapiens
ctgcctcggactcc

SEQ ID NO: 1585913 - DNA, 16 bp, Homo sapiens
ctgcctcggactccat

SEQ ID NO: 1585914 - DNA, 19 bp, Homo sapiens
ctgcctcggactccatggc

SEQ ID NO: 1585915 - DNA, 20 bp, Homo sapiens
ctgcctcggactccatggct

SEQ ID NO: 1585916 - DNA, 15 bp, Homo sapiens
ctgcctctagtcccc

SEQ ID NO: 1585917 - DNA, 20 bp, Homo sapiens
ctgcctctagtccccaaggc

SEQ ID NO: 1585918 - DNA, 13 bp, Homo sapiens
ctgcctctcacac

SEQ ID NO: 1585919 - DNA, 16 bp, Homo sapiens
ctgcctctcacacaca

SEQ ID NO: 1585920 - DNA, 21 bp, Homo sapiens
ctgcctctcacacacatagat

SEQ ID NO: 1585921 - DNA, 22 bp, Homo sapiens
ctgcctctcccatcacttccct

SEQ ID NO: 1585922 - DNA, 13 bp, Homo sapiens
ctgcctctgaaaa

SEQ ID NO: 1585923 - DNA, 18 bp, Homo sapiens
ctgcctctgaaaatattt

SEQ ID NO: 1585924 - DNA, 17 bp, Homo sapiens
ctgcctctgcctgcatt

SEQ ID NO: 1585925 - DNA, 14 bp, Homo sapiens
ctgcctctgctccc

SEQ ID NO: 1585926 - DNA, 17 bp, Homo sapiens
ctgcctctgctccctct

SEQ ID NO: 1585927 - DNA, 14 bp, Homo sapiens
ctgcctctgggcca

SEQ ID NO: 1585928 - DNA, 18 bp, Homo sapiens
ctgcctctttccctagga

SEQ ID NO: 1585929 - DNA, 19 bp, Homo sapiens
ctgcctctttccctaggaa

SEQ ID NO: 1585930 - DNA, 19 bp, Homo sapiens
ctgcctgaacctggggtca

SEQ ID NO: 1585931 - DNA, 17 bp, Homo sapiens
ctgcctgagattcttta

SEQ ID NO: 1585932 - DNA, 14 bp, Homo sapiens
ctgcctgagcccag

SEQ ID NO: 1585933 - DNA, 14 bp, Homo sapiens
ctgcctgaggagga

SEQ ID NO: 1585934 - DNA, 22 bp, Homo sapiens
ctgcctgaggaggaggacacag

SEQ ID NO: 1585935 - DNA, 21 bp, Homo sapiens
ctgcctgagggcccctctgcc

SEQ ID NO: 1585936 - DNA, 23 bp, Homo sapiens
ctgcctgagggcccctctgccca

SEQ ID NO: 1585937 - DNA, 18 bp, Homo sapiens
ctgcctgcaatatttgaa

SEQ ID NO: 1585938 - DNA, 13 bp, Homo sapiens
ctgcctgcactcc

SEQ ID NO: 1585939 - DNA, 23 bp, Homo sapiens
ctgcctgcactccctggccttgc

SEQ ID NO: 1585940 - DNA, 15 bp, Homo sapiens
ctgcctgcagagcag

SEQ ID NO: 1585941 - DNA, 21 bp, Homo sapiens
ctgcctgcagaggtctgtgct

SEQ ID NO: 1585942 - DNA, 23 bp, Homo sapiens
ctgcctgcatgagctggcaacca

SEQ ID NO: 1585943 - DNA, 15 bp, Homo sapiens
ctgcctgccagctgc

SEQ ID NO: 1585944 - DNA, 20 bp, Homo sapiens
ctgcctgccagctgcactga

SEQ ID NO: 1585945 - DNA, 11 bp, Homo sapiens
ctgcctgccat

SEQ ID NO: 1585946 - DNA, 13 bp, Homo sapiens
ctgcctgcctccc

SEQ ID NO: 1585947 - DNA, 16 bp, Homo sapiens
ctgcctgcctgtctgt

SEQ ID NO: 1585948 - DNA, 16 bp, Homo sapiens
ctgcctgctcatggcc

SEQ ID NO: 1585949 - DNA, 19 bp, Homo sapiens
ctgcctgctcatggccctc

SEQ ID NO: 1585950 - DNA, 18 bp, Homo sapiens
ctgcctggaacaccagca

SEQ ID NO: 1585951 - DNA, 23 bp, Homo sapiens
ctgcctggagacaaggtgctaac

SEQ ID NO: 1585952 - DNA, 22 bp, Homo sapiens
ctgcctggagacttagggcacc

SEQ ID NO: 1585953 - DNA, 16 bp, Homo sapiens
ctgcctggccaggccc

SEQ ID NO: 1585954 - DNA, 22 bp, Homo sapiens
ctgcctggccaggccctgggtc

SEQ ID NO: 1585955 - DNA, 11 bp, Homo sapiens
ctgcctggcct

SEQ ID NO: 1585956 - DNA, 15 bp, Homo sapiens
ctgcctggcctggct

SEQ ID NO: 1585957 - DNA, 19 bp, Homo sapiens
ctgcctggcctggctcccc

SEQ ID NO: 1585958 - DNA, 11 bp, Homo sapiens
ctgcctgggcc

SEQ ID NO: 1585959 - DNA, 12 bp, Homo sapiens
ctgcctgggcct

SEQ ID NO: 1585960 - DNA, 14 bp, Homo sapiens
ctgcctgggcctgt

SEQ ID NO: 1585961 - DNA, 23 bp, Homo sapiens
ctgcctgggcctgtgcagcagcc

SEQ ID NO: 1585962 - DNA, 19 bp, Homo sapiens
ctgcctgggctgttggcac

SEQ ID NO: 1585963 - DNA, 20 bp, Homo sapiens
ctgcctgggctgttggcact

SEQ ID NO: 1585964 - DNA, 21 bp, Homo sapiens
ctgcctgggctgttggcactc

SEQ ID NO: 1585965 - DNA, 22 bp, Homo sapiens
ctgcctggggcctccagaagct

SEQ ID NO: 1585966 - DNA, 21 bp, Homo sapiens
ctgcctggtcctccctcccaa

SEQ ID NO: 1585967 - DNA, 19 bp, Homo sapiens
ctgcctggtctgtctggat

SEQ ID NO: 1585968 - DNA, 18 bp, Homo sapiens
ctgcctggtgcattgctg

SEQ ID NO: 1585969 - DNA, 21 bp, Homo sapiens
ctgcctggtgcattgctgtgt

SEQ ID NO: 1585970 - DNA, 23 bp, Homo sapiens
ctgcctggtgcattgctgtgtga

SEQ ID NO: 1585971 - DNA, 17 bp, Homo sapiens
ctgcctgtatttgagag

SEQ ID NO: 1585972 - DNA, 18 bp, Homo sapiens
ctgcctgtatttgagaga

SEQ ID NO: 1585973 - DNA, 12 bp, Homo sapiens
ctgcctgtctcc

SEQ ID NO: 1585974 - DNA, 15 bp, Homo sapiens
ctgcctgtctccatg

SEQ ID NO: 1585975 - DNA, 15 bp, Homo sapiens
ctgcctgtctgtctc

SEQ ID NO: 1585976 - DNA, 17 bp, Homo sapiens
ctgcctgtgagccagtc

SEQ ID NO: 1585977 - DNA, 13 bp, Homo sapiens
ctgcctgtggcct

SEQ ID NO: 1585978 - DNA, 23 bp, Homo sapiens
ctgcctgtggccttgcccgccag

SEQ ID NO: 1585979 - DNA, 22 bp, Homo sapiens
ctgcctgtggcgccgtctccag

SEQ ID NO: 1585980 - DNA, 18 bp, Homo sapiens
ctgcctgttataactctg

SEQ ID NO: 1585981 - DNA, 19 bp, Homo sapiens
ctgcctgttggcaggccca

SEQ ID NO: 1585982 - DNA, 16 bp, Homo sapiens
ctgccttaaaaccaaa

SEQ ID NO: 1585983 - DNA, 17 bp, Homo sapiens
ctgccttaaaaccaaag

SEQ ID NO: 1585984 - DNA, 18 bp, Homo sapiens
ctgccttaaaaccaaaga

SEQ ID NO: 1585985 - DNA, 22 bp, Homo sapiens
ctgccttaatgacattcccctc

SEQ ID NO: 1585986 - DNA, 16 bp, Homo sapiens
ctgccttcacaaatgt

SEQ ID NO: 1585987 - DNA, 12 bp, Homo sapiens
ctgccttcctca

SEQ ID NO: 1585988 - DNA, 23 bp, Homo sapiens
ctgccttcgcttcttgcctctgt

SEQ ID NO: 1585989 - DNA, 13 bp, Homo sapiens
ctgccttcgttaa

SEQ ID NO: 1585990 - DNA, 19 bp, Homo sapiens
ctgccttcgttaactgtgt

SEQ ID NO: 1585991 - DNA, 17 bp, Homo sapiens
ctgccttctcaggcccc

SEQ ID NO: 1585992 - DNA, 24 bp, Homo sapiens
ctgccttcttcggggaactcctgg

SEQ ID NO: 1585993 - DNA, 17 bp, Homo sapiens
ctgccttctttccatca

SEQ ID NO: 1585994 - DNA, 16 bp, Homo sapiens
ctgccttgaagccact

SEQ ID NO: 1585995 - DNA, 22 bp, Homo sapiens
ctgccttggctcagacatgttt

SEQ ID NO: 1585996 - DNA, 15 bp, Homo sapiens
ctgccttgtccctct

SEQ ID NO: 1585997 - DNA, 19 bp, Homo sapiens
ctgccttgtccctctcact

SEQ ID NO: 1585998 - DNA, 15 bp, Homo sapiens
ctgcctttaagccaa

SEQ ID NO: 1585999 - DNA, 17 bp, Homo sapiens
ctgcctttaagccaaag

SEQ ID NO: 1586000 - DNA, 20 bp, Homo sapiens
ctgcctttaagccaaagaaa

SEQ ID NO: 1586001 - DNA, 23 bp, Homo sapiens
ctgcctttaagccaaagaaacaa

SEQ ID NO: 1586002 - DNA, 19 bp, Homo sapiens
ctgcctttagcctggacca

SEQ ID NO: 1586003 - DNA, 23 bp, Homo sapiens
ctgcctttagcctggaccaaagg

SEQ ID NO: 1586004 - DNA, 19 bp, Homo sapiens
ctgcctttatgatgctaag

SEQ ID NO: 1586005 - DNA, 14 bp, Homo sapiens
ctgcctttgcacca

SEQ ID NO: 1586006 - DNA, 23 bp, Homo sapiens
ctgcctttgcagttggactctca

SEQ ID NO: 1586007 - DNA, 21 bp, Homo sapiens
ctgcctttggcactctgactt

SEQ ID NO: 1586008 - DNA, 20 bp, Homo sapiens
ctgcgaagaccctcttgccc

SEQ ID NO: 1586009 - DNA, 22 bp, Homo sapiens
ctgcgaagaccctcttgcccat

SEQ ID NO: 1586010 - DNA, 19 bp, Homo sapiens
ctgcgaaggggccctggtc

SEQ ID NO: 1586011 - DNA, 14 bp, Homo sapiens
ctgcgactttctgc

SEQ ID NO: 1586012 - DNA, 19 bp, Homo sapiens
ctgcgactttctgcctgga

SEQ ID NO: 1586013 - DNA, 22 bp, Homo sapiens
ctgcgagacgcacacagctgag

SEQ ID NO: 1586014 - DNA, 23 bp, Homo sapiens
ctgcgagtagatgaacctgcagc

SEQ ID NO: 1586015 - DNA, 16 bp, Homo sapiens
ctgcgcaggtctcttc

SEQ ID NO: 1586016 - DNA, 18 bp, Homo sapiens
ctgcgcaggtctcttctg

SEQ ID NO: 1586017 - DNA, 18 bp, Homo sapiens
ctgcgccaggcagagctg

SEQ ID NO: 1586018 - DNA, 16 bp, Homo sapiens
ctgcgccagtcctgct

SEQ ID NO: 1586019 - DNA, 20 bp, Homo sapiens
ctgcgcctccagaggtcctc

SEQ ID NO: 1586020 - DNA, 15 bp, Homo sapiens
ctgcgcctgaaaagg

SEQ ID NO: 1586021 - DNA, 13 bp, Homo sapiens
ctgcggaagccaa

SEQ ID NO: 1586022 - DNA, 16 bp, Homo sapiens
ctgcggaagccaaagg

SEQ ID NO: 1586023 - DNA, 15 bp, Homo sapiens
ctgcggagccggcac

SEQ ID NO: 1586024 - DNA, 21 bp, Homo sapiens
ctgcggagtgaagaggggcag

SEQ ID NO: 1586025 - DNA, 23 bp, Homo sapiens
ctgcggagtgaagaggggcagcc

SEQ ID NO: 1586026 - DNA, 15 bp, Homo sapiens
ctgcggatctcagct

SEQ ID NO: 1586027 - DNA, 23 bp, Homo sapiens
ctgcggcgcgggcccctcacctg

SEQ ID NO: 1586028 - DNA, 15 bp, Homo sapiens
ctgcggctgtgggcg

SEQ ID NO: 1586029 - DNA, 18 bp, Homo sapiens
ctgcgggacagaggacca

SEQ ID NO: 1586030 - DNA, 18 bp, Homo sapiens
ctgcgggatggtcctggg

SEQ ID NO: 1586031 - DNA, 16 bp, Homo sapiens
ctgcgtccccactccc

SEQ ID NO: 1586032 - DNA, 13 bp, Homo sapiens
ctgcgtcctcatt

SEQ ID NO: 1586033 - DNA, 13 bp, Homo sapiens
ctgcgtcctcctc

SEQ ID NO: 1586034 - DNA, 14 bp, Homo sapiens
ctgcgtcctcctca

SEQ ID NO: 1586035 - DNA, 15 bp, Homo sapiens
ctgcgtcctcctcac

SEQ ID NO: 1586036 - DNA, 18 bp, Homo sapiens
ctgcgtcctcctcacctc

SEQ ID NO: 1586037 - DNA, 19 bp, Homo sapiens
ctgcgtcctcctcacctca

SEQ ID NO: 1586038 - DNA, 24 bp, Homo sapiens
ctgcgtcctcctcacctcatgccc

SEQ ID NO: 1586039 - DNA, 15 bp, Homo sapiens
ctgcgtgcacttccc

SEQ ID NO: 1586040 - DNA, 20 bp, Homo sapiens
ctgcgtgcagggacaaagag

SEQ ID NO: 1586041 - DNA, 13 bp, Homo sapiens
ctgcgttctgcaa

SEQ ID NO: 1586042 - DNA, 16 bp, Homo sapiens
ctgcgttggagccact

SEQ ID NO: 1586043 - DNA, 23 bp, Homo sapiens
ctgcgttggagccactcctgtcc

SEQ ID NO: 1586044 - DNA, 17 bp, Homo sapiens
ctgcgtttggaggcccc

SEQ ID NO: 1586045 - DNA, 20 bp, Homo sapiens
ctgcgttttggaagctctga

SEQ ID NO: 1586046 - DNA, 14 bp, Homo sapiens
ctgctaaatcctca

SEQ ID NO: 1586047 - DNA, 13 bp, Homo sapiens
ctgctaagaagct

SEQ ID NO: 1586048 - DNA, 16 bp, Homo sapiens
ctgctaaggctcctcc

SEQ ID NO: 1586049 - DNA, 14 bp, Homo sapiens
ctgctaagtagggg

SEQ ID NO: 1586050 - DNA, 21 bp, Homo sapiens
ctgctaagtatttcccagcac

SEQ ID NO: 1586051 - DNA, 23 bp, Homo sapiens
ctgctaagtatttcccagcacat

SEQ ID NO: 1586052 - DNA, 18 bp, Homo sapiens
ctgctaagttctcccaac

SEQ ID NO: 1586053 - DNA, 16 bp, Homo sapiens
ctgctaataaaaccca

SEQ ID NO: 1586054 - DNA, 15 bp, Homo sapiens
ctgctaattctttgc

SEQ ID NO: 1586055 - DNA, 23 bp, Homo sapiens
ctgctacaaatactcttaggaag

SEQ ID NO: 1586056 - DNA, 16 bp, Homo sapiens
ctgctacatcagactc

SEQ ID NO: 1586057 - DNA, 17 bp, Homo sapiens
ctgctacatcagactct

SEQ ID NO: 1586058 - DNA, 21 bp, Homo sapiens
ctgctacattataatgtacag

SEQ ID NO: 1586059 - DNA, 16 bp, Homo sapiens
ctgctacctctgagaa

SEQ ID NO: 1586060 - DNA, 17 bp, Homo sapiens
ctgctacctctgagaag

SEQ ID NO: 1586061 - DNA, 13 bp, Homo sapiens
ctgctacctgttc

SEQ ID NO: 1586062 - DNA, 18 bp, Homo sapiens
ctgctacctttcaaagct

SEQ ID NO: 1586063 - DNA, 16 bp, Homo sapiens
ctgctactacccgagc

SEQ ID NO: 1586064 - DNA, 20 bp, Homo sapiens
ctgctactacccgagcccag

SEQ ID NO: 1586065 - DNA, 22 bp, Homo sapiens
ctgctactacccgagcccagct

SEQ ID NO: 1586066 - DNA, 17 bp, Homo sapiens
ctgctactctgttcctt

SEQ ID NO: 1586067 - DNA, 16 bp, Homo sapiens
ctgctactgtcttact

SEQ ID NO: 1586068 - DNA, 15 bp, Homo sapiens
ctgctacttccccag

SEQ ID NO: 1586069 - DNA, 12 bp, Homo sapiens
ctgctagaacct

SEQ ID NO: 1586070 - DNA, 19 bp, Homo sapiens
ctgctagagcaacccctgt

SEQ ID NO: 1586071 - DNA, 16 bp, Homo sapiens
ctgctagagccagcaa

SEQ ID NO: 1586072 - DNA, 22 bp, Homo sapiens
ctgctagattttaatttatttg

SEQ ID NO: 1586073 - DNA, 16 bp, Homo sapiens
ctgctagctgtagaaa

SEQ ID NO: 1586074 - DNA, 20 bp, Homo sapiens
ctgctagtgaaatggctggg

SEQ ID NO: 1586075 - DNA, 22 bp, Homo sapiens
ctgctatgaaaatgagcatcag

SEQ ID NO: 1586076 - DNA, 17 bp, Homo sapiens
ctgctatttacactatt

SEQ ID NO: 1586077 - DNA, 22 bp, Homo sapiens
ctgctcaactctacccctgctc

SEQ ID NO: 1586078 - DNA, 18 bp, Homo sapiens
ctgctcaagccgcaagct

SEQ ID NO: 1586079 - DNA, 20 bp, Homo sapiens
ctgctcaagccgcaagctct

SEQ ID NO: 1586080 - DNA, 22 bp, Homo sapiens
ctgctcaagccgcaagctctca

SEQ ID NO: 1586081 - DNA, 20 bp, Homo sapiens
ctgctcaccgcccatcaggg

SEQ ID NO: 1586082 - DNA, 20 bp, Homo sapiens
ctgctcacctgtgtgcccag

SEQ ID NO: 1586083 - DNA, 18 bp, Homo sapiens
ctgctcacgtcaaatgca

SEQ ID NO: 1586084 - DNA, 18 bp, Homo sapiens
ctgctcacgtctctgccg

SEQ ID NO: 1586085 - DNA, 18 bp, Homo sapiens
ctgctcactttaaacctg

SEQ ID NO: 1586086 - DNA, 22 bp, Homo sapiens
ctgctcagaacttgctgctgtc

SEQ ID NO: 1586087 - DNA, 14 bp, Homo sapiens
ctgctcagcagcca

SEQ ID NO: 1586088 - DNA, 20 bp, Homo sapiens
ctgctcagcagccagtctca

SEQ ID NO: 1586089 - DNA, 21 bp, Homo sapiens
ctgctcagcctcatcctgaga

SEQ ID NO: 1586090 - DNA, 23 bp, Homo sapiens
ctgctcagctctggtccaggccc

SEQ ID NO: 1586091 - DNA, 19 bp, Homo sapiens
ctgctcagtaaagcacttg

SEQ ID NO: 1586092 - DNA, 15 bp, Homo sapiens
ctgctcataggacct

SEQ ID NO: 1586093 - DNA, 16 bp, Homo sapiens
ctgctcataggacctg

SEQ ID NO: 1586094 - DNA, 17 bp, Homo sapiens
ctgctcataggacctgc

SEQ ID NO: 1586095 - DNA, 20 bp, Homo sapiens
ctgctcataggacctgcatc

SEQ ID NO: 1586096 - DNA, 19 bp, Homo sapiens
ctgctcatattgtgattct

SEQ ID NO: 1586097 - DNA, 21 bp, Homo sapiens
ctgctcattacagttctttcc

SEQ ID NO: 1586098 - DNA, 20 bp, Homo sapiens
ctgctccaccagcagcatgg

SEQ ID NO: 1586099 - DNA, 11 bp, Homo sapiens
ctgctccaccc

SEQ ID NO: 1586100 - DNA, 16 bp, Homo sapiens
ctgctccacccttggc

SEQ ID NO: 1586101 - DNA, 13 bp, Homo sapiens
ctgctccagaaga

SEQ ID NO: 1586102 - DNA, 15 bp, Homo sapiens
ctgctccagacctga

SEQ ID NO: 1586103 - DNA, 22 bp, Homo sapiens
ctgctccagcaactgcccttcc

SEQ ID NO: 1586104 - DNA, 13 bp, Homo sapiens
ctgctccagcagc

SEQ ID NO: 1586105 - DNA, 19 bp, Homo sapiens
ctgctccagcagcacacct

SEQ ID NO: 1586106 - DNA, 20 bp, Homo sapiens
ctgctccataccttttctct

SEQ ID NO: 1586107 - DNA, 21 bp, Homo sapiens
ctgctccataccttttctctt

SEQ ID NO: 1586108 - DNA, 19 bp, Homo sapiens
ctgctccatgactggctgt

SEQ ID NO: 1586109 - DNA, 19 bp, Homo sapiens
ctgctcccagatgccttct

SEQ ID NO: 1586110 - DNA, 23 bp, Homo sapiens
ctgctcccagatgccttctagat

SEQ ID NO: 1586111 - DNA, 16 bp, Homo sapiens
ctgctcccagcagccc

SEQ ID NO: 1586112 - DNA, 17 bp, Homo sapiens
ctgctcccagcagccct

SEQ ID NO: 1586113 - DNA, 21 bp, Homo sapiens
ctgctcccagcagccctaagg

SEQ ID NO: 1586114 - DNA, 13 bp, Homo sapiens
ctgctcccagtgg

SEQ ID NO: 1586115 - DNA, 14 bp, Homo sapiens
ctgctcccattcct

SEQ ID NO: 1586116 - DNA, 23 bp, Homo sapiens
ctgctcccccaccccctccccag

SEQ ID NO: 1586117 - DNA, 13 bp, Homo sapiens
ctgctcccctaac

SEQ ID NO: 1586118 - DNA, 15 bp, Homo sapiens
ctgctccgctgcctg

SEQ ID NO: 1586119 - DNA, 16 bp, Homo sapiens
ctgctccgctgcctgg

SEQ ID NO: 1586120 - DNA, 18 bp, Homo sapiens
ctgctccgctgcctggaa

SEQ ID NO: 1586121 - DNA, 13 bp, Homo sapiens
ctgctcctcaccc

SEQ ID NO: 1586122 - DNA, 12 bp, Homo sapiens
ctgctcctccag

SEQ ID NO: 1586123 - DNA, 16 bp, Homo sapiens
ctgctcctccagggcc

SEQ ID NO: 1586124 - DNA, 11 bp, Homo sapiens
ctgctcctccc

SEQ ID NO: 1586125 - DNA, 12 bp, Homo sapiens
ctgctcctccct

SEQ ID NO: 1586126 - DNA, 13 bp, Homo sapiens
ctgctcctccctg

SEQ ID NO: 1586127 - DNA, 18 bp, Homo sapiens
ctgctcctccctgccccc

SEQ ID NO: 1586128 - DNA, 20 bp, Homo sapiens
ctgctcctccctgcccccca

SEQ ID NO: 1586129 - DNA, 18 bp, Homo sapiens
ctgctcctccctggctgc

SEQ ID NO: 1586130 - DNA, 21 bp, Homo sapiens
ctgctcctccctggctgccct

SEQ ID NO: 1586131 - DNA, 12 bp, Homo sapiens
ctgctcctgctt

SEQ ID NO: 1586132 - DNA, 14 bp, Homo sapiens
ctgctcctgctttt

SEQ ID NO: 1586133 - DNA, 22 bp, Homo sapiens
ctgctcctgcttttctgtcctg

SEQ ID NO: 1586134 - DNA, 16 bp, Homo sapiens
ctgctcctgtggcagg

SEQ ID NO: 1586135 - DNA, 12 bp, Homo sapiens
ctgctccttcac

SEQ ID NO: 1586136 - DNA, 21 bp, Homo sapiens
ctgctccttcactgttccctc

SEQ ID NO: 1586137 - DNA, 22 bp, Homo sapiens
ctgctccttcactgttccctct

SEQ ID NO: 1586138 - DNA, 18 bp, Homo sapiens
ctgctcggcttcttggac

SEQ ID NO: 1586139 - DNA, 22 bp, Homo sapiens
ctgctcggcttcttggaccttg

SEQ ID NO: 1586140 - DNA, 19 bp, Homo sapiens
ctgctcgtggactgtgctg

SEQ ID NO: 1586141 - DNA, 18 bp, Homo sapiens
ctgctctagattcataaa

SEQ ID NO: 1586142 - DNA, 19 bp, Homo sapiens
ctgctctagattcataaat

SEQ ID NO: 1586143 - DNA, 16 bp, Homo sapiens
ctgctctagccaggag

SEQ ID NO: 1586144 - DNA, 17 bp, Homo sapiens
ctgctctagccaggagt

SEQ ID NO: 1586145 - DNA, 22 bp, Homo sapiens
ctgctctagggaatctggatta

SEQ ID NO: 1586146 - DNA, 23 bp, Homo sapiens
ctgctctattgtagcatttcttg

SEQ ID NO: 1586147 - DNA, 17 bp, Homo sapiens
ctgctctcagcctccca

SEQ ID NO: 1586148 - DNA, 15 bp, Homo sapiens
ctgctctcttcagga

SEQ ID NO: 1586149 - DNA, 19 bp, Homo sapiens
ctgctctcttcaggaggcc

SEQ ID NO: 1586150 - DNA, 22 bp, Homo sapiens
ctgctctgagaattgttgagat

SEQ ID NO: 1586151 - DNA, 11 bp, Homo sapiens
ctgctctgccc

SEQ ID NO: 1586152 - DNA, 13 bp, Homo sapiens
ctgctctgcccct

SEQ ID NO: 1586153 - DNA, 16 bp, Homo sapiens
ctgctctgcctggagt

SEQ ID NO: 1586154 - DNA, 23 bp, Homo sapiens
ctgctctgcgtggcgcaggtgcc

SEQ ID NO: 1586155 - DNA, 12 bp, Homo sapiens
ctgctctgggac

SEQ ID NO: 1586156 - DNA, 14 bp, Homo sapiens
ctgctctgggacgt

SEQ ID NO: 1586157 - DNA, 18 bp, Homo sapiens
ctgctctgggacgtggac

SEQ ID NO: 1586158 - DNA, 13 bp, Homo sapiens
ctgctctggtggc

SEQ ID NO: 1586159 - DNA, 19 bp, Homo sapiens
ctgctcttagtgcccgcct

SEQ ID NO: 1586160 - DNA, 15 bp, Homo sapiens
ctgctcttcatccca

SEQ ID NO: 1586161 - DNA, 19 bp, Homo sapiens
ctgctcttgcagttgctct

SEQ ID NO: 1586162 - DNA, 14 bp, Homo sapiens
ctgctcttgtttct

SEQ ID NO: 1586163 - DNA, 15 bp, Homo sapiens
ctgctctttctctgc

SEQ ID NO: 1586164 - DNA, 18 bp, Homo sapiens
ctgctctttctctgccag

SEQ ID NO: 1586165 - DNA, 21 bp, Homo sapiens
ctgctctttctctgccagtga

SEQ ID NO: 1586166 - DNA, 16 bp, Homo sapiens
ctgctgaaatttggaa

SEQ ID NO: 1586167 - DNA, 17 bp, Homo sapiens
ctgctgaacacagtgtc

SEQ ID NO: 1586168 - DNA, 12 bp, Homo sapiens
ctgctgaagctg

SEQ ID NO: 1586169 - DNA, 17 bp, Homo sapiens
ctgctgaagctgctgca

SEQ ID NO: 1586170 - DNA, 16 bp, Homo sapiens
ctgctgaagttctgag

SEQ ID NO: 1586171 - DNA, 18 bp, Homo sapiens
ctgctgaagttctgagcc

SEQ ID NO: 1586172 - DNA, 22 bp, Homo sapiens
ctgctgaatgatttccaaagag

SEQ ID NO: 1586173 - DNA, 19 bp, Homo sapiens
ctgctgaatgcagggaatg

SEQ ID NO: 1586174 - DNA, 22 bp, Homo sapiens
ctgctgacacgcagcctgctct

SEQ ID NO: 1586175 - DNA, 17 bp, Homo sapiens
ctgctgacagacactaa

SEQ ID NO: 1586176 - DNA, 9 bp, Homo sapiens
ctgctgacc

SEQ ID NO: 1586177 - DNA, 22 bp, Homo sapiens
ctgctgaccaaatggccagttt

SEQ ID NO: 1586178 - DNA, 20 bp, Homo sapiens
ctgctgaccaattgtgctgc

SEQ ID NO: 1586179 - DNA, 21 bp, Homo sapiens
ctgctgaccaattgtgctgcc

SEQ ID NO: 1586180 - DNA, 15 bp, Homo sapiens
ctgctgacctcactg

SEQ ID NO: 1586181 - DNA, 23 bp, Homo sapiens
ctgctgacctcactgtcctgtga

SEQ ID NO: 1586182 - DNA, 21 bp, Homo sapiens
ctgctgagagacccaaggagg

SEQ ID NO: 1586183 - DNA, 22 bp, Homo sapiens
ctgctgagagacccaaggagga

SEQ ID NO: 1586184 - DNA, 14 bp, Homo sapiens
ctgctgaggcagtg

SEQ ID NO: 1586185 - DNA, 13 bp, Homo sapiens
ctgctgaggccca

SEQ ID NO: 1586186 - DNA, 14 bp, Homo sapiens
ctgctgaggcccag

SEQ ID NO: 1586187 - DNA, 17 bp, Homo sapiens
ctgctgaggcccagtgc

SEQ ID NO: 1586188 - DNA, 19 bp, Homo sapiens
ctgctgaggcccagtgcat

SEQ ID NO: 1586189 - DNA, 20 bp, Homo sapiens
ctgctgaggcccagtgcata

SEQ ID NO: 1586190 - DNA, 22 bp, Homo sapiens
ctgctgaggcccagtgcatatg

SEQ ID NO: 1586191 - DNA, 17 bp, Homo sapiens
ctgctgagggaccagcc

SEQ ID NO: 1586192 - DNA, 23 bp, Homo sapiens
ctgctgagggaccttggagagct

SEQ ID NO: 1586193 - DNA, 20 bp, Homo sapiens
ctgctgagtcagactgtcag

SEQ ID NO: 1586194 - DNA, 13 bp, Homo sapiens
ctgctgagtgaca

SEQ ID NO: 1586195 - DNA, 14 bp, Homo sapiens
ctgctgagtgacag

SEQ ID NO: 1586196 - DNA, 21 bp, Homo sapiens
ctgctgagttggcctggccat

SEQ ID NO: 1586197 - DNA, 22 bp, Homo sapiens
ctgctgagttggcctggccatt

SEQ ID NO: 1586198 - DNA, 23 bp, Homo sapiens
ctgctgatatcaacagcttccct

SEQ ID NO: 1586199 - DNA, 14 bp, Homo sapiens
ctgctgattcttgt

SEQ ID NO: 1586200 - DNA, 15 bp, Homo sapiens
ctgctgattcttgta

SEQ ID NO: 1586201 - DNA, 19 bp, Homo sapiens
ctgctgattcttgtaaatc

SEQ ID NO: 1586202 - DNA, 21 bp, Homo sapiens
ctgctgattcttgtaaatctt

SEQ ID NO: 1586203 - DNA, 21 bp, Homo sapiens
ctgctgcaaaggacagtgggc

SEQ ID NO: 1586204 - DNA, 21 bp, Homo sapiens
ctgctgcaaggtggcctctgc

SEQ ID NO: 1586205 - DNA, 14 bp, Homo sapiens
ctgctgcaccagag

SEQ ID NO: 1586206 - DNA, 15 bp, Homo sapiens
ctgctgcaccagagt

SEQ ID NO: 1586207 - DNA, 16 bp, Homo sapiens
ctgctgcaccagagtg

SEQ ID NO: 1586208 - DNA, 13 bp, Homo sapiens
ctgctgcagccct

SEQ ID NO: 1586209 - DNA, 14 bp, Homo sapiens
ctgctgcagccctg

SEQ ID NO: 1586210 - DNA, 13 bp, Homo sapiens
ctgctgcaggaca

SEQ ID NO: 1586211 - DNA, 18 bp, Homo sapiens
ctgctgcaggacattaat

SEQ ID NO: 1586212 - DNA, 22 bp, Homo sapiens
ctgctgcaggccgtgtgtctgt

SEQ ID NO: 1586213 - DNA, 13 bp, Homo sapiens
ctgctgcatactt

SEQ ID NO: 1586214 - DNA, 16 bp, Homo sapiens
ctgctgcatggggtgg

SEQ ID NO: 1586215 - DNA, 20 bp, Homo sapiens
ctgctgccagcacagtaggt

SEQ ID NO: 1586216 - DNA, 21 bp, Homo sapiens
ctgctgcccccaccccgggga

SEQ ID NO: 1586217 - DNA, 16 bp, Homo sapiens
ctgctgccccgcttcc

SEQ ID NO: 1586218 - DNA, 19 bp, Homo sapiens
ctgctgccccgcttcccca

SEQ ID NO: 1586219 - DNA, 23 bp, Homo sapiens
ctgctgccccgcttccccacaga

SEQ ID NO: 1586220 - DNA, 14 bp, Homo sapiens
ctgctgcccctgca

SEQ ID NO: 1586221 - DNA, 14 bp, Homo sapiens
ctgctgccctccca

SEQ ID NO: 1586222 - DNA, 15 bp, Homo sapiens
ctggacttcctgtca

SEQ ID NO: 1586223 - DNA, 23 bp, Homo sapiens
ctggacttcctgtcattttcaca

SEQ ID NO: 1586224 - DNA, 23 bp, Homo sapiens
ctggacttctacctgccctcaag

SEQ ID NO: 1586225 - DNA, 14 bp, Homo sapiens
ctggactttcctgc

SEQ ID NO: 1586226 - DNA, 16 bp, Homo sapiens
ctggactttcctgcaa

SEQ ID NO: 1586227 - DNA, 18 bp, Homo sapiens
ctggactttcctgcaact

SEQ ID NO: 1586228 - DNA, 18 bp, Homo sapiens
ctggagaaaaaggtgcca

SEQ ID NO: 1586229 - DNA, 14 bp, Homo sapiens
ctggagaaagagct

SEQ ID NO: 1586230 - DNA, 19 bp, Homo sapiens
ctggagaaagagctgcctg

SEQ ID NO: 1586231 - DNA, 15 bp, Homo sapiens
ctggagaactagaga

SEQ ID NO: 1586232 - DNA, 14 bp, Homo sapiens
ctggagaattgact

SEQ ID NO: 1586233 - DNA, 16 bp, Homo sapiens
ctggagacaaggtgct

SEQ ID NO: 1586234 - DNA, 18 bp, Homo sapiens
ctggagaccagggagcct

SEQ ID NO: 1586235 - DNA, 19 bp, Homo sapiens
ctggagaccagggagcctt

SEQ ID NO: 1586236 - DNA, 23 bp, Homo sapiens
ctggagatattataagggagagc

SEQ ID NO: 1586237 - DNA, 15 bp, Homo sapiens
ctggagatgcagcta

SEQ ID NO: 1586238 - DNA, 15 bp, Homo sapiens
ctggagatggatcct

SEQ ID NO: 1586239 - DNA, 19 bp, Homo sapiens
ctggagcaacctactgtct

SEQ ID NO: 1586240 - DNA, 20 bp, Homo sapiens
ctggagcaagaaggaaggag

SEQ ID NO: 1586241 - DNA, 15 bp, Homo sapiens
ctggagcaccaggca

SEQ ID NO: 1586242 - DNA, 13 bp, Homo sapiens
ctggagcagacca

SEQ ID NO: 1586243 - DNA, 13 bp, Homo sapiens
ctggagcagccaa

SEQ ID NO: 1586244 - DNA, 18 bp, Homo sapiens
ctggagcagccaaggccg

SEQ ID NO: 1586245 - DNA, 23 bp, Homo sapiens
ctggagcagcggattgctctgga

SEQ ID NO: 1586246 - DNA, 13 bp, Homo sapiens
ctggagcaggagc

SEQ ID NO: 1586247 - DNA, 16 bp, Homo sapiens
ctggagcaggagcccc

SEQ ID NO: 1586248 - DNA, 16 bp, Homo sapiens
ctggagcatggacagt

SEQ ID NO: 1586249 - DNA, 12 bp, Homo sapiens
ctggagccaggg

SEQ ID NO: 1586250 - DNA, 16 bp, Homo sapiens
ctggagccagggcaga

SEQ ID NO: 1586251 - DNA, 19 bp, Homo sapiens
ctggagccagggcagagga

SEQ ID NO: 1586252 - DNA, 22 bp, Homo sapiens
ctggagccatcccttcggagcc

SEQ ID NO: 1586253 - DNA, 17 bp, Homo sapiens
ctggagcccagaggagg

SEQ ID NO: 1586254 - DNA, 12 bp, Homo sapiens
ctggagcccctg

SEQ ID NO: 1586255 - DNA, 18 bp, Homo sapiens
ctggagcccctgggtggg

SEQ ID NO: 1586256 - DNA, 14 bp, Homo sapiens
ctggagccctaacc

SEQ ID NO: 1586257 - DNA, 24 bp, Homo sapiens
ctggagcctccgacgctgcctctc

SEQ ID NO: 1586258 - DNA, 17 bp, Homo sapiens
ctggagcctgcagatga

SEQ ID NO: 1586259 - DNA, 16 bp, Homo sapiens
ctggagctctgtgggt

SEQ ID NO: 1586260 - DNA, 23 bp, Homo sapiens
ctggagctctgtgggtctctgga

SEQ ID NO: 1586261 - DNA, 21 bp, Homo sapiens
ctggagctcttggaagagctc

SEQ ID NO: 1586262 - DNA, 17 bp, Homo sapiens
ctggagctgggagacaa

SEQ ID NO: 1586263 - DNA, 16 bp, Homo sapiens
ctggagctgtccttca

SEQ ID NO: 1586264 - DNA, 20 bp, Homo sapiens
ctggagcttttaaaaatgtt

SEQ ID NO: 1586265 - DNA, 20 bp, Homo sapiens
ctggaggaaagggaggagtg

SEQ ID NO: 1586266 - DNA, 18 bp, Homo sapiens
ctggaggaacacttgatg

SEQ ID NO: 1586267 - DNA, 19 bp, Homo sapiens
ctggaggaagccagtgggg

SEQ ID NO: 1586268 - DNA, 18 bp, Homo sapiens
ctggaggagcagcttcct

SEQ ID NO: 1586269 - DNA, 16 bp, Homo sapiens
ctggaggagctggcct

SEQ ID NO: 1586270 - DNA, 17 bp, Homo sapiens
ctggaggagctggcctg

SEQ ID NO: 1586271 - DNA, 19 bp, Homo sapiens
ctggaggagctggcctgtg

SEQ ID NO: 1586272 - DNA, 20 bp, Homo sapiens
ctggaggagctggcctgtgg

SEQ ID NO: 1586273 - DNA, 20 bp, Homo sapiens
ctggaggcacgcaccactgc

SEQ ID NO: 1586274 - DNA, 20 bp, Homo sapiens
ctggaggcagggccttgccc

SEQ ID NO: 1586275 - DNA, 22 bp, Homo sapiens
ctggaggcagggccttgcccag

SEQ ID NO: 1586276 - DNA, 21 bp, Homo sapiens
ctggaggcagggggtgagggg

SEQ ID NO: 1586277 - DNA, 18 bp, Homo sapiens
ctggaggcccaggctggg

SEQ ID NO: 1586278 - DNA, 19 bp, Homo sapiens
ctggaggcccaggctggga

SEQ ID NO: 1586279 - DNA, 21 bp, Homo sapiens
ctggaggcccagttcaccctg

SEQ ID NO: 1586280 - DNA, 19 bp, Homo sapiens
ctggaggcccctggagcca

SEQ ID NO: 1586281 - DNA, 12 bp, Homo sapiens
ctggaggccgag

SEQ ID NO: 1586282 - DNA, 14 bp, Homo sapiens
ctggaggcctcagg

SEQ ID NO: 1586283 - DNA, 17 bp, Homo sapiens
ctggaggggagagcttt

SEQ ID NO: 1586284 - DNA, 18 bp, Homo sapiens
ctggaggggagagctttg

SEQ ID NO: 1586285 - DNA, 16 bp, Homo sapiens
ctggaggggcaccagg

SEQ ID NO: 1586286 - DNA, 14 bp, Homo sapiens
ctggaggggcccac

SEQ ID NO: 1586287 - DNA, 12 bp, Homo sapiens
ctggaggggtgg

SEQ ID NO: 1586288 - DNA, 15 bp, Homo sapiens
ctggaggggtgggga

SEQ ID NO: 1586289 - DNA, 16 bp, Homo sapiens
ctggaggggtggggag

SEQ ID NO: 1586290 - DNA, 14 bp, Homo sapiens
ctggaggtcatctg

SEQ ID NO: 1586291 - DNA, 16 bp, Homo sapiens
ctggaggtctggctga

SEQ ID NO: 1586292 - DNA, 17 bp, Homo sapiens
ctggaggtctggctgag

SEQ ID NO: 1586293 - DNA, 18 bp, Homo sapiens
ctggaggtctggctgagc

SEQ ID NO: 1586294 - DNA, 20 bp, Homo sapiens
ctggaggtctggctgagccc

SEQ ID NO: 1586295 - DNA, 15 bp, Homo sapiens
ctggaggtggggttg

SEQ ID NO: 1586296 - DNA, 22 bp, Homo sapiens
ctggaggtggggttgggattgg

SEQ ID NO: 1586297 - DNA, 15 bp, Homo sapiens
ctggagtcagggtga

SEQ ID NO: 1586298 - DNA, 14 bp, Homo sapiens
ctggagtccctgtg

SEQ ID NO: 1586299 - DNA, 18 bp, Homo sapiens
ctggagtctcagagcaca

SEQ ID NO: 1586300 - DNA, 16 bp, Homo sapiens
ctggagtgaggcttcc

SEQ ID NO: 1586301 - DNA, 20 bp, Homo sapiens
ctggagtgaggcttccaggc

SEQ ID NO: 1586302 - DNA, 19 bp, Homo sapiens
ctggagtgcccccagccca

SEQ ID NO: 1586303 - DNA, 19 bp, Homo sapiens
ctggagtgcgctcttggtc

SEQ ID NO: 1586304 - DNA, 20 bp, Homo sapiens
ctggagtgtcggatcctgtg

SEQ ID NO: 1586305 - DNA, 21 bp, Homo sapiens
ctggagtgtcggatcctgtga

SEQ ID NO: 1586306 - DNA, 20 bp, Homo sapiens
ctggagttccttatccctct

SEQ ID NO: 1586307 - DNA, 21 bp, Homo sapiens
ctggagttccttatccctctc

SEQ ID NO: 1586308 - DNA, 20 bp, Homo sapiens
ctggagttgatctggaaccc

SEQ ID NO: 1586309 - DNA, 22 bp, Homo sapiens
ctggagttgatctggaacccag

SEQ ID NO: 1586310 - DNA, 16 bp, Homo sapiens
ctggataaagccactg

SEQ ID NO: 1586311 - DNA, 13 bp, Homo sapiens
ctggatagacttg

SEQ ID NO: 1586312 - DNA, 19 bp, Homo sapiens
ctggattaatgttttgtac

SEQ ID NO: 1586313 - DNA, 21 bp, Homo sapiens
ctggattataagttctatttt

SEQ ID NO: 1586314 - DNA, 23 bp, Homo sapiens
ctggattataagttctattttac

SEQ ID NO: 1586315 - DNA, 16 bp, Homo sapiens
ctggattcatttcctg

SEQ ID NO: 1586316 - DNA, 18 bp, Homo sapiens
ctggattcatttcctgcc

SEQ ID NO: 1586317 - DNA, 19 bp, Homo sapiens
ctggattcatttcctgccc

SEQ ID NO: 1586318 - DNA, 22 bp, Homo sapiens
ctggattccagcagtgaatgct

SEQ ID NO: 1586319 - DNA, 18 bp, Homo sapiens
ctggatttgggagctctg

SEQ ID NO: 1586320 - DNA, 19 bp, Homo sapiens
ctggatttgggagctctgc

SEQ ID NO: 1586321 - DNA, 22 bp, Homo sapiens
ctggatttttttttctttatat

SEQ ID NO: 1586322 - DNA, 18 bp, Homo sapiens
ctggcaaaccctcccaga

SEQ ID NO: 1586323 - DNA, 19 bp, Homo sapiens
ctggcaaagggagcagaac

SEQ ID NO: 1586324 - DNA, 23 bp, Homo sapiens
ctggcaacaacagcttcagtcca

SEQ ID NO: 1586325 - DNA, 22 bp, Homo sapiens
ctggcaacatagtgagatccca

SEQ ID NO: 1586326 - DNA, 19 bp, Homo sapiens
ctggcaatgtttatttcat

SEQ ID NO: 1586327 - DNA, 12 bp, Homo sapiens
ctggcacacatc

SEQ ID NO: 1586328 - DNA, 14 bp, Homo sapiens
ctggcacaggactg

SEQ ID NO: 1586329 - DNA, 15 bp, Homo sapiens
ctggcacaggactga

SEQ ID NO: 1586330 - DNA, 18 bp, Homo sapiens
ctggcacagttttctgag

SEQ ID NO: 1586331 - DNA, 12 bp, Homo sapiens
ctggcacattgt

SEQ ID NO: 1586332 - DNA, 14 bp, Homo sapiens
ctggcaccatcagc

SEQ ID NO: 1586333 - DNA, 17 bp, Homo sapiens
ctggcaccatcagcctg

SEQ ID NO: 1586334 - DNA, 23 bp, Homo sapiens
ctggcacgccctactccactgcc

SEQ ID NO: 1586335 - DNA, 15 bp, Homo sapiens
ctggcactataatgt

SEQ ID NO: 1586336 - DNA, 23 bp, Homo sapiens
ctggcactataatgtaagctcta

SEQ ID NO: 1586337 - DNA, 18 bp, Homo sapiens
ctggcacttagcccaaga

SEQ ID NO: 1586338 - DNA, 23 bp, Homo sapiens
ctggcacttagcccaagaggtct

SEQ ID NO: 1586339 - DNA, 21 bp, Homo sapiens
ctggcagaaagcaaatgtgac

SEQ ID NO: 1586340 - DNA, 12 bp, Homo sapiens
ctggcagaagca

SEQ ID NO: 1586341 - DNA, 20 bp, Homo sapiens
ctggcagacacaacccaata

SEQ ID NO: 1586342 - DNA, 13 bp, Homo sapiens
ctggcagcagcag

SEQ ID NO: 1586343 - DNA, 13 bp, Homo sapiens
ctggcagccgtgc

SEQ ID NO: 1586344 - DNA, 19 bp, Homo sapiens
ctggcagccgtgccttcag

SEQ ID NO: 1586345 - DNA, 12 bp, Homo sapiens
ctggcagcctgc

SEQ ID NO: 1586346 - DNA, 17 bp, Homo sapiens
ctggcagcctgcacctg

SEQ ID NO: 1586347 - DNA, 19 bp, Homo sapiens
ctggcagctcctctccttg

SEQ ID NO: 1586348 - DNA, 21 bp, Homo sapiens
ctggcagctcctctccttggg

SEQ ID NO: 1586349 - DNA, 17 bp, Homo sapiens
ctggcagctctggacag

SEQ ID NO: 1586350 - DNA, 18 bp, Homo sapiens
ctggcagctctggacagc

SEQ ID NO: 1586351 - DNA, 12 bp, Homo sapiens
ctggcagctgag

SEQ ID NO: 1586352 - DNA, 15 bp, Homo sapiens
ctggcagctgagagc

SEQ ID NO: 1586353 - DNA, 20 bp, Homo sapiens
ctggcagggacctgagagca

SEQ ID NO: 1586354 - DNA, 19 bp, Homo sapiens
ctggcaggggagacaggag

SEQ ID NO: 1586355 - DNA, 20 bp, Homo sapiens
ctggcaggggagacaggagc

SEQ ID NO: 1586356 - DNA, 17 bp, Homo sapiens
ctggcagggtgggatgg

SEQ ID NO: 1586357 - DNA, 22 bp, Homo sapiens
ctggcaggtgcagatgggctgt

SEQ ID NO: 1586358 - DNA, 20 bp, Homo sapiens
ctggcaggtggccaggcagg

SEQ ID NO: 1586359 - DNA, 23 bp, Homo sapiens
ctggcaggtgttgggacctgctg

SEQ ID NO: 1586360 - DNA, 15 bp, Homo sapiens
ctggcataactaaaa

SEQ ID NO: 1586361 - DNA, 22 bp, Homo sapiens
ctggcatcaagaggtgggaggg

SEQ ID NO: 1586362 - DNA, 18 bp, Homo sapiens
ctggcatcgcaccattct

SEQ ID NO: 1586363 - DNA, 20 bp, Homo sapiens
ctggcatcgcaccattctga

SEQ ID NO: 1586364 - DNA, 22 bp, Homo sapiens
ctggcatcgcaccattctgact

SEQ ID NO: 1586365 - DNA, 14 bp, Homo sapiens
ctggcatctgctct

SEQ ID NO: 1586366 - DNA, 16 bp, Homo sapiens
ctggcatcttctggag

SEQ ID NO: 1586367 - DNA, 23 bp, Homo sapiens
ctggcattacaggtgtgagccac

SEQ ID NO: 1586368 - DNA, 18 bp, Homo sapiens
ctggcattagaattattt

SEQ ID NO: 1586369 - DNA, 18 bp, Homo sapiens
ctggccaaacccttgctt

SEQ ID NO: 1586370 - DNA, 20 bp, Homo sapiens
ctggccaaagagcctttcca

SEQ ID NO: 1586371 - DNA, 13 bp, Homo sapiens
ctggccaacatgg

SEQ ID NO: 1586372 - DNA, 18 bp, Homo sapiens
ctggccaaggtgtccagg

SEQ ID NO: 1586373 - DNA, 21 bp, Homo sapiens
ctggccacaaggaaaaggagg

SEQ ID NO: 1586374 - DNA, 24 bp, Homo sapiens
ctggccacaaggaaaaggaggagg

SEQ ID NO: 1586375 - DNA, 20 bp, Homo sapiens
ctggccacaaggacgctggc

SEQ ID NO: 1586376 - DNA, 13 bp, Homo sapiens
ctggccaccaggc

SEQ ID NO: 1586377 - DNA, 17 bp, Homo sapiens
ctggccaccatggtcat

SEQ ID NO: 1586378 - DNA, 21 bp, Homo sapiens
ctggccacctagaagtctccc

SEQ ID NO: 1586379 - DNA, 16 bp, Homo sapiens
ctggccacctctctcc

SEQ ID NO: 1586380 - DNA, 18 bp, Homo sapiens
ctggccacgcagccagga

SEQ ID NO: 1586381 - DNA, 20 bp, Homo sapiens
ctggccacgcagccaggaca

SEQ ID NO: 1586382 - DNA, 17 bp, Homo sapiens
ctggccactaaagcttc

SEQ ID NO: 1586383 - DNA, 18 bp, Homo sapiens
ctggccactaaagcttca

SEQ ID NO: 1586384 - DNA, 20 bp, Homo sapiens
ctggccactaaagcttcaga

SEQ ID NO: 1586385 - DNA, 13 bp, Homo sapiens
ctggccagaatgc

SEQ ID NO: 1586386 - DNA, 17 bp, Homo sapiens
ctggccagacacaggcc

SEQ ID NO: 1586387 - DNA, 19 bp, Homo sapiens
ctggccagacacaggccct

SEQ ID NO: 1586388 - DNA, 11 bp, Homo sapiens
ctggccagaga

SEQ ID NO: 1586389 - DNA, 23 bp, Homo sapiens
ctggccagagagggcccagctgt

SEQ ID NO: 1586390 - DNA, 14 bp, Homo sapiens
ctggccaggagcag

SEQ ID NO: 1586391 - DNA, 13 bp, Homo sapiens
ctggccaggagct

SEQ ID NO: 1586392 - DNA, 20 bp, Homo sapiens
ctggccaggagctcttcagg

SEQ ID NO: 1586393 - DNA, 11 bp, Homo sapiens
ctggccaggca

SEQ ID NO: 1586394 - DNA, 14 bp, Homo sapiens
ctggccaggccctg

SEQ ID NO: 1586395 - DNA, 14 bp, Homo sapiens
ctggccagggccac

SEQ ID NO: 1586396 - DNA, 17 bp, Homo sapiens
ctggccagggccacgct

SEQ ID NO: 1586397 - DNA, 18 bp, Homo sapiens
ctggccagggccacgctc

SEQ ID NO: 1586398 - DNA, 23 bp, Homo sapiens
ctggccagggccacgctccagct

SEQ ID NO: 1586399 - DNA, 13 bp, Homo sapiens
ctggccaggggtc

SEQ ID NO: 1586400 - DNA, 18 bp, Homo sapiens
ctggccagtccaggctgc

SEQ ID NO: 1586401 - DNA, 19 bp, Homo sapiens
ctggccagtccaggctgcc

SEQ ID NO: 1586402 - DNA, 22 bp, Homo sapiens
ctggccagtccaggctgccgtg

SEQ ID NO: 1586403 - DNA, 18 bp, Homo sapiens
ctggccagtcctggtcct

SEQ ID NO: 1586404 - DNA, 16 bp, Homo sapiens
ctggccagtcttcctc

SEQ ID NO: 1586405 - DNA, 13 bp, Homo sapiens
ctggctctccaag

SEQ ID NO: 1586406 - DNA, 18 bp, Homo sapiens
ctggctctgccccctccc

SEQ ID NO: 1586407 - DNA, 20 bp, Homo sapiens
ctggctctgccccctccccc

SEQ ID NO: 1586408 - DNA, 21 bp, Homo sapiens
ctggctctgccccctccccca

SEQ ID NO: 1586409 - DNA, 12 bp, Homo sapiens
ctggctctgtga

SEQ ID NO: 1586410 - DNA, 21 bp, Homo sapiens
ctggctcttgatacccccctc

SEQ ID NO: 1586411 - DNA, 23 bp, Homo sapiens
ctggctcttgatacccccctctg

SEQ ID NO: 1586412 - DNA, 17 bp, Homo sapiens
ctggctgaaccctgtgc

SEQ ID NO: 1586413 - DNA, 23 bp, Homo sapiens
ctggctgaaccctgtgctggtgt

SEQ ID NO: 1586414 - DNA, 20 bp, Homo sapiens
ctggctgagcccctggggaa

SEQ ID NO: 1586415 - DNA, 21 bp, Homo sapiens
ctggctgagtggaatgcaggg

SEQ ID NO: 1586416 - DNA, 24 bp, Homo sapiens
ctggctgagtggaatgcagggaag

SEQ ID NO: 1586417 - DNA, 18 bp, Homo sapiens
ctggctgatgatccagaa

SEQ ID NO: 1586418 - DNA, 14 bp, Homo sapiens
ctggctgcactctt

SEQ ID NO: 1586419 - DNA, 13 bp, Homo sapiens
ctggctgcagtga

SEQ ID NO: 1586420 - DNA, 17 bp, Homo sapiens
ctggctgccaggcgttg

SEQ ID NO: 1586421 - DNA, 23 bp, Homo sapiens
ctggctgccaggcgttggtgcca

SEQ ID NO: 1586422 - DNA, 20 bp, Homo sapiens
ctggctgccccaacctgctg

SEQ ID NO: 1586423 - DNA, 14 bp, Homo sapiens
ctggctgccctggc

SEQ ID NO: 1586424 - DNA, 16 bp, Homo sapiens
ctggctgccctggccc

SEQ ID NO: 1586425 - DNA, 17 bp, Homo sapiens
ctggctgccctggccct

SEQ ID NO: 1586426 - DNA, 18 bp, Homo sapiens
ctggctgccctggccctg

SEQ ID NO: 1586427 - DNA, 20 bp, Homo sapiens
ctggctgccctggccctgag

SEQ ID NO: 1586428 - DNA, 19 bp, Homo sapiens
ctggctgccttagaacctt

SEQ ID NO: 1586429 - DNA, 13 bp, Homo sapiens
ctggctgctgccc

SEQ ID NO: 1586430 - DNA, 17 bp, Homo sapiens
ctggctggagagctgct

SEQ ID NO: 1586431 - DNA, 20 bp, Homo sapiens
ctggctggagtctcagagca

SEQ ID NO: 1586432 - DNA, 15 bp, Homo sapiens
ctggctggcaggtgt

SEQ ID NO: 1586433 - DNA, 17 bp, Homo sapiens
ctggctggcctcaccca

SEQ ID NO: 1586434 - DNA, 14 bp, Homo sapiens
ctggctgggcatgg

SEQ ID NO: 1586435 - DNA, 17 bp, Homo sapiens
ctggctgggcatggacg

SEQ ID NO: 1586436 - DNA, 15 bp, Homo sapiens
ctggctgggccttca

SEQ ID NO: 1586437 - DNA, 20 bp, Homo sapiens
ctggctgggctggctgaaga

SEQ ID NO: 1586438 - DNA, 13 bp, Homo sapiens
ctggctggggcag

SEQ ID NO: 1586439 - DNA, 22 bp, Homo sapiens
ctggctggggcagaggggcagc

SEQ ID NO: 1586440 - DNA, 23 bp, Homo sapiens
ctggctggtgggaaggccggcag

SEQ ID NO: 1586441 - DNA, 15 bp, Homo sapiens
ctggctgtaaggctc

SEQ ID NO: 1586442 - DNA, 19 bp, Homo sapiens
ctggctgtcagtatgacat

SEQ ID NO: 1586443 - DNA, 16 bp, Homo sapiens
ctggctgtctagaatg

SEQ ID NO: 1586444 - DNA, 17 bp, Homo sapiens
ctggctgtctagaatgt

SEQ ID NO: 1586445 - DNA, 19 bp, Homo sapiens
ctggctgtgacacctggtg

SEQ ID NO: 1586446 - DNA, 13 bp, Homo sapiens
ctggctgtgagca

SEQ ID NO: 1586447 - DNA, 16 bp, Homo sapiens
ctggctgtgagcagcc

SEQ ID NO: 1586448 - DNA, 14 bp, Homo sapiens
ctggctgtgcccag

SEQ ID NO: 1586449 - DNA, 20 bp, Homo sapiens
ctggctgtgcccagcaggcc

SEQ ID NO: 1586450 - DNA, 21 bp, Homo sapiens
ctggctgtgcccagcaggccc

SEQ ID NO: 1586451 - DNA, 18 bp, Homo sapiens
ctggctgtggaggcctga

SEQ ID NO: 1586452 - DNA, 21 bp, Homo sapiens
ctggctgtggaggcctgatgc

SEQ ID NO: 1586453 - DNA, 22 bp, Homo sapiens
ctggctgtggaggcctgatgct

SEQ ID NO: 1586454 - DNA, 23 bp, Homo sapiens
ctggctgttctgtggttcctctg

SEQ ID NO: 1586455 - DNA, 12 bp, Homo sapiens
ctggctgtttga

SEQ ID NO: 1586456 - DNA, 20 bp, Homo sapiens
ctggcttacctatctgtgga

SEQ ID NO: 1586457 - DNA, 21 bp, Homo sapiens
ctggcttcagcccccaccagg

SEQ ID NO: 1586458 - DNA, 14 bp, Homo sapiens
ctggcttccctgga

SEQ ID NO: 1586459 - DNA, 15 bp, Homo sapiens
ctggcttccctggaa

SEQ ID NO: 1586460 - DNA, 20 bp, Homo sapiens
ctggcttctctcttttcctc

SEQ ID NO: 1586461 - DNA, 18 bp, Homo sapiens
ctggcttctgcttgtcat

SEQ ID NO: 1586462 - DNA, 15 bp, Homo sapiens
ctggcttctggagcc

SEQ ID NO: 1586463 - DNA, 16 bp, Homo sapiens
ctggcttctggagccc

SEQ ID NO: 1586464 - DNA, 20 bp, Homo sapiens
ctggcttctggagcccttgg

SEQ ID NO: 1586465 - DNA, 14 bp, Homo sapiens
ctggcttctgtgca

SEQ ID NO: 1586466 - DNA, 21 bp, Homo sapiens
ctggcttgaaggactgcagac

SEQ ID NO: 1586467 - DNA, 22 bp, Homo sapiens
ctggcttgaaggactgcagaca

SEQ ID NO: 1586468 - DNA, 22 bp, Homo sapiens
ctggcttgctccagggtcttgg

SEQ ID NO: 1586469 - DNA, 19 bp, Homo sapiens
ctggcttgtaactccacca

SEQ ID NO: 1586470 - DNA, 13 bp, Homo sapiens
ctggcttgtacat

SEQ ID NO: 1586471 - DNA, 15 bp, Homo sapiens
ctggctttctctctg

SEQ ID NO: 1586472 - DNA, 15 bp, Homo sapiens
ctggctttgcctctt

SEQ ID NO: 1586473 - DNA, 20 bp, Homo sapiens
ctggctttggtgaactgttg

SEQ ID NO: 1586474 - DNA, 19 bp, Homo sapiens
ctggcttttgcctgtaaga

SEQ ID NO: 1586475 - DNA, 20 bp, Homo sapiens
ctggctttttctgccactga

SEQ ID NO: 1586476 - DNA, 23 bp, Homo sapiens
ctgggaaaaaagttttgatgaaa

SEQ ID NO: 1586477 - DNA, 22 bp, Homo sapiens
ctgggaaaaactttggaaccag

SEQ ID NO: 1586478 - DNA, 9 bp, Homo sapiens
ctgggaaac

SEQ ID NO: 1586479 - DNA, 20 bp, Homo sapiens
ctgggaaaggacccacccat

SEQ ID NO: 1586480 - DNA, 14 bp, Homo sapiens
ctgggaaccactcc

SEQ ID NO: 1586481 - DNA, 20 bp, Homo sapiens
ctgggaaccactcccaccac

SEQ ID NO: 1586482 - DNA, 13 bp, Homo sapiens
ctgggaaccccgc

SEQ ID NO: 1586483 - DNA, 17 bp, Homo sapiens
ctgggaactcatctggt

SEQ ID NO: 1586484 - DNA, 22 bp, Homo sapiens
ctgggaagataggctctgcaca

SEQ ID NO: 1586485 - DNA, 20 bp, Homo sapiens
ctgggaagcctgtgccagca

SEQ ID NO: 1586486 - DNA, 23 bp, Homo sapiens
ctgggaagctgtactcagagcag

SEQ ID NO: 1586487 - DNA, 19 bp, Homo sapiens
ctgggaagcttgagcctcc

SEQ ID NO: 1586488 - DNA, 20 bp, Homo sapiens
ctgggaagcttgagcctccc

SEQ ID NO: 1586489 - DNA, 23 bp, Homo sapiens
ctgggaagcttgagcctccccca

SEQ ID NO: 1586490 - DNA, 17 bp, Homo sapiens
ctgggaaggagggagct

SEQ ID NO: 1586491 - DNA, 22 bp, Homo sapiens
ctgggaaggagggagctgctca

SEQ ID NO: 1586492 - DNA, 23 bp, Homo sapiens
ctgggaaggagggagctgctcag

SEQ ID NO: 1586493 - DNA, 17 bp, Homo sapiens
ctgggaaggccacctcc

SEQ ID NO: 1586494 - DNA, 16 bp, Homo sapiens
ctgggaatgggagagg

SEQ ID NO: 1586495 - DNA, 18 bp, Homo sapiens
ctgggaatgggagagggg

SEQ ID NO: 1586496 - DNA, 15 bp, Homo sapiens
ctgggaatggggaca

SEQ ID NO: 1586497 - DNA, 18 bp, Homo sapiens
ctgggaatggggacacgg

SEQ ID NO: 1586498 - DNA, 23 bp, Homo sapiens
ctgggaatgggggagagaaggga

SEQ ID NO: 1586499 - DNA, 19 bp, Homo sapiens
ctgggaatgtattattctg

SEQ ID NO: 1586500 - DNA, 19 bp, Homo sapiens
ctgggacacttaacagatg

SEQ ID NO: 1586501 - DNA, 14 bp, Homo sapiens
ctgggacagctggc

SEQ ID NO: 1586502 - DNA, 16 bp, Homo sapiens
ctgggacagctggctg

SEQ ID NO: 1586503 - DNA, 12 bp, Homo sapiens
ctgggaccagag

SEQ ID NO: 1586504 - DNA, 15 bp, Homo sapiens
ctgggacccacctcc

SEQ ID NO: 1586505 - DNA, 17 bp, Homo sapiens
ctgggacccagctactc

SEQ ID NO: 1586506 - DNA, 21 bp, Homo sapiens
ctgggacccgaggatttctgg

SEQ ID NO: 1586507 - DNA, 12 bp, Homo sapiens
ctggccccagcc

SEQ ID NO: 1586508 - DNA, 20 bp, Homo sapiens
ctggccccaggtagaaactt

SEQ ID NO: 1586509 - DNA, 16 bp, Homo sapiens
ctggccccatgtctct

SEQ ID NO: 1586510 - DNA, 23 bp, Homo sapiens
ctggcccccaacctcagggctcc

SEQ ID NO: 1586511 - DNA, 11 bp, Homo sapiens
ctggcccccag

SEQ ID NO: 1586512 - DNA, 16 bp, Homo sapiens
ctggccccgcctgcct

SEQ ID NO: 1586513 - DNA, 20 bp, Homo sapiens
ctggccccgcctgcctgcca

SEQ ID NO: 1586514 - DNA, 21 bp, Homo sapiens
ctggccccgggctctggccac

SEQ ID NO: 1586515 - DNA, 18 bp, Homo sapiens
ctggcccgtcatgttcct

SEQ ID NO: 1586516 - DNA, 22 bp, Homo sapiens
ctggcccgtcatgttcctcaaa

SEQ ID NO: 1586517 - DNA, 17 bp, Homo sapiens
ctggccctcacccctgc

SEQ ID NO: 1586518 - DNA, 16 bp, Homo sapiens
ctggccctcagtttcc

SEQ ID NO: 1586519 - DNA, 21 bp, Homo sapiens
ctggccctccactcctcatcc

SEQ ID NO: 1586520 - DNA, 11 bp, Homo sapiens
ctggccctgcc

SEQ ID NO: 1586521 - DNA, 21 bp, Homo sapiens
ctggccctgcttcctgcttgc

SEQ ID NO: 1586522 - DNA, 22 bp, Homo sapiens
ctggccctgcttcctgcttgcc

SEQ ID NO: 1586523 - DNA, 14 bp, Homo sapiens
ctggccctggggat

SEQ ID NO: 1586524 - DNA, 15 bp, Homo sapiens
ctggccctgttctcc

SEQ ID NO: 1586525 - DNA, 14 bp, Homo sapiens
ctggcccttcagtc

SEQ ID NO: 1586526 - DNA, 17 bp, Homo sapiens
ctggcccttcagtctgc

SEQ ID NO: 1586527 - DNA, 18 bp, Homo sapiens
ctggcccttcagtctgct

SEQ ID NO: 1586528 - DNA, 19 bp, Homo sapiens
ctggcccttcagtctgctc

SEQ ID NO: 1586529 - DNA, 21 bp, Homo sapiens
ctggcccttcagtctgctcca

SEQ ID NO: 1586530 - DNA, 23 bp, Homo sapiens
ctggcccttcagtctgctccacc

SEQ ID NO: 1586531 - DNA, 21 bp, Homo sapiens
ctggccgagggtcctggctcc

SEQ ID NO: 1586532 - DNA, 13 bp, Homo sapiens
ctggccgccaccc

SEQ ID NO: 1586533 - DNA, 13 bp, Homo sapiens
ctggccgccccct

SEQ ID NO: 1586534 - DNA, 16 bp, Homo sapiens
ctggccgctaagttgc

SEQ ID NO: 1586535 - DNA, 23 bp, Homo sapiens
ctggccggctccagtttccccat

SEQ ID NO: 1586536 - DNA, 14 bp, Homo sapiens
ctggccggtgctgg

SEQ ID NO: 1586537 - DNA, 21 bp, Homo sapiens
ctggccggtgctgggttccca

SEQ ID NO: 1586538 - DNA, 16 bp, Homo sapiens
ctggccgttcagcctg

SEQ ID NO: 1586539 - DNA, 19 bp, Homo sapiens
ctggccgttcagcctgtct

SEQ ID NO: 1586540 - DNA, 19 bp, Homo sapiens
ctggcctagaccagcagac

SEQ ID NO: 1586541 - DNA, 22 bp, Homo sapiens
ctggcctagaccagcagacaga

SEQ ID NO: 1586542 - DNA, 19 bp, Homo sapiens
ctggcctaggggccagggc

SEQ ID NO: 1586543 - DNA, 14 bp, Homo sapiens
ctggcctcactggc

SEQ ID NO: 1586544 - DNA, 14 bp, Homo sapiens
ctggcctccagctc

SEQ ID NO: 1586545 - DNA, 18 bp, Homo sapiens
ctggcctccagctcccac

SEQ ID NO: 1586546 - DNA, 20 bp, Homo sapiens
ctggcctccagctcccactc

SEQ ID NO: 1586547 - DNA, 17 bp, Homo sapiens
ctggcctcccacccgat

SEQ ID NO: 1586548 - DNA, 16 bp, Homo sapiens
ctggcctcccctgcca

SEQ ID NO: 1586549 - DNA, 14 bp, Homo sapiens
ctggcctctgcttt

SEQ ID NO: 1586550 - DNA, 21 bp, Homo sapiens
ctggcctctgggcagtgtggc

SEQ ID NO: 1586551 - DNA, 11 bp, Homo sapiens
ctggcctctgt

SEQ ID NO: 1586552 - DNA, 18 bp, Homo sapiens
ctggcctgaactgaggag

SEQ ID NO: 1586553 - DNA, 12 bp, Homo sapiens
ctggcctgagct

SEQ ID NO: 1586554 - DNA, 14 bp, Homo sapiens
ctggcctgagctgg

SEQ ID NO: 1586555 - DNA, 14 bp, Homo sapiens
ctggcctgctggga

SEQ ID NO: 1586556 - DNA, 17 bp, Homo sapiens
ctggcctgctgggaacc

SEQ ID NO: 1586557 - DNA, 23 bp, Homo sapiens
ctggcctgctgggaaccccgcag

SEQ ID NO: 1586558 - DNA, 19 bp, Homo sapiens
ctggcctgctgggctctcc

SEQ ID NO: 1586559 - DNA, 20 bp, Homo sapiens
ctggcctgctgggctctcca

SEQ ID NO: 1586560 - DNA, 22 bp, Homo sapiens
ctggcctggactgttttctctc

SEQ ID NO: 1586561 - DNA, 12 bp, Homo sapiens
ctggcctggatc

SEQ ID NO: 1586562 - DNA, 21 bp, Homo sapiens
ctggcctggatctccccactc

SEQ ID NO: 1586563 - DNA, 13 bp, Homo sapiens
ctggcctggcaca

SEQ ID NO: 1586564 - DNA, 16 bp, Homo sapiens
ctggcctggcacacat

SEQ ID NO: 1586565 - DNA, 18 bp, Homo sapiens
ctggcctggcacacatca

SEQ ID NO: 1586566 - DNA, 22 bp, Homo sapiens
ctggcctggcacacatcaggag

SEQ ID NO: 1586567 - DNA, 19 bp, Homo sapiens
ctggcctggctccccacga

SEQ ID NO: 1586568 - DNA, 17 bp, Homo sapiens
ctggcctgggccacacc

SEQ ID NO: 1586569 - DNA, 21 bp, Homo sapiens
ctggcctggtccctggtcctt

SEQ ID NO: 1586570 - DNA, 16 bp, Homo sapiens
ctggcctgtggcacag

SEQ ID NO: 1586571 - DNA, 22 bp, Homo sapiens
ctggccttaaaaggggcccaag

SEQ ID NO: 1586572 - DNA, 19 bp, Homo sapiens
ctggcctttttcatttatc

SEQ ID NO: 1586573 - DNA, 13 bp, Homo sapiens
ctggcgcagccaa

SEQ ID NO: 1586574 - DNA, 16 bp, Homo sapiens
ctggcgcagccaaggc

SEQ ID NO: 1586575 - DNA, 15 bp, Homo sapiens
ctggcgcctccgagg

SEQ ID NO: 1586576 - DNA, 13 bp, Homo sapiens
ctggcgccttctc

SEQ ID NO: 1586577 - DNA, 16 bp, Homo sapiens
ctggcgccttctcgga

SEQ ID NO: 1586578 - DNA, 19 bp, Homo sapiens
ctggcggagatgggtcctg

SEQ ID NO: 1586579 - DNA, 22 bp, Homo sapiens
ctggcggcccttctgactgttt

SEQ ID NO: 1586580 - DNA, 23 bp, Homo sapiens
ctggcggcccttctgactgttta

SEQ ID NO: 1586581 - DNA, 16 bp, Homo sapiens
ctggcggctactcagc

SEQ ID NO: 1586582 - DNA, 23 bp, Homo sapiens
ctggcggctactcagcagccctc

SEQ ID NO: 1586583 - DNA, 18 bp, Homo sapiens
ctggcggcttcctgtcca

SEQ ID NO: 1586584 - DNA, 19 bp, Homo sapiens
ctggcggcttcctgtccac

SEQ ID NO: 1586585 - DNA, 13 bp, Homo sapiens
ctggcgtgctcag

SEQ ID NO: 1586586 - DNA, 16 bp, Homo sapiens
ctggcgtgctcagacc

SEQ ID NO: 1586587 - DNA, 16 bp, Homo sapiens
ctggcgttctcaagaa

SEQ ID NO: 1586588 - DNA, 21 bp, Homo sapiens
ctggctacagtaccatgcctc

SEQ ID NO: 1586589 - DNA, 12 bp, Homo sapiens
ctggctacatcc

SEQ ID NO: 1586590 - DNA, 14 bp, Homo sapiens
ctggctactgtcta

SEQ ID NO: 1586591 - DNA, 21 bp, Homo sapiens
ctggctactgtctattaaaat

SEQ ID NO: 1586592 - DNA, 17 bp, Homo sapiens
ctggctacttcccttcc

SEQ ID NO: 1586593 - DNA, 18 bp, Homo sapiens
ctggctacttcccttcct

SEQ ID NO: 1586594 - DNA, 14 bp, Homo sapiens
ctggctagagccga

SEQ ID NO: 1586595 - DNA, 17 bp, Homo sapiens
ctggctagagccgaggg

SEQ ID NO: 1586596 - DNA, 17 bp, Homo sapiens
ctggctagagtcctcac

SEQ ID NO: 1586597 - DNA, 20 bp, Homo sapiens
ctggctagagtcctcactcc

SEQ ID NO: 1586598 - DNA, 21 bp, Homo sapiens
ctggctagagtcctcactccc

SEQ ID NO: 1586599 - DNA, 19 bp, Homo sapiens
ctggctcactggcaggtgt

SEQ ID NO: 1586600 - DNA, 15 bp, Homo sapiens
ctggctcaggcccag

SEQ ID NO: 1586601 - DNA, 20 bp, Homo sapiens
ctggctcagggtcaaagaca

SEQ ID NO: 1586602 - DNA, 14 bp, Homo sapiens
ctggctccactctt

SEQ ID NO: 1586603 - DNA, 23 bp, Homo sapiens
ctggctccactcttgatctctct

SEQ ID NO: 1586604 - DNA, 18 bp, Homo sapiens
ctggctccaggcagaagg

SEQ ID NO: 1586605 - DNA, 14 bp, Homo sapiens
ctgggacctcctta

SEQ ID NO: 1586606 - DNA, 19 bp, Homo sapiens
ctgggacctgccaggcagg

SEQ ID NO: 1586607 - DNA, 20 bp, Homo sapiens
ctgggacctgccaggcaggg

SEQ ID NO: 1586608 - DNA, 23 bp, Homo sapiens
ctgggaccttctttattctgtgt

SEQ ID NO: 1586609 - DNA, 20 bp, Homo sapiens
ctgggacgtggacatgcctc

SEQ ID NO: 1586610 - DNA, 17 bp, Homo sapiens
ctgggactacaggcgcc

SEQ ID NO: 1586611 - DNA, 22 bp, Homo sapiens
ctgggactacaggctcatgcca

SEQ ID NO: 1586612 - DNA, 21 bp, Homo sapiens
ctgggactcagccttcagaca

SEQ ID NO: 1586613 - DNA, 13 bp, Homo sapiens
ctgggactctcct

SEQ ID NO: 1586614 - DNA, 16 bp, Homo sapiens
ctgggactctcctcct

SEQ ID NO: 1586615 - DNA, 19 bp, Homo sapiens
ctgggactctcctcctccc

SEQ ID NO: 1586616 - DNA, 20 bp, Homo sapiens
ctgggactctcctcctcccc

SEQ ID NO: 1586617 - DNA, 23 bp, Homo sapiens
ctgggactctcctcctcccctcc

SEQ ID NO: 1586618 - DNA, 14 bp, Homo sapiens
ctgggactgagcca

SEQ ID NO: 1586619 - DNA, 16 bp, Homo sapiens
ctgggactgagccagt

SEQ ID NO: 1586620 - DNA, 14 bp, Homo sapiens
ctgggacttccatg

SEQ ID NO: 1586621 - DNA, 17 bp, Homo sapiens
ctgggacttccatgcct

SEQ ID NO: 1586622 - DNA, 15 bp, Homo sapiens
ctgggagaaaatcat

SEQ ID NO: 1586623 - DNA, 19 bp, Homo sapiens
ctgggagaaaatcatcaag

SEQ ID NO: 1586624 - DNA, 14 bp, Homo sapiens
ctgggagaacctca

SEQ ID NO: 1586625 - DNA, 15 bp, Homo sapiens
ctgggagaacctcag

SEQ ID NO: 1586626 - DNA, 12 bp, Homo sapiens
ctgggagaccct

SEQ ID NO: 1586627 - DNA, 22 bp, Homo sapiens
ctgggagccacttctccccaga

SEQ ID NO: 1586628 - DNA, 12 bp, Homo sapiens
ctgggagcccag

SEQ ID NO: 1586629 - DNA, 13 bp, Homo sapiens
ctgggagcccaga

SEQ ID NO: 1586630 - DNA, 17 bp, Homo sapiens
ctgggagctccactctg

SEQ ID NO: 1586631 - DNA, 14 bp, Homo sapiens
ctgggaggaagcag

SEQ ID NO: 1586632 - DNA, 21 bp, Homo sapiens
ctgggaggaagcaggttgagg

SEQ ID NO: 1586633 - DNA, 14 bp, Homo sapiens
ctgggaggaaggac

SEQ ID NO: 1586634 - DNA, 17 bp, Homo sapiens
ctgggaggagggagagg

SEQ ID NO: 1586635 - DNA, 19 bp, Homo sapiens
ctgggaggagggagaggga

SEQ ID NO: 1586636 - DNA, 18 bp, Homo sapiens
ctgggaggcaagaaaagg

SEQ ID NO: 1586637 - DNA, 23 bp, Homo sapiens
ctgggaggcaagaggggtggaga

SEQ ID NO: 1586638 - DNA, 13 bp, Homo sapiens
ctgggaggcagag

SEQ ID NO: 1586639 - DNA, 20 bp, Homo sapiens
ctgggagggttcccctggcc

SEQ ID NO: 1586640 - DNA, 12 bp, Homo sapiens
ctgggaggtaga

SEQ ID NO: 1586641 - DNA, 23 bp, Homo sapiens
ctgggagtagttgtctttcctgg

SEQ ID NO: 1586642 - DNA, 16 bp, Homo sapiens
ctgggagtcacacagt

SEQ ID NO: 1586643 - DNA, 17 bp, Homo sapiens
ctgggagtcacacagtg

SEQ ID NO: 1586644 - DNA, 22 bp, Homo sapiens
ctgggatatatggaggattctt

SEQ ID NO: 1586645 - DNA, 18 bp, Homo sapiens
ctgggatatggctgccca

SEQ ID NO: 1586646 - DNA, 22 bp, Homo sapiens
ctgggatatggctgcccaggag

SEQ ID NO: 1586647 - DNA, 21 bp, Homo sapiens
ctgggatctggcacactccct

SEQ ID NO: 1586648 - DNA, 19 bp, Homo sapiens
ctgggatctgttttctgga

SEQ ID NO: 1586649 - DNA, 18 bp, Homo sapiens
ctgggatgggctcccacc

SEQ ID NO: 1586650 - DNA, 14 bp, Homo sapiens
ctgggatgtaaacc

SEQ ID NO: 1586651 - DNA, 17 bp, Homo sapiens
ctgggatgtagaacttc

SEQ ID NO: 1586652 - DNA, 21 bp, Homo sapiens
ctgggatgtccacagatgcct

SEQ ID NO: 1586653 - DNA, 19 bp, Homo sapiens
ctgggattaagaaaccttg

SEQ ID NO: 1586654 - DNA, 20 bp, Homo sapiens
ctgggattaagaaaccttgc

SEQ ID NO: 1586655 - DNA, 14 bp, Homo sapiens
ctgggatttgagat

SEQ ID NO: 1586656 - DNA, 15 bp, Homo sapiens
ctgggcaaacagagc

SEQ ID NO: 1586657 - DNA, 17 bp, Homo sapiens
ctgggcaaacagagcta

SEQ ID NO: 1586658 - DNA, 22 bp, Homo sapiens
ctgggcaaacagagctactgag

SEQ ID NO: 1586659 - DNA, 23 bp, Homo sapiens
ctgggcaaacagagctactgaga

SEQ ID NO: 1586660 - DNA, 22 bp, Homo sapiens
ctgggcaccacctctgtgggca

SEQ ID NO: 1586661 - DNA, 18 bp, Homo sapiens
ctgggcacccacctccac

SEQ ID NO: 1586662 - DNA, 16 bp, Homo sapiens
ctgggcaccctcccac

SEQ ID NO: 1586663 - DNA, 17 bp, Homo sapiens
ctgggcaccgggacccc

SEQ ID NO: 1586664 - DNA, 18 bp, Homo sapiens
ctgggcacctgcgcacag

SEQ ID NO: 1586665 - DNA, 19 bp, Homo sapiens
ctgggcacctgcgcacagg

SEQ ID NO: 1586666 - DNA, 21 bp, Homo sapiens
ctgggcacctgcgcacaggtg

SEQ ID NO: 1586667 - DNA, 14 bp, Homo sapiens
ctgggcagcaaggc

SEQ ID NO: 1586668 - DNA, 17 bp, Homo sapiens
ctgggcagcatagcaag

SEQ ID NO: 1586669 - DNA, 16 bp, Homo sapiens
ctgggcagccaggctg

SEQ ID NO: 1586670 - DNA, 13 bp, Homo sapiens
ctgggcagggtga

SEQ ID NO: 1586671 - DNA, 15 bp, Homo sapiens
ctgggcaggtgggag

SEQ ID NO: 1586672 - DNA, 18 bp, Homo sapiens
ctgggcaggtgggagctg

SEQ ID NO: 1586673 - DNA, 14 bp, Homo sapiens
ctgggcagtgtggc

SEQ ID NO: 1586674 - DNA, 15 bp, Homo sapiens
ctgggcagtgtggcc

SEQ ID NO: 1586675 - DNA, 20 bp, Homo sapiens
ctgggcatactttctctcta

SEQ ID NO: 1586676 - DNA, 16 bp, Homo sapiens
ctgggcatcttctggc

SEQ ID NO: 1586677 - DNA, 21 bp, Homo sapiens
ctgggcatgccatgtctgagc

SEQ ID NO: 1586678 - DNA, 16 bp, Homo sapiens
ctgggcatgggtccag

SEQ ID NO: 1586679 - DNA, 17 bp, Homo sapiens
ctgggcatgggtccagg

SEQ ID NO: 1586680 - DNA, 22 bp, Homo sapiens
ctgggcatgggtccagggcctg

SEQ ID NO: 1586681 - DNA, 12 bp, Homo sapiens
ctgggcattgct

SEQ ID NO: 1586682 - DNA, 16 bp, Homo sapiens
ctgggcattgctttcc

SEQ ID NO: 1586683 - DNA, 14 bp, Homo sapiens
ctgggcatttcaat

SEQ ID NO: 1586684 - DNA, 22 bp, Homo sapiens
ctgggcatttcaatccattttt

SEQ ID NO: 1586685 - DNA, 20 bp, Homo sapiens
ctgggccaagttcctctagt

SEQ ID NO: 1586686 - DNA, 13 bp, Homo sapiens
ctgggccacacct

SEQ ID NO: 1586687 - DNA, 15 bp, Homo sapiens
ctgggccacacctga

SEQ ID NO: 1586688 - DNA, 16 bp, Homo sapiens
ctgggccacacctgag

SEQ ID NO: 1586689 - DNA, 17 bp, Homo sapiens
ctgggccacacctgagc

SEQ ID NO: 1586690 - DNA, 21 bp, Homo sapiens
ctgggccacacctgagcgctg

SEQ ID NO: 1586691 - DNA, 23 bp, Homo sapiens
ctgggccacacctgagcgctgtg

SEQ ID NO: 1586692 - DNA, 17 bp, Homo sapiens
ctgggccactggggact

SEQ ID NO: 1586693 - DNA, 18 bp, Homo sapiens
ctgggccacttctgggtg

SEQ ID NO: 1586694 - DNA, 19 bp, Homo sapiens
ctgggccagccctgcagcc

SEQ ID NO: 1586695 - DNA, 11 bp, Homo sapiens
ctgggccaggg

SEQ ID NO: 1586696 - DNA, 21 bp, Homo sapiens
ctgggccagggaaacaaagtt

SEQ ID NO: 1586697 - DNA, 16 bp, Homo sapiens
ctgggccaggtctccg

SEQ ID NO: 1586698 - DNA, 14 bp, Homo sapiens
ctgggccagtggct

SEQ ID NO: 1586699 - DNA, 17 bp, Homo sapiens
ctgggccagtggctggg

SEQ ID NO: 1586700 - DNA, 22 bp, Homo sapiens
ctgggccatgtccaaagaggct

SEQ ID NO: 1586701 - DNA, 23 bp, Homo sapiens
ctgggccatgtccaaagaggctg

SEQ ID NO: 1586702 - DNA, 23 bp, Homo sapiens
ctgggcccagcaggggccctcac

SEQ ID NO: 1586703 - DNA, 13 bp, Homo sapiens
ctgggcccaggca

SEQ ID NO: 1586704 - DNA, 16 bp, Homo sapiens
ctgggcccaggcaggt

SEQ ID NO: 1586705 - DNA, 24 bp, Homo sapiens
ctgggccccaaacgggctgccctg

SEQ ID NO: 1586706 - DNA, 14 bp, Homo sapiens
ctgggccccaccac

SEQ ID NO: 1586707 - DNA, 15 bp, Homo sapiens
ctgggccccacctac

SEQ ID NO: 1586708 - DNA, 13 bp, Homo sapiens
ctgggccccagct

SEQ ID NO: 1586709 - DNA, 14 bp, Homo sapiens
ctgggccccatgct

SEQ ID NO: 1586710 - DNA, 17 bp, Homo sapiens
ctgggccccatgctctg

SEQ ID NO: 1586711 - DNA, 12 bp, Homo sapiens
ctgggcccctgc

SEQ ID NO: 1586712 - DNA, 19 bp, Homo sapiens
ctgggccctctttccctgc

SEQ ID NO: 1586713 - DNA, 20 bp, Homo sapiens
ctgggccctctttccctgcg

SEQ ID NO: 1586714 - DNA, 23 bp, Homo sapiens
ctgggccctctttccctgcgaga

SEQ ID NO: 1586715 - DNA, 11 bp, Homo sapiens
ctgggccctgg

SEQ ID NO: 1586716 - DNA, 16 bp, Homo sapiens
ctgggccctgggctga

SEQ ID NO: 1586717 - DNA, 23 bp, Homo sapiens
ctgggccgaggcgcgtttgtgca

SEQ ID NO: 1586718 - DNA, 16 bp, Homo sapiens
ctgggccgctgccacg

SEQ ID NO: 1586719 - DNA, 14 bp, Homo sapiens
ctgggccggctgag

SEQ ID NO: 1586720 - DNA, 15 bp, Homo sapiens
ctgggccggctgagt

SEQ ID NO: 1586721 - DNA, 22 bp, Homo sapiens
ctgggcctgaactcattctctt

SEQ ID NO: 1586722 - DNA, 13 bp, Homo sapiens
ctgggcctgaggg

SEQ ID NO: 1586723 - DNA, 17 bp, Homo sapiens
ctgggcctgagggtcca

SEQ ID NO: 1586724 - DNA, 18 bp, Homo sapiens
ctgggcctgagggtccac

SEQ ID NO: 1586725 - DNA, 19 bp, Homo sapiens
ctgggcctgcttttccagg

SEQ ID NO: 1586726 - DNA, 21 bp, Homo sapiens
ctgggcctgcttttccaggat

SEQ ID NO: 1586727 - DNA, 23 bp, Homo sapiens
ctgggcctggagggggagcacca

SEQ ID NO: 1586728 - DNA, 14 bp, Homo sapiens
ctgggcctgtcccc

SEQ ID NO: 1586729 - DNA, 20 bp, Homo sapiens
ctgggcctgtgcagcagccc

SEQ ID NO: 1586730 - DNA, 13 bp, Homo sapiens
ctgggcgacagag

SEQ ID NO: 1586731 - DNA, 21 bp, Homo sapiens
ctgggcgacagagcgagactc

SEQ ID NO: 1586732 - DNA, 20 bp, Homo sapiens
ctgggcgagcccctccttct

SEQ ID NO: 1586733 - DNA, 18 bp, Homo sapiens
ctgggcgccctggaagcc

SEQ ID NO: 1586734 - DNA, 19 bp, Homo sapiens
ctgggcggcatccctgcag

SEQ ID NO: 1586735 - DNA, 16 bp, Homo sapiens
ctgggcgtctgagctg

SEQ ID NO: 1586736 - DNA, 19 bp, Homo sapiens
ctgggcgtctgagctgggg

SEQ ID NO: 1586737 - DNA, 16 bp, Homo sapiens
ctgggcgtgtgtgaca

SEQ ID NO: 1586738 - DNA, 21 bp, Homo sapiens
ctgggcgtgtgtgacactgat

SEQ ID NO: 1586739 - DNA, 12 bp, Homo sapiens
ctgggctcagcc

SEQ ID NO: 1586740 - DNA, 16 bp, Homo sapiens
ctgggctcagggctgg

SEQ ID NO: 1586741 - DNA, 17 bp, Homo sapiens
ctgggctcagggctgga

SEQ ID NO: 1586742 - DNA, 14 bp, Homo sapiens
ctgggctcctggaa

SEQ ID NO: 1586743 - DNA, 15 bp, Homo sapiens
ctgggctctccacct

SEQ ID NO: 1586744 - DNA, 18 bp, Homo sapiens
ctgggctctccacctcag

SEQ ID NO: 1586745 - DNA, 19 bp, Homo sapiens
ctgggctctccacctcagc

SEQ ID NO: 1586746 - DNA, 23 bp, Homo sapiens
ctgggctctgcaattcccctctg

SEQ ID NO: 1586747 - DNA, 13 bp, Homo sapiens
ctgggctctgcca

SEQ ID NO: 1586748 - DNA, 20 bp, Homo sapiens
ctgggctctgccaccctacc

SEQ ID NO: 1586749 - DNA, 23 bp, Homo sapiens
ctgggctctgccccagctctggc

SEQ ID NO: 1586750 - DNA, 15 bp, Homo sapiens
ctgggctctggctct

SEQ ID NO: 1586751 - DNA, 14 bp, Homo sapiens
ctgggctgagcccc

SEQ ID NO: 1586752 - DNA, 15 bp, Homo sapiens
ctgggctgagcccct

SEQ ID NO: 1586753 - DNA, 17 bp, Homo sapiens
ctgggctgcagagtctg

SEQ ID NO: 1586754 - DNA, 17 bp, Homo sapiens
ctgggctggaacgtgaa

SEQ ID NO: 1586755 - DNA, 16 bp, Homo sapiens
ctgggctggctgaaga

SEQ ID NO: 1586756 - DNA, 17 bp, Homo sapiens
ctgggctggctgaagaa

SEQ ID NO: 1586757 - DNA, 12 bp, Homo sapiens
ctgggctgggaa

SEQ ID NO: 1586758 - DNA, 16 bp, Homo sapiens
ctgggctgggccctct

SEQ ID NO: 1586759 - DNA, 15 bp, Homo sapiens
ctgggctggggagga

SEQ ID NO: 1586760 - DNA, 22 bp, Homo sapiens
ctgggctgtaacgtggcactgg

SEQ ID NO: 1586761 - DNA, 23 bp, Homo sapiens
ctgggctgtaacgtggcactggt

SEQ ID NO: 1586762 - DNA, 12 bp, Homo sapiens
ctgggctgtgct

SEQ ID NO: 1586763 - DNA, 12 bp, Homo sapiens
ctgggctgttgt

SEQ ID NO: 1586764 - DNA, 19 bp, Homo sapiens
ctgggcttatatgtacttt

SEQ ID NO: 1586765 - DNA, 15 bp, Homo sapiens
ctgggcttcatctgg

SEQ ID NO: 1586766 - DNA, 19 bp, Homo sapiens
ctgggcttcatctggcaac

SEQ ID NO: 1586767 - DNA, 19 bp, Homo sapiens
ctgggcttcattccggact

SEQ ID NO: 1586768 - DNA, 16 bp, Homo sapiens
ctgggcttcattctgg

SEQ ID NO: 1586769 - DNA, 20 bp, Homo sapiens
ctgggcttcattctggaaac

SEQ ID NO: 1586770 - DNA, 13 bp, Homo sapiens
ctgggcttggcct

SEQ ID NO: 1586771 - DNA, 15 bp, Homo sapiens
ctgggcttggcctgc

SEQ ID NO: 1586772 - DNA, 16 bp, Homo sapiens
ctgggcttggcctgct

SEQ ID NO: 1586773 - DNA, 20 bp, Homo sapiens
ctgggcttggggcttcctaa

SEQ ID NO: 1586774 - DNA, 22 bp, Homo sapiens
ctgggcttttggtttgggggcg

SEQ ID NO: 1586775 - DNA, 20 bp, Homo sapiens
ctggggaaacaacatttata

SEQ ID NO: 1586776 - DNA, 22 bp, Homo sapiens
ctggggaaagacactgcctggg

SEQ ID NO: 1586777 - DNA, 23 bp, Homo sapiens
ctggggaaagacactgcctgggc

SEQ ID NO: 1586778 - DNA, 16 bp, Homo sapiens
ctggggaaagggctgg

SEQ ID NO: 1586779 - DNA, 15 bp, Homo sapiens
ctggggaaaggggac

SEQ ID NO: 1586780 - DNA, 16 bp, Homo sapiens
ctggggaaaggggaca

SEQ ID NO: 1586781 - DNA, 16 bp, Homo sapiens
ctggggaagacagtgg

SEQ ID NO: 1586782 - DNA, 18 bp, Homo sapiens
ctggggaagacagtggcc

SEQ ID NO: 1586783 - DNA, 16 bp, Homo sapiens
ctggggaagaggatga

SEQ ID NO: 1586784 - DNA, 17 bp, Homo sapiens
ctggggaaggagccagt

SEQ ID NO: 1586785 - DNA, 14 bp, Homo sapiens
ctggggaccaggag

SEQ ID NO: 1586786 - DNA, 17 bp, Homo sapiens
ctggggaccaggagcta

SEQ ID NO: 1586787 - DNA, 19 bp, Homo sapiens
ctggggacgctccgctgcc

SEQ ID NO: 1586788 - DNA, 15 bp, Homo sapiens
ctggggactcaggga

SEQ ID NO: 1586789 - DNA, 13 bp, Homo sapiens
ctggggacttgtg

SEQ ID NO: 1586790 - DNA, 18 bp, Homo sapiens
ctggggagagcggctgga

SEQ ID NO: 1586791 - DNA, 18 bp, Homo sapiens
ctggggaggaggagagag

SEQ ID NO: 1586792 - DNA, 19 bp, Homo sapiens
ctggggaggaggagagagt

SEQ ID NO: 1586793 - DNA, 20 bp, Homo sapiens
ctggggaggaggagagagtc

SEQ ID NO: 1586794 - DNA, 14 bp, Homo sapiens
ctggggaggcaggc

SEQ ID NO: 1586795 - DNA, 12 bp, Homo sapiens
ctggggagtccc

SEQ ID NO: 1586796 - DNA, 13 bp, Homo sapiens
ctggggagtcctc

SEQ ID NO: 1586797 - DNA, 19 bp, Homo sapiens
ctggggatgtcatagccaa

SEQ ID NO: 1586798 - DNA, 17 bp, Homo sapiens
ctggggatgtctctcat

SEQ ID NO: 1586799 - DNA, 22 bp, Homo sapiens
ctggggatgtctctcatgacca

SEQ ID NO: 1586800 - DNA, 16 bp, Homo sapiens
ctggggcaagtccctg

SEQ ID NO: 1586801 - DNA, 14 bp, Homo sapiens
ctggggcacggcgg

SEQ ID NO: 1586802 - DNA, 13 bp, Homo sapiens
ctggggcagaggg

SEQ ID NO: 1586803 - DNA, 24 bp, Homo sapiens
ctggggcagaggggcagccgctag

SEQ ID NO: 1586804 - DNA, 14 bp, Homo sapiens
ctggggcagcactc

SEQ ID NO: 1586805 - DNA, 19 bp, Homo sapiens
ctggggcagcactccccag

SEQ ID NO: 1586806 - DNA, 12 bp, Homo sapiens
ctggggcaggct

SEQ ID NO: 1586807 - DNA, 18 bp, Homo sapiens
ctggggcatcctgtgcca

SEQ ID NO: 1586808 - DNA, 18 bp, Homo sapiens
ctggggcatgtgtgcctg

SEQ ID NO: 1586809 - DNA, 20 bp, Homo sapiens
ctggggcatgtgtgcctgtg

SEQ ID NO: 1586810 - DNA, 21 bp, Homo sapiens
ctggggccacaaatcaaagca

SEQ ID NO: 1586811 - DNA, 18 bp, Homo sapiens
ctggggccccgctgggat

SEQ ID NO: 1586812 - DNA, 16 bp, Homo sapiens
ctggggccggggctga

SEQ ID NO: 1586813 - DNA, 22 bp, Homo sapiens
ctggggcctagcgatctctcct

SEQ ID NO: 1586814 - DNA, 23 bp, Homo sapiens
ctggggcctagcgatctctcctg

SEQ ID NO: 1586815 - DNA, 22 bp, Homo sapiens
ctggggcctccagaagctgctc

SEQ ID NO: 1586816 - DNA, 24 bp, Homo sapiens
ctggggcctccagaagctgctcct

SEQ ID NO: 1586817 - DNA, 12 bp, Homo sapiens
ctggggcctctt

SEQ ID NO: 1586818 - DNA, 15 bp, Homo sapiens
ctggggcctgactgc

SEQ ID NO: 1586819 - DNA, 16 bp, Homo sapiens
ctggggcctggacctg

SEQ ID NO: 1586820 - DNA, 16 bp, Homo sapiens
ctggggcgtggggagg

SEQ ID NO: 1586821 - DNA, 12 bp, Homo sapiens
ctggggctccct

SEQ ID NO: 1586822 - DNA, 16 bp, Homo sapiens
ctggggctccgaaatt

SEQ ID NO: 1586823 - DNA, 23 bp, Homo sapiens
ctggggctcctttctccagccag

SEQ ID NO: 1586824 - DNA, 14 bp, Homo sapiens
ctggggctctggga

SEQ ID NO: 1586825 - DNA, 13 bp, Homo sapiens
ctggggctgagtc

SEQ ID NO: 1586826 - DNA, 16 bp, Homo sapiens
ctggggctgatctcag

SEQ ID NO: 1586827 - DNA, 21 bp, Homo sapiens
ctggggctgatctcagggaag

SEQ ID NO: 1586828 - DNA, 16 bp, Homo sapiens
ctggggctgctcccct

SEQ ID NO: 1586829 - DNA, 18 bp, Homo sapiens
ctggggcttcaccagtct

SEQ ID NO: 1586830 - DNA, 20 bp, Homo sapiens
ctggggcttcaccagtctgt

SEQ ID NO: 1586831 - DNA, 22 bp, Homo sapiens
ctggggcttcaccagtctgtct

SEQ ID NO: 1586832 - DNA, 18 bp, Homo sapiens
ctggtccctggtccttca

SEQ ID NO: 1586833 - DNA, 23 bp, Homo sapiens
ctggtccctgttttcccacgagg

SEQ ID NO: 1586834 - DNA, 21 bp, Homo sapiens
ctggtcccttgcagctagttt

SEQ ID NO: 1586835 - DNA, 20 bp, Homo sapiens
ctggtcctccgcctactgtc

SEQ ID NO: 1586836 - DNA, 15 bp, Homo sapiens
ctggtcctggcctcc

SEQ ID NO: 1586837 - DNA, 16 bp, Homo sapiens
ctggtcctggctgcac

SEQ ID NO: 1586838 - DNA, 13 bp, Homo sapiens
ctggtccttattt

SEQ ID NO: 1586839 - DNA, 15 bp, Homo sapiens
ctggtccttcactgg

SEQ ID NO: 1586840 - DNA, 16 bp, Homo sapiens
ctggtccttccaggcc

SEQ ID NO: 1586841 - DNA, 18 bp, Homo sapiens
ctggtcgctcctgcccac

SEQ ID NO: 1586842 - DNA, 17 bp, Homo sapiens
ctggtctactctagaag

SEQ ID NO: 1586843 - DNA, 18 bp, Homo sapiens
ctggtctcaaactcctga

SEQ ID NO: 1586844 - DNA, 13 bp, Homo sapiens
ctggtctgtctgg

SEQ ID NO: 1586845 - DNA, 17 bp, Homo sapiens
ctggtctgtgaagagcc

SEQ ID NO: 1586846 - DNA, 18 bp, Homo sapiens
ctggtcttgaactcctgg

SEQ ID NO: 1586847 - DNA, 14 bp, Homo sapiens
ctggtcttgagatg

SEQ ID NO: 1586848 - DNA, 15 bp, Homo sapiens
ctggtgaacactgtg

SEQ ID NO: 1586849 - DNA, 17 bp, Homo sapiens
ctggtgaacactgtgac

SEQ ID NO: 1586850 - DNA, 18 bp, Homo sapiens
ctggtgaacactgtgacc

SEQ ID NO: 1586851 - DNA, 18 bp, Homo sapiens
ctggtgaactgagctggg

SEQ ID NO: 1586852 - DNA, 13 bp, Homo sapiens
ctggtgatgccta

SEQ ID NO: 1586853 - DNA, 16 bp, Homo sapiens
ctggtgcaaattcaga

SEQ ID NO: 1586854 - DNA, 19 bp, Homo sapiens
ctggtgcacagccactccc

SEQ ID NO: 1586855 - DNA, 13 bp, Homo sapiens
ctggtgcagggcc

SEQ ID NO: 1586856 - DNA, 14 bp, Homo sapiens
ctggtgcagggcct

SEQ ID NO: 1586857 - DNA, 15 bp, Homo sapiens
ctggtgcattgctgt

SEQ ID NO: 1586858 - DNA, 20 bp, Homo sapiens
ctggtgccaaatagccccag

SEQ ID NO: 1586859 - DNA, 22 bp, Homo sapiens
ctggtgccaaatagccccagac

SEQ ID NO: 1586860 - DNA, 23 bp, Homo sapiens
ctggtgccaaatagccccagact

SEQ ID NO: 1586861 - DNA, 14 bp, Homo sapiens
ctggtgccagcctt

SEQ ID NO: 1586862 - DNA, 17 bp, Homo sapiens
ctggtgccagccttcct

SEQ ID NO: 1586863 - DNA, 15 bp, Homo sapiens
ctggtgccatttctg

SEQ ID NO: 1586864 - DNA, 18 bp, Homo sapiens
ctggtgccccacctgcct

SEQ ID NO: 1586865 - DNA, 19 bp, Homo sapiens
ctggtgccccacctgcctg

SEQ ID NO: 1586866 - DNA, 22 bp, Homo sapiens
ctggtgccccacctgcctggtg

SEQ ID NO: 1586867 - DNA, 21 bp, Homo sapiens
ctggtgccccccacccctgga

SEQ ID NO: 1586868 - DNA, 14 bp, Homo sapiens
ctggtgcctccaga

SEQ ID NO: 1586869 - DNA, 13 bp, Homo sapiens
ctggtgcctctgt

SEQ ID NO: 1586870 - DNA, 17 bp, Homo sapiens
ctggtgcctctgtgcac

SEQ ID NO: 1586871 - DNA, 15 bp, Homo sapiens
ctggtgcgacccccc

SEQ ID NO: 1586872 - DNA, 17 bp, Homo sapiens
ctggtgcgaccccccac

SEQ ID NO: 1586873 - DNA, 22 bp, Homo sapiens
ctggtgcgaccccccacccccg

SEQ ID NO: 1586874 - DNA, 16 bp, Homo sapiens
ctggtgcgggcctggc

SEQ ID NO: 1586875 - DNA, 17 bp, Homo sapiens
ctggtgcgggcctggcc

SEQ ID NO: 1586876 - DNA, 17 bp, Homo sapiens
ctggtgctgcagtatgt

SEQ ID NO: 1586877 - DNA, 12 bp, Homo sapiens
ctggtgctgcca

SEQ ID NO: 1586878 - DNA, 13 bp, Homo sapiens
ctggtgctgccac

SEQ ID NO: 1586879 - DNA, 15 bp, Homo sapiens
ctggtggacagtcct

SEQ ID NO: 1586880 - DNA, 18 bp, Homo sapiens
ctggtggacagtcctggg

SEQ ID NO: 1586881 - DNA, 21 bp, Homo sapiens
ctggtggacagtcctgggaga

SEQ ID NO: 1586882 - DNA, 15 bp, Homo sapiens
ctggtggaccacagg

SEQ ID NO: 1586883 - DNA, 15 bp, Homo sapiens
ctggtggagaaagca

SEQ ID NO: 1586884 - DNA, 23 bp, Homo sapiens
ctggtggagaaagcactgacctg

SEQ ID NO: 1586885 - DNA, 21 bp, Homo sapiens
ctggtggccccgtttctggtg

SEQ ID NO: 1586886 - DNA, 15 bp, Homo sapiens
ctggtggcccctgcc

SEQ ID NO: 1586887 - DNA, 16 bp, Homo sapiens
ctggtggccctgtgcc

SEQ ID NO: 1586888 - DNA, 19 bp, Homo sapiens
ctggtggccctgtgcctgg

SEQ ID NO: 1586889 - DNA, 15 bp, Homo sapiens
ctggtggccttgggc

SEQ ID NO: 1586890 - DNA, 17 bp, Homo sapiens
ctggtggccttgggcct

SEQ ID NO: 1586891 - DNA, 18 bp, Homo sapiens
ctggtggccttgggcctt

SEQ ID NO: 1586892 - DNA, 19 bp, Homo sapiens
ctggtggcttaagtgagca

SEQ ID NO: 1586893 - DNA, 17 bp, Homo sapiens
ctggtgggacagtggtg

SEQ ID NO: 1586894 - DNA, 13 bp, Homo sapiens
ctggtgggccaac

SEQ ID NO: 1586895 - DNA, 14 bp, Homo sapiens
ctggtgggccccca

SEQ ID NO: 1586896 - DNA, 12 bp, Homo sapiens
ctggtgggcctc

SEQ ID NO: 1586897 - DNA, 12 bp, Homo sapiens
ctggtggggctg

SEQ ID NO: 1586898 - DNA, 20 bp, Homo sapiens
ctggtggggctgtcctgctg

SEQ ID NO: 1586899 - DNA, 21 bp, Homo sapiens
ctggtggggtgtgcatgccac

SEQ ID NO: 1586900 - DNA, 19 bp, Homo sapiens
ctggtgggtcagcccagca

SEQ ID NO: 1586901 - DNA, 20 bp, Homo sapiens
ctggtgggtcagcccagcac

SEQ ID NO: 1586902 - DNA, 21 bp, Homo sapiens
ctggtgggtcagcccagcacc

SEQ ID NO: 1586903 - DNA, 15 bp, Homo sapiens
ctggtgggtggagtc

SEQ ID NO: 1586904 - DNA, 17 bp, Homo sapiens
ctggtgggtggagtcag

SEQ ID NO: 1586905 - DNA, 15 bp, Homo sapiens
ctggtggtacctgtg

SEQ ID NO: 1586906 - DNA, 12 bp, Homo sapiens
ctggtgtatgca

SEQ ID NO: 1586907 - DNA, 16 bp, Homo sapiens
ctggtgtccagctgag

SEQ ID NO: 1586908 - DNA, 12 bp, Homo sapiens
ctggtgtcctga

SEQ ID NO: 1586909 - DNA, 13 bp, Homo sapiens
ctggtgtcctgac

SEQ ID NO: 1586910 - DNA, 13 bp, Homo sapiens
ctggtgtctagtt

SEQ ID NO: 1586911 - DNA, 23 bp, Homo sapiens
ctggttaaattaacattgcataa

SEQ ID NO: 1586912 - DNA, 17 bp, Homo sapiens
ctggttaccactctttt

SEQ ID NO: 1586913 - DNA, 15 bp, Homo sapiens
ctggttagctgacag

SEQ ID NO: 1586914 - DNA, 16 bp, Homo sapiens
ctggttatttttctct

SEQ ID NO: 1586915 - DNA, 13 bp, Homo sapiens
ctggttccagggt

SEQ ID NO: 1586916 - DNA, 14 bp, Homo sapiens
ctggttccagggtc

SEQ ID NO: 1586917 - DNA, 16 bp, Homo sapiens
ctggttccagggtccc

SEQ ID NO: 1586918 - DNA, 23 bp, Homo sapiens
ctggttccagggtccctctgtgt

SEQ ID NO: 1586919 - DNA, 19 bp, Homo sapiens
ctggttccgccaggcgctg

SEQ ID NO: 1586920 - DNA, 18 bp, Homo sapiens
ctggttcctagatgtgtt

SEQ ID NO: 1586921 - DNA, 15 bp, Homo sapiens
ctggttcctgctgtc

SEQ ID NO: 1586922 - DNA, 23 bp, Homo sapiens
ctggttcggatttggggtggatt

SEQ ID NO: 1586923 - DNA, 18 bp, Homo sapiens
ctggttctatttaatgga

SEQ ID NO: 1586924 - DNA, 12 bp, Homo sapiens
ctggttctcatc

SEQ ID NO: 1586925 - DNA, 15 bp, Homo sapiens
ctggttctcatcttt

SEQ ID NO: 1586926 - DNA, 17 bp, Homo sapiens
ctggttgagtgtgtggt

SEQ ID NO: 1586927 - DNA, 13 bp, Homo sapiens
ctggttgctgtag

SEQ ID NO: 1586928 - DNA, 16 bp, Homo sapiens
ctggttgctgtagaaa

SEQ ID NO: 1586929 - DNA, 19 bp, Homo sapiens
ctggttgcttcagacctga

SEQ ID NO: 1586930 - DNA, 13 bp, Homo sapiens
ctggttgggcagc

SEQ ID NO: 1586931 - DNA, 22 bp, Homo sapiens
ctggttgtatttctatatttat

SEQ ID NO: 1586932 - DNA, 13 bp, Homo sapiens
ctggttgttcctg

SEQ ID NO: 1586933 - DNA, 15 bp, Homo sapiens
ctggttgttcctgca

SEQ ID NO: 1586934 - DNA, 16 bp, Homo sapiens
ctggttgttcctgcat

SEQ ID NO: 1586935 - DNA, 22 bp, Homo sapiens
ctggttgttgcaccatctgctt

SEQ ID NO: 1586936 - DNA, 17 bp, Homo sapiens
ctggttgttgccaggtt

SEQ ID NO: 1586937 - DNA, 22 bp, Homo sapiens
ctggttgttgccaggttgcagc

SEQ ID NO: 1586938 - DNA, 23 bp, Homo sapiens
ctggtttcctatttgcagttact

SEQ ID NO: 1586939 - DNA, 19 bp, Homo sapiens
ctggtttctcagaatccaa

SEQ ID NO: 1586940 - DNA, 23 bp, Homo sapiens
ctggtttctcagaatccaaagat

SEQ ID NO: 1586941 - DNA, 23 bp, Homo sapiens
ctggtttcttttaatgtgaggaa

SEQ ID NO: 1586942 - DNA, 21 bp, Homo sapiens
ctggtttgaaagatgcagtgg

SEQ ID NO: 1586943 - DNA, 16 bp, Homo sapiens
ctggtttgaaagatta

SEQ ID NO: 1586944 - DNA, 15 bp, Homo sapiens
ctgtatatgtattcc

SEQ ID NO: 1586945 - DNA, 19 bp, Homo sapiens
ctgtatatgttgtaataaa

SEQ ID NO: 1586946 - DNA, 14 bp, Homo sapiens
ctgtatattcagga

SEQ ID NO: 1586947 - DNA, 19 bp, Homo sapiens
ctgtatatttgtaaagcta

SEQ ID NO: 1586948 - DNA, 20 bp, Homo sapiens
ctgtatatttgtaaagctat

SEQ ID NO: 1586949 - DNA, 20 bp, Homo sapiens
ctgtatccgtgaattgcttt

SEQ ID NO: 1586950 - DNA, 20 bp, Homo sapiens
ctgtatcctccctggcagac

SEQ ID NO: 1586951 - DNA, 20 bp, Homo sapiens
ctgtatctaaaaaataactg

SEQ ID NO: 1586952 - DNA, 21 bp, Homo sapiens
ctgtatctactaaaaatacaa

SEQ ID NO: 1586953 - DNA, 14 bp, Homo sapiens
ctgtatctgtgtag

SEQ ID NO: 1586954 - DNA, 18 bp, Homo sapiens
ctgtatctgtgtagacta

SEQ ID NO: 1586955 - DNA, 20 bp, Homo sapiens
ctgtatgatttaggcttcta

SEQ ID NO: 1586956 - DNA, 13 bp, Homo sapiens
ctgtatgatttgt

SEQ ID NO: 1586957 - DNA, 17 bp, Homo sapiens
ctgtatggcactctgta

SEQ ID NO: 1586958 - DNA, 16 bp, Homo sapiens
ctgtatggtggaagct

SEQ ID NO: 1586959 - DNA, 18 bp, Homo sapiens
ctgtatgtgctgtaattt

SEQ ID NO: 1586960 - DNA, 14 bp, Homo sapiens
ctgtattaaatctt

SEQ ID NO: 1586961 - DNA, 21 bp, Homo sapiens
ctgtattagagcgccagctcc

SEQ ID NO: 1586962 - DNA, 20 bp, Homo sapiens
ctgtattccgatacaaagtg

SEQ ID NO: 1586963 - DNA, 21 bp, Homo sapiens
ctgtattctcaaacacagtta

SEQ ID NO: 1586964 - DNA, 16 bp, Homo sapiens
ctgtattcttgtttga

SEQ ID NO: 1586965 - DNA, 18 bp, Homo sapiens
ctgtattgggccttttgg

SEQ ID NO: 1586966 - DNA, 13 bp, Homo sapiens
ctgtattgtctga

SEQ ID NO: 1586967 - DNA, 14 bp, Homo sapiens
ctgtattgtctgaa

SEQ ID NO: 1586968 - DNA, 12 bp, Homo sapiens
ctgtatttccaa

SEQ ID NO: 1586969 - DNA, 13 bp, Homo sapiens
ctgtatttcctgc

SEQ ID NO: 1586970 - DNA, 21 bp, Homo sapiens
ctgtattttatttagacaaga

SEQ ID NO: 1586971 - DNA, 22 bp, Homo sapiens
ctgtattttatttagacaagag

SEQ ID NO: 1586972 - DNA, 20 bp, Homo sapiens
ctgtattttcttttatatct

SEQ ID NO: 1586973 - DNA, 22 bp, Homo sapiens
ctgtattttcttttatatctgt

SEQ ID NO: 1586974 - DNA, 21 bp, Homo sapiens
ctgtatttttacctttttcct

SEQ ID NO: 1586975 - DNA, 14 bp, Homo sapiens
ctgtcaaaactact

SEQ ID NO: 1586976 - DNA, 17 bp, Homo sapiens
ctgtcaaaataatttta

SEQ ID NO: 1586977 - DNA, 13 bp, Homo sapiens
ctgtcaaatgttt

SEQ ID NO: 1586978 - DNA, 19 bp, Homo sapiens
ctgtcaaatgtttccttaa

SEQ ID NO: 1586979 - DNA, 19 bp, Homo sapiens
ctgtcaagttaacaaggaa

SEQ ID NO: 1586980 - DNA, 23 bp, Homo sapiens
ctgtcaatatcgtacctgtccct

SEQ ID NO: 1586981 - DNA, 23 bp, Homo sapiens
ctgtcaatttcattatcatcaag

SEQ ID NO: 1586982 - DNA, 13 bp, Homo sapiens
ctgtcaccaaatt

SEQ ID NO: 1586983 - DNA, 16 bp, Homo sapiens
ctgtcaccaaggaaac

SEQ ID NO: 1586984 - DNA, 23 bp, Homo sapiens
ctgtcaccagagcttctctgggc

SEQ ID NO: 1586985 - DNA, 22 bp, Homo sapiens
ctgtcacccaggttggagtgca

SEQ ID NO: 1586986 - DNA, 14 bp, Homo sapiens
ctgtcaccctgcag

SEQ ID NO: 1586987 - DNA, 23 bp, Homo sapiens
ctgtcacgctcatgtcctgtcct

SEQ ID NO: 1586988 - DNA, 19 bp, Homo sapiens
ctgtcacgctctggtgcag

SEQ ID NO: 1586989 - DNA, 19 bp, Homo sapiens
ctgtcacgtgaaatattta

SEQ ID NO: 1586990 - DNA, 17 bp, Homo sapiens
ctgtcactcagctgaga

SEQ ID NO: 1586991 - DNA, 14 bp, Homo sapiens
ctgtcactcattgc

SEQ ID NO: 1586992 - DNA, 17 bp, Homo sapiens
ctgtcactgctctggac

SEQ ID NO: 1586993 - DNA, 24 bp, Homo sapiens
ctgtcactgctctggactgtgtgg

SEQ ID NO: 1586994 - DNA, 21 bp, Homo sapiens
ctgtcagatgggaagacatga

SEQ ID NO: 1586995 - DNA, 23 bp, Homo sapiens
ctgtcagccgggccctgagtaat

SEQ ID NO: 1586996 - DNA, 14 bp, Homo sapiens
ctgtcagctgagct

SEQ ID NO: 1586997 - DNA, 12 bp, Homo sapiens
ctgtcagctgca

SEQ ID NO: 1586998 - DNA, 21 bp, Homo sapiens
ctgtcaggacaccagcctggt

SEQ ID NO: 1586999 - DNA, 16 bp, Homo sapiens
ctgtcagtatgacatt

SEQ ID NO: 1587000 - DNA, 20 bp, Homo sapiens
ctgtcagtgtacacgtctgg

SEQ ID NO: 1587001 - DNA, 17 bp, Homo sapiens
ctgtcagtgttaaagat

SEQ ID NO: 1587002 - DNA, 22 bp, Homo sapiens
ctgtcagtgttaaagattttgt

SEQ ID NO: 1587003 - DNA, 15 bp, Homo sapiens
ctgtcataggtttta

SEQ ID NO: 1587004 - DNA, 22 bp, Homo sapiens
ctgtcataggttttaaatctgc

SEQ ID NO: 1587005 - DNA, 20 bp, Homo sapiens
ctgtcatcctcaaagaaagt

SEQ ID NO: 1587006 - DNA, 21 bp, Homo sapiens
ctgtcatcctcaaagaaagtg

SEQ ID NO: 1587007 - DNA, 23 bp, Homo sapiens
ctgtcatctaaagtcctggccct

SEQ ID NO: 1587008 - DNA, 16 bp, Homo sapiens
ctgtcatctttttcca

SEQ ID NO: 1587009 - DNA, 13 bp, Homo sapiens
ctgtcatgccccc

SEQ ID NO: 1587010 - DNA, 19 bp, Homo sapiens
ctgtcatggtcctttctgg

SEQ ID NO: 1587011 - DNA, 20 bp, Homo sapiens
ctgtcatggtcctttctgga

SEQ ID NO: 1587012 - DNA, 23 bp, Homo sapiens
ctgtcatggtcctttctggaagt

SEQ ID NO: 1587013 - DNA, 15 bp, Homo sapiens
ctgtcattgcccctc

SEQ ID NO: 1587014 - DNA, 16 bp, Homo sapiens
ctgtcattgcccctcc

SEQ ID NO: 1587015 - DNA, 17 bp, Homo sapiens
ctgtcatttgaacctgg

SEQ ID NO: 1587016 - DNA, 17 bp, Homo sapiens
ctgtcatttttaacagc

SEQ ID NO: 1587017 - DNA, 18 bp, Homo sapiens
ctgtccaaaggaggctgg

SEQ ID NO: 1587018 - DNA, 16 bp, Homo sapiens
ctgtccaacatggtga

SEQ ID NO: 1587019 - DNA, 18 bp, Homo sapiens
ctgtccacatccccagag

SEQ ID NO: 1587020 - DNA, 21 bp, Homo sapiens
ctgtccacatccccagagccc

SEQ ID NO: 1587021 - DNA, 22 bp, Homo sapiens
ctgtccacatccccagagccca

SEQ ID NO: 1587022 - DNA, 23 bp, Homo sapiens
ctgtccaccctcatttctgccag

SEQ ID NO: 1587023 - DNA, 14 bp, Homo sapiens
ctgtccaccctgcc

SEQ ID NO: 1587024 - DNA, 12 bp, Homo sapiens
ctgtccactctc

SEQ ID NO: 1587025 - DNA, 23 bp, Homo sapiens
ctgtccactctcggggcccttgg

SEQ ID NO: 1587026 - DNA, 18 bp, Homo sapiens
ctgtccagcctgggcagc

SEQ ID NO: 1587027 - DNA, 18 bp, Homo sapiens
ctgtccagctccaacctg

SEQ ID NO: 1587028 - DNA, 21 bp, Homo sapiens
ctgtccagctccaacctgcaa

SEQ ID NO: 1587029 - DNA, 13 bp, Homo sapiens
ctgtccaggcagc

SEQ ID NO: 1587030 - DNA, 18 bp, Homo sapiens
ctgtccaggcagctccct

SEQ ID NO: 1587031 - DNA, 16 bp, Homo sapiens
ctgtccaggccactgt

SEQ ID NO: 1587032 - DNA, 17 bp, Homo sapiens
ctgtccaggccactgtg

SEQ ID NO: 1587033 - DNA, 20 bp, Homo sapiens
ctgtccaggccactgtggcc

SEQ ID NO: 1587034 - DNA, 18 bp, Homo sapiens
ctgtccagggccctgagc

SEQ ID NO: 1587035 - DNA, 22 bp, Homo sapiens
ctgtccagggccctgagctcgg

SEQ ID NO: 1587036 - DNA, 17 bp, Homo sapiens
ctgtcccacaaaatatt

SEQ ID NO: 1587037 - DNA, 14 bp, Homo sapiens
ctgtcccaccaact

SEQ ID NO: 1587038 - DNA, 19 bp, Homo sapiens
ctgtcccaccaactctgca

SEQ ID NO: 1587039 - DNA, 20 bp, Homo sapiens
ctgtcccaccaactctgcac

SEQ ID NO: 1587040 - DNA, 23 bp, Homo sapiens
ctgtcccacccacacagctgccc

SEQ ID NO: 1587041 - DNA, 16 bp, Homo sapiens
ctgtcccacccccacc

SEQ ID NO: 1587042 - DNA, 11 bp, Homo sapiens
ctgtcccagag

SEQ ID NO: 1587043 - DNA, 23 bp, Homo sapiens
ctgtcccagaggttatctgcctg

SEQ ID NO: 1587044 - DNA, 12 bp, Homo sapiens
ctgtcccagcta

SEQ ID NO: 1587045 - DNA, 22 bp, Homo sapiens
ctgtcccagctaccaagtcaga

SEQ ID NO: 1587046 - DNA, 22 bp, Homo sapiens
ctgtcccagggccctcccagcc

SEQ ID NO: 1587047 - DNA, 14 bp, Homo sapiens
ctgtcccattctag

SEQ ID NO: 1587048 - DNA, 21 bp, Homo sapiens
ctgtcccattctagatcctgc

SEQ ID NO: 1587049 - DNA, 22 bp, Homo sapiens
ctgtcccattctagatcctgca

SEQ ID NO: 1587050 - DNA, 18 bp, Homo sapiens
ctgtccccaccctccact

SEQ ID NO: 1587051 - DNA, 13 bp, Homo sapiens
ctgtcccccagct

SEQ ID NO: 1587052 - DNA, 15 bp, Homo sapiens
ctgtcccccagctct

SEQ ID NO: 1587053 - DNA, 15 bp, Homo sapiens
ctgtccccgcagccc

SEQ ID NO: 1587054 - DNA, 17 bp, Homo sapiens
ctgtccccgcagccctg

SEQ ID NO: 1587055 - DNA, 14 bp, Homo sapiens
ctgtcccctcagcg

SEQ ID NO: 1587056 - DNA, 15 bp, Homo sapiens
ctgtcccctctgtca

SEQ ID NO: 1587057 - DNA, 16 bp, Homo sapiens
ctgtcccctctgtcat

SEQ ID NO: 1587058 - DNA, 20 bp, Homo sapiens
ctgtcccctgaaaaactgat

SEQ ID NO: 1587059 - DNA, 16 bp, Homo sapiens
ctgtctgtctctccat

SEQ ID NO: 1587060 - DNA, 14 bp, Homo sapiens
ctgtctgtgggccg

SEQ ID NO: 1587061 - DNA, 19 bp, Homo sapiens
ctgtcttatggtccagaaa

SEQ ID NO: 1587062 - DNA, 21 bp, Homo sapiens
ctgtcttatggtccagaaact

SEQ ID NO: 1587063 - DNA, 18 bp, Homo sapiens
ctgtcttcagtctcacag

SEQ ID NO: 1587064 - DNA, 23 bp, Homo sapiens
ctgtcttcagtctcacagagaag

SEQ ID NO: 1587065 - DNA, 17 bp, Homo sapiens
ctgtcttctcaggctct

SEQ ID NO: 1587066 - DNA, 23 bp, Homo sapiens
ctgtcttctccctgcacaagcca

SEQ ID NO: 1587067 - DNA, 13 bp, Homo sapiens
ctgtcttctggac

SEQ ID NO: 1587068 - DNA, 19 bp, Homo sapiens
ctgtcttgaataagagtga

SEQ ID NO: 1587069 - DNA, 13 bp, Homo sapiens
ctgtcttgccagc

SEQ ID NO: 1587070 - DNA, 17 bp, Homo sapiens
ctgtcttgccagccaga

SEQ ID NO: 1587071 - DNA, 19 bp, Homo sapiens
ctgtcttgccagccagaag

SEQ ID NO: 1587072 - DNA, 19 bp, Homo sapiens
ctgtcttgttaatgctttt

SEQ ID NO: 1587073 - DNA, 15 bp, Homo sapiens
ctgtcttgtttcagt

SEQ ID NO: 1587074 - DNA, 15 bp, Homo sapiens
ctgtctttcagatac

SEQ ID NO: 1587075 - DNA, 20 bp, Homo sapiens
ctgtctttcagatacatggt

SEQ ID NO: 1587076 - DNA, 15 bp, Homo sapiens
ctgtctttcagcatt

SEQ ID NO: 1587077 - DNA, 16 bp, Homo sapiens
ctgtctttgactgtga

SEQ ID NO: 1587078 - DNA, 18 bp, Homo sapiens
ctgtctttgttgtctccc

SEQ ID NO: 1587079 - DNA, 17 bp, Homo sapiens
ctgtgaaaaatcagatg

SEQ ID NO: 1587080 - DNA, 17 bp, Homo sapiens
ctgtgaaaactctggta

SEQ ID NO: 1587081 - DNA, 22 bp, Homo sapiens
ctgtgaaaatagtgtaagaact

SEQ ID NO: 1587082 - DNA, 23 bp, Homo sapiens
ctgtgaaactggcactgaattaa

SEQ ID NO: 1587083 - DNA, 24 bp, Homo sapiens
ctgtgaaataccacaagcctgaga

SEQ ID NO: 1587084 - DNA, 21 bp, Homo sapiens
ctgtgaacagcttgctgtcac

SEQ ID NO: 1587085 - DNA, 16 bp, Homo sapiens
ctgtgaacgatttaga

SEQ ID NO: 1587086 - DNA, 18 bp, Homo sapiens
ctgtgaacgatttagaaa

SEQ ID NO: 1587087 - DNA, 19 bp, Homo sapiens
ctgtgaactcaatctccag

SEQ ID NO: 1587088 - DNA, 20 bp, Homo sapiens
ctgtgaactcaatctccagg

SEQ ID NO: 1587089 - DNA, 23 bp, Homo sapiens
ctgtgaactcaatctccagggct

SEQ ID NO: 1587090 - DNA, 21 bp, Homo sapiens
ctgtgaagagaatgtattctg

SEQ ID NO: 1587091 - DNA, 19 bp, Homo sapiens
ctgtgaagcagtcagccct

SEQ ID NO: 1587092 - DNA, 18 bp, Homo sapiens
ctgtgaagggtacagatt

SEQ ID NO: 1587093 - DNA, 22 bp, Homo sapiens
ctgtgaagtaacccctcctggc

SEQ ID NO: 1587094 - DNA, 20 bp, Homo sapiens
ctgtgaatgccactgccttc

SEQ ID NO: 1587095 - DNA, 21 bp, Homo sapiens
ctgtgaatgccactgccttcg

SEQ ID NO: 1587096 - DNA, 20 bp, Homo sapiens
ctgtgaatgtaaaacagagc

SEQ ID NO: 1587097 - DNA, 22 bp, Homo sapiens
ctgtgaatgtaaaacagagcca

SEQ ID NO: 1587098 - DNA, 13 bp, Homo sapiens
ctgtgacaaaatg

SEQ ID NO: 1587099 - DNA, 15 bp, Homo sapiens
ctgtgacacatcgtt

SEQ ID NO: 1587100 - DNA, 14 bp, Homo sapiens
ctgtgacacctggt

SEQ ID NO: 1587101 - DNA, 22 bp, Homo sapiens
ctgtgacacctggtgcgggcct

SEQ ID NO: 1587102 - DNA, 20 bp, Homo sapiens
ctgtgacatggtgcctgaga

SEQ ID NO: 1587103 - DNA, 14 bp, Homo sapiens
ctgtgaccagcact

SEQ ID NO: 1587104 - DNA, 19 bp, Homo sapiens
ctgtgacgtcggccgacca

SEQ ID NO: 1587105 - DNA, 16 bp, Homo sapiens
ctgtgactataaagct

SEQ ID NO: 1587106 - DNA, 17 bp, Homo sapiens
ctgtgactataaagctg

SEQ ID NO: 1587107 - DNA, 19 bp, Homo sapiens
ctgtgactataaagctgtt

SEQ ID NO: 1587108 - DNA, 17 bp, Homo sapiens
ctgtgactctgggcagg

SEQ ID NO: 1587109 - DNA, 19 bp, Homo sapiens
ctgtgactctgggcaggga

SEQ ID NO: 1587110 - DNA, 18 bp, Homo sapiens
ctgtgacttaagaagcct

SEQ ID NO: 1587111 - DNA, 19 bp, Homo sapiens
ctgtgagaaggtttattgt

SEQ ID NO: 1587112 - DNA, 22 bp, Homo sapiens
ctgtgagaaggtttattgttaa

SEQ ID NO: 1587113 - DNA, 14 bp, Homo sapiens
ctgtgagaccccca

SEQ ID NO: 1587114 - DNA, 15 bp, Homo sapiens
ctgtgagacccccac

SEQ ID NO: 1587115 - DNA, 18 bp, Homo sapiens
ctgtgagacgaggcaggg

SEQ ID NO: 1587116 - DNA, 21 bp, Homo sapiens
ctgtgagacgaggcaggggct

SEQ ID NO: 1587117 - DNA, 20 bp, Homo sapiens
ctgtgagactcgagaacttt

SEQ ID NO: 1587118 - DNA, 23 bp, Homo sapiens
ctgtgagcaaggagcacaagcca

SEQ ID NO: 1587119 - DNA, 15 bp, Homo sapiens
ctgtgagcagcctcc

SEQ ID NO: 1587120 - DNA, 19 bp, Homo sapiens
ctgtgagcatccttcccag

SEQ ID NO: 1587121 - DNA, 23 bp, Homo sapiens
ctgtgagcatccttcccagcaga

SEQ ID NO: 1587122 - DNA, 17 bp, Homo sapiens
ctgtgagcttacattga

SEQ ID NO: 1587123 - DNA, 13 bp, Homo sapiens
ctgtgaggcaggg

SEQ ID NO: 1587124 - DNA, 14 bp, Homo sapiens
ctgtgaggcagggg

SEQ ID NO: 1587125 - DNA, 12 bp, Homo sapiens
ctgtgaggctgt

SEQ ID NO: 1587126 - DNA, 17 bp, Homo sapiens
ctgtgaggctgtcctgt

SEQ ID NO: 1587127 - DNA, 15 bp, Homo sapiens
ctgtgagggagggga

SEQ ID NO: 1587128 - DNA, 16 bp, Homo sapiens
ctgtgaggggaaggcc

SEQ ID NO: 1587129 - DNA, 19 bp, Homo sapiens
ctgtgaggggctctctcat

SEQ ID NO: 1587130 - DNA, 17 bp, Homo sapiens
ctgtgaggtgctgatga

SEQ ID NO: 1587131 - DNA, 19 bp, Homo sapiens
ctgtgagtgtaagtgtgag

SEQ ID NO: 1587132 - DNA, 20 bp, Homo sapiens
ctgtgagtgtaagtgtgagt

SEQ ID NO: 1587133 - DNA, 14 bp, Homo sapiens
ctgtgataaaaaga

SEQ ID NO: 1587134 - DNA, 18 bp, Homo sapiens
ctgtgatccttggtgctg

SEQ ID NO: 1587135 - DNA, 21 bp, Homo sapiens
ctgtgatccttggtgctgtgt

SEQ ID NO: 1587136 - DNA, 20 bp, Homo sapiens
ctgtgatctagtccttgtct

SEQ ID NO: 1587137 - DNA, 17 bp, Homo sapiens
ctgtgatcttttaaagt

SEQ ID NO: 1587138 - DNA, 13 bp, Homo sapiens
ctgtgatgagctg

SEQ ID NO: 1587139 - DNA, 17 bp, Homo sapiens
ctgtgatgatcctcata

SEQ ID NO: 1587140 - DNA, 13 bp, Homo sapiens
ctgtgatgcatga

SEQ ID NO: 1587141 - DNA, 14 bp, Homo sapiens
ctgtgatgcatgag

SEQ ID NO: 1587142 - DNA, 14 bp, Homo sapiens
ctgtgatgccacac

SEQ ID NO: 1587143 - DNA, 23 bp, Homo sapiens
ctgtgatggccaggccaggggac

SEQ ID NO: 1587144 - DNA, 16 bp, Homo sapiens
ctgtgattagatcaca

SEQ ID NO: 1587145 - DNA, 19 bp, Homo sapiens
ctgtgattagatcacatct

SEQ ID NO: 1587146 - DNA, 13 bp, Homo sapiens
ctgtgattgctgc

SEQ ID NO: 1587147 - DNA, 12 bp, Homo sapiens
ctgtgattggct

SEQ ID NO: 1587148 - DNA, 15 bp, Homo sapiens
ctgtgattggctggt

SEQ ID NO: 1587149 - DNA, 16 bp, Homo sapiens
ctgtgatttatttgga

SEQ ID NO: 1587150 - DNA, 13 bp, Homo sapiens
ctgtgatttctgg

SEQ ID NO: 1587151 - DNA, 16 bp, Homo sapiens
ctgtgcaaatccttga

SEQ ID NO: 1587152 - DNA, 18 bp, Homo sapiens
ctgtgcaacggtctcctg

SEQ ID NO: 1587153 - DNA, 18 bp, Homo sapiens
ctgtgcacagtggcttct

SEQ ID NO: 1587154 - DNA, 13 bp, Homo sapiens
ctgtgcacctacc

SEQ ID NO: 1587155 - DNA, 19 bp, Homo sapiens
ctgtgcacctaccccttgg

SEQ ID NO: 1587156 - DNA, 22 bp, Homo sapiens
ctgtgcacctaccccttggaaa

SEQ ID NO: 1587157 - DNA, 15 bp, Homo sapiens
ctgtgcacggtggac

SEQ ID NO: 1587158 - DNA, 16 bp, Homo sapiens
ctgtgcactagcctgt

SEQ ID NO: 1587159 - DNA, 20 bp, Homo sapiens
ctgtgcactagcctgtgatt

SEQ ID NO: 1587160 - DNA, 21 bp, Homo sapiens
ctgtgcactagcctgtgatta

SEQ ID NO: 1587161 - DNA, 11 bp, Homo sapiens
ctgtgcagaag

SEQ ID NO: 1587162 - DNA, 15 bp, Homo sapiens
ctgtgcagatgagca

SEQ ID NO: 1587163 - DNA, 18 bp, Homo sapiens
ctgtgcagatgagcagtc

SEQ ID NO: 1587164 - DNA, 17 bp, Homo sapiens
ctgtgcagcagcccagc

SEQ ID NO: 1587165 - DNA, 22 bp, Homo sapiens
ctgtgcagcagcccagcttcct

SEQ ID NO: 1587166 - DNA, 23 bp, Homo sapiens
ctgtgcagcagcccagcttcctg

SEQ ID NO: 1587167 - DNA, 12 bp, Homo sapiens
ctgtgcaggtgc

SEQ ID NO: 1587168 - DNA, 13 bp, Homo sapiens
ctgtgcaggtgct

SEQ ID NO: 1587169 - DNA, 16 bp, Homo sapiens
ctgtgcagtcactgga

SEQ ID NO: 1587170 - DNA, 20 bp, Homo sapiens
ctgtgcatcaaccaggaaga

SEQ ID NO: 1587171 - DNA, 20 bp, Homo sapiens
ctgtgcatgggtgaagggag

SEQ ID NO: 1587172 - DNA, 15 bp, Homo sapiens
ctgtgcatgtatgtc

SEQ ID NO: 1587173 - DNA, 16 bp, Homo sapiens
ctgtgcatgtatgtct

SEQ ID NO: 1587174 - DNA, 19 bp, Homo sapiens
ctgtgcattcatgcaagag

SEQ ID NO: 1587175 - DNA, 12 bp, Homo sapiens
ctgtgccaacct

SEQ ID NO: 1587176 - DNA, 21 bp, Homo sapiens
ctgtgccactcaccgaagcca

SEQ ID NO: 1587177 - DNA, 20 bp, Homo sapiens
ctgtgccactgacttgctgt

SEQ ID NO: 1587178 - DNA, 22 bp, Homo sapiens
ctgtgccactgacttgctgtgt

SEQ ID NO: 1587179 - DNA, 11 bp, Homo sapiens
ctgtgccagca

SEQ ID NO: 1587180 - DNA, 13 bp, Homo sapiens
ctgtgccagcagg

SEQ ID NO: 1587181 - DNA, 20 bp, Homo sapiens
ctgtgccatgctgggccact

SEQ ID NO: 1587182 - DNA, 23 bp, Homo sapiens
ctgtgccattttaaaaatagaat

SEQ ID NO: 1587183 - DNA, 15 bp, Homo sapiens
ctgtgcccagcaggc

SEQ ID NO: 1587184 - DNA, 16 bp, Homo sapiens
ctgtgcccagcaggcc

SEQ ID NO: 1587185 - DNA, 11 bp, Homo sapiens
ctgtgccccac

SEQ ID NO: 1587186 - DNA, 14 bp, Homo sapiens
ctgtgccccaccac

SEQ ID NO: 1587187 - DNA, 21 bp, Homo sapiens
ctgtgccccatgcctgtccag

SEQ ID NO: 1587188 - DNA, 21 bp, Homo sapiens
ctgtgcccctgatgcagcctg

SEQ ID NO: 1587189 - DNA, 17 bp, Homo sapiens
ctgtgccctggtggaga

SEQ ID NO: 1587190 - DNA, 15 bp, Homo sapiens
ctgtgcctcagagac

SEQ ID NO: 1587191 - DNA, 16 bp, Homo sapiens
ctgtgcctcagagacc

SEQ ID NO: 1587192 - DNA, 19 bp, Homo sapiens
ctgtgcctcagagaccagg

SEQ ID NO: 1587193 - DNA, 22 bp, Homo sapiens
ctgtgcctcagagaccagggct

SEQ ID NO: 1587194 - DNA, 15 bp, Homo sapiens
ctgtgcctcaggcca

SEQ ID NO: 1587195 - DNA, 20 bp, Homo sapiens
ctgtgcctcaggccagggct

SEQ ID NO: 1587196 - DNA, 14 bp, Homo sapiens
ctgtgcctcccaaa

SEQ ID NO: 1587197 - DNA, 14 bp, Homo sapiens
ctgtgcctcccccc

SEQ ID NO: 1587198 - DNA, 17 bp, Homo sapiens
ctgtgcctccccccaga

SEQ ID NO: 1587199 - DNA, 21 bp, Homo sapiens
ctgtgcctccccccagacccc

SEQ ID NO: 1587200 - DNA, 16 bp, Homo sapiens
ctgtgcctcctcaccc

SEQ ID NO: 1587201 - DNA, 18 bp, Homo sapiens
ctgtgcctctgggactgg

SEQ ID NO: 1587202 - DNA, 17 bp, Homo sapiens
ctgtgcctgctagagca

SEQ ID NO: 1587203 - DNA, 19 bp, Homo sapiens
ctgtgcctgctagagcaac

SEQ ID NO: 1587204 - DNA, 21 bp, Homo sapiens
ctgtgcctgctagagcaaccc

SEQ ID NO: 1587205 - DNA, 20 bp, Homo sapiens
ctgtgcctgctcagcagcca

SEQ ID NO: 1587206 - DNA, 17 bp, Homo sapiens
ctgtgcctgggccctgg

SEQ ID NO: 1587207 - DNA, 18 bp, Homo sapiens
ctgtgcctgggccctggg

SEQ ID NO: 1587208 - DNA, 21 bp, Homo sapiens
ctgtgcctgggccctgggctg

SEQ ID NO: 1587209 - DNA, 19 bp, Homo sapiens
ctgtgccttcttttgatta

SEQ ID NO: 1587210 - DNA, 17 bp, Homo sapiens
ctgtgcgcccagggctg

SEQ ID NO: 1587211 - DNA, 15 bp, Homo sapiens
ctgtgcgccttgtag

SEQ ID NO: 1587212 - DNA, 23 bp, Homo sapiens
ctgtgcgtcccagctgaaggcag

SEQ ID NO: 1587213 - DNA, 19 bp, Homo sapiens
ctgtgcgtcttggtgtaat

SEQ ID NO: 1587214 - DNA, 20 bp, Homo sapiens
ctgtgctagttttacagatt

SEQ ID NO: 1587215 - DNA, 13 bp, Homo sapiens
ctgtgctatgaat

SEQ ID NO: 1587216 - DNA, 16 bp, Homo sapiens
ctgtgctatgaatttt

SEQ ID NO: 1587217 - DNA, 16 bp, Homo sapiens
ctgtgctatttgtaca

SEQ ID NO: 1587218 - DNA, 12 bp, Homo sapiens
ctgtgctcagcc

SEQ ID NO: 1587219 - DNA, 17 bp, Homo sapiens
ctgtgctcatcggagac

SEQ ID NO: 1587220 - DNA, 21 bp, Homo sapiens
ctgtgctcatcggagactgcc

SEQ ID NO: 1587221 - DNA, 15 bp, Homo sapiens
ctgtgctccaacctg

SEQ ID NO: 1587222 - DNA, 23 bp, Homo sapiens
ctgtgctcccctgccacactgat

SEQ ID NO: 1587223 - DNA, 19 bp, Homo sapiens
ctgtgctccgtgcctccac

SEQ ID NO: 1587224 - DNA, 20 bp, Homo sapiens
ctgtgctccgtgcctccacc

SEQ ID NO: 1587225 - DNA, 15 bp, Homo sapiens
ctgtgctcctgccca

SEQ ID NO: 1587226 - DNA, 16 bp, Homo sapiens
ctgtgctcctgcccag

SEQ ID NO: 1587227 - DNA, 19 bp, Homo sapiens
ctgtgctcctgcccaggag

SEQ ID NO: 1587228 - DNA, 21 bp, Homo sapiens
ctgtgctcctgcccaggagca

SEQ ID NO: 1587229 - DNA, 22 bp, Homo sapiens
ctgtgctcctgcccaggagcag

SEQ ID NO: 1587230 - DNA, 20 bp, Homo sapiens
ctgtgctctggaggctgcag

SEQ ID NO: 1587231 - DNA, 13 bp, Homo sapiens
ctgtgctctggca

SEQ ID NO: 1587232 - DNA, 15 bp, Homo sapiens
ctgtgctctggcacc

SEQ ID NO: 1587233 - DNA, 16 bp, Homo sapiens
ctgtgctcttttggtg

SEQ ID NO: 1587234 - DNA, 22 bp, Homo sapiens
ctgtgctcttttggtggggagc

SEQ ID NO: 1587235 - DNA, 14 bp, Homo sapiens
ctgtgctgcatgcg

SEQ ID NO: 1587236 - DNA, 22 bp, Homo sapiens
ctgtgctgcccgtcttcagcct

SEQ ID NO: 1587237 - DNA, 21 bp, Homo sapiens
ctgtgctgggccagtggctgg

SEQ ID NO: 1587238 - DNA, 19 bp, Homo sapiens
ctgtgctggtgtcctgacc

SEQ ID NO: 1587239 - DNA, 23 bp, Homo sapiens
ctgtgctggtgtcctgaccaccc

SEQ ID NO: 1587240 - DNA, 18 bp, Homo sapiens
ctgtgctgtgcctgctag

SEQ ID NO: 1587241 - DNA, 21 bp, Homo sapiens
ctgtgctgtgcctgctagagc

SEQ ID NO: 1587242 - DNA, 11 bp, Homo sapiens
ctgtgctgtgt

SEQ ID NO: 1587243 - DNA, 18 bp, Homo sapiens
ctgtgctgtgtgtgacgt

SEQ ID NO: 1587244 - DNA, 17 bp, Homo sapiens
ctgtgcttcgactactg

SEQ ID NO: 1587245 - DNA, 22 bp, Homo sapiens
ctgtgctttcccagaggacacc

SEQ ID NO: 1587246 - DNA, 14 bp, Homo sapiens
ctgtggaagcaagg

SEQ ID NO: 1587247 - DNA, 18 bp, Homo sapiens
ctgtggacaggatgagga

SEQ ID NO: 1587248 - DNA, 16 bp, Homo sapiens
ctgtggacatgtgggt

SEQ ID NO: 1587249 - DNA, 20 bp, Homo sapiens
ctgtggaccgtggacaggcc

SEQ ID NO: 1587250 - DNA, 15 bp, Homo sapiens
ctgtggagactttct

SEQ ID NO: 1587251 - DNA, 14 bp, Homo sapiens
ctgtggagctgcca

SEQ ID NO: 1587252 - DNA, 17 bp, Homo sapiens
ctgtggagctgccacag

SEQ ID NO: 1587253 - DNA, 19 bp, Homo sapiens
ctgtggagctgccacagag

SEQ ID NO: 1587254 - DNA, 22 bp, Homo sapiens
ctgtggagctgccacagagaag

SEQ ID NO: 1587255 - DNA, 13 bp, Homo sapiens
ctgtggaggcctg

SEQ ID NO: 1587256 - DNA, 14 bp, Homo sapiens
ctgtggaggcctga

SEQ ID NO: 1587257 - DNA, 16 bp, Homo sapiens
ctgtggaggcctgatg

SEQ ID NO: 1587258 - DNA, 18 bp, Homo sapiens
ctgtggaggcctgatgct

SEQ ID NO: 1587259 - DNA, 22 bp, Homo sapiens
ctgtggaggcctgatgctgccc

SEQ ID NO: 1587260 - DNA, 16 bp, Homo sapiens
ctgtggagtccagctc

SEQ ID NO: 1587261 - DNA, 15 bp, Homo sapiens
ctgtggcacagactt

SEQ ID NO: 1587262 - DNA, 18 bp, Homo sapiens
ctgtggcacagccctgag

SEQ ID NO: 1587263 - DNA, 19 bp, Homo sapiens
ctgtggcacagccctgagt

SEQ ID NO: 1587264 - DNA, 21 bp, Homo sapiens
ctgtggcacttgcctgggtca

SEQ ID NO: 1587265 - DNA, 16 bp, Homo sapiens
ctgtggcagaaaagag

SEQ ID NO: 1587266 - DNA, 19 bp, Homo sapiens
ctgtggcagaaaagaggag

SEQ ID NO: 1587267 - DNA, 18 bp, Homo sapiens
ctgtggcagagttacagt

SEQ ID NO: 1587268 - DNA, 19 bp, Homo sapiens
ctgtggcagccgtcccagg

SEQ ID NO: 1587269 - DNA, 16 bp, Homo sapiens
ctgtggcagctgcccc

SEQ ID NO: 1587270 - DNA, 15 bp, Homo sapiens
ctgtggcataaattg

SEQ ID NO: 1587271 - DNA, 13 bp, Homo sapiens
ctgtggcatttcc

SEQ ID NO: 1587272 - DNA, 17 bp, Homo sapiens
ctgtggcatttccaaac

SEQ ID NO: 1587273 - DNA, 14 bp, Homo sapiens
ctgtggccacagcc

SEQ ID NO: 1587274 - DNA, 12 bp, Homo sapiens
ctgtggccagag

SEQ ID NO: 1587275 - DNA, 18 bp, Homo sapiens
ctgtggccagagctggaa

SEQ ID NO: 1587276 - DNA, 19 bp, Homo sapiens
ctgtggccagagctggaag

SEQ ID NO: 1587277 - DNA, 22 bp, Homo sapiens
ctgtggccagcttgttatttat

SEQ ID NO: 1587278 - DNA, 16 bp, Homo sapiens
ctgtggccctggccac

SEQ ID NO: 1587279 - DNA, 19 bp, Homo sapiens
ctgtggccgttatctggaa

SEQ ID NO: 1587280 - DNA, 20 bp, Homo sapiens
ctgtggccgttatctggaag

SEQ ID NO: 1587281 - DNA, 11 bp, Homo sapiens
ctgtggcctgg

SEQ ID NO: 1587282 - DNA, 16 bp, Homo sapiens
ctgtggcctgggcaag

SEQ ID NO: 1587283 - DNA, 14 bp, Homo sapiens
ctgtggcctgtgtc

SEQ ID NO: 1587284 - DNA, 20 bp, Homo sapiens
ctgtggcctgtgtcccatga

SEQ ID NO: 1587285 - DNA, 23 bp, Homo sapiens
ctgtggcctgtgtcccatgaccc

SEQ ID NO: 1587286 - DNA, 14 bp, Homo sapiens
ctgtggccttgccc

SEQ ID NO: 1587287 - DNA, 21 bp, Homo sapiens
ctgtggcgccgtctccagggg

SEQ ID NO: 1587288 - DNA, 16 bp, Homo sapiens
ctgtggcggccttccg

SEQ ID NO: 1587289 - DNA, 18 bp, Homo sapiens
ctgtggcgttctgctgcc

SEQ ID NO: 1587290 - DNA, 19 bp, Homo sapiens
ctgtggcgttctgctgccc

SEQ ID NO: 1587291 - DNA, 23 bp, Homo sapiens
ctgtggcgttctgctgcccctgc

SEQ ID NO: 1587292 - DNA, 20 bp, Homo sapiens
ctgtggctaaacagatgtaa

SEQ ID NO: 1587293 - DNA, 15 bp, Homo sapiens
ctgtggctagtgaca

SEQ ID NO: 1587294 - DNA, 11 bp, Homo sapiens
ctgtggctcca

SEQ ID NO: 1587295 - DNA, 16 bp, Homo sapiens
ctgtggctccctcctc

SEQ ID NO: 1587296 - DNA, 17 bp, Homo sapiens
ctgtggctgctagcact

SEQ ID NO: 1587297 - DNA, 20 bp, Homo sapiens
ctgtggctggaggagctggc

SEQ ID NO: 1587298 - DNA, 16 bp, Homo sapiens
ctgtggcttggagtgg

SEQ ID NO: 1587299 - DNA, 21 bp, Homo sapiens
ctgtggctttttgttcagaat

SEQ ID NO: 1587300 - DNA, 14 bp, Homo sapiens
ctgtgggagcctgc

SEQ ID NO: 1587301 - DNA, 20 bp, Homo sapiens
ctgtgggagggactttgctg

SEQ ID NO: 1587302 - DNA, 21 bp, Homo sapiens
ctgtgggcaattgttacaagt

SEQ ID NO: 1587303 - DNA, 16 bp, Homo sapiens
ctgtgggcactggtgg

SEQ ID NO: 1587304 - DNA, 22 bp, Homo sapiens
ctgtgggcttatgtctctgcct

SEQ ID NO: 1587305 - DNA, 15 bp, Homo sapiens
ctgtgggcttcccca

SEQ ID NO: 1587306 - DNA, 13 bp, Homo sapiens
cttaatgttactc

SEQ ID NO: 1587307 - DNA, 15 bp, Homo sapiens
cttaatgtttattcc

SEQ ID NO: 1587308 - DNA, 16 bp, Homo sapiens
cttaatgtttattcct

SEQ ID NO: 1587309 - DNA, 15 bp, Homo sapiens
cttaattctctgcaa

SEQ ID NO: 1587310 - DNA, 20 bp, Homo sapiens
cttaattctttgttctgttt

SEQ ID NO: 1587311 - DNA, 16 bp, Homo sapiens
cttaattgttcatttt

SEQ ID NO: 1587312 - DNA, 14 bp, Homo sapiens
cttaatttcctttt

SEQ ID NO: 1587313 - DNA, 21 bp, Homo sapiens
cttaatttcctttttgacact

SEQ ID NO: 1587314 - DNA, 23 bp, Homo sapiens
cttaatttcctttttgacactga

SEQ ID NO: 1587315 - DNA, 13 bp, Homo sapiens
cttacaaaatgcc

SEQ ID NO: 1587316 - DNA, 15 bp, Homo sapiens
cttacaaaatgccaa

SEQ ID NO: 1587317 - DNA, 11 bp, Homo sapiens
cttacaaactt

SEQ ID NO: 1587318 - DNA, 23 bp, Homo sapiens
cttacaaagggaaagcctctggc

SEQ ID NO: 1587319 - DNA, 22 bp, Homo sapiens
cttacaaggccctttcctttgg

SEQ ID NO: 1587320 - DNA, 21 bp, Homo sapiens
cttacaatattgattgggaaa

SEQ ID NO: 1587321 - DNA, 16 bp, Homo sapiens
cttacaattgcactgc

SEQ ID NO: 1587322 - DNA, 20 bp, Homo sapiens
cttacaattgcactgctgtt

SEQ ID NO: 1587323 - DNA, 17 bp, Homo sapiens
cttacacttggagcccg

SEQ ID NO: 1587324 - DNA, 23 bp, Homo sapiens
cttacacttggagcccgtgcagt

SEQ ID NO: 1587325 - DNA, 12 bp, Homo sapiens
cttacagagcct

SEQ ID NO: 1587326 - DNA, 20 bp, Homo sapiens
cttacaggaaaacctgcaga

SEQ ID NO: 1587327 - DNA, 17 bp, Homo sapiens
cttacagtaactaattt

SEQ ID NO: 1587328 - DNA, 15 bp, Homo sapiens
cttacatgtgtaaag

SEQ ID NO: 1587329 - DNA, 21 bp, Homo sapiens
cttacattagcagtttgcttt

SEQ ID NO: 1587330 - DNA, 15 bp, Homo sapiens
cttacattgaaaaca

SEQ ID NO: 1587331 - DNA, 15 bp, Homo sapiens
cttacattgtgaaac

SEQ ID NO: 1587332 - DNA, 20 bp, Homo sapiens
cttacattttcctgagacct

SEQ ID NO: 1587333 - DNA, 14 bp, Homo sapiens
cttacatttttaca

SEQ ID NO: 1587334 - DNA, 23 bp, Homo sapiens
cttaccaagttgtgcttttctgt

SEQ ID NO: 1587335 - DNA, 15 bp, Homo sapiens
cttacccaagctgtg

SEQ ID NO: 1587336 - DNA, 22 bp, Homo sapiens
cttacccaagctgtggcagccg

SEQ ID NO: 1587337 - DNA, 21 bp, Homo sapiens
cttacccggagaaggccgctg

SEQ ID NO: 1587338 - DNA, 23 bp, Homo sapiens
cttacccggagaaggccgctgcc

SEQ ID NO: 1587339 - DNA, 18 bp, Homo sapiens
cttacctaaacagatata

SEQ ID NO: 1587340 - DNA, 19 bp, Homo sapiens
cttacctaaacagatataa

SEQ ID NO: 1587341 - DNA, 21 bp, Homo sapiens
cttacctaaacagatataaat

SEQ ID NO: 1587342 - DNA, 15 bp, Homo sapiens
cttacctaacatctg

SEQ ID NO: 1587343 - DNA, 18 bp, Homo sapiens
cttacctaacttgaacat

SEQ ID NO: 1587344 - DNA, 15 bp, Homo sapiens
cttacctcctgccca

SEQ ID NO: 1587345 - DNA, 16 bp, Homo sapiens
cttacctcctgcccag

SEQ ID NO: 1587346 - DNA, 18 bp, Homo sapiens
cttacctcctgcccagga

SEQ ID NO: 1587347 - DNA, 13 bp, Homo sapiens
cttacctgacaca

SEQ ID NO: 1587348 - DNA, 19 bp, Homo sapiens
cttacctgacacaagagga

SEQ ID NO: 1587349 - DNA, 13 bp, Homo sapiens
cttatccctctct

SEQ ID NO: 1587350 - DNA, 17 bp, Homo sapiens
cttatccctctcttccc

SEQ ID NO: 1587351 - DNA, 16 bp, Homo sapiens
cttatcccttcttttt

SEQ ID NO: 1587352 - DNA, 20 bp, Homo sapiens
cttatcctctctctcttcta

SEQ ID NO: 1587353 - DNA, 15 bp, Homo sapiens
cttatctcagatatt

SEQ ID NO: 1587354 - DNA, 19 bp, Homo sapiens
cttatctcagatatttgca

SEQ ID NO: 1587355 - DNA, 20 bp, Homo sapiens
cttatctcagatatttgcac

SEQ ID NO: 1587356 - DNA, 18 bp, Homo sapiens
cttatctctcaaaacaat

SEQ ID NO: 1587357 - DNA, 14 bp, Homo sapiens
cttatcttatgcca

SEQ ID NO: 1587358 - DNA, 13 bp, Homo sapiens
cttatcttctgga

SEQ ID NO: 1587359 - DNA, 16 bp, Homo sapiens
cttatcttctggatta

SEQ ID NO: 1587360 - DNA, 21 bp, Homo sapiens
cttatctttctaaaactgcct

SEQ ID NO: 1587361 - DNA, 13 bp, Homo sapiens
cttatgagatggg

SEQ ID NO: 1587362 - DNA, 15 bp, Homo sapiens
cttatgaggagggga

SEQ ID NO: 1587363 - DNA, 15 bp, Homo sapiens
cttatgcatgaaatg

SEQ ID NO: 1587364 - DNA, 18 bp, Homo sapiens
cttatgcatgaaatgaat

SEQ ID NO: 1587365 - DNA, 19 bp, Homo sapiens
cttatgcatgaaatgaatg

SEQ ID NO: 1587366 - DNA, 21 bp, Homo sapiens
cttatgctagtttattggaag

SEQ ID NO: 1587367 - DNA, 21 bp, Homo sapiens
cttatgggtccccctcagcaa

SEQ ID NO: 1587368 - DNA, 19 bp, Homo sapiens
cttatgtagcaggaaataa

SEQ ID NO: 1587369 - DNA, 14 bp, Homo sapiens
cttatgtctctgcc

SEQ ID NO: 1587370 - DNA, 13 bp, Homo sapiens
cttatgttccaga

SEQ ID NO: 1587371 - DNA, 16 bp, Homo sapiens
cttattacattttatt

SEQ ID NO: 1587372 - DNA, 22 bp, Homo sapiens
cttattaccctgattgaatgtg

SEQ ID NO: 1587373 - DNA, 14 bp, Homo sapiens
cttattactattat

SEQ ID NO: 1587374 - DNA, 15 bp, Homo sapiens
cttattcaccttttt

SEQ ID NO: 1587375 - DNA, 18 bp, Homo sapiens
cttattccgagcattcca

SEQ ID NO: 1587376 - DNA, 20 bp, Homo sapiens
cttattccgagcattccagt

SEQ ID NO: 1587377 - DNA, 14 bp, Homo sapiens
cttattctgtagat

SEQ ID NO: 1587378 - DNA, 17 bp, Homo sapiens
cttattcttgtggttaa

SEQ ID NO: 1587379 - DNA, 14 bp, Homo sapiens
cttattgcgctgct

SEQ ID NO: 1587380 - DNA, 15 bp, Homo sapiens
cttattggaactctg

SEQ ID NO: 1587381 - DNA, 13 bp, Homo sapiens
cttattggccact

SEQ ID NO: 1587382 - DNA, 21 bp, Homo sapiens
cttattgtgtgcgctgcctgg

SEQ ID NO: 1587383 - DNA, 12 bp, Homo sapiens
cttattgtttaa

SEQ ID NO: 1587384 - DNA, 18 bp, Homo sapiens
cttattgtttctctgaaa

SEQ ID NO: 1587385 - DNA, 18 bp, Homo sapiens
cttatttaaaaatatttc

SEQ ID NO: 1587386 - DNA, 21 bp, Homo sapiens
cttatttaaaaatatttcaga

SEQ ID NO: 1587387 - DNA, 22 bp, Homo sapiens
cttatttaaaaatatttcagat

SEQ ID NO: 1587388 - DNA, 22 bp, Homo sapiens
cttatttaatcttttcttattt

SEQ ID NO: 1587389 - DNA, 15 bp, Homo sapiens
cttatttaatgaaag

SEQ ID NO: 1587390 - DNA, 15 bp, Homo sapiens
cttatttaccctttt

SEQ ID NO: 1587391 - DNA, 21 bp, Homo sapiens
cttatttatcctagtattcct

SEQ ID NO: 1587392 - DNA, 16 bp, Homo sapiens
cttatttctaactatt

SEQ ID NO: 1587393 - DNA, 16 bp, Homo sapiens
cttatttctatgacaa

SEQ ID NO: 1587394 - DNA, 22 bp, Homo sapiens
cttatttgccttctactcccct

SEQ ID NO: 1587395 - DNA, 21 bp, Homo sapiens
cttatttgtctgtaaaaaatg

SEQ ID NO: 1587396 - DNA, 14 bp, Homo sapiens
cttattttagacaa

SEQ ID NO: 1587397 - DNA, 18 bp, Homo sapiens
cttattttattatgagct

SEQ ID NO: 1587398 - DNA, 18 bp, Homo sapiens
cttattttcaagaaactg

SEQ ID NO: 1587399 - DNA, 11 bp, Homo sapiens
cttattttctg

SEQ ID NO: 1587400 - DNA, 13 bp, Homo sapiens
cttattttctgaa

SEQ ID NO: 1587401 - DNA, 23 bp, Homo sapiens
cttattttctgttcagattaaaa

SEQ ID NO: 1587402 - DNA, 20 bp, Homo sapiens
cttattttgcattccagaat

SEQ ID NO: 1587403 - DNA, 13 bp, Homo sapiens
cttattttgtaag

SEQ ID NO: 1587404 - DNA, 22 bp, Homo sapiens
cttatttttctgaggtccttat

SEQ ID NO: 1587405 - DNA, 17 bp, Homo sapiens
cttatttttgacagtgt

SEQ ID NO: 1587406 - DNA, 18 bp, Homo sapiens
cttcaaaatgttctattt

SEQ ID NO: 1587407 - DNA, 20 bp, Homo sapiens
cttcaaaatgttctatttaa

SEQ ID NO: 1587408 - DNA, 13 bp, Homo sapiens
cttcaaagccttc

SEQ ID NO: 1587409 - DNA, 20 bp, Homo sapiens
cttcaaaggccaagagaatt

SEQ ID NO: 1587410 - DNA, 14 bp, Homo sapiens
cttcaaatgcaaat

SEQ ID NO: 1587411 - DNA, 19 bp, Homo sapiens
cttcaaattagaagacatt

SEQ ID NO: 1587412 - DNA, 22 bp, Homo sapiens
cttcaacaacgtgagagaaaga

SEQ ID NO: 1587413 - DNA, 15 bp, Homo sapiens
cttcaacatttacat

SEQ ID NO: 1587414 - DNA, 15 bp, Homo sapiens
cttcaacccagtggg

SEQ ID NO: 1587415 - DNA, 18 bp, Homo sapiens
cttcagtctgctccacca

SEQ ID NO: 1587416 - DNA, 18 bp, Homo sapiens
cttcagtgaagaacccta

SEQ ID NO: 1587417 - DNA, 19 bp, Homo sapiens
cttcagtgaatatttttgt

SEQ ID NO: 1587418 - DNA, 23 bp, Homo sapiens
cttcagtgaatatttttgtattt

SEQ ID NO: 1587419 - DNA, 14 bp, Homo sapiens
cttcagtgactcct

SEQ ID NO: 1587420 - DNA, 15 bp, Homo sapiens
cttcagtgactcctg

SEQ ID NO: 1587421 - DNA, 21 bp, Homo sapiens
cttcagtgactcctgctggta

SEQ ID NO: 1587422 - DNA, 23 bp, Homo sapiens
cttcagtgactcctgctggtacc

SEQ ID NO: 1587423 - DNA, 13 bp, Homo sapiens
cttcagtgcccac

SEQ ID NO: 1587424 - DNA, 23 bp, Homo sapiens
cttcagtggaccgaaatctgtat

SEQ ID NO: 1587425 - DNA, 18 bp, Homo sapiens
cttcagtgtaatgtgact

SEQ ID NO: 1587426 - DNA, 14 bp, Homo sapiens
cttcagttgcttgt

SEQ ID NO: 1587427 - DNA, 14 bp, Homo sapiens
cttcagtttatttc

SEQ ID NO: 1587428 - DNA, 20 bp, Homo sapiens
cttcagtttccgaatctctt

SEQ ID NO: 1587429 - DNA, 14 bp, Homo sapiens
cttcagtttgtaaa

SEQ ID NO: 1587430 - DNA, 19 bp, Homo sapiens
cttcataacaattttagga

SEQ ID NO: 1587431 - DNA, 12 bp, Homo sapiens
cttcataatcca

SEQ ID NO: 1587432 - DNA, 18 bp, Homo sapiens
cttcataccgcctcgtgc

SEQ ID NO: 1587433 - DNA, 21 bp, Homo sapiens
cttcataccgcctcgtgccag

SEQ ID NO: 1587434 - DNA, 15 bp, Homo sapiens
cttcatagaaacctc

SEQ ID NO: 1587435 - DNA, 18 bp, Homo sapiens
cttcatagcagattttaa

SEQ ID NO: 1587436 - DNA, 21 bp, Homo sapiens
cttcataggcggtcatgtgtg

SEQ ID NO: 1587437 - DNA, 23 bp, Homo sapiens
cttcataggcggtcatgtgtgca

SEQ ID NO: 1587438 - DNA, 20 bp, Homo sapiens
cttcatatgtcacctttgct

SEQ ID NO: 1587439 - DNA, 16 bp, Homo sapiens
cttcatccaatgtgaa

SEQ ID NO: 1587440 - DNA, 18 bp, Homo sapiens
cttcatccaatgtgaagt

SEQ ID NO: 1587441 - DNA, 17 bp, Homo sapiens
cttcatcccattccagg

SEQ ID NO: 1587442 - DNA, 13 bp, Homo sapiens
cttcatctccagg

SEQ ID NO: 1587443 - DNA, 12 bp, Homo sapiens
cttcatctgact

SEQ ID NO: 1587444 - DNA, 13 bp, Homo sapiens
cttcatctggcaa

SEQ ID NO: 1587445 - DNA, 20 bp, Homo sapiens
cttcatcttcctgtgtcctg

SEQ ID NO: 1587446 - DNA, 17 bp, Homo sapiens
cttcatgcctttgtaag

SEQ ID NO: 1587447 - DNA, 16 bp, Homo sapiens
cttcatgtaattttat

SEQ ID NO: 1587448 - DNA, 21 bp, Homo sapiens
cttcatgtaattttattttaa

SEQ ID NO: 1587449 - DNA, 20 bp, Homo sapiens
cttcattaccttttttgata

SEQ ID NO: 1587450 - DNA, 17 bp, Homo sapiens
cttcattattcaagaat

SEQ ID NO: 1587451 - DNA, 21 bp, Homo sapiens
cttcattattcaagaatgaaa

SEQ ID NO: 1587452 - DNA, 14 bp, Homo sapiens
cttcattcagatct

SEQ ID NO: 1587453 - DNA, 20 bp, Homo sapiens
cttcattccggactggcaga

SEQ ID NO: 1587454 - DNA, 22 bp, Homo sapiens
cttcattccggactggcagaag

SEQ ID NO: 1587455 - DNA, 23 bp, Homo sapiens
cttcattccggactggcagaagc

SEQ ID NO: 1587456 - DNA, 19 bp, Homo sapiens
cttcattccgttaggaata

SEQ ID NO: 1587457 - DNA, 22 bp, Homo sapiens
cttcattctccttgttgttggt

SEQ ID NO: 1587458 - DNA, 18 bp, Homo sapiens
cttcattctgagaccaaa

SEQ ID NO: 1587459 - DNA, 15 bp, Homo sapiens
cttcattctggaaac

SEQ ID NO: 1587460 - DNA, 21 bp, Homo sapiens
cttcattctttactgcactca

SEQ ID NO: 1587461 - DNA, 13 bp, Homo sapiens
cttcattgaaagc

SEQ ID NO: 1587462 - DNA, 14 bp, Homo sapiens
cttcattgagagtt

SEQ ID NO: 1587463 - DNA, 14 bp, Homo sapiens
cttcattgttttaa

SEQ ID NO: 1587464 - DNA, 15 bp, Homo sapiens
cttcatttattttga

SEQ ID NO: 1587465 - DNA, 13 bp, Homo sapiens
cttcatttctctg

SEQ ID NO: 1587466 - DNA, 14 bp, Homo sapiens
cttcatttctctgc

SEQ ID NO: 1587467 - DNA, 11 bp, Homo sapiens
cttcatttgta

SEQ ID NO: 1587468 - DNA, 18 bp, Homo sapiens
cttccaaaacctgcttcc

SEQ ID NO: 1587469 - DNA, 18 bp, Homo sapiens
cttcctcacacccctgtc

SEQ ID NO: 1587470 - DNA, 19 bp, Homo sapiens
cttcctcactatgacactg

SEQ ID NO: 1587471 - DNA, 16 bp, Homo sapiens
cttcctcactgcccaa

SEQ ID NO: 1587472 - DNA, 14 bp, Homo sapiens
cttcctcagcctcc

SEQ ID NO: 1587473 - DNA, 18 bp, Homo sapiens
cttcctcagcctccaaag

SEQ ID NO: 1587474 - DNA, 20 bp, Homo sapiens
cttcctcagtttaatccttc

SEQ ID NO: 1587475 - DNA, 18 bp, Homo sapiens
cttcctcatccaccccat

SEQ ID NO: 1587476 - DNA, 23 bp, Homo sapiens
cttcctccccacactccactctg

SEQ ID NO: 1587477 - DNA, 16 bp, Homo sapiens
cttcctcccggggcct

SEQ ID NO: 1587478 - DNA, 22 bp, Homo sapiens
cttcctcccggggccttccttt

SEQ ID NO: 1587479 - DNA, 14 bp, Homo sapiens
cttcctccctgggg

SEQ ID NO: 1587480 - DNA, 16 bp, Homo sapiens
cttcctccgtccaccc

SEQ ID NO: 1587481 - DNA, 19 bp, Homo sapiens
cttcctccgtccacccagg

SEQ ID NO: 1587482 - DNA, 21 bp, Homo sapiens
cttcctccgtccacccaggct

SEQ ID NO: 1587483 - DNA, 13 bp, Homo sapiens
cttcctcctccac

SEQ ID NO: 1587484 - DNA, 17 bp, Homo sapiens
cttcctcctccccactt

SEQ ID NO: 1587485 - DNA, 11 bp, Homo sapiens
cttcctcctga

SEQ ID NO: 1587486 - DNA, 12 bp, Homo sapiens
cttcctcctgat

SEQ ID NO: 1587487 - DNA, 13 bp, Homo sapiens
cttcctcctgatg

SEQ ID NO: 1587488 - DNA, 14 bp, Homo sapiens
cttcctcctggaaa

SEQ ID NO: 1587489 - DNA, 14 bp, Homo sapiens
cttcctctccactg

SEQ ID NO: 1587490 - DNA, 21 bp, Homo sapiens
cttcctctccactgccttcga

SEQ ID NO: 1587491 - DNA, 15 bp, Homo sapiens
cttcctctctccaga

SEQ ID NO: 1587492 - DNA, 16 bp, Homo sapiens
cttcctctctccagat

SEQ ID NO: 1587493 - DNA, 21 bp, Homo sapiens
cttcctctctctaccagtcta

SEQ ID NO: 1587494 - DNA, 19 bp, Homo sapiens
cttcctctgcagctgacct

SEQ ID NO: 1587495 - DNA, 11 bp, Homo sapiens
cttcctctggt

SEQ ID NO: 1587496 - DNA, 14 bp, Homo sapiens
cttcctcttagcct

SEQ ID NO: 1587497 - DNA, 17 bp, Homo sapiens
cttcctcttagcctctg

SEQ ID NO: 1587498 - DNA, 15 bp, Homo sapiens
cttcctcttcctgcc

SEQ ID NO: 1587499 - DNA, 19 bp, Homo sapiens
cttcctcttcctgcccttg

SEQ ID NO: 1587500 - DNA, 16 bp, Homo sapiens
cttcctcttggctgag

SEQ ID NO: 1587501 - DNA, 14 bp, Homo sapiens
cttcctcttgtctg

SEQ ID NO: 1587502 - DNA, 20 bp, Homo sapiens
cttcctctttggtggcatgg

SEQ ID NO: 1587503 - DNA, 18 bp, Homo sapiens
cttcctgacactttaatt

SEQ ID NO: 1587504 - DNA, 12 bp, Homo sapiens
cttcctgactct

SEQ ID NO: 1587505 - DNA, 20 bp, Homo sapiens
cttcctgcattcacccagac

SEQ ID NO: 1587506 - DNA, 12 bp, Homo sapiens
cttcctgccagc

SEQ ID NO: 1587507 - DNA, 14 bp, Homo sapiens
cttcctgctgcacc

SEQ ID NO: 1587508 - DNA, 23 bp, Homo sapiens
cttcctgctgcaccctgcgcctc

SEQ ID NO: 1587509 - DNA, 17 bp, Homo sapiens
cttcctgctgctgctac

SEQ ID NO: 1587510 - DNA, 22 bp, Homo sapiens
cttcctgctgctgtaactgctg

SEQ ID NO: 1587511 - DNA, 18 bp, Homo sapiens
cttcctgcttcctcagag

SEQ ID NO: 1587512 - DNA, 14 bp, Homo sapiens
cttcctggaaacag

SEQ ID NO: 1587513 - DNA, 19 bp, Homo sapiens
cttcctggaaacagcatga

SEQ ID NO: 1587514 - DNA, 13 bp, Homo sapiens
cttcctggacctg

SEQ ID NO: 1587515 - DNA, 17 bp, Homo sapiens
cttcctggacctgagtc

SEQ ID NO: 1587516 - DNA, 21 bp, Homo sapiens
cttcctggcctcactggctgg

SEQ ID NO: 1587517 - DNA, 22 bp, Homo sapiens
cttcctggcctcccttctcctt

SEQ ID NO: 1587518 - DNA, 21 bp, Homo sapiens
cttcctggggacgaattccac

SEQ ID NO: 1587519 - DNA, 17 bp, Homo sapiens
cttcctggggccccgct

SEQ ID NO: 1587520 - DNA, 22 bp, Homo sapiens
cttcctgggtcctgcctggtcc

SEQ ID NO: 1587521 - DNA, 18 bp, Homo sapiens
cttcctgtccagctccaa

SEQ ID NO: 1587522 - DNA, 20 bp, Homo sapiens
cttcctgtgtacctctagaa

SEQ ID NO: 1587523 - DNA, 15 bp, Homo sapiens
cttcctgtgtcctga

SEQ ID NO: 1587524 - DNA, 23 bp, Homo sapiens
cttcctgtgtgtccaaaactgcc

SEQ ID NO: 1587525 - DNA, 14 bp, Homo sapiens
cttccttcagggtt

SEQ ID NO: 1587526 - DNA, 18 bp, Homo sapiens
cttccttcagggtttaat

SEQ ID NO: 1587527 - DNA, 23 bp, Homo sapiens
cttccttcagggtttaatagact

SEQ ID NO: 1587528 - DNA, 18 bp, Homo sapiens
cttccttccctgggctgt

SEQ ID NO: 1587529 - DNA, 14 bp, Homo sapiens
cttccttcctgctt

SEQ ID NO: 1587530 - DNA, 15 bp, Homo sapiens
cttccttctacccca

SEQ ID NO: 1587531 - DNA, 21 bp, Homo sapiens
cttccttctaccccaaggcca

SEQ ID NO: 1587532 - DNA, 13 bp, Homo sapiens
cttccttctggga

SEQ ID NO: 1587533 - DNA, 22 bp, Homo sapiens
cttccttgaagaactgcaggcc

SEQ ID NO: 1587534 - DNA, 15 bp, Homo sapiens
cttccttgaccagca

SEQ ID NO: 1587535 - DNA, 16 bp, Homo sapiens
cttccttgaccagcag

SEQ ID NO: 1587536 - DNA, 22 bp, Homo sapiens
cttccttgaccagcagatccca

SEQ ID NO: 1587537 - DNA, 20 bp, Homo sapiens
cttccttgagacacggagcc

SEQ ID NO: 1587538 - DNA, 19 bp, Homo sapiens
cttccttggactcatttta

SEQ ID NO: 1587539 - DNA, 16 bp, Homo sapiens
cttcctttaaaaaact

SEQ ID NO: 1587540 - DNA, 17 bp, Homo sapiens
cttcctttcaggccaag

SEQ ID NO: 1587541 - DNA, 19 bp, Homo sapiens
cttcctttcccaagccttc

SEQ ID NO: 1587542 - DNA, 18 bp, Homo sapiens
cttcctttctcctgcccc

SEQ ID NO: 1587543 - DNA, 19 bp, Homo sapiens
cttcctttctcctgcccca

SEQ ID NO: 1587544 - DNA, 20 bp, Homo sapiens
cttcctttctcctgccccaa

SEQ ID NO: 1587545 - DNA, 18 bp, Homo sapiens
cttcctttctctcctggc

SEQ ID NO: 1587546 - DNA, 19 bp, Homo sapiens
cttcctttctctcctggct

SEQ ID NO: 1587547 - DNA, 15 bp, Homo sapiens
cttcgaaacctggga

SEQ ID NO: 1587548 - DNA, 20 bp, Homo sapiens
cttcgaaagcatcattattt

SEQ ID NO: 1587549 - DNA, 16 bp, Homo sapiens
cttcgaaaggccttca

SEQ ID NO: 1587550 - DNA, 18 bp, Homo sapiens
cttcgaaaggccttcaga

SEQ ID NO: 1587551 - DNA, 19 bp, Homo sapiens
cttcgacagctgggctgga

SEQ ID NO: 1587552 - DNA, 13 bp, Homo sapiens
cttcgactactgc

SEQ ID NO: 1587553 - DNA, 18 bp, Homo sapiens
cttcgactactgctcctg

SEQ ID NO: 1587554 - DNA, 16 bp, Homo sapiens
cttcgactcaggatcc

SEQ ID NO: 1587555 - DNA, 18 bp, Homo sapiens
cttcgactcaggatccag

SEQ ID NO: 1587556 - DNA, 16 bp, Homo sapiens
cttcgatacaccgggc

SEQ ID NO: 1587557 - DNA, 13 bp, Homo sapiens
cttcgcctgcagc

SEQ ID NO: 1587558 - DNA, 19 bp, Homo sapiens
cttcgcgtgccctcgctgc

SEQ ID NO: 1587559 - DNA, 15 bp, Homo sapiens
cttcgctgctctagc

SEQ ID NO: 1587560 - DNA, 17 bp, Homo sapiens
cttcgctgctctagctg

SEQ ID NO: 1587561 - DNA, 19 bp, Homo sapiens
cttcgctgctctagctggc

SEQ ID NO: 1587562 - DNA, 15 bp, Homo sapiens
cttcgcttcttgcct

SEQ ID NO: 1587563 - DNA, 16 bp, Homo sapiens
cttcgcttcttgcctc

SEQ ID NO: 1587564 - DNA, 18 bp, Homo sapiens
cttcgcttcttgcctctg

SEQ ID NO: 1587565 - DNA, 18 bp, Homo sapiens
cttcggagggcccctgcg

SEQ ID NO: 1587566 - DNA, 14 bp, Homo sapiens
cttcggcagggagg

SEQ ID NO: 1587567 - DNA, 14 bp, Homo sapiens
cttcggggcctcct

SEQ ID NO: 1587568 - DNA, 14 bp, Homo sapiens
cttcgtctttccca

SEQ ID NO: 1587569 - DNA, 22 bp, Homo sapiens
cttcgtctttcccatggggagg

SEQ ID NO: 1587570 - DNA, 13 bp, Homo sapiens
cttcgtgaacata

SEQ ID NO: 1587571 - DNA, 22 bp, Homo sapiens
cttcgtggttgtgtttctcgtg

SEQ ID NO: 1587572 - DNA, 16 bp, Homo sapiens
cttcgtgtctctccca

SEQ ID NO: 1587573 - DNA, 17 bp, Homo sapiens
cttcgtgtctctcccac

SEQ ID NO: 1587574 - DNA, 15 bp, Homo sapiens
cttcgtttattttca

SEQ ID NO: 1587575 - DNA, 14 bp, Homo sapiens
cttctaaaaatgaa

SEQ ID NO: 1587576 - DNA, 16 bp, Homo sapiens
cttctaaaagccatta

SEQ ID NO: 1587577 - DNA, 14 bp, Homo sapiens
cttctaaacatttt

SEQ ID NO: 1587578 - DNA, 15 bp, Homo sapiens
cttctaaacattttt

SEQ ID NO: 1587579 - DNA, 20 bp, Homo sapiens
cttctaagaagacattttgt

SEQ ID NO: 1587580 - DNA, 12 bp, Homo sapiens
cttctaagagcg

SEQ ID NO: 1587581 - DNA, 22 bp, Homo sapiens
cttctaaggaaatggagaagct

SEQ ID NO: 1587582 - DNA, 14 bp, Homo sapiens
ctgtaaaatgcaaa

SEQ ID NO: 1587583 - DNA, 18 bp, Homo sapiens
ctgtaaaatgcaaaaaat

SEQ ID NO: 1587584 - DNA, 13 bp, Homo sapiens
ctgtaaactgtgt

SEQ ID NO: 1587585 - DNA, 20 bp, Homo sapiens
ctgtaaactgtgtattccaa

SEQ ID NO: 1587586 - DNA, 19 bp, Homo sapiens
ctgtaaagaaacatttcct

SEQ ID NO: 1587587 - DNA, 12 bp, Homo sapiens
ctgtaaagatgt

SEQ ID NO: 1587588 - DNA, 17 bp, Homo sapiens
ctgtaaataaaatgtgt

SEQ ID NO: 1587589 - DNA, 13 bp, Homo sapiens
ctgtaaatatatc

SEQ ID NO: 1587590 - DNA, 19 bp, Homo sapiens
ctgtaaatatgtttgtgcc

SEQ ID NO: 1587591 - DNA, 22 bp, Homo sapiens
ctgtaaatatgtttgtgcctta

SEQ ID NO: 1587592 - DNA, 16 bp, Homo sapiens
ctgtaaatttaactgc

SEQ ID NO: 1587593 - DNA, 17 bp, Homo sapiens
ctgtaaatttaactgca

SEQ ID NO: 1587594 - DNA, 19 bp, Homo sapiens
ctgtaaatttaactgcata

SEQ ID NO: 1587595 - DNA, 21 bp, Homo sapiens
ctgtaaatttttgttctttta

SEQ ID NO: 1587596 - DNA, 16 bp, Homo sapiens
ctgtaacactcctctg

SEQ ID NO: 1587597 - DNA, 13 bp, Homo sapiens
ctgtaacctgatt

SEQ ID NO: 1587598 - DNA, 19 bp, Homo sapiens
ctgtaactactttataact

SEQ ID NO: 1587599 - DNA, 15 bp, Homo sapiens
ctgtaacttaaaata

SEQ ID NO: 1587600 - DNA, 18 bp, Homo sapiens
ctgtaagaaaaaaaatgt

SEQ ID NO: 1587601 - DNA, 20 bp, Homo sapiens
ctgtaagaagagactgggaa

SEQ ID NO: 1587602 - DNA, 22 bp, Homo sapiens
ctgtaagaagagactgggaaga

SEQ ID NO: 1587603 - DNA, 16 bp, Homo sapiens
ctgtaagagaaaatat

SEQ ID NO: 1587604 - DNA, 17 bp, Homo sapiens
ctgtaagcctatatata

SEQ ID NO: 1587605 - DNA, 14 bp, Homo sapiens
ctgtaaggctctag

SEQ ID NO: 1587606 - DNA, 12 bp, Homo sapiens
ctgtaagggcag

SEQ ID NO: 1587607 - DNA, 14 bp, Homo sapiens
ctgtaagggcagtg

SEQ ID NO: 1587608 - DNA, 17 bp, Homo sapiens
ctgtaagtgtagctcaa

SEQ ID NO: 1587609 - DNA, 23 bp, Homo sapiens
ctgtaagtttattttttctacac

SEQ ID NO: 1587610 - DNA, 21 bp, Homo sapiens
ctgtaatacgtagctctctta

SEQ ID NO: 1587611 - DNA, 22 bp, Homo sapiens
ctgtaatagttcagtagaatta

SEQ ID NO: 1587612 - DNA, 20 bp, Homo sapiens
ctgtaatataaagtattcaa

SEQ ID NO: 1587613 - DNA, 15 bp, Homo sapiens
ctgtaatcaagaaaa

SEQ ID NO: 1587614 - DNA, 19 bp, Homo sapiens
ctgtaatcatataataaat

SEQ ID NO: 1587615 - DNA, 17 bp, Homo sapiens
ctgtaatgtaaataaac

SEQ ID NO: 1587616 - DNA, 15 bp, Homo sapiens
ctgtaattcaggttt

SEQ ID NO: 1587617 - DNA, 12 bp, Homo sapiens
ctgtaattgtgt

SEQ ID NO: 1587618 - DNA, 21 bp, Homo sapiens
ctgtaatttcgccttaaactc

SEQ ID NO: 1587619 - DNA, 15 bp, Homo sapiens
ctgtacaaagtagaa

SEQ ID NO: 1587620 - DNA, 18 bp, Homo sapiens
ctgtacacgtgtcctgta

SEQ ID NO: 1587621 - DNA, 19 bp, Homo sapiens
ctgtacactgaatatttat

SEQ ID NO: 1587622 - DNA, 15 bp, Homo sapiens
ctgtacactgacttg

SEQ ID NO: 1587623 - DNA, 18 bp, Homo sapiens
ctgtacagaatgctattt

SEQ ID NO: 1587624 - DNA, 21 bp, Homo sapiens
ctgtacagaatgctatttcac

SEQ ID NO: 1587625 - DNA, 21 bp, Homo sapiens
ctgtacattgtgagctctggt

SEQ ID NO: 1587626 - DNA, 13 bp, Homo sapiens
ctgtacatttaaa

SEQ ID NO: 1587627 - DNA, 19 bp, Homo sapiens
ctgtaccacatctgctcta

SEQ ID NO: 1587628 - DNA, 16 bp, Homo sapiens
ctgtaccagttaattt

SEQ ID NO: 1587629 - DNA, 23 bp, Homo sapiens
ctgtacccagctccttttgtccc

SEQ ID NO: 1587630 - DNA, 23 bp, Homo sapiens
ctgtaccctcgcatgactgttac

SEQ ID NO: 1587631 - DNA, 15 bp, Homo sapiens
ctgtaccctttaaga

SEQ ID NO: 1587632 - DNA, 19 bp, Homo sapiens
ctgtaccgcccggcagccc

SEQ ID NO: 1587633 - DNA, 21 bp, Homo sapiens
ctgtaccgcccggcagcccct

SEQ ID NO: 1587634 - DNA, 21 bp, Homo sapiens
ctgtacctgttccttagacct

SEQ ID NO: 1587635 - DNA, 23 bp, Homo sapiens
ctgtaccttttgaggagccccag

SEQ ID NO: 1587636 - DNA, 13 bp, Homo sapiens
ctgtacgaaaaag

SEQ ID NO: 1587637 - DNA, 17 bp, Homo sapiens
ctgtacgaaaaagagca

SEQ ID NO: 1587638 - DNA, 17 bp, Homo sapiens
ctgtactactgccttgt

SEQ ID NO: 1587639 - DNA, 14 bp, Homo sapiens
ctgtactcagagca

SEQ ID NO: 1587640 - DNA, 16 bp, Homo sapiens
ctgtactcctcccagg

SEQ ID NO: 1587641 - DNA, 21 bp, Homo sapiens
ctgtactcctcccaggcgccc

SEQ ID NO: 1587642 - DNA, 16 bp, Homo sapiens
ctgtactcttgctgat

SEQ ID NO: 1587643 - DNA, 20 bp, Homo sapiens
ctgtactgatttttgtaaga

SEQ ID NO: 1587644 - DNA, 22 bp, Homo sapiens
ctgtactgttactgggccctga

SEQ ID NO: 1587645 - DNA, 20 bp, Homo sapiens
ctgtactgttctgtgtcttt

SEQ ID NO: 1587646 - DNA, 14 bp, Homo sapiens
ctgtactgttttct

SEQ ID NO: 1587647 - DNA, 16 bp, Homo sapiens
ctgtacttaataaatt

SEQ ID NO: 1587648 - DNA, 18 bp, Homo sapiens
ctgtacttaataaattca

SEQ ID NO: 1587649 - DNA, 17 bp, Homo sapiens
ctgtacttcactgtcag

SEQ ID NO: 1587650 - DNA, 17 bp, Homo sapiens
ctgtacttcttgaatat

SEQ ID NO: 1587651 - DNA, 19 bp, Homo sapiens
ctgtactttgccatttttc

SEQ ID NO: 1587652 - DNA, 18 bp, Homo sapiens
ctgtacttttcattctct

SEQ ID NO: 1587653 - DNA, 22 bp, Homo sapiens
ctgtagaaaggggagaatgtca

SEQ ID NO: 1587654 - DNA, 15 bp, Homo sapiens
ctgtagactagtgcc

SEQ ID NO: 1587655 - DNA, 23 bp, Homo sapiens
ctgtagacttctggttgtatttc

SEQ ID NO: 1587656 - DNA, 16 bp, Homo sapiens
ctgtagatcaggtttg

SEQ ID NO: 1587657 - DNA, 18 bp, Homo sapiens
ctgtagatggtgacctgg

SEQ ID NO: 1587658 - DNA, 19 bp, Homo sapiens
ctgtagatggtgacctggg

SEQ ID NO: 1587659 - DNA, 22 bp, Homo sapiens
ctgtagatggtgacctgggtat

SEQ ID NO: 1587660 - DNA, 15 bp, Homo sapiens
ctgtagattctgtgg

SEQ ID NO: 1587661 - DNA, 18 bp, Homo sapiens
ctgtagcattacagtggg

SEQ ID NO: 1587662 - DNA, 14 bp, Homo sapiens
ctgtagccactggc

SEQ ID NO: 1587663 - DNA, 14 bp, Homo sapiens
ctgtagccatggct

SEQ ID NO: 1587664 - DNA, 16 bp, Homo sapiens
ctgtagccatggctca

SEQ ID NO: 1587665 - DNA, 19 bp, Homo sapiens
ctgtagccatggctcaggc

SEQ ID NO: 1587666 - DNA, 20 bp, Homo sapiens
ctgtagccatggctcaggca

SEQ ID NO: 1587667 - DNA, 23 bp, Homo sapiens
ctgtagcctaaaacgaatggtct

SEQ ID NO: 1587668 - DNA, 21 bp, Homo sapiens
ctgtagctataatgagcatgt

SEQ ID NO: 1587669 - DNA, 14 bp, Homo sapiens
ctgtagctcagtca

SEQ ID NO: 1587670 - DNA, 21 bp, Homo sapiens
ctgtagctgcagcctgcatcc

SEQ ID NO: 1587671 - DNA, 18 bp, Homo sapiens
ctgtagctgtaagcaagt

SEQ ID NO: 1587672 - DNA, 12 bp, Homo sapiens
ctgtaggaacaa

SEQ ID NO: 1587673 - DNA, 16 bp, Homo sapiens
ctgtaggcacagagct

SEQ ID NO: 1587674 - DNA, 12 bp, Homo sapiens
ctgtaggcagca

SEQ ID NO: 1587675 - DNA, 15 bp, Homo sapiens
ctgtagggctggacc

SEQ ID NO: 1587676 - DNA, 21 bp, Homo sapiens
ctgtagggctggacctatgtc

SEQ ID NO: 1587677 - DNA, 20 bp, Homo sapiens
ctgtaggtttctctcttccc

SEQ ID NO: 1587678 - DNA, 22 bp, Homo sapiens
ctgtagtcctagccactcagga

SEQ ID NO: 1587679 - DNA, 23 bp, Homo sapiens
ctgtagtcctagccactcaggag

SEQ ID NO: 1587680 - DNA, 18 bp, Homo sapiens
ctgtagtgagaaactgat

SEQ ID NO: 1587681 - DNA, 13 bp, Homo sapiens
ctgtagttgcagc

SEQ ID NO: 1587682 - DNA, 20 bp, Homo sapiens
ctgtagtttatgatgcaaat

SEQ ID NO: 1587683 - DNA, 21 bp, Homo sapiens
ctgtagtttatggcagaaggg

SEQ ID NO: 1587684 - DNA, 22 bp, Homo sapiens
ctgtagttttccctgcactgtg

SEQ ID NO: 1587685 - DNA, 21 bp, Homo sapiens
ctgtagtttttgaaaattatg

SEQ ID NO: 1587686 - DNA, 15 bp, Homo sapiens
ctgtataagttattt

SEQ ID NO: 1587687 - DNA, 22 bp, Homo sapiens
ctgtataagttatttttgtaca

SEQ ID NO: 1587688 - DNA, 19 bp, Homo sapiens
ctgtatacaaccctggcat

SEQ ID NO: 1587689 - DNA, 15 bp, Homo sapiens
cttgatcttaaagat

SEQ ID NO: 1587690 - DNA, 16 bp, Homo sapiens
cttgatcttaaagatc

SEQ ID NO: 1587691 - DNA, 19 bp, Homo sapiens
cttgatgccagagggccag

SEQ ID NO: 1587692 - DNA, 20 bp, Homo sapiens
cttgatgccagagggccagc

SEQ ID NO: 1587693 - DNA, 13 bp, Homo sapiens
cttgatgtaaaat

SEQ ID NO: 1587694 - DNA, 17 bp, Homo sapiens
cttgatgtaaaatcttg

SEQ ID NO: 1587695 - DNA, 16 bp, Homo sapiens
cttgatgtgtcatcta

SEQ ID NO: 1587696 - DNA, 21 bp, Homo sapiens
cttgatgttccacctgccaca

SEQ ID NO: 1587697 - DNA, 15 bp, Homo sapiens
cttgattaacatctt

SEQ ID NO: 1587698 - DNA, 16 bp, Homo sapiens
cttgattcagtcacat

SEQ ID NO: 1587699 - DNA, 15 bp, Homo sapiens
cttgattcctggctc

SEQ ID NO: 1587700 - DNA, 23 bp, Homo sapiens
cttgattcctggctctaccctgt

SEQ ID NO: 1587701 - DNA, 15 bp, Homo sapiens
cttgattgagaaaga

SEQ ID NO: 1587702 - DNA, 12 bp, Homo sapiens
cttgattggaag

SEQ ID NO: 1587703 - DNA, 12 bp, Homo sapiens
cttgatttttgc

SEQ ID NO: 1587704 - DNA, 19 bp, Homo sapiens
cttgcacactcccctgcac

SEQ ID NO: 1587705 - DNA, 23 bp, Homo sapiens
cttgcacactcccctgcactgga

SEQ ID NO: 1587706 - DNA, 20 bp, Homo sapiens
cttgcacagccaacgagaca

SEQ ID NO: 1587707 - DNA, 15 bp, Homo sapiens
cttgcacagtcactg

SEQ ID NO: 1587708 - DNA, 14 bp, Homo sapiens
cttgcacctgcatc

SEQ ID NO: 1587709 - DNA, 19 bp, Homo sapiens
cttgcacgaccgccccagt

SEQ ID NO: 1587710 - DNA, 13 bp, Homo sapiens
cttgcagagcttg

SEQ ID NO: 1587711 - DNA, 18 bp, Homo sapiens
cttgcagatatctgcatg

SEQ ID NO: 1587712 - DNA, 16 bp, Homo sapiens
cttgcagattctattt

SEQ ID NO: 1587713 - DNA, 15 bp, Homo sapiens
cttgcagctggccca

SEQ ID NO: 1587714 - DNA, 19 bp, Homo sapiens
cttgcaggggtcccccctc

SEQ ID NO: 1587715 - DNA, 17 bp, Homo sapiens
cttgcagtggcttttca

SEQ ID NO: 1587716 - DNA, 18 bp, Homo sapiens
cttgcagttcagcaccac

SEQ ID NO: 1587717 - DNA, 22 bp, Homo sapiens
cttgcagttcagcaccacccta

SEQ ID NO: 1587718 - DNA, 22 bp, Homo sapiens
cttgcataataagctaaagagg

SEQ ID NO: 1587719 - DNA, 15 bp, Homo sapiens
cttgcatacatatat

SEQ ID NO: 1587720 - DNA, 23 bp, Homo sapiens
cttgcatcaatttttcttatttc

SEQ ID NO: 1587721 - DNA, 16 bp, Homo sapiens
cttgctgtcctaggcc

SEQ ID NO: 1587722 - DNA, 17 bp, Homo sapiens
cttgcttcctgcatggt

SEQ ID NO: 1587723 - DNA, 19 bp, Homo sapiens
cttgcttctctagctctct

SEQ ID NO: 1587724 - DNA, 19 bp, Homo sapiens
cttgcttctttctagaaag

SEQ ID NO: 1587725 - DNA, 23 bp, Homo sapiens
cttgcttgaggaatgaagacctt

SEQ ID NO: 1587726 - DNA, 17 bp, Homo sapiens
cttgcttgcctgcaggg

SEQ ID NO: 1587727 - DNA, 19 bp, Homo sapiens
cttgcttggaagccaggta

SEQ ID NO: 1587728 - DNA, 18 bp, Homo sapiens
cttgcttggggaacttgt

SEQ ID NO: 1587729 - DNA, 22 bp, Homo sapiens
cttgcttgttgggattcctgac

SEQ ID NO: 1587730 - DNA, 16 bp, Homo sapiens
cttgctttcacaaata

SEQ ID NO: 1587731 - DNA, 18 bp, Homo sapiens
cttgctttcacaaatata

SEQ ID NO: 1587732 - DNA, 23 bp, Homo sapiens
cttgctttcacaaatatagttga

SEQ ID NO: 1587733 - DNA, 17 bp, Homo sapiens
cttgctttcctgcatct

SEQ ID NO: 1587734 - DNA, 16 bp, Homo sapiens
cttgctttcctgggcc

SEQ ID NO: 1587735 - DNA, 18 bp, Homo sapiens
cttgctttcctgggcctt

SEQ ID NO: 1587736 - DNA, 24 bp, Homo sapiens
cttgctttcggagctcctgtccaa

SEQ ID NO: 1587737 - DNA, 15 bp, Homo sapiens
cttgctttgggcttt

SEQ ID NO: 1587738 - DNA, 23 bp, Homo sapiens
cttgctttgggctttgcaggctc

SEQ ID NO: 1587739 - DNA, 21 bp, Homo sapiens
cttgctttggggggtgtgctg

SEQ ID NO: 1587740 - DNA, 16 bp, Homo sapiens
cttggaaacctgccct

SEQ ID NO: 1587741 - DNA, 20 bp, Homo sapiens
cttggaaacctgccctgcct

SEQ ID NO: 1587742 - DNA, 21 bp, Homo sapiens
cttggaaacctgccctgcctg

SEQ ID NO: 1587743 - DNA, 22 bp, Homo sapiens
cttggaaagcatcacctcaggc

SEQ ID NO: 1587744 - DNA, 23 bp, Homo sapiens
cttggaaagcatcacctcaggcc

SEQ ID NO: 1587745 - DNA, 24 bp, Homo sapiens
cttggaaagctgatgatgtctctt

SEQ ID NO: 1587746 - DNA, 22 bp, Homo sapiens
cttgtgaggattatgggtcctg

SEQ ID NO: 1587747 - DNA, 19 bp, Homo sapiens
cttgtgagtggataatcag

SEQ ID NO: 1587748 - DNA, 23 bp, Homo sapiens
cttgtgatccactcgcctcagcc

SEQ ID NO: 1587749 - DNA, 15 bp, Homo sapiens
cttgtgattatttat

SEQ ID NO: 1587750 - DNA, 16 bp, Homo sapiens
cttgtgattgctgcca

SEQ ID NO: 1587751 - DNA, 18 bp, Homo sapiens
cttgtgattgctgccata

SEQ ID NO: 1587752 - DNA, 14 bp, Homo sapiens
cttgtgattggctg

SEQ ID NO: 1587753 - DNA, 13 bp, Homo sapiens
cttgtgccctgcc

SEQ ID NO: 1587754 - DNA, 23 bp, Homo sapiens
cttgtgctcacgctcccccgcag

SEQ ID NO: 1587755 - DNA, 23 bp, Homo sapiens
cttgtgcttggtggggctcgtgg

SEQ ID NO: 1587756 - DNA, 16 bp, Homo sapiens
cttgtggactggctgt

SEQ ID NO: 1587757 - DNA, 21 bp, Homo sapiens
cttgtggactggctgtgcccc
